United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 53

SEQ ID NO: 1892281 - RNA, 18 nt, Shigella flexneri 2a str. 2457T
gcguuuaucgacagacgc

SEQ ID NO: 1892282 - RNA, 15 nt, Shigella flexneri 2a str. 2457T
gcguuuacgccgcau

SEQ ID NO: 1892283 - RNA, 21 nt, Shigella flexneri 2a str. 2457T
gcguuggcgugacuucgccga

SEQ ID NO: 1892284 - RNA, 14 nt, Shigella flexneri 2a str. 2457T
gcguuggcagguca

SEQ ID NO: 1892285 - RNA, 21 nt, Shigella flexneri 2a str. 2457T
gcuaaggcuguuguagaccgg

SEQ ID NO: 1892286 - RNA, 17 nt, Shigella flexneri 2a str. 2457T
gcuaagcgccaccguca

SEQ ID NO: 1892287 - RNA, 17 nt, Shigella flexneri 2a str. 2457T
gcuaacuaggcgaacau

SEQ ID NO: 1892288 - RNA, 14 nt, Shigella flexneri 2a str. 2457T
gcuaaaugccgcgu

SEQ ID NO: 1892289 - RNA, 13 nt, Shigella flexneri 2a str. 2457T
gcuaacagcagca

SEQ ID NO: 1892290 - RNA, 20 nt, Shigella flexneri 2a str. 2457T
gcuaaaugccgcguggccug

SEQ ID NO: 1892291 - RNA, 13 nt, Shigella flexneri 2a str. 2457T
gcguuuugcagau

SEQ ID NO: 1892292 - RNA, 14 nt, Shigella flexneri 2a str. 2457T
gcuaaaaacaucau

SEQ ID NO: 1892293 - RNA, 14 nt, Shigella flexneri 2a str. 2457T
gcguugagaaacgc

SEQ ID NO: 1892294 - RNA, 14 nt, Shigella flexneri 2a str. 2457T
gcguugcgccuguu

SEQ ID NO: 1892295 - RNA, 15 nt, Shigella flexneri 2a str. 2457T
gcguucugucgauaa

SEQ ID NO: 1892296 - RNA, 17 nt, Shigella flexneri 2a str. 2457T
gcguucugccuggcgca

SEQ ID NO: 1892297 - RNA, 13 nt, Shigella flexneri 2a str. 2457T
gcguucgucgaua

SEQ ID NO: 1892298 - RNA, 22 nt, Shigella flexneri 2a str. 2457T
gcgugucgagcauugccagcau

SEQ ID NO: 1892299 - RNA, 22 nt, Shigella flexneri 2a str. 2457T
gcguucgcgccgcauccggcau

SEQ ID NO: 1892300 - RNA, 15 nt, Shigella flexneri 2a str. 2457T
gcguucgcgccgcau

SEQ ID NO: 1892301 - RNA, 17 nt, Shigella flexneri 2a str. 2457T
gucaccgccgauaccga

SEQ ID NO: 1892302 - RNA, 13 nt, Shigella flexneri 2a str. 2457T
gucacaucagcga

SEQ ID NO: 1892303 - RNA, 16 nt, Shigella flexneri 2a str. 2457T
gucacaggccaucaca

SEQ ID NO: 1892304 - RNA, 20 nt, Shigella flexneri 2a str. 2457T
gucaacuguacgccgacgcc

SEQ ID NO: 1892305 - RNA, 14 nt, Shigella flexneri 2a str. 2457T
guaucuugcgucac

SEQ ID NO: 1892306 - RNA, 14 nt, Shigella flexneri 2a str. 2457T
gucaaauaauuccu

SEQ ID NO: 1892307 - RNA, 22 nt, Shigella flexneri 2a str. 2457T
guauucaggucagcggccaguu

SEQ ID NO: 1892308 - RNA, 19 nt, Shigella flexneri 2a str. 2457T
gucagcaguucacgcagcu

SEQ ID NO: 1892309 - RNA, 21 nt, Shigella flexneri 2a str. 2457T
gucagcaucauaccuccgcaa

SEQ ID NO: 1892310 - RNA, 14 nt, Shigella flexneri 2a str. 2457T
gucagcaccagaga

SEQ ID NO: 1892311 - RNA, 19 nt, Shigella flexneri 2a str. 2457T
gucagccugcucaguugca

SEQ ID NO: 1892312 - RNA, 18 nt, Shigella flexneri 2a str. 2457T
gucagcguacaggacggu

SEQ ID NO: 1892313 - RNA, 17 nt, Shigella flexneri 2a str. 2457T
gucacucgacagcaccg

SEQ ID NO: 1892314 - RNA, 19 nt, Shigella flexneri 2a str. 2457T
gucagcaaucaccugacgu

SEQ ID NO: 1892315 - RNA, 20 nt, Shigella flexneri 2a str. 2457T
gucagcaaucaccugacguu

SEQ ID NO: 1892316 - RNA, 19 nt, Shigella flexneri 2a str. 2457T
gucagcaacuguaacgcag

SEQ ID NO: 1892317 - RNA, 16 nt, Shigella flexneri 2a str. 2457T
gucagaguguugcggc

SEQ ID NO: 1892318 - RNA, 12 nt, Shigella flexneri 2a str. 2457T
gucagaugcggc

SEQ ID NO: 1892319 - RNA, 14 nt, Shigella flexneri 2a str. 2457T
gucacuuuuacuca

SEQ ID NO: 1892320 - RNA, 20 nt, Shigella flexneri 2a str. 2457T
gucacggcgacggcuggcaa

SEQ ID NO: 1892321 - RNA, 15 nt, Shigella flexneri 2a str. 2457T
guaagcaaaggugcc

SEQ ID NO: 1892322 - RNA, 18 nt, Shigella flexneri 2a str. 2457T
guaagcacucugacggau

SEQ ID NO: 1892323 - RNA, 18 nt, Shigella flexneri 2a str. 2457T
guaacucacugaugccgu

SEQ ID NO: 1892324 - RNA, 15 nt, Shigella flexneri 2a str. 2457T
guaaggccgaauacc

SEQ ID NO: 1892325 - RNA, 17 nt, Shigella flexneri 2a str. 2457T
guaagguugucgauacc

SEQ ID NO: 1892326 - RNA, 17 nt, Shigella flexneri 2a str. 2457T
guaaagggcugccggaa

SEQ ID NO: 1892327 - RNA, 15 nt, Shigella flexneri 2a str. 2457T
guaaaauaacagcgg

SEQ ID NO: 1892328 - RNA, 15 nt, Shigella flexneri 2a str. 2457T
guaaaaccaugccau

SEQ ID NO: 1892329 - RNA, 15 nt, Shigella flexneri 2a str. 2457T
gguuuuuugaacaga

SEQ ID NO: 1892330 - RNA, 19 nt, Shigella flexneri 2a str. 2457T
gguuuucgcgccagccagu

SEQ ID NO: 1892331 - RNA, 20 nt, Shigella flexneri 2a str. 2457T
guacaaauuuuaggcguuaa

SEQ ID NO: 1892332 - RNA, 17 nt, Shigella flexneri 2a str. 2457T
guacaccaacaucacgc

SEQ ID NO: 1892333 - RNA, 14 nt, Shigella flexneri 2a str. 2457T
guacaacgccguuu

SEQ ID NO: 1892334 - RNA, 18 nt, Shigella flexneri 2a str. 2457T
guacaaacgcuuuacuca

SEQ ID NO: 1892335 - RNA, 17 nt, Shigella flexneri 2a str. 2457T
guaaucaucuauccggc

SEQ ID NO: 1892336 - RNA, 12 nt, Shigella flexneri 2a str. 2457T
guaauccugaaa

SEQ ID NO: 1892337 - RNA, 14 nt, Shigella flexneri 2a str. 2457T
guacccuucgucaa

SEQ ID NO: 1892338 - RNA, 18 nt, Shigella flexneri 2a str. 2457T
guacccguucgaugcggu

SEQ ID NO: 1892339 - RNA, 17 nt, Shigella flexneri 2a str. 2457T
guaccaugauccugcaa

SEQ ID NO: 1892340 - RNA, 16 nt, Shigella flexneri 2a str. 2457T
guacgggacagcaggu

SEQ ID NO: 1892341 - RNA, 20 nt, Shigella flexneri 2a str. 2457T
guagccaauaaaugccacca

SEQ ID NO: 1892342 - RNA, 15 nt, Shigella flexneri 2a str. 2457T
guacuguggcaucgg

SEQ ID NO: 1892343 - RNA, 18 nt, Shigella flexneri 2a str. 2457T
guacuuaugcucugcgau

SEQ ID NO: 1892344 - RNA, 15 nt, Shigella flexneri 2a str. 2457T
guagcuuucaacgcu

SEQ ID NO: 1892345 - RNA, 16 nt, Shigella flexneri 2a str. 2457T
aagucggcaucgccac

SEQ ID NO: 1892346 - RNA, 18 nt, Shigella flexneri 2a str. 2457T
aagucauuaccagcgagg

SEQ ID NO: 1892347 - RNA, 15 nt, Shigella flexneri 2a str. 2457T
aaguccaccgcgaug

SEQ ID NO: 1892348 - RNA, 18 nt, Shigella flexneri 2a str. 2457T
guauauuucgaaugcuca

SEQ ID NO: 1892349 - RNA, 17 nt, Shigella flexneri 2a str. 2457T
aagucguaggccugaua

SEQ ID NO: 1892350 - RNA, 15 nt, Shigella flexneri 2a str. 2457T
aagucguaggccuga

SEQ ID NO: 1892351 - RNA, 22 nt, Shigella flexneri 2a str. 2457T
guccugcucaaacuucgucaca

SEQ ID NO: 1892352 - RNA, 17 nt, Shigella flexneri 2a str. 2457T
guccuacacacgccagu

SEQ ID NO: 1892353 - RNA, 18 nt, Shigella flexneri 2a str. 2457T
gucgaaugcgcaaccgua

SEQ ID NO: 1892354 - RNA, 20 nt, Shigella flexneri 2a str. 2457T
gucgaagaaaacauggcgug

SEQ ID NO: 1892355 - RNA, 22 nt, Shigella flexneri 2a str. 2457T
gucauccggcgucauauuacug

SEQ ID NO: 1892356 - RNA, 12 nt, Shigella flexneri 2a str. 2457T
gucgcugacgca

SEQ ID NO: 1892357 - RNA, 20 nt, Shigella flexneri 2a str. 2457T
gucgcuugcaggaucagcuc

SEQ ID NO: 1892358 - RNA, 12 nt, Shigella flexneri 2a str. 2457T
gucggaccauca

SEQ ID NO: 1892359 - RNA, 13 nt, Shigella flexneri 2a str. 2457T
gucggacggaauu

SEQ ID NO: 1892360 - RNA, 19 nt, Shigella flexneri 2a str. 2457T
gucggcaauguagcgcugc

SEQ ID NO: 1892361 - RNA, 13 nt, Shigella flexneri 2a str. 2457T
gucggcaguucgu

SEQ ID NO: 1892362 - RNA, 22 nt, Shigella flexneri 2a str. 2457T
gucgauagcgcccgaacggaaa

SEQ ID NO: 1892363 - RNA, 23 nt, Shigella flexneri 2a str. 2457T
gucgaucacccaagcuucgggau

SEQ ID NO: 1892364 - RNA, 15 nt, Shigella flexneri 2a str. 2457T
gucgcaucaggcauu

SEQ ID NO: 1892365 - RNA, 15 nt, Shigella flexneri 2a str. 2457T
gucgccagacgcagc

SEQ ID NO: 1892366 - RNA, 18 nt, Shigella flexneri 2a str. 2457T
gucgccccggaacgggag

SEQ ID NO: 1892367 - RNA, 17 nt, Shigella flexneri 2a str. 2457T
ggugcgaccaaacugcu

SEQ ID NO: 1892368 - RNA, 17 nt, Shigella flexneri 2a str. 2457T
ggugccagcaacuggcg

SEQ ID NO: 1892369 - RNA, 14 nt, Shigella flexneri 2a str. 2457T
ggucugauauggau

SEQ ID NO: 1892370 - RNA, 23 nt, Shigella flexneri 2a str. 2457T
ggucuguaccaccagaaucgcca

SEQ ID NO: 1892371 - RNA, 18 nt, Shigella flexneri 2a str. 2457T
ggugaagcgcccugcaau

SEQ ID NO: 1892372 - RNA, 20 nt, Shigella flexneri 2a str. 2457T
ggugcacaacaaucugcaaa

SEQ ID NO: 1892373 - RNA, 20 nt, Shigella flexneri 2a str. 2457T
ggugauuaucggcauagcca

SEQ ID NO: 1892374 - RNA, 13 nt, Shigella flexneri 2a str. 2457T
gguaccagcaccg

SEQ ID NO: 1892375 - RNA, 12 nt, Shigella flexneri 2a str. 2457T
gguaagugccac

SEQ ID NO: 1892376 - RNA, 23 nt, Shigella flexneri 2a str. 2457T
gguaaucacgcauggacacugcc

SEQ ID NO: 1892377 - RNA, 20 nt, Shigella flexneri 2a str. 2457T
gguaacgucgguuucaucac

SEQ ID NO: 1892378 - RNA, 22 nt, Shigella flexneri 2a str. 2457T
gguaacggcgucaacaccgggu

SEQ ID NO: 1892379 - RNA, 14 nt, Shigella flexneri 2a str. 2457T
gguaaccgccagua

SEQ ID NO: 1892380 - RNA, 22 nt, Shigella flexneri 2a str. 2457T
gguaagaucuuuguuucgguau

SEQ ID NO: 1892381 - RNA, 17 nt, Shigella flexneri 2a str. 2457T
gguaacuuaucuguaau

SEQ ID NO: 1892382 - RNA, 23 nt, Shigella flexneri 2a str. 2457T
gguaaagccgugcugcugccaaa

SEQ ID NO: 1892383 - RNA, 16 nt, Shigella flexneri 2a str. 2457T
gguaaaugcaucgccg

SEQ ID NO: 1892384 - RNA, 19 nt, Shigella flexneri 2a str. 2457T
gguaaccccucuucagccc

SEQ ID NO: 1892385 - RNA, 19 nt, Shigella flexneri 2a str. 2457T
ggguguauucaugcccugc

SEQ ID NO: 1892386 - RNA, 17 nt, Shigella flexneri 2a str. 2457T
gguauccagacggcgcu

SEQ ID NO: 1892387 - RNA, 13 nt, Shigella flexneri 2a str. 2457T
gguauggaguuua

SEQ ID NO: 1892388 - RNA, 22 nt, Shigella flexneri 2a str. 2457T
gguauuaccaccggacaucgca

SEQ ID NO: 1892389 - RNA, 22 nt, Shigella flexneri 2a str. 2457T
gguauuagcgcaaagacggaug

SEQ ID NO: 1892390 - RNA, 23 nt, Shigella flexneri 2a str. 2457T
ggucaaguaauuaucuuuacuga

SEQ ID NO: 1892391 - RNA, 10 nt, Shigella flexneri 2a str. 2457T
ggucaucaca

SEQ ID NO: 1892392 - RNA, 17 nt, Shigella flexneri 2a str. 2457T
ggucaguccccacgcca

SEQ ID NO: 1892393 - RNA, 15 nt, Shigella flexneri 2a str. 2457T
ggucaccgccgauac

SEQ ID NO: 1892394 - RNA, 20 nt, Shigella flexneri 2a str. 2457T
gggcgauaaaucuccacccg

SEQ ID NO: 1892395 - RNA, 14 nt, Shigella flexneri 2a str. 2457T
gggcucuuaagcac

SEQ ID NO: 1892396 - RNA, 21 nt, Shigella flexneri 2a str. 2457T
gggcuuucaucacuugaucca

SEQ ID NO: 1892397 - RNA, 22 nt, Shigella flexneri 2a str. 2457T
gggcuguauacgcgccacauca

SEQ ID NO: 1892398 - RNA, 20 nt, Shigella flexneri 2a str. 2457T
ggcgucacgccgaccagacc

SEQ ID NO: 1892399 - RNA, 12 nt, Shigella flexneri 2a str. 2457T
ggcgucaaacgg

SEQ ID NO: 1892400 - RNA, 22 nt, Shigella flexneri 2a str. 2457T
ggcgucaaacggcuaaagccgu

SEQ ID NO: 1892401 - RNA, 13 nt, Shigella flexneri 2a str. 2457T
ggcguccagaugc

SEQ ID NO: 1892402 - RNA, 16 nt, Shigella flexneri 2a str. 2457T
gggacgguccgugcgc

SEQ ID NO: 1892403 - RNA, 22 nt, Shigella flexneri 2a str. 2457T
gggagauguaagggcuaaucug

SEQ ID NO: 1892404 - RNA, 22 nt, Shigella flexneri 2a str. 2457T
gggauauaacccucgcgcgaca

SEQ ID NO: 1892405 - RNA, 23 nt, Shigella flexneri 2a str. 2457T
gggcaaacaccgcuucaacagcg

SEQ ID NO: 1892406 - RNA, 17 nt, Shigella flexneri 2a str. 2457T
gggaucuucuuccgcgc

SEQ ID NO: 1892407 - RNA, 16 nt, Shigella flexneri 2a str. 2457T
gggcaucggcaaucac

SEQ ID NO: 1892408 - RNA, 17 nt, Shigella flexneri 2a str. 2457T
gggcauggcgcagcgau

SEQ ID NO: 1892409 - RNA, 14 nt, Shigella flexneri 2a str. 2457T
ggacaaagagcuuu

SEQ ID NO: 1892410 - RNA, 17 nt, Shigella flexneri 2a str. 2457T
ggaccccgucaauuacc

SEQ ID NO: 1892411 - RNA, 16 nt, Shigella flexneri 2a str. 2457T
ggaacgauuuuagcaa

SEQ ID NO: 1892412 - RNA, 17 nt, Shigella flexneri 2a str. 2457T
gcuggcggaaacggguu

SEQ ID NO: 1892413 - RNA, 19 nt, Shigella flexneri 2a str. 2457T
ggaagauccagguuacgca

SEQ ID NO: 1892414 - RNA, 12 nt, Shigella flexneri 2a str. 2457T
ggaagaguuugu

SEQ ID NO: 1892415 - RNA, 20 nt, Shigella flexneri 2a str. 2457T
ggaagguuuuaaucgcuauc

SEQ ID NO: 1892416 - RNA, 19 nt, Shigella flexneri 2a str. 2457T
ggaaucgcaaagccgauac

SEQ ID NO: 1892417 - RNA, 19 nt, Shigella flexneri 2a str. 2457T
ggaauuaacgauacuucug

SEQ ID NO: 1892418 - RNA, 16 nt, Shigella flexneri 2a str. 2457T
ggaaugguauaacgca

SEQ ID NO: 1892419 - RNA, 12 nt, Shigella flexneri 2a str. 2457T
ggaucagccgcu

SEQ ID NO: 1892420 - RNA, 21 nt, Shigella flexneri 2a str. 2457T
ggauaauccgguuuacccgcu

SEQ ID NO: 1892421 - RNA, 22 nt, Shigella flexneri 2a str. 2457T
ggaucaaggauugcagcacuga

SEQ ID NO: 1892422 - RNA, 19 nt, Shigella flexneri 2a str. 2457T
ggauaaaucuccauuucau

SEQ ID NO: 1892423 - RNA, 21 nt, Shigella flexneri 2a str. 2457T
ggauaaagcguucacgccgca

SEQ ID NO: 1892424 - RNA, 15 nt, Shigella flexneri 2a str. 2457T
ggaguugaucgccaa

SEQ ID NO: 1892425 - RNA, 15 nt, Shigella flexneri 2a str. 2457T
ggaggcgcugguaau

SEQ ID NO: 1892426 - RNA, 23 nt, Shigella flexneri 2a str. 2457T
ggagucagacccugcucuuucag

SEQ ID NO: 1892427 - RNA, 17 nt, Shigella flexneri 2a str. 2457T
ggaggcaagacaugcug

SEQ ID NO: 1892428 - RNA, 15 nt, Shigella flexneri 2a str. 2457T
ggacuucaucacgau

SEQ ID NO: 1892429 - RNA, 19 nt, Shigella flexneri 2a str. 2457T
ggagccacauagacgguuu

SEQ ID NO: 1892430 - RNA, 19 nt, Shigella flexneri 2a str. 2457T
aaggauugcgauguugcgu

SEQ ID NO: 1892431 - RNA, 19 nt, Shigella flexneri 2a str. 2457T
aaggcagaaacaaacgcaa

SEQ ID NO: 1892432 - RNA, 20 nt, Shigella flexneri 2a str. 2457T
aaggcaaucugcucuauccg

SEQ ID NO: 1892433 - RNA, 16 nt, Shigella flexneri 2a str. 2457T
ggccaccagcguggca

SEQ ID NO: 1892434 - RNA, 14 nt, Shigella flexneri 2a str. 2457T
ggccacgacauucg

SEQ ID NO: 1892435 - RNA, 14 nt, Shigella flexneri 2a str. 2457T
ggccagccagagau

SEQ ID NO: 1892436 - RNA, 14 nt, Shigella flexneri 2a str. 2457T
ggccagcgccacca

SEQ ID NO: 1892437 - RNA, 13 nt, Shigella flexneri 2a str. 2457T
ggccauccaucaa

SEQ ID NO: 1892438 - RNA, 19 nt, Shigella flexneri 2a str. 2457T
ggccaguuucauagugcaa

SEQ ID NO: 1892439 - RNA, 10 nt, Shigella flexneri 2a str. 2457T
ggccaguugc

SEQ ID NO: 1892440 - RNA, 21 nt, Shigella flexneri 2a str. 2457T
ggccaugggcgcgauaaugcg

SEQ ID NO: 1892441 - RNA, 12 nt, Shigella flexneri 2a str. 2457T
ggcagaacgcuu

SEQ ID NO: 1892442 - RNA, 14 nt, Shigella flexneri 2a str. 2457T
ggcacacaagcgua

SEQ ID NO: 1892443 - RNA, 12 nt, Shigella flexneri 2a str. 2457T
ggcaaucgccag

SEQ ID NO: 1892444 - RNA, 12 nt, Shigella flexneri 2a str. 2457T
ggcaauccguaa

SEQ ID NO: 1892445 - RNA, 19 nt, Shigella flexneri 2a str. 2457T
ggcaauucucucugauuac

SEQ ID NO: 1892446 - RNA, 22 nt, Shigella flexneri 2a str. 2457T
ggcaauucaguacguucacgca

SEQ ID NO: 1892447 - RNA, 18 nt, Shigella flexneri 2a str. 2457T
ggcaaucauucccagacc

SEQ ID NO: 1892448 - RNA, 18 nt, Shigella flexneri 2a str. 2457T
ggcaaauucuucacggaa

SEQ ID NO: 1892449 - RNA, 14 nt, Shigella flexneri 2a str. 2457T
ggcaucagcagaau

SEQ ID NO: 1892450 - RNA, 18 nt, Shigella flexneri 2a str. 2457T
ggcaucauacacgccgcc

SEQ ID NO: 1892451 - RNA, 17 nt, Shigella flexneri 2a str. 2457T
ggcaguggugcggcuga

SEQ ID NO: 1892452 - RNA, 22 nt, Shigella flexneri 2a str. 2457T
ggcagugcuuucauuucagcgu

SEQ ID NO: 1892453 - RNA, 22 nt, Shigella flexneri 2a str. 2457T
ggcagcaacggcaguuugcggu

SEQ ID NO: 1892454 - RNA, 19 nt, Shigella flexneri 2a str. 2457T
ggccuaccaugaccugcaa

SEQ ID NO: 1892455 - RNA, 19 nt, Shigella flexneri 2a str. 2457T
ggccuacgcguccccugca

SEQ ID NO: 1892456 - RNA, 21 nt, Shigella flexneri 2a str. 2457T
ggccuacgugguuuaugcaau

SEQ ID NO: 1892457 - RNA, 17 nt, Shigella flexneri 2a str. 2457T
ggccucgcuacgccagc

SEQ ID NO: 1892458 - RNA, 20 nt, Shigella flexneri 2a str. 2457T
ggccuacauagucccugcaa

SEQ ID NO: 1892459 - RNA, 16 nt, Shigella flexneri 2a str. 2457T
ggccgcguaccgcagc

SEQ ID NO: 1892460 - RNA, 14 nt, Shigella flexneri 2a str. 2457T
ggccgcgcagggca

SEQ ID NO: 1892461 - RNA, 17 nt, Shigella flexneri 2a str. 2457T
ggcccauaacgccugcu

SEQ ID NO: 1892462 - RNA, 12 nt, Shigella flexneri 2a str. 2457T
ggcgagagcuuu

SEQ ID NO: 1892463 - RNA, 17 nt, Shigella flexneri 2a str. 2457T
aaggcguuuucgccaca

SEQ ID NO: 1892464 - RNA, 20 nt, Shigella flexneri 2a str. 2457T
aaggcguuuacgccgcaucc

SEQ ID NO: 1892465 - RNA, 20 nt, Shigella flexneri 2a str. 2457T
aaggcguucgcgccgcaucc

SEQ ID NO: 1892466 - RNA, 19 nt, Shigella flexneri 2a str. 2457T
aaggcguucacgccgcauc

SEQ ID NO: 1892467 - RNA, 17 nt, Shigella flexneri 2a str. 2457T
aaggcguucacgccaca

SEQ ID NO: 1892468 - RNA, 18 nt, Shigella flexneri 2a str. 2457T
aaggcguucacgccgcau

SEQ ID NO: 1892469 - RNA, 15 nt, Shigella flexneri 2a str. 2457T
ggcgaacauuccggu

SEQ ID NO: 1892470 - RNA, 18 nt, Shigella flexneri 2a str. 2457T
aaggcguuauacugcggc

SEQ ID NO: 1892471 - RNA, 20 nt, Shigella flexneri 2a str. 2457T
aaggcgaaaccuccgcaaug

SEQ ID NO: 1892472 - RNA, 18 nt, Shigella flexneri 2a str. 2457T
aaggcguacacgccgcau

SEQ ID NO: 1892473 - RNA, 16 nt, Shigella flexneri 2a str. 2457T
ggccucuccuuuacca

SEQ ID NO: 1892474 - RNA, 14 nt, Shigella flexneri 2a str. 2457T
ggcgagccagcgca

SEQ ID NO: 1892475 - RNA, 14 nt, Shigella flexneri 2a str. 2457T
aagggguuguaauc

SEQ ID NO: 1892476 - RNA, 17 nt, Shigella flexneri 2a str. 2457T
aaggguuuuauaaucgc

SEQ ID NO: 1892477 - RNA, 16 nt, Shigella flexneri 2a str. 2457T
aaggguuucgcgguug

SEQ ID NO: 1892478 - RNA, 15 nt, Shigella flexneri 2a str. 2457T
ggcgcaggauaucgu

SEQ ID NO: 1892479 - RNA, 19 nt, Shigella flexneri 2a str. 2457T
ggcgcuaucaauacuuucc

SEQ ID NO: 1892480 - RNA, 16 nt, Shigella flexneri 2a str. 2457T
aaggucgacagcagcc

SEQ ID NO: 1892481 - RNA, 14 nt, Shigella flexneri 2a str. 2457T
aagguuggcgucgg

SEQ ID NO: 1892482 - RNA, 20 nt, Shigella flexneri 2a str. 2457T
aaggucuccgcccagcguac

SEQ ID NO: 1892483 - RNA, 16 nt, Shigella flexneri 2a str. 2457T
ggcgguaaaaucaucc

SEQ ID NO: 1892484 - RNA, 23 nt, Shigella flexneri 2a str. 2457T
ggcggugucuaacgaugccagca

SEQ ID NO: 1892485 - RNA, 13 nt, Shigella flexneri 2a str. 2457T
ggcggucuggcga

SEQ ID NO: 1892486 - RNA, 17 nt, Shigella flexneri 2a str. 2457T
ggcggcguucagucgcc

SEQ ID NO: 1892487 - RNA, 18 nt, Shigella flexneri 2a str. 2457T
gcaacugcugcgguugaa

SEQ ID NO: 1892488 - RNA, 15 nt, Shigella flexneri 2a str. 2457T
gcaagagugguuagc

SEQ ID NO: 1892489 - RNA, 18 nt, Shigella flexneri 2a str. 2457T
gcaagauaguuaaucaau

SEQ ID NO: 1892490 - RNA, 14 nt, Shigella flexneri 2a str. 2457T
gcaacugcgcugca

SEQ ID NO: 1892491 - RNA, 16 nt, Shigella flexneri 2a str. 2457T
gcaacguugaccaguc

SEQ ID NO: 1892492 - RNA, 19 nt, Shigella flexneri 2a str. 2457T
gcaagcgggcggugguauu

SEQ ID NO: 1892493 - RNA, 16 nt, Shigella flexneri 2a str. 2457T
gcaagccgucgugaau

SEQ ID NO: 1892494 - RNA, 19 nt, Shigella flexneri 2a str. 2457T
gcaacgaacuaaccgcgcu

SEQ ID NO: 1892495 - RNA, 20 nt, Shigella flexneri 2a str. 2457T
gcaacgcuucaaccaacgca

SEQ ID NO: 1892496 - RNA, 18 nt, Shigella flexneri 2a str. 2457T
gcaacggcggaucaccgc

SEQ ID NO: 1892497 - RNA, 23 nt, Shigella flexneri 2a str. 2457T
gcaacgugacucaauggcauccg

SEQ ID NO: 1892498 - RNA, 23 nt, Shigella flexneri 2a str. 2457T
gcaacgucggaaaccgcuuugcc

SEQ ID NO: 1892499 - RNA, 20 nt, Shigella flexneri 2a str. 2457T
gcaacguguuuguucaacga

SEQ ID NO: 1892500 - RNA, 23 nt, Shigella flexneri 2a str. 2457T
gcaauaaucucuuuacccagcgg

SEQ ID NO: 1892501 - RNA, 21 nt, Shigella flexneri 2a str. 2457T
gcaauaaugccagucccgcga

SEQ ID NO: 1892502 - RNA, 22 nt, Shigella flexneri 2a str. 2457T
gcaaucgagcccagaugccgga

SEQ ID NO: 1892503 - RNA, 14 nt, Shigella flexneri 2a str. 2457T
gcaaucgccagcgg

SEQ ID NO: 1892504 - RNA, 16 nt, Shigella flexneri 2a str. 2457T
gcaaucgccagcggca

SEQ ID NO: 1892505 - RNA, 20 nt, Shigella flexneri 2a str. 2457T
gcaaucaucuuguaggccug

SEQ ID NO: 1892506 - RNA, 15 nt, Shigella flexneri 2a str. 2457T
gcaauccccgccagc

SEQ ID NO: 1892507 - RNA, 19 nt, Shigella flexneri 2a str. 2457T
gcaauccaccauuggcgca

SEQ ID NO: 1892508 - RNA, 15 nt, Shigella flexneri 2a str. 2457T
gcaauagcacugcuu

SEQ ID NO: 1892509 - RNA, 17 nt, Shigella flexneri 2a str. 2457T
gcaauacccugacccag

SEQ ID NO: 1892510 - RNA, 13 nt, Shigella flexneri 2a str. 2457T
gcaauaucgcggc

SEQ ID NO: 1892511 - RNA, 17 nt, Shigella flexneri 2a str. 2457T
gcaaucaaaaaaggcug

SEQ ID NO: 1892512 - RNA, 22 nt, Shigella flexneri 2a str. 2457T
gcaaucacuuccucaagcguuu

SEQ ID NO: 1892513 - RNA, 12 nt, Shigella flexneri 2a str. 2457T
gcacacguuuca

SEQ ID NO: 1892514 - RNA, 17 nt, Shigella flexneri 2a str. 2457T
gcacaaauggcaaugac

SEQ ID NO: 1892515 - RNA, 16 nt, Shigella flexneri 2a str. 2457T
gcacaacgucgcgcga

SEQ ID NO: 1892516 - RNA, 19 nt, Shigella flexneri 2a str. 2457T
gcaaucucuucaagcugcu

SEQ ID NO: 1892517 - RNA, 21 nt, Shigella flexneri 2a str. 2457T
gcaaucuccguguaggccuga

SEQ ID NO: 1892518 - RNA, 20 nt, Shigella flexneri 2a str. 2457T
gcaaucuccguguaggccug

SEQ ID NO: 1892519 - RNA, 12 nt, Shigella flexneri 2a str. 2457T
gcaaugcgcaca

SEQ ID NO: 1892520 - RNA, 21 nt, Shigella flexneri 2a str. 2457T
gcaaugcccgguguucccgcg

SEQ ID NO: 1892521 - RNA, 19 nt, Shigella flexneri 2a str. 2457T
gcaaugcguagcugagcaa

SEQ ID NO: 1892522 - RNA, 17 nt, Shigella flexneri 2a str. 2457T
gauugaccgccagcgcc

SEQ ID NO: 1892523 - RNA, 17 nt, Shigella flexneri 2a str. 2457T
gauugcuucaguugccu

SEQ ID NO: 1892524 - RNA, 18 nt, Shigella flexneri 2a str. 2457T
gauugcuccugcucauca

SEQ ID NO: 1892525 - RNA, 18 nt, Shigella flexneri 2a str. 2457T
gauuggucgcucgcgccg

SEQ ID NO: 1892526 - RNA, 16 nt, Shigella flexneri 2a str. 2457T
gauuguauugauugcu

SEQ ID NO: 1892527 - RNA, 22 nt, Shigella flexneri 2a str. 2457T
gauuacugcaaacucaucgccg

SEQ ID NO: 1892528 - RNA, 15 nt, Shigella flexneri 2a str. 2457T
gauuaugcacucagu

SEQ ID NO: 1892529 - RNA, 20 nt, Shigella flexneri 2a str. 2457T
gauuauuucgcugcggauug

SEQ ID NO: 1892530 - RNA, 21 nt, Shigella flexneri 2a str. 2457T
gcaaagagaacugagcgauca

SEQ ID NO: 1892531 - RNA, 15 nt, Shigella flexneri 2a str. 2457T
gcaaaccaggccggu

SEQ ID NO: 1892532 - RNA, 18 nt, Shigella flexneri 2a str. 2457T
gcaaaauacugaacaggc

SEQ ID NO: 1892533 - RNA, 23 nt, Shigella flexneri 2a str. 2457T
gcaaaacggcucuuauguccgga

SEQ ID NO: 1892534 - RNA, 13 nt, Shigella flexneri 2a str. 2457T
gcaaaacacccgc

SEQ ID NO: 1892535 - RNA, 17 nt, Shigella flexneri 2a str. 2457T
gcaaaaaucggcaacau

SEQ ID NO: 1892536 - RNA, 12 nt, Shigella flexneri 2a str. 2457T
gcaaaaacgcau

SEQ ID NO: 1892537 - RNA, 20 nt, Shigella flexneri 2a str. 2457T
gcaaaaaaacuugauacuga

SEQ ID NO: 1892538 - RNA, 18 nt, Shigella flexneri 2a str. 2457T
gauuuuuugccagcacca

SEQ ID NO: 1892539 - RNA, 14 nt, Shigella flexneri 2a str. 2457T
gcaacaauggcauu

SEQ ID NO: 1892540 - RNA, 13 nt, Shigella flexneri 2a str. 2457T
gcaacaacugaaa

SEQ ID NO: 1892541 - RNA, 16 nt, Shigella flexneri 2a str. 2457T
gcaaauugcauacugc

SEQ ID NO: 1892542 - RNA, 22 nt, Shigella flexneri 2a str. 2457T
gcaaaggcguuauacugcggca

SEQ ID NO: 1892543 - RNA, 14 nt, Shigella flexneri 2a str. 2457T
gcaaaggccagcaa

SEQ ID NO: 1892544 - RNA, 18 nt, Shigella flexneri 2a str. 2457T
gauggaauuucaucauca

SEQ ID NO: 1892545 - RNA, 18 nt, Shigella flexneri 2a str. 2457T
gauggaagaaaccagcgu

SEQ ID NO: 1892546 - RNA, 20 nt, Shigella flexneri 2a str. 2457T
gaugcggucgcugacgccau

SEQ ID NO: 1892547 - RNA, 12 nt, Shigella flexneri 2a str. 2457T
gaugcggcguaa

SEQ ID NO: 1892548 - RNA, 20 nt, Shigella flexneri 2a str. 2457T
gaugcggcguaaacgccuua

SEQ ID NO: 1892549 - RNA, 20 nt, Shigella flexneri 2a str. 2457T
gaugcggcguaaaugccuua

SEQ ID NO: 1892550 - RNA, 20 nt, Shigella flexneri 2a str. 2457T
gaugcggcgugaaugccuua

SEQ ID NO: 1892551 - RNA, 20 nt, Shigella flexneri 2a str. 2457T
gaugcggcgugaacgccuua

SEQ ID NO: 1892552 - RNA, 16 nt, Shigella flexneri 2a str. 2457T
gaugcggcgugaacgc

SEQ ID NO: 1892553 - RNA, 13 nt, Shigella flexneri 2a str. 2457T
gaugcggcgugaa

SEQ ID NO: 1892554 - RNA, 18 nt, Shigella flexneri 2a str. 2457T
gaugugagcgauacccau

SEQ ID NO: 1892555 - RNA, 18 nt, Shigella flexneri 2a str. 2457T
gaugugaacuugcucauc

SEQ ID NO: 1892556 - RNA, 16 nt, Shigella flexneri 2a str. 2457T
gauggcgggacagcau

SEQ ID NO: 1892557 - RNA, 23 nt, Shigella flexneri 2a str. 2457T
gaugggcgaagagaaagaacgag

SEQ ID NO: 1892558 - RNA, 20 nt, Shigella flexneri 2a str. 2457T
gaugguacuucaaucgccac

SEQ ID NO: 1892559 - RNA, 18 nt, Shigella flexneri 2a str. 2457T
gauggcguuuaaucgccu

SEQ ID NO: 1892560 - RNA, 20 nt, Shigella flexneri 2a str. 2457T
gcagccuucauucaggcauu

SEQ ID NO: 1892561 - RNA, 20 nt, Shigella flexneri 2a str. 2457T
gcagccgucgccaguaccag

SEQ ID NO: 1892562 - RNA, 17 nt, Shigella flexneri 2a str. 2457T
gcagccaucaccacgcu

SEQ ID NO: 1892563 - RNA, 16 nt, Shigella flexneri 2a str. 2457T
gcagccaucacugacu

SEQ ID NO: 1892564 - RNA, 13 nt, Shigella flexneri 2a str. 2457T
gcagcaucaccgg

SEQ ID NO: 1892565 - RNA, 15 nt, Shigella flexneri 2a str. 2457T
gcagcaucgucauca

SEQ ID NO: 1892566 - RNA, 13 nt, Shigella flexneri 2a str. 2457T
gcagcagcgguug

SEQ ID NO: 1892567 - RNA, 17 nt, Shigella flexneri 2a str. 2457T
gcagcauugcucaccgc

SEQ ID NO: 1892568 - RNA, 18 nt, Shigella flexneri 2a str. 2457T
gcagcauucagguugauc

SEQ ID NO: 1892569 - RNA, 19 nt, Shigella flexneri 2a str. 2457T
gcagccagggucaacauaa

SEQ ID NO: 1892570 - RNA, 18 nt, Shigella flexneri 2a str. 2457T
gcagccaccacuugcagc

SEQ ID NO: 1892571 - RNA, 17 nt, Shigella flexneri 2a str. 2457T
gcagaucggcauucaca

SEQ ID NO: 1892572 - RNA, 12 nt, Shigella flexneri 2a str. 2457T
gcagcaccauca

SEQ ID NO: 1892573 - RNA, 17 nt, Shigella flexneri 2a str. 2457T
gcagcagcgcaauucgc

SEQ ID NO: 1892574 - RNA, 22 nt, Shigella flexneri 2a str. 2457T
gcagcagccgguauccagcgcg

SEQ ID NO: 1892575 - RNA, 21 nt, Shigella flexneri 2a str. 2457T
gcagcagccgguauccagcgc

SEQ ID NO: 1892576 - RNA, 20 nt, Shigella flexneri 2a str. 2457T
gcagcagaaagcgacuuugc

SEQ ID NO: 1892577 - RNA, 13 nt, Shigella flexneri 2a str. 2457T
gcagaagcaauca

SEQ ID NO: 1892578 - RNA, 15 nt, Shigella flexneri 2a str. 2457T
gcagaaugguuucau

SEQ ID NO: 1892579 - RNA, 17 nt, Shigella flexneri 2a str. 2457T
gcagacuuuuugcggca

SEQ ID NO: 1892580 - RNA, 21 nt, Shigella flexneri 2a str. 2457T
gcagacguuuuuucugcccca

SEQ ID NO: 1892581 - RNA, 22 nt, Shigella flexneri 2a str. 2457T
gcaccagucgauggucgcguug

SEQ ID NO: 1892582 - RNA, 17 nt, Shigella flexneri 2a str. 2457T
gcacagcacgcuuuuca

SEQ ID NO: 1892583 - RNA, 21 nt, Shigella flexneri 2a str. 2457T
gcaccauccauuuuucacgca

SEQ ID NO: 1892584 - RNA, 13 nt, Shigella flexneri 2a str. 2457T
gcaccaucccgcu

SEQ ID NO: 1892585 - RNA, 19 nt, Shigella flexneri 2a str. 2457T
gcacccauuuauccagcgg

SEQ ID NO: 1892586 - RNA, 16 nt, Shigella flexneri 2a str. 2457T
gcaccgacgucgauau

SEQ ID NO: 1892587 - RNA, 17 nt, Shigella flexneri 2a str. 2457T
gcacgcagugagaagcc

SEQ ID NO: 1892588 - RNA, 18 nt, Shigella flexneri 2a str. 2457T
gcaccuuuacgccaggca

SEQ ID NO: 1892589 - RNA, 22 nt, Shigella flexneri 2a str. 2457T
gcacggugcaucuucacacuga

SEQ ID NO: 1892590 - RNA, 20 nt, Shigella flexneri 2a str. 2457T
gcacgguggucaggcgcgga

SEQ ID NO: 1892591 - RNA, 17 nt, Shigella flexneri 2a str. 2457T
gcacgccggauuugaga

SEQ ID NO: 1892592 - RNA, 17 nt, Shigella flexneri 2a str. 2457T
gaucgccccggucauca

SEQ ID NO: 1892593 - RNA, 22 nt, Shigella flexneri 2a str. 2457T
gaucgccccggaagcaucaaac

SEQ ID NO: 1892594 - RNA, 18 nt, Shigella flexneri 2a str. 2457T
gaucgacgcguccaggcu

SEQ ID NO: 1892595 - RNA, 20 nt, Shigella flexneri 2a str. 2457T
gaucagcaaauccaucgccu

SEQ ID NO: 1892596 - RNA, 22 nt, Shigella flexneri 2a str. 2457T
gauccauauuuugaaucggcgg

SEQ ID NO: 1892597 - RNA, 15 nt, Shigella flexneri 2a str. 2457T
gaucgggcauuucca

SEQ ID NO: 1892598 - RNA, 19 nt, Shigella flexneri 2a str. 2457T
gaucuaugucgcauccggc

SEQ ID NO: 1892599 - RNA, 19 nt, Shigella flexneri 2a str. 2457T
gaucguggugaugaucgug

SEQ ID NO: 1892600 - RNA, 20 nt, Shigella flexneri 2a str. 2457T
gaucgugugccaccagcgca

SEQ ID NO: 1892601 - RNA, 22 nt, Shigella flexneri 2a str. 2457T
gaucgcuuucagugucugcgcu

SEQ ID NO: 1892602 - RNA, 12 nt, Shigella flexneri 2a str. 2457T
gauagucaugau

SEQ ID NO: 1892603 - RNA, 13 nt, Shigella flexneri 2a str. 2457T
gauaucgccgguu

SEQ ID NO: 1892604 - RNA, 14 nt, Shigella flexneri 2a str. 2457T
gauaucguggcacg

SEQ ID NO: 1892605 - RNA, 16 nt, Shigella flexneri 2a str. 2457T
gaucaacacauccagu

SEQ ID NO: 1892606 - RNA, 18 nt, Shigella flexneri 2a str. 2457T
gaucaagcacaugcugac

SEQ ID NO: 1892607 - RNA, 21 nt, Shigella flexneri 2a str. 2457T
gaucaagcacaugcugacauu

SEQ ID NO: 1892608 - RNA, 21 nt, Shigella flexneri 2a str. 2457T
gauaauccgguuuacccgcuu

SEQ ID NO: 1892609 - RNA, 20 nt, Shigella flexneri 2a str. 2457T
gauaauagguaaacauccgu

SEQ ID NO: 1892610 - RNA, 13 nt, Shigella flexneri 2a str. 2457T
gauaagcgaacau

SEQ ID NO: 1892611 - RNA, 19 nt, Shigella flexneri 2a str. 2457T
gauaaguuaaccccaguaa

SEQ ID NO: 1892612 - RNA, 14 nt, Shigella flexneri 2a str. 2457T
gauaauacgcguaa

SEQ ID NO: 1892613 - RNA, 14 nt, Shigella flexneri 2a str. 2457T
gauaagacgcguca

SEQ ID NO: 1892614 - RNA, 16 nt, Shigella flexneri 2a str. 2457T
gauaagccccaguucc

SEQ ID NO: 1892615 - RNA, 15 nt, Shigella flexneri 2a str. 2457T
gauaauuuucagcgu

SEQ ID NO: 1892616 - RNA, 18 nt, Shigella flexneri 2a str. 2457T
gauaauucagcagggcga

SEQ ID NO: 1892617 - RNA, 17 nt, Shigella flexneri 2a str. 2457T
gauacgagagccggaag

SEQ ID NO: 1892618 - RNA, 22 nt, Shigella flexneri 2a str. 2457T
gauaccuaacacgaucagccau

SEQ ID NO: 1892619 - RNA, 19 nt, Shigella flexneri 2a str. 2457T
gauaccguucagacggcag

SEQ ID NO: 1892620 - RNA, 17 nt, Shigella flexneri 2a str. 2457T
gaguuguucugcgacgc

SEQ ID NO: 1892621 - RNA, 19 nt, Shigella flexneri 2a str. 2457T
gaguugcuccacugcucac

SEQ ID NO: 1892622 - RNA, 17 nt, Shigella flexneri 2a str. 2457T
gauaaacucaaucaggc

SEQ ID NO: 1892623 - RNA, 15 nt, Shigella flexneri 2a str. 2457T
gaguuuuaaacgcag

SEQ ID NO: 1892624 - RNA, 19 nt, Shigella flexneri 2a str. 2457T
gauaaaaaagggugcugca

SEQ ID NO: 1892625 - RNA, 13 nt, Shigella flexneri 2a str. 2457T
gauaagacgcgca

SEQ ID NO: 1892626 - RNA, 15 nt, Shigella flexneri 2a str. 2457T
gauaagaacugacuu

SEQ ID NO: 1892627 - RNA, 17 nt, Shigella flexneri 2a str. 2457T
gagucagcccaacaaag

SEQ ID NO: 1892628 - RNA, 17 nt, Shigella flexneri 2a str. 2457T
gagugaagucgcgcuca

SEQ ID NO: 1892629 - RNA, 20 nt, Shigella flexneri 2a str. 2457T
gaguguuauaaaacgcgccc

SEQ ID NO: 1892630 - RNA, 17 nt, Shigella flexneri 2a str. 2457T
gagucaagggugucggc

SEQ ID NO: 1892631 - RNA, 13 nt, Shigella flexneri 2a str. 2457T
gagggagcguccu

SEQ ID NO: 1892632 - RNA, 15 nt, Shigella flexneri 2a str. 2457T
gaggacagcuaucgc

SEQ ID NO: 1892633 - RNA, 22 nt, Shigella flexneri 2a str. 2457T
gacuucaaaaauaaguugccac

SEQ ID NO: 1892634 - RNA, 14 nt, Shigella flexneri 2a str. 2457T
aacucaacgccuuc

SEQ ID NO: 1892635 - RNA, 18 nt, Shigella flexneri 2a str. 2457T
aacuaucgacgcaaacgc

SEQ ID NO: 1892636 - RNA, 18 nt, Shigella flexneri 2a str. 2457T
aacguucggcagugguga

SEQ ID NO: 1892637 - RNA, 20 nt, Shigella flexneri 2a str. 2457T
aacguguuuauauuugaaca

SEQ ID NO: 1892638 - RNA, 15 nt, Shigella flexneri 2a str. 2457T
aacgugguuugcggc

SEQ ID NO: 1892639 - RNA, 19 nt, Shigella flexneri 2a str. 2457T
aacguugagaauggccaau

SEQ ID NO: 1892640 - RNA, 13 nt, Shigella flexneri 2a str. 2457T
aacguugccugau

SEQ ID NO: 1892641 - RNA, 22 nt, Shigella flexneri 2a str. 2457T
aacguugggaucaguaaacgcu

SEQ ID NO: 1892642 - RNA, 19 nt, Shigella flexneri 2a str. 2457T
gagaacugcgccagacgcg

SEQ ID NO: 1892643 - RNA, 14 nt, Shigella flexneri 2a str. 2457T
gagaaaaccggugu

SEQ ID NO: 1892644 - RNA, 16 nt, Shigella flexneri 2a str. 2457T
gagaaagaaacgccau

SEQ ID NO: 1892645 - RNA, 16 nt, Shigella flexneri 2a str. 2457T
gacugcggccugaguu

SEQ ID NO: 1892646 - RNA, 17 nt, Shigella flexneri 2a str. 2457T
gacugcagcggucacau

SEQ ID NO: 1892647 - RNA, 14 nt, Shigella flexneri 2a str. 2457T
gacugcgcccugaa

SEQ ID NO: 1892648 - RNA, 14 nt, Shigella flexneri 2a str. 2457T
gacuguaggccgga

SEQ ID NO: 1892649 - RNA, 15 nt, Shigella flexneri 2a str. 2457T
aacguggccaugagc

SEQ ID NO: 1892650 - RNA, 16 nt, Shigella flexneri 2a str. 2457T
aacgugcuucgcgcug

SEQ ID NO: 1892651 - RNA, 21 nt, Shigella flexneri 2a str. 2457T
gacugggugccgcgcagcgug

SEQ ID NO: 1892652 - RNA, 15 nt, Shigella flexneri 2a str. 2457T
gacugaauacgcugg

SEQ ID NO: 1892653 - RNA, 18 nt, Shigella flexneri 2a str. 2457T
gacugaccgaaaccguaa

SEQ ID NO: 1892654 - RNA, 22 nt, Shigella flexneri 2a str. 2457T
gacugauguguaggucgcauag

SEQ ID NO: 1892655 - RNA, 18 nt, Shigella flexneri 2a str. 2457T
gacucgaggagcuggagg

SEQ ID NO: 1892656 - RNA, 21 nt, Shigella flexneri 2a str. 2457T
gacguagcucgacuccugacu

SEQ ID NO: 1892657 - RNA, 16 nt, Shigella flexneri 2a str. 2457T
gacguucgcguacugc

SEQ ID NO: 1892658 - RNA, 17 nt, Shigella flexneri 2a str. 2457T
gacguucugccaaacgc

SEQ ID NO: 1892659 - RNA, 18 nt, Shigella flexneri 2a str. 2457T
gacgugcucgaacauccc

SEQ ID NO: 1892660 - RNA, 17 nt, Shigella flexneri 2a str. 2457T
gacuaccacguaacgac

SEQ ID NO: 1892661 - RNA, 19 nt, Shigella flexneri 2a str. 2457T
gacuaauugagcgugaagu

SEQ ID NO: 1892662 - RNA, 16 nt, Shigella flexneri 2a str. 2457T
gacuaaauacauuagu

SEQ ID NO: 1892663 - RNA, 13 nt, Shigella flexneri 2a str. 2457T
gacuauuugacac

SEQ ID NO: 1892664 - RNA, 20 nt, Shigella flexneri 2a str. 2457T
gacuauuaugaauuuacucu

SEQ ID NO: 1892665 - RNA, 15 nt, Shigella flexneri 2a str. 2457T
gacuccagcgccagc

SEQ ID NO: 1892666 - RNA, 19 nt, Shigella flexneri 2a str. 2457T
gagcgccguugcgcccauc

SEQ ID NO: 1892667 - RNA, 14 nt, Shigella flexneri 2a str. 2457T
aacucauaugcagc

SEQ ID NO: 1892668 - RNA, 14 nt, Shigella flexneri 2a str. 2457T
aacucaucgccgcu

SEQ ID NO: 1892669 - RNA, 20 nt, Shigella flexneri 2a str. 2457T
aacuccauacaucuucauca

SEQ ID NO: 1892670 - RNA, 20 nt, Shigella flexneri 2a str. 2457T
aacuccagaauaccgccaau

SEQ ID NO: 1892671 - RNA, 16 nt, Shigella flexneri 2a str. 2457T
gagcaucgguaucuuc

SEQ ID NO: 1892672 - RNA, 18 nt, Shigella flexneri 2a str. 2457T
gagcaucaguuaacggca

SEQ ID NO: 1892673 - RNA, 19 nt, Shigella flexneri 2a str. 2457T
gagcaucaguuaacggcac

SEQ ID NO: 1892674 - RNA, 15 nt, Shigella flexneri 2a str. 2457T
gagcauaggcauuaa

SEQ ID NO: 1892675 - RNA, 15 nt, Shigella flexneri 2a str. 2457T
gagcaguagcgucgc

SEQ ID NO: 1892676 - RNA, 13 nt, Shigella flexneri 2a str. 2457T
gagaucgccgcug

SEQ ID NO: 1892677 - RNA, 18 nt, Shigella flexneri 2a str. 2457T
gagaucgcuuaacagaac

SEQ ID NO: 1892678 - RNA, 17 nt, Shigella flexneri 2a str. 2457T
gagauaaccacguucau

SEQ ID NO: 1892679 - RNA, 13 nt, Shigella flexneri 2a str. 2457T
gagagaagccaga

SEQ ID NO: 1892680 - RNA, 15 nt, Shigella flexneri 2a str. 2457T
gagagaacugcgcca

SEQ ID NO: 1892681 - RNA, 16 nt, Shigella flexneri 2a str. 2457T
gagaauaaccaguucc

SEQ ID NO: 1892682 - RNA, 22 nt, Shigella flexneri 2a str. 2457T
gagaagucggcuuuuagcgaca

SEQ ID NO: 1892683 - RNA, 21 nt, Shigella flexneri 2a str. 2457T
gagacagcuuagacagcgccg

SEQ ID NO: 1892684 - RNA, 14 nt, Shigella flexneri 2a str. 2457T
gagacaaucgccac

SEQ ID NO: 1892685 - RNA, 22 nt, Shigella flexneri 2a str. 2457T
gagacgguuauauuuacaaauc

SEQ ID NO: 1892686 - RNA, 23 nt, Shigella flexneri 2a str. 2457T
gagaucguuggucgcgcacugcg

SEQ ID NO: 1892687 - RNA, 23 nt, Shigella flexneri 2a str. 2457T
gagaucuuuaucaaucaccgcuu

SEQ ID NO: 1892688 - RNA, 16 nt, Shigella flexneri 2a str. 2457T
gagcaaccugcacguu

SEQ ID NO: 1892689 - RNA, 21 nt, Shigella flexneri 2a str. 2457T
gagcaccgcgugcgcggcagc

SEQ ID NO: 1892690 - RNA, 21 nt, Shigella flexneri 2a str. 2457T
aagagugacuucgccgugaaa

SEQ ID NO: 1892691 - RNA, 18 nt, Shigella flexneri 2a str. 2457T
gccccggcaaaugacgau

SEQ ID NO: 1892692 - RNA, 15 nt, Shigella flexneri 2a str. 2457T
gcccgaagccaauuu

SEQ ID NO: 1892693 - RNA, 15 nt, Shigella flexneri 2a str. 2457T
gcccgccagcaccgg

SEQ ID NO: 1892694 - RNA, 15 nt, Shigella flexneri 2a str. 2457T
gcccgacgauaccgc

SEQ ID NO: 1892695 - RNA, 16 nt, Shigella flexneri 2a str. 2457T
gcccgaggagggcgag

SEQ ID NO: 1892696 - RNA, 19 nt, Shigella flexneri 2a str. 2457T
gccccgacgaacgcagcgu

SEQ ID NO: 1892697 - RNA, 18 nt, Shigella flexneri 2a str. 2457T
aagacguucacgucgcau

SEQ ID NO: 1892698 - RNA, 19 nt, Shigella flexneri 2a str. 2457T
gcccccagcagcgccgcaa

SEQ ID NO: 1892699 - RNA, 19 nt, Shigella flexneri 2a str. 2457T
gcccaugaugacaacauag

SEQ ID NO: 1892700 - RNA, 22 nt, Shigella flexneri 2a str. 2457T
gcccaugcguugucgccaucca

SEQ ID NO: 1892701 - RNA, 22 nt, Shigella flexneri 2a str. 2457T
gcccagugaguuggggccagca

SEQ ID NO: 1892702 - RNA, 23 nt, Shigella flexneri 2a str. 2457T
gcccaguccgcucgccgcagaga

SEQ ID NO: 1892703 - RNA, 24 nt, Shigella flexneri 2a str. 2457T
gcccggcauucaccucugcggcaa

SEQ ID NO: 1892704 - RNA, 23 nt, Shigella flexneri 2a str. 2457T
gcccguaccgucaaucuucacgc

SEQ ID NO: 1892705 - RNA, 12 nt, Shigella flexneri 2a str. 2457T
gcccucacccgu

SEQ ID NO: 1892706 - RNA, 21 nt, Shigella flexneri 2a str. 2457T
gcccguuaaccgcucugcgau

SEQ ID NO: 1892707 - RNA, 23 nt, Shigella flexneri 2a str. 2457T
gcccguuuggugguuuggcggcg

SEQ ID NO: 1892708 - RNA, 14 nt, Shigella flexneri 2a str. 2457T
gcccgucgugaaga

SEQ ID NO: 1892709 - RNA, 22 nt, Shigella flexneri 2a str. 2457T
gcccguccaucaacaagcgaau

SEQ ID NO: 1892710 - RNA, 14 nt, Shigella flexneri 2a str. 2457T
gccgaaccagugcu

SEQ ID NO: 1892711 - RNA, 16 nt, Shigella flexneri 2a str. 2457T
gccgacaaaugcaguu

SEQ ID NO: 1892712 - RNA, 19 nt, Shigella flexneri 2a str. 2457T
gccgaaugccacgacguuu

SEQ ID NO: 1892713 - RNA, 15 nt, Shigella flexneri 2a str. 2457T
gccgaacguaggcug

SEQ ID NO: 1892714 - RNA, 17 nt, Shigella flexneri 2a str. 2457T
gccgaacguaggcugga

SEQ ID NO: 1892715 - RNA, 16 nt, Shigella flexneri 2a str. 2457T
aagaugcacccgccag

SEQ ID NO: 1892716 - RNA, 21 nt, Shigella flexneri 2a str. 2457T
gccgagaauaaaacaggcagc

SEQ ID NO: 1892717 - RNA, 19 nt, Shigella flexneri 2a str. 2457T
gccgcccuguuugguugcc

SEQ ID NO: 1892718 - RNA, 21 nt, Shigella flexneri 2a str. 2457T
gccgccaucucuuccagcgau

SEQ ID NO: 1892719 - RNA, 19 nt, Shigella flexneri 2a str. 2457T
gccgccauugaaucguuau

SEQ ID NO: 1892720 - RNA, 17 nt, Shigella flexneri 2a str. 2457T
gccgcaguaaagcgcag

SEQ ID NO: 1892721 - RNA, 23 nt, Shigella flexneri 2a str. 2457T
gccgcaguuuuugcacgcuuucu

SEQ ID NO: 1892722 - RNA, 13 nt, Shigella flexneri 2a str. 2457T
gccgcagccauca

SEQ ID NO: 1892723 - RNA, 11 nt, Shigella flexneri 2a str. 2457T
gccgcauugac

SEQ ID NO: 1892724 - RNA, 20 nt, Shigella flexneri 2a str. 2457T
gccgcauggaaccaguucac

SEQ ID NO: 1892725 - RNA, 15 nt, Shigella flexneri 2a str. 2457T
gccgcagcaguugcc

SEQ ID NO: 1892726 - RNA, 16 nt, Shigella flexneri 2a str. 2457T
gccaggccagccuggu

SEQ ID NO: 1892727 - RNA, 21 nt, Shigella flexneri 2a str. 2457T
gccagcguaaauccugacgcu

SEQ ID NO: 1892728 - RNA, 18 nt, Shigella flexneri 2a str. 2457T
gccagcgucgcacccggc

SEQ ID NO: 1892729 - RNA, 21 nt, Shigella flexneri 2a str. 2457T
gccagcgucgcaucaggcauc

SEQ ID NO: 1892730 - RNA, 17 nt, Shigella flexneri 2a str. 2457T
gccaggucgugccagaa

SEQ ID NO: 1892731 - RNA, 14 nt, Shigella flexneri 2a str. 2457T
gccaguaccagcag

SEQ ID NO: 1892732 - RNA, 15 nt, Shigella flexneri 2a str. 2457T
gccagugccacacgc

SEQ ID NO: 1892733 - RNA, 15 nt, Shigella flexneri 2a str. 2457T
gccaguuacugccac

SEQ ID NO: 1892734 - RNA, 14 nt, Shigella flexneri 2a str. 2457T
gccauccguuucag

SEQ ID NO: 1892735 - RNA, 16 nt, Shigella flexneri 2a str. 2457T
gccauccuuacgcagc

SEQ ID NO: 1892736 - RNA, 21 nt, Shigella flexneri 2a str. 2457T
gccaucuccgcauguuucgac

SEQ ID NO: 1892737 - RNA, 19 nt, Shigella flexneri 2a str. 2457T
gccaucguuaauuaacgcg

SEQ ID NO: 1892738 - RNA, 15 nt, Shigella flexneri 2a str. 2457T
gccaucugccagcaa

SEQ ID NO: 1892739 - RNA, 21 nt, Shigella flexneri 2a str. 2457T
gccaugagcggacugaacgcg

SEQ ID NO: 1892740 - RNA, 23 nt, Shigella flexneri 2a str. 2457T
gccauccauaauuacgcuguuca

SEQ ID NO: 1892741 - RNA, 17 nt, Shigella flexneri 2a str. 2457T
gccauccaucaacgcca

SEQ ID NO: 1892742 - RNA, 14 nt, Shigella flexneri 2a str. 2457T
gccaucagcagcgg

SEQ ID NO: 1892743 - RNA, 13 nt, Shigella flexneri 2a str. 2457T
gccaucagcagcg

SEQ ID NO: 1892744 - RNA, 22 nt, Shigella flexneri 2a str. 2457T
gccaucaacguaguaucguaau

SEQ ID NO: 1892745 - RNA, 16 nt, Shigella flexneri 2a str. 2457T
gccaucaauuuccggc

SEQ ID NO: 1892746 - RNA, 14 nt, Shigella flexneri 2a str. 2457T
gccaucaauugcuc

SEQ ID NO: 1892747 - RNA, 19 nt, Shigella flexneri 2a str. 2457T
gccauauacgccaucgcca

SEQ ID NO: 1892748 - RNA, 23 nt, Shigella flexneri 2a str. 2457T
gccauauacgccaucgccagcag

SEQ ID NO: 1892749 - RNA, 23 nt, Shigella flexneri 2a str. 2457T
gccaguuuacugucugcuucugc

SEQ ID NO: 1892750 - RNA, 18 nt, Shigella flexneri 2a str. 2457T
gccaguugcuuauccagc

SEQ ID NO: 1892751 - RNA, 19 nt, Shigella flexneri 2a str. 2457T
gccauaauaaucaucacgc

SEQ ID NO: 1892752 - RNA, 14 nt, Shigella flexneri 2a str. 2457T
gccauaauaaucau

SEQ ID NO: 1892753 - RNA, 22 nt, Shigella flexneri 2a str. 2457T
gccacucugacggcgcauccga

SEQ ID NO: 1892754 - RNA, 13 nt, Shigella flexneri 2a str. 2457T
gccacggcuccag

SEQ ID NO: 1892755 - RNA, 22 nt, Shigella flexneri 2a str. 2457T
gccacggcgaccguucgccagg

SEQ ID NO: 1892756 - RNA, 15 nt, Shigella flexneri 2a str. 2457T
gccacgguauuugcc

SEQ ID NO: 1892757 - RNA, 16 nt, Shigella flexneri 2a str. 2457T
gccagagagaacugcg

SEQ ID NO: 1892758 - RNA, 16 nt, Shigella flexneri 2a str. 2457T
gccagagcccaucaca

SEQ ID NO: 1892759 - RNA, 22 nt, Shigella flexneri 2a str. 2457T
gccagaccugcgacauauuccc

SEQ ID NO: 1892760 - RNA, 17 nt, Shigella flexneri 2a str. 2457T
gccagacccauaaucag

SEQ ID NO: 1892761 - RNA, 13 nt, Shigella flexneri 2a str. 2457T
gccagaagcccgg

SEQ ID NO: 1892762 - RNA, 16 nt, Shigella flexneri 2a str. 2457T
gccacggcaugaaagc

SEQ ID NO: 1892763 - RNA, 19 nt, Shigella flexneri 2a str. 2457T
gccacaggcuuuccugaua

SEQ ID NO: 1892764 - RNA, 15 nt, Shigella flexneri 2a str. 2457T
gccacaggucagcag

SEQ ID NO: 1892765 - RNA, 23 nt, Shigella flexneri 2a str. 2457T
gccacgaaucagcaccguagcgu

SEQ ID NO: 1892766 - RNA, 16 nt, Shigella flexneri 2a str. 2457T
gccagauaguucgcga

SEQ ID NO: 1892767 - RNA, 15 nt, Shigella flexneri 2a str. 2457T
gccagauagauugcg

SEQ ID NO: 1892768 - RNA, 22 nt, Shigella flexneri 2a str. 2457T
gccagauaaggcguucacgccg

SEQ ID NO: 1892769 - RNA, 14 nt, Shigella flexneri 2a str. 2457T
gccagaugcggcgu

SEQ ID NO: 1892770 - RNA, 18 nt, Shigella flexneri 2a str. 2457T
gccagcacgaccgccauu

SEQ ID NO: 1892771 - RNA, 17 nt, Shigella flexneri 2a str. 2457T
gccagcgccaccaccag

SEQ ID NO: 1892772 - RNA, 14 nt, Shigella flexneri 2a str. 2457T
gccagcgcugacgu

SEQ ID NO: 1892773 - RNA, 12 nt, Shigella flexneri 2a str. 2457T
gcaucgccgcua

SEQ ID NO: 1892774 - RNA, 16 nt, Shigella flexneri 2a str. 2457T
gcaucgccaaacaggc

SEQ ID NO: 1892775 - RNA, 21 nt, Shigella flexneri 2a str. 2457T
gcaucaugcucagaugccuga

SEQ ID NO: 1892776 - RNA, 16 nt, Shigella flexneri 2a str. 2457T
gcaucauggaagcaau

SEQ ID NO: 1892777 - RNA, 17 nt, Shigella flexneri 2a str. 2457T
gcaucaucgcuuugugc

SEQ ID NO: 1892778 - RNA, 13 nt, Shigella flexneri 2a str. 2457T
gcaucaggcaaug

SEQ ID NO: 1892779 - RNA, 13 nt, Shigella flexneri 2a str. 2457T
gcauccagcguuc

SEQ ID NO: 1892780 - RNA, 18 nt, Shigella flexneri 2a str. 2457T
gcauccgacaaggcauca

SEQ ID NO: 1892781 - RNA, 21 nt, Shigella flexneri 2a str. 2457T
gcauccgugguggcagccagc

SEQ ID NO: 1892782 - RNA, 16 nt, Shigella flexneri 2a str. 2457T
gcauccggugauaggc

SEQ ID NO: 1892783 - RNA, 21 nt, Shigella flexneri 2a str. 2457T
gcaucgacaguuucaccugcu

SEQ ID NO: 1892784 - RNA, 22 nt, Shigella flexneri 2a str. 2457T
gcaucgacaguuucaccugcug

SEQ ID NO: 1892785 - RNA, 14 nt, Shigella flexneri 2a str. 2457T
gcaucagcgccacc

SEQ ID NO: 1892786 - RNA, 23 nt, Shigella flexneri 2a str. 2457T
gcaucagacaaaugucacugcuu

SEQ ID NO: 1892787 - RNA, 17 nt, Shigella flexneri 2a str. 2457T
gcaucagacauuauugc

SEQ ID NO: 1892788 - RNA, 21 nt, Shigella flexneri 2a str. 2457T
gcaucacuucuuuguucggca

SEQ ID NO: 1892789 - RNA, 15 nt, Shigella flexneri 2a str. 2457T
gcaucaaugccggac

SEQ ID NO: 1892790 - RNA, 16 nt, Shigella flexneri 2a str. 2457T
gcaucaauaccgcgua

SEQ ID NO: 1892791 - RNA, 15 nt, Shigella flexneri 2a str. 2457T
gcaucaauaccgcgu

SEQ ID NO: 1892792 - RNA, 14 nt, Shigella flexneri 2a str. 2457T
gcaucaauaaucaa

SEQ ID NO: 1892793 - RNA, 13 nt, Shigella flexneri 2a str. 2457T
gcaucaauugcua

SEQ ID NO: 1892794 - RNA, 14 nt, Shigella flexneri 2a str. 2457T
gcaucacaucgcug

SEQ ID NO: 1892795 - RNA, 17 nt, Shigella flexneri 2a str. 2457T
gcauaugcaaaaggcug

SEQ ID NO: 1892796 - RNA, 21 nt, Shigella flexneri 2a str. 2457T
gcauauguuuacgcuggcgga

SEQ ID NO: 1892797 - RNA, 19 nt, Shigella flexneri 2a str. 2457T
gcauaucgguaaaugcuuu

SEQ ID NO: 1892798 - RNA, 22 nt, Shigella flexneri 2a str. 2457T
gcauagccaccuggcugcguuu

SEQ ID NO: 1892799 - RNA, 17 nt, Shigella flexneri 2a str. 2457T
gcauacugaaccacgga

SEQ ID NO: 1892800 - RNA, 24 nt, Shigella flexneri 2a str. 2457T
gcauaccuucacagaaggccagga

SEQ ID NO: 1892801 - RNA, 20 nt, Shigella flexneri 2a str. 2457T
gcauaccuuccagcgcguuc

SEQ ID NO: 1892802 - RNA, 23 nt, Shigella flexneri 2a str. 2457T
gcauacggaauagcuuaccgguc

SEQ ID NO: 1892803 - RNA, 22 nt, Shigella flexneri 2a str. 2457T
gcauacagccagacaaucgaaa

SEQ ID NO: 1892804 - RNA, 22 nt, Shigella flexneri 2a str. 2457T
gcauaaucggcuggguuuccgg

SEQ ID NO: 1892805 - RNA, 15 nt, Shigella flexneri 2a str. 2457T
gcauaaugcagccau

SEQ ID NO: 1892806 - RNA, 17 nt, Shigella flexneri 2a str. 2457T
gcauaaugcagccaucc

SEQ ID NO: 1892807 - RNA, 14 nt, Shigella flexneri 2a str. 2457T
gcaguguuuccggc

SEQ ID NO: 1892808 - RNA, 16 nt, Shigella flexneri 2a str. 2457T
gcagugccaguucuuc

SEQ ID NO: 1892809 - RNA, 10 nt, Shigella flexneri 2a str. 2457T
gcagugccag

SEQ ID NO: 1892810 - RNA, 15 nt, Shigella flexneri 2a str. 2457T
gcauaaauaccggca

SEQ ID NO: 1892811 - RNA, 19 nt, Shigella flexneri 2a str. 2457T
gcauaacguugcagcguuu

SEQ ID NO: 1892812 - RNA, 22 nt, Shigella flexneri 2a str. 2457T
gcauaagccgucccuaccggua

SEQ ID NO: 1892813 - RNA, 21 nt, Shigella flexneri 2a str. 2457T
gcaguuuauccagccacggcu

SEQ ID NO: 1892814 - RNA, 22 nt, Shigella flexneri 2a str. 2457T
gcauaaaccgggcguggaucug

SEQ ID NO: 1892815 - RNA, 16 nt, Shigella flexneri 2a str. 2457T
gcaguuuuuuaacgcc

SEQ ID NO: 1892816 - RNA, 12 nt, Shigella flexneri 2a str. 2457T
gcaguuuaccgu

SEQ ID NO: 1892817 - RNA, 24 nt, Shigella flexneri 2a str. 2457T
gcaguuugguuaagucacgggcag

SEQ ID NO: 1892818 - RNA, 22 nt, Shigella flexneri 2a str. 2457T
gcaguucgggccgaucauacga

SEQ ID NO: 1892819 - RNA, 17 nt, Shigella flexneri 2a str. 2457T
gcaguugcccgguuucg

SEQ ID NO: 1892820 - RNA, 16 nt, Shigella flexneri 2a str. 2457T
gcaguugacagccaca

SEQ ID NO: 1892821 - RNA, 17 nt, Shigella flexneri 2a str. 2457T
gcaucuuccccugcgau

SEQ ID NO: 1892822 - RNA, 15 nt, Shigella flexneri 2a str. 2457T
gcaugaacauugcug

SEQ ID NO: 1892823 - RNA, 20 nt, Shigella flexneri 2a str. 2457T
gcaucuggaaagucugaaug

SEQ ID NO: 1892824 - RNA, 15 nt, Shigella flexneri 2a str. 2457T
gcaugauagcccgga

SEQ ID NO: 1892825 - RNA, 14 nt, Shigella flexneri 2a str. 2457T
gcaugauaccgauu

SEQ ID NO: 1892826 - RNA, 15 nt, Shigella flexneri 2a str. 2457T
gcaugauaagacgcg

SEQ ID NO: 1892827 - RNA, 15 nt, Shigella flexneri 2a str. 2457T
gcaugaugccugaug

SEQ ID NO: 1892828 - RNA, 22 nt, Shigella flexneri 2a str. 2457T
gcaugccgguagaagccaguca

SEQ ID NO: 1892829 - RNA, 20 nt, Shigella flexneri 2a str. 2457T
gcauucacccggggugauaa

SEQ ID NO: 1892830 - RNA, 14 nt, Shigella flexneri 2a str. 2457T
gcauucacgccgca

SEQ ID NO: 1892831 - RNA, 22 nt, Shigella flexneri 2a str. 2457T
gcauucagugcaaaugccagau

SEQ ID NO: 1892832 - RNA, 18 nt, Shigella flexneri 2a str. 2457T
gcauuaucacaucagcgc

SEQ ID NO: 1892833 - RNA, 16 nt, Shigella flexneri 2a str. 2457T
gcauguguaaccgcuu

SEQ ID NO: 1892834 - RNA, 14 nt, Shigella flexneri 2a str. 2457T
gcaugguaccgugu

SEQ ID NO: 1892835 - RNA, 16 nt, Shigella flexneri 2a str. 2457T
gcauggggaucgugau

SEQ ID NO: 1892836 - RNA, 15 nt, Shigella flexneri 2a str. 2457T
gcauggaaauguucc

SEQ ID NO: 1892837 - RNA, 14 nt, Shigella flexneri 2a str. 2457T
gccacaauauuccg

SEQ ID NO: 1892838 - RNA, 18 nt, Shigella flexneri 2a str. 2457T
gccacaaucucacccgcu

SEQ ID NO: 1892839 - RNA, 16 nt, Shigella flexneri 2a str. 2457T
gccaaugcaggcaucg

SEQ ID NO: 1892840 - RNA, 18 nt, Shigella flexneri 2a str. 2457T
gccaaucacucaccugcu

SEQ ID NO: 1892841 - RNA, 18 nt, Shigella flexneri 2a str. 2457T
gccaaucagcagaaccgc

SEQ ID NO: 1892842 - RNA, 22 nt, Shigella flexneri 2a str. 2457T
gccaacccgcucuggauaauca

SEQ ID NO: 1892843 - RNA, 21 nt, Shigella flexneri 2a str. 2457T
gccaaccgauaucuuuccggc

SEQ ID NO: 1892844 - RNA, 20 nt, Shigella flexneri 2a str. 2457T
gcauugcucaccgccagcau

SEQ ID NO: 1892845 - RNA, 14 nt, Shigella flexneri 2a str. 2457T
gcauuggacagauu

SEQ ID NO: 1892846 - RNA, 22 nt, Shigella flexneri 2a str. 2457T
gcauugcuuugguggucaccau

SEQ ID NO: 1892847 - RNA, 13 nt, Shigella flexneri 2a str. 2457T
gcauuggcaaauu

SEQ ID NO: 1892848 - RNA, 14 nt, Shigella flexneri 2a str. 2457T
gcauucucaucacc

SEQ ID NO: 1892849 - RNA, 16 nt, Shigella flexneri 2a str. 2457T
gcauuucauugagcgu

SEQ ID NO: 1892850 - RNA, 23 nt, Shigella flexneri 2a str. 2457T
gcauuuggcucucgaugccugau

SEQ ID NO: 1892851 - RNA, 23 nt, Shigella flexneri 2a str. 2457T
gcauuucucacuuuucaccgcuu

SEQ ID NO: 1892852 - RNA, 19 nt, Shigella flexneri 2a str. 2457T
gcauuuuuuucaccaacgc

SEQ ID NO: 1892853 - RNA, 13 nt, Shigella flexneri 2a str. 2457T
gcauuuugcagau

SEQ ID NO: 1892854 - RNA, 18 nt, Shigella flexneri 2a str. 2457T
gccaaaugucaccagccg

SEQ ID NO: 1892855 - RNA, 20 nt, Shigella flexneri 2a str. 2457T
gccaaaucauccagacugcu

SEQ ID NO: 1892856 - RNA, 14 nt, Shigella flexneri 2a str. 2457T
gccaacaaucucuu

SEQ ID NO: 1892857 - RNA, 23 nt, Shigella flexneri 2a str. 2457T
gccaaauacauugauauacagcc

SEQ ID NO: 1892858 - RNA, 22 nt, Shigella flexneri 2a str. 2457T
gccaaaauugguuucagccgga

SEQ ID NO: 1892859 - RNA, 19 nt, Shigella flexneri 2a str. 2457T
gaaacuuauucaaucucuu

SEQ ID NO: 1892860 - RNA, 19 nt, Shigella flexneri 2a str. 2457T
gaaagauaccgccgccaug

SEQ ID NO: 1892861 - RNA, 21 nt, Shigella flexneri 2a str. 2457T
gaaagagggcauucuuaccgg

SEQ ID NO: 1892862 - RNA, 19 nt, Shigella flexneri 2a str. 2457T
gaaagcaauuaacagugac

SEQ ID NO: 1892863 - RNA, 13 nt, Shigella flexneri 2a str. 2457T
gaaagaucgccac

SEQ ID NO: 1892864 - RNA, 23 nt, Shigella flexneri 2a str. 2457T
gaaagcagcauguagaugccggu

SEQ ID NO: 1892865 - RNA, 17 nt, Shigella flexneri 2a str. 2457T
gaaagcagcgaugcuuu

SEQ ID NO: 1892866 - RNA, 14 nt, Shigella flexneri 2a str. 2457T
gaaagcucauaacg

SEQ ID NO: 1892867 - RNA, 17 nt, Shigella flexneri 2a str. 2457T
gaaagucguaggccuga

SEQ ID NO: 1892868 - RNA, 18 nt, Shigella flexneri 2a str. 2457T
gaaaccgugcccgauccu

SEQ ID NO: 1892869 - RNA, 13 nt, Shigella flexneri 2a str. 2457T
gaaacucacgcag

SEQ ID NO: 1892870 - RNA, 17 nt, Shigella flexneri 2a str. 2457T
gaacaggccgacuggca

SEQ ID NO: 1892871 - RNA, 13 nt, Shigella flexneri 2a str. 2457T
gaaaucgaucauc

SEQ ID NO: 1892872 - RNA, 23 nt, Shigella flexneri 2a str. 2457T
gaaaucucacccgguacaucaau

SEQ ID NO: 1892873 - RNA, 15 nt, Shigella flexneri 2a str. 2457T
gaacaccaccugcca

SEQ ID NO: 1892874 - RNA, 21 nt, Shigella flexneri 2a str. 2457T
gaaaugagauauuucagagcu

SEQ ID NO: 1892875 - RNA, 15 nt, Shigella flexneri 2a str. 2457T
gaacagcacaucagc

SEQ ID NO: 1892876 - RNA, 15 nt, Shigella flexneri 2a str. 2457T
gaacagaccagcacc

SEQ ID NO: 1892877 - RNA, 15 nt, Shigella flexneri 2a str. 2457T
gaacgcagcgucuca

SEQ ID NO: 1892878 - RNA, 21 nt, Shigella flexneri 2a str. 2457T
gaacgccgaauaacgcgcagc

SEQ ID NO: 1892879 - RNA, 14 nt, Shigella flexneri 2a str. 2457T
gaaccguacagcau

SEQ ID NO: 1892880 - RNA, 18 nt, Shigella flexneri 2a str. 2457T
gaacauuuucuucugcca

SEQ ID NO: 1892881 - RNA, 14 nt, Shigella flexneri 2a str. 2457T
gaacuuccgggauc

SEQ ID NO: 1892882 - RNA, 19 nt, Shigella flexneri 2a str. 2457T
gaagaauuuguaggccgga

SEQ ID NO: 1892883 - RNA, 23 nt, Shigella flexneri 2a str. 2457T
gaagaagucgaaugcgcaaccgu

SEQ ID NO: 1892884 - RNA, 17 nt, Shigella flexneri 2a str. 2457T
gaacucgcugcgcggca

SEQ ID NO: 1892885 - RNA, 22 nt, Shigella flexneri 2a str. 2457T
gaacucggugaccgaucgcccg

SEQ ID NO: 1892886 - RNA, 20 nt, Shigella flexneri 2a str. 2457T
gaacgggagaaacccggcca

SEQ ID NO: 1892887 - RNA, 21 nt, Shigella flexneri 2a str. 2457T
gaagugaacguguaggccuga

SEQ ID NO: 1892888 - RNA, 16 nt, Shigella flexneri 2a str. 2457T
gaaucacguaggccug

SEQ ID NO: 1892889 - RNA, 12 nt, Shigella flexneri 2a str. 2457T
gaaugacgccau

SEQ ID NO: 1892890 - RNA, 18 nt, Shigella flexneri 2a str. 2457T
gaaugaggaucagccgcu

SEQ ID NO: 1892891 - RNA, 19 nt, Shigella flexneri 2a str. 2457T
gaaugccgcagcacccuga

SEQ ID NO: 1892892 - RNA, 19 nt, Shigella flexneri 2a str. 2457T
gaauggcaucuacgcucuc

SEQ ID NO: 1892893 - RNA, 16 nt, Shigella flexneri 2a str. 2457T
gaaugccggaugcggc

SEQ ID NO: 1892894 - RNA, 13 nt, Shigella flexneri 2a str. 2457T
gaaucgcuguuga

SEQ ID NO: 1892895 - RNA, 17 nt, Shigella flexneri 2a str. 2457T
gaaucgggcgugauucc

SEQ ID NO: 1892896 - RNA, 19 nt, Shigella flexneri 2a str. 2457T
gaaggugaaauugucggcg

SEQ ID NO: 1892897 - RNA, 20 nt, Shigella flexneri 2a str. 2457T
gaagguucaagacgaauacc

SEQ ID NO: 1892898 - RNA, 14 nt, Shigella flexneri 2a str. 2457T
gaaguaauaaucaa

SEQ ID NO: 1892899 - RNA, 20 nt, Shigella flexneri 2a str. 2457T
gaagucaacgcucaggccga

SEQ ID NO: 1892900 - RNA, 15 nt, Shigella flexneri 2a str. 2457T
gaaggcgcugacguu

SEQ ID NO: 1892901 - RNA, 14 nt, Shigella flexneri 2a str. 2457T
gaaggguuggugaa

SEQ ID NO: 1892902 - RNA, 16 nt, Shigella flexneri 2a str. 2457T
gaagcgcaacgcauca

SEQ ID NO: 1892903 - RNA, 23 nt, Shigella flexneri 2a str. 2457T
gaagcgcauggcguccgucaucg

SEQ ID NO: 1892904 - RNA, 17 nt, Shigella flexneri 2a str. 2457T
gaaggcaagaaagcgua

SEQ ID NO: 1892905 - RNA, 14 nt, Shigella flexneri 2a str. 2457T
gaaggccagcaggu

SEQ ID NO: 1892906 - RNA, 20 nt, Shigella flexneri 2a str. 2457T
gaaggcaaacuucucgccau

SEQ ID NO: 1892907 - RNA, 18 nt, Shigella flexneri 2a str. 2457T
gaagcugacaggcgcuga

SEQ ID NO: 1892908 - RNA, 15 nt, Shigella flexneri 2a str. 2457T
gaagcacucguaaga

SEQ ID NO: 1892909 - RNA, 22 nt, Shigella flexneri 2a str. 2457T
gaagcaauguauuuguccacgc

SEQ ID NO: 1892910 - RNA, 23 nt, Shigella flexneri 2a str. 2457T
gaagcaacaguaauaaugcccau

SEQ ID NO: 1892911 - RNA, 18 nt, Shigella flexneri 2a str. 2457T
gacagggugagcagggca

SEQ ID NO: 1892912 - RNA, 22 nt, Shigella flexneri 2a str. 2457T
gacagggcgcgggcaacagaau

SEQ ID NO: 1892913 - RNA, 14 nt, Shigella flexneri 2a str. 2457T
gaauuacuggcaga

SEQ ID NO: 1892914 - RNA, 15 nt, Shigella flexneri 2a str. 2457T
gaauucacgccgcau

SEQ ID NO: 1892915 - RNA, 18 nt, Shigella flexneri 2a str. 2457T
gaauucacucuauaccgc

SEQ ID NO: 1892916 - RNA, 20 nt, Shigella flexneri 2a str. 2457T
gaaugguggcgaugauuucc

SEQ ID NO: 1892917 - RNA, 15 nt, Shigella flexneri 2a str. 2457T
gacauguacuuaugc

SEQ ID NO: 1892918 - RNA, 20 nt, Shigella flexneri 2a str. 2457T
gacaugcgguucacgcgcca

SEQ ID NO: 1892919 - RNA, 16 nt, Shigella flexneri 2a str. 2457T
gacauuucugcugccu

SEQ ID NO: 1892920 - RNA, 24 nt, Shigella flexneri 2a str. 2457T
gacauugugugaaaucagcacaua

SEQ ID NO: 1892921 - RNA, 17 nt, Shigella flexneri 2a str. 2457T
gacaggucagcgccugg

SEQ ID NO: 1892922 - RNA, 22 nt, Shigella flexneri 2a str. 2457T
gacaggugccggauuucauauc

SEQ ID NO: 1892923 - RNA, 21 nt, Shigella flexneri 2a str. 2457T
gacaguaugguuacugucguu

SEQ ID NO: 1892924 - RNA, 14 nt, Shigella flexneri 2a str. 2457T
aacgauaauucagc

SEQ ID NO: 1892925 - RNA, 18 nt, Shigella flexneri 2a str. 2457T
gaccaaucacacaaccau

SEQ ID NO: 1892926 - RNA, 22 nt, Shigella flexneri 2a str. 2457T
gaccaaucacacaaccaugcag

SEQ ID NO: 1892927 - RNA, 17 nt, Shigella flexneri 2a str. 2457T
gaccaauccgccagcca

SEQ ID NO: 1892928 - RNA, 15 nt, Shigella flexneri 2a str. 2457T
aacgagagucgacac

SEQ ID NO: 1892929 - RNA, 19 nt, Shigella flexneri 2a str. 2457T
aacgagaaaaugacgauga

SEQ ID NO: 1892930 - RNA, 15 nt, Shigella flexneri 2a str. 2457T
gaccaacaaaaaucu

SEQ ID NO: 1892931 - RNA, 22 nt, Shigella flexneri 2a str. 2457T
gaccaaagccuuucacuucggu

SEQ ID NO: 1892932 - RNA, 20 nt, Shigella flexneri 2a str. 2457T
aacgcagcaucaugccgcuc

SEQ ID NO: 1892933 - RNA, 15 nt, Shigella flexneri 2a str. 2457T
aacgcaagcggcauc

SEQ ID NO: 1892934 - RNA, 18 nt, Shigella flexneri 2a str. 2457T
aacgcaccgaccaucggc

SEQ ID NO: 1892935 - RNA, 20 nt, Shigella flexneri 2a str. 2457T
aacgccuuauccagccuaca

SEQ ID NO: 1892936 - RNA, 18 nt, Shigella flexneri 2a str. 2457T
aacgccuuauccggccua

SEQ ID NO: 1892937 - RNA, 20 nt, Shigella flexneri 2a str. 2457T
aacgccuuauccggccuaca

SEQ ID NO: 1892938 - RNA, 23 nt, Shigella flexneri 2a str. 2457T
aacgccugcuuaucgcccugcuc

SEQ ID NO: 1892939 - RNA, 21 nt, Shigella flexneri 2a str. 2457T
aacgccugauagcccgcacaa

SEQ ID NO: 1892940 - RNA, 24 nt, Shigella flexneri 2a str. 2457T
aacgccggugaccaucagcaugac

SEQ ID NO: 1892941 - RNA, 21 nt, Shigella flexneri 2a str. 2457T
aacgccggaaaacguuucaaa

SEQ ID NO: 1892942 - RNA, 23 nt, Shigella flexneri 2a str. 2457T
aacgccaccauuuuacguccgcg

SEQ ID NO: 1892943 - RNA, 17 nt, Shigella flexneri 2a str. 2457T
aacgcccgcuuucacca

SEQ ID NO: 1892944 - RNA, 13 nt, Shigella flexneri 2a str. 2457T
gaccaucagcagc

SEQ ID NO: 1892945 - RNA, 14 nt, Shigella flexneri 2a str. 2457T
gaccaucagcagcg

SEQ ID NO: 1892946 - RNA, 14 nt, Shigella flexneri 2a str. 2457T
gaccaguugcucca

SEQ ID NO: 1892947 - RNA, 15 nt, Shigella flexneri 2a str. 2457T
aacgcgcaaccagca

SEQ ID NO: 1892948 - RNA, 19 nt, Shigella flexneri 2a str. 2457T
aacgccuuucgcuguaaac

SEQ ID NO: 1892949 - RNA, 19 nt, Shigella flexneri 2a str. 2457T
gaccagcgucgcaucaggc

SEQ ID NO: 1892950 - RNA, 17 nt, Shigella flexneri 2a str. 2457T
gaccagcgucgcaucag

SEQ ID NO: 1892951 - RNA, 13 nt, Shigella flexneri 2a str. 2457T
gaccagcuaccac

SEQ ID NO: 1892952 - RNA, 20 nt, Shigella flexneri 2a str. 2457T
gaccuuuacggcuugcgcgc

SEQ ID NO: 1892953 - RNA, 16 nt, Shigella flexneri 2a str. 2457T
gaccugaaaccgccuu

SEQ ID NO: 1892954 - RNA, 13 nt, Shigella flexneri 2a str. 2457T
gaccgugccggac

SEQ ID NO: 1892955 - RNA, 17 nt, Shigella flexneri 2a str. 2457T
aacggcgguuucgcaaa

SEQ ID NO: 1892956 - RNA, 16 nt, Shigella flexneri 2a str. 2457T
aacgggaaacgauacc

SEQ ID NO: 1892957 - RNA, 12 nt, Shigella flexneri 2a str. 2457T
aacggucgcgga

SEQ ID NO: 1892958 - RNA, 22 nt, Shigella flexneri 2a str. 2457T
aacggucauucgacgcgcgcac

SEQ ID NO: 1892959 - RNA, 22 nt, Shigella flexneri 2a str. 2457T
aacgggcuguauacgcgccaca

SEQ ID NO: 1892960 - RNA, 15 nt, Shigella flexneri 2a str. 2457T
aacggugucgauacc

SEQ ID NO: 1892961 - RNA, 12 nt, Shigella flexneri 2a str. 2457T
aacgcuggcagg

SEQ ID NO: 1892962 - RNA, 21 nt, Shigella flexneri 2a str. 2457T
aacgcuguccggcgcacuggu

SEQ ID NO: 1892963 - RNA, 12 nt, Shigella flexneri 2a str. 2457T
aacgcuggugag

SEQ ID NO: 1892964 - RNA, 16 nt, Shigella flexneri 2a str. 2457T
gacccgagccacguca

SEQ ID NO: 1892965 - RNA, 15 nt, Shigella flexneri 2a str. 2457T
aacgcuuaaaacgcu

SEQ ID NO: 1892966 - RNA, 18 nt, Shigella flexneri 2a str. 2457T
aacgcugugcguaaucgc

SEQ ID NO: 1892967 - RNA, 17 nt, Shigella flexneri 2a str. 2457T
aacgcuuaaaacgcucg

SEQ ID NO: 1892968 - RNA, 15 nt, Shigella flexneri 2a str. 2457T
gaccgcuccgccauc

SEQ ID NO: 1892969 - RNA, 14 nt, Shigella flexneri 2a str. 2457T
gaccggacugacuc

SEQ ID NO: 1892970 - RNA, 12 nt, Shigella flexneri 2a str. 2457T
aacggcggcuug

SEQ ID NO: 1892971 - RNA, 15 nt, Shigella flexneri 2a str. 2457T
cugcuuauagcgcau

SEQ ID NO: 1892972 - RNA, 17 nt, Shigella flexneri 2a str. 2457T
cugcuuaacugcgcuuu

SEQ ID NO: 1892973 - RNA, 17 nt, Shigella flexneri 2a str. 2457T
cugcuuuaucagaucac

SEQ ID NO: 1892974 - RNA, 13 nt, Shigella flexneri 2a str. 2457T
cuggcaugaaugg

SEQ ID NO: 1892975 - RNA, 13 nt, Shigella flexneri 2a str. 2457T
cuggauugccagc

SEQ ID NO: 1892976 - RNA, 22 nt, Shigella flexneri 2a str. 2457T
cuggauuuucucuguuuccaga

SEQ ID NO: 1892977 - RNA, 20 nt, Shigella flexneri 2a str. 2457T
cuggcaguggugcggcugau

SEQ ID NO: 1892978 - RNA, 19 nt, Shigella flexneri 2a str. 2457T
aaccgcuuuagcggugaag

SEQ ID NO: 1892979 - RNA, 16 nt, Shigella flexneri 2a str. 2457T
aaccggauuuucacca

SEQ ID NO: 1892980 - RNA, 16 nt, Shigella flexneri 2a str. 2457T
cugcugcguuccggca

SEQ ID NO: 1892981 - RNA, 19 nt, Shigella flexneri 2a str. 2457T
cugcugcggaauugccggu

SEQ ID NO: 1892982 - RNA, 11 nt, Shigella flexneri 2a str. 2457T
cugcugcggcg

SEQ ID NO: 1892983 - RNA, 20 nt, Shigella flexneri 2a str. 2457T
cugcgucaccacauccagcu

SEQ ID NO: 1892984 - RNA, 21 nt, Shigella flexneri 2a str. 2457T
cugcguaugguugccgggcug

SEQ ID NO: 1892985 - RNA, 14 nt, Shigella flexneri 2a str. 2457T
cugcguuccugggg

SEQ ID NO: 1892986 - RNA, 14 nt, Shigella flexneri 2a str. 2457T
cugcuccugcggcu

SEQ ID NO: 1892987 - RNA, 17 nt, Shigella flexneri 2a str. 2457T
cugcuccauuagcccga

SEQ ID NO: 1892988 - RNA, 18 nt, Shigella flexneri 2a str. 2457T
cugcucaaucugcgcuuc

SEQ ID NO: 1892989 - RNA, 14 nt, Shigella flexneri 2a str. 2457T
cugccgcaauggcc

SEQ ID NO: 1892990 - RNA, 20 nt, Shigella flexneri 2a str. 2457T
cugaaacucgcguaaaucca

SEQ ID NO: 1892991 - RNA, 24 nt, Shigella flexneri 2a str. 2457T
cugaaacggcgauggcuucuucag

SEQ ID NO: 1892992 - RNA, 17 nt, Shigella flexneri 2a str. 2457T
cugaaauagaauggcau

SEQ ID NO: 1892993 - RNA, 21 nt, Shigella flexneri 2a str. 2457T
cugaaauagaauggcaucaga

SEQ ID NO: 1892994 - RNA, 15 nt, Shigella flexneri 2a str. 2457T
cugccggguucgcac

SEQ ID NO: 1892995 - RNA, 16 nt, Shigella flexneri 2a str. 2457T
cugccggaacgugcau

SEQ ID NO: 1892996 - RNA, 17 nt, Shigella flexneri 2a str. 2457T
cugcgacgcgcgguggu

SEQ ID NO: 1892997 - RNA, 21 nt, Shigella flexneri 2a str. 2457T
cugcgauugugacacgcgcgc

SEQ ID NO: 1892998 - RNA, 17 nt, Shigella flexneri 2a str. 2457T
cugcgauuuaacgccug

SEQ ID NO: 1892999 - RNA, 13 nt, Shigella flexneri 2a str. 2457T
cugccguugcugc

SEQ ID NO: 1893000 - RNA, 21 nt, Shigella flexneri 2a str. 2457T
cugccugcugauaagacgcau

SEQ ID NO: 1893001 - RNA, 10 nt, Shigella flexneri 2a str. 2457T
cugccugaug

SEQ ID NO: 1893002 - RNA, 17 nt, Shigella flexneri 2a str. 2457T
cugccucucuucgcugc

SEQ ID NO: 1893003 - RNA, 15 nt, Shigella flexneri 2a str. 2457T
cugcgcgaugaugcc

SEQ ID NO: 1893004 - RNA, 16 nt, Shigella flexneri 2a str. 2457T
cugcgcauuucccagc

SEQ ID NO: 1893005 - RNA, 12 nt, Shigella flexneri 2a str. 2457T
cugcgccagacg

SEQ ID NO: 1893006 - RNA, 17 nt, Shigella flexneri 2a str. 2457T
cugcggcaagaucgcga

SEQ ID NO: 1893007 - RNA, 14 nt, Shigella flexneri 2a str. 2457T
cugcggccagcagc

SEQ ID NO: 1893008 - RNA, 16 nt, Shigella flexneri 2a str. 2457T
cugcggcgcgcaucuu

SEQ ID NO: 1893009 - RNA, 13 nt, Shigella flexneri 2a str. 2457T
cugcggacgcacc

SEQ ID NO: 1893010 - RNA, 14 nt, Shigella flexneri 2a str. 2457T
cugcgcuuccugca

SEQ ID NO: 1893011 - RNA, 12 nt, Shigella flexneri 2a str. 2457T
cugcgcuuccag

SEQ ID NO: 1893012 - RNA, 19 nt, Shigella flexneri 2a str. 2457T
cugcgcuuacacacccggc

SEQ ID NO: 1893013 - RNA, 21 nt, Shigella flexneri 2a str. 2457T
cugcgcuggaacaacgcgcgu

SEQ ID NO: 1893014 - RNA, 12 nt, Shigella flexneri 2a str. 2457T
cuucuaugccag

SEQ ID NO: 1893015 - RNA, 23 nt, Shigella flexneri 2a str. 2457T
cuucugugauuccgccaguucuu

SEQ ID NO: 1893016 - RNA, 18 nt, Shigella flexneri 2a str. 2457T
cuucuucaaccgucgcgc

SEQ ID NO: 1893017 - RNA, 17 nt, Shigella flexneri 2a str. 2457T
cuugaccuuacggucag

SEQ ID NO: 1893018 - RNA, 17 nt, Shigella flexneri 2a str. 2457T
cuuccuccagcgguuua

SEQ ID NO: 1893019 - RNA, 19 nt, Shigella flexneri 2a str. 2457T
cuuccaguuugcucaaauc

SEQ ID NO: 1893020 - RNA, 21 nt, Shigella flexneri 2a str. 2457T
cuuccccgcuugggcagaaua

SEQ ID NO: 1893021 - RNA, 24 nt, Shigella flexneri 2a str. 2457T
cuucagccaccagguucaacagcg

SEQ ID NO: 1893022 - RNA, 22 nt, Shigella flexneri 2a str. 2457T
cuucagcagcagccgcgcuuuc

SEQ ID NO: 1893023 - RNA, 16 nt, Shigella flexneri 2a str. 2457T
cuucacucugcugcca

SEQ ID NO: 1893024 - RNA, 16 nt, Shigella flexneri 2a str. 2457T
cuucgccugccugcag

SEQ ID NO: 1893025 - RNA, 21 nt, Shigella flexneri 2a str. 2457T
cuucgccuuucaguucaacgg

SEQ ID NO: 1893026 - RNA, 18 nt, Shigella flexneri 2a str. 2457T
cuucgcgaacacccgacg

SEQ ID NO: 1893027 - RNA, 14 nt, Shigella flexneri 2a str. 2457T
cuugguuuugccau

SEQ ID NO: 1893028 - RNA, 21 nt, Shigella flexneri 2a str. 2457T
cuugcaccggcgacaucccag

SEQ ID NO: 1893029 - RNA, 21 nt, Shigella flexneri 2a str. 2457T
cuuaccacagacaaaauccug

SEQ ID NO: 1893030 - RNA, 13 nt, Shigella flexneri 2a str. 2457T
cuuacgcgucaga

SEQ ID NO: 1893031 - RNA, 20 nt, Shigella flexneri 2a str. 2457T
cuuacguuacccagcacgga

SEQ ID NO: 1893032 - RNA, 20 nt, Shigella flexneri 2a str. 2457T
cuuacuucagcaagcgauaa

SEQ ID NO: 1893033 - RNA, 21 nt, Shigella flexneri 2a str. 2457T
cuguugcugaaauuccaucac

SEQ ID NO: 1893034 - RNA, 13 nt, Shigella flexneri 2a str. 2457T
cuguugugaugca

SEQ ID NO: 1893035 - RNA, 13 nt, Shigella flexneri 2a str. 2457T
cuuauccagcaga

SEQ ID NO: 1893036 - RNA, 17 nt, Shigella flexneri 2a str. 2457T
cuuaucaugccuacaua

SEQ ID NO: 1893037 - RNA, 14 nt, Shigella flexneri 2a str. 2457T
cuuaucaggccugu

SEQ ID NO: 1893038 - RNA, 11 nt, Shigella flexneri 2a str. 2457T
cuuaucaggcc

SEQ ID NO: 1893039 - RNA, 18 nt, Shigella flexneri 2a str. 2457T
cuuaucgauaaacggcac

SEQ ID NO: 1893040 - RNA, 18 nt, Shigella flexneri 2a str. 2457T
cuuauaaagaaaaucuga

SEQ ID NO: 1893041 - RNA, 20 nt, Shigella flexneri 2a str. 2457T
cuuauacggcuggauuucgc

SEQ ID NO: 1893042 - RNA, 17 nt, Shigella flexneri 2a str. 2457T
cuuauagcgcaucgcag

SEQ ID NO: 1893043 - RNA, 15 nt, Shigella flexneri 2a str. 2457T
cuucaccuuccagua

SEQ ID NO: 1893044 - RNA, 16 nt, Shigella flexneri 2a str. 2457T
cuucacccaucgccag

SEQ ID NO: 1893045 - RNA, 15 nt, Shigella flexneri 2a str. 2457T
cuucaccgcaucguc

SEQ ID NO: 1893046 - RNA, 21 nt, Shigella flexneri 2a str. 2457T
cuguccugagugggcgucagc

SEQ ID NO: 1893047 - RNA, 19 nt, Shigella flexneri 2a str. 2457T
cuguacaaagccgguuuca

SEQ ID NO: 1893048 - RNA, 12 nt, Shigella flexneri 2a str. 2457T
cuguaauugccg

SEQ ID NO: 1893049 - RNA, 14 nt, Shigella flexneri 2a str. 2457T
cugguuugccacgu

SEQ ID NO: 1893050 - RNA, 16 nt, Shigella flexneri 2a str. 2457T
cuguugaaaagccgga

SEQ ID NO: 1893051 - RNA, 19 nt, Shigella flexneri 2a str. 2457T
cugugacagcagcggcaga

SEQ ID NO: 1893052 - RNA, 22 nt, Shigella flexneri 2a str. 2457T
cuguucauccucuucugccugc

SEQ ID NO: 1893053 - RNA, 18 nt, Shigella flexneri 2a str. 2457T
cugucguccggcagcaga

SEQ ID NO: 1893054 - RNA, 13 nt, Shigella flexneri 2a str. 2457T
cugucuuaacgca

SEQ ID NO: 1893055 - RNA, 14 nt, Shigella flexneri 2a str. 2457T
cugugacagcagcg

SEQ ID NO: 1893056 - RNA, 15 nt, Shigella flexneri 2a str. 2457T
cuggguuucgccugc

SEQ ID NO: 1893057 - RNA, 18 nt, Shigella flexneri 2a str. 2457T
cugguacucgacuguggc

SEQ ID NO: 1893058 - RNA, 22 nt, Shigella flexneri 2a str. 2457T
cuggccguuguugaacggcaaa

SEQ ID NO: 1893059 - RNA, 16 nt, Shigella flexneri 2a str. 2457T
cugggccgccauccgg

SEQ ID NO: 1893060 - RNA, 14 nt, Shigella flexneri 2a str. 2457T
cuggugaccuggga

SEQ ID NO: 1893061 - RNA, 23 nt, Shigella flexneri 2a str. 2457T
cuggugauuucguccagcgaacc

SEQ ID NO: 1893062 - RNA, 13 nt, Shigella flexneri 2a str. 2457T
cuggugauugccg

SEQ ID NO: 1893063 - RNA, 21 nt, Shigella flexneri 2a str. 2457T
cugguaguccaggaugugcgu

SEQ ID NO: 1893064 - RNA, 17 nt, Shigella flexneri 2a str. 2457T
cugguagcuguagguaa

SEQ ID NO: 1893065 - RNA, 17 nt, Shigella flexneri 2a str. 2457T
cugguggacaauacgcg

SEQ ID NO: 1893066 - RNA, 23 nt, Shigella flexneri 2a str. 2457T
cugguucugcggguuagucugca

SEQ ID NO: 1893067 - RNA, 17 nt, Shigella flexneri 2a str. 2457T
cgucgcuucucaagcuc

SEQ ID NO: 1893068 - RNA, 22 nt, Shigella flexneri 2a str. 2457T
cgucgauaaucguuggcagacg

SEQ ID NO: 1893069 - RNA, 15 nt, Shigella flexneri 2a str. 2457T
cgucguaguaguuca

SEQ ID NO: 1893070 - RNA, 19 nt, Shigella flexneri 2a str. 2457T
cguccagaugcgagauguc

SEQ ID NO: 1893071 - RNA, 23 nt, Shigella flexneri 2a str. 2457T
cguccauccacaggguguauuca

SEQ ID NO: 1893072 - RNA, 22 nt, Shigella flexneri 2a str. 2457T
cgucaguuuuucacccgcaauc

SEQ ID NO: 1893073 - RNA, 14 nt, Shigella flexneri 2a str. 2457T
cgucaucaaacggc

SEQ ID NO: 1893074 - RNA, 22 nt, Shigella flexneri 2a str. 2457T
cgucauauagccgcgcaguuuc

SEQ ID NO: 1893075 - RNA, 22 nt, Shigella flexneri 2a str. 2457T
cguccuucaucuucauccggcu

SEQ ID NO: 1893076 - RNA, 15 nt, Shigella flexneri 2a str. 2457T
cguccugcuugccag

SEQ ID NO: 1893077 - RNA, 15 nt, Shigella flexneri 2a str. 2457T
cgucgaaauuauuca

SEQ ID NO: 1893078 - RNA, 14 nt, Shigella flexneri 2a str. 2457T
cgucagauccgcca

SEQ ID NO: 1893079 - RNA, 15 nt, Shigella flexneri 2a str. 2457T
cgucacaggcacacc

SEQ ID NO: 1893080 - RNA, 16 nt, Shigella flexneri 2a str. 2457T
cgucacggacucggcg

SEQ ID NO: 1893081 - RNA, 23 nt, Shigella flexneri 2a str. 2457T
cgucagcguuccacgugcggccg

SEQ ID NO: 1893082 - RNA, 13 nt, Shigella flexneri 2a str. 2457T
cgucagcuuucag

SEQ ID NO: 1893083 - RNA, 16 nt, Shigella flexneri 2a str. 2457T
cgucagucccaacuga

SEQ ID NO: 1893084 - RNA, 14 nt, Shigella flexneri 2a str. 2457T
cgucaguucacgcg

SEQ ID NO: 1893085 - RNA, 18 nt, Shigella flexneri 2a str. 2457T
cgucaggcgcgugaaugc

SEQ ID NO: 1893086 - RNA, 13 nt, Shigella flexneri 2a str. 2457T
cguauaacacgcc

SEQ ID NO: 1893087 - RNA, 22 nt, Shigella flexneri 2a str. 2457T
cguauucaacgaaggccugcau

SEQ ID NO: 1893088 - RNA, 14 nt, Shigella flexneri 2a str. 2457T
cgucaacagggcag

SEQ ID NO: 1893089 - RNA, 18 nt, Shigella flexneri 2a str. 2457T
cguaaggcuucaaucaau

SEQ ID NO: 1893090 - RNA, 23 nt, Shigella flexneri 2a str. 2457T
cguaauggaugcccgcgggcgaa

SEQ ID NO: 1893091 - RNA, 16 nt, Shigella flexneri 2a str. 2457T
cguaaucagcaucuca

SEQ ID NO: 1893092 - RNA, 20 nt, Shigella flexneri 2a str. 2457T
cguaggcuggauaaggcguu

SEQ ID NO: 1893093 - RNA, 15 nt, Shigella flexneri 2a str. 2457T
cgguucagcgucggc

SEQ ID NO: 1893094 - RNA, 23 nt, Shigella flexneri 2a str. 2457T
cgguuaaaucgacguucugccaa

SEQ ID NO: 1893095 - RNA, 20 nt, Shigella flexneri 2a str. 2457T
cgguuucaaauuacgaucca

SEQ ID NO: 1893096 - RNA, 13 nt, Shigella flexneri 2a str. 2457T
cgguuucaucaca

SEQ ID NO: 1893097 - RNA, 13 nt, Shigella flexneri 2a str. 2457T
cguaaaucaaacc

SEQ ID NO: 1893098 - RNA, 18 nt, Shigella flexneri 2a str. 2457T
cguaaauaccuuccggcg

SEQ ID NO: 1893099 - RNA, 22 nt, Shigella flexneri 2a str. 2457T
cguaaacgccuuauccggccua

SEQ ID NO: 1893100 - RNA, 11 nt, Shigella flexneri 2a str. 2457T
cgguuuaaccg

SEQ ID NO: 1893101 - RNA, 15 nt, Shigella flexneri 2a str. 2457T
cgguugggccaccga

SEQ ID NO: 1893102 - RNA, 17 nt, Shigella flexneri 2a str. 2457T
cgguuggccugccggau

SEQ ID NO: 1893103 - RNA, 16 nt, Shigella flexneri 2a str. 2457T
cgguugcggcuuacca

SEQ ID NO: 1893104 - RNA, 12 nt, Shigella flexneri 2a str. 2457T
cggugucgccag

SEQ ID NO: 1893105 - RNA, 17 nt, Shigella flexneri 2a str. 2457T
cgguggccuugccguug

SEQ ID NO: 1893106 - RNA, 15 nt, Shigella flexneri 2a str. 2457T
cggugguauuaccgc

SEQ ID NO: 1893107 - RNA, 19 nt, Shigella flexneri 2a str. 2457T
cggugcuccagugcgcuuu

SEQ ID NO: 1893108 - RNA, 15 nt, Shigella flexneri 2a str. 2457T
cggugcgcagccgcg

SEQ ID NO: 1893109 - RNA, 22 nt, Shigella flexneri 2a str. 2457T
cggugcgggaguugaucgccaa

SEQ ID NO: 1893110 - RNA, 18 nt, Shigella flexneri 2a str. 2457T
cggugcgguaaucgcccg

SEQ ID NO: 1893111 - RNA, 18 nt, Shigella flexneri 2a str. 2457T
cggugccaucgauaauca

SEQ ID NO: 1893112 - RNA, 14 nt, Shigella flexneri 2a str. 2457T
cggugauacagcaa

SEQ ID NO: 1893113 - RNA, 17 nt, Shigella flexneri 2a str. 2457T
cggugaccgaucgcccg

SEQ ID NO: 1893114 - RNA, 14 nt, Shigella flexneri 2a str. 2457T
cggugagcugcauc

SEQ ID NO: 1893115 - RNA, 14 nt, Shigella flexneri 2a str. 2457T
cggucugcucaaac

SEQ ID NO: 1893116 - RNA, 15 nt, Shigella flexneri 2a str. 2457T
cggugacagcgagcg

SEQ ID NO: 1893117 - RNA, 17 nt, Shigella flexneri 2a str. 2457T
cggucgcugacgccaug

SEQ ID NO: 1893118 - RNA, 17 nt, Shigella flexneri 2a str. 2457T
cguuugccaccugugca

SEQ ID NO: 1893119 - RNA, 16 nt, Shigella flexneri 2a str. 2457T
cguuugcaggccugau

SEQ ID NO: 1893120 - RNA, 18 nt, Shigella flexneri 2a str. 2457T
cguuugccuuucggcgca

SEQ ID NO: 1893121 - RNA, 16 nt, Shigella flexneri 2a str. 2457T
cguuuguugcgcuaag

SEQ ID NO: 1893122 - RNA, 17 nt, Shigella flexneri 2a str. 2457T
cguuuguaggccggaua

SEQ ID NO: 1893123 - RNA, 23 nt, Shigella flexneri 2a str. 2457T
cguuuggggcauauuaucagcaa

SEQ ID NO: 1893124 - RNA, 21 nt, Shigella flexneri 2a str. 2457T
cguuuucaguugcucugcagc

SEQ ID NO: 1893125 - RNA, 21 nt, Shigella flexneri 2a str. 2457T
cguuuucgccacaucagguaa

SEQ ID NO: 1893126 - RNA, 17 nt, Shigella flexneri 2a str. 2457T
cguuuuucgcugucggu

SEQ ID NO: 1893127 - RNA, 17 nt, Shigella flexneri 2a str. 2457T
cguuuuuuaugccggau

SEQ ID NO: 1893128 - RNA, 19 nt, Shigella flexneri 2a str. 2457T
cuaacguuuuacgcgucac

SEQ ID NO: 1893129 - RNA, 16 nt, Shigella flexneri 2a str. 2457T
cuaacaaggcuucgcu

SEQ ID NO: 1893130 - RNA, 16 nt, Shigella flexneri 2a str. 2457T
cuaaauguagcgaacu

SEQ ID NO: 1893131 - RNA, 14 nt, Shigella flexneri 2a str. 2457T
cguuggucaucacu

SEQ ID NO: 1893132 - RNA, 18 nt, Shigella flexneri 2a str. 2457T
cguuuaaaccaggcgaga

SEQ ID NO: 1893133 - RNA, 23 nt, Shigella flexneri 2a str. 2457T
cguuguuccuuccagcuggcuac

SEQ ID NO: 1893134 - RNA, 14 nt, Shigella flexneri 2a str. 2457T
cguuuaccgccauc

SEQ ID NO: 1893135 - RNA, 15 nt, Shigella flexneri 2a str. 2457T
cguuuacgccgcauc

SEQ ID NO: 1893136 - RNA, 22 nt, Shigella flexneri 2a str. 2457T
cguuuacgccgcauccggcaau

SEQ ID NO: 1893137 - RNA, 23 nt, Shigella flexneri 2a str. 2457T
cuacuuuguaaacgaagcgccau

SEQ ID NO: 1893138 - RNA, 21 nt, Shigella flexneri 2a str. 2457T
cuacuuuuuuaagauccaguu

SEQ ID NO: 1893139 - RNA, 14 nt, Shigella flexneri 2a str. 2457T
cuaccguguucagc

SEQ ID NO: 1893140 - RNA, 18 nt, Shigella flexneri 2a str. 2457T
cuacgcuuaucaggccua

SEQ ID NO: 1893141 - RNA, 13 nt, Shigella flexneri 2a str. 2457T
cuacgcuuaucag

SEQ ID NO: 1893142 - RNA, 13 nt, Shigella flexneri 2a str. 2457T
cuaccuuucagug

SEQ ID NO: 1893143 - RNA, 21 nt, Shigella flexneri 2a str. 2457T
cuaaugcuuuuuccugcguca

SEQ ID NO: 1893144 - RNA, 16 nt, Shigella flexneri 2a str. 2457T
cuaaugauugccggac

SEQ ID NO: 1893145 - RNA, 20 nt, Shigella flexneri 2a str. 2457T
cuaagccgugcauaacggag

SEQ ID NO: 1893146 - RNA, 13 nt, Shigella flexneri 2a str. 2457T
cuaagccaguuca

SEQ ID NO: 1893147 - RNA, 16 nt, Shigella flexneri 2a str. 2457T
cuaccagcgccaccgg

SEQ ID NO: 1893148 - RNA, 16 nt, Shigella flexneri 2a str. 2457T
cuaccacguaacgacu

SEQ ID NO: 1893149 - RNA, 15 nt, Shigella flexneri 2a str. 2457T
cuacaaaaaugcccg

SEQ ID NO: 1893150 - RNA, 15 nt, Shigella flexneri 2a str. 2457T
cuacaccaugccggu

SEQ ID NO: 1893151 - RNA, 23 nt, Shigella flexneri 2a str. 2457T
cuacacgcuaccaaaaaaucaau

SEQ ID NO: 1893152 - RNA, 16 nt, Shigella flexneri 2a str. 2457T
cuacacauacuuauua

SEQ ID NO: 1893153 - RNA, 23 nt, Shigella flexneri 2a str. 2457T
cuacagcgcccgccagcaccgga

SEQ ID NO: 1893154 - RNA, 18 nt, Shigella flexneri 2a str. 2457T
cuaauuuuuccagcauuu

SEQ ID NO: 1893155 - RNA, 20 nt, Shigella flexneri 2a str. 2457T
cuacaauauccucaagcguu

SEQ ID NO: 1893156 - RNA, 13 nt, Shigella flexneri 2a str. 2457T
cuacaagcagaga

SEQ ID NO: 1893157 - RNA, 15 nt, Shigella flexneri 2a str. 2457T
cgucuccaucaauac

SEQ ID NO: 1893158 - RNA, 17 nt, Shigella flexneri 2a str. 2457T
cguggauuuaaugccaa

SEQ ID NO: 1893159 - RNA, 22 nt, Shigella flexneri 2a str. 2457T
cguggaucaagccccagcagga

SEQ ID NO: 1893160 - RNA, 17 nt, Shigella flexneri 2a str. 2457T
cgugcuguacagcagua

SEQ ID NO: 1893161 - RNA, 22 nt, Shigella flexneri 2a str. 2457T
cguuaccguaccaaccgcaauu

SEQ ID NO: 1893162 - RNA, 21 nt, Shigella flexneri 2a str. 2457T
cguuacccacaguuucauauc

SEQ ID NO: 1893163 - RNA, 15 nt, Shigella flexneri 2a str. 2457T
cguuaccccuucauc

SEQ ID NO: 1893164 - RNA, 18 nt, Shigella flexneri 2a str. 2457T
cguuagucgucgccgaua

SEQ ID NO: 1893165 - RNA, 19 nt, Shigella flexneri 2a str. 2457T
cguuaguguggccaguucc

SEQ ID NO: 1893166 - RNA, 19 nt, Shigella flexneri 2a str. 2457T
cguuauacaucgcuuucca

SEQ ID NO: 1893167 - RNA, 17 nt, Shigella flexneri 2a str. 2457T
cguuccuggcuugccag

SEQ ID NO: 1893168 - RNA, 23 nt, Shigella flexneri 2a str. 2457T
cguucauuaacgccccaaucaga

SEQ ID NO: 1893169 - RNA, 22 nt, Shigella flexneri 2a str. 2457T
cguucauggcgcgacauggcga

SEQ ID NO: 1893170 - RNA, 21 nt, Shigella flexneri 2a str. 2457T
cguuccacccacggcguuaac

SEQ ID NO: 1893171 - RNA, 13 nt, Shigella flexneri 2a str. 2457T
cguuccaggcgau

SEQ ID NO: 1893172 - RNA, 16 nt, Shigella flexneri 2a str. 2457T
cguugcccaucgccac

SEQ ID NO: 1893173 - RNA, 20 nt, Shigella flexneri 2a str. 2457T
cguugcggcugcccaucauc

SEQ ID NO: 1893174 - RNA, 20 nt, Shigella flexneri 2a str. 2457T
cguucugaucuuucuucagc

SEQ ID NO: 1893175 - RNA, 15 nt, Shigella flexneri 2a str. 2457T
cguucugccaaacgc

SEQ ID NO: 1893176 - RNA, 21 nt, Shigella flexneri 2a str. 2457T
cguugcauaaaugccgcaaug

SEQ ID NO: 1893177 - RNA, 17 nt, Shigella flexneri 2a str. 2457T
cguugaucggcuggcga

SEQ ID NO: 1893178 - RNA, 14 nt, Shigella flexneri 2a str. 2457T
cuccagcgccgcca

SEQ ID NO: 1893179 - RNA, 16 nt, Shigella flexneri 2a str. 2457T
cucccccagcaucuau

SEQ ID NO: 1893180 - RNA, 16 nt, Shigella flexneri 2a str. 2457T
cuccagcagugccgca

SEQ ID NO: 1893181 - RNA, 15 nt, Shigella flexneri 2a str. 2457T
cuccagcaacucaau

SEQ ID NO: 1893182 - RNA, 19 nt, Shigella flexneri 2a str. 2457T
cucccuggcccaucgccag

SEQ ID NO: 1893183 - RNA, 13 nt, Shigella flexneri 2a str. 2457T
cucaucagcgucg

SEQ ID NO: 1893184 - RNA, 16 nt, Shigella flexneri 2a str. 2457T
cucagugguugucgca

SEQ ID NO: 1893185 - RNA, 21 nt, Shigella flexneri 2a str. 2457T
cucaucgacggcuacgcucau

SEQ ID NO: 1893186 - RNA, 15 nt, Shigella flexneri 2a str. 2457T
cucaucggguaacgg

SEQ ID NO: 1893187 - RNA, 18 nt, Shigella flexneri 2a str. 2457T
cucaucuuccaccacguc

SEQ ID NO: 1893188 - RNA, 13 nt, Shigella flexneri 2a str. 2457T
cucgaugccgccc

SEQ ID NO: 1893189 - RNA, 11 nt, Shigella flexneri 2a str. 2457T
cuccguucccc

SEQ ID NO: 1893190 - RNA, 11 nt, Shigella flexneri 2a str. 2457T
cuccgccagca

SEQ ID NO: 1893191 - RNA, 12 nt, Shigella flexneri 2a str. 2457T
cuccgccagcaa

SEQ ID NO: 1893192 - RNA, 23 nt, Shigella flexneri 2a str. 2457T
cucgcguuacuaccggcgugcgu

SEQ ID NO: 1893193 - RNA, 14 nt, Shigella flexneri 2a str. 2457T
cucgcugccagcac

SEQ ID NO: 1893194 - RNA, 15 nt, Shigella flexneri 2a str. 2457T
cucgcgagaacggcg

SEQ ID NO: 1893195 - RNA, 15 nt, Shigella flexneri 2a str. 2457T
cucgcccagcagacg

SEQ ID NO: 1893196 - RNA, 14 nt, Shigella flexneri 2a str. 2457T
cucgccauccagug

SEQ ID NO: 1893197 - RNA, 19 nt, Shigella flexneri 2a str. 2457T
cucgccagcgauucccguu

SEQ ID NO: 1893198 - RNA, 23 nt, Shigella flexneri 2a str. 2457T
cucggugaacgccugcgacgugg

SEQ ID NO: 1893199 - RNA, 18 nt, Shigella flexneri 2a str. 2457T
cucgguaaaaucaacgcc

SEQ ID NO: 1893200 - RNA, 13 nt, Shigella flexneri 2a str. 2457T
cucugaaucgcua

SEQ ID NO: 1893201 - RNA, 14 nt, Shigella flexneri 2a str. 2457T
cucugauugccuuc

SEQ ID NO: 1893202 - RNA, 14 nt, Shigella flexneri 2a str. 2457T
cucuuccggcgucg

SEQ ID NO: 1893203 - RNA, 14 nt, Shigella flexneri 2a str. 2457T
cucuucgccugccu

SEQ ID NO: 1893204 - RNA, 17 nt, Shigella flexneri 2a str. 2457T
cucuucgcgugugccgg

SEQ ID NO: 1893205 - RNA, 23 nt, Shigella flexneri 2a str. 2457T
cucgucguuguucuacgugcgcu

SEQ ID NO: 1893206 - RNA, 19 nt, Shigella flexneri 2a str. 2457T
cucguuaccccuucaucca

SEQ ID NO: 1893207 - RNA, 15 nt, Shigella flexneri 2a str. 2457T
cucgugggauugccg

SEQ ID NO: 1893208 - RNA, 12 nt, Shigella flexneri 2a str. 2457T
cucgucgguggu

SEQ ID NO: 1893209 - RNA, 22 nt, Shigella flexneri 2a str. 2457T
uuuuucaacauauccuucacac

SEQ ID NO: 1893210 - RNA, 12 nt, Shigella flexneri 2a str. 2457T
uuuuuccguuuu

SEQ ID NO: 1893211 - RNA, 23 nt, Shigella flexneri 2a str. 2457T
uuuuaagauccaguugaccugcg

SEQ ID NO: 1893212 - RNA, 20 nt, Shigella flexneri 2a str. 2457T
uuuugcuugcgauagcgcac

SEQ ID NO: 1893213 - RNA, 21 nt, Shigella flexneri 2a str. 2457T
uuucugaaggauuagccggau

SEQ ID NO: 1893214 - RNA, 18 nt, Shigella flexneri 2a str. 2457T
uuucugaauuucagcgcc

SEQ ID NO: 1893215 - RNA, 14 nt, Shigella flexneri 2a str. 2457T
uuucuuccagcgcc

SEQ ID NO: 1893216 - RNA, 22 nt, Shigella flexneri 2a str. 2457T
uuucugggaugaucaccugcau

SEQ ID NO: 1893217 - RNA, 14 nt, Shigella flexneri 2a str. 2457T
uuuccccaacgaug

SEQ ID NO: 1893218 - RNA, 22 nt, Shigella flexneri 2a str. 2457T
uuuccagccgagccgacgguuu

SEQ ID NO: 1893219 - RNA, 14 nt, Shigella flexneri 2a str. 2457T
uuuccagcaguucc

SEQ ID NO: 1893220 - RNA, 21 nt, Shigella flexneri 2a str. 2457T
uuuccagacugaugugaucca

SEQ ID NO: 1893221 - RNA, 14 nt, Shigella flexneri 2a str. 2457T
uuucagccaucauc

SEQ ID NO: 1893222 - RNA, 19 nt, Shigella flexneri 2a str. 2457T
uuuccgcgcaaucgcccag

SEQ ID NO: 1893223 - RNA, 14 nt, Shigella flexneri 2a str. 2457T
uuucuuuugccaga

SEQ ID NO: 1893224 - RNA, 22 nt, Shigella flexneri 2a str. 2457T
uuugcgcguaacgaucgccugg

SEQ ID NO: 1893225 - RNA, 14 nt, Shigella flexneri 2a str. 2457T
uuugauugccggau

SEQ ID NO: 1893226 - RNA, 19 nt, Shigella flexneri 2a str. 2457T
uucuuugcugccguuaacc

SEQ ID NO: 1893227 - RNA, 21 nt, Shigella flexneri 2a str. 2457T
uuggcgcauaacucaccauca

SEQ ID NO: 1893228 - RNA, 20 nt, Shigella flexneri 2a str. 2457T
uuguaggccggauaaggcgc

SEQ ID NO: 1893229 - RNA, 20 nt, Shigella flexneri 2a str. 2457T
uuguaggcuggauaaggcgu

SEQ ID NO: 1893230 - RNA, 19 nt, Shigella flexneri 2a str. 2457T
uuguaggucugauagcgua

SEQ ID NO: 1893231 - RNA, 20 nt, Shigella flexneri 2a str. 2457T
uuguaggccggauaaggcgu

SEQ ID NO: 1893232 - RNA, 20 nt, Shigella flexneri 2a str. 2457T
uuguaggccagauaagacgu

SEQ ID NO: 1893233 - RNA, 18 nt, Shigella flexneri 2a str. 2457T
uugucggcgugaacgcgc

SEQ ID NO: 1893234 - RNA, 20 nt, Shigella flexneri 2a str. 2457T
uuggcuauauaaagcaucaa

SEQ ID NO: 1893235 - RNA, 14 nt, Shigella flexneri 2a str. 2457T
uugggaucgccagg

SEQ ID NO: 1893236 - RNA, 14 nt, Shigella flexneri 2a str. 2457T
uuuacuuuuuaacu

SEQ ID NO: 1893237 - RNA, 17 nt, Shigella flexneri 2a str. 2457T
uuuaugccggaugcgga

SEQ ID NO: 1893238 - RNA, 15 nt, Shigella flexneri 2a str. 2457T
uuucagcagcggcac

SEQ ID NO: 1893239 - RNA, 14 nt, Shigella flexneri 2a str. 2457T
uuucacuucugagu

SEQ ID NO: 1893240 - RNA, 18 nt, Shigella flexneri 2a str. 2457T
uuucacugugcuuuacau

SEQ ID NO: 1893241 - RNA, 21 nt, Shigella flexneri 2a str. 2457T
uuucacgcaauaccuggcgca

SEQ ID NO: 1893242 - RNA, 23 nt, Shigella flexneri 2a str. 2457T
uuucaccugcugauuauccgcau

SEQ ID NO: 1893243 - RNA, 16 nt, Shigella flexneri 2a str. 2457T
uuguuaugagauaauu

SEQ ID NO: 1893244 - RNA, 12 nt, Shigella flexneri 2a str. 2457T
uuuacgucugca

SEQ ID NO: 1893245 - RNA, 24 nt, Shigella flexneri 2a str. 2457T
uuuacuauuauuuuucauauggau

SEQ ID NO: 1893246 - RNA, 14 nt, Shigella flexneri 2a str. 2457T
uuuacgggccggau

SEQ ID NO: 1893247 - RNA, 19 nt, Shigella flexneri 2a str. 2457T
uuuacgccgcauccggcau

SEQ ID NO: 1893248 - RNA, 19 nt, Shigella flexneri 2a str. 2457T
uuuacgccgcauccggcaa

SEQ ID NO: 1893249 - RNA, 17 nt, Shigella flexneri 2a str. 2457T
uuuacgaagaaagcaau

SEQ ID NO: 1893250 - RNA, 22 nt, Shigella flexneri 2a str. 2457T
uucgaaccacaaaagacgauag

SEQ ID NO: 1893251 - RNA, 13 nt, Shigella flexneri 2a str. 2457T
uucgacaccaucu

SEQ ID NO: 1893252 - RNA, 22 nt, Shigella flexneri 2a str. 2457T
uucgacagaaaccugauuacgc

SEQ ID NO: 1893253 - RNA, 15 nt, Shigella flexneri 2a str. 2457T
uucgaguacauccac

SEQ ID NO: 1893254 - RNA, 20 nt, Shigella flexneri 2a str. 2457T
uuccuguagcguuaccagca

SEQ ID NO: 1893255 - RNA, 14 nt, Shigella flexneri 2a str. 2457T
uuccugcgucgcua

SEQ ID NO: 1893256 - RNA, 12 nt, Shigella flexneri 2a str. 2457T
uuccugacuccu

SEQ ID NO: 1893257 - RNA, 17 nt, Shigella flexneri 2a str. 2457T
uucccccuuugaccagc

SEQ ID NO: 1893258 - RNA, 18 nt, Shigella flexneri 2a str. 2457T
uucggcaaguguuggcga

SEQ ID NO: 1893259 - RNA, 19 nt, Shigella flexneri 2a str. 2457T
uucggcaaccgcauccaga

SEQ ID NO: 1893260 - RNA, 19 nt, Shigella flexneri 2a str. 2457T
uucggcagaaaauccacca

SEQ ID NO: 1893261 - RNA, 14 nt, Shigella flexneri 2a str. 2457T
uucgcuuucggugc

SEQ ID NO: 1893262 - RNA, 17 nt, Shigella flexneri 2a str. 2457T
uucgcuuuaucgccuac

SEQ ID NO: 1893263 - RNA, 18 nt, Shigella flexneri 2a str. 2457T
uucgcuggaauaaucgua

SEQ ID NO: 1893264 - RNA, 19 nt, Shigella flexneri 2a str. 2457T
uucgcguaacugaagcauu

SEQ ID NO: 1893265 - RNA, 19 nt, Shigella flexneri 2a str. 2457T
uucgccugcguacuggcau

SEQ ID NO: 1893266 - RNA, 14 nt, Shigella flexneri 2a str. 2457T
uucgcccgucguga

SEQ ID NO: 1893267 - RNA, 20 nt, Shigella flexneri 2a str. 2457T
uucgcccuggacaacauucc

SEQ ID NO: 1893268 - RNA, 12 nt, Shigella flexneri 2a str. 2457T
uucgcccuucgg

SEQ ID NO: 1893269 - RNA, 14 nt, Shigella flexneri 2a str. 2457T
uucgcaucggugau

SEQ ID NO: 1893270 - RNA, 16 nt, Shigella flexneri 2a str. 2457T
uucgguaagcaaagcg

SEQ ID NO: 1893271 - RNA, 16 nt, Shigella flexneri 2a str. 2457T
uucgguaaugacucca

SEQ ID NO: 1893272 - RNA, 18 nt, Shigella flexneri 2a str. 2457T
uucggugauauacgucac

SEQ ID NO: 1893273 - RNA, 13 nt, Shigella flexneri 2a str. 2457T
uucggcaucagca

SEQ ID NO: 1893274 - RNA, 17 nt, Shigella flexneri 2a str. 2457T
uucgugauuguuggcga

SEQ ID NO: 1893275 - RNA, 22 nt, Shigella flexneri 2a str. 2457T
uucgucaccugguagcggguga

SEQ ID NO: 1893276 - RNA, 14 nt, Shigella flexneri 2a str. 2457T
uucuguugcugaaa

SEQ ID NO: 1893277 - RNA, 19 nt, Shigella flexneri 2a str. 2457T
uucugugcaaucgccgcug

SEQ ID NO: 1893278 - RNA, 12 nt, Shigella flexneri 2a str. 2457T
uucugguaacag

SEQ ID NO: 1893279 - RNA, 19 nt, Shigella flexneri 2a str. 2457T
uucuggucgagaucgccaa

SEQ ID NO: 1893280 - RNA, 23 nt, Shigella flexneri 2a str. 2457T
uucuuaccggucccuucaaucuc

SEQ ID NO: 1893281 - RNA, 24 nt, Shigella flexneri 2a str. 2457T
uucuuacuucaacacauaaccgua

SEQ ID NO: 1893282 - RNA, 21 nt, Shigella flexneri 2a str. 2457T
uucuucaauuuccgucgcaug

SEQ ID NO: 1893283 - RNA, 18 nt, Shigella flexneri 2a str. 2457T
uucucgcccagcagacgu

SEQ ID NO: 1893284 - RNA, 15 nt, Shigella flexneri 2a str. 2457T
uucuccugaaguagc

SEQ ID NO: 1893285 - RNA, 13 nt, Shigella flexneri 2a str. 2457T
uucugauccugca

SEQ ID NO: 1893286 - RNA, 13 nt, Shigella flexneri 2a str. 2457T
uucugcgacguga

SEQ ID NO: 1893287 - RNA, 15 nt, Shigella flexneri 2a str. 2457T
uucugcacgcuugcc

SEQ ID NO: 1893288 - RNA, 21 nt, Shigella flexneri 2a str. 2457T
uucugccacgccacgcugccg

SEQ ID NO: 1893289 - RNA, 15 nt, Shigella flexneri 2a str. 2457T
uuaauucuuugagca

SEQ ID NO: 1893290 - RNA, 19 nt, Shigella flexneri 2a str. 2457T
uuaccuagcacuguaaacc

SEQ ID NO: 1893291 - RNA, 19 nt, Shigella flexneri 2a str. 2457T
uuaccggucccuucaaucu

SEQ ID NO: 1893292 - RNA, 16 nt, Shigella flexneri 2a str. 2457T
uuacgguuacgcaucu

SEQ ID NO: 1893293 - RNA, 19 nt, Shigella flexneri 2a str. 2457T
uuacuacccuguccgccau

SEQ ID NO: 1893294 - RNA, 22 nt, Shigella flexneri 2a str. 2457T
uuacgacucaaccccagccauu

SEQ ID NO: 1893295 - RNA, 13 nt, Shigella flexneri 2a str. 2457T
uuacgccaccgca

SEQ ID NO: 1893296 - RNA, 21 nt, Shigella flexneri 2a str. 2457T
uuacgaccuacaaucaauggu

SEQ ID NO: 1893297 - RNA, 19 nt, Shigella flexneri 2a str. 2457T
uuacgccgcauccggcaua

SEQ ID NO: 1893298 - RNA, 18 nt, Shigella flexneri 2a str. 2457T
uuauccacgaaacggcgu

SEQ ID NO: 1893299 - RNA, 12 nt, Shigella flexneri 2a str. 2457T
uuaucccauccc

SEQ ID NO: 1893300 - RNA, 17 nt, Shigella flexneri 2a str. 2457T
uuaucccaggcguuaau

SEQ ID NO: 1893301 - RNA, 13 nt, Shigella flexneri 2a str. 2457T
uuaguucaaugcg

SEQ ID NO: 1893302 - RNA, 16 nt, Shigella flexneri 2a str. 2457T
uuauaacggugcugca

SEQ ID NO: 1893303 - RNA, 14 nt, Shigella flexneri 2a str. 2457T
uuagcaugcuggcu

SEQ ID NO: 1893304 - RNA, 16 nt, Shigella flexneri 2a str. 2457T
uuacugagaacgcaau

SEQ ID NO: 1893305 - RNA, 22 nt, Shigella flexneri 2a str. 2457T
uuacugaggccggaugucgcug

SEQ ID NO: 1893306 - RNA, 22 nt, Shigella flexneri 2a str. 2457T
uuagcgucaaggggucaaugcc

SEQ ID NO: 1893307 - RNA, 16 nt, Shigella flexneri 2a str. 2457T
uuaaaaacccugcaga

SEQ ID NO: 1893308 - RNA, 18 nt, Shigella flexneri 2a str. 2457T
uguuuagguugaacccuu

SEQ ID NO: 1893309 - RNA, 20 nt, Shigella flexneri 2a str. 2457T
uguuuauaacuucccgcauc

SEQ ID NO: 1893310 - RNA, 16 nt, Shigella flexneri 2a str. 2457T
uguuguagaccggaaa

SEQ ID NO: 1893311 - RNA, 12 nt, Shigella flexneri 2a str. 2457T
uguuggugccag

SEQ ID NO: 1893312 - RNA, 14 nt, Shigella flexneri 2a str. 2457T
uguuggugccagau

SEQ ID NO: 1893313 - RNA, 21 nt, Shigella flexneri 2a str. 2457T
uuaaaucccgcuucaacgacc

SEQ ID NO: 1893314 - RNA, 14 nt, Shigella flexneri 2a str. 2457T
uuaauaccaucggc

SEQ ID NO: 1893315 - RNA, 21 nt, Shigella flexneri 2a str. 2457T
uucacgcuaauaccggaugcc

SEQ ID NO: 1893316 - RNA, 18 nt, Shigella flexneri 2a str. 2457T
uucagauguuccgccauu

SEQ ID NO: 1893317 - RNA, 22 nt, Shigella flexneri 2a str. 2457T
uucagcaacgugcuucgcgcug

SEQ ID NO: 1893318 - RNA, 18 nt, Shigella flexneri 2a str. 2457T
uucacgccgcauccggca

SEQ ID NO: 1893319 - RNA, 20 nt, Shigella flexneri 2a str. 2457T
uucaccugcugauuaucggc

SEQ ID NO: 1893320 - RNA, 17 nt, Shigella flexneri 2a str. 2457T
uucacgacgcauccggc

SEQ ID NO: 1893321 - RNA, 14 nt, Shigella flexneri 2a str. 2457T
uuauuucauguuug

SEQ ID NO: 1893322 - RNA, 14 nt, Shigella flexneri 2a str. 2457T
uuauuguagccugc

SEQ ID NO: 1893323 - RNA, 20 nt, Shigella flexneri 2a str. 2457T
uucaaaaauaaguugccacg

SEQ ID NO: 1893324 - RNA, 21 nt, Shigella flexneri 2a str. 2457T
uucaaacgcuucuggcgacau

SEQ ID NO: 1893325 - RNA, 18 nt, Shigella flexneri 2a str. 2457T
uuaucgcgucaacagggc

SEQ ID NO: 1893326 - RNA, 16 nt, Shigella flexneri 2a str. 2457T
uuauccucuguaaacu

SEQ ID NO: 1893327 - RNA, 14 nt, Shigella flexneri 2a str. 2457T
uuaucgccagcgcc

SEQ ID NO: 1893328 - RNA, 22 nt, Shigella flexneri 2a str. 2457T
uuccaggcucauaccuuccacu

SEQ ID NO: 1893329 - RNA, 19 nt, Shigella flexneri 2a str. 2457T
uucauuaguuuggccaaua

SEQ ID NO: 1893330 - RNA, 20 nt, Shigella flexneri 2a str. 2457T
uucauccggcuguuccagca

SEQ ID NO: 1893331 - RNA, 21 nt, Shigella flexneri 2a str. 2457T
uucaucgcaucgaugguugcc

SEQ ID NO: 1893332 - RNA, 12 nt, Shigella flexneri 2a str. 2457T
uucaucgccagc

SEQ ID NO: 1893333 - RNA, 23 nt, Shigella flexneri 2a str. 2457T
uucaucggcggugaccagcagca

SEQ ID NO: 1893334 - RNA, 14 nt, Shigella flexneri 2a str. 2457T
uucaugcuccagca

SEQ ID NO: 1893335 - RNA, 15 nt, Shigella flexneri 2a str. 2457T
uucagcguaucccag

SEQ ID NO: 1893336 - RNA, 17 nt, Shigella flexneri 2a str. 2457T
uucagcgauauccagcg

SEQ ID NO: 1893337 - RNA, 15 nt, Shigella flexneri 2a str. 2457T
uucagccccagcacu

SEQ ID NO: 1893338 - RNA, 20 nt, Shigella flexneri 2a str. 2457T
ugugcgccacauccggcaua

SEQ ID NO: 1893339 - RNA, 20 nt, Shigella flexneri 2a str. 2457T
ugugccgcgaugauugggcu

SEQ ID NO: 1893340 - RNA, 13 nt, Shigella flexneri 2a str. 2457T
ugugccaggacuu

SEQ ID NO: 1893341 - RNA, 19 nt, Shigella flexneri 2a str. 2457T
ugucguuuccauggacgau

SEQ ID NO: 1893342 - RNA, 19 nt, Shigella flexneri 2a str. 2457T
ugucuaacaugagguccag

SEQ ID NO: 1893343 - RNA, 14 nt, Shigella flexneri 2a str. 2457T
ugucugccgcagga

SEQ ID NO: 1893344 - RNA, 17 nt, Shigella flexneri 2a str. 2457T
ugucuguacggcaguga

SEQ ID NO: 1893345 - RNA, 15 nt, Shigella flexneri 2a str. 2457T
ugucucccacaugcu

SEQ ID NO: 1893346 - RNA, 16 nt, Shigella flexneri 2a str. 2457T
ugucuauuccgcguga

SEQ ID NO: 1893347 - RNA, 14 nt, Shigella flexneri 2a str. 2457T
ugucggcgauaaua

SEQ ID NO: 1893348 - RNA, 15 nt, Shigella flexneri 2a str. 2457T
ugucgguuuguacuc

SEQ ID NO: 1893349 - RNA, 14 nt, Shigella flexneri 2a str. 2457T
uguccauccauacg

SEQ ID NO: 1893350 - RNA, 22 nt, Shigella flexneri 2a str. 2457T
uguaaagauugauuauugagcg

SEQ ID NO: 1893351 - RNA, 16 nt, Shigella flexneri 2a str. 2457T
uguaguucuggccuuu

SEQ ID NO: 1893352 - RNA, 20 nt, Shigella flexneri 2a str. 2457T
uguaggucggauaaggcguu

SEQ ID NO: 1893353 - RNA, 18 nt, Shigella flexneri 2a str. 2457T
uguauggcgauagcccag

SEQ ID NO: 1893354 - RNA, 14 nt, Shigella flexneri 2a str. 2457T
ugucaaucagggcg

SEQ ID NO: 1893355 - RNA, 16 nt, Shigella flexneri 2a str. 2457T
uggucauuaugaccgu

SEQ ID NO: 1893356 - RNA, 20 nt, Shigella flexneri 2a str. 2457T
uggucauugccaggcaggau

SEQ ID NO: 1893357 - RNA, 19 nt, Shigella flexneri 2a str. 2457T
uggucaguuguggcagaau

SEQ ID NO: 1893358 - RNA, 17 nt, Shigella flexneri 2a str. 2457T
uggucagcggauacagg

SEQ ID NO: 1893359 - RNA, 13 nt, Shigella flexneri 2a str. 2457T
uggugauugccgg

SEQ ID NO: 1893360 - RNA, 16 nt, Shigella flexneri 2a str. 2457T
uggugauuucaggcuu

SEQ ID NO: 1893361 - RNA, 20 nt, Shigella flexneri 2a str. 2457T
uggucuguaccaccagaauc

SEQ ID NO: 1893362 - RNA, 17 nt, Shigella flexneri 2a str. 2457T
uggucgguuaacuccac

SEQ ID NO: 1893363 - RNA, 21 nt, Shigella flexneri 2a str. 2457T
ugguuagagcacaucacucau

SEQ ID NO: 1893364 - RNA, 19 nt, Shigella flexneri 2a str. 2457T
ugguuauccagcaaccagg

SEQ ID NO: 1893365 - RNA, 20 nt, Shigella flexneri 2a str. 2457T
uggugcaccgauugccggau

SEQ ID NO: 1893366 - RNA, 15 nt, Shigella flexneri 2a str. 2457T
uggcgauaaucagcg

SEQ ID NO: 1893367 - RNA, 18 nt, Shigella flexneri 2a str. 2457T
uggcgcgaacagcacauc

SEQ ID NO: 1893368 - RNA, 15 nt, Shigella flexneri 2a str. 2457T
uggcgcguaccgccg

SEQ ID NO: 1893369 - RNA, 17 nt, Shigella flexneri 2a str. 2457T
uggcgcguuuaaucaca

SEQ ID NO: 1893370 - RNA, 11 nt, Shigella flexneri 2a str. 2457T
ugcuuucaguu

SEQ ID NO: 1893371 - RNA, 17 nt, Shigella flexneri 2a str. 2457T
uggaaacgcgaucgcca

SEQ ID NO: 1893372 - RNA, 23 nt, Shigella flexneri 2a str. 2457T
uggccguacccagcugucaaacu

SEQ ID NO: 1893373 - RNA, 16 nt, Shigella flexneri 2a str. 2457T
uggccgcuuccagcau

SEQ ID NO: 1893374 - RNA, 18 nt, Shigella flexneri 2a str. 2457T
uggccgugcagaccgcug

SEQ ID NO: 1893375 - RNA, 20 nt, Shigella flexneri 2a str. 2457T
uggccguuguugaacggcaa

SEQ ID NO: 1893376 - RNA, 21 nt, Shigella flexneri 2a str. 2457T
uggccugagacugaugacaaa

SEQ ID NO: 1893377 - RNA, 22 nt, Shigella flexneri 2a str. 2457T
uggcgaauggcacguugcugcg

SEQ ID NO: 1893378 - RNA, 13 nt, Shigella flexneri 2a str. 2457T
uggguaacggcag

SEQ ID NO: 1893379 - RNA, 19 nt, Shigella flexneri 2a str. 2457T
uggggcagaugggcuggcu

SEQ ID NO: 1893380 - RNA, 22 nt, Shigella flexneri 2a str. 2457T
uggggaaugauauuuucugccg

SEQ ID NO: 1893381 - RNA, 17 nt, Shigella flexneri 2a str. 2457T
uggcgggaucaccugca

SEQ ID NO: 1893382 - RNA, 20 nt, Shigella flexneri 2a str. 2457T
uggcuacccugguuuccgcu

SEQ ID NO: 1893383 - RNA, 15 nt, Shigella flexneri 2a str. 2457T
uggcguuugccaccu

SEQ ID NO: 1893384 - RNA, 14 nt, Shigella flexneri 2a str. 2457T
uggcguuuucgccg

SEQ ID NO: 1893385 - RNA, 13 nt, Shigella flexneri 2a str. 2457T
uggcucaucgccu

SEQ ID NO: 1893386 - RNA, 13 nt, Shigella flexneri 2a str. 2457T
uggcucuucaccu

SEQ ID NO: 1893387 - RNA, 22 nt, Shigella flexneri 2a str. 2457T
guuuuuucugccucugccagac

SEQ ID NO: 1893388 - RNA, 15 nt, Shigella flexneri 2a str. 2457T
guuuuguagaccuga

SEQ ID NO: 1893389 - RNA, 14 nt, Shigella flexneri 2a str. 2457T
guuuuuguugauaa

SEQ ID NO: 1893390 - RNA, 16 nt, Shigella flexneri 2a str. 2457T
guuuuuuauacuugca

SEQ ID NO: 1893391 - RNA, 20 nt, Shigella flexneri 2a str. 2457T
uaaaaccaguaaugaucggc

SEQ ID NO: 1893392 - RNA, 19 nt, Shigella flexneri 2a str. 2457T
uaaaauggccgauaccauc

SEQ ID NO: 1893393 - RNA, 15 nt, Shigella flexneri 2a str. 2457T
uaaaaugauacgcuc

SEQ ID NO: 1893394 - RNA, 23 nt, Shigella flexneri 2a str. 2457T
uaaacgguaagcccgugaccagc

SEQ ID NO: 1893395 - RNA, 17 nt, Shigella flexneri 2a str. 2457T
uaaacgucucacuaacg

SEQ ID NO: 1893396 - RNA, 21 nt, Shigella flexneri 2a str. 2457T
uaaacgugugugccagguucg

SEQ ID NO: 1893397 - RNA, 20 nt, Shigella flexneri 2a str. 2457T
uaaagcauucacgccgcauc

SEQ ID NO: 1893398 - RNA, 17 nt, Shigella flexneri 2a str. 2457T
uaaagcccucaccgaag

SEQ ID NO: 1893399 - RNA, 19 nt, Shigella flexneri 2a str. 2457T
uaaagcgcggcagugacug

SEQ ID NO: 1893400 - RNA, 20 nt, Shigella flexneri 2a str. 2457T
uaaacgcccaauccggccua

SEQ ID NO: 1893401 - RNA, 20 nt, Shigella flexneri 2a str. 2457T
uaaacgcuuuguccggccca

SEQ ID NO: 1893402 - RNA, 20 nt, Shigella flexneri 2a str. 2457T
uaaacgccuuauccagccua

SEQ ID NO: 1893403 - RNA, 18 nt, Shigella flexneri 2a str. 2457T
uaaaccuccagcaucaga

SEQ ID NO: 1893404 - RNA, 23 nt, Shigella flexneri 2a str. 2457T
uaaacgaaaugcgcuuaaucaau

SEQ ID NO: 1893405 - RNA, 12 nt, Shigella flexneri 2a str. 2457T
uaaacaaagcgc

SEQ ID NO: 1893406 - RNA, 16 nt, Shigella flexneri 2a str. 2457T
uaacggcugauaacaa

SEQ ID NO: 1893407 - RNA, 19 nt, Shigella flexneri 2a str. 2457T
uaacggccuuuugccagau

SEQ ID NO: 1893408 - RNA, 17 nt, Shigella flexneri 2a str. 2457T
uaacgcguuuucaccga

SEQ ID NO: 1893409 - RNA, 20 nt, Shigella flexneri 2a str. 2457T
uaacgcgucuuaucuggccu

SEQ ID NO: 1893410 - RNA, 23 nt, Shigella flexneri 2a str. 2457T
uaagaaauagcccucgccgcuuc

SEQ ID NO: 1893411 - RNA, 15 nt, Shigella flexneri 2a str. 2457T
uaacccgcaacagca

SEQ ID NO: 1893412 - RNA, 13 nt, Shigella flexneri 2a str. 2457T
uaacccagcgaug

SEQ ID NO: 1893413 - RNA, 20 nt, Shigella flexneri 2a str. 2457T
uaacacucgugcgucgcauc

SEQ ID NO: 1893414 - RNA, 17 nt, Shigella flexneri 2a str. 2457T
uaacagaaugcgggcga

SEQ ID NO: 1893415 - RNA, 19 nt, Shigella flexneri 2a str. 2457T
uaauaaccgaaucccgcug

SEQ ID NO: 1893416 - RNA, 19 nt, Shigella flexneri 2a str. 2457T
uaaucaauacgcacaaugc

SEQ ID NO: 1893417 - RNA, 15 nt, Shigella flexneri 2a str. 2457T
uaaucgucaucagcg

SEQ ID NO: 1893418 - RNA, 20 nt, Shigella flexneri 2a str. 2457T
uaaucgucaucagcgccaac

SEQ ID NO: 1893419 - RNA, 19 nt, Shigella flexneri 2a str. 2457T
uaaucucuacaccaacgcc

SEQ ID NO: 1893420 - RNA, 18 nt, Shigella flexneri 2a str. 2457T
uaaucuaccguuacggcu

SEQ ID NO: 1893421 - RNA, 20 nt, Shigella flexneri 2a str. 2457T
uaaggaauucacgccgcauc

SEQ ID NO: 1893422 - RNA, 22 nt, Shigella flexneri 2a str. 2457T
uaaggcuuucgugaagcuggca

SEQ ID NO: 1893423 - RNA, 20 nt, Shigella flexneri 2a str. 2457T
uaaggcguucgcgccgcauc

SEQ ID NO: 1893424 - RNA, 20 nt, Shigella flexneri 2a str. 2457T
uaaggcgcucgugccgcauc

SEQ ID NO: 1893425 - RNA, 20 nt, Shigella flexneri 2a str. 2457T
uaaggcauuuacgccgcauc

SEQ ID NO: 1893426 - RNA, 18 nt, Shigella flexneri 2a str. 2457T
uaagauaccccagcgcaa

SEQ ID NO: 1893427 - RNA, 22 nt, Shigella flexneri 2a str. 2457T
uaagauccccggucuuacccgc

SEQ ID NO: 1893428 - RNA, 22 nt, Shigella flexneri 2a str. 2457T
uaagacgcguuagcaucgcauc

SEQ ID NO: 1893429 - RNA, 15 nt, Shigella flexneri 2a str. 2457T
uaagacgcgaccggc

SEQ ID NO: 1893430 - RNA, 22 nt, Shigella flexneri 2a str. 2457T
uaagacgcgccagcgucgcauc

SEQ ID NO: 1893431 - RNA, 21 nt, Shigella flexneri 2a str. 2457T
uaagacagcgucacaucaggc

SEQ ID NO: 1893432 - RNA, 21 nt, Shigella flexneri 2a str. 2457T
uaagaacuccagcccggaaga

SEQ ID NO: 1893433 - RNA, 17 nt, Shigella flexneri 2a str. 2457T
uaauggucgagcgacag

SEQ ID NO: 1893434 - RNA, 12 nt, Shigella flexneri 2a str. 2457T
uaaugccucgug

SEQ ID NO: 1893435 - RNA, 21 nt, Shigella flexneri 2a str. 2457T
uacaggguaaaaccaugccau

SEQ ID NO: 1893436 - RNA, 22 nt, Shigella flexneri 2a str. 2457T
uacaucgcgcuuaucgccagcg

SEQ ID NO: 1893437 - RNA, 21 nt, Shigella flexneri 2a str. 2457T
uacagcucgguauggccuuuc

SEQ ID NO: 1893438 - RNA, 18 nt, Shigella flexneri 2a str. 2457T
uacagcuuaaucaccagc

SEQ ID NO: 1893439 - RNA, 13 nt, Shigella flexneri 2a str. 2457T
uacagcuuagcgc

SEQ ID NO: 1893440 - RNA, 18 nt, Shigella flexneri 2a str. 2457T
uacaaggccaauccagcc

SEQ ID NO: 1893441 - RNA, 18 nt, Shigella flexneri 2a str. 2457T
guuugugcugugacagau

SEQ ID NO: 1893442 - RNA, 20 nt, Shigella flexneri 2a str. 2457T
guuuuacaacguuaccgggu

SEQ ID NO: 1893443 - RNA, 22 nt, Shigella flexneri 2a str. 2457T
guuuuacucuuucucggaguaa

SEQ ID NO: 1893444 - RNA, 17 nt, Shigella flexneri 2a str. 2457T
guuuucaguaccgcguc

SEQ ID NO: 1893445 - RNA, 14 nt, Shigella flexneri 2a str. 2457T
guuuuccagcacca

SEQ ID NO: 1893446 - RNA, 14 nt, Shigella flexneri 2a str. 2457T
guuuugaucuccag

SEQ ID NO: 1893447 - RNA, 20 nt, Shigella flexneri 2a str. 2457T
guuuuguggguggucagcgu

SEQ ID NO: 1893448 - RNA, 14 nt, Shigella flexneri 2a str. 2457T
guuuuuauugguca

SEQ ID NO: 1893449 - RNA, 18 nt, Shigella flexneri 2a str. 2457T
guuugcagaugcgcuuca

SEQ ID NO: 1893450 - RNA, 14 nt, Shigella flexneri 2a str. 2457T
guuugcaucgccau

SEQ ID NO: 1893451 - RNA, 22 nt, Shigella flexneri 2a str. 2457T
guuuguaacccaccaugccgau

SEQ ID NO: 1893452 - RNA, 16 nt, Shigella flexneri 2a str. 2457T
guuucugcagcuccag

SEQ ID NO: 1893453 - RNA, 23 nt, Shigella flexneri 2a str. 2457T
guuuaccagcagcccugccggaa

SEQ ID NO: 1893454 - RNA, 21 nt, Shigella flexneri 2a str. 2457T
guuuaauucugcggcaaugcg

SEQ ID NO: 1893455 - RNA, 21 nt, Shigella flexneri 2a str. 2457T
guugucgauaaacaguuucgc

SEQ ID NO: 1893456 - RNA, 20 nt, Shigella flexneri 2a str. 2457T
guugucaauacuuucacaaa

SEQ ID NO: 1893457 - RNA, 17 nt, Shigella flexneri 2a str. 2457T
guugcauccggcauggc

SEQ ID NO: 1893458 - RNA, 15 nt, Shigella flexneri 2a str. 2457T
guugcagcgucauca

SEQ ID NO: 1893459 - RNA, 16 nt, Shigella flexneri 2a str. 2457T
guugcagcaggauggc

SEQ ID NO: 1893460 - RNA, 21 nt, Shigella flexneri 2a str. 2457T
guugcagauuugccaguaccg

SEQ ID NO: 1893461 - RNA, 17 nt, Shigella flexneri 2a str. 2457T
guugauuaugaucgcca

SEQ ID NO: 1893462 - RNA, 21 nt, Shigella flexneri 2a str. 2457T
guugaggauggcgucgauaau

SEQ ID NO: 1893463 - RNA, 18 nt, Shigella flexneri 2a str. 2457T
guugcacccaguacgggc

SEQ ID NO: 1893464 - RNA, 19 nt, Shigella flexneri 2a str. 2457T
guugcacgcagacacugcu

SEQ ID NO: 1893465 - RNA, 11 nt, Shigella flexneri 2a str. 2457T
guugcgcguca

SEQ ID NO: 1893466 - RNA, 15 nt, Shigella flexneri 2a str. 2457T
guucguaggccagau

SEQ ID NO: 1893467 - RNA, 16 nt, Shigella flexneri 2a str. 2457T
guucugcaaggcgagc

SEQ ID NO: 1893468 - RNA, 21 nt, Shigella flexneri 2a str. 2457T
guucugaccggccagcaugug

SEQ ID NO: 1893469 - RNA, 22 nt, Shigella flexneri 2a str. 2457T
guucguugauaauaaagcuaca

SEQ ID NO: 1893470 - RNA, 22 nt, Shigella flexneri 2a str. 2457T
guucguuauugggguuacgacc

SEQ ID NO: 1893471 - RNA, 14 nt, Shigella flexneri 2a str. 2457T
guugaggaucacaa

SEQ ID NO: 1893472 - RNA, 17 nt, Shigella flexneri 2a str. 2457T
guugacaaagugcgcgu

SEQ ID NO: 1893473 - RNA, 11 nt, Shigella flexneri 2a str. 2457T
uagucaccgcc

SEQ ID NO: 1893474 - RNA, 13 nt, Shigella flexneri 2a str. 2457T
uaguaacgccagc

SEQ ID NO: 1893475 - RNA, 19 nt, Shigella flexneri 2a str. 2457T
uaggugcucaaugccugau

SEQ ID NO: 1893476 - RNA, 14 nt, Shigella flexneri 2a str. 2457T
uauauuuccagaca

SEQ ID NO: 1893477 - RNA, 17 nt, Shigella flexneri 2a str. 2457T
uauacgcucaucggcau

SEQ ID NO: 1893478 - RNA, 19 nt, Shigella flexneri 2a str. 2457T
uauaccucugcgauggcga

SEQ ID NO: 1893479 - RNA, 15 nt, Shigella flexneri 2a str. 2457T
uauaccgcaucagca

SEQ ID NO: 1893480 - RNA, 16 nt, Shigella flexneri 2a str. 2457T
uauacccuucucagca

SEQ ID NO: 1893481 - RNA, 14 nt, Shigella flexneri 2a str. 2457T
uauacgucggguua

SEQ ID NO: 1893482 - RNA, 18 nt, Shigella flexneri 2a str. 2457T
uauagcgaccauacagca

SEQ ID NO: 1893483 - RNA, 12 nt, Shigella flexneri 2a str. 2457T
uaguuucagccu

SEQ ID NO: 1893484 - RNA, 19 nt, Shigella flexneri 2a str. 2457T
uaguuucguucgccguuuu

SEQ ID NO: 1893485 - RNA, 20 nt, Shigella flexneri 2a str. 2457T
uauacaccuguuccaugacg

SEQ ID NO: 1893486 - RNA, 23 nt, Shigella flexneri 2a str. 2457T
uauccggcauuaucacaucagcg

SEQ ID NO: 1893487 - RNA, 20 nt, Shigella flexneri 2a str. 2457T
uauccgguucacuucacgca

SEQ ID NO: 1893488 - RNA, 22 nt, Shigella flexneri 2a str. 2457T
uaucccauuuuugaauggaucu

SEQ ID NO: 1893489 - RNA, 18 nt, Shigella flexneri 2a str. 2457T
uauccgcaggugacgcgg

SEQ ID NO: 1893490 - RNA, 21 nt, Shigella flexneri 2a str. 2457T
uaucccuucuccacaccguug

SEQ ID NO: 1893491 - RNA, 14 nt, Shigella flexneri 2a str. 2457T
uauccgacaucccg

SEQ ID NO: 1893492 - RNA, 12 nt, Shigella flexneri 2a str. 2457T
uaucacauccag

SEQ ID NO: 1893493 - RNA, 16 nt, Shigella flexneri 2a str. 2457T
uaucaccccaucagcc

SEQ ID NO: 1893494 - RNA, 20 nt, Shigella flexneri 2a str. 2457T
uaucagcaaagcaaauuuug

SEQ ID NO: 1893495 - RNA, 13 nt, Shigella flexneri 2a str. 2457T
uaucagccugcaa

SEQ ID NO: 1893496 - RNA, 15 nt, Shigella flexneri 2a str. 2457T
uaucaguauacgcca

SEQ ID NO: 1893497 - RNA, 19 nt, Shigella flexneri 2a str. 2457T
uaucaugcuggauggcgca

SEQ ID NO: 1893498 - RNA, 15 nt, Shigella flexneri 2a str. 2457T
uauccaguuguucgc

SEQ ID NO: 1893499 - RNA, 17 nt, Shigella flexneri 2a str. 2457T
uauccauccccagagca

SEQ ID NO: 1893500 - RNA, 22 nt, Shigella flexneri 2a str. 2457T
uauccagcgcggcgaaggugcc

SEQ ID NO: 1893501 - RNA, 21 nt, Shigella flexneri 2a str. 2457T
uauccacaccaagccggaauu

SEQ ID NO: 1893502 - RNA, 15 nt, Shigella flexneri 2a str. 2457T
uauguugugcaucgg

SEQ ID NO: 1893503 - RNA, 19 nt, Shigella flexneri 2a str. 2457T
uaugugcuucuaccaugau

SEQ ID NO: 1893504 - RNA, 20 nt, Shigella flexneri 2a str. 2457T
uaugggguggaacggugaaa

SEQ ID NO: 1893505 - RNA, 16 nt, Shigella flexneri 2a str. 2457T
uaugacguaucaccga

SEQ ID NO: 1893506 - RNA, 13 nt, Shigella flexneri 2a str. 2457T
uaugaguaauguu

SEQ ID NO: 1893507 - RNA, 16 nt, Shigella flexneri 2a str. 2457T
uauuauuugcuaucgc

SEQ ID NO: 1893508 - RNA, 15 nt, Shigella flexneri 2a str. 2457T
uauucagcuggcagu

SEQ ID NO: 1893509 - RNA, 16 nt, Shigella flexneri 2a str. 2457T
uauugcuuuaccgcau

SEQ ID NO: 1893510 - RNA, 12 nt, Shigella flexneri 2a str. 2457T
uauuccguuacu

SEQ ID NO: 1893511 - RNA, 14 nt, Shigella flexneri 2a str. 2457T
uagccgcuucugca

SEQ ID NO: 1893512 - RNA, 19 nt, Shigella flexneri 2a str. 2457T
uagccgguaaaucaccagc

SEQ ID NO: 1893513 - RNA, 23 nt, Shigella flexneri 2a str. 2457T
uagauuucguugugucgccagca

SEQ ID NO: 1893514 - RNA, 22 nt, Shigella flexneri 2a str. 2457T
uagccgcuuuuucugcgcacac

SEQ ID NO: 1893515 - RNA, 21 nt, Shigella flexneri 2a str. 2457T
uagcuauaaaccugcuggcgc

SEQ ID NO: 1893516 - RNA, 14 nt, Shigella flexneri 2a str. 2457T
uagcgcugcugcac

SEQ ID NO: 1893517 - RNA, 16 nt, Shigella flexneri 2a str. 2457T
uagcgcggugcugaaa

SEQ ID NO: 1893518 - RNA, 14 nt, Shigella flexneri 2a str. 2457T
uagccuucaucaga

SEQ ID NO: 1893519 - RNA, 17 nt, Shigella flexneri 2a str. 2457T
uagccuuuuucagccgc

SEQ ID NO: 1893520 - RNA, 13 nt, Shigella flexneri 2a str. 2457T
uaggcgucacauc

SEQ ID NO: 1893521 - RNA, 19 nt, Shigella flexneri 2a str. 2457T
uaggcggcaaacaguuucu

SEQ ID NO: 1893522 - RNA, 16 nt, Shigella flexneri 2a str. 2457T
uaggccggauaaggcg

SEQ ID NO: 1893523 - RNA, 19 nt, Shigella flexneri 2a str. 2457T
uaggccugauaagacgcga

SEQ ID NO: 1893524 - RNA, 20 nt, Shigella flexneri 2a str. 2457T
uaggccugauaagacgcgua

SEQ ID NO: 1893525 - RNA, 20 nt, Shigella flexneri 2a str. 2457T
uaggccugauaagacgcguc

SEQ ID NO: 1893526 - RNA, 15 nt, Shigella flexneri 2a str. 2457T
uagcucuggguaaca

SEQ ID NO: 1893527 - RNA, 17 nt, Shigella flexneri 2a str. 2457T
uagcuuuggugccagau

SEQ ID NO: 1893528 - RNA, 18 nt, Shigella flexneri 2a str. 2457T
uaggacagcguugccagc

SEQ ID NO: 1893529 - RNA, 20 nt, Shigella flexneri 2a str. 2457T
uaggccagauaagacgcguc

SEQ ID NO: 1893530 - RNA, 20 nt, Shigella flexneri 2a str. 2457T
uaggccagauaagacgcguu

SEQ ID NO: 1893531 - RNA, 21 nt, Shigella flexneri 2a str. 2457T
uacugagcggaugcuuaaccg

SEQ ID NO: 1893532 - RNA, 13 nt, Shigella flexneri 2a str. 2457T
uacugucggcaau

SEQ ID NO: 1893533 - RNA, 21 nt, Shigella flexneri 2a str. 2457T
uacuguacagauccgccauuu

SEQ ID NO: 1893534 - RNA, 15 nt, Shigella flexneri 2a str. 2457T
uacuucaaucgccac

SEQ ID NO: 1893535 - RNA, 13 nt, Shigella flexneri 2a str. 2457T
uacugaaaccuga

SEQ ID NO: 1893536 - RNA, 18 nt, Shigella flexneri 2a str. 2457T
uacucuugugccaguuca

SEQ ID NO: 1893537 - RNA, 16 nt, Shigella flexneri 2a str. 2457T
uacucuccugcggcga

SEQ ID NO: 1893538 - RNA, 16 nt, Shigella flexneri 2a str. 2457T
uacucucgcuccaguu

SEQ ID NO: 1893539 - RNA, 17 nt, Shigella flexneri 2a str. 2457T
uacucugguauuaaccg

SEQ ID NO: 1893540 - RNA, 16 nt, Shigella flexneri 2a str. 2457T
uacucuccuccagguu

SEQ ID NO: 1893541 - RNA, 17 nt, Shigella flexneri 2a str. 2457T
uacuccugcucgccgau

SEQ ID NO: 1893542 - RNA, 15 nt, Shigella flexneri 2a str. 2457T
uacuucgcaauacgc

SEQ ID NO: 1893543 - RNA, 20 nt, Shigella flexneri 2a str. 2457T
uacuucagacggucagcgag

SEQ ID NO: 1893544 - RNA, 16 nt, Shigella flexneri 2a str. 2457T
uacuucugaacccggu

SEQ ID NO: 1893545 - RNA, 14 nt, Shigella flexneri 2a str. 2457T
uagaaacagaauga

SEQ ID NO: 1893546 - RNA, 16 nt, Shigella flexneri 2a str. 2457T
uagaaacagaaugaug

SEQ ID NO: 1893547 - RNA, 20 nt, Shigella flexneri 2a str. 2457T
uacuccaacucccuauagua

SEQ ID NO: 1893548 - RNA, 18 nt, Shigella flexneri 2a str. 2457T
uacguuccuuuacgguga

SEQ ID NO: 1893549 - RNA, 20 nt, Shigella flexneri 2a str. 2457T
uacguugcuucaugccggau

SEQ ID NO: 1893550 - RNA, 21 nt, Shigella flexneri 2a str. 2457T
uacgggcaauuucacguucac

SEQ ID NO: 1893551 - RNA, 19 nt, Shigella flexneri 2a str. 2457T
uacgggcgcgagguaacau

SEQ ID NO: 1893552 - RNA, 17 nt, Shigella flexneri 2a str. 2457T
uacggcguuaacuuguu

SEQ ID NO: 1893553 - RNA, 14 nt, Shigella flexneri 2a str. 2457T
uacguacguuaaca

SEQ ID NO: 1893554 - RNA, 15 nt, Shigella flexneri 2a str. 2457T
uacguaggccugaua

SEQ ID NO: 1893555 - RNA, 17 nt, Shigella flexneri 2a str. 2457T
uacgguuuuuugaacag

SEQ ID NO: 1893556 - RNA, 20 nt, Shigella flexneri 2a str. 2457T
uacgcgggucguugaucggc

SEQ ID NO: 1893557 - RNA, 14 nt, Shigella flexneri 2a str. 2457T
uacgcucacugcaa

SEQ ID NO: 1893558 - RNA, 20 nt, Shigella flexneri 2a str. 2457T
uacgcucaucggcauacagc

SEQ ID NO: 1893559 - RNA, 16 nt, Shigella flexneri 2a str. 2457T
uacgcucaucggcaua

SEQ ID NO: 1893560 - RNA, 14 nt, Shigella flexneri 2a str. 2457T
uacgcgucuuauca

SEQ ID NO: 1893561 - RNA, 14 nt, Shigella flexneri 2a str. 2457T
uacgcuugccggac

SEQ ID NO: 1893562 - RNA, 16 nt, Shigella flexneri 2a str. 2457T
uacgcuugccggacau

SEQ ID NO: 1893563 - RNA, 17 nt, Shigella flexneri 2a str. 2457T
uacgcuuaucaggccua

SEQ ID NO: 1893564 - RNA, 12 nt, Shigella flexneri 2a str. 2457T
uacgcucggcaa

SEQ ID NO: 1893565 - RNA, 21 nt, Shigella flexneri 2a str. 2457T
uacgcugaggauuuucaucuu

SEQ ID NO: 1893566 - RNA, 18 nt, Shigella flexneri 2a str. 2457T
uaccucagcagacugaua

SEQ ID NO: 1893567 - RNA, 12 nt, Shigella flexneri 2a str. 2457T
uaccuuccuuau

SEQ ID NO: 1893568 - RNA, 23 nt, Shigella flexneri 2a str. 2457T
uacgacgcuucaguucagcgaua

SEQ ID NO: 1893569 - RNA, 19 nt, Shigella flexneri 2a str. 2457T
uaccuaaaagcacgccaga

SEQ ID NO: 1893570 - RNA, 16 nt, Shigella flexneri 2a str. 2457T
uacauuggugccggau

SEQ ID NO: 1893571 - RNA, 21 nt, Shigella flexneri 2a str. 2457T
uccuggccguuguugaacggc

SEQ ID NO: 1893572 - RNA, 21 nt, Shigella flexneri 2a str. 2457T
uccuggcugauugauauccag

SEQ ID NO: 1893573 - RNA, 12 nt, Shigella flexneri 2a str. 2457T
uccuuccagcuc

SEQ ID NO: 1893574 - RNA, 16 nt, Shigella flexneri 2a str. 2457T
uccuucgggaagccuu

SEQ ID NO: 1893575 - RNA, 15 nt, Shigella flexneri 2a str. 2457T
uccuuaugaacgacc

SEQ ID NO: 1893576 - RNA, 23 nt, Shigella flexneri 2a str. 2457T
ucgaaaccaagaccaauccgcca

SEQ ID NO: 1893577 - RNA, 16 nt, Shigella flexneri 2a str. 2457T
uccuuuuauuuaaccg

SEQ ID NO: 1893578 - RNA, 18 nt, Shigella flexneri 2a str. 2457T
uccuuuacggugaacuca

SEQ ID NO: 1893579 - RNA, 16 nt, Shigella flexneri 2a str. 2457T
ucgaaagccacggaua

SEQ ID NO: 1893580 - RNA, 22 nt, Shigella flexneri 2a str. 2457T
ucgaaauagagaaaguaaacca

SEQ ID NO: 1893581 - RNA, 11 nt, Shigella flexneri 2a str. 2457T
uccucgccguu

SEQ ID NO: 1893582 - RNA, 20 nt, Shigella flexneri 2a str. 2457T
uccucuucccagacccaguu

SEQ ID NO: 1893583 - RNA, 14 nt, Shigella flexneri 2a str. 2457T
uccucuugucaggc

SEQ ID NO: 1893584 - RNA, 13 nt, Shigella flexneri 2a str. 2457T
uccugcgucgcua

SEQ ID NO: 1893585 - RNA, 16 nt, Shigella flexneri 2a str. 2457T
uccugcggaugcgcca

SEQ ID NO: 1893586 - RNA, 18 nt, Shigella flexneri 2a str. 2457T
uccugcuuacgguuacgc

SEQ ID NO: 1893587 - RNA, 22 nt, Shigella flexneri 2a str. 2457T
uccugcugcacgcccugauaaa

SEQ ID NO: 1893588 - RNA, 14 nt, Shigella flexneri 2a str. 2457T
uccugccaugcgca

SEQ ID NO: 1893589 - RNA, 19 nt, Shigella flexneri 2a str. 2457T
uccugauacagaccgcgca

SEQ ID NO: 1893590 - RNA, 23 nt, Shigella flexneri 2a str. 2457T
uccugacggugauacagcaaaau

SEQ ID NO: 1893591 - RNA, 17 nt, Shigella flexneri 2a str. 2457T
uccugacuugccagaua

SEQ ID NO: 1893592 - RNA, 13 nt, Shigella flexneri 2a str. 2457T
uccugcaacagca

SEQ ID NO: 1893593 - RNA, 20 nt, Shigella flexneri 2a str. 2457T
ucgacagcgauuccaguucg

SEQ ID NO: 1893594 - RNA, 18 nt, Shigella flexneri 2a str. 2457T
ucgacagacgccagcgcu

SEQ ID NO: 1893595 - RNA, 15 nt, Shigella flexneri 2a str. 2457T
ucgacaagauacugc

SEQ ID NO: 1893596 - RNA, 16 nt, Shigella flexneri 2a str. 2457T
ucgaaugccgucgagg

SEQ ID NO: 1893597 - RNA, 15 nt, Shigella flexneri 2a str. 2457T
ucgaacgccaguuca

SEQ ID NO: 1893598 - RNA, 18 nt, Shigella flexneri 2a str. 2457T
ucgaagcgggcgcgcagg

SEQ ID NO: 1893599 - RNA, 21 nt, Shigella flexneri 2a str. 2457T
ucgaccagccaggccgccagu

SEQ ID NO: 1893600 - RNA, 18 nt, Shigella flexneri 2a str. 2457T
ucgaccaggccaucagca

SEQ ID NO: 1893601 - RNA, 22 nt, Shigella flexneri 2a str. 2457T
ucgacgaugaucaagcgcacaa

SEQ ID NO: 1893602 - RNA, 20 nt, Shigella flexneri 2a str. 2457T
uccggucuaccgauccggca

SEQ ID NO: 1893603 - RNA, 19 nt, Shigella flexneri 2a str. 2457T
uccgucagcgaguugauca

SEQ ID NO: 1893604 - RNA, 22 nt, Shigella flexneri 2a str. 2457T
uccgguuguucaaccaccggca

SEQ ID NO: 1893605 - RNA, 14 nt, Shigella flexneri 2a str. 2457T
uccguaaagcccau

SEQ ID NO: 1893606 - RNA, 18 nt, Shigella flexneri 2a str. 2457T
uccgugaagcucacuucg

SEQ ID NO: 1893607 - RNA, 19 nt, Shigella flexneri 2a str. 2457T
uccucaguuucgacgccuu

SEQ ID NO: 1893608 - RNA, 22 nt, Shigella flexneri 2a str. 2457T
uccgggccgcaaaccagcgcau

SEQ ID NO: 1893609 - RNA, 13 nt, Shigella flexneri 2a str. 2457T
uccggcugggcgu

SEQ ID NO: 1893610 - RNA, 20 nt, Shigella flexneri 2a str. 2457T
uccggcugggcgugaaucug

SEQ ID NO: 1893611 - RNA, 18 nt, Shigella flexneri 2a str. 2457T
uccgcugcgguaagguug

SEQ ID NO: 1893612 - RNA, 23 nt, Shigella flexneri 2a str. 2457T
uccgcuggagcggggaacaccuc

SEQ ID NO: 1893613 - RNA, 20 nt, Shigella flexneri 2a str. 2457T
uccgcugauucaagauuagc

SEQ ID NO: 1893614 - RNA, 12 nt, Shigella flexneri 2a str. 2457T
uccggcaauucu

SEQ ID NO: 1893615 - RNA, 20 nt, Shigella flexneri 2a str. 2457T
uccggcaauugugaugguca

SEQ ID NO: 1893616 - RNA, 21 nt, Shigella flexneri 2a str. 2457T
uccgcuuacucauccacugcc

SEQ ID NO: 1893617 - RNA, 22 nt, Shigella flexneri 2a str. 2457T
uccggcauucagugcaaaugcc

SEQ ID NO: 1893618 - RNA, 18 nt, Shigella flexneri 2a str. 2457T
uccggcaugaacaaagcg

SEQ ID NO: 1893619 - RNA, 22 nt, Shigella flexneri 2a str. 2457T
uccggcaugauaccgauuacuc

SEQ ID NO: 1893620 - RNA, 15 nt, Shigella flexneri 2a str. 2457T
uccggcauccagcgu

SEQ ID NO: 1893621 - RNA, 13 nt, Shigella flexneri 2a str. 2457T
uccggcagagaaa

SEQ ID NO: 1893622 - RNA, 18 nt, Shigella flexneri 2a str. 2457T
uccggcaguaauaccaga

SEQ ID NO: 1893623 - RNA, 15 nt, Shigella flexneri 2a str. 2457T
uccauuacaucacga

SEQ ID NO: 1893624 - RNA, 20 nt, Shigella flexneri 2a str. 2457T
uccauucgcugcugcggcga

SEQ ID NO: 1893625 - RNA, 15 nt, Shigella flexneri 2a str. 2457T
ucccgccagcaccag

SEQ ID NO: 1893626 - RNA, 14 nt, Shigella flexneri 2a str. 2457T
ucccgugaugcggu

SEQ ID NO: 1893627 - RNA, 14 nt, Shigella flexneri 2a str. 2457T
ucccggcagagaaa

SEQ ID NO: 1893628 - RNA, 13 nt, Shigella flexneri 2a str. 2457T
uccgccgcgcggu

SEQ ID NO: 1893629 - RNA, 21 nt, Shigella flexneri 2a str. 2457T
uccgcacgaggaagauuacgc

SEQ ID NO: 1893630 - RNA, 22 nt, Shigella flexneri 2a str. 2457T
uccgaggcguuuucuaacagcg

SEQ ID NO: 1893631 - RNA, 14 nt, Shigella flexneri 2a str. 2457T
uccgcaauacagcc

SEQ ID NO: 1893632 - RNA, 18 nt, Shigella flexneri 2a str. 2457T
uccgaguggcugaaggag

SEQ ID NO: 1893633 - RNA, 17 nt, Shigella flexneri 2a str. 2457T
ucccugcuucggucaga

SEQ ID NO: 1893634 - RNA, 14 nt, Shigella flexneri 2a str. 2457T
ucccugcgguaagu

SEQ ID NO: 1893635 - RNA, 13 nt, Shigella flexneri 2a str. 2457T
ucccuucaaucuc

SEQ ID NO: 1893636 - RNA, 18 nt, Shigella flexneri 2a str. 2457T
ucccuuaguaacgccagc

SEQ ID NO: 1893637 - RNA, 14 nt, Shigella flexneri 2a str. 2457T
ucccuuucgauaag

SEQ ID NO: 1893638 - RNA, 16 nt, Shigella flexneri 2a str. 2457T
uccaucauaugcgcca

SEQ ID NO: 1893639 - RNA, 23 nt, Shigella flexneri 2a str. 2457T
uccagguccuccuguaccuucac

SEQ ID NO: 1893640 - RNA, 19 nt, Shigella flexneri 2a str. 2457T
uccagcucaaccagauucg

SEQ ID NO: 1893641 - RNA, 22 nt, Shigella flexneri 2a str. 2457T
uccagcccgcgcgaugagccgc

SEQ ID NO: 1893642 - RNA, 20 nt, Shigella flexneri 2a str. 2457T
uccagccagucggaaccggc

SEQ ID NO: 1893643 - RNA, 19 nt, Shigella flexneri 2a str. 2457T
uccacgcuauacagcagcc

SEQ ID NO: 1893644 - RNA, 16 nt, Shigella flexneri 2a str. 2457T
uccacggugaggcgau

SEQ ID NO: 1893645 - RNA, 21 nt, Shigella flexneri 2a str. 2457T
uccagauuuugcuuacgcgug

SEQ ID NO: 1893646 - RNA, 19 nt, Shigella flexneri 2a str. 2457T
uccagauucaguuucaccg

SEQ ID NO: 1893647 - RNA, 17 nt, Shigella flexneri 2a str. 2457T
uccacuuucuuaaagcc

SEQ ID NO: 1893648 - RNA, 18 nt, Shigella flexneri 2a str. 2457T
ucaguggcuuaucuuccu

SEQ ID NO: 1893649 - RNA, 15 nt, Shigella flexneri 2a str. 2457T
ucagugcgucgcugc

SEQ ID NO: 1893650 - RNA, 15 nt, Shigella flexneri 2a str. 2457T
ucagugaucgccugc

SEQ ID NO: 1893651 - RNA, 22 nt, Shigella flexneri 2a str. 2457T
ucagugagauaccaguugauca

SEQ ID NO: 1893652 - RNA, 14 nt, Shigella flexneri 2a str. 2457T
ucagugagcacauc

SEQ ID NO: 1893653 - RNA, 12 nt, Shigella flexneri 2a str. 2457T
ucaucaucacga

SEQ ID NO: 1893654 - RNA, 15 nt, Shigella flexneri 2a str. 2457T
ucaucacgaaaauca

SEQ ID NO: 1893655 - RNA, 12 nt, Shigella flexneri 2a str. 2457T
ucauaacggcaa

SEQ ID NO: 1893656 - RNA, 13 nt, Shigella flexneri 2a str. 2457T
ucaucaacgccau

SEQ ID NO: 1893657 - RNA, 19 nt, Shigella flexneri 2a str. 2457T
ucaugaccccagguaucgu

SEQ ID NO: 1893658 - RNA, 17 nt, Shigella flexneri 2a str. 2457T
ucauccaaaucgcccag

SEQ ID NO: 1893659 - RNA, 14 nt, Shigella flexneri 2a str. 2457T
ucaucggguaacgg

SEQ ID NO: 1893660 - RNA, 16 nt, Shigella flexneri 2a str. 2457T
ucaugguuagccugua

SEQ ID NO: 1893661 - RNA, 14 nt, Shigella flexneri 2a str. 2457T
ucaugugucgccgc

SEQ ID NO: 1893662 - RNA, 19 nt, Shigella flexneri 2a str. 2457T
ucauguauauuauccauca

SEQ ID NO: 1893663 - RNA, 15 nt, Shigella flexneri 2a str. 2457T
ucauucgccgguucc

SEQ ID NO: 1893664 - RNA, 20 nt, Shigella flexneri 2a str. 2457T
ucauucgccgguuccagcuu

SEQ ID NO: 1893665 - RNA, 14 nt, Shigella flexneri 2a str. 2457T
ucauugacgccaag

SEQ ID NO: 1893666 - RNA, 23 nt, Shigella flexneri 2a str. 2457T
ucauucucgcgauagaacuucug

SEQ ID NO: 1893667 - RNA, 14 nt, Shigella flexneri 2a str. 2457T
ucaccgcaucguca

SEQ ID NO: 1893668 - RNA, 14 nt, Shigella flexneri 2a str. 2457T
ucaccgcagcaucg

SEQ ID NO: 1893669 - RNA, 13 nt, Shigella flexneri 2a str. 2457T
uauuuucaaucug

SEQ ID NO: 1893670 - RNA, 15 nt, Shigella flexneri 2a str. 2457T
ucaccgcaccagucg

SEQ ID NO: 1893671 - RNA, 16 nt, Shigella flexneri 2a str. 2457T
uauuuggcauugguca

SEQ ID NO: 1893672 - RNA, 21 nt, Shigella flexneri 2a str. 2457T
uauuucuuuugguugccguca

SEQ ID NO: 1893673 - RNA, 19 nt, Shigella flexneri 2a str. 2457T
ucacggugucgguauacac

SEQ ID NO: 1893674 - RNA, 13 nt, Shigella flexneri 2a str. 2457T
ucacgucgcccac

SEQ ID NO: 1893675 - RNA, 17 nt, Shigella flexneri 2a str. 2457T
ucacgcccaucagcauc

SEQ ID NO: 1893676 - RNA, 20 nt, Shigella flexneri 2a str. 2457T
ucacgcguugcuaugcugaa

SEQ ID NO: 1893677 - RNA, 18 nt, Shigella flexneri 2a str. 2457T
ucacgccaucaucggcaa

SEQ ID NO: 1893678 - RNA, 16 nt, Shigella flexneri 2a str. 2457T
ucacgcaggcgagaau

SEQ ID NO: 1893679 - RNA, 22 nt, Shigella flexneri 2a str. 2457T
ucacgccaauaauggccuuuuc

SEQ ID NO: 1893680 - RNA, 18 nt, Shigella flexneri 2a str. 2457T
ucacgcauggacacugcc

SEQ ID NO: 1893681 - RNA, 15 nt, Shigella flexneri 2a str. 2457T
ucacgcagugcugca

SEQ ID NO: 1893682 - RNA, 18 nt, Shigella flexneri 2a str. 2457T
ucagacucagucgcccag

SEQ ID NO: 1893683 - RNA, 17 nt, Shigella flexneri 2a str. 2457T
ucagcaaucgcgccagc

SEQ ID NO: 1893684 - RNA, 21 nt, Shigella flexneri 2a str. 2457T
ucagcaaucggcuugccguug

SEQ ID NO: 1893685 - RNA, 18 nt, Shigella flexneri 2a str. 2457T
ucagcaacuguaacgcag

SEQ ID NO: 1893686 - RNA, 23 nt, Shigella flexneri 2a str. 2457T
ucacuucgcuuacgccugccagc

SEQ ID NO: 1893687 - RNA, 16 nt, Shigella flexneri 2a str. 2457T
ucacuucgucagaaau

SEQ ID NO: 1893688 - RNA, 13 nt, Shigella flexneri 2a str. 2457T
ucacuucaggaug

SEQ ID NO: 1893689 - RNA, 16 nt, Shigella flexneri 2a str. 2457T
ucagaccaauccagcc

SEQ ID NO: 1893690 - RNA, 11 nt, Shigella flexneri 2a str. 2457T
ucacugacgcc

SEQ ID NO: 1893691 - RNA, 14 nt, Shigella flexneri 2a str. 2457T
ucacugacaccagc

SEQ ID NO: 1893692 - RNA, 13 nt, Shigella flexneri 2a str. 2457T
ucagcgccugaua

SEQ ID NO: 1893693 - RNA, 22 nt, Shigella flexneri 2a str. 2457T
ucagcggcacuguuucgccagg

SEQ ID NO: 1893694 - RNA, 14 nt, Shigella flexneri 2a str. 2457T
ucagcggcaguucg

SEQ ID NO: 1893695 - RNA, 16 nt, Shigella flexneri 2a str. 2457T
ucagcggccaguuucg

SEQ ID NO: 1893696 - RNA, 16 nt, Shigella flexneri 2a str. 2457T
ucagcgcaugauuccc

SEQ ID NO: 1893697 - RNA, 20 nt, Shigella flexneri 2a str. 2457T
ucagcgcagacaaucacauc

SEQ ID NO: 1893698 - RNA, 16 nt, Shigella flexneri 2a str. 2457T
ucagcgaucgcuuucg

SEQ ID NO: 1893699 - RNA, 16 nt, Shigella flexneri 2a str. 2457T
ucagcgaguuaccuua

SEQ ID NO: 1893700 - RNA, 21 nt, Shigella flexneri 2a str. 2457T
ucagcgucucacuaucgcuga

SEQ ID NO: 1893701 - RNA, 22 nt, Shigella flexneri 2a str. 2457T
ucagcgggguucuccugagaau

SEQ ID NO: 1893702 - RNA, 13 nt, Shigella flexneri 2a str. 2457T
ucagcucaagaau

SEQ ID NO: 1893703 - RNA, 19 nt, Shigella flexneri 2a str. 2457T
ucaggcacccgccguuauc

SEQ ID NO: 1893704 - RNA, 16 nt, Shigella flexneri 2a str. 2457T
ucaggccgaggcacag

SEQ ID NO: 1893705 - RNA, 17 nt, Shigella flexneri 2a str. 2457T
ucagcuuuuuauagcaa

SEQ ID NO: 1893706 - RNA, 20 nt, Shigella flexneri 2a str. 2457T
ucagcuuauuaucgcuaucc

SEQ ID NO: 1893707 - RNA, 20 nt, Shigella flexneri 2a str. 2457T
ugcuacuaugauuuuccuga

SEQ ID NO: 1893708 - RNA, 18 nt, Shigella flexneri 2a str. 2457T
ugcguuuguaggccggau

SEQ ID NO: 1893709 - RNA, 21 nt, Shigella flexneri 2a str. 2457T
ugcucaaggguuucgcgguug

SEQ ID NO: 1893710 - RNA, 16 nt, Shigella flexneri 2a str. 2457T
ugcuauucaccagcaa

SEQ ID NO: 1893711 - RNA, 16 nt, Shigella flexneri 2a str. 2457T
ugcucaucgauaucga

SEQ ID NO: 1893712 - RNA, 16 nt, Shigella flexneri 2a str. 2457T
ugcucaaugccugaug

SEQ ID NO: 1893713 - RNA, 18 nt, Shigella flexneri 2a str. 2457T
ugcucacaaccccggcaa

SEQ ID NO: 1893714 - RNA, 20 nt, Shigella flexneri 2a str. 2457T
ugcucacaaccccggcaaau

SEQ ID NO: 1893715 - RNA, 17 nt, Shigella flexneri 2a str. 2457T
ugcucagaugccugaug

SEQ ID NO: 1893716 - RNA, 14 nt, Shigella flexneri 2a str. 2457T
ugcucacuacggcu

SEQ ID NO: 1893717 - RNA, 22 nt, Shigella flexneri 2a str. 2457T
ugcucacucccggggcgcggug

SEQ ID NO: 1893718 - RNA, 19 nt, Shigella flexneri 2a str. 2457T
ugcucccggcaaugcgccg

SEQ ID NO: 1893719 - RNA, 16 nt, Shigella flexneri 2a str. 2457T
ugcuccuccuucucac

SEQ ID NO: 1893720 - RNA, 22 nt, Shigella flexneri 2a str. 2457T
ugcucccgcugcggugacgcaa

SEQ ID NO: 1893721 - RNA, 23 nt, Shigella flexneri 2a str. 2457T
ugcucgacagcgcuaauacgaug

SEQ ID NO: 1893722 - RNA, 17 nt, Shigella flexneri 2a str. 2457T
ugcguacaccaacauca

SEQ ID NO: 1893723 - RNA, 22 nt, Shigella flexneri 2a str. 2457T
ugcguacauugccgacauggca

SEQ ID NO: 1893724 - RNA, 22 nt, Shigella flexneri 2a str. 2457T
ugcguauggcgacaaggcguug

SEQ ID NO: 1893725 - RNA, 13 nt, Shigella flexneri 2a str. 2457T
ugcgugaccgcca

SEQ ID NO: 1893726 - RNA, 12 nt, Shigella flexneri 2a str. 2457T
ugcgucuuccgu

SEQ ID NO: 1893727 - RNA, 19 nt, Shigella flexneri 2a str. 2457T
ugcguugucgccauccaga

SEQ ID NO: 1893728 - RNA, 19 nt, Shigella flexneri 2a str. 2457T
ugcguuccccgaagacgug

SEQ ID NO: 1893729 - RNA, 13 nt, Shigella flexneri 2a str. 2457T
ugcguuaagccau

SEQ ID NO: 1893730 - RNA, 19 nt, Shigella flexneri 2a str. 2457T
ugcugacauaauuggcacu

SEQ ID NO: 1893731 - RNA, 20 nt, Shigella flexneri 2a str. 2457T
ugcugcgccaguugcuuauc

SEQ ID NO: 1893732 - RNA, 16 nt, Shigella flexneri 2a str. 2457T
ugcugccuucacggcu

SEQ ID NO: 1893733 - RNA, 15 nt, Shigella flexneri 2a str. 2457T
ugcugccaucuucuu

SEQ ID NO: 1893734 - RNA, 22 nt, Shigella flexneri 2a str. 2457T
ugcugaugcaggcgaucgacgu

SEQ ID NO: 1893735 - RNA, 19 nt, Shigella flexneri 2a str. 2457T
ugcugcaauaaaauaucuu

SEQ ID NO: 1893736 - RNA, 22 nt, Shigella flexneri 2a str. 2457T
ugcugcacauacugcaucagcg

SEQ ID NO: 1893737 - RNA, 20 nt, Shigella flexneri 2a str. 2457T
ugcugugaagauggcuaacu

SEQ ID NO: 1893738 - RNA, 22 nt, Shigella flexneri 2a str. 2457T
ugcugguuuuguaggccggaua

SEQ ID NO: 1893739 - RNA, 18 nt, Shigella flexneri 2a str. 2457T
ugcugguauuuccagucc

SEQ ID NO: 1893740 - RNA, 12 nt, Shigella flexneri 2a str. 2457T
ugcuugaggcug

SEQ ID NO: 1893741 - RNA, 14 nt, Shigella flexneri 2a str. 2457T
ugcuucugccggag

SEQ ID NO: 1893742 - RNA, 13 nt, Shigella flexneri 2a str. 2457T
ugcuuuaucgaac

SEQ ID NO: 1893743 - RNA, 15 nt, Shigella flexneri 2a str. 2457T
ugcuuaaggcagaaa

SEQ ID NO: 1893744 - RNA, 15 nt, Shigella flexneri 2a str. 2457T
ugcuguuuccaguaa

SEQ ID NO: 1893745 - RNA, 15 nt, Shigella flexneri 2a str. 2457T
ugcgcagauuagccg

SEQ ID NO: 1893746 - RNA, 11 nt, Shigella flexneri 2a str. 2457T
ugcgcccaguu

SEQ ID NO: 1893747 - RNA, 12 nt, Shigella flexneri 2a str. 2457T
ugcgcccagcgu

SEQ ID NO: 1893748 - RNA, 20 nt, Shigella flexneri 2a str. 2457T
ugcgccagacccagacgcuc

SEQ ID NO: 1893749 - RNA, 13 nt, Shigella flexneri 2a str. 2457T
ugcgccagcaucg

SEQ ID NO: 1893750 - RNA, 15 nt, Shigella flexneri 2a str. 2457T
ugcgccauauaagca

SEQ ID NO: 1893751 - RNA, 15 nt, Shigella flexneri 2a str. 2457T
ugcgccaucaaugcc

SEQ ID NO: 1893752 - RNA, 15 nt, Shigella flexneri 2a str. 2457T
ugccgucaccagcau

SEQ ID NO: 1893753 - RNA, 22 nt, Shigella flexneri 2a str. 2457T
ugccgcgucuuaucaggccuac

SEQ ID NO: 1893754 - RNA, 14 nt, Shigella flexneri 2a str. 2457T
ugccguagcgauag

SEQ ID NO: 1893755 - RNA, 22 nt, Shigella flexneri 2a str. 2457T
ugcgaaaacgauguuugcugcg

SEQ ID NO: 1893756 - RNA, 13 nt, Shigella flexneri 2a str. 2457T
ugccguugccacg

SEQ ID NO: 1893757 - RNA, 22 nt, Shigella flexneri 2a str. 2457T
ugccuacgggaaccugaccgua

SEQ ID NO: 1893758 - RNA, 14 nt, Shigella flexneri 2a str. 2457T
ugccuuccagcgau

SEQ ID NO: 1893759 - RNA, 14 nt, Shigella flexneri 2a str. 2457T
ugccguuucuauca

SEQ ID NO: 1893760 - RNA, 19 nt, Shigella flexneri 2a str. 2457T
ugcggcuguagagcuaccg

SEQ ID NO: 1893761 - RNA, 14 nt, Shigella flexneri 2a str. 2457T
ugcggcugcaucuc

SEQ ID NO: 1893762 - RNA, 22 nt, Shigella flexneri 2a str. 2457T
ugcggcugcaucuccggcgcau

SEQ ID NO: 1893763 - RNA, 22 nt, Shigella flexneri 2a str. 2457T
ugcggguuagucugcauuuucu

SEQ ID NO: 1893764 - RNA, 22 nt, Shigella flexneri 2a str. 2457T
ugcgcuucucgcucgcuaucau

SEQ ID NO: 1893765 - RNA, 15 nt, Shigella flexneri 2a str. 2457T
ugcgcugcgcuuauc

SEQ ID NO: 1893766 - RNA, 19 nt, Shigella flexneri 2a str. 2457T
ugccgccgaggauacagcc

SEQ ID NO: 1893767 - RNA, 20 nt, Shigella flexneri 2a str. 2457T
ugccgcgccucuuacgcgaa

SEQ ID NO: 1893768 - RNA, 22 nt, Shigella flexneri 2a str. 2457T
ugccgcgcagggacacucgcug

SEQ ID NO: 1893769 - RNA, 16 nt, Shigella flexneri 2a str. 2457T
ugccgcauccggcaua

SEQ ID NO: 1893770 - RNA, 23 nt, Shigella flexneri 2a str. 2457T
ugccgaauaaagcauucacgccg

SEQ ID NO: 1893771 - RNA, 22 nt, Shigella flexneri 2a str. 2457T
ugccaucauacagccggcaaua

SEQ ID NO: 1893772 - RNA, 19 nt, Shigella flexneri 2a str. 2457T
ugccaucauacagccggca

SEQ ID NO: 1893773 - RNA, 21 nt, Shigella flexneri 2a str. 2457T
ugccaucauggcgaugagaau

SEQ ID NO: 1893774 - RNA, 19 nt, Shigella flexneri 2a str. 2457T
ugccaucauaaaucggaaa

SEQ ID NO: 1893775 - RNA, 20 nt, Shigella flexneri 2a str. 2457T
ugccauauucgcuuucagcg

SEQ ID NO: 1893776 - RNA, 17 nt, Shigella flexneri 2a str. 2457T
ugccaucaacuucucgc

SEQ ID NO: 1893777 - RNA, 17 nt, Shigella flexneri 2a str. 2457T
ugcccgccaaccguggc

SEQ ID NO: 1893778 - RNA, 16 nt, Shigella flexneri 2a str. 2457T
ugcccuggcgcgaaac

SEQ ID NO: 1893779 - RNA, 14 nt, Shigella flexneri 2a str. 2457T
ugcagcgccuguua

SEQ ID NO: 1893780 - RNA, 16 nt, Shigella flexneri 2a str. 2457T
ugcaggaacagaaugg

SEQ ID NO: 1893781 - RNA, 21 nt, Shigella flexneri 2a str. 2457T
ugcaggaagguuuuaaucgcu

SEQ ID NO: 1893782 - RNA, 16 nt, Shigella flexneri 2a str. 2457T
ugcagcgguaauuccg

SEQ ID NO: 1893783 - RNA, 20 nt, Shigella flexneri 2a str. 2457T
ugcagcguaaaccccuuauc

SEQ ID NO: 1893784 - RNA, 21 nt, Shigella flexneri 2a str. 2457T
ugcagcucaucuaaugcaggg

SEQ ID NO: 1893785 - RNA, 20 nt, Shigella flexneri 2a str. 2457T
ugcagcguuaacugcuuauc

SEQ ID NO: 1893786 - RNA, 18 nt, Shigella flexneri 2a str. 2457T
ugcagggcuuucacgccg

SEQ ID NO: 1893787 - RNA, 17 nt, Shigella flexneri 2a str. 2457T
ugcaggccugauaagcg

SEQ ID NO: 1893788 - RNA, 14 nt, Shigella flexneri 2a str. 2457T
ugccaggcuuacgc

SEQ ID NO: 1893789 - RNA, 18 nt, Shigella flexneri 2a str. 2457T
ugccaguuaucgcaggua

SEQ ID NO: 1893790 - RNA, 20 nt, Shigella flexneri 2a str. 2457T
ugccauaacgggcggcguug

SEQ ID NO: 1893791 - RNA, 16 nt, Shigella flexneri 2a str. 2457T
ugccagaaauccaggc

SEQ ID NO: 1893792 - RNA, 14 nt, Shigella flexneri 2a str. 2457T
ugccagaaccgcuu

SEQ ID NO: 1893793 - RNA, 18 nt, Shigella flexneri 2a str. 2457T
ugccaggaauauucaccg

SEQ ID NO: 1893794 - RNA, 16 nt, Shigella flexneri 2a str. 2457T
ugccagagcagcaaca

SEQ ID NO: 1893795 - RNA, 19 nt, Shigella flexneri 2a str. 2457T
ugccagagcccaucacaau

SEQ ID NO: 1893796 - RNA, 13 nt, Shigella flexneri 2a str. 2457T
ugcauuuucucgc

SEQ ID NO: 1893797 - RNA, 22 nt, Shigella flexneri 2a str. 2457T
ugccaaacuggaacugaaaggc

SEQ ID NO: 1893798 - RNA, 19 nt, Shigella flexneri 2a str. 2457T
ugccaaacacccgucgcgg

SEQ ID NO: 1893799 - RNA, 21 nt, Shigella flexneri 2a str. 2457T
ugcauuuucggcgcucucguu

SEQ ID NO: 1893800 - RNA, 18 nt, Shigella flexneri 2a str. 2457T
ugcauuuccgcugauuca

SEQ ID NO: 1893801 - RNA, 23 nt, Shigella flexneri 2a str. 2457T
ugcauggucuuguaggccagaua

SEQ ID NO: 1893802 - RNA, 22 nt, Shigella flexneri 2a str. 2457T
ugcauguuggcgauugccguug

SEQ ID NO: 1893803 - RNA, 16 nt, Shigella flexneri 2a str. 2457T
ugauaugccugcuggc

SEQ ID NO: 1893804 - RNA, 18 nt, Shigella flexneri 2a str. 2457T
ugauauuggcaucgccag

SEQ ID NO: 1893805 - RNA, 12 nt, Shigella flexneri 2a str. 2457T
ugauaggcguug

SEQ ID NO: 1893806 - RNA, 21 nt, Shigella flexneri 2a str. 2457T
ugauagcuuacggcgcuguga

SEQ ID NO: 1893807 - RNA, 12 nt, Shigella flexneri 2a str. 2457T
ugauacgcgcca

SEQ ID NO: 1893808 - RNA, 20 nt, Shigella flexneri 2a str. 2457T
ugauaccgauuacucagcaa

SEQ ID NO: 1893809 - RNA, 22 nt, Shigella flexneri 2a str. 2457T
ugauaccgauuacucagcaacu

SEQ ID NO: 1893810 - RNA, 14 nt, Shigella flexneri 2a str. 2457T
ugauacccaucauc

SEQ ID NO: 1893811 - RNA, 18 nt, Shigella flexneri 2a str. 2457T
ugauaauccaucacuuca

SEQ ID NO: 1893812 - RNA, 22 nt, Shigella flexneri 2a str. 2457T
ugaggaucaccaguccaucggc

SEQ ID NO: 1893813 - RNA, 20 nt, Shigella flexneri 2a str. 2457T
ugagucaauuucugcaaaau

SEQ ID NO: 1893814 - RNA, 18 nt, Shigella flexneri 2a str. 2457T
ugauaaaugagugaugau

SEQ ID NO: 1893815 - RNA, 12 nt, Shigella flexneri 2a str. 2457T
ugaacugacagc

SEQ ID NO: 1893816 - RNA, 19 nt, Shigella flexneri 2a str. 2457T
ugaacugacagccaaaggg

SEQ ID NO: 1893817 - RNA, 17 nt, Shigella flexneri 2a str. 2457T
ugaagcacugcaucaau

SEQ ID NO: 1893818 - RNA, 20 nt, Shigella flexneri 2a str. 2457T
ugaagcccgcugaaaagcgg

SEQ ID NO: 1893819 - RNA, 16 nt, Shigella flexneri 2a str. 2457T
ugacuaucaucgccgu

SEQ ID NO: 1893820 - RNA, 16 nt, Shigella flexneri 2a str. 2457T
ugacgugucuuaucag

SEQ ID NO: 1893821 - RNA, 20 nt, Shigella flexneri 2a str. 2457T
ugacgugucuuaucaggccu

SEQ ID NO: 1893822 - RNA, 19 nt, Shigella flexneri 2a str. 2457T
ugaagccuucgccuuucag

SEQ ID NO: 1893823 - RNA, 18 nt, Shigella flexneri 2a str. 2457T
ugagacaacaacaucagc

SEQ ID NO: 1893824 - RNA, 14 nt, Shigella flexneri 2a str. 2457T
ugagaucacugcaa

SEQ ID NO: 1893825 - RNA, 17 nt, Shigella flexneri 2a str. 2457T
ugagaacaguucagcag

SEQ ID NO: 1893826 - RNA, 22 nt, Shigella flexneri 2a str. 2457T
ugagcaaauccgcacucaucuu

SEQ ID NO: 1893827 - RNA, 14 nt, Shigella flexneri 2a str. 2457T
ugcagaaacauaau

SEQ ID NO: 1893828 - RNA, 19 nt, Shigella flexneri 2a str. 2457T
ugcagaaacggauaaucau

SEQ ID NO: 1893829 - RNA, 19 nt, Shigella flexneri 2a str. 2457T
ugcacuuucucgacaucca

SEQ ID NO: 1893830 - RNA, 17 nt, Shigella flexneri 2a str. 2457T
ugcacucgcauccucuu

SEQ ID NO: 1893831 - RNA, 19 nt, Shigella flexneri 2a str. 2457T
ugcacguuccguauaccgu

SEQ ID NO: 1893832 - RNA, 12 nt, Shigella flexneri 2a str. 2457T
ugcagaaucaau

SEQ ID NO: 1893833 - RNA, 18 nt, Shigella flexneri 2a str. 2457T
ugcagaccgcugacggca

SEQ ID NO: 1893834 - RNA, 14 nt, Shigella flexneri 2a str. 2457T
ugcacgucauacug

SEQ ID NO: 1893835 - RNA, 19 nt, Shigella flexneri 2a str. 2457T
ugauuucguagacugcagc

SEQ ID NO: 1893836 - RNA, 13 nt, Shigella flexneri 2a str. 2457T
ugauugccugaug

SEQ ID NO: 1893837 - RNA, 22 nt, Shigella flexneri 2a str. 2457T
ugcacauucccugcagucaccu

SEQ ID NO: 1893838 - RNA, 21 nt, Shigella flexneri 2a str. 2457T
ugcacagguggcaaacgccac

SEQ ID NO: 1893839 - RNA, 15 nt, Shigella flexneri 2a str. 2457T
ugaugcacaccaucg

SEQ ID NO: 1893840 - RNA, 19 nt, Shigella flexneri 2a str. 2457T
ugaugaccagaucaggcuu

SEQ ID NO: 1893841 - RNA, 18 nt, Shigella flexneri 2a str. 2457T
ugaugaacggugcgcagg

SEQ ID NO: 1893842 - RNA, 13 nt, Shigella flexneri 2a str. 2457T
ugaugggcagaau

SEQ ID NO: 1893843 - RNA, 18 nt, Shigella flexneri 2a str. 2457T
ugauggcuggcuuccagu

SEQ ID NO: 1893844 - RNA, 22 nt, Shigella flexneri 2a str. 2457T
ugauugaaauagccaauacgau

SEQ ID NO: 1893845 - RNA, 15 nt, Shigella flexneri 2a str. 2457T
ugaugugauccauca

SEQ ID NO: 1893846 - RNA, 20 nt, Shigella flexneri 2a str. 2457T
ugauguuugagcuaagccgu

SEQ ID NO: 1893847 - RNA, 23 nt, Shigella flexneri 2a str. 2457T
ugaacaugaaaaaacuggcuacc

SEQ ID NO: 1893848 - RNA, 20 nt, Shigella flexneri 2a str. 2457T
ugaacgcguuauccggcuaa

SEQ ID NO: 1893849 - RNA, 20 nt, Shigella flexneri 2a str. 2457T
ugaacgccuuaucuggccua

SEQ ID NO: 1893850 - RNA, 20 nt, Shigella flexneri 2a str. 2457T
ugaacgccuuauccggccug

SEQ ID NO: 1893851 - RNA, 22 nt, Shigella flexneri 2a str. 2457T
ugaacaggcaacaacaaccgau

SEQ ID NO: 1893852 - RNA, 23 nt, Shigella flexneri 2a str. 2457T
ugaacagggcgucaccggucaga

SEQ ID NO: 1893853 - RNA, 13 nt, Shigella flexneri 2a str. 2457T
ugaacagccugug

SEQ ID NO: 1893854 - RNA, 13 nt, Shigella flexneri 2a str. 2457T
ugaaacacauggu

SEQ ID NO: 1893855 - RNA, 16 nt, Shigella flexneri 2a str. 2457T
ugaaaagucauccggc

SEQ ID NO: 1893856 - RNA, 14 nt, Shigella flexneri 2a str. 2457T
ugaaaaucaccauu

SEQ ID NO: 1893857 - RNA, 20 nt, Shigella flexneri 2a str. 2457T
ugaaaaguccaggcugcaaa

SEQ ID NO: 1893858 - RNA, 17 nt, Shigella flexneri 2a str. 2457T
ucuuuaaugcacggcag

SEQ ID NO: 1893859 - RNA, 14 nt, Shigella flexneri 2a str. 2457T
ucuuuucgcuuuac

SEQ ID NO: 1893860 - RNA, 18 nt, Shigella flexneri 2a str. 2457T
ucuuuuggcgagagacgc

SEQ ID NO: 1893861 - RNA, 20 nt, Shigella flexneri 2a str. 2457T
ucuugaguuggcaugcguau

SEQ ID NO: 1893862 - RNA, 19 nt, Shigella flexneri 2a str. 2457T
ucuucgcgugugccgguaa

SEQ ID NO: 1893863 - RNA, 13 nt, Shigella flexneri 2a str. 2457T
ucuucuccggcau

SEQ ID NO: 1893864 - RNA, 14 nt, Shigella flexneri 2a str. 2457T
ucuucuugcagcuu

SEQ ID NO: 1893865 - RNA, 19 nt, Shigella flexneri 2a str. 2457T
ucuucaaggcagagucauu

SEQ ID NO: 1893866 - RNA, 15 nt, Shigella flexneri 2a str. 2457T
ucuucaaacggcaua

SEQ ID NO: 1893867 - RNA, 16 nt, Shigella flexneri 2a str. 2457T
ucuuaucuggccuacu

SEQ ID NO: 1893868 - RNA, 17 nt, Shigella flexneri 2a str. 2457T
ucuucccauggauuacc

SEQ ID NO: 1893869 - RNA, 13 nt, Shigella flexneri 2a str. 2457T
ucuggccaugcgg

SEQ ID NO: 1893870 - RNA, 20 nt, Shigella flexneri 2a str. 2457T
ucuggcacgaccuggcagca

SEQ ID NO: 1893871 - RNA, 16 nt, Shigella flexneri 2a str. 2457T
ucuggcagcgcgcauu

SEQ ID NO: 1893872 - RNA, 14 nt, Shigella flexneri 2a str. 2457T
ucuggcgcgaacag

SEQ ID NO: 1893873 - RNA, 22 nt, Shigella flexneri 2a str. 2457T
ucuggcgcgaacagcacaucag

SEQ ID NO: 1893874 - RNA, 12 nt, Shigella flexneri 2a str. 2457T
ucuggcgcugga

SEQ ID NO: 1893875 - RNA, 20 nt, Shigella flexneri 2a str. 2457T
ucugcuuguggcggaaagac

SEQ ID NO: 1893876 - RNA, 19 nt, Shigella flexneri 2a str. 2457T
ucuggacgauugugcuggu

SEQ ID NO: 1893877 - RNA, 16 nt, Shigella flexneri 2a str. 2457T
ucuggguugccugaug

SEQ ID NO: 1893878 - RNA, 15 nt, Shigella flexneri 2a str. 2457T
ucuggguuucgccag

SEQ ID NO: 1893879 - RNA, 19 nt, Shigella flexneri 2a str. 2457T
ucuggugguaaucgacaac

SEQ ID NO: 1893880 - RNA, 20 nt, Shigella flexneri 2a str. 2457T
ucuguccaaauccuucagca

SEQ ID NO: 1893881 - RNA, 23 nt, Shigella flexneri 2a str. 2457T
ucuguaccaccagaaucgccagc

SEQ ID NO: 1893882 - RNA, 18 nt, Shigella flexneri 2a str. 2457T
ucuguuccauaaucgccu

SEQ ID NO: 1893883 - RNA, 20 nt, Shigella flexneri 2a str. 2457T
ucugcgcauaacugccggau

SEQ ID NO: 1893884 - RNA, 14 nt, Shigella flexneri 2a str. 2457T
ucugcgccugcacg

SEQ ID NO: 1893885 - RNA, 20 nt, Shigella flexneri 2a str. 2457T
ucugcggguuagucugcauu

SEQ ID NO: 1893886 - RNA, 17 nt, Shigella flexneri 2a str. 2457T
ucugcguaucgcccugc

SEQ ID NO: 1893887 - RNA, 22 nt, Shigella flexneri 2a str. 2457T
ucugcgugaucuaaaaucgcuu

SEQ ID NO: 1893888 - RNA, 21 nt, Shigella flexneri 2a str. 2457T
ucugcguuagaaaacgccugc

SEQ ID NO: 1893889 - RNA, 14 nt, Shigella flexneri 2a str. 2457T
ucugcaugacggcu

SEQ ID NO: 1893890 - RNA, 15 nt, Shigella flexneri 2a str. 2457T
ucugcccgaccagau

SEQ ID NO: 1893891 - RNA, 20 nt, Shigella flexneri 2a str. 2457T
ucucuucuucuucggucaga

SEQ ID NO: 1893892 - RNA, 21 nt, Shigella flexneri 2a str. 2457T
ucugacguuuucucguccagu

SEQ ID NO: 1893893 - RNA, 16 nt, Shigella flexneri 2a str. 2457T
ucugagcaugaugccu

SEQ ID NO: 1893894 - RNA, 20 nt, Shigella flexneri 2a str. 2457T
ucucuggcacgagaucguca

SEQ ID NO: 1893895 - RNA, 22 nt, Shigella flexneri 2a str. 2457T
ucucuggccgcuuccagcauuu

SEQ ID NO: 1893896 - RNA, 20 nt, Shigella flexneri 2a str. 2457T
ucucgucauccuaaacgcug

SEQ ID NO: 1893897 - RNA, 15 nt, Shigella flexneri 2a str. 2457T
ucucggcccggccca

SEQ ID NO: 1893898 - RNA, 18 nt, Shigella flexneri 2a str. 2457T
ucucgccuaccauccaua

SEQ ID NO: 1893899 - RNA, 14 nt, Shigella flexneri 2a str. 2457T
ucucaaaccggcuc

SEQ ID NO: 1893900 - RNA, 14 nt, Shigella flexneri 2a str. 2457T
ucuacugcaccgca

SEQ ID NO: 1893901 - RNA, 20 nt, Shigella flexneri 2a str. 2457T
ucuaugaagaacuggaacgc

SEQ ID NO: 1893902 - RNA, 21 nt, Shigella flexneri 2a str. 2457T
ucguuaaacucugccgcaauc

SEQ ID NO: 1893903 - RNA, 17 nt, Shigella flexneri 2a str. 2457T
ucguucagcggcccguu

SEQ ID NO: 1893904 - RNA, 19 nt, Shigella flexneri 2a str. 2457T
ucguuauccgaugguacgc

SEQ ID NO: 1893905 - RNA, 13 nt, Shigella flexneri 2a str. 2457T
ucggucagagaau

SEQ ID NO: 1893906 - RNA, 14 nt, Shigella flexneri 2a str. 2457T
ucggcucagccgau

SEQ ID NO: 1893907 - RNA, 19 nt, Shigella flexneri 2a str. 2457T
ucggugcacgaugccugau

SEQ ID NO: 1893908 - RNA, 18 nt, Shigella flexneri 2a str. 2457T
ucggugcaaaugccagau

SEQ ID NO: 1893909 - RNA, 12 nt, Shigella flexneri 2a str. 2457T
ucggugaucuca

SEQ ID NO: 1893910 - RNA, 22 nt, Shigella flexneri 2a str. 2457T
ucggugagcuaaugcaaaucac

SEQ ID NO: 1893911 - RNA, 21 nt, Shigella flexneri 2a str. 2457T
ucguaccguugcgcgucaacu

SEQ ID NO: 1893912 - RNA, 18 nt, Shigella flexneri 2a str. 2457T
ucguaaaaacggauuuca

SEQ ID NO: 1893913 - RNA, 13 nt, Shigella flexneri 2a str. 2457T
ucguaagcaggag

SEQ ID NO: 1893914 - RNA, 14 nt, Shigella flexneri 2a str. 2457T
ucgguuuucaaucg

SEQ ID NO: 1893915 - RNA, 15 nt, Shigella flexneri 2a str. 2457T
ucguccaugcugucg

SEQ ID NO: 1893916 - RNA, 21 nt, Shigella flexneri 2a str. 2457T
ucggcguaauccugaaagcgu

SEQ ID NO: 1893917 - RNA, 22 nt, Shigella flexneri 2a str. 2457T
ucggcgucaucgacaucaacga

SEQ ID NO: 1893918 - RNA, 18 nt, Shigella flexneri 2a str. 2457T
ucggcgucauuuuuucga

SEQ ID NO: 1893919 - RNA, 19 nt, Shigella flexneri 2a str. 2457T
ucgcgucuuauccggccuu

SEQ ID NO: 1893920 - RNA, 16 nt, Shigella flexneri 2a str. 2457T
ucgcguaaauccagcg

SEQ ID NO: 1893921 - RNA, 16 nt, Shigella flexneri 2a str. 2457T
ucgcguacucaccgcu

SEQ ID NO: 1893922 - RNA, 16 nt, Shigella flexneri 2a str. 2457T
ucgcguaacugcugcu

SEQ ID NO: 1893923 - RNA, 15 nt, Shigella flexneri 2a str. 2457T
ucgcuccugccggac

SEQ ID NO: 1893924 - RNA, 15 nt, Shigella flexneri 2a str. 2457T
ucgcugaaaggcgau

SEQ ID NO: 1893925 - RNA, 22 nt, Shigella flexneri 2a str. 2457T
ucgcuggugccaagcuccagca

SEQ ID NO: 1893926 - RNA, 22 nt, Shigella flexneri 2a str. 2457T
ucgcugaacgggccauccauca

SEQ ID NO: 1893927 - RNA, 18 nt, Shigella flexneri 2a str. 2457T
ucgcuacaccaaucguca

SEQ ID NO: 1893928 - RNA, 18 nt, Shigella flexneri 2a str. 2457T
ucgcguuugcccgcaacg

SEQ ID NO: 1893929 - RNA, 19 nt, Shigella flexneri 2a str. 2457T
ucgcuuucaggucagcgaa

SEQ ID NO: 1893930 - RNA, 18 nt, Shigella flexneri 2a str. 2457T
ucggaacaguaaagcgca

SEQ ID NO: 1893931 - RNA, 19 nt, Shigella flexneri 2a str. 2457T
ucggaagcagcguaacggc

SEQ ID NO: 1893932 - RNA, 18 nt, Shigella flexneri 2a str. 2457T
ucggcaagauaaaucgca

SEQ ID NO: 1893933 - RNA, 19 nt, Shigella flexneri 2a str. 2457T
ucgccgcgacacaacgcuu

SEQ ID NO: 1893934 - RNA, 18 nt, Shigella flexneri 2a str. 2457T
ucgccaucuuuacaccuu

SEQ ID NO: 1893935 - RNA, 22 nt, Shigella flexneri 2a str. 2457T
ucgccauggucggcagagaguu

SEQ ID NO: 1893936 - RNA, 23 nt, Shigella flexneri 2a str. 2457T
ucgcccacgccagagauaaccca

SEQ ID NO: 1893937 - RNA, 12 nt, Shigella flexneri 2a str. 2457T
ucgccaucaggc

SEQ ID NO: 1893938 - RNA, 16 nt, Shigella flexneri 2a str. 2457T
ucgcccaggcgaccag

SEQ ID NO: 1893939 - RNA, 17 nt, Shigella flexneri 2a str. 2457T
ucgcggcagcagagaaa

SEQ ID NO: 1893940 - RNA, 18 nt, Shigella flexneri 2a str. 2457T
ucgcggcgauauccagcg

SEQ ID NO: 1893941 - RNA, 20 nt, Shigella flexneri 2a str. 2457T
ucgcggcaauuuuuaccggu

SEQ ID NO: 1893942 - RNA, 19 nt, Shigella flexneri 2a str. 2457T
ucgcgauuaugccgccgac

SEQ ID NO: 1893943 - RNA, 12 nt, Shigella flexneri 2a str. 2457T
ucgcgcacugcg

SEQ ID NO: 1893944 - RNA, 18 nt, Shigella flexneri 2a str. 2457T
ucgcgccagaaagcagca

SEQ ID NO: 1893945 - RNA, 15 nt, Shigella flexneri 2a str. 2457T
ucgcgccaaucagcg

SEQ ID NO: 1893946 - RNA, 15 nt, Shigella flexneri 2a str. 2457T
ucgcgccaggcgcug

SEQ ID NO: 1893947 - RNA, 19 nt, Shigella flexneri 2a str. 2457T
ucgcgauagaacuucugca

SEQ ID NO: 1893948 - RNA, 15 nt, Shigella flexneri 2a str. 2457T
ucgcgauaacggauc

SEQ ID NO: 1893949 - RNA, 20 nt, Shigella flexneri 2a str. 2457T
ucgcgaucaaacgccagauc

SEQ ID NO: 1893950 - RNA, 19 nt, Shigella flexneri 2a str. 2457T
ucgccguaagcaaacagcg

SEQ ID NO: 1893951 - RNA, 20 nt, Shigella flexneri 2a str. 2457T
ucgccgucaggcaagccgcu

SEQ ID NO: 1893952 - RNA, 13 nt, Shigella flexneri 2a str. 2457T
gcuuuuucgcgau

SEQ ID NO: 1893953 - RNA, 22 nt, Shigella flexneri 2a str. 2457T
gcuuuuugcauuuccgcugauu

SEQ ID NO: 1893954 - RNA, 17 nt, Shigella flexneri 2a str. 2457T
gcuuuuucaauuuccag

SEQ ID NO: 1893955 - RNA, 17 nt, Shigella flexneri 2a str. 2457T
gcuuuuacugcauucac

SEQ ID NO: 1893956 - RNA, 20 nt, Shigella flexneri 2a str. 2457T
gcuuuauagcguugcccgau

SEQ ID NO: 1893957 - RNA, 21 nt, Shigella flexneri 2a str. 2457T
gcuuuauccugcccacuccag

SEQ ID NO: 1893958 - RNA, 17 nt, Shigella flexneri 2a str. 2457T
gcuuucaccgccugauc

SEQ ID NO: 1893959 - RNA, 15 nt, Shigella flexneri 2a str. 2457T
gcuuuccaccaucac

SEQ ID NO: 1893960 - RNA, 13 nt, Shigella flexneri 2a str. 2457T
gcuuucagcagcg

SEQ ID NO: 1893961 - RNA, 16 nt, Shigella flexneri 2a str. 2457T
gcuuucacgucaggau

SEQ ID NO: 1893962 - RNA, 21 nt, Shigella flexneri 2a str. 2457T
gcuuucacucugaaaacgcug

SEQ ID NO: 1893963 - RNA, 12 nt, Shigella flexneri 2a str. 2457T
gcuuggcagagc

SEQ ID NO: 1893964 - RNA, 12 nt, Shigella flexneri 2a str. 2457T
gcuugcgguuug

SEQ ID NO: 1893965 - RNA, 13 nt, Shigella flexneri 2a str. 2457T
gcuugggcagaau

SEQ ID NO: 1893966 - RNA, 21 nt, Shigella flexneri 2a str. 2457T
gcuguuucgcuucuucagccu

SEQ ID NO: 1893967 - RNA, 19 nt, Shigella flexneri 2a str. 2457T
gcuguuuguucaagcgcaa

SEQ ID NO: 1893968 - RNA, 20 nt, Shigella flexneri 2a str. 2457T
gcuugccagagcagcaacaa

SEQ ID NO: 1893969 - RNA, 14 nt, Shigella flexneri 2a str. 2457T
gcuugcgagacggc

SEQ ID NO: 1893970 - RNA, 13 nt, Shigella flexneri 2a str. 2457T
gcuugcgccgcuu

SEQ ID NO: 1893971 - RNA, 19 nt, Shigella flexneri 2a str. 2457T
ggacaaaguuccugccgau

SEQ ID NO: 1893972 - RNA, 17 nt, Shigella flexneri 2a str. 2457T
ggaacugcgugccguga

SEQ ID NO: 1893973 - RNA, 20 nt, Shigella flexneri 2a str. 2457T
ggaacugaaaggcgcucauu

SEQ ID NO: 1893974 - RNA, 22 nt, Shigella flexneri 2a str. 2457T
ggaacgcgcgauagucaugaug

SEQ ID NO: 1893975 - RNA, 21 nt, Shigella flexneri 2a str. 2457T
ggaaaaagagcagcugauuga

SEQ ID NO: 1893976 - RNA, 16 nt, Shigella flexneri 2a str. 2457T
ggacagauucaugcug

SEQ ID NO: 1893977 - RNA, 20 nt, Shigella flexneri 2a str. 2457T
ggacacucgcugacugauau

SEQ ID NO: 1893978 - RNA, 20 nt, Shigella flexneri 2a str. 2457T
ggagaguaaacggugauacu

SEQ ID NO: 1893979 - RNA, 17 nt, Shigella flexneri 2a str. 2457T
ggagcaggagucauguc

SEQ ID NO: 1893980 - RNA, 22 nt, Shigella flexneri 2a str. 2457T
ggagcagagcauucccgccauc

SEQ ID NO: 1893981 - RNA, 21 nt, Shigella flexneri 2a str. 2457T
ggauaaggcguuuacgccgca

SEQ ID NO: 1893982 - RNA, 18 nt, Shigella flexneri 2a str. 2457T
ggauaaggcguuaacgcc

SEQ ID NO: 1893983 - RNA, 21 nt, Shigella flexneri 2a str. 2457T
ggauaaggcguucacgccgca

SEQ ID NO: 1893984 - RNA, 12 nt, Shigella flexneri 2a str. 2457T
ggauacgccgca

SEQ ID NO: 1893985 - RNA, 17 nt, Shigella flexneri 2a str. 2457T
ggaguggugaaacaggg

SEQ ID NO: 1893986 - RNA, 19 nt, Shigella flexneri 2a str. 2457T
ggaguaguugaucgccccg

SEQ ID NO: 1893987 - RNA, 13 nt, Shigella flexneri 2a str. 2457T
ggaucgcagccga

SEQ ID NO: 1893988 - RNA, 21 nt, Shigella flexneri 2a str. 2457T
ggaucaacauucagaucgguu

SEQ ID NO: 1893989 - RNA, 15 nt, Shigella flexneri 2a str. 2457T
ggaucagaaugcgcu

SEQ ID NO: 1893990 - RNA, 14 nt, Shigella flexneri 2a str. 2457T
ggaugcgccagcau

SEQ ID NO: 1893991 - RNA, 23 nt, Shigella flexneri 2a str. 2457T
ggaugccugaugcgacgcugaua

SEQ ID NO: 1893992 - RNA, 21 nt, Shigella flexneri 2a str. 2457T
ggaugcaugauccggcaucuu

SEQ ID NO: 1893993 - RNA, 20 nt, Shigella flexneri 2a str. 2457T
ggaugggcugucagcucauc

SEQ ID NO: 1893994 - RNA, 20 nt, Shigella flexneri 2a str. 2457T
ggaucgucgcccgaugcaua

SEQ ID NO: 1893995 - RNA, 14 nt, Shigella flexneri 2a str. 2457T
ggaucugaugggau

SEQ ID NO: 1893996 - RNA, 20 nt, Shigella flexneri 2a str. 2457T
gcugucggcaagauacugca

SEQ ID NO: 1893997 - RNA, 16 nt, Shigella flexneri 2a str. 2457T
gcugucaacugacuau

SEQ ID NO: 1893998 - RNA, 20 nt, Shigella flexneri 2a str. 2457T
gcugugccagugccacacgc

SEQ ID NO: 1893999 - RNA, 23 nt, Shigella flexneri 2a str. 2457T
gcugugacagauuuugccagcau

SEQ ID NO: 1894000 - RNA, 16 nt, Shigella flexneri 2a str. 2457T
gcugucggugccauca

SEQ ID NO: 1894001 - RNA, 17 nt, Shigella flexneri 2a str. 2457T
gcuggugauuucgucca

SEQ ID NO: 1894002 - RNA, 14 nt, Shigella flexneri 2a str. 2457T
gcuggugacgcauu

SEQ ID NO: 1894003 - RNA, 16 nt, Shigella flexneri 2a str. 2457T
gcuggugaguaacgcg

SEQ ID NO: 1894004 - RNA, 14 nt, Shigella flexneri 2a str. 2457T
gcuggugauugccg

SEQ ID NO: 1894005 - RNA, 13 nt, Shigella flexneri 2a str. 2457T
gcuggcgacgccu

SEQ ID NO: 1894006 - RNA, 16 nt, Shigella flexneri 2a str. 2457T
gcuggcguacccauca

SEQ ID NO: 1894007 - RNA, 14 nt, Shigella flexneri 2a str. 2457T
gcugggcgauuucg

SEQ ID NO: 1894008 - RNA, 13 nt, Shigella flexneri 2a str. 2457T
gcugcucgguucg

SEQ ID NO: 1894009 - RNA, 23 nt, Shigella flexneri 2a str. 2457T
gcugccgcuucuucuucagcgcu

SEQ ID NO: 1894010 - RNA, 13 nt, Shigella flexneri 2a str. 2457T
gcugccggcacag

SEQ ID NO: 1894011 - RNA, 22 nt, Shigella flexneri 2a str. 2457T
gcugcuguggauucagcaccgu

SEQ ID NO: 1894012 - RNA, 17 nt, Shigella flexneri 2a str. 2457T
gcuggaaauguccgcga

SEQ ID NO: 1894013 - RNA, 16 nt, Shigella flexneri 2a str. 2457T
gcuggaacaaacugcc

SEQ ID NO: 1894014 - RNA, 19 nt, Shigella flexneri 2a str. 2457T
gcuggaaagcguaaacggu

SEQ ID NO: 1894015 - RNA, 14 nt, Shigella flexneri 2a str. 2457T
gcuggaucugcggg

SEQ ID NO: 1894016 - RNA, 16 nt, Shigella flexneri 2a str. 2457T
gcuggcagcugcuacg

SEQ ID NO: 1894017 - RNA, 17 nt, Shigella flexneri 2a str. 2457T
gcuggauuuucugugca

SEQ ID NO: 1894018 - RNA, 16 nt, Shigella flexneri 2a str. 2457T
gcuccaguaccugcaa

SEQ ID NO: 1894019 - RNA, 11 nt, Shigella flexneri 2a str. 2457T
gcucggucaga

SEQ ID NO: 1894020 - RNA, 15 nt, Shigella flexneri 2a str. 2457T
gcucggucacugaca

SEQ ID NO: 1894021 - RNA, 12 nt, Shigella flexneri 2a str. 2457T
gcucugccagac

SEQ ID NO: 1894022 - RNA, 14 nt, Shigella flexneri 2a str. 2457T
gcucugcgguaucg

SEQ ID NO: 1894023 - RNA, 19 nt, Shigella flexneri 2a str. 2457T
gcucugcgcgugcaguggu

SEQ ID NO: 1894024 - RNA, 15 nt, Shigella flexneri 2a str. 2457T
gcucuucuucgcgau

SEQ ID NO: 1894025 - RNA, 15 nt, Shigella flexneri 2a str. 2457T
gcucuucaaugguca

SEQ ID NO: 1894026 - RNA, 19 nt, Shigella flexneri 2a str. 2457T
gcugcauggcaauuuucgu

SEQ ID NO: 1894027 - RNA, 13 nt, Shigella flexneri 2a str. 2457T
gcugcauccgcgc

SEQ ID NO: 1894028 - RNA, 14 nt, Shigella flexneri 2a str. 2457T
gcugcaucugaaac

SEQ ID NO: 1894029 - RNA, 20 nt, Shigella flexneri 2a str. 2457T
gcugcauacggugaaagucc

SEQ ID NO: 1894030 - RNA, 22 nt, Shigella flexneri 2a str. 2457T
gcugcaggaauaaucagcaacg

SEQ ID NO: 1894031 - RNA, 17 nt, Shigella flexneri 2a str. 2457T
gcugcacgaugacugaa

SEQ ID NO: 1894032 - RNA, 15 nt, Shigella flexneri 2a str. 2457T
gcugccgacgccagu

SEQ ID NO: 1894033 - RNA, 21 nt, Shigella flexneri 2a str. 2457T
gcugcaaacccugagcgguua

SEQ ID NO: 1894034 - RNA, 14 nt, Shigella flexneri 2a str. 2457T
gcugauuccugcaa

SEQ ID NO: 1894035 - RNA, 22 nt, Shigella flexneri 2a str. 2457T
gcugauuaccuuccugccagau

SEQ ID NO: 1894036 - RNA, 17 nt, Shigella flexneri 2a str. 2457T
gcugauguucgccagau

SEQ ID NO: 1894037 - RNA, 14 nt, Shigella flexneri 2a str. 2457T
gcugaauaccgauu

SEQ ID NO: 1894038 - RNA, 22 nt, Shigella flexneri 2a str. 2457T
gcugaaagcgccgggaaugcca

SEQ ID NO: 1894039 - RNA, 15 nt, Shigella flexneri 2a str. 2457T
gcucuuucagcaccg

SEQ ID NO: 1894040 - RNA, 21 nt, Shigella flexneri 2a str. 2457T
gcugaagaaaauggccagcca

SEQ ID NO: 1894041 - RNA, 22 nt, Shigella flexneri 2a str. 2457T
gcugaagcagaaagcggaucag

SEQ ID NO: 1894042 - RNA, 16 nt, Shigella flexneri 2a str. 2457T
gcuaucgaggcucuga

SEQ ID NO: 1894043 - RNA, 16 nt, Shigella flexneri 2a str. 2457T
gcuauauuuugccgga

SEQ ID NO: 1894044 - RNA, 23 nt, Shigella flexneri 2a str. 2457T
gcuaucuucgauaaacucaauca

SEQ ID NO: 1894045 - RNA, 15 nt, Shigella flexneri 2a str. 2457T
gcucaaugugcugag

SEQ ID NO: 1894046 - RNA, 15 nt, Shigella flexneri 2a str. 2457T
gcucaaagccgucga

SEQ ID NO: 1894047 - RNA, 20 nt, Shigella flexneri 2a str. 2457T
gcuauuuuuugcaggccaga

SEQ ID NO: 1894048 - RNA, 21 nt, Shigella flexneri 2a str. 2457T
gcuauuuaccacuacugcguc

SEQ ID NO: 1894049 - RNA, 14 nt, Shigella flexneri 2a str. 2457T
gcuaccggcaaacu

SEQ ID NO: 1894050 - RNA, 22 nt, Shigella flexneri 2a str. 2457T
gcguugcacgcagacacugcug

SEQ ID NO: 1894051 - RNA, 13 nt, Shigella flexneri 2a str. 2457T
gcguugcagcagg

SEQ ID NO: 1894052 - RNA, 20 nt, Shigella flexneri 2a str. 2457T
gcguugaugauuugucgaua

SEQ ID NO: 1894053 - RNA, 15 nt, Shigella flexneri 2a str. 2457T
gcguugauuggcgca

SEQ ID NO: 1894054 - RNA, 17 nt, Shigella flexneri 2a str. 2457T
gcuaccuugcucggcgc

SEQ ID NO: 1894055 - RNA, 17 nt, Shigella flexneri 2a str. 2457T
gcuacgccagcaagggu

SEQ ID NO: 1894056 - RNA, 21 nt, Shigella flexneri 2a str. 2457T
gcuacgcuaauuuugccauca

SEQ ID NO: 1894057 - RNA, 12 nt, Shigella flexneri 2a str. 2457T
gcuacggcauga

SEQ ID NO: 1894058 - RNA, 18 nt, Shigella flexneri 2a str. 2457T
gcucacugcaaaacaggu

SEQ ID NO: 1894059 - RNA, 20 nt, Shigella flexneri 2a str. 2457T
gcucacuacggcucaguaau

SEQ ID NO: 1894060 - RNA, 15 nt, Shigella flexneri 2a str. 2457T
gcucaccugauacgc

SEQ ID NO: 1894061 - RNA, 15 nt, Shigella flexneri 2a str. 2457T
gcucauuuuccggga

SEQ ID NO: 1894062 - RNA, 17 nt, Shigella flexneri 2a str. 2457T
gcucauuuucucuuuca

SEQ ID NO: 1894063 - RNA, 13 nt, Shigella flexneri 2a str. 2457T
gcucauuauuugc

SEQ ID NO: 1894064 - RNA, 20 nt, Shigella flexneri 2a str. 2457T
gcucaucgccuuccagcgau

SEQ ID NO: 1894065 - RNA, 17 nt, Shigella flexneri 2a str. 2457T
gcucaucugcugcguuu

SEQ ID NO: 1894066 - RNA, 15 nt, Shigella flexneri 2a str. 2457T
gcucauaaccgucca

SEQ ID NO: 1894067 - RNA, 20 nt, Shigella flexneri 2a str. 2457T
gcucauaaaaucacgcgccu

SEQ ID NO: 1894068 - RNA, 13 nt, Shigella flexneri 2a str. 2457T
gcucauccagcgu

SEQ ID NO: 1894069 - RNA, 15 nt, Shigella flexneri 2a str. 2457T
gcucaucaauacgcc

SEQ ID NO: 1894070 - RNA, 14 nt, Shigella flexneri 2a str. 2457T
gcgucgccagcgcg

SEQ ID NO: 1894071 - RNA, 18 nt, Shigella flexneri 2a str. 2457T
gcgucgcaucaggcauca

SEQ ID NO: 1894072 - RNA, 14 nt, Shigella flexneri 2a str. 2457T
gcgucgcauccgac

SEQ ID NO: 1894073 - RNA, 20 nt, Shigella flexneri 2a str. 2457T
gcgucguccccacagcguca

SEQ ID NO: 1894074 - RNA, 21 nt, Shigella flexneri 2a str. 2457T
gcguuaacugcuuaucaucac

SEQ ID NO: 1894075 - RNA, 15 nt, Shigella flexneri 2a str. 2457T
gcguuacccauucaa

SEQ ID NO: 1894076 - RNA, 18 nt, Shigella flexneri 2a str. 2457T
gcguuagcaucgcaucag

SEQ ID NO: 1894077 - RNA, 21 nt, Shigella flexneri 2a str. 2457T
gcguucagugaucgccugcau

SEQ ID NO: 1894078 - RNA, 19 nt, Shigella flexneri 2a str. 2457T
gcguucauccaacaauagu

SEQ ID NO: 1894079 - RNA, 15 nt, Shigella flexneri 2a str. 2457T
gcguuccccagaagc

SEQ ID NO: 1894080 - RNA, 21 nt, Shigella flexneri 2a str. 2457T
gcgugcaguggugcgaucucg

SEQ ID NO: 1894081 - RNA, 18 nt, Shigella flexneri 2a str. 2457T
gcggcgauauccagcgcg

SEQ ID NO: 1894082 - RNA, 14 nt, Shigella flexneri 2a str. 2457T
gcggcgagcaucgc

SEQ ID NO: 1894083 - RNA, 17 nt, Shigella flexneri 2a str. 2457T
gcggcgaauguuccauc

SEQ ID NO: 1894084 - RNA, 14 nt, Shigella flexneri 2a str. 2457T
gcggcucaccugca

SEQ ID NO: 1894085 - RNA, 18 nt, Shigella flexneri 2a str. 2457T
gcggcguaaacgccuuau

SEQ ID NO: 1894086 - RNA, 18 nt, Shigella flexneri 2a str. 2457T
gcggcgugaacgccuuau

SEQ ID NO: 1894087 - RNA, 19 nt, Shigella flexneri 2a str. 2457T
gcgggaugccagucaauga

SEQ ID NO: 1894088 - RNA, 14 nt, Shigella flexneri 2a str. 2457T
gcggcuuuuuacgc

SEQ ID NO: 1894089 - RNA, 21 nt, Shigella flexneri 2a str. 2457T
gcgggucaccgcgguguauac

SEQ ID NO: 1894090 - RNA, 18 nt, Shigella flexneri 2a str. 2457T
gcggguuagucugcauuu

SEQ ID NO: 1894091 - RNA, 16 nt, Shigella flexneri 2a str. 2457T
gcgguaacauccagau

SEQ ID NO: 1894092 - RNA, 17 nt, Shigella flexneri 2a str. 2457T
gcgguaaaccguuauca

SEQ ID NO: 1894093 - RNA, 17 nt, Shigella flexneri 2a str. 2457T
gcggugaccagcagcau

SEQ ID NO: 1894094 - RNA, 23 nt, Shigella flexneri 2a str. 2457T
gcggugucuaacgaugccagcac

SEQ ID NO: 1894095 - RNA, 20 nt, Shigella flexneri 2a str. 2457T
gcgguacaccaaagcgguaa

SEQ ID NO: 1894096 - RNA, 17 nt, Shigella flexneri 2a str. 2457T
gcgguacaccaaagcgg

SEQ ID NO: 1894097 - RNA, 14 nt, Shigella flexneri 2a str. 2457T
gcgcggcggguaac

SEQ ID NO: 1894098 - RNA, 13 nt, Shigella flexneri 2a str. 2457T
gcgcgucaacugu

SEQ ID NO: 1894099 - RNA, 23 nt, Shigella flexneri 2a str. 2457T
gcgcgguaucaccacccagcggu

SEQ ID NO: 1894100 - RNA, 20 nt, Shigella flexneri 2a str. 2457T
gcgcuauaucgcugauauca

SEQ ID NO: 1894101 - RNA, 15 nt, Shigella flexneri 2a str. 2457T
gcgcuacggccgcca

SEQ ID NO: 1894102 - RNA, 21 nt, Shigella flexneri 2a str. 2457T
gcgcucauuuucucuuucagc

SEQ ID NO: 1894103 - RNA, 15 nt, Shigella flexneri 2a str. 2457T
gcgcugacauuacgc

SEQ ID NO: 1894104 - RNA, 16 nt, Shigella flexneri 2a str. 2457T
gcgcugaauguuugca

SEQ ID NO: 1894105 - RNA, 14 nt, Shigella flexneri 2a str. 2457T
gcgcugcauuacua

SEQ ID NO: 1894106 - RNA, 22 nt, Shigella flexneri 2a str. 2457T
gcgcugcuuguuccacuucauc

SEQ ID NO: 1894107 - RNA, 23 nt, Shigella flexneri 2a str. 2457T
gcgcucugacugaaccuucacgc

SEQ ID NO: 1894108 - RNA, 12 nt, Shigella flexneri 2a str. 2457T
gcgcucugguag

SEQ ID NO: 1894109 - RNA, 20 nt, Shigella flexneri 2a str. 2457T
gcggcaagaucgcgaugggu

SEQ ID NO: 1894110 - RNA, 21 nt, Shigella flexneri 2a str. 2457T
gcggcacagcggaguaaucgc

SEQ ID NO: 1894111 - RNA, 20 nt, Shigella flexneri 2a str. 2457T
gcggcaaaaucgccggugau

SEQ ID NO: 1894112 - RNA, 16 nt, Shigella flexneri 2a str. 2457T
gcggcaaacaguuucu

SEQ ID NO: 1894113 - RNA, 12 nt, Shigella flexneri 2a str. 2457T
gcggauggcgaa

SEQ ID NO: 1894114 - RNA, 21 nt, Shigella flexneri 2a str. 2457T
gcggauaggaaucagcaguuc

SEQ ID NO: 1894115 - RNA, 13 nt, Shigella flexneri 2a str. 2457T
gcggacugaauac

SEQ ID NO: 1894116 - RNA, 20 nt, Shigella flexneri 2a str. 2457T
gcggagcucccaggcuccgc

SEQ ID NO: 1894117 - RNA, 15 nt, Shigella flexneri 2a str. 2457T
gcggaacccagcgcg

SEQ ID NO: 1894118 - RNA, 15 nt, Shigella flexneri 2a str. 2457T
gcgcuggcggcuggg

SEQ ID NO: 1894119 - RNA, 14 nt, Shigella flexneri 2a str. 2457T
gcggaaucaccggc

SEQ ID NO: 1894120 - RNA, 18 nt, Shigella flexneri 2a str. 2457T
gcggaauaacgcgaucgc

SEQ ID NO: 1894121 - RNA, 13 nt, Shigella flexneri 2a str. 2457T
gcgcccgccagca

SEQ ID NO: 1894122 - RNA, 18 nt, Shigella flexneri 2a str. 2457T
gcgccaucaaugccgcaa

SEQ ID NO: 1894123 - RNA, 18 nt, Shigella flexneri 2a str. 2457T
gcgccagcggccagcgca

SEQ ID NO: 1894124 - RNA, 15 nt, Shigella flexneri 2a str. 2457T
gcgcaccagaauacc

SEQ ID NO: 1894125 - RNA, 12 nt, Shigella flexneri 2a str. 2457T
gcgcaccagcgu

SEQ ID NO: 1894126 - RNA, 14 nt, Shigella flexneri 2a str. 2457T
gcgcaccagcguca

SEQ ID NO: 1894127 - RNA, 16 nt, Shigella flexneri 2a str. 2457T
gcgccacauccggcau

SEQ ID NO: 1894128 - RNA, 17 nt, Shigella flexneri 2a str. 2457T
gcgccaaucagcgcagc

SEQ ID NO: 1894129 - RNA, 15 nt, Shigella flexneri 2a str. 2457T
gcgccacauccggca

SEQ ID NO: 1894130 - RNA, 14 nt, Shigella flexneri 2a str. 2457T
gcgcgaagcccuca

SEQ ID NO: 1894131 - RNA, 17 nt, Shigella flexneri 2a str. 2457T
gcgcgaagcuggcggcg

SEQ ID NO: 1894132 - RNA, 23 nt, Shigella flexneri 2a str. 2457T
gcgccuuuaauauuaacgccagc

SEQ ID NO: 1894133 - RNA, 15 nt, Shigella flexneri 2a str. 2457T
gcgccuuuaccagac

SEQ ID NO: 1894134 - RNA, 22 nt, Shigella flexneri 2a str. 2457T
gcgaccggcgucgcauccggca

SEQ ID NO: 1894135 - RNA, 17 nt, Shigella flexneri 2a str. 2457T
gcgaccaggccggugau

SEQ ID NO: 1894136 - RNA, 20 nt, Shigella flexneri 2a str. 2457T
gcgacauaucauuuugcugc

SEQ ID NO: 1894137 - RNA, 13 nt, Shigella flexneri 2a str. 2457T
gcgaaucaaccgc

SEQ ID NO: 1894138 - RNA, 14 nt, Shigella flexneri 2a str. 2457T
gcgaauagcgucua

SEQ ID NO: 1894139 - RNA, 15 nt, Shigella flexneri 2a str. 2457T
gcgaaguagacagcg

SEQ ID NO: 1894140 - RNA, 19 nt, Shigella flexneri 2a str. 2457T
gccuugucaucgucggccu

SEQ ID NO: 1894141 - RNA, 23 nt, Shigella flexneri 2a str. 2457T
gcgaccuacacgccuucuccggc

SEQ ID NO: 1894142 - RNA, 21 nt, Shigella flexneri 2a str. 2457T
gcgacgcuugcagcgucuuau

SEQ ID NO: 1894143 - RNA, 17 nt, Shigella flexneri 2a str. 2457T
gcgacgcuugccgcguc

SEQ ID NO: 1894144 - RNA, 17 nt, Shigella flexneri 2a str. 2457T
gcgacgcuuaccgcguc

SEQ ID NO: 1894145 - RNA, 21 nt, Shigella flexneri 2a str. 2457T
gcgacgcuugccgcgucuuau

SEQ ID NO: 1894146 - RNA, 20 nt, Shigella flexneri 2a str. 2457T
gcgacgcuugcgcgucuuau

SEQ ID NO: 1894147 - RNA, 14 nt, Shigella flexneri 2a str. 2457T
gcgacgcuguccgc

SEQ ID NO: 1894148 - RNA, 21 nt, Shigella flexneri 2a str. 2457T
gcgacgcuguccgcgucuuau

SEQ ID NO: 1894149 - RNA, 14 nt, Shigella flexneri 2a str. 2457T
gcgacguagcccgg

SEQ ID NO: 1894150 - RNA, 14 nt, Shigella flexneri 2a str. 2457T
gcgagacaacaaag

SEQ ID NO: 1894151 - RNA, 19 nt, Shigella flexneri 2a str. 2457T
gcgauugucauucgccuga

SEQ ID NO: 1894152 - RNA, 22 nt, Shigella flexneri 2a str. 2457T
gcgaugguacuucaaucgccac

SEQ ID NO: 1894153 - RNA, 19 nt, Shigella flexneri 2a str. 2457T
gcgcaaaggccagcaaucc

SEQ ID NO: 1894154 - RNA, 20 nt, Shigella flexneri 2a str. 2457T
gcgcaaaucagauugccaca

SEQ ID NO: 1894155 - RNA, 18 nt, Shigella flexneri 2a str. 2457T
gcgcaaaggccagcaauc

SEQ ID NO: 1894156 - RNA, 18 nt, Shigella flexneri 2a str. 2457T
gcgcaacauccgcuuucg

SEQ ID NO: 1894157 - RNA, 21 nt, Shigella flexneri 2a str. 2457T
gcgcacaggcaauccagcucg

SEQ ID NO: 1894158 - RNA, 13 nt, Shigella flexneri 2a str. 2457T
gcgcaaugcguuu

SEQ ID NO: 1894159 - RNA, 12 nt, Shigella flexneri 2a str. 2457T
gcgcaauugcca

SEQ ID NO: 1894160 - RNA, 16 nt, Shigella flexneri 2a str. 2457T
gcgcaauugccagaca

SEQ ID NO: 1894161 - RNA, 15 nt, Shigella flexneri 2a str. 2457T
gcgcaaucagcaccg

SEQ ID NO: 1894162 - RNA, 13 nt, Shigella flexneri 2a str. 2457T
gcgaucaggcauu

SEQ ID NO: 1894163 - RNA, 17 nt, Shigella flexneri 2a str. 2457T
gcgauccugauacagac

SEQ ID NO: 1894164 - RNA, 16 nt, Shigella flexneri 2a str. 2457T
gcgaucucgucagcau

SEQ ID NO: 1894165 - RNA, 21 nt, Shigella flexneri 2a str. 2457T
gcgaugacagucuggaagcca

SEQ ID NO: 1894166 - RNA, 16 nt, Shigella flexneri 2a str. 2457T
gccugggugcaaucaa

SEQ ID NO: 1894167 - RNA, 18 nt, Shigella flexneri 2a str. 2457T
gccugcucaagcguuuca

SEQ ID NO: 1894168 - RNA, 16 nt, Shigella flexneri 2a str. 2457T
gccugcucccgaaccu

SEQ ID NO: 1894169 - RNA, 14 nt, Shigella flexneri 2a str. 2457T
gccuuaccacucug

SEQ ID NO: 1894170 - RNA, 13 nt, Shigella flexneri 2a str. 2457T
gccuuauccggcc

SEQ ID NO: 1894171 - RNA, 18 nt, Shigella flexneri 2a str. 2457T
gccuucccuuucagcaaa

SEQ ID NO: 1894172 - RNA, 16 nt, Shigella flexneri 2a str. 2457T
gccuuccgucagcaaa

SEQ ID NO: 1894173 - RNA, 16 nt, Shigella flexneri 2a str. 2457T
gccugaauauccagau

SEQ ID NO: 1894174 - RNA, 23 nt, Shigella flexneri 2a str. 2457T
gccugaugcgacgcuugcagcgu

SEQ ID NO: 1894175 - RNA, 13 nt, Shigella flexneri 2a str. 2457T
gccugaugcgacg

SEQ ID NO: 1894176 - RNA, 14 nt, Shigella flexneri 2a str. 2457T
gccugaugcgacgc

SEQ ID NO: 1894177 - RNA, 18 nt, Shigella flexneri 2a str. 2457T
gccugaugcgcugcgcuu

SEQ ID NO: 1894178 - RNA, 22 nt, Shigella flexneri 2a str. 2457T
gccugaugcgcugcgcuuauca

SEQ ID NO: 1894179 - RNA, 19 nt, Shigella flexneri 2a str. 2457T
gccugaugcgcuaugcuua

SEQ ID NO: 1894180 - RNA, 22 nt, Shigella flexneri 2a str. 2457T
gccugaugcgcuacgcuuauca

SEQ ID NO: 1894181 - RNA, 23 nt, Shigella flexneri 2a str. 2457T
gccugaugcgacgcuugccgcgu

SEQ ID NO: 1894182 - RNA, 22 nt, Shigella flexneri 2a str. 2457T
gccugaugcgacgcuugcgcgu

SEQ ID NO: 1894183 - RNA, 15 nt, Shigella flexneri 2a str. 2457T
gccugauaagcgcag

SEQ ID NO: 1894184 - RNA, 23 nt, Shigella flexneri 2a str. 2457T
gccugauaagcgcagcgcaucag

SEQ ID NO: 1894185 - RNA, 23 nt, Shigella flexneri 2a str. 2457T
gccugauaaguguagcgcaucag

SEQ ID NO: 1894186 - RNA, 16 nt, Shigella flexneri 2a str. 2457T
gccugcauacguuuca

SEQ ID NO: 1894187 - RNA, 13 nt, Shigella flexneri 2a str. 2457T
gccugaugcguug

SEQ ID NO: 1894188 - RNA, 14 nt, Shigella flexneri 2a str. 2457T
gccugaugcguugc

SEQ ID NO: 1894189 - RNA, 16 nt, Shigella flexneri 2a str. 2457T
gccugcaaacgcuuua

SEQ ID NO: 1894190 - RNA, 12 nt, Shigella flexneri 2a str. 2457T
gccgguucccag

SEQ ID NO: 1894191 - RNA, 17 nt, Shigella flexneri 2a str. 2457T
gccguaaaucaccauug

SEQ ID NO: 1894192 - RNA, 17 nt, Shigella flexneri 2a str. 2457T
gccgguugucaggaagc

SEQ ID NO: 1894193 - RNA, 23 nt, Shigella flexneri 2a str. 2457T
gccuacgacuuucuccgcauccg

SEQ ID NO: 1894194 - RNA, 21 nt, Shigella flexneri 2a str. 2457T
gccucauccauacggcagaga

SEQ ID NO: 1894195 - RNA, 21 nt, Shigella flexneri 2a str. 2457T
gccguuugcugcuccugcggc

SEQ ID NO: 1894196 - RNA, 20 nt, Shigella flexneri 2a str. 2457T
gccguuuuuacccagcagca

SEQ ID NO: 1894197 - RNA, 17 nt, Shigella flexneri 2a str. 2457T
gccguuaacccgucugg

SEQ ID NO: 1894198 - RNA, 20 nt, Shigella flexneri 2a str. 2457T
gccguuauacaucgcuuucc

SEQ ID NO: 1894199 - RNA, 13 nt, Shigella flexneri 2a str. 2457T
gccgugugcaaua

SEQ ID NO: 1894200 - RNA, 19 nt, Shigella flexneri 2a str. 2457T
gccgugcugugugccgcga

SEQ ID NO: 1894201 - RNA, 16 nt, Shigella flexneri 2a str. 2457T
gccgugcccaacugcc

SEQ ID NO: 1894202 - RNA, 21 nt, Shigella flexneri 2a str. 2457T
gggcacagauuuccaagcgcg

SEQ ID NO: 1894203 - RNA, 13 nt, Shigella flexneri 2a str. 2457T
gggccaacuggca

SEQ ID NO: 1894204 - RNA, 23 nt, Shigella flexneri 2a str. 2457T
ggcucgguaaaaucaacgccgca

SEQ ID NO: 1894205 - RNA, 17 nt, Shigella flexneri 2a str. 2457T
ggcugugaaccgcacag

SEQ ID NO: 1894206 - RNA, 13 nt, Shigella flexneri 2a str. 2457T
ggcuugcgcgcaa

SEQ ID NO: 1894207 - RNA, 17 nt, Shigella flexneri 2a str. 2457T
ggcuuccuuaagccgcu

SEQ ID NO: 1894208 - RNA, 16 nt, Shigella flexneri 2a str. 2457T
ggcuuauggcucgcca

SEQ ID NO: 1894209 - RNA, 18 nt, Shigella flexneri 2a str. 2457T
gggauauccacugucaaa

SEQ ID NO: 1894210 - RNA, 21 nt, Shigella flexneri 2a str. 2457T
ggguacagcacgaugaaucug

SEQ ID NO: 1894211 - RNA, 21 nt, Shigella flexneri 2a str. 2457T
gggcugauaaacaagcguaca

SEQ ID NO: 1894212 - RNA, 23 nt, Shigella flexneri 2a str. 2457T
gggcuuugcuacagccuggugaa

SEQ ID NO: 1894213 - RNA, 18 nt, Shigella flexneri 2a str. 2457T
ggcguccuggaacuggug

SEQ ID NO: 1894214 - RNA, 13 nt, Shigella flexneri 2a str. 2457T
ggcguccagugcc

SEQ ID NO: 1894215 - RNA, 18 nt, Shigella flexneri 2a str. 2457T
ggcggugccaucgauaau

SEQ ID NO: 1894216 - RNA, 16 nt, Shigella flexneri 2a str. 2457T
ggcgggcaacguucca

SEQ ID NO: 1894217 - RNA, 19 nt, Shigella flexneri 2a str. 2457T
ggcuccgguuaacgccgcg

SEQ ID NO: 1894218 - RNA, 20 nt, Shigella flexneri 2a str. 2457T
ggcucaugcuguccagguua

SEQ ID NO: 1894219 - RNA, 14 nt, Shigella flexneri 2a str. 2457T
ggcucaucggguaa

SEQ ID NO: 1894220 - RNA, 14 nt, Shigella flexneri 2a str. 2457T
ggcuccagcaaugu

SEQ ID NO: 1894221 - RNA, 15 nt, Shigella flexneri 2a str. 2457T
ggcguucacgccgca

SEQ ID NO: 1894222 - RNA, 13 nt, Shigella flexneri 2a str. 2457T
ggcuaaucgccag

SEQ ID NO: 1894223 - RNA, 19 nt, Shigella flexneri 2a str. 2457T
ggcgcuacaauugaucgca

SEQ ID NO: 1894224 - RNA, 13 nt, Shigella flexneri 2a str. 2457T
ggcgcugaucuua

SEQ ID NO: 1894225 - RNA, 20 nt, Shigella flexneri 2a str. 2457T
ggcgcucugcccaugcuggu

SEQ ID NO: 1894226 - RNA, 16 nt, Shigella flexneri 2a str. 2457T
ggcggaauagcguacg

SEQ ID NO: 1894227 - RNA, 15 nt, Shigella flexneri 2a str. 2457T
ggcggaauaccgaca

SEQ ID NO: 1894228 - RNA, 20 nt, Shigella flexneri 2a str. 2457T
ggcgggaagaacggcaacua

SEQ ID NO: 1894229 - RNA, 19 nt, Shigella flexneri 2a str. 2457T
ggccauccgcgugacgcug

SEQ ID NO: 1894230 - RNA, 14 nt, Shigella flexneri 2a str. 2457T
ggccagagcaucag

SEQ ID NO: 1894231 - RNA, 20 nt, Shigella flexneri 2a str. 2457T
ggccagauaagacgcgucag

SEQ ID NO: 1894232 - RNA, 23 nt, Shigella flexneri 2a str. 2457T
ggcauguggcggcgcgaggcgaa

SEQ ID NO: 1894233 - RNA, 12 nt, Shigella flexneri 2a str. 2457T
ggcauucagcca

SEQ ID NO: 1894234 - RNA, 20 nt, Shigella flexneri 2a str. 2457T
ggcaucagcaacacgcugcu

SEQ ID NO: 1894235 - RNA, 18 nt, Shigella flexneri 2a str. 2457T
ggcaucaccaucgggccu

SEQ ID NO: 1894236 - RNA, 16 nt, Shigella flexneri 2a str. 2457T
ggcauacuuugauuaa

SEQ ID NO: 1894237 - RNA, 13 nt, Shigella flexneri 2a str. 2457T
ggcauauucgcgc

SEQ ID NO: 1894238 - RNA, 17 nt, Shigella flexneri 2a str. 2457T
ggccaauaacccgcugu

SEQ ID NO: 1894239 - RNA, 20 nt, Shigella flexneri 2a str. 2457T
ggccaacgauaauucagcaa

SEQ ID NO: 1894240 - RNA, 15 nt, Shigella flexneri 2a str. 2457T
ggcagagcaacauac

SEQ ID NO: 1894241 - RNA, 16 nt, Shigella flexneri 2a str. 2457T
ggcagauugagcguca

SEQ ID NO: 1894242 - RNA, 15 nt, Shigella flexneri 2a str. 2457T
ggcagguuaaugacc

SEQ ID NO: 1894243 - RNA, 13 nt, Shigella flexneri 2a str. 2457T
ggcaggucaucgu

SEQ ID NO: 1894244 - RNA, 21 nt, Shigella flexneri 2a str. 2457T
ggccuacaaaaucuauugcaa

SEQ ID NO: 1894245 - RNA, 20 nt, Shigella flexneri 2a str. 2457T
ggccuacaacuccguugaaa

SEQ ID NO: 1894246 - RNA, 13 nt, Shigella flexneri 2a str. 2457T
ggccguuuucaac

SEQ ID NO: 1894247 - RNA, 20 nt, Shigella flexneri 2a str. 2457T
ggccguuaggaccgguuuca

SEQ ID NO: 1894248 - RNA, 21 nt, Shigella flexneri 2a str. 2457T
ggccuacaucguuccugcaau

SEQ ID NO: 1894249 - RNA, 20 nt, Shigella flexneri 2a str. 2457T
ggccuacagcauauaaugca

SEQ ID NO: 1894250 - RNA, 20 nt, Shigella flexneri 2a str. 2457T
ggccuacaucguuccugcaa

SEQ ID NO: 1894251 - RNA, 19 nt, Shigella flexneri 2a str. 2457T
ggccuacauagucccugca

SEQ ID NO: 1894252 - RNA, 14 nt, Shigella flexneri 2a str. 2457T
ggccuacacaugcg

SEQ ID NO: 1894253 - RNA, 16 nt, Shigella flexneri 2a str. 2457T
ggccuaacaccaucag

SEQ ID NO: 1894254 - RNA, 14 nt, Shigella flexneri 2a str. 2457T
ggccgguaacgcuu

SEQ ID NO: 1894255 - RNA, 20 nt, Shigella flexneri 2a str. 2457T
ggccugauaaguguagcgca

SEQ ID NO: 1894256 - RNA, 20 nt, Shigella flexneri 2a str. 2457T
ggccuuaaugcccacgccgu

SEQ ID NO: 1894257 - RNA, 21 nt, Shigella flexneri 2a str. 2457T
ggcgauugucguguuaagccg

SEQ ID NO: 1894258 - RNA, 16 nt, Shigella flexneri 2a str. 2457T
ggcgauaaucucaaua

SEQ ID NO: 1894259 - RNA, 22 nt, Shigella flexneri 2a str. 2457T
ggcgauaaucagcgccagcgcg

SEQ ID NO: 1894260 - RNA, 15 nt, Shigella flexneri 2a str. 2457T
ggcgagaaacgcuuu

SEQ ID NO: 1894261 - RNA, 14 nt, Shigella flexneri 2a str. 2457T
ggcgagcaucgccc

SEQ ID NO: 1894262 - RNA, 14 nt, Shigella flexneri 2a str. 2457T
ggcgagagacgcuu

SEQ ID NO: 1894263 - RNA, 14 nt, Shigella flexneri 2a str. 2457T
ggcgagauaaugcg

SEQ ID NO: 1894264 - RNA, 17 nt, Shigella flexneri 2a str. 2457T
ggucgaugcgcucgcca

SEQ ID NO: 1894265 - RNA, 22 nt, Shigella flexneri 2a str. 2457T
gggugaccgaaggcgauaucug

SEQ ID NO: 1894266 - RNA, 16 nt, Shigella flexneri 2a str. 2457T
ggucaggaaacuugcg

SEQ ID NO: 1894267 - RNA, 15 nt, Shigella flexneri 2a str. 2457T
ggucggcaaacugcu

SEQ ID NO: 1894268 - RNA, 14 nt, Shigella flexneri 2a str. 2457T
ggucugacgcugaa

SEQ ID NO: 1894269 - RNA, 17 nt, Shigella flexneri 2a str. 2457T
ggucugccaacuuugcc

SEQ ID NO: 1894270 - RNA, 22 nt, Shigella flexneri 2a str. 2457T
ggucgucaaaaaacuucuucac

SEQ ID NO: 1894271 - RNA, 14 nt, Shigella flexneri 2a str. 2457T
gguucugcggguua

SEQ ID NO: 1894272 - RNA, 22 nt, Shigella flexneri 2a str. 2457T
gguucucgucauccuaaacgcu

SEQ ID NO: 1894273 - RNA, 20 nt, Shigella flexneri 2a str. 2457T
gguguucagauggccaauaa

SEQ ID NO: 1894274 - RNA, 21 nt, Shigella flexneri 2a str. 2457T
gguguuacccgcuaacuggug

SEQ ID NO: 1894275 - RNA, 15 nt, Shigella flexneri 2a str. 2457T
guaaacgcagcauca

SEQ ID NO: 1894276 - RNA, 20 nt, Shigella flexneri 2a str. 2457T
guaaacgcccaauccggccu

SEQ ID NO: 1894277 - RNA, 17 nt, Shigella flexneri 2a str. 2457T
guaaacgaugaugcggc

SEQ ID NO: 1894278 - RNA, 12 nt, Shigella flexneri 2a str. 2457T
guaaagcaauga

SEQ ID NO: 1894279 - RNA, 20 nt, Shigella flexneri 2a str. 2457T
guaaacgccuuauccagccu

SEQ ID NO: 1894280 - RNA, 20 nt, Shigella flexneri 2a str. 2457T
guaaaauggucagccagcgg

SEQ ID NO: 1894281 - RNA, 18 nt, Shigella flexneri 2a str. 2457T
guaaagccugcuggcagu

SEQ ID NO: 1894282 - RNA, 16 nt, Shigella flexneri 2a str. 2457T
guaacaaagccugcac

SEQ ID NO: 1894283 - RNA, 17 nt, Shigella flexneri 2a str. 2457T
guaacaaaugugccauu

SEQ ID NO: 1894284 - RNA, 22 nt, Shigella flexneri 2a str. 2457T
guaaccaaacguggucgccagc

SEQ ID NO: 1894285 - RNA, 13 nt, Shigella flexneri 2a str. 2457T
guaaccacgcagc

SEQ ID NO: 1894286 - RNA, 14 nt, Shigella flexneri 2a str. 2457T
guaaccacggcagc

SEQ ID NO: 1894287 - RNA, 13 nt, Shigella flexneri 2a str. 2457T
gguuuacggcggu

SEQ ID NO: 1894288 - RNA, 19 nt, Shigella flexneri 2a str. 2457T
guaaaaccccgcguacuga

SEQ ID NO: 1894289 - RNA, 12 nt, Shigella flexneri 2a str. 2457T
guaaaacgccca

SEQ ID NO: 1894290 - RNA, 14 nt, Shigella flexneri 2a str. 2457T
gguuuuuuucgaac

SEQ ID NO: 1894291 - RNA, 15 nt, Shigella flexneri 2a str. 2457T
guaaaaaaacaucau

SEQ ID NO: 1894292 - RNA, 20 nt, Shigella flexneri 2a str. 2457T
ggugccgccacgaaacugcu

SEQ ID NO: 1894293 - RNA, 18 nt, Shigella flexneri 2a str. 2457T
ggugcgaugccuggcaau

SEQ ID NO: 1894294 - RNA, 19 nt, Shigella flexneri 2a str. 2457T
ggugccuuauccgacauuu

SEQ ID NO: 1894295 - RNA, 15 nt, Shigella flexneri 2a str. 2457T
ggugcuguugccaaa

SEQ ID NO: 1894296 - RNA, 13 nt, Shigella flexneri 2a str. 2457T
gguggcgaccgga

SEQ ID NO: 1894297 - RNA, 14 nt, Shigella flexneri 2a str. 2457T
guacugaccaucag

SEQ ID NO: 1894298 - RNA, 17 nt, Shigella flexneri 2a str. 2457T
guacuggcaaucgccag

SEQ ID NO: 1894299 - RNA, 19 nt, Shigella flexneri 2a str. 2457T
guagauaagcaaggcaauc

SEQ ID NO: 1894300 - RNA, 21 nt, Shigella flexneri 2a str. 2457T
guaauaauuacuuacaucugu

SEQ ID NO: 1894301 - RNA, 18 nt, Shigella flexneri 2a str. 2457T
guaaucaacuccgccagc

SEQ ID NO: 1894302 - RNA, 18 nt, Shigella flexneri 2a str. 2457T
guaaucaaugcguucucc

SEQ ID NO: 1894303 - RNA, 18 nt, Shigella flexneri 2a str. 2457T
guaaguacgccaucacgc

SEQ ID NO: 1894304 - RNA, 13 nt, Shigella flexneri 2a str. 2457T
guaaguacgccau

SEQ ID NO: 1894305 - RNA, 18 nt, Shigella flexneri 2a str. 2457T
guaggccugauaagcgua

SEQ ID NO: 1894306 - RNA, 14 nt, Shigella flexneri 2a str. 2457T
guaggccugauaag

SEQ ID NO: 1894307 - RNA, 20 nt, Shigella flexneri 2a str. 2457T
guaggccugauaagacgcga

SEQ ID NO: 1894308 - RNA, 20 nt, Shigella flexneri 2a str. 2457T
guaggccugauaagacgcgc

SEQ ID NO: 1894309 - RNA, 20 nt, Shigella flexneri 2a str. 2457T
guaggccugauaagacgcgg

SEQ ID NO: 1894310 - RNA, 20 nt, Shigella flexneri 2a str. 2457T
guaggccugauaagacgcgu

SEQ ID NO: 1894311 - RNA, 20 nt, Shigella flexneri 2a str. 2457T
guaggccugauaagcguagc

SEQ ID NO: 1894312 - RNA, 18 nt, Shigella flexneri 2a str. 2457T
guaggccggauaaggcgu

SEQ ID NO: 1894313 - RNA, 20 nt, Shigella flexneri 2a str. 2457T
guaggccagauaauacgcgu

SEQ ID NO: 1894314 - RNA, 18 nt, Shigella flexneri 2a str. 2457T
guaggcggauaaggcguu

SEQ ID NO: 1894315 - RNA, 17 nt, Shigella flexneri 2a str. 2457T
guaggcguccugcugaa

SEQ ID NO: 1894316 - RNA, 22 nt, Shigella flexneri 2a str. 2457T
guagcuacgcaucaacugcguu

SEQ ID NO: 1894317 - RNA, 19 nt, Shigella flexneri 2a str. 2457T
guagccgaugccgcugcac

SEQ ID NO: 1894318 - RNA, 19 nt, Shigella flexneri 2a str. 2457T
guagccgcggaucacgcga

SEQ ID NO: 1894319 - RNA, 18 nt, Shigella flexneri 2a str. 2457T
gucacugcgcccuacucc

SEQ ID NO: 1894320 - RNA, 13 nt, Shigella flexneri 2a str. 2457T
gucacuucaucgu

SEQ ID NO: 1894321 - RNA, 19 nt, Shigella flexneri 2a str. 2457T
gucagaccaaaacgcgcca

SEQ ID NO: 1894322 - RNA, 23 nt, Shigella flexneri 2a str. 2457T
gucagaacgguucuugaaaauca

SEQ ID NO: 1894323 - RNA, 17 nt, Shigella flexneri 2a str. 2457T
gucaauuccuucugggc

SEQ ID NO: 1894324 - RNA, 14 nt, Shigella flexneri 2a str. 2457T
gucaauaaacgccu

SEQ ID NO: 1894325 - RNA, 15 nt, Shigella flexneri 2a str. 2457T
guauucuucagcgac

SEQ ID NO: 1894326 - RNA, 20 nt, Shigella flexneri 2a str. 2457T
gucaaaauuagagauuccgg

SEQ ID NO: 1894327 - RNA, 20 nt, Shigella flexneri 2a str. 2457T
gucaaaagaugcgcugagua

SEQ ID NO: 1894328 - RNA, 19 nt, Shigella flexneri 2a str. 2457T
guaucuggugucagcguga

SEQ ID NO: 1894329 - RNA, 19 nt, Shigella flexneri 2a str. 2457T
guaucuuuacagcgcuaac

SEQ ID NO: 1894330 - RNA, 14 nt, Shigella flexneri 2a str. 2457T
guaucgcucggcag

SEQ ID NO: 1894331 - RNA, 14 nt, Shigella flexneri 2a str. 2457T
gucccaguucaugu

SEQ ID NO: 1894332 - RNA, 18 nt, Shigella flexneri 2a str. 2457T
guccacuggucugacgcu

SEQ ID NO: 1894333 - RNA, 13 nt, Shigella flexneri 2a str. 2457T
guccacgucauca

SEQ ID NO: 1894334 - RNA, 12 nt, Shigella flexneri 2a str. 2457T
guccagccgcca

SEQ ID NO: 1894335 - RNA, 18 nt, Shigella flexneri 2a str. 2457T
gucaggcgcgugaaugcc

SEQ ID NO: 1894336 - RNA, 19 nt, Shigella flexneri 2a str. 2457T
gucaggccggcauauaccu

SEQ ID NO: 1894337 - RNA, 17 nt, Shigella flexneri 2a str. 2457T
gucagcgucagguccgu

SEQ ID NO: 1894338 - RNA, 21 nt, Shigella flexneri 2a str. 2457T
gucauuaaagccgccaaacgg

SEQ ID NO: 1894339 - RNA, 13 nt, Shigella flexneri 2a str. 2457T
gucauugacgcug

SEQ ID NO: 1894340 - RNA, 23 nt, Shigella flexneri 2a str. 2457T
gucauccuaaacgcuggcaggau

SEQ ID NO: 1894341 - RNA, 19 nt, Shigella flexneri 2a str. 2457T
gucaucccccaguggcagc

SEQ ID NO: 1894342 - RNA, 14 nt, Shigella flexneri 2a str. 2457T
gucaucaucgccac

SEQ ID NO: 1894343 - RNA, 15 nt, Shigella flexneri 2a str. 2457T
gucaguuucagccag

SEQ ID NO: 1894344 - RNA, 20 nt, Shigella flexneri 2a str. 2457T
gucauacgagucgccuguac

SEQ ID NO: 1894345 - RNA, 20 nt, Shigella flexneri 2a str. 2457T
gucaucaccuccagccugau

SEQ ID NO: 1894346 - RNA, 12 nt, Shigella flexneri 2a str. 2457T
gucaucaaucag

SEQ ID NO: 1894347 - RNA, 12 nt, Shigella flexneri 2a str. 2457T
gucauauagccg

SEQ ID NO: 1894348 - RNA, 23 nt, Shigella flexneri 2a str. 2457T
gugccauuaaugucggaugcggc

SEQ ID NO: 1894349 - RNA, 22 nt, Shigella flexneri 2a str. 2457T
gugcccaacugccugaugcgau

SEQ ID NO: 1894350 - RNA, 14 nt, Shigella flexneri 2a str. 2457T
gugccccgagcggu

SEQ ID NO: 1894351 - RNA, 20 nt, Shigella flexneri 2a str. 2457T
gugcaucauggaagcaaugu

SEQ ID NO: 1894352 - RNA, 16 nt, Shigella flexneri 2a str. 2457T
gugcaguuccugcaac

SEQ ID NO: 1894353 - RNA, 22 nt, Shigella flexneri 2a str. 2457T
gugcaccaccaaagguuaacug

SEQ ID NO: 1894354 - RNA, 18 nt, Shigella flexneri 2a str. 2457T
gugcaccgauugccggau

SEQ ID NO: 1894355 - RNA, 14 nt, Shigella flexneri 2a str. 2457T
gugcacccgcuuca

SEQ ID NO: 1894356 - RNA, 21 nt, Shigella flexneri 2a str. 2457T
gugaacugccacacaggccau

SEQ ID NO: 1894357 - RNA, 20 nt, Shigella flexneri 2a str. 2457T
gugaacgccuuauccggccu

SEQ ID NO: 1894358 - RNA, 20 nt, Shigella flexneri 2a str. 2457T
gugaacgccuuauccgaccu

SEQ ID NO: 1894359 - RNA, 20 nt, Shigella flexneri 2a str. 2457T
gugaacgccuuaucuggccu

SEQ ID NO: 1894360 - RNA, 19 nt, Shigella flexneri 2a str. 2457T
gugaacgcguuauccggcu

SEQ ID NO: 1894361 - RNA, 17 nt, Shigella flexneri 2a str. 2457T
gugauacugaucgucau

SEQ ID NO: 1894362 - RNA, 22 nt, Shigella flexneri 2a str. 2457T
gugaugcggucgcugacgccau

SEQ ID NO: 1894363 - RNA, 11 nt, Shigella flexneri 2a str. 2457T
gugauccauca

SEQ ID NO: 1894364 - RNA, 13 nt, Shigella flexneri 2a str. 2457T
gugcucaaucuga

SEQ ID NO: 1894365 - RNA, 13 nt, Shigella flexneri 2a str. 2457T
gugcucacuacgg

SEQ ID NO: 1894366 - RNA, 16 nt, Shigella flexneri 2a str. 2457T
gugcucagagcuacaa

SEQ ID NO: 1894367 - RNA, 21 nt, Shigella flexneri 2a str. 2457T
gugcucguaaguuaacugcac

SEQ ID NO: 1894368 - RNA, 18 nt, Shigella flexneri 2a str. 2457T
gugcgccacauccggcau

SEQ ID NO: 1894369 - RNA, 12 nt, Shigella flexneri 2a str. 2457T
gugcccgcgugg

SEQ ID NO: 1894370 - RNA, 17 nt, Shigella flexneri 2a str. 2457T
gugggcgcugcuguacu

SEQ ID NO: 1894371 - RNA, 16 nt, Shigella flexneri 2a str. 2457T
guggcguuuccagcag

SEQ ID NO: 1894372 - RNA, 16 nt, Shigella flexneri 2a str. 2457T
gugggaccaccgcgcu

SEQ ID NO: 1894373 - RNA, 19 nt, Shigella flexneri 2a str. 2457T
guggcaucaauaccgcgua

SEQ ID NO: 1894374 - RNA, 16 nt, Shigella flexneri 2a str. 2457T
guggccaguuccacuu

SEQ ID NO: 1894375 - RNA, 20 nt, Shigella flexneri 2a str. 2457T
guggagcaacacgccagcgu

SEQ ID NO: 1894376 - RNA, 12 nt, Shigella flexneri 2a str. 2457T
guggcaaagaaa

SEQ ID NO: 1894377 - RNA, 19 nt, Shigella flexneri 2a str. 2457T
guggcaaucguagcccagc

SEQ ID NO: 1894378 - RNA, 12 nt, Shigella flexneri 2a str. 2457T
gucuucaauagg

SEQ ID NO: 1894379 - RNA, 19 nt, Shigella flexneri 2a str. 2457T
gucuuaucuggcauuugca

SEQ ID NO: 1894380 - RNA, 18 nt, Shigella flexneri 2a str. 2457T
gugaaaauucuccggcgu

SEQ ID NO: 1894381 - RNA, 22 nt, Shigella flexneri 2a str. 2457T
gugaaaguccucucggcaagca

SEQ ID NO: 1894382 - RNA, 16 nt, Shigella flexneri 2a str. 2457T
gucucuuucaugguua

SEQ ID NO: 1894383 - RNA, 16 nt, Shigella flexneri 2a str. 2457T
gucugaugauaaucag

SEQ ID NO: 1894384 - RNA, 17 nt, Shigella flexneri 2a str. 2457T
gucugccguugccacgu

SEQ ID NO: 1894385 - RNA, 18 nt, Shigella flexneri 2a str. 2457T
gucuccgcugagacgcgc

SEQ ID NO: 1894386 - RNA, 17 nt, Shigella flexneri 2a str. 2457T
gucguuguacaaaccau

SEQ ID NO: 1894387 - RNA, 22 nt, Shigella flexneri 2a str. 2457T
gucguccgguacgacaaucuca

SEQ ID NO: 1894388 - RNA, 13 nt, Shigella flexneri 2a str. 2457T
gucgccgccuguu

SEQ ID NO: 1894389 - RNA, 20 nt, Shigella flexneri 2a str. 2457T
gucgcccgaccaucgccagc

SEQ ID NO: 1894390 - RNA, 22 nt, Shigella flexneri 2a str. 2457T
gucgcuugugguacuaucagcg

SEQ ID NO: 1894391 - RNA, 19 nt, Shigella flexneri 2a str. 2457T
gucggcacacacaucacgg

SEQ ID NO: 1894392 - RNA, 12 nt, Shigella flexneri 2a str. 2457T
gucggaugcggc

SEQ ID NO: 1894393 - RNA, 17 nt, Shigella flexneri 2a str. 2457T
gucgaucguacauggca

SEQ ID NO: 1894394 - RNA, 17 nt, Shigella flexneri 2a str. 2457T
gucgaucguuaagcgau

SEQ ID NO: 1894395 - RNA, 14 nt, Shigella flexneri 2a str. 2457T
gucgaucugacgug

SEQ ID NO: 1894396 - RNA, 14 nt, Shigella flexneri 2a str. 2457T
gucgccaucaaagg

SEQ ID NO: 1894397 - RNA, 23 nt, Shigella flexneri 2a str. 2457T
gucgcacacaacagacauuaccc

SEQ ID NO: 1894398 - RNA, 20 nt, Shigella flexneri 2a str. 2457T
guccgcaauacaucaaagcg

SEQ ID NO: 1894399 - RNA, 12 nt, Shigella flexneri 2a str. 2457T
guccgccagccu

SEQ ID NO: 1894400 - RNA, 18 nt, Shigella flexneri 2a str. 2457T
gucgacgguauaaacgug

SEQ ID NO: 1894401 - RNA, 12 nt, Shigella flexneri 2a str. 2457T
gucgacggaaua

SEQ ID NO: 1894402 - RNA, 23 nt, Shigella flexneri 2a str. 2457T
cggcggugucuaacgaugccagc

SEQ ID NO: 1894403 - RNA, 22 nt, Shigella flexneri 2a str. 2457T
cggcguaccuuugccuuccagc

SEQ ID NO: 1894404 - RNA, 16 nt, Shigella flexneri 2a str. 2457T
cggcguaaccgcccag

SEQ ID NO: 1894405 - RNA, 14 nt, Shigella flexneri 2a str. 2457T
cggcgggcgauauc

SEQ ID NO: 1894406 - RNA, 16 nt, Shigella flexneri 2a str. 2457T
cggcucaggcgcacgc

SEQ ID NO: 1894407 - RNA, 21 nt, Shigella flexneri 2a str. 2457T
cggcucaguaaaaucgacauc

SEQ ID NO: 1894408 - RNA, 16 nt, Shigella flexneri 2a str. 2457T
cggcucagccagacgc

SEQ ID NO: 1894409 - RNA, 15 nt, Shigella flexneri 2a str. 2457T
cgggcaagccagcau

SEQ ID NO: 1894410 - RNA, 16 nt, Shigella flexneri 2a str. 2457T
cgggcaacguuccagc

SEQ ID NO: 1894411 - RNA, 16 nt, Shigella flexneri 2a str. 2457T
cgggcaucaucuuccg

SEQ ID NO: 1894412 - RNA, 19 nt, Shigella flexneri 2a str. 2457T
cgggaggcgaaggugccuc

SEQ ID NO: 1894413 - RNA, 20 nt, Shigella flexneri 2a str. 2457T
cgggaucagguauaccgaaa

SEQ ID NO: 1894414 - RNA, 22 nt, Shigella flexneri 2a str. 2457T
cggucggccuucguaccaacga

SEQ ID NO: 1894415 - RNA, 18 nt, Shigella flexneri 2a str. 2457T
cggucggagguucgaauc

SEQ ID NO: 1894416 - RNA, 23 nt, Shigella flexneri 2a str. 2457T
cgguccgccguagccgguaaugg

SEQ ID NO: 1894417 - RNA, 22 nt, Shigella flexneri 2a str. 2457T
cggucauuuucuucagcaguuc

SEQ ID NO: 1894418 - RNA, 12 nt, Shigella flexneri 2a str. 2457T
cggucagcagca

SEQ ID NO: 1894419 - RNA, 16 nt, Shigella flexneri 2a str. 2457T
cgguaauccgggugaa

SEQ ID NO: 1894420 - RNA, 13 nt, Shigella flexneri 2a str. 2457T
cgguaaacguggu

SEQ ID NO: 1894421 - RNA, 14 nt, Shigella flexneri 2a str. 2457T
cggggccagcauuc

SEQ ID NO: 1894422 - RNA, 19 nt, Shigella flexneri 2a str. 2457T
cggggccagcauuccagau

SEQ ID NO: 1894423 - RNA, 24 nt, Shigella flexneri 2a str. 2457T
cggggauaagaauaucgaccgcgu

SEQ ID NO: 1894424 - RNA, 17 nt, Shigella flexneri 2a str. 2457T
cggggaucacuggcaga

SEQ ID NO: 1894425 - RNA, 14 nt, Shigella flexneri 2a str. 2457T
cggauuacccgcgc

SEQ ID NO: 1894426 - RNA, 13 nt, Shigella flexneri 2a str. 2457T
cggcaaaaccguu

SEQ ID NO: 1894427 - RNA, 17 nt, Shigella flexneri 2a str. 2457T
cggauuucauauccggc

SEQ ID NO: 1894428 - RNA, 13 nt, Shigella flexneri 2a str. 2457T
cggcaaacacgca

SEQ ID NO: 1894429 - RNA, 13 nt, Shigella flexneri 2a str. 2457T
cggcaaacacgcc

SEQ ID NO: 1894430 - RNA, 15 nt, Shigella flexneri 2a str. 2457T
cggcaaaaucuucca

SEQ ID NO: 1894431 - RNA, 23 nt, Shigella flexneri 2a str. 2457T
cggcaaaaccguucgaacuggau

SEQ ID NO: 1894432 - RNA, 17 nt, Shigella flexneri 2a str. 2457T
cggauagcguucggcaa

SEQ ID NO: 1894433 - RNA, 19 nt, Shigella flexneri 2a str. 2457T
cggauaccaccagugccau

SEQ ID NO: 1894434 - RNA, 22 nt, Shigella flexneri 2a str. 2457T
cggaguugaccagcuccagcag

SEQ ID NO: 1894435 - RNA, 15 nt, Shigella flexneri 2a str. 2457T
cggagucgcauuaac

SEQ ID NO: 1894436 - RNA, 14 nt, Shigella flexneri 2a str. 2457T
cggcagacgggcaa

SEQ ID NO: 1894437 - RNA, 22 nt, Shigella flexneri 2a str. 2457T
cggcagagugaagguuucugca

SEQ ID NO: 1894438 - RNA, 17 nt, Shigella flexneri 2a str. 2457T
cggcagcaauugucgca

SEQ ID NO: 1894439 - RNA, 15 nt, Shigella flexneri 2a str. 2457T
cggcagcaaccgcuu

SEQ ID NO: 1894440 - RNA, 13 nt, Shigella flexneri 2a str. 2457T
cggcagcaaccgc

SEQ ID NO: 1894441 - RNA, 19 nt, Shigella flexneri 2a str. 2457T
cggcaggcagcgccacgua

SEQ ID NO: 1894442 - RNA, 15 nt, Shigella flexneri 2a str. 2457T
cggcaggaucugcgc

SEQ ID NO: 1894443 - RNA, 21 nt, Shigella flexneri 2a str. 2457T
cggcagcauguguaaccgcuu

SEQ ID NO: 1894444 - RNA, 22 nt, Shigella flexneri 2a str. 2457T
cggcagccauuccgggaaacga

SEQ ID NO: 1894445 - RNA, 14 nt, Shigella flexneri 2a str. 2457T
cggcaacggcggau

SEQ ID NO: 1894446 - RNA, 17 nt, Shigella flexneri 2a str. 2457T
cggcaacguacuuacuc

SEQ ID NO: 1894447 - RNA, 19 nt, Shigella flexneri 2a str. 2457T
cggcaccaaaauucugcug

SEQ ID NO: 1894448 - RNA, 22 nt, Shigella flexneri 2a str. 2457T
cggcaccaaucaccgccagcaa

SEQ ID NO: 1894449 - RNA, 21 nt, Shigella flexneri 2a str. 2457T
cggcaauuaaaaaagcggcua

SEQ ID NO: 1894450 - RNA, 19 nt, Shigella flexneri 2a str. 2457T
cggcacaagaaaacggcac

SEQ ID NO: 1894451 - RNA, 13 nt, Shigella flexneri 2a str. 2457T
cggcaucgcucca

SEQ ID NO: 1894452 - RNA, 17 nt, Shigella flexneri 2a str. 2457T
cggcaucgcaaaccaga

SEQ ID NO: 1894453 - RNA, 22 nt, Shigella flexneri 2a str. 2457T
cggcaucgggcgaguuuccauc

SEQ ID NO: 1894454 - RNA, 15 nt, Shigella flexneri 2a str. 2457T
cggccacagccagcc

SEQ ID NO: 1894455 - RNA, 13 nt, Shigella flexneri 2a str. 2457T
cggcgacgacggu

SEQ ID NO: 1894456 - RNA, 19 nt, Shigella flexneri 2a str. 2457T
cggcgacgacgguuuccac

SEQ ID NO: 1894457 - RNA, 21 nt, Shigella flexneri 2a str. 2457T
cggcgaaagcuggcacuggga

SEQ ID NO: 1894458 - RNA, 17 nt, Shigella flexneri 2a str. 2457T
cggccggaugacagacu

SEQ ID NO: 1894459 - RNA, 14 nt, Shigella flexneri 2a str. 2457T
cggcgcgauaucga

SEQ ID NO: 1894460 - RNA, 14 nt, Shigella flexneri 2a str. 2457T
cggcgcgccaggcg

SEQ ID NO: 1894461 - RNA, 12 nt, Shigella flexneri 2a str. 2457T
cggcgcaaucgc

SEQ ID NO: 1894462 - RNA, 22 nt, Shigella flexneri 2a str. 2457T
cggcgcaauucccggaccguca

SEQ ID NO: 1894463 - RNA, 22 nt, Shigella flexneri 2a str. 2457T
cggcgcacaggcaauccagcuc

SEQ ID NO: 1894464 - RNA, 16 nt, Shigella flexneri 2a str. 2457T
cggcgcaacauccgcu

SEQ ID NO: 1894465 - RNA, 15 nt, Shigella flexneri 2a str. 2457T
cggcgcaacauccgc

SEQ ID NO: 1894466 - RNA, 14 nt, Shigella flexneri 2a str. 2457T
cggcgacggcuggc

SEQ ID NO: 1894467 - RNA, 12 nt, Shigella flexneri 2a str. 2457T
cgcugucgguac

SEQ ID NO: 1894468 - RNA, 13 nt, Shigella flexneri 2a str. 2457T
cgcuggcggcugg

SEQ ID NO: 1894469 - RNA, 14 nt, Shigella flexneri 2a str. 2457T
cgcuuccagcauuu

SEQ ID NO: 1894470 - RNA, 15 nt, Shigella flexneri 2a str. 2457T
cgcuuccagcgcauc

SEQ ID NO: 1894471 - RNA, 13 nt, Shigella flexneri 2a str. 2457T
cgcuucagccgga

SEQ ID NO: 1894472 - RNA, 13 nt, Shigella flexneri 2a str. 2457T
cgcuucaaucuga

SEQ ID NO: 1894473 - RNA, 14 nt, Shigella flexneri 2a str. 2457T
cgcuucaacagcgg

SEQ ID NO: 1894474 - RNA, 19 nt, Shigella flexneri 2a str. 2457T
cgcuucaaggugcgcgaug

SEQ ID NO: 1894475 - RNA, 19 nt, Shigella flexneri 2a str. 2457T
cgcuucacucccugcccca

SEQ ID NO: 1894476 - RNA, 11 nt, Shigella flexneri 2a str. 2457T
cgcuuccugca

SEQ ID NO: 1894477 - RNA, 17 nt, Shigella flexneri 2a str. 2457T
cgcuucgagauugcgga

SEQ ID NO: 1894478 - RNA, 22 nt, Shigella flexneri 2a str. 2457T
cgcuuaaucaauugcaggaagg

SEQ ID NO: 1894479 - RNA, 21 nt, Shigella flexneri 2a str. 2457T
cgcuguuuguucaagcgcaau

SEQ ID NO: 1894480 - RNA, 19 nt, Shigella flexneri 2a str. 2457T
cgcuuaucaggccuacgcg

SEQ ID NO: 1894481 - RNA, 23 nt, Shigella flexneri 2a str. 2457T
cgcuguguaaacccagccgcguc

SEQ ID NO: 1894482 - RNA, 19 nt, Shigella flexneri 2a str. 2457T
cgcuguguguaggccagcg

SEQ ID NO: 1894483 - RNA, 19 nt, Shigella flexneri 2a str. 2457T
cgcugucuuuugaucaaau

SEQ ID NO: 1894484 - RNA, 13 nt, Shigella flexneri 2a str. 2457T
cggaaaucacgca

SEQ ID NO: 1894485 - RNA, 20 nt, Shigella flexneri 2a str. 2457T
cggaacccaccgcaauaacc

SEQ ID NO: 1894486 - RNA, 19 nt, Shigella flexneri 2a str. 2457T
cggaagcuccaccaguucg

SEQ ID NO: 1894487 - RNA, 21 nt, Shigella flexneri 2a str. 2457T
cggaagucgcagcugccugca

SEQ ID NO: 1894488 - RNA, 18 nt, Shigella flexneri 2a str. 2457T
cggaaguaccaauggcaa

SEQ ID NO: 1894489 - RNA, 22 nt, Shigella flexneri 2a str. 2457T
cggaauaaaugucacgucaucc

SEQ ID NO: 1894490 - RNA, 17 nt, Shigella flexneri 2a str. 2457T
cgcuuuaucgccuacca

SEQ ID NO: 1894491 - RNA, 21 nt, Shigella flexneri 2a str. 2457T
cgcuugugguacuaucagcgu

SEQ ID NO: 1894492 - RNA, 17 nt, Shigella flexneri 2a str. 2457T
cgcuuucacucaguguu

SEQ ID NO: 1894493 - RNA, 22 nt, Shigella flexneri 2a str. 2457T
cgcuuuuucaauuuccaguuug

SEQ ID NO: 1894494 - RNA, 16 nt, Shigella flexneri 2a str. 2457T
cgcuuuuucugcgcac

SEQ ID NO: 1894495 - RNA, 17 nt, Shigella flexneri 2a str. 2457T
cgcuuuuggcaggaacu

SEQ ID NO: 1894496 - RNA, 15 nt, Shigella flexneri 2a str. 2457T
cgcuugcuggcgcuu

SEQ ID NO: 1894497 - RNA, 20 nt, Shigella flexneri 2a str. 2457T
cgcuugcugauaacgugcag

SEQ ID NO: 1894498 - RNA, 13 nt, Shigella flexneri 2a str. 2457T
cgcuugacgcguc

SEQ ID NO: 1894499 - RNA, 20 nt, Shigella flexneri 2a str. 2457T
cgcuucuucugccgcuucca

SEQ ID NO: 1894500 - RNA, 17 nt, Shigella flexneri 2a str. 2457T
cgcuucuucagccugca

SEQ ID NO: 1894501 - RNA, 13 nt, Shigella flexneri 2a str. 2457T
cgcuacgacguuc

SEQ ID NO: 1894502 - RNA, 16 nt, Shigella flexneri 2a str. 2457T
cgcuacggcugauggc

SEQ ID NO: 1894503 - RNA, 14 nt, Shigella flexneri 2a str. 2457T
cgcuaucagcgcca

SEQ ID NO: 1894504 - RNA, 20 nt, Shigella flexneri 2a str. 2457T
cgcuaucaauacuuuccagc

SEQ ID NO: 1894505 - RNA, 20 nt, Shigella flexneri 2a str. 2457T
cgcuaguacccgaucacaac

SEQ ID NO: 1894506 - RNA, 15 nt, Shigella flexneri 2a str. 2457T
cgcucagcaauugca

SEQ ID NO: 1894507 - RNA, 13 nt, Shigella flexneri 2a str. 2457T
cgcucaaugcgcu

SEQ ID NO: 1894508 - RNA, 15 nt, Shigella flexneri 2a str. 2457T
cgcucaaugcgcuga

SEQ ID NO: 1894509 - RNA, 19 nt, Shigella flexneri 2a str. 2457T
cgcgguguugauacaggcg

SEQ ID NO: 1894510 - RNA, 22 nt, Shigella flexneri 2a str. 2457T
cgcgguguugauacaggcgcug

SEQ ID NO: 1894511 - RNA, 15 nt, Shigella flexneri 2a str. 2457T
cgcuaagccugcuga

SEQ ID NO: 1894512 - RNA, 13 nt, Shigella flexneri 2a str. 2457T
cgcguucuguugc

SEQ ID NO: 1894513 - RNA, 13 nt, Shigella flexneri 2a str. 2457T
cgcugacagcgcg

SEQ ID NO: 1894514 - RNA, 13 nt, Shigella flexneri 2a str. 2457T
cgcugaauacgca

SEQ ID NO: 1894515 - RNA, 16 nt, Shigella flexneri 2a str. 2457T
cgcucucucaguuaau

SEQ ID NO: 1894516 - RNA, 20 nt, Shigella flexneri 2a str. 2457T
cgcucgcgccgcauccgaca

SEQ ID NO: 1894517 - RNA, 13 nt, Shigella flexneri 2a str. 2457T
cgcugcagcucug

SEQ ID NO: 1894518 - RNA, 17 nt, Shigella flexneri 2a str. 2457T
cgcugcaucgccaaucu

SEQ ID NO: 1894519 - RNA, 22 nt, Shigella flexneri 2a str. 2457T
cgcugcaaggcucuauacgcau

SEQ ID NO: 1894520 - RNA, 21 nt, Shigella flexneri 2a str. 2457T
cgcugauucaaaaccgguucu

SEQ ID NO: 1894521 - RNA, 21 nt, Shigella flexneri 2a str. 2457T
cgcugacaguacccagauuca

SEQ ID NO: 1894522 - RNA, 17 nt, Shigella flexneri 2a str. 2457T
cgcugacccuugaugug

SEQ ID NO: 1894523 - RNA, 15 nt, Shigella flexneri 2a str. 2457T
cgcugacagcgcguc

SEQ ID NO: 1894524 - RNA, 17 nt, Shigella flexneri 2a str. 2457T
cgcggguugccaccggu

SEQ ID NO: 1894525 - RNA, 19 nt, Shigella flexneri 2a str. 2457T
cgcggcuuugucauaacca

SEQ ID NO: 1894526 - RNA, 20 nt, Shigella flexneri 2a str. 2457T
cgcgggcgaauuaucggcag

SEQ ID NO: 1894527 - RNA, 12 nt, Shigella flexneri 2a str. 2457T
cgcggcucgugg

SEQ ID NO: 1894528 - RNA, 13 nt, Shigella flexneri 2a str. 2457T
cgcggacagacuu

SEQ ID NO: 1894529 - RNA, 17 nt, Shigella flexneri 2a str. 2457T
cgcggacuccgcuguua

SEQ ID NO: 1894530 - RNA, 20 nt, Shigella flexneri 2a str. 2457T
cgcggaucacgcgaccaucg

SEQ ID NO: 1894531 - RNA, 16 nt, Shigella flexneri 2a str. 2457T
cgcgcuaauuccaguc

SEQ ID NO: 1894532 - RNA, 14 nt, Shigella flexneri 2a str. 2457T
cgcgcuauugccgu

SEQ ID NO: 1894533 - RNA, 14 nt, Shigella flexneri 2a str. 2457T
cgcgcuaucggcag

SEQ ID NO: 1894534 - RNA, 13 nt, Shigella flexneri 2a str. 2457T
cgcgcucacacca

SEQ ID NO: 1894535 - RNA, 19 nt, Shigella flexneri 2a str. 2457T
cgcgcgugaaguggcacag

SEQ ID NO: 1894536 - RNA, 15 nt, Shigella flexneri 2a str. 2457T
cgcgcgaauauggcg

SEQ ID NO: 1894537 - RNA, 13 nt, Shigella flexneri 2a str. 2457T
cgcgcgcaccuga

SEQ ID NO: 1894538 - RNA, 18 nt, Shigella flexneri 2a str. 2457T
cgcgccucuuacgcgaau

SEQ ID NO: 1894539 - RNA, 16 nt, Shigella flexneri 2a str. 2457T
cgcgccuucgugcggc

SEQ ID NO: 1894540 - RNA, 17 nt, Shigella flexneri 2a str. 2457T
cgccguaaaucccgcca

SEQ ID NO: 1894541 - RNA, 19 nt, Shigella flexneri 2a str. 2457T
cgccgguugccccgcacgc

SEQ ID NO: 1894542 - RNA, 14 nt, Shigella flexneri 2a str. 2457T
cgccguaagcgcgg

SEQ ID NO: 1894543 - RNA, 19 nt, Shigella flexneri 2a str. 2457T
cgccggugauuacaucgcg

SEQ ID NO: 1894544 - RNA, 13 nt, Shigella flexneri 2a str. 2457T
cgccuaauccagc

SEQ ID NO: 1894545 - RNA, 21 nt, Shigella flexneri 2a str. 2457T
cgccguuauuaaaaagccugc

SEQ ID NO: 1894546 - RNA, 13 nt, Shigella flexneri 2a str. 2457T
cgccgugaucugg

SEQ ID NO: 1894547 - RNA, 14 nt, Shigella flexneri 2a str. 2457T
cgccgugcacaccg

SEQ ID NO: 1894548 - RNA, 17 nt, Shigella flexneri 2a str. 2457T
cgccuccuguucugugc

SEQ ID NO: 1894549 - RNA, 16 nt, Shigella flexneri 2a str. 2457T
cgcgaccaaucacaca

SEQ ID NO: 1894550 - RNA, 16 nt, Shigella flexneri 2a str. 2457T
cgcgacuuuuuccugc

SEQ ID NO: 1894551 - RNA, 19 nt, Shigella flexneri 2a str. 2457T
cgcgacaguaucaucauua

SEQ ID NO: 1894552 - RNA, 18 nt, Shigella flexneri 2a str. 2457T
cgccuuucaguucaacgg

SEQ ID NO: 1894553 - RNA, 15 nt, Shigella flexneri 2a str. 2457T
cgccugcuucgucca

SEQ ID NO: 1894554 - RNA, 15 nt, Shigella flexneri 2a str. 2457T
cgccuggaccagcgg

SEQ ID NO: 1894555 - RNA, 22 nt, Shigella flexneri 2a str. 2457T
cgcgaaaugcagcguuuccagc

SEQ ID NO: 1894556 - RNA, 17 nt, Shigella flexneri 2a str. 2457T
cgccuuuuacgcauucg

SEQ ID NO: 1894557 - RNA, 20 nt, Shigella flexneri 2a str. 2457T
cgcgauacuacguucaauca

SEQ ID NO: 1894558 - RNA, 22 nt, Shigella flexneri 2a str. 2457T
cgcgauaaaagacgccgacauc

SEQ ID NO: 1894559 - RNA, 16 nt, Shigella flexneri 2a str. 2457T
cgcgagcuuuccggcg

SEQ ID NO: 1894560 - RNA, 13 nt, Shigella flexneri 2a str. 2457T
cgcgaggcgcaua

SEQ ID NO: 1894561 - RNA, 13 nt, Shigella flexneri 2a str. 2457T
cgcgaucucguca

SEQ ID NO: 1894562 - RNA, 14 nt, Shigella flexneri 2a str. 2457T
cgcgauccggcggu

SEQ ID NO: 1894563 - RNA, 15 nt, Shigella flexneri 2a str. 2457T
cgcgaugccgccgua

SEQ ID NO: 1894564 - RNA, 22 nt, Shigella flexneri 2a str. 2457T
cgcgauugugcgcgauccggcg

SEQ ID NO: 1894565 - RNA, 16 nt, Shigella flexneri 2a str. 2457T
cgcgauuaugccgccg

SEQ ID NO: 1894566 - RNA, 19 nt, Shigella flexneri 2a str. 2457T
cgccgccucugcgcuuugu

SEQ ID NO: 1894567 - RNA, 20 nt, Shigella flexneri 2a str. 2457T
cgccgcugucuaccagcacc

SEQ ID NO: 1894568 - RNA, 14 nt, Shigella flexneri 2a str. 2457T
cgccggacauugcg

SEQ ID NO: 1894569 - RNA, 20 nt, Shigella flexneri 2a str. 2457T
cgccggacgucaggccgcca

SEQ ID NO: 1894570 - RNA, 13 nt, Shigella flexneri 2a str. 2457T
cgccgcgcggugg

SEQ ID NO: 1894571 - RNA, 21 nt, Shigella flexneri 2a str. 2457T
cgcccguuuucuccagcgccg

SEQ ID NO: 1894572 - RNA, 11 nt, Shigella flexneri 2a str. 2457T
cgcccuacucc

SEQ ID NO: 1894573 - RNA, 14 nt, Shigella flexneri 2a str. 2457T
cgcccgccgccauu

SEQ ID NO: 1894574 - RNA, 18 nt, Shigella flexneri 2a str. 2457T
cgcccuguucugcaaggc

SEQ ID NO: 1894575 - RNA, 18 nt, Shigella flexneri 2a str. 2457T
cgcccuggguaccgagaa

SEQ ID NO: 1894576 - RNA, 21 nt, Shigella flexneri 2a str. 2457T
cgcccugggcuucauccagca

SEQ ID NO: 1894577 - RNA, 17 nt, Shigella flexneri 2a str. 2457T
cgccgaauaacgcgcag

SEQ ID NO: 1894578 - RNA, 21 nt, Shigella flexneri 2a str. 2457T
ccgucgcauggggaucgugau

SEQ ID NO: 1894579 - RNA, 23 nt, Shigella flexneri 2a str. 2457T
ccguggucuguuuaaccgcuuca

SEQ ID NO: 1894580 - RNA, 23 nt, Shigella flexneri 2a str. 2457T
ccgugcgggcaucaucuuccggu

SEQ ID NO: 1894581 - RNA, 16 nt, Shigella flexneri 2a str. 2457T
ccgucguggucgugau

SEQ ID NO: 1894582 - RNA, 14 nt, Shigella flexneri 2a str. 2457T
ccuccauguccagc

SEQ ID NO: 1894583 - RNA, 15 nt, Shigella flexneri 2a str. 2457T
ccucccagccauugu

SEQ ID NO: 1894584 - RNA, 13 nt, Shigella flexneri 2a str. 2457T
ccucaacgccgca

SEQ ID NO: 1894585 - RNA, 19 nt, Shigella flexneri 2a str. 2457T
ccucaacgccuaaugccag

SEQ ID NO: 1894586 - RNA, 18 nt, Shigella flexneri 2a str. 2457T
ccucaaaggccgacagca

SEQ ID NO: 1894587 - RNA, 14 nt, Shigella flexneri 2a str. 2457T
ccuaacauaaugca

SEQ ID NO: 1894588 - RNA, 16 nt, Shigella flexneri 2a str. 2457T
ccuaacaauucgccag

SEQ ID NO: 1894589 - RNA, 15 nt, Shigella flexneri 2a str. 2457T
ccuaauccagccuac

SEQ ID NO: 1894590 - RNA, 17 nt, Shigella flexneri 2a str. 2457T
ccuaaucgacgcggacg

SEQ ID NO: 1894591 - RNA, 17 nt, Shigella flexneri 2a str. 2457T
ccuacaaacguugcuga

SEQ ID NO: 1894592 - RNA, 12 nt, Shigella flexneri 2a str. 2457T
ccuacacgccag

SEQ ID NO: 1894593 - RNA, 19 nt, Shigella flexneri 2a str. 2457T
ccguuuacgucauuaccgc

SEQ ID NO: 1894594 - RNA, 21 nt, Shigella flexneri 2a str. 2457T
ccguuucccuguucagccuga

SEQ ID NO: 1894595 - RNA, 21 nt, Shigella flexneri 2a str. 2457T
ccguuucucuguucagccuga

SEQ ID NO: 1894596 - RNA, 23 nt, Shigella flexneri 2a str. 2457T
ccguuugccccggcugcgcgacg

SEQ ID NO: 1894597 - RNA, 21 nt, Shigella flexneri 2a str. 2457T
ccuaaaagcacgccagacauc

SEQ ID NO: 1894598 - RNA, 16 nt, Shigella flexneri 2a str. 2457T
ccguugcuguuccauc

SEQ ID NO: 1894599 - RNA, 18 nt, Shigella flexneri 2a str. 2457T
ccguugcgcccaucauca

SEQ ID NO: 1894600 - RNA, 13 nt, Shigella flexneri 2a str. 2457T
ccugcggccagca

SEQ ID NO: 1894601 - RNA, 13 nt, Shigella flexneri 2a str. 2457T
ccugcggacaguc

SEQ ID NO: 1894602 - RNA, 20 nt, Shigella flexneri 2a str. 2457T
ccugcgugacuaaaacccuu

SEQ ID NO: 1894603 - RNA, 21 nt, Shigella flexneri 2a str. 2457T
ccugcgcccgcguuaccggca

SEQ ID NO: 1894604 - RNA, 12 nt, Shigella flexneri 2a str. 2457T
ccugcgccagcg

SEQ ID NO: 1894605 - RNA, 22 nt, Shigella flexneri 2a str. 2457T
ccugcgccagcgcgcguugcug

SEQ ID NO: 1894606 - RNA, 12 nt, Shigella flexneri 2a str. 2457T
ccugcgcgauga

SEQ ID NO: 1894607 - RNA, 18 nt, Shigella flexneri 2a str. 2457T
ccugcauaaacgccguca

SEQ ID NO: 1894608 - RNA, 20 nt, Shigella flexneri 2a str. 2457T
ccugcauacgacgugccgca

SEQ ID NO: 1894609 - RNA, 17 nt, Shigella flexneri 2a str. 2457T
ccugcgaacuguaauga

SEQ ID NO: 1894610 - RNA, 17 nt, Shigella flexneri 2a str. 2457T
ccugcugauuaucggca

SEQ ID NO: 1894611 - RNA, 15 nt, Shigella flexneri 2a str. 2457T
ccugcucgucggcaa

SEQ ID NO: 1894612 - RNA, 17 nt, Shigella flexneri 2a str. 2457T
ccugcuggacgcgccaa

SEQ ID NO: 1894613 - RNA, 18 nt, Shigella flexneri 2a str. 2457T
ccugcucgucauccgcca

SEQ ID NO: 1894614 - RNA, 18 nt, Shigella flexneri 2a str. 2457T
ccugcucgccacgucacu

SEQ ID NO: 1894615 - RNA, 13 nt, Shigella flexneri 2a str. 2457T
ccugcucagcccg

SEQ ID NO: 1894616 - RNA, 21 nt, Shigella flexneri 2a str. 2457T
ccugcuccagugcauccagca

SEQ ID NO: 1894617 - RNA, 18 nt, Shigella flexneri 2a str. 2457T
ccugcaauaccgccguua

SEQ ID NO: 1894618 - RNA, 13 nt, Shigella flexneri 2a str. 2457T
ccugcaacgcuuu

SEQ ID NO: 1894619 - RNA, 12 nt, Shigella flexneri 2a str. 2457T
ccugcaacgcuu

SEQ ID NO: 1894620 - RNA, 23 nt, Shigella flexneri 2a str. 2457T
ccugagcgguuaacacggcagca

SEQ ID NO: 1894621 - RNA, 18 nt, Shigella flexneri 2a str. 2457T
ccugagugggcgucagca

SEQ ID NO: 1894622 - RNA, 13 nt, Shigella flexneri 2a str. 2457T
ccugcaaacgcuu

SEQ ID NO: 1894623 - RNA, 14 nt, Shigella flexneri 2a str. 2457T
ccugcaaacgcuuu

SEQ ID NO: 1894624 - RNA, 15 nt, Shigella flexneri 2a str. 2457T
ccugacgguuuaccu

SEQ ID NO: 1894625 - RNA, 20 nt, Shigella flexneri 2a str. 2457T
ccugacucggacgcguuuca

SEQ ID NO: 1894626 - RNA, 16 nt, Shigella flexneri 2a str. 2457T
ccugacuugccagaua

SEQ ID NO: 1894627 - RNA, 21 nt, Shigella flexneri 2a str. 2457T
ccugacggaaaucauccagca

SEQ ID NO: 1894628 - RNA, 23 nt, Shigella flexneri 2a str. 2457T
ccggcggcgcgccaggcgcugau

SEQ ID NO: 1894629 - RNA, 11 nt, Shigella flexneri 2a str. 2457T
ccggcgcuaau

SEQ ID NO: 1894630 - RNA, 16 nt, Shigella flexneri 2a str. 2457T
ccggccagcgccacca

SEQ ID NO: 1894631 - RNA, 23 nt, Shigella flexneri 2a str. 2457T
ccggccagcgccaccaccagcac

SEQ ID NO: 1894632 - RNA, 18 nt, Shigella flexneri 2a str. 2457T
ccgggcaucagcagcacg

SEQ ID NO: 1894633 - RNA, 14 nt, Shigella flexneri 2a str. 2457T
ccggcuguuccagc

SEQ ID NO: 1894634 - RNA, 23 nt, Shigella flexneri 2a str. 2457T
ccgggaagggguuuuccaguuca

SEQ ID NO: 1894635 - RNA, 23 nt, Shigella flexneri 2a str. 2457T
ccgggaagcucucuuccaguucg

SEQ ID NO: 1894636 - RNA, 22 nt, Shigella flexneri 2a str. 2457T
ccgguaaugcugaaauuacgcg

SEQ ID NO: 1894637 - RNA, 17 nt, Shigella flexneri 2a str. 2457T
ccgguacaaacaucauc

SEQ ID NO: 1894638 - RNA, 18 nt, Shigella flexneri 2a str. 2457T
ccgguaaaucaccagcgu

SEQ ID NO: 1894639 - RNA, 21 nt, Shigella flexneri 2a str. 2457T
ccggguuugccacaucacugu

SEQ ID NO: 1894640 - RNA, 20 nt, Shigella flexneri 2a str. 2457T
ccggguuauugguauggucg

SEQ ID NO: 1894641 - RNA, 18 nt, Shigella flexneri 2a str. 2457T
ccgguagucaccgcccag

SEQ ID NO: 1894642 - RNA, 22 nt, Shigella flexneri 2a str. 2457T
ccggucagccauugcuaccgcu

SEQ ID NO: 1894643 - RNA, 20 nt, Shigella flexneri 2a str. 2457T
ccgguuaaaucgacguucug

SEQ ID NO: 1894644 - RNA, 18 nt, Shigella flexneri 2a str. 2457T
ccggucuggguuucgcca

SEQ ID NO: 1894645 - RNA, 19 nt, Shigella flexneri 2a str. 2457T
ccggugaaucgcaauuuau

SEQ ID NO: 1894646 - RNA, 23 nt, Shigella flexneri 2a str. 2457T
ccguagcuucaccgcaucgucac

SEQ ID NO: 1894647 - RNA, 15 nt, Shigella flexneri 2a str. 2457T
ccgucagauccgcca

SEQ ID NO: 1894648 - RNA, 17 nt, Shigella flexneri 2a str. 2457T
ccgucacgguaauaaca

SEQ ID NO: 1894649 - RNA, 15 nt, Shigella flexneri 2a str. 2457T
ccguccggcgggcaa

SEQ ID NO: 1894650 - RNA, 20 nt, Shigella flexneri 2a str. 2457T
ccgcgauccagcgcaauacc

SEQ ID NO: 1894651 - RNA, 18 nt, Shigella flexneri 2a str. 2457T
ccgcgacgacgacaggca

SEQ ID NO: 1894652 - RNA, 16 nt, Shigella flexneri 2a str. 2457T
ccgccguugccgcagc

SEQ ID NO: 1894653 - RNA, 17 nt, Shigella flexneri 2a str. 2457T
ccgccguguucuucggu

SEQ ID NO: 1894654 - RNA, 21 nt, Shigella flexneri 2a str. 2457T
ccgccaugcuugaagggcugg

SEQ ID NO: 1894655 - RNA, 13 nt, Shigella flexneri 2a str. 2457T
ccgccaucucuuc

SEQ ID NO: 1894656 - RNA, 12 nt, Shigella flexneri 2a str. 2457T
ccgccaguuuac

SEQ ID NO: 1894657 - RNA, 12 nt, Shigella flexneri 2a str. 2457T
ccgccaguucuu

SEQ ID NO: 1894658 - RNA, 17 nt, Shigella flexneri 2a str. 2457T
ccgcccaccaccagcga

SEQ ID NO: 1894659 - RNA, 13 nt, Shigella flexneri 2a str. 2457T
ccgccaccagcgu

SEQ ID NO: 1894660 - RNA, 19 nt, Shigella flexneri 2a str. 2457T
ccgccaauaaucgcgcuaa

SEQ ID NO: 1894661 - RNA, 15 nt, Shigella flexneri 2a str. 2457T
ccgcaugcucacaga

SEQ ID NO: 1894662 - RNA, 14 nt, Shigella flexneri 2a str. 2457T
ccgccaaccagcgc

SEQ ID NO: 1894663 - RNA, 20 nt, Shigella flexneri 2a str. 2457T
ccgcaauaaccaucagcucu

SEQ ID NO: 1894664 - RNA, 16 nt, Shigella flexneri 2a str. 2457T
ccgcagaaaaagagca

SEQ ID NO: 1894665 - RNA, 16 nt, Shigella flexneri 2a str. 2457T
ccgcagauccagugcu

SEQ ID NO: 1894666 - RNA, 21 nt, Shigella flexneri 2a str. 2457T
ccgcagagauagaacugcauu

SEQ ID NO: 1894667 - RNA, 16 nt, Shigella flexneri 2a str. 2457T
ccgacgaggcgcuggc

SEQ ID NO: 1894668 - RNA, 13 nt, Shigella flexneri 2a str. 2457T
ccgaugcgcgaac

SEQ ID NO: 1894669 - RNA, 16 nt, Shigella flexneri 2a str. 2457T
ccgauggucagcuuca

SEQ ID NO: 1894670 - RNA, 18 nt, Shigella flexneri 2a str. 2457T
ccgauggcaaaagugaua

SEQ ID NO: 1894671 - RNA, 15 nt, Shigella flexneri 2a str. 2457T
ccgauuugaucucuu

SEQ ID NO: 1894672 - RNA, 21 nt, Shigella flexneri 2a str. 2457T
ccggacuguaaacgaugaugc

SEQ ID NO: 1894673 - RNA, 20 nt, Shigella flexneri 2a str. 2457T
ccggagaagaugcgucagca

SEQ ID NO: 1894674 - RNA, 18 nt, Shigella flexneri 2a str. 2457T
ccggacguguuuucaccg

SEQ ID NO: 1894675 - RNA, 14 nt, Shigella flexneri 2a str. 2457T
ccggacgucaggcc

SEQ ID NO: 1894676 - RNA, 17 nt, Shigella flexneri 2a str. 2457T
ccggaggcaaguuuccu

SEQ ID NO: 1894677 - RNA, 21 nt, Shigella flexneri 2a str. 2457T
ccggaccaucuuccaguugca

SEQ ID NO: 1894678 - RNA, 18 nt, Shigella flexneri 2a str. 2457T
ccggacccuggucaguuu

SEQ ID NO: 1894679 - RNA, 22 nt, Shigella flexneri 2a str. 2457T
ccggacccuggucaguuucagc

SEQ ID NO: 1894680 - RNA, 20 nt, Shigella flexneri 2a str. 2457T
ccggaugacguuucgcgcca

SEQ ID NO: 1894681 - RNA, 19 nt, Shigella flexneri 2a str. 2457T
ccggaugcaugauccggca

SEQ ID NO: 1894682 - RNA, 15 nt, Shigella flexneri 2a str. 2457T
ccggaugcgccagca

SEQ ID NO: 1894683 - RNA, 18 nt, Shigella flexneri 2a str. 2457T
ccggaugaucauccggcu

SEQ ID NO: 1894684 - RNA, 15 nt, Shigella flexneri 2a str. 2457T
ccggauguuuccauc

SEQ ID NO: 1894685 - RNA, 16 nt, Shigella flexneri 2a str. 2457T
ccggaugcggcguaaa

SEQ ID NO: 1894686 - RNA, 21 nt, Shigella flexneri 2a str. 2457T
ccggaugcgggugaacgcguu

SEQ ID NO: 1894687 - RNA, 20 nt, Shigella flexneri 2a str. 2457T
ccggauaagaugcgccagca

SEQ ID NO: 1894688 - RNA, 21 nt, Shigella flexneri 2a str. 2457T
ccggcaauucucucugauuac

SEQ ID NO: 1894689 - RNA, 23 nt, Shigella flexneri 2a str. 2457T
ccggcaaucggugcaaaugccag

SEQ ID NO: 1894690 - RNA, 14 nt, Shigella flexneri 2a str. 2457T
ccggcaaucugcug

SEQ ID NO: 1894691 - RNA, 23 nt, Shigella flexneri 2a str. 2457T
ccggcaauguuaccgaucgccag

SEQ ID NO: 1894692 - RNA, 17 nt, Shigella flexneri 2a str. 2457T
ccggcaaucgcgccaga

SEQ ID NO: 1894693 - RNA, 16 nt, Shigella flexneri 2a str. 2457T
ccggcaaucgccagau

SEQ ID NO: 1894694 - RNA, 16 nt, Shigella flexneri 2a str. 2457T
ccggcaacaaugccac

SEQ ID NO: 1894695 - RNA, 22 nt, Shigella flexneri 2a str. 2457T
ccggcaacaaugccacgccaca

SEQ ID NO: 1894696 - RNA, 14 nt, Shigella flexneri 2a str. 2457T
ccggcaacguugcc

SEQ ID NO: 1894697 - RNA, 20 nt, Shigella flexneri 2a str. 2457T
ccgcgcccgugcaucuccug

SEQ ID NO: 1894698 - RNA, 19 nt, Shigella flexneri 2a str. 2457T
ccgcgcuuucuggcgcaga

SEQ ID NO: 1894699 - RNA, 16 nt, Shigella flexneri 2a str. 2457T
ccgcguaccgcagcaa

SEQ ID NO: 1894700 - RNA, 14 nt, Shigella flexneri 2a str. 2457T
ccgcuccgccaucu

SEQ ID NO: 1894701 - RNA, 23 nt, Shigella flexneri 2a str. 2457T
ccgcuucugcuuuggcugccgcc

SEQ ID NO: 1894702 - RNA, 12 nt, Shigella flexneri 2a str. 2457T
ccgcuucugcag

SEQ ID NO: 1894703 - RNA, 16 nt, Shigella flexneri 2a str. 2457T
ccgcuucugcguucug

SEQ ID NO: 1894704 - RNA, 18 nt, Shigella flexneri 2a str. 2457T
ccgcuuccagcauuucug

SEQ ID NO: 1894705 - RNA, 12 nt, Shigella flexneri 2a str. 2457T
ccgcuuuccagg

SEQ ID NO: 1894706 - RNA, 16 nt, Shigella flexneri 2a str. 2457T
ccgcuucaaaguucug

SEQ ID NO: 1894707 - RNA, 16 nt, Shigella flexneri 2a str. 2457T
ccgcuucagcccgcga

SEQ ID NO: 1894708 - RNA, 21 nt, Shigella flexneri 2a str. 2457T
ccgcuguccagucgcaaaccu

SEQ ID NO: 1894709 - RNA, 16 nt, Shigella flexneri 2a str. 2457T
ccgcuguaauaccagc

SEQ ID NO: 1894710 - RNA, 13 nt, Shigella flexneri 2a str. 2457T
ccgcuggugcguc

SEQ ID NO: 1894711 - RNA, 13 nt, Shigella flexneri 2a str. 2457T
cgaugaucgccau

SEQ ID NO: 1894712 - RNA, 16 nt, Shigella flexneri 2a str. 2457T
cgaugacuggccggaa

SEQ ID NO: 1894713 - RNA, 17 nt, Shigella flexneri 2a str. 2457T
cgaucgggcauuuccau

SEQ ID NO: 1894714 - RNA, 16 nt, Shigella flexneri 2a str. 2457T
cgaucgccagcagggc

SEQ ID NO: 1894715 - RNA, 14 nt, Shigella flexneri 2a str. 2457T
cgaucgccagcagg

SEQ ID NO: 1894716 - RNA, 13 nt, Shigella flexneri 2a str. 2457T
cgaucgcgccaau

SEQ ID NO: 1894717 - RNA, 20 nt, Shigella flexneri 2a str. 2457T
cgaucgcgccaaucagcgca

SEQ ID NO: 1894718 - RNA, 20 nt, Shigella flexneri 2a str. 2457T
cgauccagcgcaauaccgau

SEQ ID NO: 1894719 - RNA, 21 nt, Shigella flexneri 2a str. 2457T
cgauaaaggucgacagcagcc

SEQ ID NO: 1894720 - RNA, 18 nt, Shigella flexneri 2a str. 2457T
cgauaaacucaaucaggc

SEQ ID NO: 1894721 - RNA, 22 nt, Shigella flexneri 2a str. 2457T
cgauaaccgcaaaaccaacgcc

SEQ ID NO: 1894722 - RNA, 15 nt, Shigella flexneri 2a str. 2457T
cgauaaacgccggau

SEQ ID NO: 1894723 - RNA, 15 nt, Shigella flexneri 2a str. 2457T
cgauaaaaauaccga

SEQ ID NO: 1894724 - RNA, 15 nt, Shigella flexneri 2a str. 2457T
cgaggcgcuggcgca

SEQ ID NO: 1894725 - RNA, 20 nt, Shigella flexneri 2a str. 2457T
cgauaucggaggccuguuca

SEQ ID NO: 1894726 - RNA, 14 nt, Shigella flexneri 2a str. 2457T
cgauacaacgcuuu

SEQ ID NO: 1894727 - RNA, 20 nt, Shigella flexneri 2a str. 2457T
cgaugcgucuugccaucaua

SEQ ID NO: 1894728 - RNA, 12 nt, Shigella flexneri 2a str. 2457T
cgauugccggau

SEQ ID NO: 1894729 - RNA, 20 nt, Shigella flexneri 2a str. 2457T
cgauugucauucgccugacg

SEQ ID NO: 1894730 - RNA, 21 nt, Shigella flexneri 2a str. 2457T
cgcaaaaccucuuccagcaga

SEQ ID NO: 1894731 - RNA, 15 nt, Shigella flexneri 2a str. 2457T
cgcaaaaaacauuga

SEQ ID NO: 1894732 - RNA, 17 nt, Shigella flexneri 2a str. 2457T
cgcaaaaccucuuccag

SEQ ID NO: 1894733 - RNA, 23 nt, Shigella flexneri 2a str. 2457T
cgauuuuuuuaauaauauucagc

SEQ ID NO: 1894734 - RNA, 14 nt, Shigella flexneri 2a str. 2457T
cgcaaacaggcgca

SEQ ID NO: 1894735 - RNA, 16 nt, Shigella flexneri 2a str. 2457T
cgcaaacaccagcgaa

SEQ ID NO: 1894736 - RNA, 12 nt, Shigella flexneri 2a str. 2457T
cgcaacauguca

SEQ ID NO: 1894737 - RNA, 18 nt, Shigella flexneri 2a str. 2457T
cgcaacaugucagcaauc

SEQ ID NO: 1894738 - RNA, 23 nt, Shigella flexneri 2a str. 2457T
cgcaacauauuccgcaccugcca

SEQ ID NO: 1894739 - RNA, 18 nt, Shigella flexneri 2a str. 2457T
cgcaacguaucaucgcug

SEQ ID NO: 1894740 - RNA, 19 nt, Shigella flexneri 2a str. 2457T
cgcaacguaucaucgcuga

SEQ ID NO: 1894741 - RNA, 19 nt, Shigella flexneri 2a str. 2457T
cgcaauaccagcucgauca

SEQ ID NO: 1894742 - RNA, 20 nt, Shigella flexneri 2a str. 2457T
cgcaauauccugcgcuuccu

SEQ ID NO: 1894743 - RNA, 15 nt, Shigella flexneri 2a str. 2457T
cgcaaucagcaccgc

SEQ ID NO: 1894744 - RNA, 19 nt, Shigella flexneri 2a str. 2457T
cgcaaucgcccagcgcgua

SEQ ID NO: 1894745 - RNA, 14 nt, Shigella flexneri 2a str. 2457T
cgcaaucgccucca

SEQ ID NO: 1894746 - RNA, 18 nt, Shigella flexneri 2a str. 2457T
cgcaaugauuuugaugga

SEQ ID NO: 1894747 - RNA, 20 nt, Shigella flexneri 2a str. 2457T
cgcaaugauaucgcuggcag

SEQ ID NO: 1894748 - RNA, 22 nt, Shigella flexneri 2a str. 2457T
cgcaauuuauacugcgauggga

SEQ ID NO: 1894749 - RNA, 22 nt, Shigella flexneri 2a str. 2457T
cgcaauucgcgucggcgucagc

SEQ ID NO: 1894750 - RNA, 22 nt, Shigella flexneri 2a str. 2457T
cgcaauugccggaugcgaguuu

SEQ ID NO: 1894751 - RNA, 22 nt, Shigella flexneri 2a str. 2457T
cgcacacauccacaaugcggau

SEQ ID NO: 1894752 - RNA, 19 nt, Shigella flexneri 2a str. 2457T
cgcacagcccgccgccauc

SEQ ID NO: 1894753 - RNA, 16 nt, Shigella flexneri 2a str. 2457T
cgcaccaccagcagcu

SEQ ID NO: 1894754 - RNA, 15 nt, Shigella flexneri 2a str. 2457T
cgcaccaccagcagc

SEQ ID NO: 1894755 - RNA, 17 nt, Shigella flexneri 2a str. 2457T
cgcacaggcaauccagc

SEQ ID NO: 1894756 - RNA, 15 nt, Shigella flexneri 2a str. 2457T
cgcacauuucaauca

SEQ ID NO: 1894757 - RNA, 13 nt, Shigella flexneri 2a str. 2457T
cgcacccgccauc

SEQ ID NO: 1894758 - RNA, 14 nt, Shigella flexneri 2a str. 2457T
cgcagccauuacca

SEQ ID NO: 1894759 - RNA, 13 nt, Shigella flexneri 2a str. 2457T
cgcagaucgaaca

SEQ ID NO: 1894760 - RNA, 22 nt, Shigella flexneri 2a str. 2457T
cgcagcaagccgucgugaaugc

SEQ ID NO: 1894761 - RNA, 19 nt, Shigella flexneri 2a str. 2457T
cgcagagauagaacugcau

SEQ ID NO: 1894762 - RNA, 17 nt, Shigella flexneri 2a str. 2457T
cgcagauaaauaucaau

SEQ ID NO: 1894763 - RNA, 21 nt, Shigella flexneri 2a str. 2457T
cgcagcugagaaaaagcgaag

SEQ ID NO: 1894764 - RNA, 15 nt, Shigella flexneri 2a str. 2457T
cgcagucuuugccgu

SEQ ID NO: 1894765 - RNA, 12 nt, Shigella flexneri 2a str. 2457T
cgcagugcugca

SEQ ID NO: 1894766 - RNA, 20 nt, Shigella flexneri 2a str. 2457T
cgcagggcuguuuaucguga

SEQ ID NO: 1894767 - RNA, 19 nt, Shigella flexneri 2a str. 2457T
cgcauaugcuuugccguca

SEQ ID NO: 1894768 - RNA, 19 nt, Shigella flexneri 2a str. 2457T
cgcauaccccaucagcgua

SEQ ID NO: 1894769 - RNA, 21 nt, Shigella flexneri 2a str. 2457T
cgcauacagccagacaaucga

SEQ ID NO: 1894770 - RNA, 23 nt, Shigella flexneri 2a str. 2457T
cgcauacauugcguaaccaauca

SEQ ID NO: 1894771 - RNA, 12 nt, Shigella flexneri 2a str. 2457T
cgcauaagccac

SEQ ID NO: 1894772 - RNA, 15 nt, Shigella flexneri 2a str. 2457T
cgcaucaggcaucgu

SEQ ID NO: 1894773 - RNA, 15 nt, Shigella flexneri 2a str. 2457T
cgcaucagcuccggu

SEQ ID NO: 1894774 - RNA, 23 nt, Shigella flexneri 2a str. 2457T
cgcauccagccaacguuucugga

SEQ ID NO: 1894775 - RNA, 11 nt, Shigella flexneri 2a str. 2457T
cgcauccagaa

SEQ ID NO: 1894776 - RNA, 22 nt, Shigella flexneri 2a str. 2457T
cgccaaccgauaucuuuccggc

SEQ ID NO: 1894777 - RNA, 16 nt, Shigella flexneri 2a str. 2457T
cgccaacgcccagcgc

SEQ ID NO: 1894778 - RNA, 18 nt, Shigella flexneri 2a str. 2457T
cgccaaaugucaccagcc

SEQ ID NO: 1894779 - RNA, 22 nt, Shigella flexneri 2a str. 2457T
cgccaaaaagaaccugaacgcc

SEQ ID NO: 1894780 - RNA, 19 nt, Shigella flexneri 2a str. 2457T
cgccaaacccaccagcuga

SEQ ID NO: 1894781 - RNA, 19 nt, Shigella flexneri 2a str. 2457T
cgccagcauucccgccagc

SEQ ID NO: 1894782 - RNA, 21 nt, Shigella flexneri 2a str. 2457T
cgccagccaccacaauugacc

SEQ ID NO: 1894783 - RNA, 19 nt, Shigella flexneri 2a str. 2457T
cgccagcacgaccgccauu

SEQ ID NO: 1894784 - RNA, 16 nt, Shigella flexneri 2a str. 2457T
cgccagcgaagccagc

SEQ ID NO: 1894785 - RNA, 13 nt, Shigella flexneri 2a str. 2457T
cgccagcguugau

SEQ ID NO: 1894786 - RNA, 14 nt, Shigella flexneri 2a str. 2457T
cgccaggccagccu

SEQ ID NO: 1894787 - RNA, 18 nt, Shigella flexneri 2a str. 2457T
cgccagagagcgaauauc

SEQ ID NO: 1894788 - RNA, 15 nt, Shigella flexneri 2a str. 2457T
cgccagaggcgacaa

SEQ ID NO: 1894789 - RNA, 23 nt, Shigella flexneri 2a str. 2457T
cgccagaacacgcucccagcaga

SEQ ID NO: 1894790 - RNA, 14 nt, Shigella flexneri 2a str. 2457T
cgccagaccagcua

SEQ ID NO: 1894791 - RNA, 16 nt, Shigella flexneri 2a str. 2457T
cgccagacccagacgc

SEQ ID NO: 1894792 - RNA, 19 nt, Shigella flexneri 2a str. 2457T
cgccagaaaucagcuuugg

SEQ ID NO: 1894793 - RNA, 15 nt, Shigella flexneri 2a str. 2457T
cgccacucugacggc

SEQ ID NO: 1894794 - RNA, 23 nt, Shigella flexneri 2a str. 2457T
cgccaccuuucucggcaucacgc

SEQ ID NO: 1894795 - RNA, 17 nt, Shigella flexneri 2a str. 2457T
cgccacgcggagcgccu

SEQ ID NO: 1894796 - RNA, 19 nt, Shigella flexneri 2a str. 2457T
cgccagugccaaagccagu

SEQ ID NO: 1894797 - RNA, 20 nt, Shigella flexneri 2a str. 2457T
cgccaguuacugccaccauc

SEQ ID NO: 1894798 - RNA, 14 nt, Shigella flexneri 2a str. 2457T
cgccagugccgccc

SEQ ID NO: 1894799 - RNA, 20 nt, Shigella flexneri 2a str. 2457T
cgccaggucagagagccagc

SEQ ID NO: 1894800 - RNA, 22 nt, Shigella flexneri 2a str. 2457T
cgccaggucagagagccagccc

SEQ ID NO: 1894801 - RNA, 12 nt, Shigella flexneri 2a str. 2457T
cgccauccggca

SEQ ID NO: 1894802 - RNA, 23 nt, Shigella flexneri 2a str. 2457T
cgccauccugauagcuuacggcg

SEQ ID NO: 1894803 - RNA, 15 nt, Shigella flexneri 2a str. 2457T
cgccaucucuuccag

SEQ ID NO: 1894804 - RNA, 21 nt, Shigella flexneri 2a str. 2457T
cgccaucguugaugcguaugg

SEQ ID NO: 1894805 - RNA, 18 nt, Shigella flexneri 2a str. 2457T
cgccaucggcagcaucgc

SEQ ID NO: 1894806 - RNA, 17 nt, Shigella flexneri 2a str. 2457T
cgccaguucuuccaguu

SEQ ID NO: 1894807 - RNA, 14 nt, Shigella flexneri 2a str. 2457T
cgccauaacggcug

SEQ ID NO: 1894808 - RNA, 14 nt, Shigella flexneri 2a str. 2457T
cgccaucaucggca

SEQ ID NO: 1894809 - RNA, 21 nt, Shigella flexneri 2a str. 2457T
cgacgccccggccuugccugu

SEQ ID NO: 1894810 - RNA, 15 nt, Shigella flexneri 2a str. 2457T
cgacgcauacgaucc

SEQ ID NO: 1894811 - RNA, 19 nt, Shigella flexneri 2a str. 2457T
cgacgauaccgccgcacaa

SEQ ID NO: 1894812 - RNA, 21 nt, Shigella flexneri 2a str. 2457T
cgacgagcgcuggugacaucg

SEQ ID NO: 1894813 - RNA, 16 nt, Shigella flexneri 2a str. 2457T
cgaccugauuuugcaa

SEQ ID NO: 1894814 - RNA, 13 nt, Shigella flexneri 2a str. 2457T
cgacgaccaccga

SEQ ID NO: 1894815 - RNA, 16 nt, Shigella flexneri 2a str. 2457T
cgacgcuggcgcgucu

SEQ ID NO: 1894816 - RNA, 16 nt, Shigella flexneri 2a str. 2457T
cgacggcaccacauuc

SEQ ID NO: 1894817 - RNA, 18 nt, Shigella flexneri 2a str. 2457T
cgacguccaaucagcaca

SEQ ID NO: 1894818 - RNA, 20 nt, Shigella flexneri 2a str. 2457T
cgaggcgaacaugcgcuggu

SEQ ID NO: 1894819 - RNA, 17 nt, Shigella flexneri 2a str. 2457T
cgaggcaaccagcacgc

SEQ ID NO: 1894820 - RNA, 18 nt, Shigella flexneri 2a str. 2457T
cgagcuuucgaccagcca

SEQ ID NO: 1894821 - RNA, 14 nt, Shigella flexneri 2a str. 2457T
cgagcauugccagc

SEQ ID NO: 1894822 - RNA, 23 nt, Shigella flexneri 2a str. 2457T
cgagcaauagacaguucuuccug

SEQ ID NO: 1894823 - RNA, 21 nt, Shigella flexneri 2a str. 2457T
cgacugacgugccugugcagc

SEQ ID NO: 1894824 - RNA, 22 nt, Shigella flexneri 2a str. 2457T
cgaaccggaaauccaggucagc

SEQ ID NO: 1894825 - RNA, 20 nt, Shigella flexneri 2a str. 2457T
cgaacggggcugccagcucu

SEQ ID NO: 1894826 - RNA, 17 nt, Shigella flexneri 2a str. 2457T
cgaagaaagcgggugaa

SEQ ID NO: 1894827 - RNA, 18 nt, Shigella flexneri 2a str. 2457T
cgaagagagcgccagaag

SEQ ID NO: 1894828 - RNA, 17 nt, Shigella flexneri 2a str. 2457T
cgaagagaucgauguuu

SEQ ID NO: 1894829 - RNA, 13 nt, Shigella flexneri 2a str. 2457T
cgaacauccggcu

SEQ ID NO: 1894830 - RNA, 22 nt, Shigella flexneri 2a str. 2457T
cgaacaguucaacgccgcuauc

SEQ ID NO: 1894831 - RNA, 15 nt, Shigella flexneri 2a str. 2457T
cgaaccaaacagcgc

SEQ ID NO: 1894832 - RNA, 22 nt, Shigella flexneri 2a str. 2457T
cgaaccaucaccucuucagcgu

SEQ ID NO: 1894833 - RNA, 13 nt, Shigella flexneri 2a str. 2457T
cgaaagcccauca

SEQ ID NO: 1894834 - RNA, 16 nt, Shigella flexneri 2a str. 2457T
cgaaagagcuggcgaa

SEQ ID NO: 1894835 - RNA, 21 nt, Shigella flexneri 2a str. 2457T
cgaaagaggcgcagaugaagc

SEQ ID NO: 1894836 - RNA, 14 nt, Shigella flexneri 2a str. 2457T
ccuuuugccagaua

SEQ ID NO: 1894837 - RNA, 13 nt, Shigella flexneri 2a str. 2457T
ccuuuugccagua

SEQ ID NO: 1894838 - RNA, 15 nt, Shigella flexneri 2a str. 2457T
ccuuugcuggcauga

SEQ ID NO: 1894839 - RNA, 13 nt, Shigella flexneri 2a str. 2457T
ccuugucaugcag

SEQ ID NO: 1894840 - RNA, 15 nt, Shigella flexneri 2a str. 2457T
ccuucuucugccgcc

SEQ ID NO: 1894841 - RNA, 16 nt, Shigella flexneri 2a str. 2457T
ccuugcggaagcguca

SEQ ID NO: 1894842 - RNA, 20 nt, Shigella flexneri 2a str. 2457T
ccuguuacauaugcgcuggc

SEQ ID NO: 1894843 - RNA, 16 nt, Shigella flexneri 2a str. 2457T
ccugugcgccaggaua

SEQ ID NO: 1894844 - RNA, 16 nt, Shigella flexneri 2a str. 2457T
ccuggcaaugcgcugu

SEQ ID NO: 1894845 - RNA, 13 nt, Shigella flexneri 2a str. 2457T
ccuggcagcaccg

SEQ ID NO: 1894846 - RNA, 17 nt, Shigella flexneri 2a str. 2457T
ccuuagcaacaggccag

SEQ ID NO: 1894847 - RNA, 21 nt, Shigella flexneri 2a str. 2457T
ccuuagcaacaggccaguucg

SEQ ID NO: 1894848 - RNA, 20 nt, Shigella flexneri 2a str. 2457T
ccuuacuuacacaucaagau

SEQ ID NO: 1894849 - RNA, 16 nt, Shigella flexneri 2a str. 2457T
ccuuauccggcuuacc

SEQ ID NO: 1894850 - RNA, 13 nt, Shigella flexneri 2a str. 2457T
ccuguugcccuuu

SEQ ID NO: 1894851 - RNA, 23 nt, Shigella flexneri 2a str. 2457T
ccuguuucacuucgucagaaaug

SEQ ID NO: 1894852 - RNA, 22 nt, Shigella flexneri 2a str. 2457T
ccuuccaucgcaucuucgccca

SEQ ID NO: 1894853 - RNA, 20 nt, Shigella flexneri 2a str. 2457T
ccuucuaccuuaacgguauc

SEQ ID NO: 1894854 - RNA, 15 nt, Shigella flexneri 2a str. 2457T
ccuucgaaucccgca

SEQ ID NO: 1894855 - RNA, 17 nt, Shigella flexneri 2a str. 2457T
cgacagcgauuccaguu

SEQ ID NO: 1894856 - RNA, 15 nt, Shigella flexneri 2a str. 2457T
cgacaggcaagcaua

SEQ ID NO: 1894857 - RNA, 14 nt, Shigella flexneri 2a str. 2457T
cgacaccagccauc

SEQ ID NO: 1894858 - RNA, 21 nt, Shigella flexneri 2a str. 2457T
cgaaguauggaaaucacccag

SEQ ID NO: 1894859 - RNA, 14 nt, Shigella flexneri 2a str. 2457T
cgaagcaagcggag

SEQ ID NO: 1894860 - RNA, 16 nt, Shigella flexneri 2a str. 2457T
cgaagcagucaacacc

SEQ ID NO: 1894861 - RNA, 18 nt, Shigella flexneri 2a str. 2457T
cgaagcauucagacacgc

SEQ ID NO: 1894862 - RNA, 20 nt, Shigella flexneri 2a str. 2457T
cgaaugacccgagccacguc

SEQ ID NO: 1894863 - RNA, 21 nt, Shigella flexneri 2a str. 2457T
cgaaugacccgagccacguca

SEQ ID NO: 1894864 - RNA, 19 nt, Shigella flexneri 2a str. 2457T
cgaaguuccgauaaucggu

SEQ ID NO: 1894865 - RNA, 20 nt, Shigella flexneri 2a str. 2457T
cgaaguggacgaacaguuca

SEQ ID NO: 1894866 - RNA, 15 nt, Shigella flexneri 2a str. 2457T
cgaccagcagcugcg

SEQ ID NO: 1894867 - RNA, 17 nt, Shigella flexneri 2a str. 2457T
cgaccaggccaucagca

SEQ ID NO: 1894868 - RNA, 18 nt, Shigella flexneri 2a str. 2457T
cgaccaggccaucagcag

SEQ ID NO: 1894869 - RNA, 22 nt, Shigella flexneri 2a str. 2457T
cgaccagcggaauucccgcuuc

SEQ ID NO: 1894870 - RNA, 13 nt, Shigella flexneri 2a str. 2457T
cgaccaccagcgu

SEQ ID NO: 1894871 - RNA, 13 nt, Shigella flexneri 2a str. 2457T
cgaccaaucgcgg

SEQ ID NO: 1894872 - RNA, 14 nt, Shigella flexneri 2a str. 2457T
cgacaugcuuacca

SEQ ID NO: 1894873 - RNA, 15 nt, Shigella flexneri 2a str. 2457T
cgacauuucugcugc

SEQ ID NO: 1894874 - RNA, 21 nt, Shigella flexneri 2a str. 2457T
cgacauuuucucuacccgcuc

SEQ ID NO: 1894875 - RNA, 15 nt, Shigella flexneri 2a str. 2457T
cgacaugcaucacgc

SEQ ID NO: 1894876 - RNA, 15 nt, Shigella flexneri 2a str. 2457T
cuuuuuaaucgccau

SEQ ID NO: 1894877 - RNA, 12 nt, Shigella flexneri 2a str. 2457T
cuuuugccagaa

SEQ ID NO: 1894878 - RNA, 16 nt, Shigella flexneri 2a str. 2457T
cuuuucgucaggauua

SEQ ID NO: 1894879 - RNA, 15 nt, Shigella flexneri 2a str. 2457T
cuuuuaccuucaggu

SEQ ID NO: 1894880 - RNA, 14 nt, Shigella flexneri 2a str. 2457T
cuuuaugugcuucu

SEQ ID NO: 1894881 - RNA, 21 nt, Shigella flexneri 2a str. 2457T
cuuuuuucauggguaccagau

SEQ ID NO: 1894882 - RNA, 14 nt, Shigella flexneri 2a str. 2457T
gaaaacgaaagcgc

SEQ ID NO: 1894883 - RNA, 15 nt, Shigella flexneri 2a str. 2457T
gaaaacgaaggccgg

SEQ ID NO: 1894884 - RNA, 15 nt, Shigella flexneri 2a str. 2457T
gaaaacgaauacugg

SEQ ID NO: 1894885 - RNA, 15 nt, Shigella flexneri 2a str. 2457T
gaaaaccgaugcagu

SEQ ID NO: 1894886 - RNA, 13 nt, Shigella flexneri 2a str. 2457T
gaaaagccggaau

SEQ ID NO: 1894887 - RNA, 13 nt, Shigella flexneri 2a str. 2457T
gaaaacucuuagc

SEQ ID NO: 1894888 - RNA, 20 nt, Shigella flexneri 2a str. 2457T
gaaaacgauguuugcugcga

SEQ ID NO: 1894889 - RNA, 15 nt, Shigella flexneri 2a str. 2457T
gaaaacgcauaccag

SEQ ID NO: 1894890 - RNA, 14 nt, Shigella flexneri 2a str. 2457T
gaaaacgcccggca

SEQ ID NO: 1894891 - RNA, 18 nt, Shigella flexneri 2a str. 2457T
gaaaauucuccggcguuu

SEQ ID NO: 1894892 - RNA, 21 nt, Shigella flexneri 2a str. 2457T
gaaaaugccgcacaucaccgc

SEQ ID NO: 1894893 - RNA, 16 nt, Shigella flexneri 2a str. 2457T
gaaaaugggcaucagu

SEQ ID NO: 1894894 - RNA, 18 nt, Shigella flexneri 2a str. 2457T
gaaagaucgccacugcug

SEQ ID NO: 1894895 - RNA, 19 nt, Shigella flexneri 2a str. 2457T
gaaagcgggugaaggugcc

SEQ ID NO: 1894896 - RNA, 15 nt, Shigella flexneri 2a str. 2457T
gaaagcgagcaguac

SEQ ID NO: 1894897 - RNA, 20 nt, Shigella flexneri 2a str. 2457T
gaaagcgacuuugccuggcg

SEQ ID NO: 1894898 - RNA, 13 nt, Shigella flexneri 2a str. 2457T
gaaacucgcguaa

SEQ ID NO: 1894899 - RNA, 21 nt, Shigella flexneri 2a str. 2457T
gaaacugucaauaaacgccug

SEQ ID NO: 1894900 - RNA, 13 nt, Shigella flexneri 2a str. 2457T
gaaacugccggaa

SEQ ID NO: 1894901 - RNA, 14 nt, Shigella flexneri 2a str. 2457T
gaaacugccggaag

SEQ ID NO: 1894902 - RNA, 24 nt, Shigella flexneri 2a str. 2457T
gaaacugucaauaaacgccugcuu

SEQ ID NO: 1894903 - RNA, 17 nt, Shigella flexneri 2a str. 2457T
gaaauacguaggccuga

SEQ ID NO: 1894904 - RNA, 20 nt, Shigella flexneri 2a str. 2457T
gaaaucaccgccaccagcgu

SEQ ID NO: 1894905 - RNA, 20 nt, Shigella flexneri 2a str. 2457T
gaaaucaccaccagcaccgc

SEQ ID NO: 1894906 - RNA, 19 nt, Shigella flexneri 2a str. 2457T
gaaaucaccaccagcaccg

SEQ ID NO: 1894907 - RNA, 19 nt, Shigella flexneri 2a str. 2457T
gaaaucacgauugcugccg

SEQ ID NO: 1894908 - RNA, 20 nt, Shigella flexneri 2a str. 2457T
gaaaucaucaauaccagccc

SEQ ID NO: 1894909 - RNA, 14 nt, Shigella flexneri 2a str. 2457T
gaaauaaaccgcgc

SEQ ID NO: 1894910 - RNA, 23 nt, Shigella flexneri 2a str. 2457T
gaaaguuuuucaacaccaugaca

SEQ ID NO: 1894911 - RNA, 21 nt, Shigella flexneri 2a str. 2457T
gaaauaacaucccuuaacacu

SEQ ID NO: 1894912 - RNA, 12 nt, Shigella flexneri 2a str. 2457T
gaaauaaucacc

SEQ ID NO: 1894913 - RNA, 17 nt, Shigella flexneri 2a str. 2457T
cuugcuguuucgccagu

SEQ ID NO: 1894914 - RNA, 23 nt, Shigella flexneri 2a str. 2457T
cuugcugcauugagguaaacaga

SEQ ID NO: 1894915 - RNA, 20 nt, Shigella flexneri 2a str. 2457T
cuugcucaaugaguucgcgc

SEQ ID NO: 1894916 - RNA, 14 nt, Shigella flexneri 2a str. 2457T
cuugcucauccgga

SEQ ID NO: 1894917 - RNA, 21 nt, Shigella flexneri 2a str. 2457T
cuugcggcaacgugcgguuuc

SEQ ID NO: 1894918 - RNA, 14 nt, Shigella flexneri 2a str. 2457T
cuucguuaucccag

SEQ ID NO: 1894919 - RNA, 16 nt, Shigella flexneri 2a str. 2457T
cuuguuaccugaugca

SEQ ID NO: 1894920 - RNA, 15 nt, Shigella flexneri 2a str. 2457T
cuuuaauuuugugca

SEQ ID NO: 1894921 - RNA, 20 nt, Shigella flexneri 2a str. 2457T
cuuuaauauuaacgccagcc

SEQ ID NO: 1894922 - RNA, 15 nt, Shigella flexneri 2a str. 2457T
cuuguuguaaugaca

SEQ ID NO: 1894923 - RNA, 16 nt, Shigella flexneri 2a str. 2457T
gaaaugggugacaucg

SEQ ID NO: 1894924 - RNA, 23 nt, Shigella flexneri 2a str. 2457T
gaaauguugaauugccgggugca

SEQ ID NO: 1894925 - RNA, 15 nt, Shigella flexneri 2a str. 2457T
gaaauuccagcggca

SEQ ID NO: 1894926 - RNA, 14 nt, Shigella flexneri 2a str. 2457T
gaaauucagcgucg

SEQ ID NO: 1894927 - RNA, 11 nt, Shigella flexneri 2a str. 2457T
gaaaucgccaa

SEQ ID NO: 1894928 - RNA, 13 nt, Shigella flexneri 2a str. 2457T
gaaaucuuccggc

SEQ ID NO: 1894929 - RNA, 14 nt, Shigella flexneri 2a str. 2457T
gaaaucucacccgg

SEQ ID NO: 1894930 - RNA, 21 nt, Shigella flexneri 2a str. 2457T
gaaaucucacccgguacauca

SEQ ID NO: 1894931 - RNA, 16 nt, Shigella flexneri 2a str. 2457T
gaacaacguaucuugc

SEQ ID NO: 1894932 - RNA, 18 nt, Shigella flexneri 2a str. 2457T
gaacaacguaucuugcgu

SEQ ID NO: 1894933 - RNA, 22 nt, Shigella flexneri 2a str. 2457T
gaacaaggcuuuaauauccggu

SEQ ID NO: 1894934 - RNA, 13 nt, Shigella flexneri 2a str. 2457T
gaacacgaucuca

SEQ ID NO: 1894935 - RNA, 14 nt, Shigella flexneri 2a str. 2457T
gaacaguaaagcgc

SEQ ID NO: 1894936 - RNA, 17 nt, Shigella flexneri 2a str. 2457T
gaacaggugcuuacguu

SEQ ID NO: 1894937 - RNA, 15 nt, Shigella flexneri 2a str. 2457T
gaacaguucagcagc

SEQ ID NO: 1894938 - RNA, 16 nt, Shigella flexneri 2a str. 2457T
gaacaguucagcagca

SEQ ID NO: 1894939 - RNA, 12 nt, Shigella flexneri 2a str. 2457T
gaacaucugccc

SEQ ID NO: 1894940 - RNA, 14 nt, Shigella flexneri 2a str. 2457T
gaacagaacuggcg

SEQ ID NO: 1894941 - RNA, 13 nt, Shigella flexneri 2a str. 2457T
gaacagcagcggu

SEQ ID NO: 1894942 - RNA, 21 nt, Shigella flexneri 2a str. 2457T
gaacagccacuggugagcggu

SEQ ID NO: 1894943 - RNA, 17 nt, Shigella flexneri 2a str. 2457T
gaacagccagaagcccg

SEQ ID NO: 1894944 - RNA, 19 nt, Shigella flexneri 2a str. 2457T
gaacccacgguacucauca

SEQ ID NO: 1894945 - RNA, 21 nt, Shigella flexneri 2a str. 2457T
gaaccaucgagaaucagcgag

SEQ ID NO: 1894946 - RNA, 14 nt, Shigella flexneri 2a str. 2457T
gaaccagugcucca

SEQ ID NO: 1894947 - RNA, 14 nt, Shigella flexneri 2a str. 2457T
gaaccagcggacaa

SEQ ID NO: 1894948 - RNA, 13 nt, Shigella flexneri 2a str. 2457T
gaaccaggcgcga

SEQ ID NO: 1894949 - RNA, 15 nt, Shigella flexneri 2a str. 2457T
gaaccgugucgccau

SEQ ID NO: 1894950 - RNA, 21 nt, Shigella flexneri 2a str. 2457T
gaacccuuacgucccgacccc

SEQ ID NO: 1894951 - RNA, 20 nt, Shigella flexneri 2a str. 2457T
gaacgccuguguccuguuga

SEQ ID NO: 1894952 - RNA, 18 nt, Shigella flexneri 2a str. 2457T
gaaccugugacagcagcg

SEQ ID NO: 1894953 - RNA, 15 nt, Shigella flexneri 2a str. 2457T
gaacggauucaguga

SEQ ID NO: 1894954 - RNA, 21 nt, Shigella flexneri 2a str. 2457T
gaacggcaauaccugaccguu

SEQ ID NO: 1894955 - RNA, 19 nt, Shigella flexneri 2a str. 2457T
gaacuacguuccauggcag

SEQ ID NO: 1894956 - RNA, 16 nt, Shigella flexneri 2a str. 2457T
cuggucgcccuucauc

SEQ ID NO: 1894957 - RNA, 15 nt, Shigella flexneri 2a str. 2457T
cugguagcaucugca

SEQ ID NO: 1894958 - RNA, 16 nt, Shigella flexneri 2a str. 2457T
cugguaccagcaccgu

SEQ ID NO: 1894959 - RNA, 22 nt, Shigella flexneri 2a str. 2457T
cuggucugacgcugaauacgca

SEQ ID NO: 1894960 - RNA, 22 nt, Shigella flexneri 2a str. 2457T
cugguggcgagguaggcaguca

SEQ ID NO: 1894961 - RNA, 18 nt, Shigella flexneri 2a str. 2457T
cuggcguacccaucaaca

SEQ ID NO: 1894962 - RNA, 18 nt, Shigella flexneri 2a str. 2457T
cugggagaauugcgaauu

SEQ ID NO: 1894963 - RNA, 21 nt, Shigella flexneri 2a str. 2457T
cugggcaaugcugucgguggu

SEQ ID NO: 1894964 - RNA, 18 nt, Shigella flexneri 2a str. 2457T
cuggcuugccagccauga

SEQ ID NO: 1894965 - RNA, 22 nt, Shigella flexneri 2a str. 2457T
cuggcuugguaacaugcucuuu

SEQ ID NO: 1894966 - RNA, 19 nt, Shigella flexneri 2a str. 2457T
cugggcaugguggcccgga

SEQ ID NO: 1894967 - RNA, 14 nt, Shigella flexneri 2a str. 2457T
cuggcgaaccagga

SEQ ID NO: 1894968 - RNA, 17 nt, Shigella flexneri 2a str. 2457T
cuggcgaacucuuccgg

SEQ ID NO: 1894969 - RNA, 22 nt, Shigella flexneri 2a str. 2457T
cuggccgaaaaaggaucaaccg

SEQ ID NO: 1894970 - RNA, 22 nt, Shigella flexneri 2a str. 2457T
cuggaucagacgcagccagcgu

SEQ ID NO: 1894971 - RNA, 22 nt, Shigella flexneri 2a str. 2457T
cuggacguugcguugcagcagg

SEQ ID NO: 1894972 - RNA, 21 nt, Shigella flexneri 2a str. 2457T
cugcgagguuauccgccagcg

SEQ ID NO: 1894973 - RNA, 23 nt, Shigella flexneri 2a str. 2457T
cugcgagguuauccgccagcgcc

SEQ ID NO: 1894974 - RNA, 19 nt, Shigella flexneri 2a str. 2457T
cugcgagauuccgccgcca

SEQ ID NO: 1894975 - RNA, 22 nt, Shigella flexneri 2a str. 2457T
cuggcagaugcgucuucugcag

SEQ ID NO: 1894976 - RNA, 13 nt, Shigella flexneri 2a str. 2457T
cuggaucugcggg

SEQ ID NO: 1894977 - RNA, 18 nt, Shigella flexneri 2a str. 2457T
cuggaucggcagucugcu

SEQ ID NO: 1894978 - RNA, 22 nt, Shigella flexneri 2a str. 2457T
cuggaugagucggaccaucauu

SEQ ID NO: 1894979 - RNA, 17 nt, Shigella flexneri 2a str. 2457T
cuggaugaagagcgaca

SEQ ID NO: 1894980 - RNA, 18 nt, Shigella flexneri 2a str. 2457T
cuggcagaaaguucgcga

SEQ ID NO: 1894981 - RNA, 15 nt, Shigella flexneri 2a str. 2457T
cuggcagaugcgucu

SEQ ID NO: 1894982 - RNA, 17 nt, Shigella flexneri 2a str. 2457T
cuuccagcuccagccgc

SEQ ID NO: 1894983 - RNA, 21 nt, Shigella flexneri 2a str. 2457T
cuucaucgugcucgcuuucca

SEQ ID NO: 1894984 - RNA, 21 nt, Shigella flexneri 2a str. 2457T
cuucaucacgcagcgucagca

SEQ ID NO: 1894985 - RNA, 13 nt, Shigella flexneri 2a str. 2457T
cuucaucgcccac

SEQ ID NO: 1894986 - RNA, 22 nt, Shigella flexneri 2a str. 2457T
cuucagcgaagcccacgccgcc

SEQ ID NO: 1894987 - RNA, 21 nt, Shigella flexneri 2a str. 2457T
cuucaggaauaagacaauuga

SEQ ID NO: 1894988 - RNA, 20 nt, Shigella flexneri 2a str. 2457T
cuucaguuuuucccgcuucg

SEQ ID NO: 1894989 - RNA, 15 nt, Shigella flexneri 2a str. 2457T
cuucacgcccagauc

SEQ ID NO: 1894990 - RNA, 23 nt, Shigella flexneri 2a str. 2457T
cuuaucaggccuguggugauuca

SEQ ID NO: 1894991 - RNA, 12 nt, Shigella flexneri 2a str. 2457T
cuuauccggcau

SEQ ID NO: 1894992 - RNA, 17 nt, Shigella flexneri 2a str. 2457T
cuucagccgcaaaccug

SEQ ID NO: 1894993 - RNA, 14 nt, Shigella flexneri 2a str. 2457T
cuucagcagcccau

SEQ ID NO: 1894994 - RNA, 19 nt, Shigella flexneri 2a str. 2457T
cuucacgguuacggccuuc

SEQ ID NO: 1894995 - RNA, 14 nt, Shigella flexneri 2a str. 2457T
cuuauccagcugcg

SEQ ID NO: 1894996 - RNA, 16 nt, Shigella flexneri 2a str. 2457T
cuucacuuuugccaga

SEQ ID NO: 1894997 - RNA, 20 nt, Shigella flexneri 2a str. 2457T
cuucgcgaacacccgacgug

SEQ ID NO: 1894998 - RNA, 22 nt, Shigella flexneri 2a str. 2457T
cuucgcgaucaaacgccagauc

SEQ ID NO: 1894999 - RNA, 22 nt, Shigella flexneri 2a str. 2457T
cuucgcggacaucguccagcuu

SEQ ID NO: 1895000 - RNA, 22 nt, Shigella flexneri 2a str. 2457T
cuucgcucauguuaucaagaua

SEQ ID NO: 1895001 - RNA, 16 nt, Shigella flexneri 2a str. 2457T
cuucgcuggcaacaca

SEQ ID NO: 1895002 - RNA, 18 nt, Shigella flexneri 2a str. 2457T
cuuccauuucaucgccag

SEQ ID NO: 1895003 - RNA, 14 nt, Shigella flexneri 2a str. 2457T
cuucccaaagaucu

SEQ ID NO: 1895004 - RNA, 15 nt, Shigella flexneri 2a str. 2457T
cuguaaccagcgcag

SEQ ID NO: 1895005 - RNA, 21 nt, Shigella flexneri 2a str. 2457T
cuguaccaccagaaucgccag

SEQ ID NO: 1895006 - RNA, 15 nt, Shigella flexneri 2a str. 2457T
cuguaccacaaccug

SEQ ID NO: 1895007 - RNA, 14 nt, Shigella flexneri 2a str. 2457T
cuguacauugagcu

SEQ ID NO: 1895008 - RNA, 17 nt, Shigella flexneri 2a str. 2457T
cuguaagccaccgaaca

SEQ ID NO: 1895009 - RNA, 13 nt, Shigella flexneri 2a str. 2457T
cugguucugcggg

SEQ ID NO: 1895010 - RNA, 21 nt, Shigella flexneri 2a str. 2457T
cugguuacucaccagccgcga

SEQ ID NO: 1895011 - RNA, 13 nt, Shigella flexneri 2a str. 2457T
cugucgcagccag

SEQ ID NO: 1895012 - RNA, 14 nt, Shigella flexneri 2a str. 2457T
cugucgaucuccgg

SEQ ID NO: 1895013 - RNA, 16 nt, Shigella flexneri 2a str. 2457T
cuguuugucgaucauc

SEQ ID NO: 1895014 - RNA, 14 nt, Shigella flexneri 2a str. 2457T
cuguucugcgcuug

SEQ ID NO: 1895015 - RNA, 18 nt, Shigella flexneri 2a str. 2457T
cuguugauguccaguucc

SEQ ID NO: 1895016 - RNA, 12 nt, Shigella flexneri 2a str. 2457T
cuguuugccagu

SEQ ID NO: 1895017 - RNA, 16 nt, Shigella flexneri 2a str. 2457T
cuuagcaacaggccag

SEQ ID NO: 1895018 - RNA, 22 nt, Shigella flexneri 2a str. 2457T
cuuagcguucugcguuaagacu

SEQ ID NO: 1895019 - RNA, 17 nt, Shigella flexneri 2a str. 2457T
cugucgggaacacuuua

SEQ ID NO: 1895020 - RNA, 17 nt, Shigella flexneri 2a str. 2457T
cuguucacugugcuggu

SEQ ID NO: 1895021 - RNA, 20 nt, Shigella flexneri 2a str. 2457T
cugugcgcgccaggagacgc

SEQ ID NO: 1895022 - RNA, 13 nt, Shigella flexneri 2a str. 2457T
gacuuccagcgua

SEQ ID NO: 1895023 - RNA, 21 nt, Shigella flexneri 2a str. 2457T
gagaaaaauaucguaggccug

SEQ ID NO: 1895024 - RNA, 18 nt, Shigella flexneri 2a str. 2457T
gagaaagucguaggccug

SEQ ID NO: 1895025 - RNA, 13 nt, Shigella flexneri 2a str. 2457T
gacugcaaaccau

SEQ ID NO: 1895026 - RNA, 18 nt, Shigella flexneri 2a str. 2457T
gacugccggaugcaucgc

SEQ ID NO: 1895027 - RNA, 18 nt, Shigella flexneri 2a str. 2457T
gacugcccgcgagcgugg

SEQ ID NO: 1895028 - RNA, 22 nt, Shigella flexneri 2a str. 2457T
gacugcggcgugggcgcuguug

SEQ ID NO: 1895029 - RNA, 13 nt, Shigella flexneri 2a str. 2457T
gacuggaaaucaa

SEQ ID NO: 1895030 - RNA, 20 nt, Shigella flexneri 2a str. 2457T
gacuguuucacccgccuguu

SEQ ID NO: 1895031 - RNA, 16 nt, Shigella flexneri 2a str. 2457T
gacuggagccgcauca

SEQ ID NO: 1895032 - RNA, 15 nt, Shigella flexneri 2a str. 2457T
gacuauccgccgcuu

SEQ ID NO: 1895033 - RNA, 19 nt, Shigella flexneri 2a str. 2457T
gacucagcggcugccagca

SEQ ID NO: 1895034 - RNA, 13 nt, Shigella flexneri 2a str. 2457T
gacugauaacgcg

SEQ ID NO: 1895035 - RNA, 19 nt, Shigella flexneri 2a str. 2457T
gacugauaacgcggcagca

SEQ ID NO: 1895036 - RNA, 11 nt, Shigella flexneri 2a str. 2457T
gacugacuccg

SEQ ID NO: 1895037 - RNA, 13 nt, Shigella flexneri 2a str. 2457T
gagaaucacgucg

SEQ ID NO: 1895038 - RNA, 17 nt, Shigella flexneri 2a str. 2457T
gagaagccaccgcgcca

SEQ ID NO: 1895039 - RNA, 18 nt, Shigella flexneri 2a str. 2457T
gagagcuuuucagccuga

SEQ ID NO: 1895040 - RNA, 15 nt, Shigella flexneri 2a str. 2457T
gagauacaucaccgc

SEQ ID NO: 1895041 - RNA, 17 nt, Shigella flexneri 2a str. 2457T
gagauacaucaccgcca

SEQ ID NO: 1895042 - RNA, 13 nt, Shigella flexneri 2a str. 2457T
gagcaacugcgcu

SEQ ID NO: 1895043 - RNA, 13 nt, Shigella flexneri 2a str. 2457T
gagcaaccaccug

SEQ ID NO: 1895044 - RNA, 20 nt, Shigella flexneri 2a str. 2457T
gagauuuaugacaaacgcaa

SEQ ID NO: 1895045 - RNA, 21 nt, Shigella flexneri 2a str. 2457T
gagaucuuuaucaaucaccgc

SEQ ID NO: 1895046 - RNA, 16 nt, Shigella flexneri 2a str. 2457T
gagaucgagcgccguu

SEQ ID NO: 1895047 - RNA, 21 nt, Shigella flexneri 2a str. 2457T
gagcacgcaagguuucaguaa

SEQ ID NO: 1895048 - RNA, 18 nt, Shigella flexneri 2a str. 2457T
gacguuaacuacaaucac

SEQ ID NO: 1895049 - RNA, 17 nt, Shigella flexneri 2a str. 2457T
gacguguugucagcuca

SEQ ID NO: 1895050 - RNA, 21 nt, Shigella flexneri 2a str. 2457T
gacgugcgcaaacuucuucag

SEQ ID NO: 1895051 - RNA, 22 nt, Shigella flexneri 2a str. 2457T
gacguucuucgcugacaguacc

SEQ ID NO: 1895052 - RNA, 14 nt, Shigella flexneri 2a str. 2457T
gacguucagccaua

SEQ ID NO: 1895053 - RNA, 19 nt, Shigella flexneri 2a str. 2457T
gacguaacgaccaccaccg

SEQ ID NO: 1895054 - RNA, 16 nt, Shigella flexneri 2a str. 2457T
gacggcuacgcucauu

SEQ ID NO: 1895055 - RNA, 14 nt, Shigella flexneri 2a str. 2457T
gacggcugauaugc

SEQ ID NO: 1895056 - RNA, 18 nt, Shigella flexneri 2a str. 2457T
gacgcccugcgcugguga

SEQ ID NO: 1895057 - RNA, 20 nt, Shigella flexneri 2a str. 2457T
gacgcauccgaucgcgcauc

SEQ ID NO: 1895058 - RNA, 17 nt, Shigella flexneri 2a str. 2457T
gacgcgcagcgucgcau

SEQ ID NO: 1895059 - RNA, 14 nt, Shigella flexneri 2a str. 2457T
gacgcgcagcuuca

SEQ ID NO: 1895060 - RNA, 13 nt, Shigella flexneri 2a str. 2457T
gacgcgcaucacg

SEQ ID NO: 1895061 - RNA, 17 nt, Shigella flexneri 2a str. 2457T
gacgcgguauuggugaa

SEQ ID NO: 1895062 - RNA, 18 nt, Shigella flexneri 2a str. 2457T
gacgcgucagugucuuau

SEQ ID NO: 1895063 - RNA, 15 nt, Shigella flexneri 2a str. 2457T
gacgcuggucgcguc

SEQ ID NO: 1895064 - RNA, 22 nt, Shigella flexneri 2a str. 2457T
gacgcugaugucagcacuucca

SEQ ID NO: 1895065 - RNA, 20 nt, Shigella flexneri 2a str. 2457T
gacgcuguuccggcggcagg

SEQ ID NO: 1895066 - RNA, 13 nt, Shigella flexneri 2a str. 2457T
gacgcuuacggac

SEQ ID NO: 1895067 - RNA, 17 nt, Shigella flexneri 2a str. 2457T
gacggauaaggcguuca

SEQ ID NO: 1895068 - RNA, 14 nt, Shigella flexneri 2a str. 2457T
gacccgcagccagc

SEQ ID NO: 1895069 - RNA, 21 nt, Shigella flexneri 2a str. 2457T
gaccaucuuccaguugcacgc

SEQ ID NO: 1895070 - RNA, 12 nt, Shigella flexneri 2a str. 2457T
gaccaucgccag

SEQ ID NO: 1895071 - RNA, 15 nt, Shigella flexneri 2a str. 2457T
gaccaucagcugcca

SEQ ID NO: 1895072 - RNA, 15 nt, Shigella flexneri 2a str. 2457T
gaccaguaccaccgc

SEQ ID NO: 1895073 - RNA, 18 nt, Shigella flexneri 2a str. 2457T
gaccauacagcagcaacg

SEQ ID NO: 1895074 - RNA, 14 nt, Shigella flexneri 2a str. 2457T
gacgaaaccgggca

SEQ ID NO: 1895075 - RNA, 17 nt, Shigella flexneri 2a str. 2457T
gaccuucuucagcaaua

SEQ ID NO: 1895076 - RNA, 17 nt, Shigella flexneri 2a str. 2457T
gaccuucugaauaauga

SEQ ID NO: 1895077 - RNA, 17 nt, Shigella flexneri 2a str. 2457T
gaccguucgccagguca

SEQ ID NO: 1895078 - RNA, 23 nt, Shigella flexneri 2a str. 2457T
gacaaggcguugauuggcgcagg

SEQ ID NO: 1895079 - RNA, 16 nt, Shigella flexneri 2a str. 2457T
gacacaauccaugcca

SEQ ID NO: 1895080 - RNA, 13 nt, Shigella flexneri 2a str. 2457T
gacaaucgccagu

SEQ ID NO: 1895081 - RNA, 14 nt, Shigella flexneri 2a str. 2457T
gaauuugcgccguu

SEQ ID NO: 1895082 - RNA, 16 nt, Shigella flexneri 2a str. 2457T
gaauuuguaggccgga

SEQ ID NO: 1895083 - RNA, 22 nt, Shigella flexneri 2a str. 2457T
gaacucuuucaaaccguagucc

SEQ ID NO: 1895084 - RNA, 20 nt, Shigella flexneri 2a str. 2457T
gaacucgcugcgcggcagcu

SEQ ID NO: 1895085 - RNA, 23 nt, Shigella flexneri 2a str. 2457T
gaauacagaacagugccaugcca

SEQ ID NO: 1895086 - RNA, 15 nt, Shigella flexneri 2a str. 2457T
gaauaccguaacgac

SEQ ID NO: 1895087 - RNA, 21 nt, Shigella flexneri 2a str. 2457T
gaauacgcuggcgcgccgccu

SEQ ID NO: 1895088 - RNA, 23 nt, Shigella flexneri 2a str. 2457T
gaaucaggaaccacaaccacuuu

SEQ ID NO: 1895089 - RNA, 19 nt, Shigella flexneri 2a str. 2457T
gaaugacgacguaccagcg

SEQ ID NO: 1895090 - RNA, 12 nt, Shigella flexneri 2a str. 2457T
gaaucugauuag

SEQ ID NO: 1895091 - RNA, 20 nt, Shigella flexneri 2a str. 2457T
gaaucguucauaccacgcca

SEQ ID NO: 1895092 - RNA, 15 nt, Shigella flexneri 2a str. 2457T
gacaguccccucgcc

SEQ ID NO: 1895093 - RNA, 18 nt, Shigella flexneri 2a str. 2457T
gacagucuggaagccagu

SEQ ID NO: 1895094 - RNA, 15 nt, Shigella flexneri 2a str. 2457T
gacaucgccacggca

SEQ ID NO: 1895095 - RNA, 14 nt, Shigella flexneri 2a str. 2457T
gaccaccagcacgc

SEQ ID NO: 1895096 - RNA, 17 nt, Shigella flexneri 2a str. 2457T
gaccagagcugauacgg

SEQ ID NO: 1895097 - RNA, 22 nt, Shigella flexneri 2a str. 2457T
gaccacuucgguacccagacgc

SEQ ID NO: 1895098 - RNA, 19 nt, Shigella flexneri 2a str. 2457T
gaccagaaacgccaccauu

SEQ ID NO: 1895099 - RNA, 14 nt, Shigella flexneri 2a str. 2457T
gacagcgccgcuuu

SEQ ID NO: 1895100 - RNA, 13 nt, Shigella flexneri 2a str. 2457T
gacagccuaccag

SEQ ID NO: 1895101 - RNA, 14 nt, Shigella flexneri 2a str. 2457T
gacagggaucucuu

SEQ ID NO: 1895102 - RNA, 18 nt, Shigella flexneri 2a str. 2457T
gacagcagguugcgugca

SEQ ID NO: 1895103 - RNA, 13 nt, Shigella flexneri 2a str. 2457T
gacaccagaaugg

SEQ ID NO: 1895104 - RNA, 15 nt, Shigella flexneri 2a str. 2457T
cucaucgcugcgcuc

SEQ ID NO: 1895105 - RNA, 16 nt, Shigella flexneri 2a str. 2457T
cucaucuggcguacca

SEQ ID NO: 1895106 - RNA, 19 nt, Shigella flexneri 2a str. 2457T
cucaucgccuuccagcgau

SEQ ID NO: 1895107 - RNA, 19 nt, Shigella flexneri 2a str. 2457T
cucaucggcauacagcgac

SEQ ID NO: 1895108 - RNA, 15 nt, Shigella flexneri 2a str. 2457T
cucagucggugcgau

SEQ ID NO: 1895109 - RNA, 15 nt, Shigella flexneri 2a str. 2457T
cucaguuaacggcau

SEQ ID NO: 1895110 - RNA, 14 nt, Shigella flexneri 2a str. 2457T
cucaguuaaucgcg

SEQ ID NO: 1895111 - RNA, 13 nt, Shigella flexneri 2a str. 2457T
cucaccagccgcg

SEQ ID NO: 1895112 - RNA, 23 nt, Shigella flexneri 2a str. 2457T
cucacgggcggcagguugaugau

SEQ ID NO: 1895113 - RNA, 18 nt, Shigella flexneri 2a str. 2457T
cucauuugauugccggau

SEQ ID NO: 1895114 - RNA, 17 nt, Shigella flexneri 2a str. 2457T
cuccagcgccagcgcgc

SEQ ID NO: 1895115 - RNA, 15 nt, Shigella flexneri 2a str. 2457T
cuccagcccgcgucg

SEQ ID NO: 1895116 - RNA, 20 nt, Shigella flexneri 2a str. 2457T
cuacuucuucuucgcugcag

SEQ ID NO: 1895117 - RNA, 15 nt, Shigella flexneri 2a str. 2457T
cguucuucggcacug

SEQ ID NO: 1895118 - RNA, 22 nt, Shigella flexneri 2a str. 2457T
cguugagaaaacuuccggcaga

SEQ ID NO: 1895119 - RNA, 22 nt, Shigella flexneri 2a str. 2457T
cguugagcaaucgacgccguuu

SEQ ID NO: 1895120 - RNA, 16 nt, Shigella flexneri 2a str. 2457T
cguugagggcgcaauu

SEQ ID NO: 1895121 - RNA, 14 nt, Shigella flexneri 2a str. 2457T
cuacagguaaggua

SEQ ID NO: 1895122 - RNA, 17 nt, Shigella flexneri 2a str. 2457T
cuacagaggaaucgcug

SEQ ID NO: 1895123 - RNA, 21 nt, Shigella flexneri 2a str. 2457T
cucaaucuucacgucuuucgg

SEQ ID NO: 1895124 - RNA, 19 nt, Shigella flexneri 2a str. 2457T
cucaacuucgcuaaaucug

SEQ ID NO: 1895125 - RNA, 19 nt, Shigella flexneri 2a str. 2457T
cucaaacgaaucugcaauc

SEQ ID NO: 1895126 - RNA, 18 nt, Shigella flexneri 2a str. 2457T
cuauaccgccgaucgccg

SEQ ID NO: 1895127 - RNA, 16 nt, Shigella flexneri 2a str. 2457T
cuaucugccguucagc

SEQ ID NO: 1895128 - RNA, 21 nt, Shigella flexneri 2a str. 2457T
cuaucugcugcuugcgguuug

SEQ ID NO: 1895129 - RNA, 15 nt, Shigella flexneri 2a str. 2457T
cuaucuucgauaaac

SEQ ID NO: 1895130 - RNA, 16 nt, Shigella flexneri 2a str. 2457T
cuaugaagaacuggaa

SEQ ID NO: 1895131 - RNA, 20 nt, Shigella flexneri 2a str. 2457T
cucgacgcccagcuucauca

SEQ ID NO: 1895132 - RNA, 21 nt, Shigella flexneri 2a str. 2457T
cuccggcuuuuuacuucucag

SEQ ID NO: 1895133 - RNA, 14 nt, Shigella flexneri 2a str. 2457T
cucccugccuccau

SEQ ID NO: 1895134 - RNA, 14 nt, Shigella flexneri 2a str. 2457T
cuccgcaauaugcg

SEQ ID NO: 1895135 - RNA, 10 nt, Shigella flexneri 2a str. 2457T
cuccgcaaug

SEQ ID NO: 1895136 - RNA, 19 nt, Shigella flexneri 2a str. 2457T
cucgccaucaaauagcccc

SEQ ID NO: 1895137 - RNA, 19 nt, Shigella flexneri 2a str. 2457T
cugccagcguaccaugauc

SEQ ID NO: 1895138 - RNA, 16 nt, Shigella flexneri 2a str. 2457T
cugccagggagcgaaa

SEQ ID NO: 1895139 - RNA, 20 nt, Shigella flexneri 2a str. 2457T
cugccagcguaaauccugac

SEQ ID NO: 1895140 - RNA, 20 nt, Shigella flexneri 2a str. 2457T
cugccagacccauaaucaga

SEQ ID NO: 1895141 - RNA, 19 nt, Shigella flexneri 2a str. 2457T
cugccaguuauagcgcaga

SEQ ID NO: 1895142 - RNA, 20 nt, Shigella flexneri 2a str. 2457T
cugccaguuauagcgcagac

SEQ ID NO: 1895143 - RNA, 16 nt, Shigella flexneri 2a str. 2457T
cugcccgcguggcgca

SEQ ID NO: 1895144 - RNA, 19 nt, Shigella flexneri 2a str. 2457T
cugcaucaaccaacaccug

SEQ ID NO: 1895145 - RNA, 23 nt, Shigella flexneri 2a str. 2457T
cugccggaugcaucgcauccgac

SEQ ID NO: 1895146 - RNA, 13 nt, Shigella flexneri 2a str. 2457T
cugcccugcuggu

SEQ ID NO: 1895147 - RNA, 16 nt, Shigella flexneri 2a str. 2457T
cugcccguuaaccaua

SEQ ID NO: 1895148 - RNA, 15 nt, Shigella flexneri 2a str. 2457T
cugccgaccaucugu

SEQ ID NO: 1895149 - RNA, 12 nt, Shigella flexneri 2a str. 2457T
cugccgccagca

SEQ ID NO: 1895150 - RNA, 19 nt, Shigella flexneri 2a str. 2457T
cugccguuaacccgucugg

SEQ ID NO: 1895151 - RNA, 13 nt, Shigella flexneri 2a str. 2457T
cugcgaaucgcuu

SEQ ID NO: 1895152 - RNA, 22 nt, Shigella flexneri 2a str. 2457T
cugcgacagggaucucuuccag

SEQ ID NO: 1895153 - RNA, 23 nt, Shigella flexneri 2a str. 2457T
cugcgacgcaaacgacgagcgcu

SEQ ID NO: 1895154 - RNA, 13 nt, Shigella flexneri 2a str. 2457T
cugcgacucucag

SEQ ID NO: 1895155 - RNA, 18 nt, Shigella flexneri 2a str. 2457T
cugccuucacuuccggca

SEQ ID NO: 1895156 - RNA, 15 nt, Shigella flexneri 2a str. 2457T
cugccuuauccagca

SEQ ID NO: 1895157 - RNA, 13 nt, Shigella flexneri 2a str. 2457T
cugccucugaaac

SEQ ID NO: 1895158 - RNA, 13 nt, Shigella flexneri 2a str. 2457T
cugccugaugcgc

SEQ ID NO: 1895159 - RNA, 21 nt, Shigella flexneri 2a str. 2457T
cugccucucuucgcugcuggu

SEQ ID NO: 1895160 - RNA, 20 nt, Shigella flexneri 2a str. 2457T
cugaccacggccacagccag

SEQ ID NO: 1895161 - RNA, 19 nt, Shigella flexneri 2a str. 2457T
cugaccaaauacacgcacg

SEQ ID NO: 1895162 - RNA, 20 nt, Shigella flexneri 2a str. 2457T
cugacgugauuuagcaccga

SEQ ID NO: 1895163 - RNA, 18 nt, Shigella flexneri 2a str. 2457T
cugagcgguuaacacggc

SEQ ID NO: 1895164 - RNA, 17 nt, Shigella flexneri 2a str. 2457T
cugaucaauauagauau

SEQ ID NO: 1895165 - RNA, 23 nt, Shigella flexneri 2a str. 2457T
cugcacggagauauccagcgccg

SEQ ID NO: 1895166 - RNA, 16 nt, Shigella flexneri 2a str. 2457T
cugcacuggcuuccag

SEQ ID NO: 1895167 - RNA, 23 nt, Shigella flexneri 2a str. 2457T
cugcacuuugugucagcgccaga

SEQ ID NO: 1895168 - RNA, 15 nt, Shigella flexneri 2a str. 2457T
cugcaaacgacguau

SEQ ID NO: 1895169 - RNA, 16 nt, Shigella flexneri 2a str. 2457T
cugaugcaggcgaucg

SEQ ID NO: 1895170 - RNA, 15 nt, Shigella flexneri 2a str. 2457T
cugcaacgucuccgg

SEQ ID NO: 1895171 - RNA, 15 nt, Shigella flexneri 2a str. 2457T
cugaucgugccagga

SEQ ID NO: 1895172 - RNA, 22 nt, Shigella flexneri 2a str. 2457T
cugaucgcgcaguaaauccgcc

SEQ ID NO: 1895173 - RNA, 21 nt, Shigella flexneri 2a str. 2457T
cucgugaagagauggaucaac

SEQ ID NO: 1895174 - RNA, 23 nt, Shigella flexneri 2a str. 2457T
cucguugaucacccacaucagcg

SEQ ID NO: 1895175 - RNA, 14 nt, Shigella flexneri 2a str. 2457T
cucgucgaacucau

SEQ ID NO: 1895176 - RNA, 13 nt, Shigella flexneri 2a str. 2457T
cucuuucauuuca

SEQ ID NO: 1895177 - RNA, 18 nt, Shigella flexneri 2a str. 2457T
cucuuucccggcaaucac

SEQ ID NO: 1895178 - RNA, 18 nt, Shigella flexneri 2a str. 2457T
cucuuuaaaaagaaaccu

SEQ ID NO: 1895179 - RNA, 22 nt, Shigella flexneri 2a str. 2457T
cucuugcuccacaagcuccggc

SEQ ID NO: 1895180 - RNA, 15 nt, Shigella flexneri 2a str. 2457T
cucugccgcaauggc

SEQ ID NO: 1895181 - RNA, 13 nt, Shigella flexneri 2a str. 2457T
cucucuuccaguu

SEQ ID NO: 1895182 - RNA, 18 nt, Shigella flexneri 2a str. 2457T
cucucuuucucgcugaca

SEQ ID NO: 1895183 - RNA, 23 nt, Shigella flexneri 2a str. 2457T
cugaacuaaagccuuuugccagu

SEQ ID NO: 1895184 - RNA, 19 nt, Shigella flexneri 2a str. 2457T
cugaagaaaucccccagca

SEQ ID NO: 1895185 - RNA, 23 nt, Shigella flexneri 2a str. 2457T
cugaagaaaauggccagccagca

SEQ ID NO: 1895186 - RNA, 17 nt, Shigella flexneri 2a str. 2457T
cugaauaucacgggcgc

SEQ ID NO: 1895187 - RNA, 19 nt, Shigella flexneri 2a str. 2457T
cugacacuauucgccagca

SEQ ID NO: 1895188 - RNA, 18 nt, Shigella flexneri 2a str. 2457T
cugacauaaacaccagca

SEQ ID NO: 1895189 - RNA, 13 nt, Shigella flexneri 2a str. 2457T
cugaaugccggau

SEQ ID NO: 1895190 - RNA, 15 nt, Shigella flexneri 2a str. 2457T
cugaauuucgccgca

SEQ ID NO: 1895191 - RNA, 16 nt, Shigella flexneri 2a str. 2457T
cguggagagcagcauc

SEQ ID NO: 1895192 - RNA, 15 nt, Shigella flexneri 2a str. 2457T
cgugcugcgcagacg

SEQ ID NO: 1895193 - RNA, 13 nt, Shigella flexneri 2a str. 2457T
cgugcugccagcg

SEQ ID NO: 1895194 - RNA, 18 nt, Shigella flexneri 2a str. 2457T
cgugcucuggcaagcgac

SEQ ID NO: 1895195 - RNA, 14 nt, Shigella flexneri 2a str. 2457T
cgugcgcgccguga

SEQ ID NO: 1895196 - RNA, 16 nt, Shigella flexneri 2a str. 2457T
cgugacuuccagcgua

SEQ ID NO: 1895197 - RNA, 20 nt, Shigella flexneri 2a str. 2457T
cgugauugucggugccggaa

SEQ ID NO: 1895198 - RNA, 16 nt, Shigella flexneri 2a str. 2457T
cgugauuuagcaccga

SEQ ID NO: 1895199 - RNA, 19 nt, Shigella flexneri 2a str. 2457T
cgugccagaacugauaacg

SEQ ID NO: 1895200 - RNA, 11 nt, Shigella flexneri 2a str. 2457T
cgugccauaaa

SEQ ID NO: 1895201 - RNA, 14 nt, Shigella flexneri 2a str. 2457T
cgucuacuaacgcu

SEQ ID NO: 1895202 - RNA, 20 nt, Shigella flexneri 2a str. 2457T
cgugacaauaauacccagca

SEQ ID NO: 1895203 - RNA, 20 nt, Shigella flexneri 2a str. 2457T
cgugaccaguugcuccagca

SEQ ID NO: 1895204 - RNA, 22 nt, Shigella flexneri 2a str. 2457T
cgucucuucaauucgcgauaac

SEQ ID NO: 1895205 - RNA, 17 nt, Shigella flexneri 2a str. 2457T
cgucggcgucagcgcca

SEQ ID NO: 1895206 - RNA, 23 nt, Shigella flexneri 2a str. 2457T
cguuaucagggagucuugcugga

SEQ ID NO: 1895207 - RNA, 15 nt, Shigella flexneri 2a str. 2457T
cguucaaaacggcug

SEQ ID NO: 1895208 - RNA, 12 nt, Shigella flexneri 2a str. 2457T
cguuaugucucc

SEQ ID NO: 1895209 - RNA, 22 nt, Shigella flexneri 2a str. 2457T
cguuaugcaccgacaauccggu

SEQ ID NO: 1895210 - RNA, 16 nt, Shigella flexneri 2a str. 2457T
cguuauucagccugac

SEQ ID NO: 1895211 - RNA, 13 nt, Shigella flexneri 2a str. 2457T
cguuaccuucggc

SEQ ID NO: 1895212 - RNA, 15 nt, Shigella flexneri 2a str. 2457T
cguuacugucgcgca

SEQ ID NO: 1895213 - RNA, 20 nt, Shigella flexneri 2a str. 2457T
cguuacccgcagccaucaac

SEQ ID NO: 1895214 - RNA, 21 nt, Shigella flexneri 2a str. 2457T
cguuaauauugcccgggcgag

SEQ ID NO: 1895215 - RNA, 23 nt, Shigella flexneri 2a str. 2457T
cguuaacguuuuucgcugucggu

SEQ ID NO: 1895216 - RNA, 22 nt, Shigella flexneri 2a str. 2457T
cguguuuagcccuucacgcacc

SEQ ID NO: 1895217 - RNA, 15 nt, Shigella flexneri 2a str. 2457T
cguguuaauuaccua

SEQ ID NO: 1895218 - RNA, 22 nt, Shigella flexneri 2a str. 2457T
cgugucggugcucaucagcccg

SEQ ID NO: 1895219 - RNA, 12 nt, Shigella flexneri 2a str. 2457T
cguucgccguuu

SEQ ID NO: 1895220 - RNA, 21 nt, Shigella flexneri 2a str. 2457T
cguucgcgccgcauccggcau

SEQ ID NO: 1895221 - RNA, 17 nt, Shigella flexneri 2a str. 2457T
cguucaucccacucuga

SEQ ID NO: 1895222 - RNA, 18 nt, Shigella flexneri 2a str. 2457T
cguucaucaguuccaguu

SEQ ID NO: 1895223 - RNA, 21 nt, Shigella flexneri 2a str. 2457T
cguucacgccgcauccggcau

SEQ ID NO: 1895224 - RNA, 16 nt, Shigella flexneri 2a str. 2457T
cguucacgccgcaucc

SEQ ID NO: 1895225 - RNA, 13 nt, Shigella flexneri 2a str. 2457T
cguguaggccuga

SEQ ID NO: 1895226 - RNA, 19 nt, Shigella flexneri 2a str. 2457T
cguggucaauauuaucgau

SEQ ID NO: 1895227 - RNA, 22 nt, Shigella flexneri 2a str. 2457T
cguggcccauacguuugccuuu

SEQ ID NO: 1895228 - RNA, 20 nt, Shigella flexneri 2a str. 2457T
cguggcagggaaucagauuc

SEQ ID NO: 1895229 - RNA, 14 nt, Shigella flexneri 2a str. 2457T
cggugaccagcagc

SEQ ID NO: 1895230 - RNA, 13 nt, Shigella flexneri 2a str. 2457T
cgguugccagaua

SEQ ID NO: 1895231 - RNA, 20 nt, Shigella flexneri 2a str. 2457T
cgguugcggaacccagcgcg

SEQ ID NO: 1895232 - RNA, 14 nt, Shigella flexneri 2a str. 2457T
cgguucaucacgaa

SEQ ID NO: 1895233 - RNA, 18 nt, Shigella flexneri 2a str. 2457T
cgguucauggucgccaag

SEQ ID NO: 1895234 - RNA, 16 nt, Shigella flexneri 2a str. 2457T
cgguucaauuuccagu

SEQ ID NO: 1895235 - RNA, 13 nt, Shigella flexneri 2a str. 2457T
cguaaacgugcgg

SEQ ID NO: 1895236 - RNA, 21 nt, Shigella flexneri 2a str. 2457T
cguaagcaaaaguagcaaagu

SEQ ID NO: 1895237 - RNA, 16 nt, Shigella flexneri 2a str. 2457T
cguaacucauccaacu

SEQ ID NO: 1895238 - RNA, 16 nt, Shigella flexneri 2a str. 2457T
cguaaaucccgccauu

SEQ ID NO: 1895239 - RNA, 14 nt, Shigella flexneri 2a str. 2457T
cguaaccgagcaga

SEQ ID NO: 1895240 - RNA, 19 nt, Shigella flexneri 2a str. 2457T
cguaaccagacggcguaau

SEQ ID NO: 1895241 - RNA, 15 nt, Shigella flexneri 2a str. 2457T
cguaacgacugacuu

SEQ ID NO: 1895242 - RNA, 21 nt, Shigella flexneri 2a str. 2457T
cguacucaccagacaucccag

SEQ ID NO: 1895243 - RNA, 17 nt, Shigella flexneri 2a str. 2457T
cguaccggccuugccag

SEQ ID NO: 1895244 - RNA, 22 nt, Shigella flexneri 2a str. 2457T
cguaccgcagcaauggccggaa

SEQ ID NO: 1895245 - RNA, 16 nt, Shigella flexneri 2a str. 2457T
cguaauaaaaucuauu

SEQ ID NO: 1895246 - RNA, 21 nt, Shigella flexneri 2a str. 2457T
cguaauaagguucauugagcg

SEQ ID NO: 1895247 - RNA, 17 nt, Shigella flexneri 2a str. 2457T
cguauguggugggcgaa

SEQ ID NO: 1895248 - RNA, 22 nt, Shigella flexneri 2a str. 2457T
cguauugagaucaccugcugga

SEQ ID NO: 1895249 - RNA, 18 nt, Shigella flexneri 2a str. 2457T
cgucaaacgcacgucuga

SEQ ID NO: 1895250 - RNA, 22 nt, Shigella flexneri 2a str. 2457T
cguauugcgcagagaugcccau

SEQ ID NO: 1895251 - RNA, 17 nt, Shigella flexneri 2a str. 2457T
cguauggcgacaaggcg

SEQ ID NO: 1895252 - RNA, 15 nt, Shigella flexneri 2a str. 2457T
cguaugcccagcgca

SEQ ID NO: 1895253 - RNA, 19 nt, Shigella flexneri 2a str. 2457T
cguaggucggauaagacgc

SEQ ID NO: 1895254 - RNA, 15 nt, Shigella flexneri 2a str. 2457T
cguaggacacagaau

SEQ ID NO: 1895255 - RNA, 18 nt, Shigella flexneri 2a str. 2457T
cgucgauugcucaacgcc

SEQ ID NO: 1895256 - RNA, 13 nt, Shigella flexneri 2a str. 2457T
cgucgaucaacgc

SEQ ID NO: 1895257 - RNA, 15 nt, Shigella flexneri 2a str. 2457T
cgucgcccgcgcgag

SEQ ID NO: 1895258 - RNA, 22 nt, Shigella flexneri 2a str. 2457T
cgucauccuaaacgcuggcagg

SEQ ID NO: 1895259 - RNA, 15 nt, Shigella flexneri 2a str. 2457T
cgucagccugcucag

SEQ ID NO: 1895260 - RNA, 20 nt, Shigella flexneri 2a str. 2457T
cgucauggcuguccuuuacc

SEQ ID NO: 1895261 - RNA, 15 nt, Shigella flexneri 2a str. 2457T
cgucauugacgcugg

SEQ ID NO: 1895262 - RNA, 21 nt, Shigella flexneri 2a str. 2457T
gcccgcuuucaccaucgcgau

SEQ ID NO: 1895263 - RNA, 17 nt, Shigella flexneri 2a str. 2457T
gcccgcuuucaccaucg

SEQ ID NO: 1895264 - RNA, 18 nt, Shigella flexneri 2a str. 2457T
gcccgcuuccagcgcauc

SEQ ID NO: 1895265 - RNA, 17 nt, Shigella flexneri 2a str. 2457T
gcccgcuucaucgugcu

SEQ ID NO: 1895266 - RNA, 19 nt, Shigella flexneri 2a str. 2457T
gcccggcaacguugcccgu

SEQ ID NO: 1895267 - RNA, 16 nt, Shigella flexneri 2a str. 2457T
gcccggcaauggguaa

SEQ ID NO: 1895268 - RNA, 16 nt, Shigella flexneri 2a str. 2457T
gcccggagcagcaguc

SEQ ID NO: 1895269 - RNA, 14 nt, Shigella flexneri 2a str. 2457T
gcccagcgcaucag

SEQ ID NO: 1895270 - RNA, 22 nt, Shigella flexneri 2a str. 2457T
gcccagcgcaucaggcaaucuu

SEQ ID NO: 1895271 - RNA, 22 nt, Shigella flexneri 2a str. 2457T
gccccacaaacccgccagacca

SEQ ID NO: 1895272 - RNA, 22 nt, Shigella flexneri 2a str. 2457T
gcccagugagucggggccagca

SEQ ID NO: 1895273 - RNA, 21 nt, Shigella flexneri 2a str. 2457T
gcccaguuagacgugcgaaug

SEQ ID NO: 1895274 - RNA, 20 nt, Shigella flexneri 2a str. 2457T
gccccagcuugucauacgga

SEQ ID NO: 1895275 - RNA, 18 nt, Shigella flexneri 2a str. 2457T
gccccagcgucagcauca

SEQ ID NO: 1895276 - RNA, 23 nt, Shigella flexneri 2a str. 2457T
gccccgcuguuugaaauugugau

SEQ ID NO: 1895277 - RNA, 17 nt, Shigella flexneri 2a str. 2457T
gccccggcugcgcgacg

SEQ ID NO: 1895278 - RNA, 22 nt, Shigella flexneri 2a str. 2457T
gcccgacaagauccugauacuc

SEQ ID NO: 1895279 - RNA, 20 nt, Shigella flexneri 2a str. 2457T
gcccgauggcaucaccaucg

SEQ ID NO: 1895280 - RNA, 19 nt, Shigella flexneri 2a str. 2457T
gccacgcgaaugugcguuu

SEQ ID NO: 1895281 - RNA, 13 nt, Shigella flexneri 2a str. 2457T
gccacucgauacc

SEQ ID NO: 1895282 - RNA, 20 nt, Shigella flexneri 2a str. 2457T
gccagaauuuucucacccgc

SEQ ID NO: 1895283 - RNA, 14 nt, Shigella flexneri 2a str. 2457T
gccagaccacugcg

SEQ ID NO: 1895284 - RNA, 15 nt, Shigella flexneri 2a str. 2457T
gccagacaauugccg

SEQ ID NO: 1895285 - RNA, 17 nt, Shigella flexneri 2a str. 2457T
gccacuuucacgccgcc

SEQ ID NO: 1895286 - RNA, 18 nt, Shigella flexneri 2a str. 2457T
gccagaaauccaggcccg

SEQ ID NO: 1895287 - RNA, 21 nt, Shigella flexneri 2a str. 2457T
gccagaaacaccguuaacguu

SEQ ID NO: 1895288 - RNA, 18 nt, Shigella flexneri 2a str. 2457T
gccagaaaaccuggcgca

SEQ ID NO: 1895289 - RNA, 23 nt, Shigella flexneri 2a str. 2457T
gccagaacugauaacgcauuuca

SEQ ID NO: 1895290 - RNA, 15 nt, Shigella flexneri 2a str. 2457T
gccagacgguauagc

SEQ ID NO: 1895291 - RNA, 21 nt, Shigella flexneri 2a str. 2457T
gccagaugcggcgugaacgcc

SEQ ID NO: 1895292 - RNA, 16 nt, Shigella flexneri 2a str. 2457T
gccagccccagcguca

SEQ ID NO: 1895293 - RNA, 21 nt, Shigella flexneri 2a str. 2457T
gccagccaccacaauugacca

SEQ ID NO: 1895294 - RNA, 22 nt, Shigella flexneri 2a str. 2457T
gccagcgucaucauagacuucc

SEQ ID NO: 1895295 - RNA, 18 nt, Shigella flexneri 2a str. 2457T
gccagcguaaauccugac

SEQ ID NO: 1895296 - RNA, 19 nt, Shigella flexneri 2a str. 2457T
gccaggcagaacgcuuucg

SEQ ID NO: 1895297 - RNA, 13 nt, Shigella flexneri 2a str. 2457T
gccauuuuaauca

SEQ ID NO: 1895298 - RNA, 19 nt, Shigella flexneri 2a str. 2457T
gccauuuaacgcaucacga

SEQ ID NO: 1895299 - RNA, 19 nt, Shigella flexneri 2a str. 2457T
gccauuccgggaaacgaac

SEQ ID NO: 1895300 - RNA, 16 nt, Shigella flexneri 2a str. 2457T
gccauauucgcuuuca

SEQ ID NO: 1895301 - RNA, 16 nt, Shigella flexneri 2a str. 2457T
gccauaucauucgaca

SEQ ID NO: 1895302 - RNA, 14 nt, Shigella flexneri 2a str. 2457T
gccaucacugacug

SEQ ID NO: 1895303 - RNA, 20 nt, Shigella flexneri 2a str. 2457T
gccaucgcguugucauacga

SEQ ID NO: 1895304 - RNA, 15 nt, Shigella flexneri 2a str. 2457T
gccgagcgccagcca

SEQ ID NO: 1895305 - RNA, 23 nt, Shigella flexneri 2a str. 2457T
gccgaucucaccgaucaucacga

SEQ ID NO: 1895306 - RNA, 16 nt, Shigella flexneri 2a str. 2457T
gccgaggauacagccg

SEQ ID NO: 1895307 - RNA, 15 nt, Shigella flexneri 2a str. 2457T
gccgcaacuuuagcc

SEQ ID NO: 1895308 - RNA, 19 nt, Shigella flexneri 2a str. 2457T
gccgcacuuaauauacgcu

SEQ ID NO: 1895309 - RNA, 16 nt, Shigella flexneri 2a str. 2457T
gccgcacuuaauauac

SEQ ID NO: 1895310 - RNA, 13 nt, Shigella flexneri 2a str. 2457T
gccgauuguauac

SEQ ID NO: 1895311 - RNA, 20 nt, Shigella flexneri 2a str. 2457T
gccgauuaaaaucagaaucg

SEQ ID NO: 1895312 - RNA, 11 nt, Shigella flexneri 2a str. 2457T
gccgccggaaa

SEQ ID NO: 1895313 - RNA, 13 nt, Shigella flexneri 2a str. 2457T
gccgccagcaucu

SEQ ID NO: 1895314 - RNA, 12 nt, Shigella flexneri 2a str. 2457T
gccgcaguuucu

SEQ ID NO: 1895315 - RNA, 15 nt, Shigella flexneri 2a str. 2457T
gccgcauccggcauc

SEQ ID NO: 1895316 - RNA, 15 nt, Shigella flexneri 2a str. 2457T
gccgggaacuggcaa

SEQ ID NO: 1895317 - RNA, 18 nt, Shigella flexneri 2a str. 2457T
gccgcgauagcaagcgcu

SEQ ID NO: 1895318 - RNA, 14 nt, Shigella flexneri 2a str. 2457T
gccgcuacggaaga

SEQ ID NO: 1895319 - RNA, 22 nt, Shigella flexneri 2a str. 2457T
gccgcuccaaggucuccgccca

SEQ ID NO: 1895320 - RNA, 23 nt, Shigella flexneri 2a str. 2457T
gccggauaugacguccggcauac

SEQ ID NO: 1895321 - RNA, 20 nt, Shigella flexneri 2a str. 2457T
gccggauguuugcauccggc

SEQ ID NO: 1895322 - RNA, 12 nt, Shigella flexneri 2a str. 2457T
gccgcugcgcgu

SEQ ID NO: 1895323 - RNA, 14 nt, Shigella flexneri 2a str. 2457T
gccggauaaggcau

SEQ ID NO: 1895324 - RNA, 19 nt, Shigella flexneri 2a str. 2457T
gccggauacgauuugcggc

SEQ ID NO: 1895325 - RNA, 22 nt, Shigella flexneri 2a str. 2457T
gccggauaaggcguucacgacg

SEQ ID NO: 1895326 - RNA, 24 nt, Shigella flexneri 2a str. 2457T
gccggauaaggcguuuucgccgca

SEQ ID NO: 1895327 - RNA, 14 nt, Shigella flexneri 2a str. 2457T
gccggagccagccg

SEQ ID NO: 1895328 - RNA, 18 nt, Shigella flexneri 2a str. 2457T
gccggaauaccacuuuca

SEQ ID NO: 1895329 - RNA, 16 nt, Shigella flexneri 2a str. 2457T
gccggaacgugcauau

SEQ ID NO: 1895330 - RNA, 22 nt, Shigella flexneri 2a str. 2457T
gcaucuuguucauagugccuga

SEQ ID NO: 1895331 - RNA, 22 nt, Shigella flexneri 2a str. 2457T
gcaucuguuuuccgaugagcga

SEQ ID NO: 1895332 - RNA, 20 nt, Shigella flexneri 2a str. 2457T
gcaucuuauccagcaaccag

SEQ ID NO: 1895333 - RNA, 17 nt, Shigella flexneri 2a str. 2457T
gcaucuucguuaacgcg

SEQ ID NO: 1895334 - RNA, 17 nt, Shigella flexneri 2a str. 2457T
gcaucuucuccacgcca

SEQ ID NO: 1895335 - RNA, 18 nt, Shigella flexneri 2a str. 2457T
gcaucuucgcccacggcu

SEQ ID NO: 1895336 - RNA, 20 nt, Shigella flexneri 2a str. 2457T
gcaucuguuucgaucagcaa

SEQ ID NO: 1895337 - RNA, 14 nt, Shigella flexneri 2a str. 2457T
gcaucugccagcca

SEQ ID NO: 1895338 - RNA, 15 nt, Shigella flexneri 2a str. 2457T
gcaucucaaucgcac

SEQ ID NO: 1895339 - RNA, 20 nt, Shigella flexneri 2a str. 2457T
gcaucgggggaagcugaaag

SEQ ID NO: 1895340 - RNA, 14 nt, Shigella flexneri 2a str. 2457T
gcaucggcaaucac

SEQ ID NO: 1895341 - RNA, 19 nt, Shigella flexneri 2a str. 2457T
gcaugcucccaaaaacgcg

SEQ ID NO: 1895342 - RNA, 20 nt, Shigella flexneri 2a str. 2457T
gcaugacuuuguaggccgga

SEQ ID NO: 1895343 - RNA, 13 nt, Shigella flexneri 2a str. 2457T
gcaugauccggca

SEQ ID NO: 1895344 - RNA, 21 nt, Shigella flexneri 2a str. 2457T
gcaugauuucgucauccggug

SEQ ID NO: 1895345 - RNA, 20 nt, Shigella flexneri 2a str. 2457T
gcaugauuuuguaggccgga

SEQ ID NO: 1895346 - RNA, 17 nt, Shigella flexneri 2a str. 2457T
gcaugauuucgucaucc

SEQ ID NO: 1895347 - RNA, 20 nt, Shigella flexneri 2a str. 2457T
gcauggucuuguaggccaga

SEQ ID NO: 1895348 - RNA, 12 nt, Shigella flexneri 2a str. 2457T
gcauguguaacc

SEQ ID NO: 1895349 - RNA, 20 nt, Shigella flexneri 2a str. 2457T
gcauugaacucuucuuccgg

SEQ ID NO: 1895350 - RNA, 23 nt, Shigella flexneri 2a str. 2457T
gcauucacgggcggcggcuuuca

SEQ ID NO: 1895351 - RNA, 15 nt, Shigella flexneri 2a str. 2457T
gcauucacgccgcau

SEQ ID NO: 1895352 - RNA, 13 nt, Shigella flexneri 2a str. 2457T
gcauuaaacgcau

SEQ ID NO: 1895353 - RNA, 16 nt, Shigella flexneri 2a str. 2457T
gcauuaauacaccgcu

SEQ ID NO: 1895354 - RNA, 17 nt, Shigella flexneri 2a str. 2457T
gcauuaauacaccgcug

SEQ ID NO: 1895355 - RNA, 22 nt, Shigella flexneri 2a str. 2457T
gcauuaggugcucaaugccuga

SEQ ID NO: 1895356 - RNA, 17 nt, Shigella flexneri 2a str. 2457T
gcauuacgcucacugca

SEQ ID NO: 1895357 - RNA, 16 nt, Shigella flexneri 2a str. 2457T
gccaaaugucaccagc

SEQ ID NO: 1895358 - RNA, 18 nt, Shigella flexneri 2a str. 2457T
gccaaauccagcgccaca

SEQ ID NO: 1895359 - RNA, 15 nt, Shigella flexneri 2a str. 2457T
gccaaaucauccaga

SEQ ID NO: 1895360 - RNA, 15 nt, Shigella flexneri 2a str. 2457T
gccaaauccagcgca

SEQ ID NO: 1895361 - RNA, 15 nt, Shigella flexneri 2a str. 2457T
gccaaauccagcgcc

SEQ ID NO: 1895362 - RNA, 13 nt, Shigella flexneri 2a str. 2457T
gccaaagcguuca

SEQ ID NO: 1895363 - RNA, 19 nt, Shigella flexneri 2a str. 2457T
gccaaacgcucccugccag

SEQ ID NO: 1895364 - RNA, 23 nt, Shigella flexneri 2a str. 2457T
gccaaaaagaaccugaacgccgg

SEQ ID NO: 1895365 - RNA, 16 nt, Shigella flexneri 2a str. 2457T
gccaaaaaucgcaaau

SEQ ID NO: 1895366 - RNA, 19 nt, Shigella flexneri 2a str. 2457T
gcauuuucucgcggacugc

SEQ ID NO: 1895367 - RNA, 17 nt, Shigella flexneri 2a str. 2457T
gcauuugcuccagacgc

SEQ ID NO: 1895368 - RNA, 23 nt, Shigella flexneri 2a str. 2457T
gcauuuggacacccuugccggau

SEQ ID NO: 1895369 - RNA, 22 nt, Shigella flexneri 2a str. 2457T
gcauuugcacugaaugccggau

SEQ ID NO: 1895370 - RNA, 22 nt, Shigella flexneri 2a str. 2457T
gcauuugcaccgauugccggau

SEQ ID NO: 1895371 - RNA, 11 nt, Shigella flexneri 2a str. 2457T
gcauuuacucu

SEQ ID NO: 1895372 - RNA, 13 nt, Shigella flexneri 2a str. 2457T
gcauuuccauaaa

SEQ ID NO: 1895373 - RNA, 14 nt, Shigella flexneri 2a str. 2457T
gcaguuucgcgacc

SEQ ID NO: 1895374 - RNA, 17 nt, Shigella flexneri 2a str. 2457T
gcaguucuggcaccgga

SEQ ID NO: 1895375 - RNA, 13 nt, Shigella flexneri 2a str. 2457T
gcaggugccuuac

SEQ ID NO: 1895376 - RNA, 14 nt, Shigella flexneri 2a str. 2457T
gcagugcauccagc

SEQ ID NO: 1895377 - RNA, 14 nt, Shigella flexneri 2a str. 2457T
gcaucgcagcauca

SEQ ID NO: 1895378 - RNA, 21 nt, Shigella flexneri 2a str. 2457T
gcaucgaugguugcccugcug

SEQ ID NO: 1895379 - RNA, 22 nt, Shigella flexneri 2a str. 2457T
gcaucgccgguaguuucagcgg

SEQ ID NO: 1895380 - RNA, 18 nt, Shigella flexneri 2a str. 2457T
gcauccggcaauugugau

SEQ ID NO: 1895381 - RNA, 17 nt, Shigella flexneri 2a str. 2457T
gcaucccgcaccagcgg

SEQ ID NO: 1895382 - RNA, 14 nt, Shigella flexneri 2a str. 2457T
gcaucccgcaccag

SEQ ID NO: 1895383 - RNA, 12 nt, Shigella flexneri 2a str. 2457T
gcaucaaucuuu

SEQ ID NO: 1895384 - RNA, 18 nt, Shigella flexneri 2a str. 2457T
gcaggcucagaagacgcu

SEQ ID NO: 1895385 - RNA, 15 nt, Shigella flexneri 2a str. 2457T
gcaggcucagacuga

SEQ ID NO: 1895386 - RNA, 14 nt, Shigella flexneri 2a str. 2457T
gcagguauaccgga

SEQ ID NO: 1895387 - RNA, 20 nt, Shigella flexneri 2a str. 2457T
gcagcgugaguaugauacgu

SEQ ID NO: 1895388 - RNA, 18 nt, Shigella flexneri 2a str. 2457T
gcagcggcgaucgugagc

SEQ ID NO: 1895389 - RNA, 16 nt, Shigella flexneri 2a str. 2457T
gcagcggcgaucguga

SEQ ID NO: 1895390 - RNA, 22 nt, Shigella flexneri 2a str. 2457T
gcagcgaugguacuucaaucgc

SEQ ID NO: 1895391 - RNA, 18 nt, Shigella flexneri 2a str. 2457T
gcagcgaaggguauacgc

SEQ ID NO: 1895392 - RNA, 22 nt, Shigella flexneri 2a str. 2457T
gcagccgcauuuuuucuucagu

SEQ ID NO: 1895393 - RNA, 17 nt, Shigella flexneri 2a str. 2457T
gcagacagccuaccaga

SEQ ID NO: 1895394 - RNA, 23 nt, Shigella flexneri 2a str. 2457T
gcagaccaaacucuucgacaauc

SEQ ID NO: 1895395 - RNA, 19 nt, Shigella flexneri 2a str. 2457T
gcagaccaauguuacgacc

SEQ ID NO: 1895396 - RNA, 20 nt, Shigella flexneri 2a str. 2457T
gcagacccguuaagcguuca

SEQ ID NO: 1895397 - RNA, 16 nt, Shigella flexneri 2a str. 2457T
gcagaaacaaacgcaa

SEQ ID NO: 1895398 - RNA, 16 nt, Shigella flexneri 2a str. 2457T
gcagacagccuaccag

SEQ ID NO: 1895399 - RNA, 20 nt, Shigella flexneri 2a str. 2457T
gcagagaugcccauucaccg

SEQ ID NO: 1895400 - RNA, 22 nt, Shigella flexneri 2a str. 2457T
gcagagcaaaaaucgacagcag

SEQ ID NO: 1895401 - RNA, 13 nt, Shigella flexneri 2a str. 2457T
gcagacugaauac

SEQ ID NO: 1895402 - RNA, 20 nt, Shigella flexneri 2a str. 2457T
gcagauuucuucuggcuacu

SEQ ID NO: 1895403 - RNA, 23 nt, Shigella flexneri 2a str. 2457T
gcagcaaauagccgagcgcguua

SEQ ID NO: 1895404 - RNA, 15 nt, Shigella flexneri 2a str. 2457T
gcagcaacggcaguu

SEQ ID NO: 1895405 - RNA, 15 nt, Shigella flexneri 2a str. 2457T
gcagcagccugcgcu

SEQ ID NO: 1895406 - RNA, 23 nt, Shigella flexneri 2a str. 2457T
gcagcagccaguuguugauaagc

SEQ ID NO: 1895407 - RNA, 16 nt, Shigella flexneri 2a str. 2457T
gcagcaagucggcauc

SEQ ID NO: 1895408 - RNA, 21 nt, Shigella flexneri 2a str. 2457T
gcagcaaggcuauucagcagu

SEQ ID NO: 1895409 - RNA, 14 nt, Shigella flexneri 2a str. 2457T
gcacugccgcaucg

SEQ ID NO: 1895410 - RNA, 17 nt, Shigella flexneri 2a str. 2457T
gcacugcgcccgccagc

SEQ ID NO: 1895411 - RNA, 18 nt, Shigella flexneri 2a str. 2457T
gcacuggcggcagcaggu

SEQ ID NO: 1895412 - RNA, 18 nt, Shigella flexneri 2a str. 2457T
gcacuucacccaucgcca

SEQ ID NO: 1895413 - RNA, 19 nt, Shigella flexneri 2a str. 2457T
gcacuguuacugucggcaa

SEQ ID NO: 1895414 - RNA, 14 nt, Shigella flexneri 2a str. 2457T
gcacguugucagca

SEQ ID NO: 1895415 - RNA, 20 nt, Shigella flexneri 2a str. 2457T
gcacgcucuucaucgcuaaa

SEQ ID NO: 1895416 - RNA, 13 nt, Shigella flexneri 2a str. 2457T
gcacggcauacuu

SEQ ID NO: 1895417 - RNA, 23 nt, Shigella flexneri 2a str. 2457T
gcacggcaggaucugcgcggcaa

SEQ ID NO: 1895418 - RNA, 17 nt, Shigella flexneri 2a str. 2457T
gcacaccgccgccgcca

SEQ ID NO: 1895419 - RNA, 23 nt, Shigella flexneri 2a str. 2457T
gcaccgcgcguuuaggcgcagga

SEQ ID NO: 1895420 - RNA, 20 nt, Shigella flexneri 2a str. 2457T
gcacccucaacaacagcgau

SEQ ID NO: 1895421 - RNA, 21 nt, Shigella flexneri 2a str. 2457T
gcaccgauugccggaugcggc

SEQ ID NO: 1895422 - RNA, 14 nt, Shigella flexneri 2a str. 2457T
gcaccuacagccau

SEQ ID NO: 1895423 - RNA, 18 nt, Shigella flexneri 2a str. 2457T
gcacgaaccguaaaagcc

SEQ ID NO: 1895424 - RNA, 16 nt, Shigella flexneri 2a str. 2457T
gcacgaaaccacugca

SEQ ID NO: 1895425 - RNA, 18 nt, Shigella flexneri 2a str. 2457T
gcaacgugguuugcggca

SEQ ID NO: 1895426 - RNA, 17 nt, Shigella flexneri 2a str. 2457T
gcaacggacgaccgauu

SEQ ID NO: 1895427 - RNA, 15 nt, Shigella flexneri 2a str. 2457T
gcaacgcggcgguga

SEQ ID NO: 1895428 - RNA, 21 nt, Shigella flexneri 2a str. 2457T
gcaacggcggaucaccgcguc

SEQ ID NO: 1895429 - RNA, 14 nt, Shigella flexneri 2a str. 2457T
gcaacgagugcauc

SEQ ID NO: 1895430 - RNA, 14 nt, Shigella flexneri 2a str. 2457T
gcaacgaaagguga

SEQ ID NO: 1895431 - RNA, 21 nt, Shigella flexneri 2a str. 2457T
gcaacgaaaggugaaguggug

SEQ ID NO: 1895432 - RNA, 23 nt, Shigella flexneri 2a str. 2457T
gcaaccuuuuccauugccgcaga

SEQ ID NO: 1895433 - RNA, 20 nt, Shigella flexneri 2a str. 2457T
gcaaccgucguggucgugau

SEQ ID NO: 1895434 - RNA, 13 nt, Shigella flexneri 2a str. 2457T
gcaacagcaauac

SEQ ID NO: 1895435 - RNA, 22 nt, Shigella flexneri 2a str. 2457T
gcaacagugaaacacaugguuu

SEQ ID NO: 1895436 - RNA, 22 nt, Shigella flexneri 2a str. 2457T
gcaacauacugcccgagcgcca

SEQ ID NO: 1895437 - RNA, 23 nt, Shigella flexneri 2a str. 2457T
gcaacauauuccgcaccugccag

SEQ ID NO: 1895438 - RNA, 19 nt, Shigella flexneri 2a str. 2457T
gcaacaugucagcaaucac

SEQ ID NO: 1895439 - RNA, 13 nt, Shigella flexneri 2a str. 2457T
gcaaccagcaccg

SEQ ID NO: 1895440 - RNA, 17 nt, Shigella flexneri 2a str. 2457T
gcaaccaacgccagcag

SEQ ID NO: 1895441 - RNA, 13 nt, Shigella flexneri 2a str. 2457T
gcaaccaacggcc

SEQ ID NO: 1895442 - RNA, 19 nt, Shigella flexneri 2a str. 2457T
gcaauccccucuucagccg

SEQ ID NO: 1895443 - RNA, 14 nt, Shigella flexneri 2a str. 2457T
gcaaugaagaaccg

SEQ ID NO: 1895444 - RNA, 21 nt, Shigella flexneri 2a str. 2457T
gcaaucaucuuguaggccuga

SEQ ID NO: 1895445 - RNA, 16 nt, Shigella flexneri 2a str. 2457T
gcaaucaucguacugu

SEQ ID NO: 1895446 - RNA, 18 nt, Shigella flexneri 2a str. 2457T
gcaagucggcaucgccac

SEQ ID NO: 1895447 - RNA, 16 nt, Shigella flexneri 2a str. 2457T
gcaaggugaaagcaau

SEQ ID NO: 1895448 - RNA, 22 nt, Shigella flexneri 2a str. 2457T
gcaauaauagccccaaccgaac

SEQ ID NO: 1895449 - RNA, 14 nt, Shigella flexneri 2a str. 2457T
gcaauuacaugcug

SEQ ID NO: 1895450 - RNA, 21 nt, Shigella flexneri 2a str. 2457T
gcaauguugcguuugucauca

SEQ ID NO: 1895451 - RNA, 12 nt, Shigella flexneri 2a str. 2457T
gcaauuaacgcc

SEQ ID NO: 1895452 - RNA, 16 nt, Shigella flexneri 2a str. 2457T
gcaauuaacagugaca

SEQ ID NO: 1895453 - RNA, 13 nt, Shigella flexneri 2a str. 2457T
gcacacacugcuu

SEQ ID NO: 1895454 - RNA, 15 nt, Shigella flexneri 2a str. 2457T
gcaauuuccauugcu

SEQ ID NO: 1895455 - RNA, 14 nt, Shigella flexneri 2a str. 2457T
gcaauugucgcaga

SEQ ID NO: 1895456 - RNA, 18 nt, Shigella flexneri 2a str. 2457T
gcaagcgcugagacgcgc

SEQ ID NO: 1895457 - RNA, 18 nt, Shigella flexneri 2a str. 2457T
gcaagcggcggcaauggc

SEQ ID NO: 1895458 - RNA, 18 nt, Shigella flexneri 2a str. 2457T
gcaaggaaagccacugug

SEQ ID NO: 1895459 - RNA, 16 nt, Shigella flexneri 2a str. 2457T
gcaagggcaucguaau

SEQ ID NO: 1895460 - RNA, 13 nt, Shigella flexneri 2a str. 2457T
gcaacugacggca

SEQ ID NO: 1895461 - RNA, 15 nt, Shigella flexneri 2a str. 2457T
gcaacuccggcgaaa

SEQ ID NO: 1895462 - RNA, 14 nt, Shigella flexneri 2a str. 2457T
gcaacuguaacgca

SEQ ID NO: 1895463 - RNA, 14 nt, Shigella flexneri 2a str. 2457T
gcaacuucaacgca

SEQ ID NO: 1895464 - RNA, 18 nt, Shigella flexneri 2a str. 2457T
gcaacuucucuuucggca

SEQ ID NO: 1895465 - RNA, 12 nt, Shigella flexneri 2a str. 2457T
gcaacuggcaaa

SEQ ID NO: 1895466 - RNA, 19 nt, Shigella flexneri 2a str. 2457T
gcaagaauaauaccgucca

SEQ ID NO: 1895467 - RNA, 15 nt, Shigella flexneri 2a str. 2457T
gcaaaggaauggucg

SEQ ID NO: 1895468 - RNA, 18 nt, Shigella flexneri 2a str. 2457T
gcaaaguagcggccugac

SEQ ID NO: 1895469 - RNA, 18 nt, Shigella flexneri 2a str. 2457T
gcaaagccgauaccuucc

SEQ ID NO: 1895470 - RNA, 21 nt, Shigella flexneri 2a str. 2457T
gcaaagcaaauuuugugggca

SEQ ID NO: 1895471 - RNA, 19 nt, Shigella flexneri 2a str. 2457T
gcaaauacugacuggcaag

SEQ ID NO: 1895472 - RNA, 21 nt, Shigella flexneri 2a str. 2457T
gcaaauaccggacacacuuca

SEQ ID NO: 1895473 - RNA, 20 nt, Shigella flexneri 2a str. 2457T
gcaaauaaucccgcgcaaca

SEQ ID NO: 1895474 - RNA, 18 nt, Shigella flexneri 2a str. 2457T
gcaaauugcauacugcga

SEQ ID NO: 1895475 - RNA, 13 nt, Shigella flexneri 2a str. 2457T
gcaacaacagcgc

SEQ ID NO: 1895476 - RNA, 19 nt, Shigella flexneri 2a str. 2457T
gcaaauugaggaucugcgc

SEQ ID NO: 1895477 - RNA, 18 nt, Shigella flexneri 2a str. 2457T
gcaaaugauuagugccag

SEQ ID NO: 1895478 - RNA, 18 nt, Shigella flexneri 2a str. 2457T
gcaaaccaggccgguaac

SEQ ID NO: 1895479 - RNA, 16 nt, Shigella flexneri 2a str. 2457T
gcaaacccaaccggua

SEQ ID NO: 1895480 - RNA, 17 nt, Shigella flexneri 2a str. 2457T
gcaaaccagacgcgcgu

SEQ ID NO: 1895481 - RNA, 12 nt, Shigella flexneri 2a str. 2457T
gcaaaaugccag

SEQ ID NO: 1895482 - RNA, 18 nt, Shigella flexneri 2a str. 2457T
gcaaacaguaacccggca

SEQ ID NO: 1895483 - RNA, 23 nt, Shigella flexneri 2a str. 2457T
gcaaaccaguacggcuucgauca

SEQ ID NO: 1895484 - RNA, 11 nt, Shigella flexneri 2a str. 2457T
gcaaacugcug

SEQ ID NO: 1895485 - RNA, 16 nt, Shigella flexneri 2a str. 2457T
gcaaacugaguggagu

SEQ ID NO: 1895486 - RNA, 19 nt, Shigella flexneri 2a str. 2457T
gcaaacucgcgcaggcuga

SEQ ID NO: 1895487 - RNA, 23 nt, Shigella flexneri 2a str. 2457T
gauuucgcaacgacaccguuaaa

SEQ ID NO: 1895488 - RNA, 14 nt, Shigella flexneri 2a str. 2457T
gauuucaugaagcu

SEQ ID NO: 1895489 - RNA, 21 nt, Shigella flexneri 2a str. 2457T
gauuugcuucaauacgcucca

SEQ ID NO: 1895490 - RNA, 17 nt, Shigella flexneri 2a str. 2457T
gauuucgcagccauuac

SEQ ID NO: 1895491 - RNA, 21 nt, Shigella flexneri 2a str. 2457T
gauuacucguuaucagaaccg

SEQ ID NO: 1895492 - RNA, 22 nt, Shigella flexneri 2a str. 2457T
gauuaguauugcggaacggcag

SEQ ID NO: 1895493 - RNA, 15 nt, Shigella flexneri 2a str. 2457T
gauuaucuucaccgu

SEQ ID NO: 1895494 - RNA, 18 nt, Shigella flexneri 2a str. 2457T
gauuauauaauaugcauu

SEQ ID NO: 1895495 - RNA, 17 nt, Shigella flexneri 2a str. 2457T
gauucugauugccgcuu

SEQ ID NO: 1895496 - RNA, 22 nt, Shigella flexneri 2a str. 2457T
gauucugagaaacucaguugau

SEQ ID NO: 1895497 - RNA, 15 nt, Shigella flexneri 2a str. 2457T
gauugucgaucgcau

SEQ ID NO: 1895498 - RNA, 17 nt, Shigella flexneri 2a str. 2457T
gauugucauucgccuga

SEQ ID NO: 1895499 - RNA, 17 nt, Shigella flexneri 2a str. 2457T
gauuuaaaaaauggcca

SEQ ID NO: 1895500 - RNA, 14 nt, Shigella flexneri 2a str. 2457T
gauuguucgcaccg

SEQ ID NO: 1895501 - RNA, 18 nt, Shigella flexneri 2a str. 2457T
gauugugacacgcgcgca

SEQ ID NO: 1895502 - RNA, 15 nt, Shigella flexneri 2a str. 2457T
gauucggcaaucacc

SEQ ID NO: 1895503 - RNA, 19 nt, Shigella flexneri 2a str. 2457T
gauggccugaugugacgcu

SEQ ID NO: 1895504 - RNA, 17 nt, Shigella flexneri 2a str. 2457T
gauggcaaaugcagcau

SEQ ID NO: 1895505 - RNA, 15 nt, Shigella flexneri 2a str. 2457T
gauggaucaacuugg

SEQ ID NO: 1895506 - RNA, 13 nt, Shigella flexneri 2a str. 2457T
gaugcucucauca

SEQ ID NO: 1895507 - RNA, 13 nt, Shigella flexneri 2a str. 2457T
gauggcauuaccg

SEQ ID NO: 1895508 - RNA, 11 nt, Shigella flexneri 2a str. 2457T
gauggcagagu

SEQ ID NO: 1895509 - RNA, 16 nt, Shigella flexneri 2a str. 2457T
gaugggauaaagaucu

SEQ ID NO: 1895510 - RNA, 16 nt, Shigella flexneri 2a str. 2457T
gauggcgcgcggcagg

SEQ ID NO: 1895511 - RNA, 16 nt, Shigella flexneri 2a str. 2457T
gaugguauucaucgcg

SEQ ID NO: 1895512 - RNA, 14 nt, Shigella flexneri 2a str. 2457T
gaugcgggcgguaa

SEQ ID NO: 1895513 - RNA, 19 nt, Shigella flexneri 2a str. 2457T
gaugcggcgugaacgccua

SEQ ID NO: 1895514 - RNA, 20 nt, Shigella flexneri 2a str. 2457T
gaugcggcguuaacgccuua

SEQ ID NO: 1895515 - RNA, 17 nt, Shigella flexneri 2a str. 2457T
gaugcggcgugaaugcc

SEQ ID NO: 1895516 - RNA, 20 nt, Shigella flexneri 2a str. 2457T
gaugcggcgaaaacgccuua

SEQ ID NO: 1895517 - RNA, 23 nt, Shigella flexneri 2a str. 2457T
gaugcuccacgcugcaucgccaa

SEQ ID NO: 1895518 - RNA, 15 nt, Shigella flexneri 2a str. 2457T
gaugacauuaucugg

SEQ ID NO: 1895519 - RNA, 18 nt, Shigella flexneri 2a str. 2457T
gaugacauugaugcgcca

SEQ ID NO: 1895520 - RNA, 18 nt, Shigella flexneri 2a str. 2457T
gaugccugaugcgacgcu

SEQ ID NO: 1895521 - RNA, 16 nt, Shigella flexneri 2a str. 2457T
gaugccgugcagcacg

SEQ ID NO: 1895522 - RNA, 11 nt, Shigella flexneri 2a str. 2457T
gaucaucgccc

SEQ ID NO: 1895523 - RNA, 18 nt, Shigella flexneri 2a str. 2457T
gauccgcacccgcacgcu

SEQ ID NO: 1895524 - RNA, 14 nt, Shigella flexneri 2a str. 2457T
gaucgccaaagaaa

SEQ ID NO: 1895525 - RNA, 17 nt, Shigella flexneri 2a str. 2457T
gaucggaggcagcgucu

SEQ ID NO: 1895526 - RNA, 18 nt, Shigella flexneri 2a str. 2457T
gaucgguaauugaucuca

SEQ ID NO: 1895527 - RNA, 14 nt, Shigella flexneri 2a str. 2457T
gaucucgucagcau

SEQ ID NO: 1895528 - RNA, 23 nt, Shigella flexneri 2a str. 2457T
gaugacagucuggaagccaguca

SEQ ID NO: 1895529 - RNA, 16 nt, Shigella flexneri 2a str. 2457T
gagcagcacgcaguga

SEQ ID NO: 1895530 - RNA, 19 nt, Shigella flexneri 2a str. 2457T
gagguuaauauuuucgcca

SEQ ID NO: 1895531 - RNA, 14 nt, Shigella flexneri 2a str. 2457T
gagucggaccauca

SEQ ID NO: 1895532 - RNA, 23 nt, Shigella flexneri 2a str. 2457T
gaguaaagcccgccaucgcccau

SEQ ID NO: 1895533 - RNA, 16 nt, Shigella flexneri 2a str. 2457T
gagugcggaugacgau

SEQ ID NO: 1895534 - RNA, 20 nt, Shigella flexneri 2a str. 2457T
gagugccuugcugaccgcca

SEQ ID NO: 1895535 - RNA, 19 nt, Shigella flexneri 2a str. 2457T
gaguuaccagcggccggau

SEQ ID NO: 1895536 - RNA, 19 nt, Shigella flexneri 2a str. 2457T
gaguuaaauuaauaaucac

SEQ ID NO: 1895537 - RNA, 12 nt, Shigella flexneri 2a str. 2457T
gauaaaaccuuc

SEQ ID NO: 1895538 - RNA, 13 nt, Shigella flexneri 2a str. 2457T
gauacaucagcga

SEQ ID NO: 1895539 - RNA, 18 nt, Shigella flexneri 2a str. 2457T
gauaccaaaaucggcaac

SEQ ID NO: 1895540 - RNA, 20 nt, Shigella flexneri 2a str. 2457T
gauaccaaaauggcgcagga

SEQ ID NO: 1895541 - RNA, 20 nt, Shigella flexneri 2a str. 2457T
gauacccgcgaggcgcauaa

SEQ ID NO: 1895542 - RNA, 17 nt, Shigella flexneri 2a str. 2457T
gauaccacccgcaguga

SEQ ID NO: 1895543 - RNA, 23 nt, Shigella flexneri 2a str. 2457T
gauacccccucucgucugccgga

SEQ ID NO: 1895544 - RNA, 12 nt, Shigella flexneri 2a str. 2457T
gauaaauuacug

SEQ ID NO: 1895545 - RNA, 15 nt, Shigella flexneri 2a str. 2457T
gauacagaagcaccg

SEQ ID NO: 1895546 - RNA, 19 nt, Shigella flexneri 2a str. 2457T
gauaaagcccccgcaacau

SEQ ID NO: 1895547 - RNA, 15 nt, Shigella flexneri 2a str. 2457T
gauaaaccuccagca

SEQ ID NO: 1895548 - RNA, 22 nt, Shigella flexneri 2a str. 2457T
gauagcaagcgcugagacgcgc

SEQ ID NO: 1895549 - RNA, 12 nt, Shigella flexneri 2a str. 2457T
gauacgcaguac

SEQ ID NO: 1895550 - RNA, 19 nt, Shigella flexneri 2a str. 2457T
gauacgauguuguagcauc

SEQ ID NO: 1895551 - RNA, 20 nt, Shigella flexneri 2a str. 2457T
gauaguucgcgaucgcgcca

SEQ ID NO: 1895552 - RNA, 11 nt, Shigella flexneri 2a str. 2457T
gaucagcaucc

SEQ ID NO: 1895553 - RNA, 11 nt, Shigella flexneri 2a str. 2457T
gaucagcaauu

SEQ ID NO: 1895554 - RNA, 15 nt, Shigella flexneri 2a str. 2457T
gaucacucacccgcu

SEQ ID NO: 1895555 - RNA, 16 nt, Shigella flexneri 2a str. 2457T
gauauuccccagacga

SEQ ID NO: 1895556 - RNA, 23 nt, Shigella flexneri 2a str. 2457T
gauauuaucuucaucgauacugc

SEQ ID NO: 1895557 - RNA, 21 nt, Shigella flexneri 2a str. 2457T
gauauuauccccugcgauggu

SEQ ID NO: 1895558 - RNA, 16 nt, Shigella flexneri 2a str. 2457T
gauauuggcaucgcca

SEQ ID NO: 1895559 - RNA, 12 nt, Shigella flexneri 2a str. 2457T
gaucaccgcguc

SEQ ID NO: 1895560 - RNA, 13 nt, Shigella flexneri 2a str. 2457T
gauauacagcccg

SEQ ID NO: 1895561 - RNA, 15 nt, Shigella flexneri 2a str. 2457T
gauaugccggcauca

SEQ ID NO: 1895562 - RNA, 14 nt, Shigella flexneri 2a str. 2457T
gauaucagccugca

SEQ ID NO: 1895563 - RNA, 13 nt, Shigella flexneri 2a str. 2457T
gauaucuuuccgg

SEQ ID NO: 1895564 - RNA, 18 nt, Shigella flexneri 2a str. 2457T
cacuuuuggcccgacgau

SEQ ID NO: 1895565 - RNA, 20 nt, Shigella flexneri 2a str. 2457T
cagaaagcccgaaucaguaa

SEQ ID NO: 1895566 - RNA, 14 nt, Shigella flexneri 2a str. 2457T
cagaaagcgccagc

SEQ ID NO: 1895567 - RNA, 15 nt, Shigella flexneri 2a str. 2457T
cagaaagcgccagca

SEQ ID NO: 1895568 - RNA, 18 nt, Shigella flexneri 2a str. 2457T
cagaacgccgaauaacgc

SEQ ID NO: 1895569 - RNA, 17 nt, Shigella flexneri 2a str. 2457T
cagaacuacccgguucg

SEQ ID NO: 1895570 - RNA, 16 nt, Shigella flexneri 2a str. 2457T
cagacaccagccaggu

SEQ ID NO: 1895571 - RNA, 12 nt, Shigella flexneri 2a str. 2457T
cacuucuucagc

SEQ ID NO: 1895572 - RNA, 19 nt, Shigella flexneri 2a str. 2457T
cacucuacauguguucagc

SEQ ID NO: 1895573 - RNA, 17 nt, Shigella flexneri 2a str. 2457T
cacucgcuguggcagcg

SEQ ID NO: 1895574 - RNA, 16 nt, Shigella flexneri 2a str. 2457T
cacucguaagaggcgu

SEQ ID NO: 1895575 - RNA, 17 nt, Shigella flexneri 2a str. 2457T
cacuccagccagagcca

SEQ ID NO: 1895576 - RNA, 22 nt, Shigella flexneri 2a str. 2457T
cagacccaguuucggcaucagc

SEQ ID NO: 1895577 - RNA, 22 nt, Shigella flexneri 2a str. 2457T
cagaccacucauuuuuucgguu

SEQ ID NO: 1895578 - RNA, 14 nt, Shigella flexneri 2a str. 2457T
cagaccagcaccgg

SEQ ID NO: 1895579 - RNA, 23 nt, Shigella flexneri 2a str. 2457T
cagacaggcgaaacccgcugcca

SEQ ID NO: 1895580 - RNA, 14 nt, Shigella flexneri 2a str. 2457T
cagacacugcugau

SEQ ID NO: 1895581 - RNA, 19 nt, Shigella flexneri 2a str. 2457T
cagacacgccgccagacca

SEQ ID NO: 1895582 - RNA, 16 nt, Shigella flexneri 2a str. 2457T
cagacaguaauacggu

SEQ ID NO: 1895583 - RNA, 20 nt, Shigella flexneri 2a str. 2457T
cagaccuucgcuaucaaacu

SEQ ID NO: 1895584 - RNA, 17 nt, Shigella flexneri 2a str. 2457T
cagacgccagccacagg

SEQ ID NO: 1895585 - RNA, 21 nt, Shigella flexneri 2a str. 2457T
cagaccugaauuugcuccaga

SEQ ID NO: 1895586 - RNA, 13 nt, Shigella flexneri 2a str. 2457T
cagaccugcguca

SEQ ID NO: 1895587 - RNA, 15 nt, Shigella flexneri 2a str. 2457T
cagauaaaucacgcu

SEQ ID NO: 1895588 - RNA, 20 nt, Shigella flexneri 2a str. 2457T
cagaguuguaccagcaauuu

SEQ ID NO: 1895589 - RNA, 21 nt, Shigella flexneri 2a str. 2457T
cagauuguugauuaacaggcu

SEQ ID NO: 1895590 - RNA, 18 nt, Shigella flexneri 2a str. 2457T
cagaucugccuguccggc

SEQ ID NO: 1895591 - RNA, 22 nt, Shigella flexneri 2a str. 2457T
cagauuguugauuaacaggcug

SEQ ID NO: 1895592 - RNA, 22 nt, Shigella flexneri 2a str. 2457T
cagcaaaucacccugugcgcca

SEQ ID NO: 1895593 - RNA, 17 nt, Shigella flexneri 2a str. 2457T
cagcaaauccagcgguu

SEQ ID NO: 1895594 - RNA, 11 nt, Shigella flexneri 2a str. 2457T
cagcaacauag

SEQ ID NO: 1895595 - RNA, 14 nt, Shigella flexneri 2a str. 2457T
cagaguaucgccau

SEQ ID NO: 1895596 - RNA, 21 nt, Shigella flexneri 2a str. 2457T
cagaguaauugauucacaucc

SEQ ID NO: 1895597 - RNA, 14 nt, Shigella flexneri 2a str. 2457T
cagaggagccauca

SEQ ID NO: 1895598 - RNA, 19 nt, Shigella flexneri 2a str. 2457T
cagagaaaaugccgcacau

SEQ ID NO: 1895599 - RNA, 16 nt, Shigella flexneri 2a str. 2457T
cagagaaaccacauca

SEQ ID NO: 1895600 - RNA, 20 nt, Shigella flexneri 2a str. 2457T
cagacuugacgccuuuaccg

SEQ ID NO: 1895601 - RNA, 22 nt, Shigella flexneri 2a str. 2457T
cagagacgcacugcuugaagcg

SEQ ID NO: 1895602 - RNA, 23 nt, Shigella flexneri 2a str. 2457T
cagagcaucgguaucuucccagc

SEQ ID NO: 1895603 - RNA, 14 nt, Shigella flexneri 2a str. 2457T
cagagcaucgguau

SEQ ID NO: 1895604 - RNA, 21 nt, Shigella flexneri 2a str. 2457T
cagagcacuguuacugucggc

SEQ ID NO: 1895605 - RNA, 20 nt, Shigella flexneri 2a str. 2457T
cagacguuuuuucugcccca

SEQ ID NO: 1895606 - RNA, 11 nt, Shigella flexneri 2a str. 2457T
cagacguugca

SEQ ID NO: 1895607 - RNA, 23 nt, Shigella flexneri 2a str. 2457T
cagacugggcaagaucuggcgaa

SEQ ID NO: 1895608 - RNA, 22 nt, Shigella flexneri 2a str. 2457T
cagacuaauuuuucccucuuca

SEQ ID NO: 1895609 - RNA, 15 nt, Shigella flexneri 2a str. 2457T
cagacggcguaaucg

SEQ ID NO: 1895610 - RNA, 22 nt, Shigella flexneri 2a str. 2457T
cagacgcuuacguuuacgcauc

SEQ ID NO: 1895611 - RNA, 22 nt, Shigella flexneri 2a str. 2457T
cacguaccaugcgcaucaucga

SEQ ID NO: 1895612 - RNA, 20 nt, Shigella flexneri 2a str. 2457T
cacguccacggugaggcgau

SEQ ID NO: 1895613 - RNA, 17 nt, Shigella flexneri 2a str. 2457T
cacgucaggaucgugcg

SEQ ID NO: 1895614 - RNA, 13 nt, Shigella flexneri 2a str. 2457T
cacguaggccuga

SEQ ID NO: 1895615 - RNA, 19 nt, Shigella flexneri 2a str. 2457T
cacguuccagaaugcuacg

SEQ ID NO: 1895616 - RNA, 18 nt, Shigella flexneri 2a str. 2457T
cacguugccguaugcgcc

SEQ ID NO: 1895617 - RNA, 11 nt, Shigella flexneri 2a str. 2457T
cacuaacgaca

SEQ ID NO: 1895618 - RNA, 15 nt, Shigella flexneri 2a str. 2457T
cacuauuauauucug

SEQ ID NO: 1895619 - RNA, 18 nt, Shigella flexneri 2a str. 2457T
cacuauucgccagcacgg

SEQ ID NO: 1895620 - RNA, 14 nt, Shigella flexneri 2a str. 2457T
cacucacccgcuag

SEQ ID NO: 1895621 - RNA, 16 nt, Shigella flexneri 2a str. 2457T
cacuaccggaacccac

SEQ ID NO: 1895622 - RNA, 16 nt, Shigella flexneri 2a str. 2457T
cacgcugauugcauaa

SEQ ID NO: 1895623 - RNA, 16 nt, Shigella flexneri 2a str. 2457T
cacgcucccagcagag

SEQ ID NO: 1895624 - RNA, 16 nt, Shigella flexneri 2a str. 2457T
cacgcucaaagacgcg

SEQ ID NO: 1895625 - RNA, 19 nt, Shigella flexneri 2a str. 2457T
cacgcuuaauugaaccuaa

SEQ ID NO: 1895626 - RNA, 17 nt, Shigella flexneri 2a str. 2457T
cacggaaagcagcauac

SEQ ID NO: 1895627 - RNA, 12 nt, Shigella flexneri 2a str. 2457T
cacgcugucggc

SEQ ID NO: 1895628 - RNA, 17 nt, Shigella flexneri 2a str. 2457T
cacgcgguauccauacc

SEQ ID NO: 1895629 - RNA, 16 nt, Shigella flexneri 2a str. 2457T
cacgccugcauccgcc

SEQ ID NO: 1895630 - RNA, 12 nt, Shigella flexneri 2a str. 2457T
cacgcgcugacc

SEQ ID NO: 1895631 - RNA, 21 nt, Shigella flexneri 2a str. 2457T
cagcgccacauaagaucaucg

SEQ ID NO: 1895632 - RNA, 14 nt, Shigella flexneri 2a str. 2457T
cagcgcauucggca

SEQ ID NO: 1895633 - RNA, 14 nt, Shigella flexneri 2a str. 2457T
cagcgcauugcuaa

SEQ ID NO: 1895634 - RNA, 24 nt, Shigella flexneri 2a str. 2457T
cagcgcauucggcaagauaaaucg

SEQ ID NO: 1895635 - RNA, 15 nt, Shigella flexneri 2a str. 2457T
cagcgcauucguaau

SEQ ID NO: 1895636 - RNA, 18 nt, Shigella flexneri 2a str. 2457T
cagcgcauccauuacauc

SEQ ID NO: 1895637 - RNA, 20 nt, Shigella flexneri 2a str. 2457T
cagcgcauagcuaauccccu

SEQ ID NO: 1895638 - RNA, 20 nt, Shigella flexneri 2a str. 2457T
cagcgcaggcagguuaauga

SEQ ID NO: 1895639 - RNA, 19 nt, Shigella flexneri 2a str. 2457T
cagcgcccgccagcaccgg

SEQ ID NO: 1895640 - RNA, 22 nt, Shigella flexneri 2a str. 2457T
cagcgccaggcuuuccgucagc

SEQ ID NO: 1895641 - RNA, 13 nt, Shigella flexneri 2a str. 2457T
cagcgccugcugc

SEQ ID NO: 1895642 - RNA, 15 nt, Shigella flexneri 2a str. 2457T
cagcgccugcgcggc

SEQ ID NO: 1895643 - RNA, 19 nt, Shigella flexneri 2a str. 2457T
cagccuauuucgucgcuaa

SEQ ID NO: 1895644 - RNA, 15 nt, Shigella flexneri 2a str. 2457T
cagccuaccagaccg

SEQ ID NO: 1895645 - RNA, 20 nt, Shigella flexneri 2a str. 2457T
cagccuaccagaccgcacac

SEQ ID NO: 1895646 - RNA, 13 nt, Shigella flexneri 2a str. 2457T
cagcgacagacga

SEQ ID NO: 1895647 - RNA, 13 nt, Shigella flexneri 2a str. 2457T
cagcgagauaacg

SEQ ID NO: 1895648 - RNA, 14 nt, Shigella flexneri 2a str. 2457T
cagcgaucagcauu

SEQ ID NO: 1895649 - RNA, 14 nt, Shigella flexneri 2a str. 2457T
cagcgauuccaguu

SEQ ID NO: 1895650 - RNA, 23 nt, Shigella flexneri 2a str. 2457T
cagcgcagaaccguaaacagaua

SEQ ID NO: 1895651 - RNA, 20 nt, Shigella flexneri 2a str. 2457T
cagcgcagacaaucacauca

SEQ ID NO: 1895652 - RNA, 18 nt, Shigella flexneri 2a str. 2457T
cagcaguugugugccagu

SEQ ID NO: 1895653 - RNA, 19 nt, Shigella flexneri 2a str. 2457T
cagcaguucgcccgcuuca

SEQ ID NO: 1895654 - RNA, 14 nt, Shigella flexneri 2a str. 2457T
cagcaucgcucacc

SEQ ID NO: 1895655 - RNA, 15 nt, Shigella flexneri 2a str. 2457T
cagcaucguccgcca

SEQ ID NO: 1895656 - RNA, 22 nt, Shigella flexneri 2a str. 2457T
cagcauuacccagauaauagcg

SEQ ID NO: 1895657 - RNA, 18 nt, Shigella flexneri 2a str. 2457T
cagccacacaccgcaaac

SEQ ID NO: 1895658 - RNA, 15 nt, Shigella flexneri 2a str. 2457T
cagccaagcauguca

SEQ ID NO: 1895659 - RNA, 20 nt, Shigella flexneri 2a str. 2457T
cagccacauuugcggcgaac

SEQ ID NO: 1895660 - RNA, 16 nt, Shigella flexneri 2a str. 2457T
cagccaggcgcgaaug

SEQ ID NO: 1895661 - RNA, 16 nt, Shigella flexneri 2a str. 2457T
cagccaguuuuucagc

SEQ ID NO: 1895662 - RNA, 22 nt, Shigella flexneri 2a str. 2457T
cagccaguauugccaugcacgc

SEQ ID NO: 1895663 - RNA, 17 nt, Shigella flexneri 2a str. 2457T
cagccagugauuaacgc

SEQ ID NO: 1895664 - RNA, 18 nt, Shigella flexneri 2a str. 2457T
cagccaugcgaaugccaa

SEQ ID NO: 1895665 - RNA, 14 nt, Shigella flexneri 2a str. 2457T
cagccaucauccau

SEQ ID NO: 1895666 - RNA, 13 nt, Shigella flexneri 2a str. 2457T
cagcccggcaacg

SEQ ID NO: 1895667 - RNA, 12 nt, Shigella flexneri 2a str. 2457T
cagcccggcaau

SEQ ID NO: 1895668 - RNA, 14 nt, Shigella flexneri 2a str. 2457T
cagcccggcaaugg

SEQ ID NO: 1895669 - RNA, 17 nt, Shigella flexneri 2a str. 2457T
cagcacuccugccacca

SEQ ID NO: 1895670 - RNA, 18 nt, Shigella flexneri 2a str. 2457T
cagcacugccgcaucgua

SEQ ID NO: 1895671 - RNA, 20 nt, Shigella flexneri 2a str. 2457T
cagcacuucacccaucgcca

SEQ ID NO: 1895672 - RNA, 15 nt, Shigella flexneri 2a str. 2457T
cagcacuuccagcuc

SEQ ID NO: 1895673 - RNA, 20 nt, Shigella flexneri 2a str. 2457T
cagcaagaccgcgaccaccg

SEQ ID NO: 1895674 - RNA, 23 nt, Shigella flexneri 2a str. 2457T
cagcaagauauugauaacggaac

SEQ ID NO: 1895675 - RNA, 20 nt, Shigella flexneri 2a str. 2457T
cagcaaccaaugccaccagg

SEQ ID NO: 1895676 - RNA, 18 nt, Shigella flexneri 2a str. 2457T
cagcaaggguucaccggu

SEQ ID NO: 1895677 - RNA, 20 nt, Shigella flexneri 2a str. 2457T
cagcaagucggcaucgccac

SEQ ID NO: 1895678 - RNA, 13 nt, Shigella flexneri 2a str. 2457T
cagcacggucagg

SEQ ID NO: 1895679 - RNA, 18 nt, Shigella flexneri 2a str. 2457T
cagcaguucgcccgcuuc

SEQ ID NO: 1895680 - RNA, 22 nt, Shigella flexneri 2a str. 2457T
cagcaguauuaacgccauauca

SEQ ID NO: 1895681 - RNA, 15 nt, Shigella flexneri 2a str. 2457T
cagcaguccagcgcg

SEQ ID NO: 1895682 - RNA, 15 nt, Shigella flexneri 2a str. 2457T
cagcagugccgcauc

SEQ ID NO: 1895683 - RNA, 16 nt, Shigella flexneri 2a str. 2457T
cagcaguaaaccgcuc

SEQ ID NO: 1895684 - RNA, 16 nt, Shigella flexneri 2a str. 2457T
caucgcaaaccagacg

SEQ ID NO: 1895685 - RNA, 17 nt, Shigella flexneri 2a str. 2457T
caucgcaaaccagacgc

SEQ ID NO: 1895686 - RNA, 14 nt, Shigella flexneri 2a str. 2457T
caucgacucaagcg

SEQ ID NO: 1895687 - RNA, 19 nt, Shigella flexneri 2a str. 2457T
caucgacguagugaaaucg

SEQ ID NO: 1895688 - RNA, 23 nt, Shigella flexneri 2a str. 2457T
caucgccagaacuacccgguucg

SEQ ID NO: 1895689 - RNA, 21 nt, Shigella flexneri 2a str. 2457T
caucgccaccguuauccugau

SEQ ID NO: 1895690 - RNA, 20 nt, Shigella flexneri 2a str. 2457T
caucgccggugcgguaaucg

SEQ ID NO: 1895691 - RNA, 23 nt, Shigella flexneri 2a str. 2457T
caucgcgcuuaucgccagcgcca

SEQ ID NO: 1895692 - RNA, 18 nt, Shigella flexneri 2a str. 2457T
caucgcgcuuaucgccag

SEQ ID NO: 1895693 - RNA, 18 nt, Shigella flexneri 2a str. 2457T
caucgccugaucgcgcag

SEQ ID NO: 1895694 - RNA, 18 nt, Shigella flexneri 2a str. 2457T
caucgcuacauaacgcag

SEQ ID NO: 1895695 - RNA, 15 nt, Shigella flexneri 2a str. 2457T
caucgcuuuccaggu

SEQ ID NO: 1895696 - RNA, 14 nt, Shigella flexneri 2a str. 2457T
caucgcuuuccagg

SEQ ID NO: 1895697 - RNA, 22 nt, Shigella flexneri 2a str. 2457T
caucggcauacagcgacagacg

SEQ ID NO: 1895698 - RNA, 20 nt, Shigella flexneri 2a str. 2457T
cauagcgucccaguaacguc

SEQ ID NO: 1895699 - RNA, 14 nt, Shigella flexneri 2a str. 2457T
cauagcacacuuuc

SEQ ID NO: 1895700 - RNA, 22 nt, Shigella flexneri 2a str. 2457T
cauagaucuaaaugccacugaa

SEQ ID NO: 1895701 - RNA, 15 nt, Shigella flexneri 2a str. 2457T
caucaauaaacaaug

SEQ ID NO: 1895702 - RNA, 16 nt, Shigella flexneri 2a str. 2457T
caucaagcaaggccag

SEQ ID NO: 1895703 - RNA, 17 nt, Shigella flexneri 2a str. 2457T
caucaaucgcaaucugg

SEQ ID NO: 1895704 - RNA, 12 nt, Shigella flexneri 2a str. 2457T
caucaaugccag

SEQ ID NO: 1895705 - RNA, 17 nt, Shigella flexneri 2a str. 2457T
caucacgcagcgucagc

SEQ ID NO: 1895706 - RNA, 13 nt, Shigella flexneri 2a str. 2457T
caucagcgccacc

SEQ ID NO: 1895707 - RNA, 14 nt, Shigella flexneri 2a str. 2457T
caucagcaacacgc

SEQ ID NO: 1895708 - RNA, 11 nt, Shigella flexneri 2a str. 2457T
caucagcagca

SEQ ID NO: 1895709 - RNA, 14 nt, Shigella flexneri 2a str. 2457T
cauccauucagugc

SEQ ID NO: 1895710 - RNA, 17 nt, Shigella flexneri 2a str. 2457T
caucccaguggauaucg

SEQ ID NO: 1895711 - RNA, 23 nt, Shigella flexneri 2a str. 2457T
cauccaggugaaaaauaaaagcg

SEQ ID NO: 1895712 - RNA, 22 nt, Shigella flexneri 2a str. 2457T
cauccagcuuuuuaaucgccau

SEQ ID NO: 1895713 - RNA, 12 nt, Shigella flexneri 2a str. 2457T
caucaggcaaug

SEQ ID NO: 1895714 - RNA, 19 nt, Shigella flexneri 2a str. 2457T
caucagcgguacucgcgca

SEQ ID NO: 1895715 - RNA, 23 nt, Shigella flexneri 2a str. 2457T
caucagcugccagggcacugaua

SEQ ID NO: 1895716 - RNA, 11 nt, Shigella flexneri 2a str. 2457T
cauccagcagu

SEQ ID NO: 1895717 - RNA, 13 nt, Shigella flexneri 2a str. 2457T
cauccagcagcgg

SEQ ID NO: 1895718 - RNA, 14 nt, Shigella flexneri 2a str. 2457T
cauccugcggcagc

SEQ ID NO: 1895719 - RNA, 19 nt, Shigella flexneri 2a str. 2457T
cauccugcguuaaucgccg

SEQ ID NO: 1895720 - RNA, 15 nt, Shigella flexneri 2a str. 2457T
caucgacaucaacga

SEQ ID NO: 1895721 - RNA, 23 nt, Shigella flexneri 2a str. 2457T
cauccggcaacccuugacgcggu

SEQ ID NO: 1895722 - RNA, 17 nt, Shigella flexneri 2a str. 2457T
cauccgcgguaucgccg

SEQ ID NO: 1895723 - RNA, 17 nt, Shigella flexneri 2a str. 2457T
cauccgcgcgcguaagc

SEQ ID NO: 1895724 - RNA, 19 nt, Shigella flexneri 2a str. 2457T
cagguguuauagcgcugaa

SEQ ID NO: 1895725 - RNA, 18 nt, Shigella flexneri 2a str. 2457T
cagguuccccccacaauc

SEQ ID NO: 1895726 - RNA, 23 nt, Shigella flexneri 2a str. 2457T
caguaagcaguccagcgccugac

SEQ ID NO: 1895727 - RNA, 18 nt, Shigella flexneri 2a str. 2457T
caguaaccaaaagcuggg

SEQ ID NO: 1895728 - RNA, 17 nt, Shigella flexneri 2a str. 2457T
caguaacucauugccag

SEQ ID NO: 1895729 - RNA, 15 nt, Shigella flexneri 2a str. 2457T
caguaaagcagcgaa

SEQ ID NO: 1895730 - RNA, 13 nt, Shigella flexneri 2a str. 2457T
caguaaagcagcg

SEQ ID NO: 1895731 - RNA, 21 nt, Shigella flexneri 2a str. 2457T
cagguuuugacgugucugaua

SEQ ID NO: 1895732 - RNA, 12 nt, Shigella flexneri 2a str. 2457T
cagucuuccggc

SEQ ID NO: 1895733 - RNA, 15 nt, Shigella flexneri 2a str. 2457T
caguuuuucacccgc

SEQ ID NO: 1895734 - RNA, 20 nt, Shigella flexneri 2a str. 2457T
caguugaucaccagugcgga

SEQ ID NO: 1895735 - RNA, 22 nt, Shigella flexneri 2a str. 2457T
caguugaucaccagugcggaua

SEQ ID NO: 1895736 - RNA, 16 nt, Shigella flexneri 2a str. 2457T
caguucugcuucaaca

SEQ ID NO: 1895737 - RNA, 18 nt, Shigella flexneri 2a str. 2457T
caguucuggcaccggacg

SEQ ID NO: 1895738 - RNA, 22 nt, Shigella flexneri 2a str. 2457T
cauaaagcugcggauccugagc

SEQ ID NO: 1895739 - RNA, 14 nt, Shigella flexneri 2a str. 2457T
cauaaacacgguuu

SEQ ID NO: 1895740 - RNA, 20 nt, Shigella flexneri 2a str. 2457T
cauacggcacuuucaucgcg

SEQ ID NO: 1895741 - RNA, 20 nt, Shigella flexneri 2a str. 2457T
cauagagcgcauccaguucc

SEQ ID NO: 1895742 - RNA, 22 nt, Shigella flexneri 2a str. 2457T
cauacagaucgugcaucuccug

SEQ ID NO: 1895743 - RNA, 23 nt, Shigella flexneri 2a str. 2457T
cauaccuaaaagcacgccagaca

SEQ ID NO: 1895744 - RNA, 20 nt, Shigella flexneri 2a str. 2457T
cauaccuaaaagcacgccag

SEQ ID NO: 1895745 - RNA, 16 nt, Shigella flexneri 2a str. 2457T
cauaauuugugacgau

SEQ ID NO: 1895746 - RNA, 15 nt, Shigella flexneri 2a str. 2457T
cauacaacgccauga

SEQ ID NO: 1895747 - RNA, 21 nt, Shigella flexneri 2a str. 2457T
cauaaucgcaacgccuuccgu

SEQ ID NO: 1895748 - RNA, 22 nt, Shigella flexneri 2a str. 2457T
cagugcgucgcugcucuucagu

SEQ ID NO: 1895749 - RNA, 17 nt, Shigella flexneri 2a str. 2457T
cagugcauccagcagcc

SEQ ID NO: 1895750 - RNA, 17 nt, Shigella flexneri 2a str. 2457T
cagugcaaaugccagau

SEQ ID NO: 1895751 - RNA, 19 nt, Shigella flexneri 2a str. 2457T
cagugacugccccaguucc

SEQ ID NO: 1895752 - RNA, 15 nt, Shigella flexneri 2a str. 2457T
cagugagaagccacc

SEQ ID NO: 1895753 - RNA, 22 nt, Shigella flexneri 2a str. 2457T
cagugcuucgcggacaucgucc

SEQ ID NO: 1895754 - RNA, 22 nt, Shigella flexneri 2a str. 2457T
cagugcugaagguucaagacga

SEQ ID NO: 1895755 - RNA, 23 nt, Shigella flexneri 2a str. 2457T
caguuaagcaacugacuggcucu

SEQ ID NO: 1895756 - RNA, 22 nt, Shigella flexneri 2a str. 2457T
caguuaagcaauaccgcgaauc

SEQ ID NO: 1895757 - RNA, 18 nt, Shigella flexneri 2a str. 2457T
cagcucggauaaggcuuc

SEQ ID NO: 1895758 - RNA, 13 nt, Shigella flexneri 2a str. 2457T
cagcuccagcaga

SEQ ID NO: 1895759 - RNA, 15 nt, Shigella flexneri 2a str. 2457T
cagcgugacuggcag

SEQ ID NO: 1895760 - RNA, 13 nt, Shigella flexneri 2a str. 2457T
cagcguuuccagc

SEQ ID NO: 1895761 - RNA, 17 nt, Shigella flexneri 2a str. 2457T
cagcguuuccagcacca

SEQ ID NO: 1895762 - RNA, 21 nt, Shigella flexneri 2a str. 2457T
cagcgguaacuuaucuguaau

SEQ ID NO: 1895763 - RNA, 17 nt, Shigella flexneri 2a str. 2457T
cagcgucgcaucaggca

SEQ ID NO: 1895764 - RNA, 20 nt, Shigella flexneri 2a str. 2457T
cagcgugaacugggccugca

SEQ ID NO: 1895765 - RNA, 20 nt, Shigella flexneri 2a str. 2457T
cagcgucgcaucuggcauaa

SEQ ID NO: 1895766 - RNA, 16 nt, Shigella flexneri 2a str. 2457T
cagcgucgcauccgac

SEQ ID NO: 1895767 - RNA, 20 nt, Shigella flexneri 2a str. 2457T
cagcguaacgauggcaauuu

SEQ ID NO: 1895768 - RNA, 18 nt, Shigella flexneri 2a str. 2457T
cagcgguuuugccagcga

SEQ ID NO: 1895769 - RNA, 14 nt, Shigella flexneri 2a str. 2457T
cagcguaacggcuc

SEQ ID NO: 1895770 - RNA, 17 nt, Shigella flexneri 2a str. 2457T
cagcgguuuugccagcg

SEQ ID NO: 1895771 - RNA, 18 nt, Shigella flexneri 2a str. 2457T
cagcggugccgcgauacc

SEQ ID NO: 1895772 - RNA, 12 nt, Shigella flexneri 2a str. 2457T
caggaauauggu

SEQ ID NO: 1895773 - RNA, 20 nt, Shigella flexneri 2a str. 2457T
caggaaucacguaggccuga

SEQ ID NO: 1895774 - RNA, 15 nt, Shigella flexneri 2a str. 2457T
caggaaggccagcag

SEQ ID NO: 1895775 - RNA, 18 nt, Shigella flexneri 2a str. 2457T
caggcaaucgagcccaga

SEQ ID NO: 1895776 - RNA, 18 nt, Shigella flexneri 2a str. 2457T
caggcaaugggcaaacgc

SEQ ID NO: 1895777 - RNA, 19 nt, Shigella flexneri 2a str. 2457T
caggcaauguugcguuugu

SEQ ID NO: 1895778 - RNA, 20 nt, Shigella flexneri 2a str. 2457T
caggagcuggaugcccaaca

SEQ ID NO: 1895779 - RNA, 17 nt, Shigella flexneri 2a str. 2457T
caggauggucaacguca

SEQ ID NO: 1895780 - RNA, 12 nt, Shigella flexneri 2a str. 2457T
cagcucugcugu

SEQ ID NO: 1895781 - RNA, 22 nt, Shigella flexneri 2a str. 2457T
cagcucgugcagaacauccagc

SEQ ID NO: 1895782 - RNA, 14 nt, Shigella flexneri 2a str. 2457T
cagcuucgcuuccc

SEQ ID NO: 1895783 - RNA, 18 nt, Shigella flexneri 2a str. 2457T
cagcugccagacccggca

SEQ ID NO: 1895784 - RNA, 17 nt, Shigella flexneri 2a str. 2457T
caggcucagaagacgcu

SEQ ID NO: 1895785 - RNA, 16 nt, Shigella flexneri 2a str. 2457T
cagggccuccugcagc

SEQ ID NO: 1895786 - RNA, 23 nt, Shigella flexneri 2a str. 2457T
cagggacgagucgucgauaucga

SEQ ID NO: 1895787 - RNA, 19 nt, Shigella flexneri 2a str. 2457T
caggcuuuuuuauugccau

SEQ ID NO: 1895788 - RNA, 13 nt, Shigella flexneri 2a str. 2457T
caggcuuuccguc

SEQ ID NO: 1895789 - RNA, 21 nt, Shigella flexneri 2a str. 2457T
caggcuucaacacaggccggc

SEQ ID NO: 1895790 - RNA, 21 nt, Shigella flexneri 2a str. 2457T
caggcuguuaccccugcggcc

SEQ ID NO: 1895791 - RNA, 22 nt, Shigella flexneri 2a str. 2457T
caggcgcugaugagcaaaucgc

SEQ ID NO: 1895792 - RNA, 12 nt, Shigella flexneri 2a str. 2457T
ccaccgccagcg

SEQ ID NO: 1895793 - RNA, 19 nt, Shigella flexneri 2a str. 2457T
ccaccagcggaauaucaga

SEQ ID NO: 1895794 - RNA, 21 nt, Shigella flexneri 2a str. 2457T
ccaccagcgccgcgccacuac

SEQ ID NO: 1895795 - RNA, 15 nt, Shigella flexneri 2a str. 2457T
ccaccaggccacggc

SEQ ID NO: 1895796 - RNA, 16 nt, Shigella flexneri 2a str. 2457T
ccacccagcgccgcca

SEQ ID NO: 1895797 - RNA, 20 nt, Shigella flexneri 2a str. 2457T
ccacccauguugaucgccac

SEQ ID NO: 1895798 - RNA, 15 nt, Shigella flexneri 2a str. 2457T
ccaccgaugcacagc

SEQ ID NO: 1895799 - RNA, 13 nt, Shigella flexneri 2a str. 2457T
ccacagauccgga

SEQ ID NO: 1895800 - RNA, 20 nt, Shigella flexneri 2a str. 2457T
ccacagccgagcgccaccau

SEQ ID NO: 1895801 - RNA, 17 nt, Shigella flexneri 2a str. 2457T
ccacacacgauccugca

SEQ ID NO: 1895802 - RNA, 21 nt, Shigella flexneri 2a str. 2457T
ccacaccaccgcaaucgccag

SEQ ID NO: 1895803 - RNA, 19 nt, Shigella flexneri 2a str. 2457T
ccacacggaguaaugccag

SEQ ID NO: 1895804 - RNA, 13 nt, Shigella flexneri 2a str. 2457T
ccacagcgccaga

SEQ ID NO: 1895805 - RNA, 18 nt, Shigella flexneri 2a str. 2457T
ccacagggugaucaccag

SEQ ID NO: 1895806 - RNA, 18 nt, Shigella flexneri 2a str. 2457T
ccacaguugaucagccag

SEQ ID NO: 1895807 - RNA, 21 nt, Shigella flexneri 2a str. 2457T
ccacaguuucauaucugccag

SEQ ID NO: 1895808 - RNA, 19 nt, Shigella flexneri 2a str. 2457T
ccaccacaacauucccauc

SEQ ID NO: 1895809 - RNA, 23 nt, Shigella flexneri 2a str. 2457T
ccaccacagacaaucgccaguga

SEQ ID NO: 1895810 - RNA, 22 nt, Shigella flexneri 2a str. 2457T
ccaccacguccagagugaugcg

SEQ ID NO: 1895811 - RNA, 19 nt, Shigella flexneri 2a str. 2457T
ccaaugaaagccccaccag

SEQ ID NO: 1895812 - RNA, 16 nt, Shigella flexneri 2a str. 2457T
ccacaaacccgccaga

SEQ ID NO: 1895813 - RNA, 15 nt, Shigella flexneri 2a str. 2457T
ccaaucaucgcggca

SEQ ID NO: 1895814 - RNA, 23 nt, Shigella flexneri 2a str. 2457T
ccaaccacggaguugaccagcuc

SEQ ID NO: 1895815 - RNA, 15 nt, Shigella flexneri 2a str. 2457T
ccaacaucaugccag

SEQ ID NO: 1895816 - RNA, 14 nt, Shigella flexneri 2a str. 2457T
ccaacaucuaacgc

SEQ ID NO: 1895817 - RNA, 17 nt, Shigella flexneri 2a str. 2457T
caugccggccagcgcca

SEQ ID NO: 1895818 - RNA, 21 nt, Shigella flexneri 2a str. 2457T
caugcgguucacgcgccagag

SEQ ID NO: 1895819 - RNA, 15 nt, Shigella flexneri 2a str. 2457T
caugcucacagagua

SEQ ID NO: 1895820 - RNA, 22 nt, Shigella flexneri 2a str. 2457T
cauguuccugccagucuuccgc

SEQ ID NO: 1895821 - RNA, 21 nt, Shigella flexneri 2a str. 2457T
cauguggcggcgcgaggcgaa

SEQ ID NO: 1895822 - RNA, 18 nt, Shigella flexneri 2a str. 2457T
caugguuuauuucccaga

SEQ ID NO: 1895823 - RNA, 15 nt, Shigella flexneri 2a str. 2457T
cauguaacgaugcau

SEQ ID NO: 1895824 - RNA, 19 nt, Shigella flexneri 2a str. 2457T
cauggccgggguuucagau

SEQ ID NO: 1895825 - RNA, 15 nt, Shigella flexneri 2a str. 2457T
caugcuggauggcgc

SEQ ID NO: 1895826 - RNA, 21 nt, Shigella flexneri 2a str. 2457T
cauugagaaagcccuggcgca

SEQ ID NO: 1895827 - RNA, 16 nt, Shigella flexneri 2a str. 2457T
cauugauggcgcuuuc

SEQ ID NO: 1895828 - RNA, 19 nt, Shigella flexneri 2a str. 2457T
cauuguuguuggauccccu

SEQ ID NO: 1895829 - RNA, 16 nt, Shigella flexneri 2a str. 2457T
cauuucacucacgccg

SEQ ID NO: 1895830 - RNA, 16 nt, Shigella flexneri 2a str. 2457T
cauuucaaucacauca

SEQ ID NO: 1895831 - RNA, 16 nt, Shigella flexneri 2a str. 2457T
cauuucaucgccagcg

SEQ ID NO: 1895832 - RNA, 13 nt, Shigella flexneri 2a str. 2457T
cauuuccccaauc

SEQ ID NO: 1895833 - RNA, 14 nt, Shigella flexneri 2a str. 2457T
cauuuauguucagc

SEQ ID NO: 1895834 - RNA, 13 nt, Shigella flexneri 2a str. 2457T
cauuuauuaccuu

SEQ ID NO: 1895835 - RNA, 23 nt, Shigella flexneri 2a str. 2457T
cauuucuggacgauugugcuggu

SEQ ID NO: 1895836 - RNA, 14 nt, Shigella flexneri 2a str. 2457T
ccaaaacagcgaca

SEQ ID NO: 1895837 - RNA, 23 nt, Shigella flexneri 2a str. 2457T
cauuuuuuagcgccagccagaug

SEQ ID NO: 1895838 - RNA, 17 nt, Shigella flexneri 2a str. 2457T
ccaacaauagugccgca

SEQ ID NO: 1895839 - RNA, 22 nt, Shigella flexneri 2a str. 2457T
cauuaaugcgcccagcgucagc

SEQ ID NO: 1895840 - RNA, 14 nt, Shigella flexneri 2a str. 2457T
cauuacgcgccccu

SEQ ID NO: 1895841 - RNA, 21 nt, Shigella flexneri 2a str. 2457T
cauuacccaggaagaccugca

SEQ ID NO: 1895842 - RNA, 11 nt, Shigella flexneri 2a str. 2457T
cauuaccgcga

SEQ ID NO: 1895843 - RNA, 14 nt, Shigella flexneri 2a str. 2457T
cauuaaacgccguu

SEQ ID NO: 1895844 - RNA, 22 nt, Shigella flexneri 2a str. 2457T
cauuaaccagccacugcgccau

SEQ ID NO: 1895845 - RNA, 19 nt, Shigella flexneri 2a str. 2457T
cauguugauuaccugucgc

SEQ ID NO: 1895846 - RNA, 18 nt, Shigella flexneri 2a str. 2457T
cauuaucggcucgaucug

SEQ ID NO: 1895847 - RNA, 14 nt, Shigella flexneri 2a str. 2457T
cauuaucacaucag

SEQ ID NO: 1895848 - RNA, 16 nt, Shigella flexneri 2a str. 2457T
cauucgcaguugcagu

SEQ ID NO: 1895849 - RNA, 14 nt, Shigella flexneri 2a str. 2457T
cauucgccgguucc

SEQ ID NO: 1895850 - RNA, 18 nt, Shigella flexneri 2a str. 2457T
cauucaccgacgugauga

SEQ ID NO: 1895851 - RNA, 14 nt, Shigella flexneri 2a str. 2457T
ccagcgaauuccag

SEQ ID NO: 1895852 - RNA, 15 nt, Shigella flexneri 2a str. 2457T
ccagcgaauccagca

SEQ ID NO: 1895853 - RNA, 13 nt, Shigella flexneri 2a str. 2457T
ccagcgaagccag

SEQ ID NO: 1895854 - RNA, 19 nt, Shigella flexneri 2a str. 2457T
ccagcgaugcccagugacc

SEQ ID NO: 1895855 - RNA, 17 nt, Shigella flexneri 2a str. 2457T
ccagcgauaccggugca

SEQ ID NO: 1895856 - RNA, 14 nt, Shigella flexneri 2a str. 2457T
ccagccugcaaacg

SEQ ID NO: 1895857 - RNA, 14 nt, Shigella flexneri 2a str. 2457T
ccagccggacugga

SEQ ID NO: 1895858 - RNA, 19 nt, Shigella flexneri 2a str. 2457T
ccagcaucuccugcaacag

SEQ ID NO: 1895859 - RNA, 22 nt, Shigella flexneri 2a str. 2457T
ccagcgcuucagcgaucgcuuu

SEQ ID NO: 1895860 - RNA, 17 nt, Shigella flexneri 2a str. 2457T
ccagcgcgcaguugcaa

SEQ ID NO: 1895861 - RNA, 19 nt, Shigella flexneri 2a str. 2457T
ccagcgauggacgcagacc

SEQ ID NO: 1895862 - RNA, 17 nt, Shigella flexneri 2a str. 2457T
ccagcgauuuaucggca

SEQ ID NO: 1895863 - RNA, 19 nt, Shigella flexneri 2a str. 2457T
ccaggaacgggauugccag

SEQ ID NO: 1895864 - RNA, 17 nt, Shigella flexneri 2a str. 2457T
ccagcuugcuuuccagc

SEQ ID NO: 1895865 - RNA, 18 nt, Shigella flexneri 2a str. 2457T
ccagcucaaggcgguaaa

SEQ ID NO: 1895866 - RNA, 14 nt, Shigella flexneri 2a str. 2457T
ccagcucagugacc

SEQ ID NO: 1895867 - RNA, 12 nt, Shigella flexneri 2a str. 2457T
ccagcuccagcc

SEQ ID NO: 1895868 - RNA, 22 nt, Shigella flexneri 2a str. 2457T
ccagacaauugccgccagcuca

SEQ ID NO: 1895869 - RNA, 13 nt, Shigella flexneri 2a str. 2457T
ccagaaugcccca

SEQ ID NO: 1895870 - RNA, 14 nt, Shigella flexneri 2a str. 2457T
ccagacgggcauuu

SEQ ID NO: 1895871 - RNA, 21 nt, Shigella flexneri 2a str. 2457T
ccagacucgccagacgcaucg

SEQ ID NO: 1895872 - RNA, 20 nt, Shigella flexneri 2a str. 2457T
ccagagagaacugcgccaga

SEQ ID NO: 1895873 - RNA, 16 nt, Shigella flexneri 2a str. 2457T
ccagacuacgccaaca

SEQ ID NO: 1895874 - RNA, 19 nt, Shigella flexneri 2a str. 2457T
ccagaagggguaaugccag

SEQ ID NO: 1895875 - RNA, 20 nt, Shigella flexneri 2a str. 2457T
ccagaagcacugccagaauc

SEQ ID NO: 1895876 - RNA, 19 nt, Shigella flexneri 2a str. 2457T
ccagaagcacugccagaau

SEQ ID NO: 1895877 - RNA, 19 nt, Shigella flexneri 2a str. 2457T
ccagaaacucugcggcauc

SEQ ID NO: 1895878 - RNA, 23 nt, Shigella flexneri 2a str. 2457T
ccagaacacuguuaccgcugcug

SEQ ID NO: 1895879 - RNA, 13 nt, Shigella flexneri 2a str. 2457T
ccagaaccgcgua

SEQ ID NO: 1895880 - RNA, 14 nt, Shigella flexneri 2a str. 2457T
ccacuccggcauga

SEQ ID NO: 1895881 - RNA, 20 nt, Shigella flexneri 2a str. 2457T
ccacuuucaggccagcggcu

SEQ ID NO: 1895882 - RNA, 17 nt, Shigella flexneri 2a str. 2457T
ccacuuugcaguuccug

SEQ ID NO: 1895883 - RNA, 13 nt, Shigella flexneri 2a str. 2457T
ccagaaaaccugg

SEQ ID NO: 1895884 - RNA, 21 nt, Shigella flexneri 2a str. 2457T
ccacuuaauaagaagaaaccg

SEQ ID NO: 1895885 - RNA, 18 nt, Shigella flexneri 2a str. 2457T
ccacuuccaccagcggcu

SEQ ID NO: 1895886 - RNA, 16 nt, Shigella flexneri 2a str. 2457T
ccacuuccaccagcgg

SEQ ID NO: 1895887 - RNA, 15 nt, Shigella flexneri 2a str. 2457T
ccacuuccgcgucaa

SEQ ID NO: 1895888 - RNA, 17 nt, Shigella flexneri 2a str. 2457T
ccacgcugcaucgccaa

SEQ ID NO: 1895889 - RNA, 18 nt, Shigella flexneri 2a str. 2457T
ccacgucaucagcaauuu

SEQ ID NO: 1895890 - RNA, 16 nt, Shigella flexneri 2a str. 2457T
ccagcaccgcgacaau

SEQ ID NO: 1895891 - RNA, 22 nt, Shigella flexneri 2a str. 2457T
ccagcagcagagcaaucaccag

SEQ ID NO: 1895892 - RNA, 14 nt, Shigella flexneri 2a str. 2457T
ccagcagcagccgg

SEQ ID NO: 1895893 - RNA, 14 nt, Shigella flexneri 2a str. 2457T
ccagcaucccggca

SEQ ID NO: 1895894 - RNA, 12 nt, Shigella flexneri 2a str. 2457T
ccagcaucggca

SEQ ID NO: 1895895 - RNA, 19 nt, Shigella flexneri 2a str. 2457T
ccagcaggauguuccggca

SEQ ID NO: 1895896 - RNA, 20 nt, Shigella flexneri 2a str. 2457T
ccagcagcugcguggcgcuu

SEQ ID NO: 1895897 - RNA, 14 nt, Shigella flexneri 2a str. 2457T
ccagcaauccugca

SEQ ID NO: 1895898 - RNA, 17 nt, Shigella flexneri 2a str. 2457T
ccagcaauaacaacacg

SEQ ID NO: 1895899 - RNA, 17 nt, Shigella flexneri 2a str. 2457T
ccagcaaccaacgccag

SEQ ID NO: 1895900 - RNA, 19 nt, Shigella flexneri 2a str. 2457T
ccagcaaccaacgccagca

SEQ ID NO: 1895901 - RNA, 17 nt, Shigella flexneri 2a str. 2457T
ccagcaaccaaugccac

SEQ ID NO: 1895902 - RNA, 19 nt, Shigella flexneri 2a str. 2457T
ccagcaaccaaugccacca

SEQ ID NO: 1895903 - RNA, 13 nt, Shigella flexneri 2a str. 2457T
ccagcaagcgcac

SEQ ID NO: 1895904 - RNA, 16 nt, Shigella flexneri 2a str. 2457T
ccagauuauaagccag

SEQ ID NO: 1895905 - RNA, 15 nt, Shigella flexneri 2a str. 2457T
ccaggaucagaaugc

SEQ ID NO: 1895906 - RNA, 18 nt, Shigella flexneri 2a str. 2457T
ccaggaucggugcugcca

SEQ ID NO: 1895907 - RNA, 17 nt, Shigella flexneri 2a str. 2457T
ccagggccaacuggcaa

SEQ ID NO: 1895908 - RNA, 16 nt, Shigella flexneri 2a str. 2457T
ccagucgucaucccag

SEQ ID NO: 1895909 - RNA, 21 nt, Shigella flexneri 2a str. 2457T
ccaguucaacgcccgcuuuca

SEQ ID NO: 1895910 - RNA, 15 nt, Shigella flexneri 2a str. 2457T
ccaguucaagugcua

SEQ ID NO: 1895911 - RNA, 18 nt, Shigella flexneri 2a str. 2457T
ccaguucuacaaucugcc

SEQ ID NO: 1895912 - RNA, 14 nt, Shigella flexneri 2a str. 2457T
ccaguugucgguaa

SEQ ID NO: 1895913 - RNA, 17 nt, Shigella flexneri 2a str. 2457T
ccaggugagauccggga

SEQ ID NO: 1895914 - RNA, 18 nt, Shigella flexneri 2a str. 2457T
ccaugcuuugcaucccag

SEQ ID NO: 1895915 - RNA, 19 nt, Shigella flexneri 2a str. 2457T
ccauuaaacgcaguaagcg

SEQ ID NO: 1895916 - RNA, 16 nt, Shigella flexneri 2a str. 2457T
ccaugccaaucagcag

SEQ ID NO: 1895917 - RNA, 16 nt, Shigella flexneri 2a str. 2457T
ccaugccaucugccag

SEQ ID NO: 1895918 - RNA, 23 nt, Shigella flexneri 2a str. 2457T
ccaugccgcccagaagcacugcc

SEQ ID NO: 1895919 - RNA, 21 nt, Shigella flexneri 2a str. 2457T
ccaugauauuggcaucgccag

SEQ ID NO: 1895920 - RNA, 17 nt, Shigella flexneri 2a str. 2457T
ccaugaccgaucaaggc

SEQ ID NO: 1895921 - RNA, 16 nt, Shigella flexneri 2a str. 2457T
ccaugacaaauaacgg

SEQ ID NO: 1895922 - RNA, 17 nt, Shigella flexneri 2a str. 2457T
ccaugcaauuaccgcca

SEQ ID NO: 1895923 - RNA, 17 nt, Shigella flexneri 2a str. 2457T
ccauacguuugccuuuc

SEQ ID NO: 1895924 - RNA, 19 nt, Shigella flexneri 2a str. 2457T
ccauacugacuaucaucgc

SEQ ID NO: 1895925 - RNA, 23 nt, Shigella flexneri 2a str. 2457T
ccauacucuuucccggcaaucac

SEQ ID NO: 1895926 - RNA, 23 nt, Shigella flexneri 2a str. 2457T
ccaucagguaauaggcaggcauc

SEQ ID NO: 1895927 - RNA, 22 nt, Shigella flexneri 2a str. 2457T
ccauaccugcacaaauagccag

SEQ ID NO: 1895928 - RNA, 13 nt, Shigella flexneri 2a str. 2457T
ccauacagcagca

SEQ ID NO: 1895929 - RNA, 14 nt, Shigella flexneri 2a str. 2457T
ccauccacagggug

SEQ ID NO: 1895930 - RNA, 13 nt, Shigella flexneri 2a str. 2457T
ccaucaugcgcca

SEQ ID NO: 1895931 - RNA, 12 nt, Shigella flexneri 2a str. 2457T
ccaucaucggca

SEQ ID NO: 1895932 - RNA, 13 nt, Shigella flexneri 2a str. 2457T
ccaucaucaccag

SEQ ID NO: 1895933 - RNA, 23 nt, Shigella flexneri 2a str. 2457T
ccaucauaaaucggaaacagcgg

SEQ ID NO: 1895934 - RNA, 23 nt, Shigella flexneri 2a str. 2457T
ccaucauucagugacagguugcu

SEQ ID NO: 1895935 - RNA, 15 nt, Shigella flexneri 2a str. 2457T
ccaucccuaugcaua

SEQ ID NO: 1895936 - RNA, 19 nt, Shigella flexneri 2a str. 2457T
ccaucgcaccaaacgggca

SEQ ID NO: 1895937 - RNA, 17 nt, Shigella flexneri 2a str. 2457T
ccaucgagaaucagcga

SEQ ID NO: 1895938 - RNA, 16 nt, Shigella flexneri 2a str. 2457T
ccccggcaugauugag

SEQ ID NO: 1895939 - RNA, 22 nt, Shigella flexneri 2a str. 2457T
ccccaguaaucgggcaacugcu

SEQ ID NO: 1895940 - RNA, 15 nt, Shigella flexneri 2a str. 2457T
ccccagcgucagcau

SEQ ID NO: 1895941 - RNA, 11 nt, Shigella flexneri 2a str. 2457T
ccccaaugacc

SEQ ID NO: 1895942 - RNA, 12 nt, Shigella flexneri 2a str. 2457T
cccacgccagcc

SEQ ID NO: 1895943 - RNA, 19 nt, Shigella flexneri 2a str. 2457T
cccacgauugaucucguug

SEQ ID NO: 1895944 - RNA, 18 nt, Shigella flexneri 2a str. 2457T
ccauugcaucaucgacau

SEQ ID NO: 1895945 - RNA, 12 nt, Shigella flexneri 2a str. 2457T
ccauucccugcu

SEQ ID NO: 1895946 - RNA, 16 nt, Shigella flexneri 2a str. 2457T
ccauuccggccaucgc

SEQ ID NO: 1895947 - RNA, 19 nt, Shigella flexneri 2a str. 2457T
ccauuccggccaucgccug

SEQ ID NO: 1895948 - RNA, 17 nt, Shigella flexneri 2a str. 2457T
ccauuccguuucuccac

SEQ ID NO: 1895949 - RNA, 15 nt, Shigella flexneri 2a str. 2457T
cccagcgcgaucgca

SEQ ID NO: 1895950 - RNA, 19 nt, Shigella flexneri 2a str. 2457T
cccagcgcggugacgcaca

SEQ ID NO: 1895951 - RNA, 13 nt, Shigella flexneri 2a str. 2457T
cccagcaccagua

SEQ ID NO: 1895952 - RNA, 14 nt, Shigella flexneri 2a str. 2457T
cccagucauccggc

SEQ ID NO: 1895953 - RNA, 21 nt, Shigella flexneri 2a str. 2457T
cccagugguuucgccagcacc

SEQ ID NO: 1895954 - RNA, 22 nt, Shigella flexneri 2a str. 2457T
cccagugguuucgccagcaccg

SEQ ID NO: 1895955 - RNA, 17 nt, Shigella flexneri 2a str. 2457T
cccggccugugucacuu

SEQ ID NO: 1895956 - RNA, 23 nt, Shigella flexneri 2a str. 2457T
cccggaagccaccacgccaagaa

SEQ ID NO: 1895957 - RNA, 23 nt, Shigella flexneri 2a str. 2457T
cccggcauucaccucugcggcaa

SEQ ID NO: 1895958 - RNA, 20 nt, Shigella flexneri 2a str. 2457T
cccgcucaaacaccgucgca

SEQ ID NO: 1895959 - RNA, 13 nt, Shigella flexneri 2a str. 2457T
cccgcagcaaccg

SEQ ID NO: 1895960 - RNA, 14 nt, Shigella flexneri 2a str. 2457T
ccgacauugccagc

SEQ ID NO: 1895961 - RNA, 21 nt, Shigella flexneri 2a str. 2457T
ccgaagcuuucuugcagcucu

SEQ ID NO: 1895962 - RNA, 12 nt, Shigella flexneri 2a str. 2457T
ccgaccgcuuca

SEQ ID NO: 1895963 - RNA, 22 nt, Shigella flexneri 2a str. 2457T
ccgaccgcaaggaagccugaca

SEQ ID NO: 1895964 - RNA, 15 nt, Shigella flexneri 2a str. 2457T
cccugcagcuggucg

SEQ ID NO: 1895965 - RNA, 15 nt, Shigella flexneri 2a str. 2457T
cccguuugcggaucg

SEQ ID NO: 1895966 - RNA, 16 nt, Shigella flexneri 2a str. 2457T
cccguuuuccgggcaa

SEQ ID NO: 1895967 - RNA, 22 nt, Shigella flexneri 2a str. 2457T
cccugcuggugauggacaacgc

SEQ ID NO: 1895968 - RNA, 19 nt, Shigella flexneri 2a str. 2457T
cccuugcuucgccaguucg

SEQ ID NO: 1895969 - RNA, 19 nt, Shigella flexneri 2a str. 2457T
cccuugauguggcggaugg

SEQ ID NO: 1895970 - RNA, 12 nt, Shigella flexneri 2a str. 2457T
aucacaccgcga

SEQ ID NO: 1895971 - RNA, 18 nt, Shigella flexneri 2a str. 2457T
aucacaccugcucagccc

SEQ ID NO: 1895972 - RNA, 16 nt, Shigella flexneri 2a str. 2457T
aucacaucgcuggugg

SEQ ID NO: 1895973 - RNA, 13 nt, Shigella flexneri 2a str. 2457T
aucaccauccacg

SEQ ID NO: 1895974 - RNA, 16 nt, Shigella flexneri 2a str. 2457T
aucaccugaugcccgu

SEQ ID NO: 1895975 - RNA, 15 nt, Shigella flexneri 2a str. 2457T
aucaccuuacggcac

SEQ ID NO: 1895976 - RNA, 12 nt, Shigella flexneri 2a str. 2457T
aucacgcaucac

SEQ ID NO: 1895977 - RNA, 17 nt, Shigella flexneri 2a str. 2457T
aucacgcgaccaucgcg

SEQ ID NO: 1895978 - RNA, 17 nt, Shigella flexneri 2a str. 2457T
aucacgcuuaucgcccu

SEQ ID NO: 1895979 - RNA, 16 nt, Shigella flexneri 2a str. 2457T
aucagcaaacuauccc

SEQ ID NO: 1895980 - RNA, 16 nt, Shigella flexneri 2a str. 2457T
aucagcaacgaaguaa

SEQ ID NO: 1895981 - RNA, 19 nt, Shigella flexneri 2a str. 2457T
aucagaccuucgcuaucaa

SEQ ID NO: 1895982 - RNA, 20 nt, Shigella flexneri 2a str. 2457T
aucagacaaaugucacugcu

SEQ ID NO: 1895983 - RNA, 16 nt, Shigella flexneri 2a str. 2457T
aucagacgcuuacguu

SEQ ID NO: 1895984 - RNA, 21 nt, Shigella flexneri 2a str. 2457T
aucagacuggcgauuauccau

SEQ ID NO: 1895985 - RNA, 14 nt, Shigella flexneri 2a str. 2457T
aucacuaucgccau

SEQ ID NO: 1895986 - RNA, 14 nt, Shigella flexneri 2a str. 2457T
aucacuaacgacau

SEQ ID NO: 1895987 - RNA, 23 nt, Shigella flexneri 2a str. 2457T
aucacugccagaauagccgcagc

SEQ ID NO: 1895988 - RNA, 15 nt, Shigella flexneri 2a str. 2457T
aucacuuccagcagu

SEQ ID NO: 1895989 - RNA, 14 nt, Shigella flexneri 2a str. 2457T
aucacuuccagcag

SEQ ID NO: 1895990 - RNA, 16 nt, Shigella flexneri 2a str. 2457T
aucagccugcaaacgc

SEQ ID NO: 1895991 - RNA, 15 nt, Shigella flexneri 2a str. 2457T
aucagcgcagcaccc

SEQ ID NO: 1895992 - RNA, 19 nt, Shigella flexneri 2a str. 2457T
aucagcaaauccaucgccu

SEQ ID NO: 1895993 - RNA, 17 nt, Shigella flexneri 2a str. 2457T
aucagcauaaucaccag

SEQ ID NO: 1895994 - RNA, 20 nt, Shigella flexneri 2a str. 2457T
aucagcauucucaucaccau

SEQ ID NO: 1895995 - RNA, 15 nt, Shigella flexneri 2a str. 2457T
auaugacgaaagcgc

SEQ ID NO: 1895996 - RNA, 16 nt, Shigella flexneri 2a str. 2457T
auauggcgcugcggcg

SEQ ID NO: 1895997 - RNA, 21 nt, Shigella flexneri 2a str. 2457T
auagccagguuuaccagcagc

SEQ ID NO: 1895998 - RNA, 14 nt, Shigella flexneri 2a str. 2457T
auagccaucugccu

SEQ ID NO: 1895999 - RNA, 17 nt, Shigella flexneri 2a str. 2457T
auagccagccucaucca

SEQ ID NO: 1896000 - RNA, 19 nt, Shigella flexneri 2a str. 2457T
auagccaccuggcugcguu

SEQ ID NO: 1896001 - RNA, 21 nt, Shigella flexneri 2a str. 2457T
auagcgcacaugcaacuucgc

SEQ ID NO: 1896002 - RNA, 19 nt, Shigella flexneri 2a str. 2457T
aucaagccccagcaggaug

SEQ ID NO: 1896003 - RNA, 24 nt, Shigella flexneri 2a str. 2457T
aucaaguagcagguaaucugccau

SEQ ID NO: 1896004 - RNA, 16 nt, Shigella flexneri 2a str. 2457T
aucaauaacagcgcaa

SEQ ID NO: 1896005 - RNA, 14 nt, Shigella flexneri 2a str. 2457T
aucacacagcgguu

SEQ ID NO: 1896006 - RNA, 22 nt, Shigella flexneri 2a str. 2457T
aucaaugugcugagaacaagau

SEQ ID NO: 1896007 - RNA, 13 nt, Shigella flexneri 2a str. 2457T
aucaauaccagcc

SEQ ID NO: 1896008 - RNA, 16 nt, Shigella flexneri 2a str. 2457T
auauuuuccgugaaga

SEQ ID NO: 1896009 - RNA, 15 nt, Shigella flexneri 2a str. 2457T
auauuuuuccggcag

SEQ ID NO: 1896010 - RNA, 13 nt, Shigella flexneri 2a str. 2457T
aucaaagaugaug

SEQ ID NO: 1896011 - RNA, 17 nt, Shigella flexneri 2a str. 2457T
aucaaacgugacauucu

SEQ ID NO: 1896012 - RNA, 19 nt, Shigella flexneri 2a str. 2457T
aucaacgacaaaaauacca

SEQ ID NO: 1896013 - RNA, 21 nt, Shigella flexneri 2a str. 2457T
aucaaccgcuauaccgccgau

SEQ ID NO: 1896014 - RNA, 19 nt, Shigella flexneri 2a str. 2457T
aucaacaguuuguugcauu

SEQ ID NO: 1896015 - RNA, 17 nt, Shigella flexneri 2a str. 2457T
auacucaagcagccagg

SEQ ID NO: 1896016 - RNA, 18 nt, Shigella flexneri 2a str. 2457T
auacuggcuaagaagccu

SEQ ID NO: 1896017 - RNA, 23 nt, Shigella flexneri 2a str. 2457T
auacuguuuaccggugccagcaa

SEQ ID NO: 1896018 - RNA, 20 nt, Shigella flexneri 2a str. 2457T
auagagcgcggcgcaggcaa

SEQ ID NO: 1896019 - RNA, 15 nt, Shigella flexneri 2a str. 2457T
auagaucagacgaca

SEQ ID NO: 1896020 - RNA, 22 nt, Shigella flexneri 2a str. 2457T
auagaucuaaaugccacugaau

SEQ ID NO: 1896021 - RNA, 21 nt, Shigella flexneri 2a str. 2457T
auagcagcacaccacaucgcc

SEQ ID NO: 1896022 - RNA, 11 nt, Shigella flexneri 2a str. 2457T
auagccaauuc

SEQ ID NO: 1896023 - RNA, 20 nt, Shigella flexneri 2a str. 2457T
auacguuuggucagaucagc

SEQ ID NO: 1896024 - RNA, 16 nt, Shigella flexneri 2a str. 2457T
auaccgauaucgccau

SEQ ID NO: 1896025 - RNA, 17 nt, Shigella flexneri 2a str. 2457T
auaccgauuacucagca

SEQ ID NO: 1896026 - RNA, 21 nt, Shigella flexneri 2a str. 2457T
auacaggggccaguuccgccg

SEQ ID NO: 1896027 - RNA, 14 nt, Shigella flexneri 2a str. 2457T
auacaggugcagcc

SEQ ID NO: 1896028 - RNA, 21 nt, Shigella flexneri 2a str. 2457T
auacaucgcgcuuaucgccag

SEQ ID NO: 1896029 - RNA, 18 nt, Shigella flexneri 2a str. 2457T
auaaugcccgaugaccuu

SEQ ID NO: 1896030 - RNA, 12 nt, Shigella flexneri 2a str. 2457T
auaaugcaacau

SEQ ID NO: 1896031 - RNA, 22 nt, Shigella flexneri 2a str. 2457T
auaauguuucaguguuaaacgc

SEQ ID NO: 1896032 - RNA, 21 nt, Shigella flexneri 2a str. 2457T
auaaucucuuuacccagcgga

SEQ ID NO: 1896033 - RNA, 13 nt, Shigella flexneri 2a str. 2457T
auaaugcgccacc

SEQ ID NO: 1896034 - RNA, 22 nt, Shigella flexneri 2a str. 2457T
auacaggaacagccacugguga

SEQ ID NO: 1896035 - RNA, 15 nt, Shigella flexneri 2a str. 2457T
auacaggaagcgaau

SEQ ID NO: 1896036 - RNA, 21 nt, Shigella flexneri 2a str. 2457T
auaauuuaugccugauacgca

SEQ ID NO: 1896037 - RNA, 18 nt, Shigella flexneri 2a str. 2457T
auaauuacgcuguucauc

SEQ ID NO: 1896038 - RNA, 23 nt, Shigella flexneri 2a str. 2457T
auaaucagauugugguugcgcag

SEQ ID NO: 1896039 - RNA, 16 nt, Shigella flexneri 2a str. 2457T
auaaucaccaucagca

SEQ ID NO: 1896040 - RNA, 15 nt, Shigella flexneri 2a str. 2457T
auaaucgggaacgcu

SEQ ID NO: 1896041 - RNA, 18 nt, Shigella flexneri 2a str. 2457T
auaaucgggaauacagaa

SEQ ID NO: 1896042 - RNA, 22 nt, Shigella flexneri 2a str. 2457T
auaauccaucccgcucuguaag

SEQ ID NO: 1896043 - RNA, 13 nt, Shigella flexneri 2a str. 2457T
auaaucagugccg

SEQ ID NO: 1896044 - RNA, 18 nt, Shigella flexneri 2a str. 2457T
auaauccccaaugaccuu

SEQ ID NO: 1896045 - RNA, 19 nt, Shigella flexneri 2a str. 2457T
auaagcaacgcggcgguga

SEQ ID NO: 1896046 - RNA, 20 nt, Shigella flexneri 2a str. 2457T
aguuuugucgcugauuugcu

SEQ ID NO: 1896047 - RNA, 14 nt, Shigella flexneri 2a str. 2457T
aguuuuaccuucau

SEQ ID NO: 1896048 - RNA, 18 nt, Shigella flexneri 2a str. 2457T
aguuuguguguggcgcgc

SEQ ID NO: 1896049 - RNA, 15 nt, Shigella flexneri 2a str. 2457T
aguuuacugucugcu

SEQ ID NO: 1896050 - RNA, 12 nt, Shigella flexneri 2a str. 2457T
auaaagcuguga

SEQ ID NO: 1896051 - RNA, 16 nt, Shigella flexneri 2a str. 2457T
auaaacgcucggcaac

SEQ ID NO: 1896052 - RNA, 17 nt, Shigella flexneri 2a str. 2457T
auaaacucaaucaggcu

SEQ ID NO: 1896053 - RNA, 20 nt, Shigella flexneri 2a str. 2457T
auaaaccgcucgugggcauc

SEQ ID NO: 1896054 - RNA, 18 nt, Shigella flexneri 2a str. 2457T
auaaaccugcuggcgcac

SEQ ID NO: 1896055 - RNA, 22 nt, Shigella flexneri 2a str. 2457T
auaaacgccugcuuaucgcccu

SEQ ID NO: 1896056 - RNA, 13 nt, Shigella flexneri 2a str. 2457T
aguugaucgccaa

SEQ ID NO: 1896057 - RNA, 14 nt, Shigella flexneri 2a str. 2457T
aguuccggcaucga

SEQ ID NO: 1896058 - RNA, 21 nt, Shigella flexneri 2a str. 2457T
aguuccgcaaagcccaucacc

SEQ ID NO: 1896059 - RNA, 16 nt, Shigella flexneri 2a str. 2457T
aguucagucagcagug

SEQ ID NO: 1896060 - RNA, 18 nt, Shigella flexneri 2a str. 2457T
agugucuuaucuggcauu

SEQ ID NO: 1896061 - RNA, 22 nt, Shigella flexneri 2a str. 2457T
agguuuuguugcccagcgcauc

SEQ ID NO: 1896062 - RNA, 13 nt, Shigella flexneri 2a str. 2457T
aguaaaugacagc

SEQ ID NO: 1896063 - RNA, 18 nt, Shigella flexneri 2a str. 2457T
aguaaaugacagcgaaug

SEQ ID NO: 1896064 - RNA, 18 nt, Shigella flexneri 2a str. 2457T
aguaaaccgucagcacca

SEQ ID NO: 1896065 - RNA, 18 nt, Shigella flexneri 2a str. 2457T
agguucguaagcgauaac

SEQ ID NO: 1896066 - RNA, 19 nt, Shigella flexneri 2a str. 2457T
agguucuuugcugccguua

SEQ ID NO: 1896067 - RNA, 12 nt, Shigella flexneri 2a str. 2457T
agguuaacugug

SEQ ID NO: 1896068 - RNA, 22 nt, Shigella flexneri 2a str. 2457T
agguuagcaaugccuucuggaa

SEQ ID NO: 1896069 - RNA, 14 nt, Shigella flexneri 2a str. 2457T
agguguacuggcaa

SEQ ID NO: 1896070 - RNA, 20 nt, Shigella flexneri 2a str. 2457T
aggugucuggcagcgugacg

SEQ ID NO: 1896071 - RNA, 22 nt, Shigella flexneri 2a str. 2457T
agguguuacccgcuaacuggug

SEQ ID NO: 1896072 - RNA, 20 nt, Shigella flexneri 2a str. 2457T
aggugcucauuugauugccg

SEQ ID NO: 1896073 - RNA, 14 nt, Shigella flexneri 2a str. 2457T
aguaccugaccagu

SEQ ID NO: 1896074 - RNA, 21 nt, Shigella flexneri 2a str. 2457T
aguaccuccuggaucacaauc

SEQ ID NO: 1896075 - RNA, 21 nt, Shigella flexneri 2a str. 2457T
aguacaggccgcaccaggauc

SEQ ID NO: 1896076 - RNA, 20 nt, Shigella flexneri 2a str. 2457T
aguacccggccuguuuaucc

SEQ ID NO: 1896077 - RNA, 22 nt, Shigella flexneri 2a str. 2457T
aguaacguuugauuaacgccag

SEQ ID NO: 1896078 - RNA, 22 nt, Shigella flexneri 2a str. 2457T
aguaacguaaccguugaccagc

SEQ ID NO: 1896079 - RNA, 17 nt, Shigella flexneri 2a str. 2457T
aguaacguuaguucgcg

SEQ ID NO: 1896080 - RNA, 23 nt, Shigella flexneri 2a str. 2457T
aguaacguucugucuccggcauc

SEQ ID NO: 1896081 - RNA, 21 nt, Shigella flexneri 2a str. 2457T
aguaaucuacugcaccgcagg

SEQ ID NO: 1896082 - RNA, 19 nt, Shigella flexneri 2a str. 2457T
aguaaucgggcaacugcug

SEQ ID NO: 1896083 - RNA, 16 nt, Shigella flexneri 2a str. 2457T
agucauacagccggua

SEQ ID NO: 1896084 - RNA, 16 nt, Shigella flexneri 2a str. 2457T
agucaggcgcgcggug

SEQ ID NO: 1896085 - RNA, 19 nt, Shigella flexneri 2a str. 2457T
agucaucacuuucagaccg

SEQ ID NO: 1896086 - RNA, 16 nt, Shigella flexneri 2a str. 2457T
agucauccggcucgua

SEQ ID NO: 1896087 - RNA, 16 nt, Shigella flexneri 2a str. 2457T
aggggcuucuuccggc

SEQ ID NO: 1896088 - RNA, 15 nt, Shigella flexneri 2a str. 2457T
aggugaacaucgcag

SEQ ID NO: 1896089 - RNA, 18 nt, Shigella flexneri 2a str. 2457T
aggugagucgcaaaacuc

SEQ ID NO: 1896090 - RNA, 23 nt, Shigella flexneri 2a str. 2457T
aggugauuugcgccugcuuaaca

SEQ ID NO: 1896091 - RNA, 22 nt, Shigella flexneri 2a str. 2457T
aggccggauaagaugcgccagc

SEQ ID NO: 1896092 - RNA, 14 nt, Shigella flexneri 2a str. 2457T
aggccggauaagcg

SEQ ID NO: 1896093 - RNA, 14 nt, Shigella flexneri 2a str. 2457T
aggccggagccagc

SEQ ID NO: 1896094 - RNA, 16 nt, Shigella flexneri 2a str. 2457T
aggccggcauauaccu

SEQ ID NO: 1896095 - RNA, 19 nt, Shigella flexneri 2a str. 2457T
aggccgcguaccgcagcaa

SEQ ID NO: 1896096 - RNA, 15 nt, Shigella flexneri 2a str. 2457T
aggcauuaucucuug

SEQ ID NO: 1896097 - RNA, 14 nt, Shigella flexneri 2a str. 2457T
aggccaauccagcc

SEQ ID NO: 1896098 - RNA, 17 nt, Shigella flexneri 2a str. 2457T
agcugcauacggugaaa

SEQ ID NO: 1896099 - RNA, 18 nt, Shigella flexneri 2a str. 2457T
agcugccuguacggcagu

SEQ ID NO: 1896100 - RNA, 16 nt, Shigella flexneri 2a str. 2457T
aggcgguaaccgccag

SEQ ID NO: 1896101 - RNA, 18 nt, Shigella flexneri 2a str. 2457T
aggcggacugaauacgcu

SEQ ID NO: 1896102 - RNA, 18 nt, Shigella flexneri 2a str. 2457T
aggcguuuacgccgcauc

SEQ ID NO: 1896103 - RNA, 20 nt, Shigella flexneri 2a str. 2457T
aggcguuuacgccgcaucag

SEQ ID NO: 1896104 - RNA, 22 nt, Shigella flexneri 2a str. 2457T
aggcuaaagaaaacgaauugca

SEQ ID NO: 1896105 - RNA, 23 nt, Shigella flexneri 2a str. 2457T
aggcguucacgccgcaucuggca

SEQ ID NO: 1896106 - RNA, 17 nt, Shigella flexneri 2a str. 2457T
aggcguuaacagcgcau

SEQ ID NO: 1896107 - RNA, 20 nt, Shigella flexneri 2a str. 2457T
aggcguuaacgccgcauccg

SEQ ID NO: 1896108 - RNA, 20 nt, Shigella flexneri 2a str. 2457T
aggcguucacgccgcauccg

SEQ ID NO: 1896109 - RNA, 22 nt, Shigella flexneri 2a str. 2457T
aggcgugauucauacagcggcc

SEQ ID NO: 1896110 - RNA, 14 nt, Shigella flexneri 2a str. 2457T
aggcuaccggacau

SEQ ID NO: 1896111 - RNA, 16 nt, Shigella flexneri 2a str. 2457T
aggcugagaaaugcca

SEQ ID NO: 1896112 - RNA, 19 nt, Shigella flexneri 2a str. 2457T
aggcuuuaauauccggugc

SEQ ID NO: 1896113 - RNA, 19 nt, Shigella flexneri 2a str. 2457T
aggcuuuccgucagcggca

SEQ ID NO: 1896114 - RNA, 13 nt, Shigella flexneri 2a str. 2457T
agggaauccagca

SEQ ID NO: 1896115 - RNA, 11 nt, Shigella flexneri 2a str. 2457T
agggagcgccg

SEQ ID NO: 1896116 - RNA, 20 nt, Shigella flexneri 2a str. 2457T
aggcgcuugucgucccaggc

SEQ ID NO: 1896117 - RNA, 19 nt, Shigella flexneri 2a str. 2457T
aggccuacaacuccguuga

SEQ ID NO: 1896118 - RNA, 21 nt, Shigella flexneri 2a str. 2457T
aggccuacaacuccguugaaa

SEQ ID NO: 1896119 - RNA, 21 nt, Shigella flexneri 2a str. 2457T
aggccuacaucguuccugcaa

SEQ ID NO: 1896120 - RNA, 20 nt, Shigella flexneri 2a str. 2457T
aggccuacaugauuucugca

SEQ ID NO: 1896121 - RNA, 12 nt, Shigella flexneri 2a str. 2457T
agcaaugagcua

SEQ ID NO: 1896122 - RNA, 14 nt, Shigella flexneri 2a str. 2457T
agcaauugucgcag

SEQ ID NO: 1896123 - RNA, 13 nt, Shigella flexneri 2a str. 2457T
agcaauuucuccg

SEQ ID NO: 1896124 - RNA, 23 nt, Shigella flexneri 2a str. 2457T
agcaacuuaaucaucaaugccag

SEQ ID NO: 1896125 - RNA, 18 nt, Shigella flexneri 2a str. 2457T
agcaccagcccgacgaua

SEQ ID NO: 1896126 - RNA, 18 nt, Shigella flexneri 2a str. 2457T
agcaaccggcgcggcagc

SEQ ID NO: 1896127 - RNA, 15 nt, Shigella flexneri 2a str. 2457T
agcaacgaaacgccg

SEQ ID NO: 1896128 - RNA, 17 nt, Shigella flexneri 2a str. 2457T
agcaacaugcggugauu

SEQ ID NO: 1896129 - RNA, 16 nt, Shigella flexneri 2a str. 2457T
agcaacuccaucaagc

SEQ ID NO: 1896130 - RNA, 13 nt, Shigella flexneri 2a str. 2457T
agcacggcagcaa

SEQ ID NO: 1896131 - RNA, 21 nt, Shigella flexneri 2a str. 2457T
agcacguuuagcuuuggugcc

SEQ ID NO: 1896132 - RNA, 15 nt, Shigella flexneri 2a str. 2457T
agcagcagcaagaua

SEQ ID NO: 1896133 - RNA, 15 nt, Shigella flexneri 2a str. 2457T
agcagagcaaucacc

SEQ ID NO: 1896134 - RNA, 18 nt, Shigella flexneri 2a str. 2457T
agaucgguuuuuuucgaa

SEQ ID NO: 1896135 - RNA, 12 nt, Shigella flexneri 2a str. 2457T
agaucgccgcug

SEQ ID NO: 1896136 - RNA, 22 nt, Shigella flexneri 2a str. 2457T
agaucaccgcagaagcgauaac

SEQ ID NO: 1896137 - RNA, 16 nt, Shigella flexneri 2a str. 2457T
agaucgaacacgguga

SEQ ID NO: 1896138 - RNA, 14 nt, Shigella flexneri 2a str. 2457T
agaucacgcaucac

SEQ ID NO: 1896139 - RNA, 21 nt, Shigella flexneri 2a str. 2457T
agaaaauggccagccagcaga

SEQ ID NO: 1896140 - RNA, 14 nt, Shigella flexneri 2a str. 2457T
agaaacccggccac

SEQ ID NO: 1896141 - RNA, 16 nt, Shigella flexneri 2a str. 2457T
agacuaauugagcgug

SEQ ID NO: 1896142 - RNA, 22 nt, Shigella flexneri 2a str. 2457T
agacucauauaaaaaccggugc

SEQ ID NO: 1896143 - RNA, 13 nt, Shigella flexneri 2a str. 2457T
agagagcgccaga

SEQ ID NO: 1896144 - RNA, 15 nt, Shigella flexneri 2a str. 2457T
agagauaauucagca

SEQ ID NO: 1896145 - RNA, 20 nt, Shigella flexneri 2a str. 2457T
agaguaaagcccgccaucgc

SEQ ID NO: 1896146 - RNA, 19 nt, Shigella flexneri 2a str. 2457T
agaggcguguggugaggug

SEQ ID NO: 1896147 - RNA, 13 nt, Shigella flexneri 2a str. 2457T
agaggagccauca

SEQ ID NO: 1896148 - RNA, 17 nt, Shigella flexneri 2a str. 2457T
agaggagccaucaccau

SEQ ID NO: 1896149 - RNA, 11 nt, Shigella flexneri 2a str. 2457T
agagcagcacg

SEQ ID NO: 1896150 - RNA, 19 nt, Shigella flexneri 2a str. 2457T
agagcugaauaucacgggc

SEQ ID NO: 1896151 - RNA, 13 nt, Shigella flexneri 2a str. 2457T
agcaucagcgcca

SEQ ID NO: 1896152 - RNA, 15 nt, Shigella flexneri 2a str. 2457T
agcaucaauugcuac

SEQ ID NO: 1896153 - RNA, 22 nt, Shigella flexneri 2a str. 2457T
agcauauguuuacgcuggcgga

SEQ ID NO: 1896154 - RNA, 21 nt, Shigella flexneri 2a str. 2457T
agcaugauuucauaacugaug

SEQ ID NO: 1896155 - RNA, 23 nt, Shigella flexneri 2a str. 2457T
agcaugauuuuguaggccggaua

SEQ ID NO: 1896156 - RNA, 16 nt, Shigella flexneri 2a str. 2457T
agcaugaacauugcug

SEQ ID NO: 1896157 - RNA, 16 nt, Shigella flexneri 2a str. 2457T
agcaugaugccugaug

SEQ ID NO: 1896158 - RNA, 15 nt, Shigella flexneri 2a str. 2457T
agcagcccuugugcc

SEQ ID NO: 1896159 - RNA, 15 nt, Shigella flexneri 2a str. 2457T
agcagccacugcggc

SEQ ID NO: 1896160 - RNA, 13 nt, Shigella flexneri 2a str. 2457T
agcagggccugaa

SEQ ID NO: 1896161 - RNA, 15 nt, Shigella flexneri 2a str. 2457T
agccaggccgccagu

SEQ ID NO: 1896162 - RNA, 12 nt, Shigella flexneri 2a str. 2457T
agccaucaaaga

SEQ ID NO: 1896163 - RNA, 12 nt, Shigella flexneri 2a str. 2457T
agccaucaccac

SEQ ID NO: 1896164 - RNA, 12 nt, Shigella flexneri 2a str. 2457T
agccauccagca

SEQ ID NO: 1896165 - RNA, 16 nt, Shigella flexneri 2a str. 2457T
agccacuuucggcagc

SEQ ID NO: 1896166 - RNA, 22 nt, Shigella flexneri 2a str. 2457T
agccaagcgccgccucagccag

SEQ ID NO: 1896167 - RNA, 17 nt, Shigella flexneri 2a str. 2457T
agccaacuuaccgccgg

SEQ ID NO: 1896168 - RNA, 16 nt, Shigella flexneri 2a str. 2457T
agccacggcuccagca

SEQ ID NO: 1896169 - RNA, 22 nt, Shigella flexneri 2a str. 2457T
agccccggcaaaugacgaugca

SEQ ID NO: 1896170 - RNA, 20 nt, Shigella flexneri 2a str. 2457T
agcccaguaccgccagugca

SEQ ID NO: 1896171 - RNA, 19 nt, Shigella flexneri 2a str. 2457T
agccauuuugcacauucca

SEQ ID NO: 1896172 - RNA, 14 nt, Shigella flexneri 2a str. 2457T
agccgccaucucuu

SEQ ID NO: 1896173 - RNA, 16 nt, Shigella flexneri 2a str. 2457T
agcgagcuggcgcuga

SEQ ID NO: 1896174 - RNA, 18 nt, Shigella flexneri 2a str. 2457T
agcgagcuggcgcugaua

SEQ ID NO: 1896175 - RNA, 19 nt, Shigella flexneri 2a str. 2457T
agcgauaaaaauaccgagc

SEQ ID NO: 1896176 - RNA, 15 nt, Shigella flexneri 2a str. 2457T
agcgauaagaacuau

SEQ ID NO: 1896177 - RNA, 22 nt, Shigella flexneri 2a str. 2457T
agcgcaauccaccauuggcgca

SEQ ID NO: 1896178 - RNA, 20 nt, Shigella flexneri 2a str. 2457T
agcgcacuuugccagaaauc

SEQ ID NO: 1896179 - RNA, 13 nt, Shigella flexneri 2a str. 2457T
agcgcauccggca

SEQ ID NO: 1896180 - RNA, 18 nt, Shigella flexneri 2a str. 2457T
agcgcaucaggcaguuuu

SEQ ID NO: 1896181 - RNA, 12 nt, Shigella flexneri 2a str. 2457T
agccuuucgcaa

SEQ ID NO: 1896182 - RNA, 19 nt, Shigella flexneri 2a str. 2457T
agccuugccguuugcugcu

SEQ ID NO: 1896183 - RNA, 17 nt, Shigella flexneri 2a str. 2457T
agcgcauucggcaagau

SEQ ID NO: 1896184 - RNA, 19 nt, Shigella flexneri 2a str. 2457T
agcgcauggcguccgucau

SEQ ID NO: 1896185 - RNA, 16 nt, Shigella flexneri 2a str. 2457T
agcgccaacggugaaa

SEQ ID NO: 1896186 - RNA, 21 nt, Shigella flexneri 2a str. 2457T
agcgcguaaauaccuuccggc

SEQ ID NO: 1896187 - RNA, 16 nt, Shigella flexneri 2a str. 2457T
agcgcuuuuggcgcgu

SEQ ID NO: 1896188 - RNA, 22 nt, Shigella flexneri 2a str. 2457T
agcgguggugaaaagagcggua

SEQ ID NO: 1896189 - RNA, 18 nt, Shigella flexneri 2a str. 2457T
agcgucgcgguugcuguc

SEQ ID NO: 1896190 - RNA, 21 nt, Shigella flexneri 2a str. 2457T
agcguccggcugccagccagg

SEQ ID NO: 1896191 - RNA, 20 nt, Shigella flexneri 2a str. 2457T
agcguuaauggcgauaaucg

SEQ ID NO: 1896192 - RNA, 20 nt, Shigella flexneri 2a str. 2457T
agcguguuaaugcccaucag

SEQ ID NO: 1896193 - RNA, 20 nt, Shigella flexneri 2a str. 2457T
agcgugauuguggcaaucau

SEQ ID NO: 1896194 - RNA, 18 nt, Shigella flexneri 2a str. 2457T
agcggcuucaugcaucgg

SEQ ID NO: 1896195 - RNA, 19 nt, Shigella flexneri 2a str. 2457T
agcggcuucguagacgcuu

SEQ ID NO: 1896196 - RNA, 22 nt, Shigella flexneri 2a str. 2457T
agcggcuuuuuacgcgacacaa

SEQ ID NO: 1896197 - RNA, 16 nt, Shigella flexneri 2a str. 2457T
agcggcguaucuucca

SEQ ID NO: 1896198 - RNA, 14 nt, Shigella flexneri 2a str. 2457T
agcggaugacccag

SEQ ID NO: 1896199 - RNA, 24 nt, Shigella flexneri 2a str. 2457T
agcggaugacccagcgcgaucgca

SEQ ID NO: 1896200 - RNA, 21 nt, Shigella flexneri 2a str. 2457T
agcucucagccagcuggcaga

SEQ ID NO: 1896201 - RNA, 18 nt, Shigella flexneri 2a str. 2457T
agcugaaaauggcgcugu

SEQ ID NO: 1896202 - RNA, 17 nt, Shigella flexneri 2a str. 2457T
agcugaacagggcguca

SEQ ID NO: 1896203 - RNA, 24 nt, Shigella flexneri 2a str. 2457T
agcuccgggcugguuuucagcgaa

SEQ ID NO: 1896204 - RNA, 19 nt, Shigella flexneri 2a str. 2457T
agcucauaaccguccaguu

SEQ ID NO: 1896205 - RNA, 18 nt, Shigella flexneri 2a str. 2457T
agcguuucaacaaacgau

SEQ ID NO: 1896206 - RNA, 15 nt, Shigella flexneri 2a str. 2457T
aucgccgcgguauca

SEQ ID NO: 1896207 - RNA, 19 nt, Shigella flexneri 2a str. 2457T
aucgcgauggcaagcggug

SEQ ID NO: 1896208 - RNA, 20 nt, Shigella flexneri 2a str. 2457T
aucgcgaugggucgccgcaa

SEQ ID NO: 1896209 - RNA, 20 nt, Shigella flexneri 2a str. 2457T
aucgcccaguugaucaccag

SEQ ID NO: 1896210 - RNA, 13 nt, Shigella flexneri 2a str. 2457T
aucgacugcaaac

SEQ ID NO: 1896211 - RNA, 18 nt, Shigella flexneri 2a str. 2457T
aucgacggcguauugcau

SEQ ID NO: 1896212 - RNA, 15 nt, Shigella flexneri 2a str. 2457T
aucgacguucugcca

SEQ ID NO: 1896213 - RNA, 13 nt, Shigella flexneri 2a str. 2457T
aucgagcgccguu

SEQ ID NO: 1896214 - RNA, 19 nt, Shigella flexneri 2a str. 2457T
aucggcgaagagagcgcca

SEQ ID NO: 1896215 - RNA, 18 nt, Shigella flexneri 2a str. 2457T
aucggcaauuucgcugcc

SEQ ID NO: 1896216 - RNA, 23 nt, Shigella flexneri 2a str. 2457T
aucggaugacgccacagcauucu

SEQ ID NO: 1896217 - RNA, 17 nt, Shigella flexneri 2a str. 2457T
aucgcuggccuccagua

SEQ ID NO: 1896218 - RNA, 15 nt, Shigella flexneri 2a str. 2457T
aucgcucagcgcauc

SEQ ID NO: 1896219 - RNA, 14 nt, Shigella flexneri 2a str. 2457T
aucgcgcaucagca

SEQ ID NO: 1896220 - RNA, 20 nt, Shigella flexneri 2a str. 2457T
aucgcgccagaaagcagcau

SEQ ID NO: 1896221 - RNA, 18 nt, Shigella flexneri 2a str. 2457T
aucgcgcuaauuccaguc

SEQ ID NO: 1896222 - RNA, 16 nt, Shigella flexneri 2a str. 2457T
aucgcggcacacagca

SEQ ID NO: 1896223 - RNA, 19 nt, Shigella flexneri 2a str. 2457T
aucgaacuucccgccgugg

SEQ ID NO: 1896224 - RNA, 13 nt, Shigella flexneri 2a str. 2457T
aucgaacuccgcc

SEQ ID NO: 1896225 - RNA, 18 nt, Shigella flexneri 2a str. 2457T
aucgaaguugucgauaaa

SEQ ID NO: 1896226 - RNA, 18 nt, Shigella flexneri 2a str. 2457T
aucgacagaacggauauc

SEQ ID NO: 1896227 - RNA, 16 nt, Shigella flexneri 2a str. 2457T
aucgacaguugcugcg

SEQ ID NO: 1896228 - RNA, 13 nt, Shigella flexneri 2a str. 2457T
aucgacgaaaugg

SEQ ID NO: 1896229 - RNA, 11 nt, Shigella flexneri 2a str. 2457T
aucgacgauga

SEQ ID NO: 1896230 - RNA, 17 nt, Shigella flexneri 2a str. 2457T
auccuguuaagaagggc

SEQ ID NO: 1896231 - RNA, 18 nt, Shigella flexneri 2a str. 2457T
auccuggugguacgcgua

SEQ ID NO: 1896232 - RNA, 20 nt, Shigella flexneri 2a str. 2457T
auccuguugcguuaagccau

SEQ ID NO: 1896233 - RNA, 22 nt, Shigella flexneri 2a str. 2457T
auccuucaaacguuuugcaauu

SEQ ID NO: 1896234 - RNA, 17 nt, Shigella flexneri 2a str. 2457T
auccuucuuuaugucgc

SEQ ID NO: 1896235 - RNA, 15 nt, Shigella flexneri 2a str. 2457T
aucgaaaaugcgcau

SEQ ID NO: 1896236 - RNA, 17 nt, Shigella flexneri 2a str. 2457T
auccugcauguacgcgu

SEQ ID NO: 1896237 - RNA, 20 nt, Shigella flexneri 2a str. 2457T
auccugcguuaaucgccgua

SEQ ID NO: 1896238 - RNA, 17 nt, Shigella flexneri 2a str. 2457T
auccgccgauguugcau

SEQ ID NO: 1896239 - RNA, 18 nt, Shigella flexneri 2a str. 2457T
auccgcgguaucgccguc

SEQ ID NO: 1896240 - RNA, 15 nt, Shigella flexneri 2a str. 2457T
auccuaaaggcaaaa

SEQ ID NO: 1896241 - RNA, 12 nt, Shigella flexneri 2a str. 2457T
auccggcaagug

SEQ ID NO: 1896242 - RNA, 18 nt, Shigella flexneri 2a str. 2457T
auccggcaauaagcaacg

SEQ ID NO: 1896243 - RNA, 14 nt, Shigella flexneri 2a str. 2457T
auccggcaaugcgc

SEQ ID NO: 1896244 - RNA, 16 nt, Shigella flexneri 2a str. 2457T
aucugcguaucgcccu

SEQ ID NO: 1896245 - RNA, 18 nt, Shigella flexneri 2a str. 2457T
aucuggccuacaaagggc

SEQ ID NO: 1896246 - RNA, 24 nt, Shigella flexneri 2a str. 2457T
aucuggaucaacgaccagcgcgug

SEQ ID NO: 1896247 - RNA, 20 nt, Shigella flexneri 2a str. 2457T
aucuggcauaaacaaagcgc

SEQ ID NO: 1896248 - RNA, 21 nt, Shigella flexneri 2a str. 2457T
aucugguaucgaguggcgcag

SEQ ID NO: 1896249 - RNA, 18 nt, Shigella flexneri 2a str. 2457T
aucugucuguacggcagu

SEQ ID NO: 1896250 - RNA, 13 nt, Shigella flexneri 2a str. 2457T
aucuggugucagc

SEQ ID NO: 1896251 - RNA, 15 nt, Shigella flexneri 2a str. 2457T
aucuuccacgccugc

SEQ ID NO: 1896252 - RNA, 18 nt, Shigella flexneri 2a str. 2457T
aucuuaucacgaugcuaa

SEQ ID NO: 1896253 - RNA, 21 nt, Shigella flexneri 2a str. 2457T
aucggcgucauuuuuucgaca

SEQ ID NO: 1896254 - RNA, 16 nt, Shigella flexneri 2a str. 2457T
aucggcugaacgugcu

SEQ ID NO: 1896255 - RNA, 20 nt, Shigella flexneri 2a str. 2457T
aucgucuucaaccgcaguga

SEQ ID NO: 1896256 - RNA, 18 nt, Shigella flexneri 2a str. 2457T
aucgugauacaacugccg

SEQ ID NO: 1896257 - RNA, 16 nt, Shigella flexneri 2a str. 2457T
aucgugcgcgccguga

SEQ ID NO: 1896258 - RNA, 12 nt, Shigella flexneri 2a str. 2457T
aucuaaaugcca

SEQ ID NO: 1896259 - RNA, 17 nt, Shigella flexneri 2a str. 2457T
aucuccgcacagcgguu

SEQ ID NO: 1896260 - RNA, 16 nt, Shigella flexneri 2a str. 2457T
aucuccuugcuggugg

SEQ ID NO: 1896261 - RNA, 16 nt, Shigella flexneri 2a str. 2457T
aucuauccggcauaca

SEQ ID NO: 1896262 - RNA, 16 nt, Shigella flexneri 2a str. 2457T
aucuccagcugcucgc

SEQ ID NO: 1896263 - RNA, 20 nt, Shigella flexneri 2a str. 2457T
aucuaugucgcauccggcaa

SEQ ID NO: 1896264 - RNA, 14 nt, Shigella flexneri 2a str. 2457T
augcagcggguuaa

SEQ ID NO: 1896265 - RNA, 11 nt, Shigella flexneri 2a str. 2457T
augcagcgaug

SEQ ID NO: 1896266 - RNA, 16 nt, Shigella flexneri 2a str. 2457T
augcagcguuuccagc

SEQ ID NO: 1896267 - RNA, 16 nt, Shigella flexneri 2a str. 2457T
augcaugauccggcau

SEQ ID NO: 1896268 - RNA, 14 nt, Shigella flexneri 2a str. 2457T
augcaucgccgguu

SEQ ID NO: 1896269 - RNA, 15 nt, Shigella flexneri 2a str. 2457T
augcauaauccgccg

SEQ ID NO: 1896270 - RNA, 18 nt, Shigella flexneri 2a str. 2457T
augcacugcaacgccuuu

SEQ ID NO: 1896271 - RNA, 15 nt, Shigella flexneri 2a str. 2457T
augauaaauccaucg

SEQ ID NO: 1896272 - RNA, 20 nt, Shigella flexneri 2a str. 2457T
augacgcccuacaaggaacg

SEQ ID NO: 1896273 - RNA, 12 nt, Shigella flexneri 2a str. 2457T
augaucgccgua

SEQ ID NO: 1896274 - RNA, 12 nt, Shigella flexneri 2a str. 2457T
augaucgccgga

SEQ ID NO: 1896275 - RNA, 23 nt, Shigella flexneri 2a str. 2457T
augauccugcaauaccgccguua

SEQ ID NO: 1896276 - RNA, 20 nt, Shigella flexneri 2a str. 2457T
augauccugcaauaccgccg

SEQ ID NO: 1896277 - RNA, 14 nt, Shigella flexneri 2a str. 2457T
augaucauccgccu

SEQ ID NO: 1896278 - RNA, 21 nt, Shigella flexneri 2a str. 2457T
augaucaacagcaucaucgca

SEQ ID NO: 1896279 - RNA, 20 nt, Shigella flexneri 2a str. 2457T
augaccaaaaacauugccgu

SEQ ID NO: 1896280 - RNA, 21 nt, Shigella flexneri 2a str. 2457T
augaauuacacgaugcaagag

SEQ ID NO: 1896281 - RNA, 14 nt, Shigella flexneri 2a str. 2457T
augaaguccacgcg

SEQ ID NO: 1896282 - RNA, 15 nt, Shigella flexneri 2a str. 2457T
augaaaaccguauuc

SEQ ID NO: 1896283 - RNA, 17 nt, Shigella flexneri 2a str. 2457T
aucuuucugcgcaucuu

SEQ ID NO: 1896284 - RNA, 17 nt, Shigella flexneri 2a str. 2457T
augaacauugcugcuga

SEQ ID NO: 1896285 - RNA, 14 nt, Shigella flexneri 2a str. 2457T
augaaaacgccgga

SEQ ID NO: 1896286 - RNA, 15 nt, Shigella flexneri 2a str. 2457T
augaaacugccggaa

SEQ ID NO: 1896287 - RNA, 18 nt, Shigella flexneri 2a str. 2457T
auugauaaccguacgcau

SEQ ID NO: 1896288 - RNA, 19 nt, Shigella flexneri 2a str. 2457T
auugaugcacaccaucgcg

SEQ ID NO: 1896289 - RNA, 15 nt, Shigella flexneri 2a str. 2457T
auugcacugcaucau

SEQ ID NO: 1896290 - RNA, 17 nt, Shigella flexneri 2a str. 2457T
auugccccacaccgcga

SEQ ID NO: 1896291 - RNA, 22 nt, Shigella flexneri 2a str. 2457T
auugccauauacgccaucgcca

SEQ ID NO: 1896292 - RNA, 21 nt, Shigella flexneri 2a str. 2457T
auugcauauuucaacgacgcu

SEQ ID NO: 1896293 - RNA, 19 nt, Shigella flexneri 2a str. 2457T
auugcauccuuuaccggau

SEQ ID NO: 1896294 - RNA, 22 nt, Shigella flexneri 2a str. 2457T
auugcccggucaggauggccgg

SEQ ID NO: 1896295 - RNA, 21 nt, Shigella flexneri 2a str. 2457T
auugcccgaagccaauuugcg

SEQ ID NO: 1896296 - RNA, 23 nt, Shigella flexneri 2a str. 2457T
auugccgccagacguccggcgcu

SEQ ID NO: 1896297 - RNA, 16 nt, Shigella flexneri 2a str. 2457T
auugccgccagcucac

SEQ ID NO: 1896298 - RNA, 17 nt, Shigella flexneri 2a str. 2457T
auugccgaugaacggcg

SEQ ID NO: 1896299 - RNA, 16 nt, Shigella flexneri 2a str. 2457T
auugaacgguuaaucu

SEQ ID NO: 1896300 - RNA, 22 nt, Shigella flexneri 2a str. 2457T
auugaacucuuaagguucacuu

SEQ ID NO: 1896301 - RNA, 14 nt, Shigella flexneri 2a str. 2457T
auugagcgcaaaug

SEQ ID NO: 1896302 - RNA, 22 nt, Shigella flexneri 2a str. 2457T
auugcguaaccagacggcguaa

SEQ ID NO: 1896303 - RNA, 16 nt, Shigella flexneri 2a str. 2457T
auugcucgacaagaua

SEQ ID NO: 1896304 - RNA, 24 nt, Shigella flexneri 2a str. 2457T
auugcugaaguuauaagcguuacg

SEQ ID NO: 1896305 - RNA, 19 nt, Shigella flexneri 2a str. 2457T
auugccggaugcggcguaa

SEQ ID NO: 1896306 - RNA, 17 nt, Shigella flexneri 2a str. 2457T
auugccgggugcaagag

SEQ ID NO: 1896307 - RNA, 15 nt, Shigella flexneri 2a str. 2457T
auugccugauggccu

SEQ ID NO: 1896308 - RNA, 23 nt, Shigella flexneri 2a str. 2457T
auugcgccagagcgcggcgugaa

SEQ ID NO: 1896309 - RNA, 23 nt, Shigella flexneri 2a str. 2457T
auuguagacaacgugggcuuugu

SEQ ID NO: 1896310 - RNA, 16 nt, Shigella flexneri 2a str. 2457T
auuggugaauugcacg

SEQ ID NO: 1896311 - RNA, 22 nt, Shigella flexneri 2a str. 2457T
auuggucuggaacuggcugcca

SEQ ID NO: 1896312 - RNA, 16 nt, Shigella flexneri 2a str. 2457T
auugcuuuaccgcauc

SEQ ID NO: 1896313 - RNA, 14 nt, Shigella flexneri 2a str. 2457T
auucacuggcaccg

SEQ ID NO: 1896314 - RNA, 21 nt, Shigella flexneri 2a str. 2457T
auucacgccgcauccggcauc

SEQ ID NO: 1896315 - RNA, 17 nt, Shigella flexneri 2a str. 2457T
auuaugacuccagcgcc

SEQ ID NO: 1896316 - RNA, 18 nt, Shigella flexneri 2a str. 2457T
auuaugacuccagcgcca

SEQ ID NO: 1896317 - RNA, 19 nt, Shigella flexneri 2a str. 2457T
auuaugucaucaucgccac

SEQ ID NO: 1896318 - RNA, 15 nt, Shigella flexneri 2a str. 2457T
auuaugucgauaucc

SEQ ID NO: 1896319 - RNA, 16 nt, Shigella flexneri 2a str. 2457T
auuaacagguauagaa

SEQ ID NO: 1896320 - RNA, 17 nt, Shigella flexneri 2a str. 2457T
auuaacaguccgccguu

SEQ ID NO: 1896321 - RNA, 10 nt, Shigella flexneri 2a str. 2457T
auguuggcgc

SEQ ID NO: 1896322 - RNA, 22 nt, Shigella flexneri 2a str. 2457T
auuaaagccgccaaacggauac

SEQ ID NO: 1896323 - RNA, 21 nt, Shigella flexneri 2a str. 2457T
auuaaaauucaucaaauggca

SEQ ID NO: 1896324 - RNA, 22 nt, Shigella flexneri 2a str. 2457T
auucauggcaggaguggcagca

SEQ ID NO: 1896325 - RNA, 17 nt, Shigella flexneri 2a str. 2457T
auuccgcacgaacuacc

SEQ ID NO: 1896326 - RNA, 17 nt, Shigella flexneri 2a str. 2457T
auucagugcaaaugcca

SEQ ID NO: 1896327 - RNA, 15 nt, Shigella flexneri 2a str. 2457T
auucauaugcgccag

SEQ ID NO: 1896328 - RNA, 19 nt, Shigella flexneri 2a str. 2457T
auucauaucaaacgccuga

SEQ ID NO: 1896329 - RNA, 20 nt, Shigella flexneri 2a str. 2457T
auucaggccaaagccgccga

SEQ ID NO: 1896330 - RNA, 22 nt, Shigella flexneri 2a str. 2457T
auucugaaaacggacaugccau

SEQ ID NO: 1896331 - RNA, 20 nt, Shigella flexneri 2a str. 2457T
auucuggcaccaccuggcuu

SEQ ID NO: 1896332 - RNA, 23 nt, Shigella flexneri 2a str. 2457T
auucuauacaaacuuaccgccgc

SEQ ID NO: 1896333 - RNA, 15 nt, Shigella flexneri 2a str. 2457T
auucgcuuucacuca

SEQ ID NO: 1896334 - RNA, 22 nt, Shigella flexneri 2a str. 2457T
auucgggauugccagaugcgac

SEQ ID NO: 1896335 - RNA, 17 nt, Shigella flexneri 2a str. 2457T
auucgcuuucagcgagu

SEQ ID NO: 1896336 - RNA, 16 nt, Shigella flexneri 2a str. 2457T
auucgccucgacgccu

SEQ ID NO: 1896337 - RNA, 18 nt, Shigella flexneri 2a str. 2457T
auucgcgcacggugcauc

SEQ ID NO: 1896338 - RNA, 18 nt, Shigella flexneri 2a str. 2457T
auuccugacccagcacca

SEQ ID NO: 1896339 - RNA, 15 nt, Shigella flexneri 2a str. 2457T
auucgagaagcccau

SEQ ID NO: 1896340 - RNA, 13 nt, Shigella flexneri 2a str. 2457T
augcgggcgguaa

SEQ ID NO: 1896341 - RNA, 19 nt, Shigella flexneri 2a str. 2457T
augcugcaauugcggcagg

SEQ ID NO: 1896342 - RNA, 13 nt, Shigella flexneri 2a str. 2457T
augcugcagccag

SEQ ID NO: 1896343 - RNA, 19 nt, Shigella flexneri 2a str. 2457T
augcuggaaccacagcgcc

SEQ ID NO: 1896344 - RNA, 12 nt, Shigella flexneri 2a str. 2457T
augcgccagacu

SEQ ID NO: 1896345 - RNA, 15 nt, Shigella flexneri 2a str. 2457T
augcgccagguaacg

SEQ ID NO: 1896346 - RNA, 19 nt, Shigella flexneri 2a str. 2457T
auggacgaugagacccgcc

SEQ ID NO: 1896347 - RNA, 22 nt, Shigella flexneri 2a str. 2457T
augcuuuccaacuguaccagca

SEQ ID NO: 1896348 - RNA, 22 nt, Shigella flexneri 2a str. 2457T
augcugggccgccauccggcaa

SEQ ID NO: 1896349 - RNA, 18 nt, Shigella flexneri 2a str. 2457T
augcuuccgccagcggcg

SEQ ID NO: 1896350 - RNA, 19 nt, Shigella flexneri 2a str. 2457T
auggcccgcuugccagaug

SEQ ID NO: 1896351 - RNA, 17 nt, Shigella flexneri 2a str. 2457T
auggcauucucacucca

SEQ ID NO: 1896352 - RNA, 21 nt, Shigella flexneri 2a str. 2457T
auggcagaguugccacccggc

SEQ ID NO: 1896353 - RNA, 12 nt, Shigella flexneri 2a str. 2457T
auggcaccguuc

SEQ ID NO: 1896354 - RNA, 16 nt, Shigella flexneri 2a str. 2457T
auggcauaacguugca

SEQ ID NO: 1896355 - RNA, 23 nt, Shigella flexneri 2a str. 2457T
auggggucaggugggaccaccgc

SEQ ID NO: 1896356 - RNA, 19 nt, Shigella flexneri 2a str. 2457T
augggugacaucgcccuga

SEQ ID NO: 1896357 - RNA, 22 nt, Shigella flexneri 2a str. 2457T
augggucgccgcaaucagccgg

SEQ ID NO: 1896358 - RNA, 15 nt, Shigella flexneri 2a str. 2457T
augggucggcgauaa

SEQ ID NO: 1896359 - RNA, 16 nt, Shigella flexneri 2a str. 2457T
augguuugggcguuac

SEQ ID NO: 1896360 - RNA, 16 nt, Shigella flexneri 2a str. 2457T
auguaauuaagcgcaa

SEQ ID NO: 1896361 - RNA, 22 nt, Shigella flexneri 2a str. 2457T
auggcgaauuuaucgugauggu

SEQ ID NO: 1896362 - RNA, 12 nt, Shigella flexneri 2a str. 2457T
augucuggcaga

SEQ ID NO: 1896363 - RNA, 20 nt, Shigella flexneri 2a str. 2457T
augucagggccaucgcgguu

SEQ ID NO: 1896364 - RNA, 12 nt, Shigella flexneri 2a str. 2457T
augucaucagca

SEQ ID NO: 1896365 - RNA, 14 nt, Shigella flexneri 2a str. 2457T
augucggaugcggc

SEQ ID NO: 1896366 - RNA, 15 nt, Shigella flexneri 2a str. 2457T
augucggaugcggcg

SEQ ID NO: 1896367 - RNA, 14 nt, Shigella flexneri 2a str. 2457T
augucagaugcggc

SEQ ID NO: 1896368 - RNA, 21 nt, Shigella flexneri 2a str. 2457T
auguguuauucagcuggcagu

SEQ ID NO: 1896369 - RNA, 19 nt, Shigella flexneri 2a str. 2457T
augugcuggauaacgacac

SEQ ID NO: 1896370 - RNA, 14 nt, Shigella flexneri 2a str. 2457T
augugauaaugccg

SEQ ID NO: 1896371 - RNA, 21 nt, Shigella flexneri 2a str. 2457T
caaagggcgucgcuuaauuga

SEQ ID NO: 1896372 - RNA, 21 nt, Shigella flexneri 2a str. 2457T
caaaggcguuauacugcggca

SEQ ID NO: 1896373 - RNA, 13 nt, Shigella flexneri 2a str. 2457T
caaaggccagcaa

SEQ ID NO: 1896374 - RNA, 19 nt, Shigella flexneri 2a str. 2457T
caaagcgcacuuugccaga

SEQ ID NO: 1896375 - RNA, 17 nt, Shigella flexneri 2a str. 2457T
caaagcguuuugccagu

SEQ ID NO: 1896376 - RNA, 21 nt, Shigella flexneri 2a str. 2457T
caaacccuuccauacagcuca

SEQ ID NO: 1896377 - RNA, 11 nt, Shigella flexneri 2a str. 2457T
caaaccggacg

SEQ ID NO: 1896378 - RNA, 13 nt, Shigella flexneri 2a str. 2457T
caaacuccgcgac

SEQ ID NO: 1896379 - RNA, 20 nt, Shigella flexneri 2a str. 2457T
caaacucaauuaccaacuca

SEQ ID NO: 1896380 - RNA, 21 nt, Shigella flexneri 2a str. 2457T
caaacugauuuagcaucagcg

SEQ ID NO: 1896381 - RNA, 19 nt, Shigella flexneri 2a str. 2457T
caaacugccgcgccgcauc

SEQ ID NO: 1896382 - RNA, 21 nt, Shigella flexneri 2a str. 2457T
auuguuaacgccgcgccgugc

SEQ ID NO: 1896383 - RNA, 14 nt, Shigella flexneri 2a str. 2457T
auugugucaacucc

SEQ ID NO: 1896384 - RNA, 17 nt, Shigella flexneri 2a str. 2457T
auuuaaacaauuucaga

SEQ ID NO: 1896385 - RNA, 23 nt, Shigella flexneri 2a str. 2457T
auuuaaacaccugggcaauggug

SEQ ID NO: 1896386 - RNA, 19 nt, Shigella flexneri 2a str. 2457T
auuguugcccgcgccucaa

SEQ ID NO: 1896387 - RNA, 15 nt, Shigella flexneri 2a str. 2457T
caaaaugcaucggca

SEQ ID NO: 1896388 - RNA, 13 nt, Shigella flexneri 2a str. 2457T
caaaaugccugau

SEQ ID NO: 1896389 - RNA, 16 nt, Shigella flexneri 2a str. 2457T
caaacccgccagacca

SEQ ID NO: 1896390 - RNA, 14 nt, Shigella flexneri 2a str. 2457T
caaaccacgacgaa

SEQ ID NO: 1896391 - RNA, 14 nt, Shigella flexneri 2a str. 2457T
caaauccagcgcca

SEQ ID NO: 1896392 - RNA, 18 nt, Shigella flexneri 2a str. 2457T
caaaucccgugaugcggu

SEQ ID NO: 1896393 - RNA, 16 nt, Shigella flexneri 2a str. 2457T
caaauccagcgccaca

SEQ ID NO: 1896394 - RNA, 20 nt, Shigella flexneri 2a str. 2457T
caaaucauccagaccgcuca

SEQ ID NO: 1896395 - RNA, 17 nt, Shigella flexneri 2a str. 2457T
caaaucaaauaauuacu

SEQ ID NO: 1896396 - RNA, 15 nt, Shigella flexneri 2a str. 2457T
caaauagccagcaga

SEQ ID NO: 1896397 - RNA, 22 nt, Shigella flexneri 2a str. 2457T
caaauaauuacuucgccggaau

SEQ ID NO: 1896398 - RNA, 16 nt, Shigella flexneri 2a str. 2457T
caaaugucaccagccg

SEQ ID NO: 1896399 - RNA, 16 nt, Shigella flexneri 2a str. 2457T
caaauggcaaugacua

SEQ ID NO: 1896400 - RNA, 20 nt, Shigella flexneri 2a str. 2457T
caaaugcagcauugccugau

SEQ ID NO: 1896401 - RNA, 19 nt, Shigella flexneri 2a str. 2457T
caaaucguauccggcauua

SEQ ID NO: 1896402 - RNA, 16 nt, Shigella flexneri 2a str. 2457T
caaaucguauccggca

SEQ ID NO: 1896403 - RNA, 22 nt, Shigella flexneri 2a str. 2457T
caacaaugcucucuucgccaau

SEQ ID NO: 1896404 - RNA, 17 nt, Shigella flexneri 2a str. 2457T
caacaaugccacgccac

SEQ ID NO: 1896405 - RNA, 17 nt, Shigella flexneri 2a str. 2457T
caacaauaaccgucagc

SEQ ID NO: 1896406 - RNA, 22 nt, Shigella flexneri 2a str. 2457T
caaauuuugaacagaacuggcg

SEQ ID NO: 1896407 - RNA, 19 nt, Shigella flexneri 2a str. 2457T
caacaaaauagaauccgcg

SEQ ID NO: 1896408 - RNA, 20 nt, Shigella flexneri 2a str. 2457T
caaauuuaauuugcugcgga

SEQ ID NO: 1896409 - RNA, 16 nt, Shigella flexneri 2a str. 2457T
caacaaggcaucguga

SEQ ID NO: 1896410 - RNA, 16 nt, Shigella flexneri 2a str. 2457T
caaccaacgccagcag

SEQ ID NO: 1896411 - RNA, 23 nt, Shigella flexneri 2a str. 2457T
caaccaugguuucgaacgccagu

SEQ ID NO: 1896412 - RNA, 14 nt, Shigella flexneri 2a str. 2457T
caaccaugccgccc

SEQ ID NO: 1896413 - RNA, 12 nt, Shigella flexneri 2a str. 2457T
caacaugccgaa

SEQ ID NO: 1896414 - RNA, 11 nt, Shigella flexneri 2a str. 2457T
caacauucaga

SEQ ID NO: 1896415 - RNA, 20 nt, Shigella flexneri 2a str. 2457T
caacaccuguugcgcgucgc

SEQ ID NO: 1896416 - RNA, 16 nt, Shigella flexneri 2a str. 2457T
caacaccucagccagc

SEQ ID NO: 1896417 - RNA, 20 nt, Shigella flexneri 2a str. 2457T
caaccgcuauaccgccgauc

SEQ ID NO: 1896418 - RNA, 18 nt, Shigella flexneri 2a str. 2457T
caaccgucaacguucagc

SEQ ID NO: 1896419 - RNA, 20 nt, Shigella flexneri 2a str. 2457T
caaccgucguggucgugauc

SEQ ID NO: 1896420 - RNA, 17 nt, Shigella flexneri 2a str. 2457T
caaccugaucgugccag

SEQ ID NO: 1896421 - RNA, 14 nt, Shigella flexneri 2a str. 2457T
caacgaguaagagg

SEQ ID NO: 1896422 - RNA, 17 nt, Shigella flexneri 2a str. 2457T
caacgcugaauggcgau

SEQ ID NO: 1896423 - RNA, 22 nt, Shigella flexneri 2a str. 2457T
caacgucuucccgagacauucc

SEQ ID NO: 1896424 - RNA, 18 nt, Shigella flexneri 2a str. 2457T
caacggcggcuuguacgc

SEQ ID NO: 1896425 - RNA, 17 nt, Shigella flexneri 2a str. 2457T
caacgugguuugcggca

SEQ ID NO: 1896426 - RNA, 14 nt, Shigella flexneri 2a str. 2457T
caacuccaccagca

SEQ ID NO: 1896427 - RNA, 19 nt, Shigella flexneri 2a str. 2457T
caacuacuccaacccggca

SEQ ID NO: 1896428 - RNA, 19 nt, Shigella flexneri 2a str. 2457T
caagcuucgggauggcgau

SEQ ID NO: 1896429 - RNA, 15 nt, Shigella flexneri 2a str. 2457T
caagcugugccugaa

SEQ ID NO: 1896430 - RNA, 17 nt, Shigella flexneri 2a str. 2457T
caauacgcgaggcgcua

SEQ ID NO: 1896431 - RNA, 22 nt, Shigella flexneri 2a str. 2457T
caauaccauggcucaccagcag

SEQ ID NO: 1896432 - RNA, 22 nt, Shigella flexneri 2a str. 2457T
caauaccgcccaccaccagcga

SEQ ID NO: 1896433 - RNA, 22 nt, Shigella flexneri 2a str. 2457T
caauagucaucgucgcggucgc

SEQ ID NO: 1896434 - RNA, 21 nt, Shigella flexneri 2a str. 2457T
caauauccugcgcuuccugca

SEQ ID NO: 1896435 - RNA, 14 nt, Shigella flexneri 2a str. 2457T
caauaauggccuuu

SEQ ID NO: 1896436 - RNA, 22 nt, Shigella flexneri 2a str. 2457T
caauaaucucuuuacccagcgg

SEQ ID NO: 1896437 - RNA, 16 nt, Shigella flexneri 2a str. 2457T
caauaauuaaucuggu

SEQ ID NO: 1896438 - RNA, 14 nt, Shigella flexneri 2a str. 2457T
caauaauacccagc

SEQ ID NO: 1896439 - RNA, 16 nt, Shigella flexneri 2a str. 2457T
caauaaauugcgauuc

SEQ ID NO: 1896440 - RNA, 18 nt, Shigella flexneri 2a str. 2457T
caauaacgugacggcuuu

SEQ ID NO: 1896441 - RNA, 14 nt, Shigella flexneri 2a str. 2457T
caauaaauugcgau

SEQ ID NO: 1896442 - RNA, 14 nt, Shigella flexneri 2a str. 2457T
caauaaacgccagg

SEQ ID NO: 1896443 - RNA, 21 nt, Shigella flexneri 2a str. 2457T
caaucgcugcuaauuuaucgg

SEQ ID NO: 1896444 - RNA, 22 nt, Shigella flexneri 2a str. 2457T
caaucggcuuucaccgccugau

SEQ ID NO: 1896445 - RNA, 22 nt, Shigella flexneri 2a str. 2457T
caaucggugcacgaugccugau

SEQ ID NO: 1896446 - RNA, 17 nt, Shigella flexneri 2a str. 2457T
caaucgucaaacgcacg

SEQ ID NO: 1896447 - RNA, 20 nt, Shigella flexneri 2a str. 2457T
caaucguaugaucauccgcc

SEQ ID NO: 1896448 - RNA, 14 nt, Shigella flexneri 2a str. 2457T
caaugccacgccac

SEQ ID NO: 1896449 - RNA, 22 nt, Shigella flexneri 2a str. 2457T
caaucugauauuuagccagcaa

SEQ ID NO: 1896450 - RNA, 16 nt, Shigella flexneri 2a str. 2457T
caaucaucgaugcgau

SEQ ID NO: 1896451 - RNA, 20 nt, Shigella flexneri 2a str. 2457T
caaucaucuuguaggccuga

SEQ ID NO: 1896452 - RNA, 12 nt, Shigella flexneri 2a str. 2457T
caaucagcggca

SEQ ID NO: 1896453 - RNA, 19 nt, Shigella flexneri 2a str. 2457T
caauauuuuuaugccggau

SEQ ID NO: 1896454 - RNA, 21 nt, Shigella flexneri 2a str. 2457T
caaucacaucaucaucgccag

SEQ ID NO: 1896455 - RNA, 21 nt, Shigella flexneri 2a str. 2457T
caaucaccaugccgugaugcg

SEQ ID NO: 1896456 - RNA, 15 nt, Shigella flexneri 2a str. 2457T
caaucaauaacagcg

SEQ ID NO: 1896457 - RNA, 13 nt, Shigella flexneri 2a str. 2457T
caauccccagaca

SEQ ID NO: 1896458 - RNA, 15 nt, Shigella flexneri 2a str. 2457T
caauccacgguuuau

SEQ ID NO: 1896459 - RNA, 20 nt, Shigella flexneri 2a str. 2457T
caaucccuuaguaacgccag

SEQ ID NO: 1896460 - RNA, 14 nt, Shigella flexneri 2a str. 2457T
caaucgccagauca

SEQ ID NO: 1896461 - RNA, 22 nt, Shigella flexneri 2a str. 2457T
caaucgagcccagaugccggau

SEQ ID NO: 1896462 - RNA, 18 nt, Shigella flexneri 2a str. 2457T
caauugccgccagcucac

SEQ ID NO: 1896463 - RNA, 18 nt, Shigella flexneri 2a str. 2457T
caauuggcgcaucaugcc

SEQ ID NO: 1896464 - RNA, 21 nt, Shigella flexneri 2a str. 2457T
caauugcguuaaaaucagcgu

SEQ ID NO: 1896465 - RNA, 20 nt, Shigella flexneri 2a str. 2457T
cacaaccggaaccagcgccu

SEQ ID NO: 1896466 - RNA, 16 nt, Shigella flexneri 2a str. 2457T
caauggguaacggcag

SEQ ID NO: 1896467 - RNA, 20 nt, Shigella flexneri 2a str. 2457T
caaugugaaaacccugcgca

SEQ ID NO: 1896468 - RNA, 15 nt, Shigella flexneri 2a str. 2457T
caauguagccgcacg

SEQ ID NO: 1896469 - RNA, 14 nt, Shigella flexneri 2a str. 2457T
cacaacgugggccu

SEQ ID NO: 1896470 - RNA, 19 nt, Shigella flexneri 2a str. 2457T
cacaaucucacccgcuuca

SEQ ID NO: 1896471 - RNA, 20 nt, Shigella flexneri 2a str. 2457T
cacaaugcuguaaccagcgc

SEQ ID NO: 1896472 - RNA, 15 nt, Shigella flexneri 2a str. 2457T
cacaccccgcgcagc

SEQ ID NO: 1896473 - RNA, 22 nt, Shigella flexneri 2a str. 2457T
caccguaacgaacacggaucag

SEQ ID NO: 1896474 - RNA, 20 nt, Shigella flexneri 2a str. 2457T
caccgguacggaugcgaaug

SEQ ID NO: 1896475 - RNA, 17 nt, Shigella flexneri 2a str. 2457T
caccgugauucacguuc

SEQ ID NO: 1896476 - RNA, 16 nt, Shigella flexneri 2a str. 2457T
caccguuuaggcguca

SEQ ID NO: 1896477 - RNA, 16 nt, Shigella flexneri 2a str. 2457T
caccguguucaugacc

SEQ ID NO: 1896478 - RNA, 22 nt, Shigella flexneri 2a str. 2457T
caccguguucaugaccgugauc

SEQ ID NO: 1896479 - RNA, 19 nt, Shigella flexneri 2a str. 2457T
caccgaugaucaacagcau

SEQ ID NO: 1896480 - RNA, 21 nt, Shigella flexneri 2a str. 2457T
caccgcgugagaacaccaccu

SEQ ID NO: 1896481 - RNA, 23 nt, Shigella flexneri 2a str. 2457T
caccggaugcguucgcaccaccg

SEQ ID NO: 1896482 - RNA, 15 nt, Shigella flexneri 2a str. 2457T
caccagccgcgacau

SEQ ID NO: 1896483 - RNA, 15 nt, Shigella flexneri 2a str. 2457T
caccagcgaaaguaa

SEQ ID NO: 1896484 - RNA, 11 nt, Shigella flexneri 2a str. 2457T
caccagcaucg

SEQ ID NO: 1896485 - RNA, 20 nt, Shigella flexneri 2a str. 2457T
caccagcaauaacaacacgc

SEQ ID NO: 1896486 - RNA, 14 nt, Shigella flexneri 2a str. 2457T
caccagcggcacgc

SEQ ID NO: 1896487 - RNA, 13 nt, Shigella flexneri 2a str. 2457T
caccagcggaaug

SEQ ID NO: 1896488 - RNA, 22 nt, Shigella flexneri 2a str. 2457T
caccagcggaaugcagucacgc

SEQ ID NO: 1896489 - RNA, 18 nt, Shigella flexneri 2a str. 2457T
caccagcucagugaccga

SEQ ID NO: 1896490 - RNA, 20 nt, Shigella flexneri 2a str. 2457T
caccagacgagcacgccgcc

SEQ ID NO: 1896491 - RNA, 22 nt, Shigella flexneri 2a str. 2457T
caccagaauaccuugcugcucc

SEQ ID NO: 1896492 - RNA, 22 nt, Shigella flexneri 2a str. 2457T
caccaccugggugagcgucauc

SEQ ID NO: 1896493 - RNA, 22 nt, Shigella flexneri 2a str. 2457T
cacacguaaucguauucaacgg

SEQ ID NO: 1896494 - RNA, 21 nt, Shigella flexneri 2a str. 2457T
cacacuuuccaguuccggcau

SEQ ID NO: 1896495 - RNA, 13 nt, Shigella flexneri 2a str. 2457T
caccaccagcacc

SEQ ID NO: 1896496 - RNA, 16 nt, Shigella flexneri 2a str. 2457T
cacccaccagcgccga

SEQ ID NO: 1896497 - RNA, 14 nt, Shigella flexneri 2a str. 2457T
cacccacaucagcg

SEQ ID NO: 1896498 - RNA, 18 nt, Shigella flexneri 2a str. 2457T
cacccgccaguaucagcg

SEQ ID NO: 1896499 - RNA, 21 nt, Shigella flexneri 2a str. 2457T
cacccaguacgggcagcgcau

SEQ ID NO: 1896500 - RNA, 21 nt, Shigella flexneri 2a str. 2457T
cacccgucguugcaaucagcg

SEQ ID NO: 1896501 - RNA, 19 nt, Shigella flexneri 2a str. 2457T
cacccgugagaacugcugc

SEQ ID NO: 1896502 - RNA, 16 nt, Shigella flexneri 2a str. 2457T
cacccgcuucagugac

SEQ ID NO: 1896503 - RNA, 17 nt, Shigella flexneri 2a str. 2457T
caccgacauugccagcu

SEQ ID NO: 1896504 - RNA, 13 nt, Shigella flexneri 2a str. 2457T
caccgaagacgug

SEQ ID NO: 1896505 - RNA, 19 nt, Shigella flexneri 2a str. 2457T
caccgacuggcuccgggaa

SEQ ID NO: 1896506 - RNA, 15 nt, Shigella flexneri 2a str. 2457T
accagcccgacgaua

SEQ ID NO: 1896507 - RNA, 19 nt, Shigella flexneri 2a str. 2457T
accagcauuagcaaugcgc

SEQ ID NO: 1896508 - RNA, 18 nt, Shigella flexneri 2a str. 2457T
accacguaccacggcauu

SEQ ID NO: 1896509 - RNA, 19 nt, Shigella flexneri 2a str. 2457T
accagauuaaucagcagau

SEQ ID NO: 1896510 - RNA, 21 nt, Shigella flexneri 2a str. 2457T
accagacaauggcccgccgca

SEQ ID NO: 1896511 - RNA, 16 nt, Shigella flexneri 2a str. 2457T
accagcacaaaguggc

SEQ ID NO: 1896512 - RNA, 17 nt, Shigella flexneri 2a str. 2457T
accacgacgaagcgccu

SEQ ID NO: 1896513 - RNA, 16 nt, Shigella flexneri 2a str. 2457T
accaccgcaguaaucg

SEQ ID NO: 1896514 - RNA, 14 nt, Shigella flexneri 2a str. 2457T
accacaaccgccgu

SEQ ID NO: 1896515 - RNA, 15 nt, Shigella flexneri 2a str. 2457T
acauguguugucgcu

SEQ ID NO: 1896516 - RNA, 23 nt, Shigella flexneri 2a str. 2457T
accaauguggguguuaagcgcag

SEQ ID NO: 1896517 - RNA, 21 nt, Shigella flexneri 2a str. 2457T
accaauucuccaaugccguuc

SEQ ID NO: 1896518 - RNA, 21 nt, Shigella flexneri 2a str. 2457T
acauucccugcaccggugcau

SEQ ID NO: 1896519 - RNA, 17 nt, Shigella flexneri 2a str. 2457T
acauuccugcugacggc

SEQ ID NO: 1896520 - RNA, 21 nt, Shigella flexneri 2a str. 2457T
accauccauucagugcgucgc

SEQ ID NO: 1896521 - RNA, 20 nt, Shigella flexneri 2a str. 2457T
accaucgcauacugcguguc

SEQ ID NO: 1896522 - RNA, 23 nt, Shigella flexneri 2a str. 2457T
accaucgccauuuaacgcaucac

SEQ ID NO: 1896523 - RNA, 17 nt, Shigella flexneri 2a str. 2457T
accaucaaguagcaggu

SEQ ID NO: 1896524 - RNA, 18 nt, Shigella flexneri 2a str. 2457T
accauaaucucaucagcg

SEQ ID NO: 1896525 - RNA, 23 nt, Shigella flexneri 2a str. 2457T
accaguuacguuuaugccacugu

SEQ ID NO: 1896526 - RNA, 23 nt, Shigella flexneri 2a str. 2457T
accauuuuuguaagguggcguca

SEQ ID NO: 1896527 - RNA, 21 nt, Shigella flexneri 2a str. 2457T
accauugcugccgccaguucu

SEQ ID NO: 1896528 - RNA, 19 nt, Shigella flexneri 2a str. 2457T
accaucgguuguuuucaga

SEQ ID NO: 1896529 - RNA, 16 nt, Shigella flexneri 2a str. 2457T
accaucggcagcgcca

SEQ ID NO: 1896530 - RNA, 14 nt, Shigella flexneri 2a str. 2457T
accaucggcgcuac

SEQ ID NO: 1896531 - RNA, 13 nt, Shigella flexneri 2a str. 2457T
accaguaaggcau

SEQ ID NO: 1896532 - RNA, 16 nt, Shigella flexneri 2a str. 2457T
accagcgcgugaccga

SEQ ID NO: 1896533 - RNA, 20 nt, Shigella flexneri 2a str. 2457T
accaggcucuuuaaacaguu

SEQ ID NO: 1896534 - RNA, 18 nt, Shigella flexneri 2a str. 2457T
accaggcguucugccugg

SEQ ID NO: 1896535 - RNA, 17 nt, Shigella flexneri 2a str. 2457T
accaggccggugaugau

SEQ ID NO: 1896536 - RNA, 13 nt, Shigella flexneri 2a str. 2457T
aauuugcgcucaa

SEQ ID NO: 1896537 - RNA, 21 nt, Shigella flexneri 2a str. 2457T
aauuuucuuaucaguuucagc

SEQ ID NO: 1896538 - RNA, 17 nt, Shigella flexneri 2a str. 2457T
aauuugguccugaggau

SEQ ID NO: 1896539 - RNA, 21 nt, Shigella flexneri 2a str. 2457T
acaccaccaauggcuggccug

SEQ ID NO: 1896540 - RNA, 20 nt, Shigella flexneri 2a str. 2457T
acacauugugaaugaucagc

SEQ ID NO: 1896541 - RNA, 14 nt, Shigella flexneri 2a str. 2457T
acacauuacgccag

SEQ ID NO: 1896542 - RNA, 16 nt, Shigella flexneri 2a str. 2457T
acacguaggccggaua

SEQ ID NO: 1896543 - RNA, 20 nt, Shigella flexneri 2a str. 2457T
acacuuuccaguuccggcau

SEQ ID NO: 1896544 - RNA, 14 nt, Shigella flexneri 2a str. 2457T
acacuaauccguaa

SEQ ID NO: 1896545 - RNA, 23 nt, Shigella flexneri 2a str. 2457T
acagaacagugccaugccaauca

SEQ ID NO: 1896546 - RNA, 17 nt, Shigella flexneri 2a str. 2457T
acagaacggcgaugcuu

SEQ ID NO: 1896547 - RNA, 17 nt, Shigella flexneri 2a str. 2457T
acagaccauaaccgccc

SEQ ID NO: 1896548 - RNA, 14 nt, Shigella flexneri 2a str. 2457T
acagauccgccauu

SEQ ID NO: 1896549 - RNA, 18 nt, Shigella flexneri 2a str. 2457T
acagcaucaucgcaauga

SEQ ID NO: 1896550 - RNA, 21 nt, Shigella flexneri 2a str. 2457T
acagcaggcucagaagacgcu

SEQ ID NO: 1896551 - RNA, 22 nt, Shigella flexneri 2a str. 2457T
acaggaagcgaaucacguugcc

SEQ ID NO: 1896552 - RNA, 23 nt, Shigella flexneri 2a str. 2457T
acaggcacaccgccgccgccacu

SEQ ID NO: 1896553 - RNA, 16 nt, Shigella flexneri 2a str. 2457T
acaggcagcugccaga

SEQ ID NO: 1896554 - RNA, 20 nt, Shigella flexneri 2a str. 2457T
acaggcgcugaugagcaaau

SEQ ID NO: 1896555 - RNA, 15 nt, Shigella flexneri 2a str. 2457T
acagguaaggcgcga

SEQ ID NO: 1896556 - RNA, 16 nt, Shigella flexneri 2a str. 2457T
acauggauucgaugau

SEQ ID NO: 1896557 - RNA, 18 nt, Shigella flexneri 2a str. 2457T
acaugcuauugcgccagc

SEQ ID NO: 1896558 - RNA, 21 nt, Shigella flexneri 2a str. 2457T
acaugcgguucacgcgccaga

SEQ ID NO: 1896559 - RNA, 20 nt, Shigella flexneri 2a str. 2457T
acaugcgaucccacgccgaa

SEQ ID NO: 1896560 - RNA, 15 nt, Shigella flexneri 2a str. 2457T
acaucgccagaaauc

SEQ ID NO: 1896561 - RNA, 19 nt, Shigella flexneri 2a str. 2457T
acaucgcugauuucaccau

SEQ ID NO: 1896562 - RNA, 13 nt, Shigella flexneri 2a str. 2457T
acaucgcgccaac

SEQ ID NO: 1896563 - RNA, 20 nt, Shigella flexneri 2a str. 2457T
acaguaaugcgccagguucu

SEQ ID NO: 1896564 - RNA, 17 nt, Shigella flexneri 2a str. 2457T
acagguggcguuugcca

SEQ ID NO: 1896565 - RNA, 20 nt, Shigella flexneri 2a str. 2457T
acaguaagcacucugacgga

SEQ ID NO: 1896566 - RNA, 12 nt, Shigella flexneri 2a str. 2457T
acaggucuguau

SEQ ID NO: 1896567 - RNA, 18 nt, Shigella flexneri 2a str. 2457T
acaucaccaguaccgcca

SEQ ID NO: 1896568 - RNA, 16 nt, Shigella flexneri 2a str. 2457T
acaucaucaucgccag

SEQ ID NO: 1896569 - RNA, 22 nt, Shigella flexneri 2a str. 2457T
acccuaugugaucuuuaucaca

SEQ ID NO: 1896570 - RNA, 15 nt, Shigella flexneri 2a str. 2457T
acccuguccgccaug

SEQ ID NO: 1896571 - RNA, 16 nt, Shigella flexneri 2a str. 2457T
acccgcgacgcgcuuu

SEQ ID NO: 1896572 - RNA, 18 nt, Shigella flexneri 2a str. 2457T
acccgcgaggcgcauaag

SEQ ID NO: 1896573 - RNA, 17 nt, Shigella flexneri 2a str. 2457T
acccgcgcuucgagauu

SEQ ID NO: 1896574 - RNA, 20 nt, Shigella flexneri 2a str. 2457T
acccaccgauuuucagccau

SEQ ID NO: 1896575 - RNA, 19 nt, Shigella flexneri 2a str. 2457T
accgaugcaaucuguuuau

SEQ ID NO: 1896576 - RNA, 12 nt, Shigella flexneri 2a str. 2457T
accgaucgccag

SEQ ID NO: 1896577 - RNA, 22 nt, Shigella flexneri 2a str. 2457T
accgaggcauucagccaguucu

SEQ ID NO: 1896578 - RNA, 17 nt, Shigella flexneri 2a str. 2457T
accgaggcauucagcca

SEQ ID NO: 1896579 - RNA, 18 nt, Shigella flexneri 2a str. 2457T
accgaagcccaucaguac

SEQ ID NO: 1896580 - RNA, 16 nt, Shigella flexneri 2a str. 2457T
accgaaggcaccauua

SEQ ID NO: 1896581 - RNA, 22 nt, Shigella flexneri 2a str. 2457T
accgcccgcgcgguaucaccac

SEQ ID NO: 1896582 - RNA, 22 nt, Shigella flexneri 2a str. 2457T
accgccgccaugcuugaagggc

SEQ ID NO: 1896583 - RNA, 19 nt, Shigella flexneri 2a str. 2457T
accgcacgcagaaucucug

SEQ ID NO: 1896584 - RNA, 13 nt, Shigella flexneri 2a str. 2457T
accgccaucaugg

SEQ ID NO: 1896585 - RNA, 19 nt, Shigella flexneri 2a str. 2457T
accgccaguguggcggcua

SEQ ID NO: 1896586 - RNA, 20 nt, Shigella flexneri 2a str. 2457T
accgccaguguggcggcuaa

SEQ ID NO: 1896587 - RNA, 22 nt, Shigella flexneri 2a str. 2457T
accgccaggugaaauccggcau

SEQ ID NO: 1896588 - RNA, 17 nt, Shigella flexneri 2a str. 2457T
accgccacuaccaucag

SEQ ID NO: 1896589 - RNA, 16 nt, Shigella flexneri 2a str. 2457T
accggacgacggcauc

SEQ ID NO: 1896590 - RNA, 15 nt, Shigella flexneri 2a str. 2457T
accggaaggauuauc

SEQ ID NO: 1896591 - RNA, 21 nt, Shigella flexneri 2a str. 2457T
accgcuguccagucgcaaacc

SEQ ID NO: 1896592 - RNA, 12 nt, Shigella flexneri 2a str. 2457T
accgcgucgauc

SEQ ID NO: 1896593 - RNA, 21 nt, Shigella flexneri 2a str. 2457T
accgcguaugcccagcgcaga

SEQ ID NO: 1896594 - RNA, 18 nt, Shigella flexneri 2a str. 2457T
accgcgguguauaccagc

SEQ ID NO: 1896595 - RNA, 22 nt, Shigella flexneri 2a str. 2457T
accggcauuuuuuagcgccagc

SEQ ID NO: 1896596 - RNA, 21 nt, Shigella flexneri 2a str. 2457T
accggccagcaucgcaacaug

SEQ ID NO: 1896597 - RNA, 23 nt, Shigella flexneri 2a str. 2457T
accggccccugaucggccaugau

SEQ ID NO: 1896598 - RNA, 19 nt, Shigella flexneri 2a str. 2457T
accggacuauccgccgcuu

SEQ ID NO: 1896599 - RNA, 18 nt, Shigella flexneri 2a str. 2457T
accgucugugugccuguc

SEQ ID NO: 1896600 - RNA, 14 nt, Shigella flexneri 2a str. 2457T
accguuccauucaa

SEQ ID NO: 1896601 - RNA, 12 nt, Shigella flexneri 2a str. 2457T
accguucgugag

SEQ ID NO: 1896602 - RNA, 14 nt, Shigella flexneri 2a str. 2457T
accgugauccgccg

SEQ ID NO: 1896603 - RNA, 12 nt, Shigella flexneri 2a str. 2457T
accgucuguaac

SEQ ID NO: 1896604 - RNA, 21 nt, Shigella flexneri 2a str. 2457T
accgguucggccauauccagc

SEQ ID NO: 1896605 - RNA, 15 nt, Shigella flexneri 2a str. 2457T
accgguucugccgcg

SEQ ID NO: 1896606 - RNA, 12 nt, Shigella flexneri 2a str. 2457T
accguacgcauc

SEQ ID NO: 1896607 - RNA, 14 nt, Shigella flexneri 2a str. 2457T
accguauucaacga

SEQ ID NO: 1896608 - RNA, 14 nt, Shigella flexneri 2a str. 2457T
accgggcaguacca

SEQ ID NO: 1896609 - RNA, 22 nt, Shigella flexneri 2a str. 2457T
acuuuucggcaaccgcauccag

SEQ ID NO: 1896610 - RNA, 15 nt, Shigella flexneri 2a str. 2457T
acuuugccuggcggc

SEQ ID NO: 1896611 - RNA, 11 nt, Shigella flexneri 2a str. 2457T
acuuugccugg

SEQ ID NO: 1896612 - RNA, 12 nt, Shigella flexneri 2a str. 2457T
acuuucggcagc

SEQ ID NO: 1896613 - RNA, 23 nt, Shigella flexneri 2a str. 2457T
acuuucgccugcggcgcaugcau

SEQ ID NO: 1896614 - RNA, 22 nt, Shigella flexneri 2a str. 2457T
acuuucagcaagggcaucguaa

SEQ ID NO: 1896615 - RNA, 13 nt, Shigella flexneri 2a str. 2457T
acuucugcgucga

SEQ ID NO: 1896616 - RNA, 16 nt, Shigella flexneri 2a str. 2457T
acuucauaugcgccag

SEQ ID NO: 1896617 - RNA, 17 nt, Shigella flexneri 2a str. 2457T
acuucacccaucgccag

SEQ ID NO: 1896618 - RNA, 23 nt, Shigella flexneri 2a str. 2457T
acuucaucaucguugaucuguaa

SEQ ID NO: 1896619 - RNA, 21 nt, Shigella flexneri 2a str. 2457T
acuucccagccuucgcgcaac

SEQ ID NO: 1896620 - RNA, 15 nt, Shigella flexneri 2a str. 2457T
acuucccgcauccag

SEQ ID NO: 1896621 - RNA, 18 nt, Shigella flexneri 2a str. 2457T
acuuccguaccagccuug

SEQ ID NO: 1896622 - RNA, 17 nt, Shigella flexneri 2a str. 2457T
acuucgcuuacgccugc

SEQ ID NO: 1896623 - RNA, 17 nt, Shigella flexneri 2a str. 2457T
acuucgccaucugccag

SEQ ID NO: 1896624 - RNA, 16 nt, Shigella flexneri 2a str. 2457T
acuguggcgcgaccaa

SEQ ID NO: 1896625 - RNA, 19 nt, Shigella flexneri 2a str. 2457T
acuuaaucaucaaugccag

SEQ ID NO: 1896626 - RNA, 14 nt, Shigella flexneri 2a str. 2457T
acucaccgaugauc

SEQ ID NO: 1896627 - RNA, 22 nt, Shigella flexneri 2a str. 2457T
acuauuggucuggaacuggcug

SEQ ID NO: 1896628 - RNA, 20 nt, Shigella flexneri 2a str. 2457T
acucggugaccgaucgcccg

SEQ ID NO: 1896629 - RNA, 14 nt, Shigella flexneri 2a str. 2457T
acucggcaguauca

SEQ ID NO: 1896630 - RNA, 13 nt, Shigella flexneri 2a str. 2457T
acugacuugcccg

SEQ ID NO: 1896631 - RNA, 12 nt, Shigella flexneri 2a str. 2457T
acugaguugcag

SEQ ID NO: 1896632 - RNA, 18 nt, Shigella flexneri 2a str. 2457T
acucuuaagguucacuua

SEQ ID NO: 1896633 - RNA, 18 nt, Shigella flexneri 2a str. 2457T
acugacuaugguguaacg

SEQ ID NO: 1896634 - RNA, 19 nt, Shigella flexneri 2a str. 2457T
acucucuucaacacggcgc

SEQ ID NO: 1896635 - RNA, 19 nt, Shigella flexneri 2a str. 2457T
acucugccguaccaucgcc

SEQ ID NO: 1896636 - RNA, 16 nt, Shigella flexneri 2a str. 2457T
acucugguauuaaccg

SEQ ID NO: 1896637 - RNA, 23 nt, Shigella flexneri 2a str. 2457T
acuggcggcaaaacuggguuauc

SEQ ID NO: 1896638 - RNA, 12 nt, Shigella flexneri 2a str. 2457T
acuggcggcaaa

SEQ ID NO: 1896639 - RNA, 17 nt, Shigella flexneri 2a str. 2457T
acuggcgcgaauugccg

SEQ ID NO: 1896640 - RNA, 17 nt, Shigella flexneri 2a str. 2457T
acuggcgacgcguaugu

SEQ ID NO: 1896641 - RNA, 14 nt, Shigella flexneri 2a str. 2457T
acuggcgagcgcca

SEQ ID NO: 1896642 - RNA, 15 nt, Shigella flexneri 2a str. 2457T
acuguaaaucgccau

SEQ ID NO: 1896643 - RNA, 21 nt, Shigella flexneri 2a str. 2457T
acugguucccaacaacagcgc

SEQ ID NO: 1896644 - RNA, 22 nt, Shigella flexneri 2a str. 2457T
acugggucaguauggaucaaau

SEQ ID NO: 1896645 - RNA, 15 nt, Shigella flexneri 2a str. 2457T
acugcgguucagcuu

SEQ ID NO: 1896646 - RNA, 18 nt, Shigella flexneri 2a str. 2457T
acugcuccuguaugaccc

SEQ ID NO: 1896647 - RNA, 15 nt, Shigella flexneri 2a str. 2457T
acuggagccgcauca

SEQ ID NO: 1896648 - RNA, 15 nt, Shigella flexneri 2a str. 2457T
acugccagaaucaag

SEQ ID NO: 1896649 - RNA, 23 nt, Shigella flexneri 2a str. 2457T
acgugaucgucuucaaccgcagu

SEQ ID NO: 1896650 - RNA, 17 nt, Shigella flexneri 2a str. 2457T
acgugacaaaaauugcg

SEQ ID NO: 1896651 - RNA, 16 nt, Shigella flexneri 2a str. 2457T
acgguuugcggcacag

SEQ ID NO: 1896652 - RNA, 16 nt, Shigella flexneri 2a str. 2457T
acguaaugucggugaa

SEQ ID NO: 1896653 - RNA, 19 nt, Shigella flexneri 2a str. 2457T
acgucaaaagaugcgcuga

SEQ ID NO: 1896654 - RNA, 20 nt, Shigella flexneri 2a str. 2457T
acguugcauaaaugccgcaa

SEQ ID NO: 1896655 - RNA, 14 nt, Shigella flexneri 2a str. 2457T
acguugcgcuuccc

SEQ ID NO: 1896656 - RNA, 12 nt, Shigella flexneri 2a str. 2457T
acuauucagcuc

SEQ ID NO: 1896657 - RNA, 13 nt, Shigella flexneri 2a str. 2457T
acuauucagcucu

SEQ ID NO: 1896658 - RNA, 15 nt, Shigella flexneri 2a str. 2457T
acuacaaccgggauc

SEQ ID NO: 1896659 - RNA, 16 nt, Shigella flexneri 2a str. 2457T
acgugcaccgucacuu

SEQ ID NO: 1896660 - RNA, 22 nt, Shigella flexneri 2a str. 2457T
acguuaguucgcguaacugcug

SEQ ID NO: 1896661 - RNA, 21 nt, Shigella flexneri 2a str. 2457T
acguuaucucgcgaucgccug

SEQ ID NO: 1896662 - RNA, 17 nt, Shigella flexneri 2a str. 2457T
acgugucuuaucaggcc

SEQ ID NO: 1896663 - RNA, 14 nt, Shigella flexneri 2a str. 2457T
acggcguaccgccg

SEQ ID NO: 1896664 - RNA, 17 nt, Shigella flexneri 2a str. 2457T
acggcuaucuacgcgua

SEQ ID NO: 1896665 - RNA, 18 nt, Shigella flexneri 2a str. 2457T
acggcugauggcgccagu

SEQ ID NO: 1896666 - RNA, 15 nt, Shigella flexneri 2a str. 2457T
acggcugcauuauga

SEQ ID NO: 1896667 - RNA, 16 nt, Shigella flexneri 2a str. 2457T
acgggcaccaguaacg

SEQ ID NO: 1896668 - RNA, 17 nt, Shigella flexneri 2a str. 2457T
acgguugcggcuuacca

SEQ ID NO: 1896669 - RNA, 15 nt, Shigella flexneri 2a str. 2457T
acgguucgugcuaac

SEQ ID NO: 1896670 - RNA, 19 nt, Shigella flexneri 2a str. 2457T
acgguuaaaaacagccagc

SEQ ID NO: 1896671 - RNA, 14 nt, Shigella flexneri 2a str. 2457T
acgguucagcgucg

SEQ ID NO: 1896672 - RNA, 18 nt, Shigella flexneri 2a str. 2457T
acggugucacggugucgg

SEQ ID NO: 1896673 - RNA, 15 nt, Shigella flexneri 2a str. 2457T
acggugugcggcagg

SEQ ID NO: 1896674 - RNA, 22 nt, Shigella flexneri 2a str. 2457T
acggugguuaucgucaaccugu

SEQ ID NO: 1896675 - RNA, 18 nt, Shigella flexneri 2a str. 2457T
acggugcaacccgccagg

SEQ ID NO: 1896676 - RNA, 16 nt, Shigella flexneri 2a str. 2457T
acggugcaccgcaucg

SEQ ID NO: 1896677 - RNA, 17 nt, Shigella flexneri 2a str. 2457T
acgacguaccagcgucg

SEQ ID NO: 1896678 - RNA, 17 nt, Shigella flexneri 2a str. 2457T
acgacguaacggaucaa

SEQ ID NO: 1896679 - RNA, 15 nt, Shigella flexneri 2a str. 2457T
acgacggccaguugc

SEQ ID NO: 1896680 - RNA, 17 nt, Shigella flexneri 2a str. 2457T
acgacauuuucugccca

SEQ ID NO: 1896681 - RNA, 13 nt, Shigella flexneri 2a str. 2457T
acgaagcggcugc

SEQ ID NO: 1896682 - RNA, 23 nt, Shigella flexneri 2a str. 2457T
acgaaggucgaggcaauccguaa

SEQ ID NO: 1896683 - RNA, 19 nt, Shigella flexneri 2a str. 2457T
acgagguccuuuugccgcc

SEQ ID NO: 1896684 - RNA, 12 nt, Shigella flexneri 2a str. 2457T
acgauaccgccg

SEQ ID NO: 1896685 - RNA, 22 nt, Shigella flexneri 2a str. 2457T
acgagagugacgacgcugacga

SEQ ID NO: 1896686 - RNA, 16 nt, Shigella flexneri 2a str. 2457T
acgaggcgcuggcgca

SEQ ID NO: 1896687 - RNA, 22 nt, Shigella flexneri 2a str. 2457T
accguuugccccggcugcgcga

SEQ ID NO: 1896688 - RNA, 21 nt, Shigella flexneri 2a str. 2457T
accuaaaaagaaaaucgucaa

SEQ ID NO: 1896689 - RNA, 14 nt, Shigella flexneri 2a str. 2457T
accugucgcgucga

SEQ ID NO: 1896690 - RNA, 21 nt, Shigella flexneri 2a str. 2457T
accuguccuguaggccugaua

SEQ ID NO: 1896691 - RNA, 22 nt, Shigella flexneri 2a str. 2457T
accuugccagugaaaguuuuca

SEQ ID NO: 1896692 - RNA, 15 nt, Shigella flexneri 2a str. 2457T
accuuugaacugcug

SEQ ID NO: 1896693 - RNA, 14 nt, Shigella flexneri 2a str. 2457T
acgaaaccgggcaa

SEQ ID NO: 1896694 - RNA, 23 nt, Shigella flexneri 2a str. 2457T
acgaaaccgggcaauuuaaaccc

SEQ ID NO: 1896695 - RNA, 21 nt, Shigella flexneri 2a str. 2457T
acgaaacgccggugaccauca

SEQ ID NO: 1896696 - RNA, 11 nt, Shigella flexneri 2a str. 2457T
acgcauucucg

SEQ ID NO: 1896697 - RNA, 13 nt, Shigella flexneri 2a str. 2457T
acgccacgcucac

SEQ ID NO: 1896698 - RNA, 19 nt, Shigella flexneri 2a str. 2457T
acgccagacugcgcuacca

SEQ ID NO: 1896699 - RNA, 19 nt, Shigella flexneri 2a str. 2457T
acgccagcagcagcgccaa

SEQ ID NO: 1896700 - RNA, 20 nt, Shigella flexneri 2a str. 2457T
acgcauggacacugccggaa

SEQ ID NO: 1896701 - RNA, 22 nt, Shigella flexneri 2a str. 2457T
acgcauggacacugccggaaga

SEQ ID NO: 1896702 - RNA, 17 nt, Shigella flexneri 2a str. 2457T
acgcaucuucuccggcc

SEQ ID NO: 1896703 - RNA, 21 nt, Shigella flexneri 2a str. 2457T
acgcagggaguuaccgugugc

SEQ ID NO: 1896704 - RNA, 17 nt, Shigella flexneri 2a str. 2457T
acgcagcgucagcacca

SEQ ID NO: 1896705 - RNA, 18 nt, Shigella flexneri 2a str. 2457T
acgcaggccacgaaucag

SEQ ID NO: 1896706 - RNA, 17 nt, Shigella flexneri 2a str. 2457T
acgccauaccugcacaa

SEQ ID NO: 1896707 - RNA, 18 nt, Shigella flexneri 2a str. 2457T
acgcccuacaaggaacgg

SEQ ID NO: 1896708 - RNA, 13 nt, Shigella flexneri 2a str. 2457T
acgccccggccuu

SEQ ID NO: 1896709 - RNA, 14 nt, Shigella flexneri 2a str. 2457T
acgccccagauugc

SEQ ID NO: 1896710 - RNA, 21 nt, Shigella flexneri 2a str. 2457T
acgccccacaaacccgccaga

SEQ ID NO: 1896711 - RNA, 19 nt, Shigella flexneri 2a str. 2457T
acgaugccagcaccgucag

SEQ ID NO: 1896712 - RNA, 18 nt, Shigella flexneri 2a str. 2457T
acgaugccugcaaugccg

SEQ ID NO: 1896713 - RNA, 21 nt, Shigella flexneri 2a str. 2457T
acgaucaucgacaguaccagc

SEQ ID NO: 1896714 - RNA, 22 nt, Shigella flexneri 2a str. 2457T
acgauagauagagaaguaaccg

SEQ ID NO: 1896715 - RNA, 22 nt, Shigella flexneri 2a str. 2457T
acgauauuuuuccggcaguucu

SEQ ID NO: 1896716 - RNA, 13 nt, Shigella flexneri 2a str. 2457T
acgauugccggau

SEQ ID NO: 1896717 - RNA, 15 nt, Shigella flexneri 2a str. 2457T
acgauugcugccgau

SEQ ID NO: 1896718 - RNA, 19 nt, Shigella flexneri 2a str. 2457T
acgcaaaguagcggccuga

SEQ ID NO: 1896719 - RNA, 14 nt, Shigella flexneri 2a str. 2457T
acgcaaauacugac

SEQ ID NO: 1896720 - RNA, 19 nt, Shigella flexneri 2a str. 2457T
acgcaaacaccagcgaaug

SEQ ID NO: 1896721 - RNA, 18 nt, Shigella flexneri 2a str. 2457T
acgcaacuccagcuuagc

SEQ ID NO: 1896722 - RNA, 19 nt, Shigella flexneri 2a str. 2457T
acgcugcauggcaacuuua

SEQ ID NO: 1896723 - RNA, 15 nt, Shigella flexneri 2a str. 2457T
acgcugcaucgccaa

SEQ ID NO: 1896724 - RNA, 19 nt, Shigella flexneri 2a str. 2457T
acgcugauauuucggcauu

SEQ ID NO: 1896725 - RNA, 23 nt, Shigella flexneri 2a str. 2457T
acgcuggguuucgccugccagau

SEQ ID NO: 1896726 - RNA, 17 nt, Shigella flexneri 2a str. 2457T
acgcugucggcaagaua

SEQ ID NO: 1896727 - RNA, 15 nt, Shigella flexneri 2a str. 2457T
acgcuuuugcaucgg

SEQ ID NO: 1896728 - RNA, 15 nt, Shigella flexneri 2a str. 2457T
acggaauaaccagcg

SEQ ID NO: 1896729 - RNA, 19 nt, Shigella flexneri 2a str. 2457T
acgcuaauuuugccaucag

SEQ ID NO: 1896730 - RNA, 15 nt, Shigella flexneri 2a str. 2457T
acgcguuuuucagaa

SEQ ID NO: 1896731 - RNA, 15 nt, Shigella flexneri 2a str. 2457T
acgcuauacagcagc

SEQ ID NO: 1896732 - RNA, 16 nt, Shigella flexneri 2a str. 2457T
acgcucacgcgucuua

SEQ ID NO: 1896733 - RNA, 18 nt, Shigella flexneri 2a str. 2457T
acgcucaucaggccuaca

SEQ ID NO: 1896734 - RNA, 15 nt, Shigella flexneri 2a str. 2457T
acgcucacgcgcugc

SEQ ID NO: 1896735 - RNA, 15 nt, Shigella flexneri 2a str. 2457T
acgcucacugcaaaa

SEQ ID NO: 1896736 - RNA, 23 nt, Shigella flexneri 2a str. 2457T
acgcguucgcaaagguuuuaccg

SEQ ID NO: 1896737 - RNA, 14 nt, Shigella flexneri 2a str. 2457T
acgcguuaauaccu

SEQ ID NO: 1896738 - RNA, 17 nt, Shigella flexneri 2a str. 2457T
acgcgucuuaucaggcc

SEQ ID NO: 1896739 - RNA, 21 nt, Shigella flexneri 2a str. 2457T
acgcgucuuaucaggccuaca

SEQ ID NO: 1896740 - RNA, 21 nt, Shigella flexneri 2a str. 2457T
acgcgucaagcgucgcaucag

SEQ ID NO: 1896741 - RNA, 15 nt, Shigella flexneri 2a str. 2457T
acgcgguugccagau

SEQ ID NO: 1896742 - RNA, 21 nt, Shigella flexneri 2a str. 2457T
acgcguaaagcgucgcaucag

SEQ ID NO: 1896743 - RNA, 15 nt, Shigella flexneri 2a str. 2457T
acgcguaugucgauc

SEQ ID NO: 1896744 - RNA, 20 nt, Shigella flexneri 2a str. 2457T
acgccgccggaaguauuuca

SEQ ID NO: 1896745 - RNA, 17 nt, Shigella flexneri 2a str. 2457T
acgccuuuaccgcgcau

SEQ ID NO: 1896746 - RNA, 13 nt, Shigella flexneri 2a str. 2457T
acgcgaccgccgc

SEQ ID NO: 1896747 - RNA, 13 nt, Shigella flexneri 2a str. 2457T
acgcgaccaucaa

SEQ ID NO: 1896748 - RNA, 16 nt, Shigella flexneri 2a str. 2457T
acgcgaccggcgucgc

SEQ ID NO: 1896749 - RNA, 20 nt, Shigella flexneri 2a str. 2457T
acgcgguauggucacgguga

SEQ ID NO: 1896750 - RNA, 22 nt, Shigella flexneri 2a str. 2457T
acgcggucaauggucagcgcca

SEQ ID NO: 1896751 - RNA, 20 nt, Shigella flexneri 2a str. 2457T
acgcggguaaguacgccauc

SEQ ID NO: 1896752 - RNA, 15 nt, Shigella flexneri 2a str. 2457T
acgcgggcagcagaa

SEQ ID NO: 1896753 - RNA, 20 nt, Shigella flexneri 2a str. 2457T
uuaaugcgcuuccugcagcu

SEQ ID NO: 1896754 - RNA, 20 nt, Shigella flexneri 2a str. 2457T
uuaauggcagauaauccaga

SEQ ID NO: 1896755 - RNA, 19 nt, Shigella flexneri 2a str. 2457T
uuaccgagauaacguuuug

SEQ ID NO: 1896756 - RNA, 20 nt, Shigella flexneri 2a str. 2457T
uuaagcccaguucagcggcu

SEQ ID NO: 1896757 - RNA, 18 nt, Shigella flexneri 2a str. 2457T
uuaagcgauucagcaccu

SEQ ID NO: 1896758 - RNA, 22 nt, Shigella flexneri 2a str. 2457T
uuaagcacuggcggcagcaggu

SEQ ID NO: 1896759 - RNA, 18 nt, Shigella flexneri 2a str. 2457T
uuaagagcuggcaucagc

SEQ ID NO: 1896760 - RNA, 20 nt, Shigella flexneri 2a str. 2457T
uuaagaagggcuggccaauu

SEQ ID NO: 1896761 - RNA, 21 nt, Shigella flexneri 2a str. 2457T
uguuugcagugaucgugugcc

SEQ ID NO: 1896762 - RNA, 16 nt, Shigella flexneri 2a str. 2457T
uguuugccaucgggau

SEQ ID NO: 1896763 - RNA, 16 nt, Shigella flexneri 2a str. 2457T
uguuucacccgccugu

SEQ ID NO: 1896764 - RNA, 18 nt, Shigella flexneri 2a str. 2457T
uguuuauuuauacaguga

SEQ ID NO: 1896765 - RNA, 14 nt, Shigella flexneri 2a str. 2457T
uguuuaugccggau

SEQ ID NO: 1896766 - RNA, 23 nt, Shigella flexneri 2a str. 2457T
uguuuaugccugguugaguaaau

SEQ ID NO: 1896767 - RNA, 23 nt, Shigella flexneri 2a str. 2457T
uuaaccugcuccucaguuucgac

SEQ ID NO: 1896768 - RNA, 21 nt, Shigella flexneri 2a str. 2457T
uuaaaacuaaaaacagcauca

SEQ ID NO: 1896769 - RNA, 15 nt, Shigella flexneri 2a str. 2457T
ugucggaugcggcgu

SEQ ID NO: 1896770 - RNA, 21 nt, Shigella flexneri 2a str. 2457T
uguguaagaaaggcagagugc

SEQ ID NO: 1896771 - RNA, 16 nt, Shigella flexneri 2a str. 2457T
uguguaggccagcgau

SEQ ID NO: 1896772 - RNA, 21 nt, Shigella flexneri 2a str. 2457T
uguuaaaugauaccgggcugu

SEQ ID NO: 1896773 - RNA, 15 nt, Shigella flexneri 2a str. 2457T
uguugugcucgccgg

SEQ ID NO: 1896774 - RNA, 20 nt, Shigella flexneri 2a str. 2457T
uguucaggugaugccgauug

SEQ ID NO: 1896775 - RNA, 19 nt, Shigella flexneri 2a str. 2457T
uguuccaucgcguugguga

SEQ ID NO: 1896776 - RNA, 19 nt, Shigella flexneri 2a str. 2457T
uuauacggcuggauuucgc

SEQ ID NO: 1896777 - RNA, 14 nt, Shigella flexneri 2a str. 2457T
uuauagacaucuuu

SEQ ID NO: 1896778 - RNA, 19 nt, Shigella flexneri 2a str. 2457T
uuacuccgacaacgucauu

SEQ ID NO: 1896779 - RNA, 21 nt, Shigella flexneri 2a str. 2457T
uuaccgcgccauguugccugg

SEQ ID NO: 1896780 - RNA, 20 nt, Shigella flexneri 2a str. 2457T
uuaccgcaccaccagcagcu

SEQ ID NO: 1896781 - RNA, 15 nt, Shigella flexneri 2a str. 2457T
uuaccgaucgccagc

SEQ ID NO: 1896782 - RNA, 22 nt, Shigella flexneri 2a str. 2457T
uuaucgcccugcuccagcaacu

SEQ ID NO: 1896783 - RNA, 15 nt, Shigella flexneri 2a str. 2457T
uuauccggccuggau

SEQ ID NO: 1896784 - RNA, 23 nt, Shigella flexneri 2a str. 2457T
uuaucgauuuucaaaauaucgac

SEQ ID NO: 1896785 - RNA, 17 nt, Shigella flexneri 2a str. 2457T
uuaucguaaugcucgac

SEQ ID NO: 1896786 - RNA, 22 nt, Shigella flexneri 2a str. 2457T
uuaugccgaucaucauccagca

SEQ ID NO: 1896787 - RNA, 18 nt, Shigella flexneri 2a str. 2457T
uuaugcaauagcgccugc

SEQ ID NO: 1896788 - RNA, 13 nt, Shigella flexneri 2a str. 2457T
uuaugcagcugcu

SEQ ID NO: 1896789 - RNA, 19 nt, Shigella flexneri 2a str. 2457T
uuaugcagugcauccagca

SEQ ID NO: 1896790 - RNA, 15 nt, Shigella flexneri 2a str. 2457T
uuauucaucguccuu

SEQ ID NO: 1896791 - RNA, 16 nt, Shigella flexneri 2a str. 2457T
uucagccugaccgcac

SEQ ID NO: 1896792 - RNA, 13 nt, Shigella flexneri 2a str. 2457T
uucagccguaacu

SEQ ID NO: 1896793 - RNA, 20 nt, Shigella flexneri 2a str. 2457T
uucagcccggcaacguugcc

SEQ ID NO: 1896794 - RNA, 21 nt, Shigella flexneri 2a str. 2457T
uucagccccagcacuucgcug

SEQ ID NO: 1896795 - RNA, 18 nt, Shigella flexneri 2a str. 2457T
uucaccgcaucgucacug

SEQ ID NO: 1896796 - RNA, 13 nt, Shigella flexneri 2a str. 2457T
uucaccagcaucg

SEQ ID NO: 1896797 - RNA, 21 nt, Shigella flexneri 2a str. 2457T
uucaaacgcugacggugccag

SEQ ID NO: 1896798 - RNA, 13 nt, Shigella flexneri 2a str. 2457T
uucaaaguugcau

SEQ ID NO: 1896799 - RNA, 12 nt, Shigella flexneri 2a str. 2457T
uuauuucgcugc

SEQ ID NO: 1896800 - RNA, 16 nt, Shigella flexneri 2a str. 2457T
uuauuuacucuccugc

SEQ ID NO: 1896801 - RNA, 19 nt, Shigella flexneri 2a str. 2457T
uucaacguacucugccacu

SEQ ID NO: 1896802 - RNA, 15 nt, Shigella flexneri 2a str. 2457T
uucaaauuacgaucc

SEQ ID NO: 1896803 - RNA, 16 nt, Shigella flexneri 2a str. 2457T
uucaacagcgugaacu

SEQ ID NO: 1896804 - RNA, 12 nt, Shigella flexneri 2a str. 2457T
uucaacacuggc

SEQ ID NO: 1896805 - RNA, 15 nt, Shigella flexneri 2a str. 2457T
uucaacagucgccac

SEQ ID NO: 1896806 - RNA, 21 nt, Shigella flexneri 2a str. 2457T
uugaagcccaguaccgccagu

SEQ ID NO: 1896807 - RNA, 15 nt, Shigella flexneri 2a str. 2457T
uugaacuguggcgcg

SEQ ID NO: 1896808 - RNA, 17 nt, Shigella flexneri 2a str. 2457T
uugaagaagacgccauu

SEQ ID NO: 1896809 - RNA, 16 nt, Shigella flexneri 2a str. 2457T
uugaagaguuugauca

SEQ ID NO: 1896810 - RNA, 21 nt, Shigella flexneri 2a str. 2457T
uugacgagauagcgaaguaga

SEQ ID NO: 1896811 - RNA, 19 nt, Shigella flexneri 2a str. 2457T
uugacaagcucaccucuuu

SEQ ID NO: 1896812 - RNA, 12 nt, Shigella flexneri 2a str. 2457T
uugauauccgca

SEQ ID NO: 1896813 - RNA, 17 nt, Shigella flexneri 2a str. 2457T
uugagguguacuggcaa

SEQ ID NO: 1896814 - RNA, 19 nt, Shigella flexneri 2a str. 2457T
uugacgugucuuaucaggc

SEQ ID NO: 1896815 - RNA, 22 nt, Shigella flexneri 2a str. 2457T
uugacucggagucgacuucaga

SEQ ID NO: 1896816 - RNA, 21 nt, Shigella flexneri 2a str. 2457T
uugagaacgacagugacuucc

SEQ ID NO: 1896817 - RNA, 17 nt, Shigella flexneri 2a str. 2457T
aaucagcuuuggugaaa

SEQ ID NO: 1896818 - RNA, 11 nt, Shigella flexneri 2a str. 2457T
aaucagcggca

SEQ ID NO: 1896819 - RNA, 16 nt, Shigella flexneri 2a str. 2457T
uucgguauauaacgca

SEQ ID NO: 1896820 - RNA, 19 nt, Shigella flexneri 2a str. 2457T
uucuaucaaccugaggcuc

SEQ ID NO: 1896821 - RNA, 14 nt, Shigella flexneri 2a str. 2457T
uucugccagcugcu

SEQ ID NO: 1896822 - RNA, 18 nt, Shigella flexneri 2a str. 2457T
uugaaaaaccagacgaua

SEQ ID NO: 1896823 - RNA, 23 nt, Shigella flexneri 2a str. 2457T
uucuuugcgcccccgauccagcg

SEQ ID NO: 1896824 - RNA, 18 nt, Shigella flexneri 2a str. 2457T
uuccgugagcggcaggac

SEQ ID NO: 1896825 - RNA, 15 nt, Shigella flexneri 2a str. 2457T
uuccgucagcaaagu

SEQ ID NO: 1896826 - RNA, 14 nt, Shigella flexneri 2a str. 2457T
uuccugacccagca

SEQ ID NO: 1896827 - RNA, 15 nt, Shigella flexneri 2a str. 2457T
uuccugcgcuuccag

SEQ ID NO: 1896828 - RNA, 17 nt, Shigella flexneri 2a str. 2457T
uuccuggucggcaaacu

SEQ ID NO: 1896829 - RNA, 19 nt, Shigella flexneri 2a str. 2457T
uuccggcaucacaucgcug

SEQ ID NO: 1896830 - RNA, 15 nt, Shigella flexneri 2a str. 2457T
uucccgcagcuccag

SEQ ID NO: 1896831 - RNA, 14 nt, Shigella flexneri 2a str. 2457T
uuccggacguucag

SEQ ID NO: 1896832 - RNA, 12 nt, Shigella flexneri 2a str. 2457T
uuccccagacga

SEQ ID NO: 1896833 - RNA, 17 nt, Shigella flexneri 2a str. 2457T
uucagugccucguucac

SEQ ID NO: 1896834 - RNA, 14 nt, Shigella flexneri 2a str. 2457T
uucaguacguucac

SEQ ID NO: 1896835 - RNA, 13 nt, Shigella flexneri 2a str. 2457T
uucauaucugcca

SEQ ID NO: 1896836 - RNA, 23 nt, Shigella flexneri 2a str. 2457T
uucgcuaagauaccccagcgcaa

SEQ ID NO: 1896837 - RNA, 17 nt, Shigella flexneri 2a str. 2457T
uucgcguaguaaagccu

SEQ ID NO: 1896838 - RNA, 14 nt, Shigella flexneri 2a str. 2457T
uucgccgguuccag

SEQ ID NO: 1896839 - RNA, 15 nt, Shigella flexneri 2a str. 2457T
uucgcgaaucgccac

SEQ ID NO: 1896840 - RNA, 13 nt, Shigella flexneri 2a str. 2457T
uucgcgaccgccu

SEQ ID NO: 1896841 - RNA, 19 nt, Shigella flexneri 2a str. 2457T
uucggcgcagucacaccag

SEQ ID NO: 1896842 - RNA, 20 nt, Shigella flexneri 2a str. 2457T
uucggcaucacgaauccgca

SEQ ID NO: 1896843 - RNA, 17 nt, Shigella flexneri 2a str. 2457T
uucggccauauccagcc

SEQ ID NO: 1896844 - RNA, 21 nt, Shigella flexneri 2a str. 2457T
uucgccacccagcgccgccau

SEQ ID NO: 1896845 - RNA, 17 nt, Shigella flexneri 2a str. 2457T
uucgaggcgaugggcgu

SEQ ID NO: 1896846 - RNA, 17 nt, Shigella flexneri 2a str. 2457T
uuccuuaacauccaucg

SEQ ID NO: 1896847 - RNA, 20 nt, Shigella flexneri 2a str. 2457T
uuuaucgaaguugucgauaa

SEQ ID NO: 1896848 - RNA, 13 nt, Shigella flexneri 2a str. 2457T
uuuaucgagaaua

SEQ ID NO: 1896849 - RNA, 20 nt, Shigella flexneri 2a str. 2457T
uuuaucugucuguacggcag

SEQ ID NO: 1896850 - RNA, 23 nt, Shigella flexneri 2a str. 2457T
uuucacugguagugcauccgcau

SEQ ID NO: 1896851 - RNA, 15 nt, Shigella flexneri 2a str. 2457T
uuucaaugcucugca

SEQ ID NO: 1896852 - RNA, 18 nt, Shigella flexneri 2a str. 2457T
uuucaauuaucaccgcac

SEQ ID NO: 1896853 - RNA, 23 nt, Shigella flexneri 2a str. 2457T
uuuauuugugguuggcguguuuc

SEQ ID NO: 1896854 - RNA, 17 nt, Shigella flexneri 2a str. 2457T
uuucaugccauccgcau

SEQ ID NO: 1896855 - RNA, 15 nt, Shigella flexneri 2a str. 2457T
uuucagcgccagauc

SEQ ID NO: 1896856 - RNA, 22 nt, Shigella flexneri 2a str. 2457T
uuucagaaucagguugaugcga

SEQ ID NO: 1896857 - RNA, 17 nt, Shigella flexneri 2a str. 2457T
uuucaggaacaccgcac

SEQ ID NO: 1896858 - RNA, 13 nt, Shigella flexneri 2a str. 2457T
uuucaguccacgg

SEQ ID NO: 1896859 - RNA, 18 nt, Shigella flexneri 2a str. 2457T
uuuccuuaacuccucgcc

SEQ ID NO: 1896860 - RNA, 15 nt, Shigella flexneri 2a str. 2457T
uuuccuuccuuggau

SEQ ID NO: 1896861 - RNA, 18 nt, Shigella flexneri 2a str. 2457T
uuuccaagcgcggcaggc

SEQ ID NO: 1896862 - RNA, 14 nt, Shigella flexneri 2a str. 2457T
uuuacgccgcaucc

SEQ ID NO: 1896863 - RNA, 22 nt, Shigella flexneri 2a str. 2457T
uuuacgcgggucguugaucggc

SEQ ID NO: 1896864 - RNA, 18 nt, Shigella flexneri 2a str. 2457T
uuuacguucuuacauucc

SEQ ID NO: 1896865 - RNA, 20 nt, Shigella flexneri 2a str. 2457T
uuuaagucggucaaguaauu

SEQ ID NO: 1896866 - RNA, 19 nt, Shigella flexneri 2a str. 2457T
uuuaggcacaguagcccac

SEQ ID NO: 1896867 - RNA, 17 nt, Shigella flexneri 2a str. 2457T
uuuacuuccccggcagu

SEQ ID NO: 1896868 - RNA, 12 nt, Shigella flexneri 2a str. 2457T
aauccugccgca

SEQ ID NO: 1896869 - RNA, 15 nt, Shigella flexneri 2a str. 2457T
aauccugccagcgug

SEQ ID NO: 1896870 - RNA, 17 nt, Shigella flexneri 2a str. 2457T
aauccugaguuaagcaa

SEQ ID NO: 1896871 - RNA, 20 nt, Shigella flexneri 2a str. 2457T
uuguaggacggauaaggcgu

SEQ ID NO: 1896872 - RNA, 20 nt, Shigella flexneri 2a str. 2457T
uuguaggcaggauaaggcgu

SEQ ID NO: 1896873 - RNA, 20 nt, Shigella flexneri 2a str. 2457T
uuguaggccggauaaagcgu

SEQ ID NO: 1896874 - RNA, 19 nt, Shigella flexneri 2a str. 2457T
uuguaggccggauaagcgu

SEQ ID NO: 1896875 - RNA, 19 nt, Shigella flexneri 2a str. 2457T
uuguaggccugauaagcgu

SEQ ID NO: 1896876 - RNA, 20 nt, Shigella flexneri 2a str. 2457T
uuguaggucggauaaggcgu

SEQ ID NO: 1896877 - RNA, 19 nt, Shigella flexneri 2a str. 2457T
uuguaggcggauaaggcgu

SEQ ID NO: 1896878 - RNA, 22 nt, Shigella flexneri 2a str. 2457T
uuguuucaacacaggauacgca

SEQ ID NO: 1896879 - RNA, 11 nt, Shigella flexneri 2a str. 2457T
uuguugccgcc

SEQ ID NO: 1896880 - RNA, 20 nt, Shigella flexneri 2a str. 2457T
uuguuaaugugacagagcca

SEQ ID NO: 1896881 - RNA, 15 nt, Shigella flexneri 2a str. 2457T
uuguaggaaucaggc

SEQ ID NO: 1896882 - RNA, 16 nt, Shigella flexneri 2a str. 2457T
aauccgggucuguaaa

SEQ ID NO: 1896883 - RNA, 13 nt, Shigella flexneri 2a str. 2457T
uugcuucgccagu

SEQ ID NO: 1896884 - RNA, 17 nt, Shigella flexneri 2a str. 2457T
uuggaucugauccaaca

SEQ ID NO: 1896885 - RNA, 13 nt, Shigella flexneri 2a str. 2457T
uugaucaaucugc

SEQ ID NO: 1896886 - RNA, 16 nt, Shigella flexneri 2a str. 2457T
uugaucacuuccagca

SEQ ID NO: 1896887 - RNA, 15 nt, Shigella flexneri 2a str. 2457T
uugcgcugaaguaau

SEQ ID NO: 1896888 - RNA, 18 nt, Shigella flexneri 2a str. 2457T
uugcgcuuuucuaccacc

SEQ ID NO: 1896889 - RNA, 18 nt, Shigella flexneri 2a str. 2457T
uugcuguucgagcaucac

SEQ ID NO: 1896890 - RNA, 21 nt, Shigella flexneri 2a str. 2457T
uugcugccuucacggcuuugu

SEQ ID NO: 1896891 - RNA, 17 nt, Shigella flexneri 2a str. 2457T
aauuggaguaucaccau

SEQ ID NO: 1896892 - RNA, 23 nt, Shigella flexneri 2a str. 2457T
aauugcuggcgcguuaucgacaa

SEQ ID NO: 1896893 - RNA, 14 nt, Shigella flexneri 2a str. 2457T
aauugcgucaguau

SEQ ID NO: 1896894 - RNA, 21 nt, Shigella flexneri 2a str. 2457T
aauugccauuucuggcgucaa

SEQ ID NO: 1896895 - RNA, 19 nt, Shigella flexneri 2a str. 2457T
aauugauucacauccggcc

SEQ ID NO: 1896896 - RNA, 14 nt, Shigella flexneri 2a str. 2457T
aauucucccagcca

SEQ ID NO: 1896897 - RNA, 19 nt, Shigella flexneri 2a str. 2457T
aauucgcugaauaccgauu

SEQ ID NO: 1896898 - RNA, 18 nt, Shigella flexneri 2a str. 2457T
aauuucauuaagaacucc

SEQ ID NO: 1896899 - RNA, 17 nt, Shigella flexneri 2a str. 2457T
aauuucggcagcgcgcu

SEQ ID NO: 1896900 - RNA, 19 nt, Shigella flexneri 2a str. 2457T
aauuucagguucugaccgg

SEQ ID NO: 1896901 - RNA, 14 nt, Shigella flexneri 2a str. 2457T
aauuguucugcgcu

SEQ ID NO: 1896902 - RNA, 20 nt, Shigella flexneri 2a str. 2457T
aauugugagaagcgguuaaa

SEQ ID NO: 1896903 - RNA, 17 nt, Shigella flexneri 2a str. 2457T
aauugucgccggagaga

SEQ ID NO: 1896904 - RNA, 20 nt, Shigella flexneri 2a str. 2457T
aauuaucuuuacugauaauu

SEQ ID NO: 1896905 - RNA, 14 nt, Shigella flexneri 2a str. 2457T
aauucacgccgcau

SEQ ID NO: 1896906 - RNA, 18 nt, Shigella flexneri 2a str. 2457T
aauucauacaucgcgcuu

SEQ ID NO: 1896907 - RNA, 13 nt, Shigella flexneri 2a str. 2457T
aauuccagcggca

SEQ ID NO: 1896908 - RNA, 23 nt, Shigella flexneri 2a str. 2457T
aauuccaccccuuuacugacugu

SEQ ID NO: 1896909 - RNA, 16 nt, Shigella flexneri 2a str. 2457T
aauucaucaucagcau

SEQ ID NO: 1896910 - RNA, 13 nt, Shigella flexneri 2a str. 2457T
aauuccugccgcg

SEQ ID NO: 1896911 - RNA, 18 nt, Shigella flexneri 2a str. 2457T
aauuccucccguuaugau

SEQ ID NO: 1896912 - RNA, 14 nt, Shigella flexneri 2a str. 2457T
aauuaccgcaaagc

SEQ ID NO: 1896913 - RNA, 17 nt, Shigella flexneri 2a str. 2457T
aaugcguuuugagccug

SEQ ID NO: 1896914 - RNA, 23 nt, Shigella flexneri 2a str. 2457T
aaugcucugcacguuuugcugau

SEQ ID NO: 1896915 - RNA, 13 nt, Shigella flexneri 2a str. 2457T
aaugccgucacca

SEQ ID NO: 1896916 - RNA, 22 nt, Shigella flexneri 2a str. 2457T
aaugccgguuccugcaucgccu

SEQ ID NO: 1896917 - RNA, 13 nt, Shigella flexneri 2a str. 2457T
aaugcuuuauacg

SEQ ID NO: 1896918 - RNA, 22 nt, Shigella flexneri 2a str. 2457T
aaugcugguuuugugcgccaca

SEQ ID NO: 1896919 - RNA, 22 nt, Shigella flexneri 2a str. 2457T
aaucuauucauuuauguucagc

SEQ ID NO: 1896920 - RNA, 15 nt, Shigella flexneri 2a str. 2457T
aaucucagcccgaug

SEQ ID NO: 1896921 - RNA, 12 nt, Shigella flexneri 2a str. 2457T
aaucucacuccg

SEQ ID NO: 1896922 - RNA, 19 nt, Shigella flexneri 2a str. 2457T
aaucgccgaaccagugcuc

SEQ ID NO: 1896923 - RNA, 11 nt, Shigella flexneri 2a str. 2457T
aaucugcaaau

SEQ ID NO: 1896924 - RNA, 16 nt, Shigella flexneri 2a str. 2457T
aaucucagcccgauga

SEQ ID NO: 1896925 - RNA, 15 nt, Shigella flexneri 2a str. 2457T
uuuuguaggccugau

SEQ ID NO: 1896926 - RNA, 23 nt, Shigella flexneri 2a str. 2457T
uuuuuccaacaggcgagaaacgc

SEQ ID NO: 1896927 - RNA, 12 nt, Shigella flexneri 2a str. 2457T
uuuuuccugcgu

SEQ ID NO: 1896928 - RNA, 12 nt, Shigella flexneri 2a str. 2457T
uuuuuccagcug

SEQ ID NO: 1896929 - RNA, 13 nt, Shigella flexneri 2a str. 2457T
uuuuucgaaccga

SEQ ID NO: 1896930 - RNA, 17 nt, Shigella flexneri 2a str. 2457T
aaugcccacgccgcauu

SEQ ID NO: 1896931 - RNA, 22 nt, Shigella flexneri 2a str. 2457T
aaugccaaucuucacaucauca

SEQ ID NO: 1896932 - RNA, 18 nt, Shigella flexneri 2a str. 2457T
aaugcacuuccagcggcc

SEQ ID NO: 1896933 - RNA, 15 nt, Shigella flexneri 2a str. 2457T
aaugcagcggguuaa

SEQ ID NO: 1896934 - RNA, 15 nt, Shigella flexneri 2a str. 2457T
aaugcaaaaugccgu

SEQ ID NO: 1896935 - RNA, 15 nt, Shigella flexneri 2a str. 2457T
uuuucgcuggcagac

SEQ ID NO: 1896936 - RNA, 15 nt, Shigella flexneri 2a str. 2457T
uuuuccagcugugcc

SEQ ID NO: 1896937 - RNA, 21 nt, Shigella flexneri 2a str. 2457T
uuuucauugaaugcggcaggc

SEQ ID NO: 1896938 - RNA, 19 nt, Shigella flexneri 2a str. 2457T
uuuucaauuaauugugaag

SEQ ID NO: 1896939 - RNA, 22 nt, Shigella flexneri 2a str. 2457T
uuuucaauucucuaaucaggaa

SEQ ID NO: 1896940 - RNA, 15 nt, Shigella flexneri 2a str. 2457T
uuuucagcaccagau

SEQ ID NO: 1896941 - RNA, 17 nt, Shigella flexneri 2a str. 2457T
uuuugcagaucgccaau

SEQ ID NO: 1896942 - RNA, 17 nt, Shigella flexneri 2a str. 2457T
uuuguugcccagcgcau

SEQ ID NO: 1896943 - RNA, 22 nt, Shigella flexneri 2a str. 2457T
uuucuaucaaggcgauguuccu

SEQ ID NO: 1896944 - RNA, 14 nt, Shigella flexneri 2a str. 2457T
uuucguugugucgc

SEQ ID NO: 1896945 - RNA, 17 nt, Shigella flexneri 2a str. 2457T
uuucguuacguggcaca

SEQ ID NO: 1896946 - RNA, 15 nt, Shigella flexneri 2a str. 2457T
uuuuauacacucuuu

SEQ ID NO: 1896947 - RNA, 18 nt, Shigella flexneri 2a str. 2457T
uuuuaucugaggcagugc

SEQ ID NO: 1896948 - RNA, 19 nt, Shigella flexneri 2a str. 2457T
ugcugguaauccgagaauc

SEQ ID NO: 1896949 - RNA, 15 nt, Shigella flexneri 2a str. 2457T
ugcugguagaagcug

SEQ ID NO: 1896950 - RNA, 22 nt, Shigella flexneri 2a str. 2457T
ugcuggcgcaucuuauccggcc

SEQ ID NO: 1896951 - RNA, 22 nt, Shigella flexneri 2a str. 2457T
ugcuggcgcucaccauuuccgg

SEQ ID NO: 1896952 - RNA, 16 nt, Shigella flexneri 2a str. 2457T
ugcuggcuuacgcuga

SEQ ID NO: 1896953 - RNA, 18 nt, Shigella flexneri 2a str. 2457T
ugcguuuuuaucuucaca

SEQ ID NO: 1896954 - RNA, 13 nt, Shigella flexneri 2a str. 2457T
ugcucaaccguag

SEQ ID NO: 1896955 - RNA, 20 nt, Shigella flexneri 2a str. 2457T
ugcucuccguaggccagaua

SEQ ID NO: 1896956 - RNA, 20 nt, Shigella flexneri 2a str. 2457T
ugcguugcacgcagacacug

SEQ ID NO: 1896957 - RNA, 19 nt, Shigella flexneri 2a str. 2457T
ugcguucucccucgucggu

SEQ ID NO: 1896958 - RNA, 19 nt, Shigella flexneri 2a str. 2457T
ugcguuucauguaacgaug

SEQ ID NO: 1896959 - RNA, 15 nt, Shigella flexneri 2a str. 2457T
ugcguuuguccgccg

SEQ ID NO: 1896960 - RNA, 13 nt, Shigella flexneri 2a str. 2457T
ugcuaaaccagcc

SEQ ID NO: 1896961 - RNA, 11 nt, Shigella flexneri 2a str. 2457T
ugcuaaggcug

SEQ ID NO: 1896962 - RNA, 14 nt, Shigella flexneri 2a str. 2457T
ugcguagcugagca

SEQ ID NO: 1896963 - RNA, 23 nt, Shigella flexneri 2a str. 2457T
ugcggcgacaaauguugcaucgc

SEQ ID NO: 1896964 - RNA, 20 nt, Shigella flexneri 2a str. 2457T
ugcggcgaaaacgccuuauc

SEQ ID NO: 1896965 - RNA, 20 nt, Shigella flexneri 2a str. 2457T
ugcgugcggcaaauaccgga

SEQ ID NO: 1896966 - RNA, 23 nt, Shigella flexneri 2a str. 2457T
ugcgucaguauugggaugccgaa

SEQ ID NO: 1896967 - RNA, 18 nt, Shigella flexneri 2a str. 2457T
ugcguccaaauagcucaa

SEQ ID NO: 1896968 - RNA, 14 nt, Shigella flexneri 2a str. 2457T
ugcgugacuaaaac

SEQ ID NO: 1896969 - RNA, 19 nt, Shigella flexneri 2a str. 2457T
ugcgucaccacauccagcu

SEQ ID NO: 1896970 - RNA, 22 nt, Shigella flexneri 2a str. 2457T
uggaaucaauaauuaaucuggu

SEQ ID NO: 1896971 - RNA, 20 nt, Shigella flexneri 2a str. 2457T
uggaccacggcgugccgucg

SEQ ID NO: 1896972 - RNA, 15 nt, Shigella flexneri 2a str. 2457T
uggaccagcggguug

SEQ ID NO: 1896973 - RNA, 23 nt, Shigella flexneri 2a str. 2457T
uggaaggacucgaggagcuggag

SEQ ID NO: 1896974 - RNA, 22 nt, Shigella flexneri 2a str. 2457T
ugcuguaguuguucaacaguaa

SEQ ID NO: 1896975 - RNA, 18 nt, Shigella flexneri 2a str. 2457T
ugcuguaaauugccgucg

SEQ ID NO: 1896976 - RNA, 14 nt, Shigella flexneri 2a str. 2457T
uggagcaggaacuu

SEQ ID NO: 1896977 - RNA, 17 nt, Shigella flexneri 2a str. 2457T
uggagcuaaacagcgcu

SEQ ID NO: 1896978 - RNA, 12 nt, Shigella flexneri 2a str. 2457T
uggagugcagca

SEQ ID NO: 1896979 - RNA, 16 nt, Shigella flexneri 2a str. 2457T
uggagauaucgccagg

SEQ ID NO: 1896980 - RNA, 22 nt, Shigella flexneri 2a str. 2457T
uggaugaacuucgcagccguga

SEQ ID NO: 1896981 - RNA, 15 nt, Shigella flexneri 2a str. 2457T
uggcaaccagcagau

SEQ ID NO: 1896982 - RNA, 17 nt, Shigella flexneri 2a str. 2457T
uggcaaacugaguggag

SEQ ID NO: 1896983 - RNA, 22 nt, Shigella flexneri 2a str. 2457T
uggaugcccggauuuggcaaau

SEQ ID NO: 1896984 - RNA, 22 nt, Shigella flexneri 2a str. 2457T
uggcacaggcaauagggcaacu

SEQ ID NO: 1896985 - RNA, 18 nt, Shigella flexneri 2a str. 2457T
uggcacugggaucagcuu

SEQ ID NO: 1896986 - RNA, 19 nt, Shigella flexneri 2a str. 2457T
uggcacguugcugcggcgu

SEQ ID NO: 1896987 - RNA, 14 nt, Shigella flexneri 2a str. 2457T
uggcagccagccau

SEQ ID NO: 1896988 - RNA, 17 nt, Shigella flexneri 2a str. 2457T
uggcagaguugccaccc

SEQ ID NO: 1896989 - RNA, 18 nt, Shigella flexneri 2a str. 2457T
uggcagcugcuacgccgu

SEQ ID NO: 1896990 - RNA, 22 nt, Shigella flexneri 2a str. 2457T
uggcagcgcgaagcuggcggcg

SEQ ID NO: 1896991 - RNA, 19 nt, Shigella flexneri 2a str. 2457T
ugcgauaaagcauaccgug

SEQ ID NO: 1896992 - RNA, 14 nt, Shigella flexneri 2a str. 2457T
ugcgagcuuucgac

SEQ ID NO: 1896993 - RNA, 17 nt, Shigella flexneri 2a str. 2457T
ugccuggcuugccggaa

SEQ ID NO: 1896994 - RNA, 17 nt, Shigella flexneri 2a str. 2457T
ugccuguacggcaguga

SEQ ID NO: 1896995 - RNA, 16 nt, Shigella flexneri 2a str. 2457T
ugcgacaucaucagcg

SEQ ID NO: 1896996 - RNA, 21 nt, Shigella flexneri 2a str. 2457T
ugcgcagcauaaucggcuggg

SEQ ID NO: 1896997 - RNA, 15 nt, Shigella flexneri 2a str. 2457T
ugcgcaucaaagcca

SEQ ID NO: 1896998 - RNA, 14 nt, Shigella flexneri 2a str. 2457T
ugcgauccugcaga

SEQ ID NO: 1896999 - RNA, 23 nt, Shigella flexneri 2a str. 2457T
ugccucguuggucagcucaaagc

SEQ ID NO: 1897000 - RNA, 15 nt, Shigella flexneri 2a str. 2457T
ugccugaugcggcgu

SEQ ID NO: 1897001 - RNA, 14 nt, Shigella flexneri 2a str. 2457T
ugccguuggcggcg

SEQ ID NO: 1897002 - RNA, 16 nt, Shigella flexneri 2a str. 2457T
ugccgugcagcacgga

SEQ ID NO: 1897003 - RNA, 15 nt, Shigella flexneri 2a str. 2457T
ugccgucugggcaaa

SEQ ID NO: 1897004 - RNA, 21 nt, Shigella flexneri 2a str. 2457T
ugccgucaauuuuaagcagau

SEQ ID NO: 1897005 - RNA, 22 nt, Shigella flexneri 2a str. 2457T
ugcggcaggucaucgugcguca

SEQ ID NO: 1897006 - RNA, 20 nt, Shigella flexneri 2a str. 2457T
ugcggcauuuccauaccuaa

SEQ ID NO: 1897007 - RNA, 15 nt, Shigella flexneri 2a str. 2457T
ugcggaaugagcgau

SEQ ID NO: 1897008 - RNA, 13 nt, Shigella flexneri 2a str. 2457T
ugcgcggcuccag

SEQ ID NO: 1897009 - RNA, 22 nt, Shigella flexneri 2a str. 2457T
ugcgcuccgcuuaucaggccua

SEQ ID NO: 1897010 - RNA, 20 nt, Shigella flexneri 2a str. 2457T
ugcgcuacgcuuaucaggcc

SEQ ID NO: 1897011 - RNA, 13 nt, Shigella flexneri 2a str. 2457T
ugcgcggcgacuu

SEQ ID NO: 1897012 - RNA, 14 nt, Shigella flexneri 2a str. 2457T
ugcgcgaccacgau

SEQ ID NO: 1897013 - RNA, 13 nt, Shigella flexneri 2a str. 2457T
ugucaugauuccg

SEQ ID NO: 1897014 - RNA, 20 nt, Shigella flexneri 2a str. 2457T
ugucaucgaauaaauugagc

SEQ ID NO: 1897015 - RNA, 21 nt, Shigella flexneri 2a str. 2457T
ugucaucgaauaaauugagcu

SEQ ID NO: 1897016 - RNA, 23 nt, Shigella flexneri 2a str. 2457T
ugucagucaucacuuucagaccg

SEQ ID NO: 1897017 - RNA, 13 nt, Shigella flexneri 2a str. 2457T
ugucagugcgcga

SEQ ID NO: 1897018 - RNA, 16 nt, Shigella flexneri 2a str. 2457T
ugucauaaaucagcgu

SEQ ID NO: 1897019 - RNA, 18 nt, Shigella flexneri 2a str. 2457T
ugucagcgugacuggcag

SEQ ID NO: 1897020 - RNA, 14 nt, Shigella flexneri 2a str. 2457T
uguauucaugcccu

SEQ ID NO: 1897021 - RNA, 13 nt, Shigella flexneri 2a str. 2457T
uguauacggcaac

SEQ ID NO: 1897022 - RNA, 16 nt, Shigella flexneri 2a str. 2457T
aaucaccaucagcagc

SEQ ID NO: 1897023 - RNA, 20 nt, Shigella flexneri 2a str. 2457T
aaucaccauauucagcagca

SEQ ID NO: 1897024 - RNA, 19 nt, Shigella flexneri 2a str. 2457T
uguaggccugauaagacgc

SEQ ID NO: 1897025 - RNA, 23 nt, Shigella flexneri 2a str. 2457T
uguaggccggauaaggcguucac

SEQ ID NO: 1897026 - RNA, 19 nt, Shigella flexneri 2a str. 2457T
uguaggccugauaagcgua

SEQ ID NO: 1897027 - RNA, 12 nt, Shigella flexneri 2a str. 2457T
aaucaaucccau

SEQ ID NO: 1897028 - RNA, 15 nt, Shigella flexneri 2a str. 2457T
aaucaaucgccccuu

SEQ ID NO: 1897029 - RNA, 18 nt, Shigella flexneri 2a str. 2457T
aaucacaauggucaacau

SEQ ID NO: 1897030 - RNA, 19 nt, Shigella flexneri 2a str. 2457T
uguaaaugcugcuccagcg

SEQ ID NO: 1897031 - RNA, 20 nt, Shigella flexneri 2a str. 2457T
uguaacacugauaacgggac

SEQ ID NO: 1897032 - RNA, 17 nt, Shigella flexneri 2a str. 2457T
ugucgcauccggcaauu

SEQ ID NO: 1897033 - RNA, 15 nt, Shigella flexneri 2a str. 2457T
uguccaguaaugacc

SEQ ID NO: 1897034 - RNA, 22 nt, Shigella flexneri 2a str. 2457T
uguccauaccggacuccagaca

SEQ ID NO: 1897035 - RNA, 17 nt, Shigella flexneri 2a str. 2457T
uggugauaaaacgcagu

SEQ ID NO: 1897036 - RNA, 22 nt, Shigella flexneri 2a str. 2457T
aaucaaauaccaccagcgaaag

SEQ ID NO: 1897037 - RNA, 19 nt, Shigella flexneri 2a str. 2457T
aaucaaauagccugccaga

SEQ ID NO: 1897038 - RNA, 15 nt, Shigella flexneri 2a str. 2457T
aaucaacgccgcaug

SEQ ID NO: 1897039 - RNA, 14 nt, Shigella flexneri 2a str. 2457T
aaucaacgccgcau

SEQ ID NO: 1897040 - RNA, 21 nt, Shigella flexneri 2a str. 2457T
aaucaaccgcgccugaccauu

SEQ ID NO: 1897041 - RNA, 14 nt, Shigella flexneri 2a str. 2457T
ugguuauccagcaa

SEQ ID NO: 1897042 - RNA, 21 nt, Shigella flexneri 2a str. 2457T
ugguguuuucgaacaggcagg

SEQ ID NO: 1897043 - RNA, 22 nt, Shigella flexneri 2a str. 2457T
ugguguuggcaaucagcggcag

SEQ ID NO: 1897044 - RNA, 18 nt, Shigella flexneri 2a str. 2457T
ugguuaaugcuucacacu

SEQ ID NO: 1897045 - RNA, 23 nt, Shigella flexneri 2a str. 2457T
uggugaccuguaacguugcugcg

SEQ ID NO: 1897046 - RNA, 20 nt, Shigella flexneri 2a str. 2457T
ugguaggccggauaaggcgu

SEQ ID NO: 1897047 - RNA, 21 nt, Shigella flexneri 2a str. 2457T
ugguaacaccagagugaccgc

SEQ ID NO: 1897048 - RNA, 21 nt, Shigella flexneri 2a str. 2457T
ugguaacagugcaccggacac

SEQ ID NO: 1897049 - RNA, 12 nt, Shigella flexneri 2a str. 2457T
uggguuuccgga

SEQ ID NO: 1897050 - RNA, 13 nt, Shigella flexneri 2a str. 2457T
ugggauugccgcu

SEQ ID NO: 1897051 - RNA, 23 nt, Shigella flexneri 2a str. 2457T
ugggauucaccaaucggcagaac

SEQ ID NO: 1897052 - RNA, 23 nt, Shigella flexneri 2a str. 2457T
ugggagcagccagccagacgcug

SEQ ID NO: 1897053 - RNA, 14 nt, Shigella flexneri 2a str. 2457T
uggcuuuugccgcc

SEQ ID NO: 1897054 - RNA, 17 nt, Shigella flexneri 2a str. 2457T
uggcuuugcccuggcgc

SEQ ID NO: 1897055 - RNA, 13 nt, Shigella flexneri 2a str. 2457T
ugggaacaccgua

SEQ ID NO: 1897056 - RNA, 16 nt, Shigella flexneri 2a str. 2457T
uggcuuccagcguucg

SEQ ID NO: 1897057 - RNA, 16 nt, Shigella flexneri 2a str. 2457T
uggcuguuucgcuucu

SEQ ID NO: 1897058 - RNA, 15 nt, Shigella flexneri 2a str. 2457T
uggcguacccaucaa

SEQ ID NO: 1897059 - RNA, 23 nt, Shigella flexneri 2a str. 2457T
uggcucgguaaaaucaacgccgc

SEQ ID NO: 1897060 - RNA, 15 nt, Shigella flexneri 2a str. 2457T
uggcuauguaggcuu

SEQ ID NO: 1897061 - RNA, 17 nt, Shigella flexneri 2a str. 2457T
uggcguuaggcacauca

SEQ ID NO: 1897062 - RNA, 14 nt, Shigella flexneri 2a str. 2457T
uggcguugcaccga

SEQ ID NO: 1897063 - RNA, 14 nt, Shigella flexneri 2a str. 2457T
uggcguuugccacc

SEQ ID NO: 1897064 - RNA, 13 nt, Shigella flexneri 2a str. 2457T
uggcaucggcaaa

SEQ ID NO: 1897065 - RNA, 15 nt, Shigella flexneri 2a str. 2457T
uggcauggcgcuggc

SEQ ID NO: 1897066 - RNA, 20 nt, Shigella flexneri 2a str. 2457T
uggcaugcuguccagcaggc

SEQ ID NO: 1897067 - RNA, 16 nt, Shigella flexneri 2a str. 2457T
uggcggagcucccagg

SEQ ID NO: 1897068 - RNA, 14 nt, Shigella flexneri 2a str. 2457T
uggcggacggguga

SEQ ID NO: 1897069 - RNA, 19 nt, Shigella flexneri 2a str. 2457T
uggcggaauaccgacauca

SEQ ID NO: 1897070 - RNA, 19 nt, Shigella flexneri 2a str. 2457T
gugccaugccaaucagcag

SEQ ID NO: 1897071 - RNA, 13 nt, Shigella flexneri 2a str. 2457T
gugccaucgauaa

SEQ ID NO: 1897072 - RNA, 17 nt, Shigella flexneri 2a str. 2457T
gugccaucauacagccg

SEQ ID NO: 1897073 - RNA, 22 nt, Shigella flexneri 2a str. 2457T
gugccacauccaguggcagagu

SEQ ID NO: 1897074 - RNA, 17 nt, Shigella flexneri 2a str. 2457T
gugauauccaccgcguu

SEQ ID NO: 1897075 - RNA, 19 nt, Shigella flexneri 2a str. 2457T
gugauaaacccaacggcaa

SEQ ID NO: 1897076 - RNA, 14 nt, Shigella flexneri 2a str. 2457T
gugauaaaacgcag

SEQ ID NO: 1897077 - RNA, 17 nt, Shigella flexneri 2a str. 2457T
gugcacaauugccggau

SEQ ID NO: 1897078 - RNA, 22 nt, Shigella flexneri 2a str. 2457T
gugcacaauugccggaugcggc

SEQ ID NO: 1897079 - RNA, 18 nt, Shigella flexneri 2a str. 2457T
gugccgguaaagcaauga

SEQ ID NO: 1897080 - RNA, 15 nt, Shigella flexneri 2a str. 2457T
gugccgguuucacgu

SEQ ID NO: 1897081 - RNA, 13 nt, Shigella flexneri 2a str. 2457T
gugccgucagcag

SEQ ID NO: 1897082 - RNA, 14 nt, Shigella flexneri 2a str. 2457T
gugccugucgggac

SEQ ID NO: 1897083 - RNA, 20 nt, Shigella flexneri 2a str. 2457T
gugcgggaguugaucgccaa

SEQ ID NO: 1897084 - RNA, 13 nt, Shigella flexneri 2a str. 2457T
gugcgccagcgau

SEQ ID NO: 1897085 - RNA, 14 nt, Shigella flexneri 2a str. 2457T
gugcgaggugagca

SEQ ID NO: 1897086 - RNA, 14 nt, Shigella flexneri 2a str. 2457T
gugcuuucagcgaa

SEQ ID NO: 1897087 - RNA, 18 nt, Shigella flexneri 2a str. 2457T
gugcuuucauuucagcgu

SEQ ID NO: 1897088 - RNA, 17 nt, Shigella flexneri 2a str. 2457T
guggaauaugcgccaca

SEQ ID NO: 1897089 - RNA, 21 nt, Shigella flexneri 2a str. 2457T
guggacgaacaguucaacgcc

SEQ ID NO: 1897090 - RNA, 14 nt, Shigella flexneri 2a str. 2457T
guggcaaucaucgu

SEQ ID NO: 1897091 - RNA, 23 nt, Shigella flexneri 2a str. 2457T
guggcaaagguggccauccgcgu

SEQ ID NO: 1897092 - RNA, 15 nt, Shigella flexneri 2a str. 2457T
guggauucuggugau

SEQ ID NO: 1897093 - RNA, 22 nt, Shigella flexneri 2a str. 2457T
guggcaaccacaaccgccguug

SEQ ID NO: 1897094 - RNA, 18 nt, Shigella flexneri 2a str. 2457T
guggcaaagaaauccaca

SEQ ID NO: 1897095 - RNA, 24 nt, Shigella flexneri 2a str. 2457T
gugucgccagcaacacaaacgaau

SEQ ID NO: 1897096 - RNA, 18 nt, Shigella flexneri 2a str. 2457T
guggucuuuagacugcca

SEQ ID NO: 1897097 - RNA, 23 nt, Shigella flexneri 2a str. 2457T
gugucaggccggcauauaccuca

SEQ ID NO: 1897098 - RNA, 19 nt, Shigella flexneri 2a str. 2457T
guggucccucccugacgau

SEQ ID NO: 1897099 - RNA, 17 nt, Shigella flexneri 2a str. 2457T
guggucauaucaauagu

SEQ ID NO: 1897100 - RNA, 15 nt, Shigella flexneri 2a str. 2457T
guggguggucagcgu

SEQ ID NO: 1897101 - RNA, 14 nt, Shigella flexneri 2a str. 2457T
guggcagccagcca

SEQ ID NO: 1897102 - RNA, 16 nt, Shigella flexneri 2a str. 2457T
guggcagggcagcgau

SEQ ID NO: 1897103 - RNA, 15 nt, Shigella flexneri 2a str. 2457T
gugggcgaaggcgca

SEQ ID NO: 1897104 - RNA, 20 nt, Shigella flexneri 2a str. 2457T
guucacgccgcauccggcau

SEQ ID NO: 1897105 - RNA, 18 nt, Shigella flexneri 2a str. 2457T
guucacgcagcuucucgu

SEQ ID NO: 1897106 - RNA, 14 nt, Shigella flexneri 2a str. 2457T
guucagauaaugcc

SEQ ID NO: 1897107 - RNA, 21 nt, Shigella flexneri 2a str. 2457T
guucagaaugcccacgccgca

SEQ ID NO: 1897108 - RNA, 18 nt, Shigella flexneri 2a str. 2457T
guucacuugcuaccgcga

SEQ ID NO: 1897109 - RNA, 18 nt, Shigella flexneri 2a str. 2457T
guucagccugacagcacg

SEQ ID NO: 1897110 - RNA, 20 nt, Shigella flexneri 2a str. 2457T
guucagcgucggcgucaucg

SEQ ID NO: 1897111 - RNA, 14 nt, Shigella flexneri 2a str. 2457T
guuaggcacaucaa

SEQ ID NO: 1897112 - RNA, 15 nt, Shigella flexneri 2a str. 2457T
guuagucaucaucag

SEQ ID NO: 1897113 - RNA, 23 nt, Shigella flexneri 2a str. 2457T
guguuuuccaccgugauccgccg

SEQ ID NO: 1897114 - RNA, 15 nt, Shigella flexneri 2a str. 2457T
guguuggcgucagac

SEQ ID NO: 1897115 - RNA, 16 nt, Shigella flexneri 2a str. 2457T
guguuggcaaucagcg

SEQ ID NO: 1897116 - RNA, 15 nt, Shigella flexneri 2a str. 2457T
guguugauuuccaac

SEQ ID NO: 1897117 - RNA, 21 nt, Shigella flexneri 2a str. 2457T
guucccccugccagaccauuu

SEQ ID NO: 1897118 - RNA, 22 nt, Shigella flexneri 2a str. 2457T
guuccauaccgucgccagacgc

SEQ ID NO: 1897119 - RNA, 19 nt, Shigella flexneri 2a str. 2457T
guuccagugcguacccagc

SEQ ID NO: 1897120 - RNA, 17 nt, Shigella flexneri 2a str. 2457T
guuccugcuuggcgcga

SEQ ID NO: 1897121 - RNA, 14 nt, Shigella flexneri 2a str. 2457T
guucaggcgcugca

SEQ ID NO: 1897122 - RNA, 12 nt, Shigella flexneri 2a str. 2457T
guuccacccagc

SEQ ID NO: 1897123 - RNA, 19 nt, Shigella flexneri 2a str. 2457T
guucaugaccgugaucgug

SEQ ID NO: 1897124 - RNA, 20 nt, Shigella flexneri 2a str. 2457T
guuccagagaacgaccauca

SEQ ID NO: 1897125 - RNA, 19 nt, Shigella flexneri 2a str. 2457T
guuucgcuauagacaccuu

SEQ ID NO: 1897126 - RNA, 19 nt, Shigella flexneri 2a str. 2457T
guuucgcagucgccagcaa

SEQ ID NO: 1897127 - RNA, 21 nt, Shigella flexneri 2a str. 2457T
guuguaaaaaaccccgcuccg

SEQ ID NO: 1897128 - RNA, 19 nt, Shigella flexneri 2a str. 2457T
guuucugauacugcuccgg

SEQ ID NO: 1897129 - RNA, 20 nt, Shigella flexneri 2a str. 2457T
guuucuggugugcagcguga

SEQ ID NO: 1897130 - RNA, 17 nt, Shigella flexneri 2a str. 2457T
guuugauuauucacaau

SEQ ID NO: 1897131 - RNA, 22 nt, Shigella flexneri 2a str. 2457T
guuuugcuuucuauaagauacu

SEQ ID NO: 1897132 - RNA, 19 nt, Shigella flexneri 2a str. 2457T
guuuuucaguccacgguug

SEQ ID NO: 1897133 - RNA, 21 nt, Shigella flexneri 2a str. 2457T
guuuuugcacgcuuucugcgu

SEQ ID NO: 1897134 - RNA, 22 nt, Shigella flexneri 2a str. 2457T
guuuuuguccccucaucaguga

SEQ ID NO: 1897135 - RNA, 15 nt, Shigella flexneri 2a str. 2457T
guuuuacguaaugcu

SEQ ID NO: 1897136 - RNA, 14 nt, Shigella flexneri 2a str. 2457T
guuuuauauaacgc

SEQ ID NO: 1897137 - RNA, 20 nt, Shigella flexneri 2a str. 2457T
guuuucaaugauaaagguca

SEQ ID NO: 1897138 - RNA, 20 nt, Shigella flexneri 2a str. 2457T
guuuucaaagguaaugguca

SEQ ID NO: 1897139 - RNA, 17 nt, Shigella flexneri 2a str. 2457T
guuuucgcgcgcaguua

SEQ ID NO: 1897140 - RNA, 13 nt, Shigella flexneri 2a str. 2457T
guuuuccaguuca

SEQ ID NO: 1897141 - RNA, 20 nt, Shigella flexneri 2a str. 2457T
uaaaaucgacaucugcaauu

SEQ ID NO: 1897142 - RNA, 20 nt, Shigella flexneri 2a str. 2457T
uaaaacaggcagcugccaga

SEQ ID NO: 1897143 - RNA, 15 nt, Shigella flexneri 2a str. 2457T
uaaaacaagaucgcc

SEQ ID NO: 1897144 - RNA, 15 nt, Shigella flexneri 2a str. 2457T
uaaaaauccgccaga

SEQ ID NO: 1897145 - RNA, 21 nt, Shigella flexneri 2a str. 2457T
guugcggcugcccaucaucgu

SEQ ID NO: 1897146 - RNA, 17 nt, Shigella flexneri 2a str. 2457T
guugcccagcgcaucag

SEQ ID NO: 1897147 - RNA, 12 nt, Shigella flexneri 2a str. 2457T
guugccagcgcc

SEQ ID NO: 1897148 - RNA, 18 nt, Shigella flexneri 2a str. 2457T
guugcaugauuucgucau

SEQ ID NO: 1897149 - RNA, 18 nt, Shigella flexneri 2a str. 2457T
guugcauaauuucuucgu

SEQ ID NO: 1897150 - RNA, 22 nt, Shigella flexneri 2a str. 2457T
guugcggcuuauucauuacuca

SEQ ID NO: 1897151 - RNA, 12 nt, Shigella flexneri 2a str. 2457T
guugcgguuuca

SEQ ID NO: 1897152 - RNA, 15 nt, Shigella flexneri 2a str. 2457T
guuggccugccggau

SEQ ID NO: 1897153 - RNA, 22 nt, Shigella flexneri 2a str. 2457T
guucuuaccggugacagcggug

SEQ ID NO: 1897154 - RNA, 14 nt, Shigella flexneri 2a str. 2457T
guucugucgcucug

SEQ ID NO: 1897155 - RNA, 18 nt, Shigella flexneri 2a str. 2457T
guugaguaagaggccaga

SEQ ID NO: 1897156 - RNA, 17 nt, Shigella flexneri 2a str. 2457T
guugauauuccaucuga

SEQ ID NO: 1897157 - RNA, 14 nt, Shigella flexneri 2a str. 2457T
guugaucgcuuuca

SEQ ID NO: 1897158 - RNA, 13 nt, Shigella flexneri 2a str. 2457T
guugcaccgaguu

SEQ ID NO: 1897159 - RNA, 17 nt, Shigella flexneri 2a str. 2457T
guugauuuuauaaucaa

SEQ ID NO: 1897160 - RNA, 18 nt, Shigella flexneri 2a str. 2457T
uacaugaagcacugcauc

SEQ ID NO: 1897161 - RNA, 15 nt, Shigella flexneri 2a str. 2457T
uacauggacgaaauc

SEQ ID NO: 1897162 - RNA, 21 nt, Shigella flexneri 2a str. 2457T
uacauugccgggcgcaucaga

SEQ ID NO: 1897163 - RNA, 20 nt, Shigella flexneri 2a str. 2457T
uacaucgcgcuuaucgccag

SEQ ID NO: 1897164 - RNA, 12 nt, Shigella flexneri 2a str. 2457T
uacaucaccgcc

SEQ ID NO: 1897165 - RNA, 17 nt, Shigella flexneri 2a str. 2457T
uacauaugcgcuggcag

SEQ ID NO: 1897166 - RNA, 14 nt, Shigella flexneri 2a str. 2457T
uaccaacauacugc

SEQ ID NO: 1897167 - RNA, 20 nt, Shigella flexneri 2a str. 2457T
uaccacaucaacccgcccag

SEQ ID NO: 1897168 - RNA, 14 nt, Shigella flexneri 2a str. 2457T
uacagauccgccau

SEQ ID NO: 1897169 - RNA, 15 nt, Shigella flexneri 2a str. 2457T
uacagauccgccauu

SEQ ID NO: 1897170 - RNA, 18 nt, Shigella flexneri 2a str. 2457T
uacagcauugucucccac

SEQ ID NO: 1897171 - RNA, 22 nt, Shigella flexneri 2a str. 2457T
uacagcuuagcgccuucuacag

SEQ ID NO: 1897172 - RNA, 20 nt, Shigella flexneri 2a str. 2457T
uacauacccuugaucaccgu

SEQ ID NO: 1897173 - RNA, 19 nt, Shigella flexneri 2a str. 2457T
uacaguauaaguaaugaac

SEQ ID NO: 1897174 - RNA, 17 nt, Shigella flexneri 2a str. 2457T
uacacgcggcuguugcc

SEQ ID NO: 1897175 - RNA, 22 nt, Shigella flexneri 2a str. 2457T
uacacgcggcuguugccggauu

SEQ ID NO: 1897176 - RNA, 16 nt, Shigella flexneri 2a str. 2457T
uacaccucucgcccgc

SEQ ID NO: 1897177 - RNA, 15 nt, Shigella flexneri 2a str. 2457T
uacaacgcgcgguga

SEQ ID NO: 1897178 - RNA, 22 nt, Shigella flexneri 2a str. 2457T
uaaucaguuugaugccugcauc

SEQ ID NO: 1897179 - RNA, 14 nt, Shigella flexneri 2a str. 2457T
uaaucaugucugga

SEQ ID NO: 1897180 - RNA, 17 nt, Shigella flexneri 2a str. 2457T
uaaucagcuaauggcug

SEQ ID NO: 1897181 - RNA, 17 nt, Shigella flexneri 2a str. 2457T
uaaucaggaacuggaag

SEQ ID NO: 1897182 - RNA, 18 nt, Shigella flexneri 2a str. 2457T
uaaucaccaucagcagca

SEQ ID NO: 1897183 - RNA, 21 nt, Shigella flexneri 2a str. 2457T
uaauuaagcgcaaaggccagc

SEQ ID NO: 1897184 - RNA, 17 nt, Shigella flexneri 2a str. 2457T
uaauauccugccguuuu

SEQ ID NO: 1897185 - RNA, 15 nt, Shigella flexneri 2a str. 2457T
uaauaucuccagcua

SEQ ID NO: 1897186 - RNA, 14 nt, Shigella flexneri 2a str. 2457T
uaauauuacuucgc

SEQ ID NO: 1897187 - RNA, 15 nt, Shigella flexneri 2a str. 2457T
uaagucagaaagccg

SEQ ID NO: 1897188 - RNA, 16 nt, Shigella flexneri 2a str. 2457T
uaaggucaccaguuca

SEQ ID NO: 1897189 - RNA, 12 nt, Shigella flexneri 2a str. 2457T
uaaguaaugaca

SEQ ID NO: 1897190 - RNA, 16 nt, Shigella flexneri 2a str. 2457T
uaacuuacgcgucaga

SEQ ID NO: 1897191 - RNA, 21 nt, Shigella flexneri 2a str. 2457T
uaacucaaaaauaaucaucuc

SEQ ID NO: 1897192 - RNA, 17 nt, Shigella flexneri 2a str. 2457T
uaacugccggaugcggc

SEQ ID NO: 1897193 - RNA, 14 nt, Shigella flexneri 2a str. 2457T
uaacugcugcucaa

SEQ ID NO: 1897194 - RNA, 19 nt, Shigella flexneri 2a str. 2457T
uaaggccgaauaccggcgu

SEQ ID NO: 1897195 - RNA, 20 nt, Shigella flexneri 2a str. 2457T
uaaggcgcucgcgccgcauc

SEQ ID NO: 1897196 - RNA, 20 nt, Shigella flexneri 2a str. 2457T
uaaggcgguuacgccgcauc

SEQ ID NO: 1897197 - RNA, 20 nt, Shigella flexneri 2a str. 2457T
uaaggcguacacgccgcauc

SEQ ID NO: 1897198 - RNA, 17 nt, Shigella flexneri 2a str. 2457T
uaaggcguuuacgccgc

SEQ ID NO: 1897199 - RNA, 20 nt, Shigella flexneri 2a str. 2457T
uaaggcguuuacgccgcauc

SEQ ID NO: 1897200 - RNA, 20 nt, Shigella flexneri 2a str. 2457T
uaaggcguucacgccgcauc

SEQ ID NO: 1897201 - RNA, 20 nt, Shigella flexneri 2a str. 2457T
uaaggcguuaacgccgcauc

SEQ ID NO: 1897202 - RNA, 20 nt, Shigella flexneri 2a str. 2457T
uaaggcguucacgacgcauc

SEQ ID NO: 1897203 - RNA, 22 nt, Shigella flexneri 2a str. 2457T
uaagggcuaaucugaauggcug

SEQ ID NO: 1897204 - RNA, 20 nt, Shigella flexneri 2a str. 2457T
uaaggcguuuucgccacauc

SEQ ID NO: 1897205 - RNA, 20 nt, Shigella flexneri 2a str. 2457T
uaaggcguuuucgccgcauc

SEQ ID NO: 1897206 - RNA, 15 nt, Shigella flexneri 2a str. 2457T
uaagcgcagcgcauc

SEQ ID NO: 1897207 - RNA, 18 nt, Shigella flexneri 2a str. 2457T
uaagcgccauaucggcau

SEQ ID NO: 1897208 - RNA, 17 nt, Shigella flexneri 2a str. 2457T
uaagccuguuuagccgc

SEQ ID NO: 1897209 - RNA, 13 nt, Shigella flexneri 2a str. 2457T
uaagcgacauccu

SEQ ID NO: 1897210 - RNA, 20 nt, Shigella flexneri 2a str. 2457T
uaacgcccgagccgguugcc

SEQ ID NO: 1897211 - RNA, 19 nt, Shigella flexneri 2a str. 2457T
uaacgccuuauccggccua

SEQ ID NO: 1897212 - RNA, 14 nt, Shigella flexneri 2a str. 2457T
uaacgccuggcagu

SEQ ID NO: 1897213 - RNA, 17 nt, Shigella flexneri 2a str. 2457T
uaacccucuccccgaug

SEQ ID NO: 1897214 - RNA, 14 nt, Shigella flexneri 2a str. 2457T
uaaccgcaucaaca

SEQ ID NO: 1897215 - RNA, 21 nt, Shigella flexneri 2a str. 2457T
uaacgcgucuuaucuggccua

SEQ ID NO: 1897216 - RNA, 16 nt, Shigella flexneri 2a str. 2457T
uaacgcuucuggcgua

SEQ ID NO: 1897217 - RNA, 17 nt, Shigella flexneri 2a str. 2457T
uaacggaauugccaacg

SEQ ID NO: 1897218 - RNA, 22 nt, Shigella flexneri 2a str. 2457T
uaacggcucugcuuucucagca

SEQ ID NO: 1897219 - RNA, 19 nt, Shigella flexneri 2a str. 2457T
uaacggcugauaacaauau

SEQ ID NO: 1897220 - RNA, 23 nt, Shigella flexneri 2a str. 2457T
uaaccagcacguugaacugacug

SEQ ID NO: 1897221 - RNA, 20 nt, Shigella flexneri 2a str. 2457T
uaaccaccuccacgcccagc

SEQ ID NO: 1897222 - RNA, 18 nt, Shigella flexneri 2a str. 2457T
uaaccaguugucgcacau

SEQ ID NO: 1897223 - RNA, 12 nt, Shigella flexneri 2a str. 2457T
uaacauccaacg

SEQ ID NO: 1897224 - RNA, 20 nt, Shigella flexneri 2a str. 2457T
uaacauccagaucacgcagc

SEQ ID NO: 1897225 - RNA, 19 nt, Shigella flexneri 2a str. 2457T
uaacauuuuucucggcaau

SEQ ID NO: 1897226 - RNA, 21 nt, Shigella flexneri 2a str. 2457T
uaaccaaaucuccagugguga

SEQ ID NO: 1897227 - RNA, 14 nt, Shigella flexneri 2a str. 2457T
uaacagugccgcac

SEQ ID NO: 1897228 - RNA, 17 nt, Shigella flexneri 2a str. 2457T
uaacaguuguccaaacg

SEQ ID NO: 1897229 - RNA, 20 nt, Shigella flexneri 2a str. 2457T
uaaacgccucugucagaaau

SEQ ID NO: 1897230 - RNA, 20 nt, Shigella flexneri 2a str. 2457T
uaaacgccuuauccguccua

SEQ ID NO: 1897231 - RNA, 20 nt, Shigella flexneri 2a str. 2457T
uaaacgccuuauccggccua

SEQ ID NO: 1897232 - RNA, 20 nt, Shigella flexneri 2a str. 2457T
uaaacgccuuauccggcuua

SEQ ID NO: 1897233 - RNA, 12 nt, Shigella flexneri 2a str. 2457T
uaaacgguaccg

SEQ ID NO: 1897234 - RNA, 19 nt, Shigella flexneri 2a str. 2457T
uaaaccaaucaccgccacu

SEQ ID NO: 1897235 - RNA, 20 nt, Shigella flexneri 2a str. 2457T
uaaaccccuuaucuggccua

SEQ ID NO: 1897236 - RNA, 16 nt, Shigella flexneri 2a str. 2457T
uccaagauuaaaggca

SEQ ID NO: 1897237 - RNA, 13 nt, Shigella flexneri 2a str. 2457T
ucauugccgcauc

SEQ ID NO: 1897238 - RNA, 21 nt, Shigella flexneri 2a str. 2457T
ucauuggccggaauaccacuu

SEQ ID NO: 1897239 - RNA, 18 nt, Shigella flexneri 2a str. 2457T
ucauuuacaucacgcagc

SEQ ID NO: 1897240 - RNA, 13 nt, Shigella flexneri 2a str. 2457T
ucauuucgccuga

SEQ ID NO: 1897241 - RNA, 14 nt, Shigella flexneri 2a str. 2457T
ucauuagcccaaua

SEQ ID NO: 1897242 - RNA, 14 nt, Shigella flexneri 2a str. 2457T
ucauucauccgccg

SEQ ID NO: 1897243 - RNA, 14 nt, Shigella flexneri 2a str. 2457T
ucauuaccagcgag

SEQ ID NO: 1897244 - RNA, 14 nt, Shigella flexneri 2a str. 2457T
ucauggugcaagaa

SEQ ID NO: 1897245 - RNA, 13 nt, Shigella flexneri 2a str. 2457T
ucaugucugccgc

SEQ ID NO: 1897246 - RNA, 22 nt, Shigella flexneri 2a str. 2457T
ucaucuguugugccacauccag

SEQ ID NO: 1897247 - RNA, 14 nt, Shigella flexneri 2a str. 2457T
ucaucaucgccacu

SEQ ID NO: 1897248 - RNA, 17 nt, Shigella flexneri 2a str. 2457T
ucaucagcgucgguuuc

SEQ ID NO: 1897249 - RNA, 13 nt, Shigella flexneri 2a str. 2457T
ucaucgcauccag

SEQ ID NO: 1897250 - RNA, 22 nt, Shigella flexneri 2a str. 2457T
ucaucgcaucgaugguugcccu

SEQ ID NO: 1897251 - RNA, 21 nt, Shigella flexneri 2a str. 2457T
ucaucuauagcacccgccagc

SEQ ID NO: 1897252 - RNA, 14 nt, Shigella flexneri 2a str. 2457T
ucauacuccagucg

SEQ ID NO: 1897253 - RNA, 20 nt, Shigella flexneri 2a str. 2457T
ucaguuuuucacccgcaauc

SEQ ID NO: 1897254 - RNA, 21 nt, Shigella flexneri 2a str. 2457T
ucaggccaggauuacgcucac

SEQ ID NO: 1897255 - RNA, 21 nt, Shigella flexneri 2a str. 2457T
ucaggcaucggugcuggccua

SEQ ID NO: 1897256 - RNA, 17 nt, Shigella flexneri 2a str. 2457T
ucaggcauuugcuccag

SEQ ID NO: 1897257 - RNA, 19 nt, Shigella flexneri 2a str. 2457T
uccaugcacugcaacgccu

SEQ ID NO: 1897258 - RNA, 22 nt, Shigella flexneri 2a str. 2457T
uccaugccgaguggcauuucgc

SEQ ID NO: 1897259 - RNA, 19 nt, Shigella flexneri 2a str. 2457T
uccaugaguaacagucagu

SEQ ID NO: 1897260 - RNA, 16 nt, Shigella flexneri 2a str. 2457T
uccauuauucaacgca

SEQ ID NO: 1897261 - RNA, 14 nt, Shigella flexneri 2a str. 2457T
uccauguccagcuu

SEQ ID NO: 1897262 - RNA, 22 nt, Shigella flexneri 2a str. 2457T
uccaguccaccugaccugcgac

SEQ ID NO: 1897263 - RNA, 18 nt, Shigella flexneri 2a str. 2457T
uccaguucgaucucuucg

SEQ ID NO: 1897264 - RNA, 13 nt, Shigella flexneri 2a str. 2457T
uccagugauucca

SEQ ID NO: 1897265 - RNA, 19 nt, Shigella flexneri 2a str. 2457T
uccagugccggaugauuca

SEQ ID NO: 1897266 - RNA, 17 nt, Shigella flexneri 2a str. 2457T
uccagcguaccugccgc

SEQ ID NO: 1897267 - RNA, 16 nt, Shigella flexneri 2a str. 2457T
uccagcgguugggcau

SEQ ID NO: 1897268 - RNA, 23 nt, Shigella flexneri 2a str. 2457T
uccagcuauaacguugccggaua

SEQ ID NO: 1897269 - RNA, 14 nt, Shigella flexneri 2a str. 2457T
uccagguuacgcac

SEQ ID NO: 1897270 - RNA, 20 nt, Shigella flexneri 2a str. 2457T
uccacuuccgcgucaaucug

SEQ ID NO: 1897271 - RNA, 19 nt, Shigella flexneri 2a str. 2457T
uccacuuccaccagcggcu

SEQ ID NO: 1897272 - RNA, 16 nt, Shigella flexneri 2a str. 2457T
uccacagcaaugcauu

SEQ ID NO: 1897273 - RNA, 16 nt, Shigella flexneri 2a str. 2457T
uccagcaacaacagcg

SEQ ID NO: 1897274 - RNA, 17 nt, Shigella flexneri 2a str. 2457T
uccagcaaugucauaaa

SEQ ID NO: 1897275 - RNA, 17 nt, Shigella flexneri 2a str. 2457T
ucagcgccugcugcacg

SEQ ID NO: 1897276 - RNA, 12 nt, Shigella flexneri 2a str. 2457T
ucagccucgcug

SEQ ID NO: 1897277 - RNA, 22 nt, Shigella flexneri 2a str. 2457T
ucagcccgcgauacaccugaug

SEQ ID NO: 1897278 - RNA, 19 nt, Shigella flexneri 2a str. 2457T
ucagcauuacccagauaau

SEQ ID NO: 1897279 - RNA, 14 nt, Shigella flexneri 2a str. 2457T
ucagccaacgcauu

SEQ ID NO: 1897280 - RNA, 13 nt, Shigella flexneri 2a str. 2457T
ucagccagaaugu

SEQ ID NO: 1897281 - RNA, 18 nt, Shigella flexneri 2a str. 2457T
ucagccaucauccauucg

SEQ ID NO: 1897282 - RNA, 22 nt, Shigella flexneri 2a str. 2457T
ucagaugcggcgugaacgccuu

SEQ ID NO: 1897283 - RNA, 17 nt, Shigella flexneri 2a str. 2457T
ucagauuaugucgcuca

SEQ ID NO: 1897284 - RNA, 13 nt, Shigella flexneri 2a str. 2457T
ucagauugccgug

SEQ ID NO: 1897285 - RNA, 19 nt, Shigella flexneri 2a str. 2457T
ucagcauccauaucgccau

SEQ ID NO: 1897286 - RNA, 24 nt, Shigella flexneri 2a str. 2457T
ucagcaucggugaggaucaccagu

SEQ ID NO: 1897287 - RNA, 13 nt, Shigella flexneri 2a str. 2457T
ucagcaucucauc

SEQ ID NO: 1897288 - RNA, 19 nt, Shigella flexneri 2a str. 2457T
ucagauaaaugcaaacgca

SEQ ID NO: 1897289 - RNA, 20 nt, Shigella flexneri 2a str. 2457T
ucagauaaaugcaaacgcau

SEQ ID NO: 1897290 - RNA, 23 nt, Shigella flexneri 2a str. 2457T
ucagaucgguuuuuuucgaaccg

SEQ ID NO: 1897291 - RNA, 14 nt, Shigella flexneri 2a str. 2457T
ucagcguccgggaa

SEQ ID NO: 1897292 - RNA, 21 nt, Shigella flexneri 2a str. 2457T
ucagcgucaacggagcaccgu

SEQ ID NO: 1897293 - RNA, 18 nt, Shigella flexneri 2a str. 2457T
ucagcguuccacgugcgg

SEQ ID NO: 1897294 - RNA, 22 nt, Shigella flexneri 2a str. 2457T
ucagcgucuguuuuaucacauc

SEQ ID NO: 1897295 - RNA, 12 nt, Shigella flexneri 2a str. 2457T
ucagcgucguga

SEQ ID NO: 1897296 - RNA, 19 nt, Shigella flexneri 2a str. 2457T
ucagcuaaacagcccaauc

SEQ ID NO: 1897297 - RNA, 15 nt, Shigella flexneri 2a str. 2457T
ucagcucauccagcg

SEQ ID NO: 1897298 - RNA, 14 nt, Shigella flexneri 2a str. 2457T
ucaggauaaacucc

SEQ ID NO: 1897299 - RNA, 13 nt, Shigella flexneri 2a str. 2457T
ucaggcacguucc

SEQ ID NO: 1897300 - RNA, 16 nt, Shigella flexneri 2a str. 2457T
ucagcugacaacguuu

SEQ ID NO: 1897301 - RNA, 15 nt, Shigella flexneri 2a str. 2457T
ucagcuggaucgaga

SEQ ID NO: 1897302 - RNA, 15 nt, Shigella flexneri 2a str. 2457T
ucagcuggcguaccg

SEQ ID NO: 1897303 - RNA, 20 nt, Shigella flexneri 2a str. 2457T
ucaccugauugaccgccagc

SEQ ID NO: 1897304 - RNA, 19 nt, Shigella flexneri 2a str. 2457T
ucaccuuccacgcggguaa

SEQ ID NO: 1897305 - RNA, 17 nt, Shigella flexneri 2a str. 2457T
ucaccuggagccaguug

SEQ ID NO: 1897306 - RNA, 12 nt, Shigella flexneri 2a str. 2457T
ucacgaugcuaa

SEQ ID NO: 1897307 - RNA, 22 nt, Shigella flexneri 2a str. 2457T
ucacgcccagauccacuaacug

SEQ ID NO: 1897308 - RNA, 14 nt, Shigella flexneri 2a str. 2457T
ucacgcgguuacgc

SEQ ID NO: 1897309 - RNA, 19 nt, Shigella flexneri 2a str. 2457T
ucacgccaauaauggccuu

SEQ ID NO: 1897310 - RNA, 22 nt, Shigella flexneri 2a str. 2457T
ucacccuuucguuaaauucuuc

SEQ ID NO: 1897311 - RNA, 14 nt, Shigella flexneri 2a str. 2457T
ucacaccagcgaug

SEQ ID NO: 1897312 - RNA, 20 nt, Shigella flexneri 2a str. 2457T
ucacacaagguauccagacg

SEQ ID NO: 1897313 - RNA, 20 nt, Shigella flexneri 2a str. 2457T
ucacaauggcacaaauggca

SEQ ID NO: 1897314 - RNA, 13 nt, Shigella flexneri 2a str. 2457T
ucacaauaaucgc

SEQ ID NO: 1897315 - RNA, 23 nt, Shigella flexneri 2a str. 2457T
ucaccgcagcaucgucaucagcu

SEQ ID NO: 1897316 - RNA, 13 nt, Shigella flexneri 2a str. 2457T
aauaacagcgcaa

SEQ ID NO: 1897317 - RNA, 20 nt, Shigella flexneri 2a str. 2457T
ucacggcuguagccagcucg

SEQ ID NO: 1897318 - RNA, 15 nt, Shigella flexneri 2a str. 2457T
ucacggcacucgcug

SEQ ID NO: 1897319 - RNA, 18 nt, Shigella flexneri 2a str. 2457T
aauaacuuccugagugaa

SEQ ID NO: 1897320 - RNA, 16 nt, Shigella flexneri 2a str. 2457T
ucagaacguaaacgca

SEQ ID NO: 1897321 - RNA, 17 nt, Shigella flexneri 2a str. 2457T
aauaaucaacgcggcaa

SEQ ID NO: 1897322 - RNA, 15 nt, Shigella flexneri 2a str. 2457T
ucacuucaucaucgu

SEQ ID NO: 1897323 - RNA, 20 nt, Shigella flexneri 2a str. 2457T
ucacuuaguagccagacaau

SEQ ID NO: 1897324 - RNA, 20 nt, Shigella flexneri 2a str. 2457T
ucacuuucaaauccggccag

SEQ ID NO: 1897325 - RNA, 15 nt, Shigella flexneri 2a str. 2457T
ucacuuucuggcagc

SEQ ID NO: 1897326 - RNA, 15 nt, Shigella flexneri 2a str. 2457T
ucacguucgugaaca

SEQ ID NO: 1897327 - RNA, 23 nt, Shigella flexneri 2a str. 2457T
ucacuaccagcgccaccgguuua

SEQ ID NO: 1897328 - RNA, 14 nt, Shigella flexneri 2a str. 2457T
uaucuuccuggcgc

SEQ ID NO: 1897329 - RNA, 21 nt, Shigella flexneri 2a str. 2457T
uaugaaagcaacguuaaaucg

SEQ ID NO: 1897330 - RNA, 19 nt, Shigella flexneri 2a str. 2457T
uaugaaucuuuucaucgca

SEQ ID NO: 1897331 - RNA, 21 nt, Shigella flexneri 2a str. 2457T
uaucuggcgcuaguacccgau

SEQ ID NO: 1897332 - RNA, 22 nt, Shigella flexneri 2a str. 2457T
uaucucccugauccaaccggau

SEQ ID NO: 1897333 - RNA, 12 nt, Shigella flexneri 2a str. 2457T
uaucuaccggga

SEQ ID NO: 1897334 - RNA, 21 nt, Shigella flexneri 2a str. 2457T
uauguucagauaaugcccgau

SEQ ID NO: 1897335 - RNA, 21 nt, Shigella flexneri 2a str. 2457T
uaugccagccccagcgucagc

SEQ ID NO: 1897336 - RNA, 22 nt, Shigella flexneri 2a str. 2457T
uaugccagccccagcgucagca

SEQ ID NO: 1897337 - RNA, 12 nt, Shigella flexneri 2a str. 2457T
uaugaucgccac

SEQ ID NO: 1897338 - RNA, 13 nt, Shigella flexneri 2a str. 2457T
uaugauugccuga

SEQ ID NO: 1897339 - RNA, 18 nt, Shigella flexneri 2a str. 2457T
uauuaaccuggucgcuga

SEQ ID NO: 1897340 - RNA, 16 nt, Shigella flexneri 2a str. 2457T
uauacgcucaucggca

SEQ ID NO: 1897341 - RNA, 13 nt, Shigella flexneri 2a str. 2457T
uaucggguacggg

SEQ ID NO: 1897342 - RNA, 19 nt, Shigella flexneri 2a str. 2457T
uaucccgccagcaccagca

SEQ ID NO: 1897343 - RNA, 19 nt, Shigella flexneri 2a str. 2457T
uauccgaugaaucaccaca

SEQ ID NO: 1897344 - RNA, 22 nt, Shigella flexneri 2a str. 2457T
uaucagacaaucugugugggca

SEQ ID NO: 1897345 - RNA, 13 nt, Shigella flexneri 2a str. 2457T
uaucagacaccag

SEQ ID NO: 1897346 - RNA, 18 nt, Shigella flexneri 2a str. 2457T
uauauucguuacuggcau

SEQ ID NO: 1897347 - RNA, 16 nt, Shigella flexneri 2a str. 2457T
uaucagcaacuggcaa

SEQ ID NO: 1897348 - RNA, 14 nt, Shigella flexneri 2a str. 2457T
uaucagcaacucug

SEQ ID NO: 1897349 - RNA, 20 nt, Shigella flexneri 2a str. 2457T
ucaaugaguucgcgcgcugc

SEQ ID NO: 1897350 - RNA, 15 nt, Shigella flexneri 2a str. 2457T
ucaaucccaucaggc

SEQ ID NO: 1897351 - RNA, 22 nt, Shigella flexneri 2a str. 2457T
ucaaucgccucgccgaaacgcu

SEQ ID NO: 1897352 - RNA, 15 nt, Shigella flexneri 2a str. 2457T
ucaauauuaaugcug

SEQ ID NO: 1897353 - RNA, 22 nt, Shigella flexneri 2a str. 2457T
ucaaucaacuuauugguaaacu

SEQ ID NO: 1897354 - RNA, 23 nt, Shigella flexneri 2a str. 2457T
ucaaugcccaucacuaucgccau

SEQ ID NO: 1897355 - RNA, 13 nt, Shigella flexneri 2a str. 2457T
ucaaucuggccug

SEQ ID NO: 1897356 - RNA, 21 nt, Shigella flexneri 2a str. 2457T
ucaaugugcugaguguaacgc

SEQ ID NO: 1897357 - RNA, 18 nt, Shigella flexneri 2a str. 2457T
ucaauuuguuccgccagc

SEQ ID NO: 1897358 - RNA, 20 nt, Shigella flexneri 2a str. 2457T
ucaauuuucacuuucggcag

SEQ ID NO: 1897359 - RNA, 24 nt, Shigella flexneri 2a str. 2457T
ucaauuuugaugauaucagccugc

SEQ ID NO: 1897360 - RNA, 17 nt, Shigella flexneri 2a str. 2457T
ucacaaacagcgccugu

SEQ ID NO: 1897361 - RNA, 15 nt, Shigella flexneri 2a str. 2457T
ucaauuggaucugau

SEQ ID NO: 1897362 - RNA, 20 nt, Shigella flexneri 2a str. 2457T
ucaauuugagcgaagcgcau

SEQ ID NO: 1897363 - RNA, 23 nt, Shigella flexneri 2a str. 2457T
ucaaggccggagaagaugcguca

SEQ ID NO: 1897364 - RNA, 18 nt, Shigella flexneri 2a str. 2457T
ucaagcuaacgaacgcag

SEQ ID NO: 1897365 - RNA, 18 nt, Shigella flexneri 2a str. 2457T
ucaagcgucgcaucaggc

SEQ ID NO: 1897366 - RNA, 13 nt, Shigella flexneri 2a str. 2457T
ucaauaaaagcau

SEQ ID NO: 1897367 - RNA, 13 nt, Shigella flexneri 2a str. 2457T
ucaaguuaccggu

SEQ ID NO: 1897368 - RNA, 16 nt, Shigella flexneri 2a str. 2457T
uauugccguccggcau

SEQ ID NO: 1897369 - RNA, 12 nt, Shigella flexneri 2a str. 2457T
ucaaacucuuca

SEQ ID NO: 1897370 - RNA, 22 nt, Shigella flexneri 2a str. 2457T
ucaaacgaccaaucgcgggcaa

SEQ ID NO: 1897371 - RNA, 12 nt, Shigella flexneri 2a str. 2457T
ucaacuccgucg

SEQ ID NO: 1897372 - RNA, 18 nt, Shigella flexneri 2a str. 2457T
ucaacguuauucgcuucc

SEQ ID NO: 1897373 - RNA, 14 nt, Shigella flexneri 2a str. 2457T
uacgauuugcggcg

SEQ ID NO: 1897374 - RNA, 15 nt, Shigella flexneri 2a str. 2457T
uacgcaaaaccucuu

SEQ ID NO: 1897375 - RNA, 16 nt, Shigella flexneri 2a str. 2457T
uacgaccgcaugcggu

SEQ ID NO: 1897376 - RNA, 20 nt, Shigella flexneri 2a str. 2457T
uacgacgugccgcagcuucu

SEQ ID NO: 1897377 - RNA, 15 nt, Shigella flexneri 2a str. 2457T
uaccagaaucaccuu

SEQ ID NO: 1897378 - RNA, 17 nt, Shigella flexneri 2a str. 2457T
uaccagaccauacagug

SEQ ID NO: 1897379 - RNA, 17 nt, Shigella flexneri 2a str. 2457T
uaccagauuaauuauug

SEQ ID NO: 1897380 - RNA, 11 nt, Shigella flexneri 2a str. 2457T
uaccagcagcg

SEQ ID NO: 1897381 - RNA, 14 nt, Shigella flexneri 2a str. 2457T
uaccagcccgucuc

SEQ ID NO: 1897382 - RNA, 16 nt, Shigella flexneri 2a str. 2457T
uaccagcggccggaug

SEQ ID NO: 1897383 - RNA, 20 nt, Shigella flexneri 2a str. 2457T
uacggcugauggcgccaguu

SEQ ID NO: 1897384 - RNA, 21 nt, Shigella flexneri 2a str. 2457T
uacggcggucuggcgauuggc

SEQ ID NO: 1897385 - RNA, 23 nt, Shigella flexneri 2a str. 2457T
uacggcuaaaaaaagccgccauc

SEQ ID NO: 1897386 - RNA, 16 nt, Shigella flexneri 2a str. 2457T
uacgguacugaaaccu

SEQ ID NO: 1897387 - RNA, 11 nt, Shigella flexneri 2a str. 2457T
uacgcuaccau

SEQ ID NO: 1897388 - RNA, 15 nt, Shigella flexneri 2a str. 2457T
uacgcgcucaccgcu

SEQ ID NO: 1897389 - RNA, 17 nt, Shigella flexneri 2a str. 2457T
uacugcauaaugccggu

SEQ ID NO: 1897390 - RNA, 14 nt, Shigella flexneri 2a str. 2457T
uacugauggcuacg

SEQ ID NO: 1897391 - RNA, 17 nt, Shigella flexneri 2a str. 2457T
uacugcccuuucgccgc

SEQ ID NO: 1897392 - RNA, 15 nt, Shigella flexneri 2a str. 2457T
uacugaaggcgcauu

SEQ ID NO: 1897393 - RNA, 14 nt, Shigella flexneri 2a str. 2457T
uacugaaccacgga

SEQ ID NO: 1897394 - RNA, 12 nt, Shigella flexneri 2a str. 2457T
uacuacguucaa

SEQ ID NO: 1897395 - RNA, 20 nt, Shigella flexneri 2a str. 2457T
uacuacguucaaucaccgca

SEQ ID NO: 1897396 - RNA, 23 nt, Shigella flexneri 2a str. 2457T
uacucuggcgcuggaugucuggc

SEQ ID NO: 1897397 - RNA, 12 nt, Shigella flexneri 2a str. 2457T
uacgucgagaau

SEQ ID NO: 1897398 - RNA, 21 nt, Shigella flexneri 2a str. 2457T
uacuuuuuaugucauuaaccg

SEQ ID NO: 1897399 - RNA, 18 nt, Shigella flexneri 2a str. 2457T
uacuuuccagccacaguu

SEQ ID NO: 1897400 - RNA, 21 nt, Shigella flexneri 2a str. 2457T
uacugcugcggaauugccggu

SEQ ID NO: 1897401 - RNA, 21 nt, Shigella flexneri 2a str. 2457T
uagcgaaguugaucgggacuu

SEQ ID NO: 1897402 - RNA, 23 nt, Shigella flexneri 2a str. 2457T
uagcgaaaucuuccggcguggcg

SEQ ID NO: 1897403 - RNA, 12 nt, Shigella flexneri 2a str. 2457T
uagccgcccugu

SEQ ID NO: 1897404 - RNA, 18 nt, Shigella flexneri 2a str. 2457T
uagccgcagccaucagcg

SEQ ID NO: 1897405 - RNA, 16 nt, Shigella flexneri 2a str. 2457T
uagcagcuuucagcag

SEQ ID NO: 1897406 - RNA, 18 nt, Shigella flexneri 2a str. 2457T
uagcagcuuucagcagcg

SEQ ID NO: 1897407 - RNA, 14 nt, Shigella flexneri 2a str. 2457T
uagcagcuuucagc

SEQ ID NO: 1897408 - RNA, 15 nt, Shigella flexneri 2a str. 2457T
uagcagcuuucagca

SEQ ID NO: 1897409 - RNA, 14 nt, Shigella flexneri 2a str. 2457T
uagcguuuugcgcg

SEQ ID NO: 1897410 - RNA, 18 nt, Shigella flexneri 2a str. 2457T
aaguugcagcgucaucaa

SEQ ID NO: 1897411 - RNA, 22 nt, Shigella flexneri 2a str. 2457T
aaguuuaacuaccguguucagc

SEQ ID NO: 1897412 - RNA, 21 nt, Shigella flexneri 2a str. 2457T
uaggcuuuacuuaaucccauc

SEQ ID NO: 1897413 - RNA, 20 nt, Shigella flexneri 2a str. 2457T
uaggccugauaagacgcguu

SEQ ID NO: 1897414 - RNA, 17 nt, Shigella flexneri 2a str. 2457T
uaggcaauuggcgcauc

SEQ ID NO: 1897415 - RNA, 17 nt, Shigella flexneri 2a str. 2457T
aaguuuugucgcugauu

SEQ ID NO: 1897416 - RNA, 15 nt, Shigella flexneri 2a str. 2457T
uaggcaauuggcgca

SEQ ID NO: 1897417 - RNA, 15 nt, Shigella flexneri 2a str. 2457T
uaggaagccggaauu

SEQ ID NO: 1897418 - RNA, 16 nt, Shigella flexneri 2a str. 2457T
ucggcgcuaaucaugu

SEQ ID NO: 1897419 - RNA, 22 nt, Shigella flexneri 2a str. 2457T
ucggaugcggcgugaacgccuu

SEQ ID NO: 1897420 - RNA, 15 nt, Shigella flexneri 2a str. 2457T
ucggcaaaucgcuga

SEQ ID NO: 1897421 - RNA, 20 nt, Shigella flexneri 2a str. 2457T
ucggcagcggcgaucgugag

SEQ ID NO: 1897422 - RNA, 17 nt, Shigella flexneri 2a str. 2457T
ucggcagugaaaacgca

SEQ ID NO: 1897423 - RNA, 20 nt, Shigella flexneri 2a str. 2457T
ucgcugacugauauugcccg

SEQ ID NO: 1897424 - RNA, 11 nt, Shigella flexneri 2a str. 2457T
ucggaaacggc

SEQ ID NO: 1897425 - RNA, 13 nt, Shigella flexneri 2a str. 2457T
ucggaucauucuc

SEQ ID NO: 1897426 - RNA, 21 nt, Shigella flexneri 2a str. 2457T
ucggauaaccaaucacgucgc

SEQ ID NO: 1897427 - RNA, 22 nt, Shigella flexneri 2a str. 2457T
ucggaguggcagccccaggauu

SEQ ID NO: 1897428 - RNA, 18 nt, Shigella flexneri 2a str. 2457T
ucggauaaccaaucacgu

SEQ ID NO: 1897429 - RNA, 15 nt, Shigella flexneri 2a str. 2457T
ucgccgguuccagcu

SEQ ID NO: 1897430 - RNA, 18 nt, Shigella flexneri 2a str. 2457T
ucgccgguaaugacucca

SEQ ID NO: 1897431 - RNA, 12 nt, Shigella flexneri 2a str. 2457T
ucgcgccgcauc

SEQ ID NO: 1897432 - RNA, 19 nt, Shigella flexneri 2a str. 2457T
ucgcgccgcauccggcauu

SEQ ID NO: 1897433 - RNA, 14 nt, Shigella flexneri 2a str. 2457T
ucgccgaggcgcug

SEQ ID NO: 1897434 - RNA, 17 nt, Shigella flexneri 2a str. 2457T
ucgccgggcuaaccgcu

SEQ ID NO: 1897435 - RNA, 21 nt, Shigella flexneri 2a str. 2457T
ucgccaguaaucggcugaacg

SEQ ID NO: 1897436 - RNA, 19 nt, Shigella flexneri 2a str. 2457T
ucgccagucccuuucaggu

SEQ ID NO: 1897437 - RNA, 14 nt, Shigella flexneri 2a str. 2457T
ucgccaguccuuca

SEQ ID NO: 1897438 - RNA, 23 nt, Shigella flexneri 2a str. 2457T
ucgacaaacaccgaaccagagau

SEQ ID NO: 1897439 - RNA, 13 nt, Shigella flexneri 2a str. 2457T
ucgacagcaggau

SEQ ID NO: 1897440 - RNA, 12 nt, Shigella flexneri 2a str. 2457T
ucgacagcagcc

SEQ ID NO: 1897441 - RNA, 17 nt, Shigella flexneri 2a str. 2457T
ucgacauauucaccauu

SEQ ID NO: 1897442 - RNA, 14 nt, Shigella flexneri 2a str. 2457T
ucgaagaaaccgau

SEQ ID NO: 1897443 - RNA, 18 nt, Shigella flexneri 2a str. 2457T
uccucgcgcagcuuacgc

SEQ ID NO: 1897444 - RNA, 15 nt, Shigella flexneri 2a str. 2457T
uccuguuucggacuu

SEQ ID NO: 1897445 - RNA, 13 nt, Shigella flexneri 2a str. 2457T
uccuguaucguca

SEQ ID NO: 1897446 - RNA, 12 nt, Shigella flexneri 2a str. 2457T
uccuuccagcug

SEQ ID NO: 1897447 - RNA, 13 nt, Shigella flexneri 2a str. 2457T
ucgaaaaugcgca

SEQ ID NO: 1897448 - RNA, 14 nt, Shigella flexneri 2a str. 2457T
ucgcacccgccauc

SEQ ID NO: 1897449 - RNA, 19 nt, Shigella flexneri 2a str. 2457T
ucgcaaauugacuacacca

SEQ ID NO: 1897450 - RNA, 22 nt, Shigella flexneri 2a str. 2457T
ucgcaaauccauucaucgccuu

SEQ ID NO: 1897451 - RNA, 13 nt, Shigella flexneri 2a str. 2457T
ucgaugcgcuggc

SEQ ID NO: 1897452 - RNA, 14 nt, Shigella flexneri 2a str. 2457T
ucgauaaucaucag

SEQ ID NO: 1897453 - RNA, 22 nt, Shigella flexneri 2a str. 2457T
ucgauaugucuuuuuuccagca

SEQ ID NO: 1897454 - RNA, 20 nt, Shigella flexneri 2a str. 2457T
ucgagcagagaaacgccagc

SEQ ID NO: 1897455 - RNA, 13 nt, Shigella flexneri 2a str. 2457T
ucgagcagagaaa

SEQ ID NO: 1897456 - RNA, 16 nt, Shigella flexneri 2a str. 2457T
uccgggcuaaucguca

SEQ ID NO: 1897457 - RNA, 14 nt, Shigella flexneri 2a str. 2457T
uccgucagcggcaa

SEQ ID NO: 1897458 - RNA, 23 nt, Shigella flexneri 2a str. 2457T
uccgggaauucguucagacgcuc

SEQ ID NO: 1897459 - RNA, 23 nt, Shigella flexneri 2a str. 2457T
uccgggaacaacgcaagcggcau

SEQ ID NO: 1897460 - RNA, 23 nt, Shigella flexneri 2a str. 2457T
uccgggaaaacgcuggcagcauu

SEQ ID NO: 1897461 - RNA, 13 nt, Shigella flexneri 2a str. 2457T
uccgggcaagauc

SEQ ID NO: 1897462 - RNA, 16 nt, Shigella flexneri 2a str. 2457T
uccgucgaaagcccau

SEQ ID NO: 1897463 - RNA, 14 nt, Shigella flexneri 2a str. 2457T
uccuauuguugaua

SEQ ID NO: 1897464 - RNA, 16 nt, Shigella flexneri 2a str. 2457T
uccucaacaaucguca

SEQ ID NO: 1897465 - RNA, 20 nt, Shigella flexneri 2a str. 2457T
uccuaaaaacaguaccagac

SEQ ID NO: 1897466 - RNA, 21 nt, Shigella flexneri 2a str. 2457T
uccuaaaggcaaaaugccagc

SEQ ID NO: 1897467 - RNA, 15 nt, Shigella flexneri 2a str. 2457T
uccguuuuccagccu

SEQ ID NO: 1897468 - RNA, 14 nt, Shigella flexneri 2a str. 2457T
uccggcuuccuuaa

SEQ ID NO: 1897469 - RNA, 17 nt, Shigella flexneri 2a str. 2457T
uccggcuuuggcaaacu

SEQ ID NO: 1897470 - RNA, 20 nt, Shigella flexneri 2a str. 2457T
uccggcauaaacaaagcgca

SEQ ID NO: 1897471 - RNA, 14 nt, Shigella flexneri 2a str. 2457T
uccggcauccagcc

SEQ ID NO: 1897472 - RNA, 18 nt, Shigella flexneri 2a str. 2457T
uccggcagcagaaagcga

SEQ ID NO: 1897473 - RNA, 20 nt, Shigella flexneri 2a str. 2457T
uccggcgaaaaucccggcaa

SEQ ID NO: 1897474 - RNA, 20 nt, Shigella flexneri 2a str. 2457T
uccggcaugaacaaagcgca

SEQ ID NO: 1897475 - RNA, 19 nt, Shigella flexneri 2a str. 2457T
uccggcauuaucacaucag

SEQ ID NO: 1897476 - RNA, 21 nt, Shigella flexneri 2a str. 2457T
uccggcauuaucacaucagcg

SEQ ID NO: 1897477 - RNA, 14 nt, Shigella flexneri 2a str. 2457T
uccgccggaucgaa

SEQ ID NO: 1897478 - RNA, 19 nt, Shigella flexneri 2a str. 2457T
uccgccguacgccgggugc

SEQ ID NO: 1897479 - RNA, 16 nt, Shigella flexneri 2a str. 2457T
uccggacguucagcca

SEQ ID NO: 1897480 - RNA, 13 nt, Shigella flexneri 2a str. 2457T
uccgacagagaaa

SEQ ID NO: 1897481 - RNA, 19 nt, Shigella flexneri 2a str. 2457T
ucccggugaagcgcccugc

SEQ ID NO: 1897482 - RNA, 14 nt, Shigella flexneri 2a str. 2457T
uccgagccgcuacg

SEQ ID NO: 1897483 - RNA, 18 nt, Shigella flexneri 2a str. 2457T
uccgccagcggcggcaaa

SEQ ID NO: 1897484 - RNA, 24 nt, Shigella flexneri 2a str. 2457T
ucccgcaccagcggaaugcaguca

SEQ ID NO: 1897485 - RNA, 22 nt, Shigella flexneri 2a str. 2457T
ucccgccagaugauauggcaaa

SEQ ID NO: 1897486 - RNA, 15 nt, Shigella flexneri 2a str. 2457T
ugauucauggcauuu

SEQ ID NO: 1897487 - RNA, 13 nt, Shigella flexneri 2a str. 2457T
ugauuacuaaaug

SEQ ID NO: 1897488 - RNA, 14 nt, Shigella flexneri 2a str. 2457T
ugauucacuggcaa

SEQ ID NO: 1897489 - RNA, 14 nt, Shigella flexneri 2a str. 2457T
ugauucgcgcguuc

SEQ ID NO: 1897490 - RNA, 17 nt, Shigella flexneri 2a str. 2457T
ugauuuagcaccgacgu

SEQ ID NO: 1897491 - RNA, 16 nt, Shigella flexneri 2a str. 2457T
ugauuaccgugaauca

SEQ ID NO: 1897492 - RNA, 22 nt, Shigella flexneri 2a str. 2457T
ugauccaacaaggcaucgugau

SEQ ID NO: 1897493 - RNA, 17 nt, Shigella flexneri 2a str. 2457T
ugauccaggagcuccag

SEQ ID NO: 1897494 - RNA, 14 nt, Shigella flexneri 2a str. 2457T
ugaugcauccggca

SEQ ID NO: 1897495 - RNA, 23 nt, Shigella flexneri 2a str. 2457T
ugcacaauugccggaugcggcgu

SEQ ID NO: 1897496 - RNA, 14 nt, Shigella flexneri 2a str. 2457T
ugcaauuuuuaccg

SEQ ID NO: 1897497 - RNA, 14 nt, Shigella flexneri 2a str. 2457T
ugcacaacaaucug

SEQ ID NO: 1897498 - RNA, 22 nt, Shigella flexneri 2a str. 2457T
ugcaaucagugguguagggcag

SEQ ID NO: 1897499 - RNA, 23 nt, Shigella flexneri 2a str. 2457T
ugcaaucuguuuauuugacagcc

SEQ ID NO: 1897500 - RNA, 19 nt, Shigella flexneri 2a str. 2457T
ugcaauggaauggcuggca

SEQ ID NO: 1897501 - RNA, 18 nt, Shigella flexneri 2a str. 2457T
ugcaaugaaaaaccgugu

SEQ ID NO: 1897502 - RNA, 14 nt, Shigella flexneri 2a str. 2457T
ugcacaggcaacuu

SEQ ID NO: 1897503 - RNA, 15 nt, Shigella flexneri 2a str. 2457T
ugcacccgcuucagu

SEQ ID NO: 1897504 - RNA, 23 nt, Shigella flexneri 2a str. 2457T
ugcacaugcaacgucaucaccgg

SEQ ID NO: 1897505 - RNA, 15 nt, Shigella flexneri 2a str. 2457T
ugcaccgacaauccg

SEQ ID NO: 1897506 - RNA, 17 nt, Shigella flexneri 2a str. 2457T
ugcaagauagcgcguug

SEQ ID NO: 1897507 - RNA, 21 nt, Shigella flexneri 2a str. 2457T
ugcaacgcuuugcugauugcu

SEQ ID NO: 1897508 - RNA, 15 nt, Shigella flexneri 2a str. 2457T
ugcaagaucgcgcau

SEQ ID NO: 1897509 - RNA, 19 nt, Shigella flexneri 2a str. 2457T
ugcaacugcucguucagcg

SEQ ID NO: 1897510 - RNA, 14 nt, Shigella flexneri 2a str. 2457T
ugcaacagcaccag

SEQ ID NO: 1897511 - RNA, 22 nt, Shigella flexneri 2a str. 2457T
ugcaaaauagucaucucuuccg

SEQ ID NO: 1897512 - RNA, 19 nt, Shigella flexneri 2a str. 2457T
ugcaaaggccagccaggca

SEQ ID NO: 1897513 - RNA, 19 nt, Shigella flexneri 2a str. 2457T
ugcaaaccacgguucagcg

SEQ ID NO: 1897514 - RNA, 18 nt, Shigella flexneri 2a str. 2457T
ugcaaauuauuugcguag

SEQ ID NO: 1897515 - RNA, 16 nt, Shigella flexneri 2a str. 2457T
ugaggcguuaacagcg

SEQ ID NO: 1897516 - RNA, 21 nt, Shigella flexneri 2a str. 2457T
ugagggcaaacaggcgcuggg

SEQ ID NO: 1897517 - RNA, 16 nt, Shigella flexneri 2a str. 2457T
ugauaucgcuggcagg

SEQ ID NO: 1897518 - RNA, 22 nt, Shigella flexneri 2a str. 2457T
ugaucagcaacgccgguuccag

SEQ ID NO: 1897519 - RNA, 22 nt, Shigella flexneri 2a str. 2457T
ugauauacgucacuucaucguc

SEQ ID NO: 1897520 - RNA, 23 nt, Shigella flexneri 2a str. 2457T
ugauaggcgaggcggggccaauu

SEQ ID NO: 1897521 - RNA, 20 nt, Shigella flexneri 2a str. 2457T
ugauacugacauuaacguga

SEQ ID NO: 1897522 - RNA, 15 nt, Shigella flexneri 2a str. 2457T
ugaguaucagagaac

SEQ ID NO: 1897523 - RNA, 15 nt, Shigella flexneri 2a str. 2457T
ugagugcucaaccgu

SEQ ID NO: 1897524 - RNA, 18 nt, Shigella flexneri 2a str. 2457T
ugacguaauccgccuguu

SEQ ID NO: 1897525 - RNA, 21 nt, Shigella flexneri 2a str. 2457T
ugacgugccugugcagcgacg

SEQ ID NO: 1897526 - RNA, 19 nt, Shigella flexneri 2a str. 2457T
ugacgugccugugcagcga

SEQ ID NO: 1897527 - RNA, 23 nt, Shigella flexneri 2a str. 2457T
ugaccaguaauauccccagccua

SEQ ID NO: 1897528 - RNA, 17 nt, Shigella flexneri 2a str. 2457T
ugaccccagccaguuca

SEQ ID NO: 1897529 - RNA, 18 nt, Shigella flexneri 2a str. 2457T
ugagcaggaugccugaug

SEQ ID NO: 1897530 - RNA, 20 nt, Shigella flexneri 2a str. 2457T
ugagauaauucuguaauccu

SEQ ID NO: 1897531 - RNA, 21 nt, Shigella flexneri 2a str. 2457T
ugagaacgacagugacuuccg

SEQ ID NO: 1897532 - RNA, 18 nt, Shigella flexneri 2a str. 2457T
ugacuuccguaccggccu

SEQ ID NO: 1897533 - RNA, 14 nt, Shigella flexneri 2a str. 2457T
ugacuggcagguaa

SEQ ID NO: 1897534 - RNA, 20 nt, Shigella flexneri 2a str. 2457T
ugccagguagucacgguagu

SEQ ID NO: 1897535 - RNA, 21 nt, Shigella flexneri 2a str. 2457T
ugccagugcgguuuccacgcc

SEQ ID NO: 1897536 - RNA, 15 nt, Shigella flexneri 2a str. 2457T
ugccaccaccagcgu

SEQ ID NO: 1897537 - RNA, 20 nt, Shigella flexneri 2a str. 2457T
ugccaggacuucaucacgau

SEQ ID NO: 1897538 - RNA, 14 nt, Shigella flexneri 2a str. 2457T
ugccauauacgcca

SEQ ID NO: 1897539 - RNA, 16 nt, Shigella flexneri 2a str. 2457T
ugccaucagcgccuga

SEQ ID NO: 1897540 - RNA, 19 nt, Shigella flexneri 2a str. 2457T
ugcccccgcucuuccaggc

SEQ ID NO: 1897541 - RNA, 15 nt, Shigella flexneri 2a str. 2457T
ugcccacgccgcauu

SEQ ID NO: 1897542 - RNA, 16 nt, Shigella flexneri 2a str. 2457T
ugcccauggcaagaau

SEQ ID NO: 1897543 - RNA, 19 nt, Shigella flexneri 2a str. 2457T
ugcccaugcgcucgacgau

SEQ ID NO: 1897544 - RNA, 18 nt, Shigella flexneri 2a str. 2457T
ugcaggcuucuggcggcg

SEQ ID NO: 1897545 - RNA, 21 nt, Shigella flexneri 2a str. 2457T
ugcagugaucgugugccacca

SEQ ID NO: 1897546 - RNA, 15 nt, Shigella flexneri 2a str. 2457T
ugcaucaugaaaacc

SEQ ID NO: 1897547 - RNA, 15 nt, Shigella flexneri 2a str. 2457T
ugccaaaucuaccgu

SEQ ID NO: 1897548 - RNA, 16 nt, Shigella flexneri 2a str. 2457T
ugccaaaugcguggcg

SEQ ID NO: 1897549 - RNA, 14 nt, Shigella flexneri 2a str. 2457T
ugcauucgagccaa

SEQ ID NO: 1897550 - RNA, 23 nt, Shigella flexneri 2a str. 2457T
ugccaacgcaaacgcccguccau

SEQ ID NO: 1897551 - RNA, 21 nt, Shigella flexneri 2a str. 2457T
ugccaagcuccagcaucccgu

SEQ ID NO: 1897552 - RNA, 23 nt, Shigella flexneri 2a str. 2457T
ugcaugacuuuguaggccggaua

SEQ ID NO: 1897553 - RNA, 12 nt, Shigella flexneri 2a str. 2457T
ugcaucgccuga

SEQ ID NO: 1897554 - RNA, 16 nt, Shigella flexneri 2a str. 2457T
ugcaucgccugcgcga

SEQ ID NO: 1897555 - RNA, 14 nt, Shigella flexneri 2a str. 2457T
ugcaugauccggca

SEQ ID NO: 1897556 - RNA, 17 nt, Shigella flexneri 2a str. 2457T
ugcccguuccaggcgau

SEQ ID NO: 1897557 - RNA, 14 nt, Shigella flexneri 2a str. 2457T
ugccgagauacagg

SEQ ID NO: 1897558 - RNA, 21 nt, Shigella flexneri 2a str. 2457T
ugccgcauuucgugcggguaa

SEQ ID NO: 1897559 - RNA, 20 nt, Shigella flexneri 2a str. 2457T
ugccgcauuucgugcgggua

SEQ ID NO: 1897560 - RNA, 22 nt, Shigella flexneri 2a str. 2457T
ugccgcagccccagagccugaa

SEQ ID NO: 1897561 - RNA, 13 nt, Shigella flexneri 2a str. 2457T
ucuccacgccagu

SEQ ID NO: 1897562 - RNA, 16 nt, Shigella flexneri 2a str. 2457T
ucuccagcgaauccgu

SEQ ID NO: 1897563 - RNA, 18 nt, Shigella flexneri 2a str. 2457T
ucuccagcuccccacgau

SEQ ID NO: 1897564 - RNA, 18 nt, Shigella flexneri 2a str. 2457T
ucuaugucgcauccggca

SEQ ID NO: 1897565 - RNA, 23 nt, Shigella flexneri 2a str. 2457T
ucuaugccagcuuucaccugcgc

SEQ ID NO: 1897566 - RNA, 19 nt, Shigella flexneri 2a str. 2457T
ucuaacagaucauccaucg

SEQ ID NO: 1897567 - RNA, 12 nt, Shigella flexneri 2a str. 2457T
ucguucgccguu

SEQ ID NO: 1897568 - RNA, 22 nt, Shigella flexneri 2a str. 2457T
ucguucaaacgauucggcaauc

SEQ ID NO: 1897569 - RNA, 23 nt, Shigella flexneri 2a str. 2457T
ucguucacaugagagaaaaucac

SEQ ID NO: 1897570 - RNA, 17 nt, Shigella flexneri 2a str. 2457T
ucguuugcauccagcuc

SEQ ID NO: 1897571 - RNA, 17 nt, Shigella flexneri 2a str. 2457T
ucgugcucgacagcgcu

SEQ ID NO: 1897572 - RNA, 22 nt, Shigella flexneri 2a str. 2457T
ucgugcguuuguaggccggaua

SEQ ID NO: 1897573 - RNA, 19 nt, Shigella flexneri 2a str. 2457T
ucgugcgucgcauccggca

SEQ ID NO: 1897574 - RNA, 13 nt, Shigella flexneri 2a str. 2457T
ucgugaucguggu

SEQ ID NO: 1897575 - RNA, 20 nt, Shigella flexneri 2a str. 2457T
ucggugcacaauugccggau

SEQ ID NO: 1897576 - RNA, 18 nt, Shigella flexneri 2a str. 2457T
ucggugcucaucagcccg

SEQ ID NO: 1897577 - RNA, 13 nt, Shigella flexneri 2a str. 2457T
ucgguaacgcuug

SEQ ID NO: 1897578 - RNA, 18 nt, Shigella flexneri 2a str. 2457T
ucggugaacgccugcgac

SEQ ID NO: 1897579 - RNA, 18 nt, Shigella flexneri 2a str. 2457T
ucguaagcgccaggaauu

SEQ ID NO: 1897580 - RNA, 23 nt, Shigella flexneri 2a str. 2457T
ucguacgcuuuugaggauuaugc

SEQ ID NO: 1897581 - RNA, 13 nt, Shigella flexneri 2a str. 2457T
ucgucauccgcca

SEQ ID NO: 1897582 - RNA, 19 nt, Shigella flexneri 2a str. 2457T
ucugcguuagaaaacgccu

SEQ ID NO: 1897583 - RNA, 14 nt, Shigella flexneri 2a str. 2457T
ucugcguucugauu

SEQ ID NO: 1897584 - RNA, 19 nt, Shigella flexneri 2a str. 2457T
ucugcggguuagucugcau

SEQ ID NO: 1897585 - RNA, 17 nt, Shigella flexneri 2a str. 2457T
ucugucgauaaacucau

SEQ ID NO: 1897586 - RNA, 20 nt, Shigella flexneri 2a str. 2457T
aauacguaaugucggugaaa

SEQ ID NO: 1897587 - RNA, 22 nt, Shigella flexneri 2a str. 2457T
ucuggguggugauuuucgccgc

SEQ ID NO: 1897588 - RNA, 22 nt, Shigella flexneri 2a str. 2457T
ucugucaguuggcugugguacu

SEQ ID NO: 1897589 - RNA, 13 nt, Shigella flexneri 2a str. 2457T
ucuucuucgcugc

SEQ ID NO: 1897590 - RNA, 21 nt, Shigella flexneri 2a str. 2457T
ucuguuuucguaauaauucac

SEQ ID NO: 1897591 - RNA, 11 nt, Shigella flexneri 2a str. 2457T
ucuuccggcag

SEQ ID NO: 1897592 - RNA, 22 nt, Shigella flexneri 2a str. 2457T
ucuuccucacacccuugccaga

SEQ ID NO: 1897593 - RNA, 18 nt, Shigella flexneri 2a str. 2457T
ugaaaauaacaucgccag

SEQ ID NO: 1897594 - RNA, 13 nt, Shigella flexneri 2a str. 2457T
ugaaaaucaccau

SEQ ID NO: 1897595 - RNA, 13 nt, Shigella flexneri 2a str. 2457T
ugaaaaugcuggu

SEQ ID NO: 1897596 - RNA, 14 nt, Shigella flexneri 2a str. 2457T
ugaaaaaacuggcu

SEQ ID NO: 1897597 - RNA, 15 nt, Shigella flexneri 2a str. 2457T
ucuuuuuaaugacuu

SEQ ID NO: 1897598 - RNA, 16 nt, Shigella flexneri 2a str. 2457T
ucuuugcccgcagauc

SEQ ID NO: 1897599 - RNA, 15 nt, Shigella flexneri 2a str. 2457T
ucuuuacugauaauu

SEQ ID NO: 1897600 - RNA, 16 nt, Shigella flexneri 2a str. 2457T
ucuuuaucugccggac

SEQ ID NO: 1897601 - RNA, 13 nt, Shigella flexneri 2a str. 2457T
ugaauaaugacua

SEQ ID NO: 1897602 - RNA, 18 nt, Shigella flexneri 2a str. 2457T
ugaauaacaccagccaga

SEQ ID NO: 1897603 - RNA, 23 nt, Shigella flexneri 2a str. 2457T
ugaaguuauaagcguuacgcagc

SEQ ID NO: 1897604 - RNA, 16 nt, Shigella flexneri 2a str. 2457T
ugaauauuuuagccgc

SEQ ID NO: 1897605 - RNA, 19 nt, Shigella flexneri 2a str. 2457T
ugaauagugccacaccagc

SEQ ID NO: 1897606 - RNA, 20 nt, Shigella flexneri 2a str. 2457T
ugaagccuucgccuuucagu

SEQ ID NO: 1897607 - RNA, 23 nt, Shigella flexneri 2a str. 2457T
ugaagguguaauggauaaacacu

SEQ ID NO: 1897608 - RNA, 15 nt, Shigella flexneri 2a str. 2457T
ugaaggcuaaugcug

SEQ ID NO: 1897609 - RNA, 13 nt, Shigella flexneri 2a str. 2457T
ugaagauuagccg

SEQ ID NO: 1897610 - RNA, 21 nt, Shigella flexneri 2a str. 2457T
ugaagcaguuucaccagcagu

SEQ ID NO: 1897611 - RNA, 23 nt, Shigella flexneri 2a str. 2457T
ugaagaagcggaaaucacgcauc

SEQ ID NO: 1897612 - RNA, 13 nt, Shigella flexneri 2a str. 2457T
ugaacuucggccu

SEQ ID NO: 1897613 - RNA, 20 nt, Shigella flexneri 2a str. 2457T
ugaacgccuuauccggccua

SEQ ID NO: 1897614 - RNA, 20 nt, Shigella flexneri 2a str. 2457T
ugaacgccuuauccggucua

SEQ ID NO: 1897615 - RNA, 14 nt, Shigella flexneri 2a str. 2457T
ugaacggcaaacgc

SEQ ID NO: 1897616 - RNA, 21 nt, Shigella flexneri 2a str. 2457T
ugaacgcuggcggcaggccua

SEQ ID NO: 1897617 - RNA, 19 nt, Shigella flexneri 2a str. 2457T
ugaacgcguuauccggcua

SEQ ID NO: 1897618 - RNA, 23 nt, Shigella flexneri 2a str. 2457T
ugaccagaucuucaucaccgaug

SEQ ID NO: 1897619 - RNA, 13 nt, Shigella flexneri 2a str. 2457T
ugaccagcuccag

SEQ ID NO: 1897620 - RNA, 18 nt, Shigella flexneri 2a str. 2457T
ugacauaguagccagcca

SEQ ID NO: 1897621 - RNA, 18 nt, Shigella flexneri 2a str. 2457T
ugacauaaacaccagcaa

SEQ ID NO: 1897622 - RNA, 22 nt, Shigella flexneri 2a str. 2457T
ugacagaccguugcucagaauc

SEQ ID NO: 1897623 - RNA, 12 nt, Shigella flexneri 2a str. 2457T
ugacagcccggc

SEQ ID NO: 1897624 - RNA, 13 nt, Shigella flexneri 2a str. 2457T
ugacaucgcagca

SEQ ID NO: 1897625 - RNA, 15 nt, Shigella flexneri 2a str. 2457T
ugacaucgugcuggu

SEQ ID NO: 1897626 - RNA, 22 nt, Shigella flexneri 2a str. 2457T
ugaaucggcggcggcaguugcc

SEQ ID NO: 1897627 - RNA, 16 nt, Shigella flexneri 2a str. 2457T
ugaaucgucagacgau

SEQ ID NO: 1897628 - RNA, 13 nt, Shigella flexneri 2a str. 2457T
ugaaugccggaug

SEQ ID NO: 1897629 - RNA, 12 nt, Shigella flexneri 2a str. 2457T
ugaaugaggcuu

SEQ ID NO: 1897630 - RNA, 16 nt, Shigella flexneri 2a str. 2457T
ugaaucuuuucaucgc

SEQ ID NO: 1897631 - RNA, 19 nt, Shigella flexneri 2a str. 2457T
ugaaugccggaugcggcgu

SEQ ID NO: 1897632 - RNA, 22 nt, Shigella flexneri 2a str. 2457T
ugacacuucauuaaccacgauc

SEQ ID NO: 1897633 - RNA, 23 nt, Shigella flexneri 2a str. 2457T
ugacaaaucagaggcuguuccgg

SEQ ID NO: 1897634 - RNA, 19 nt, Shigella flexneri 2a str. 2457T
ugacaacauuuugcggcua

SEQ ID NO: 1897635 - RNA, 21 nt, Shigella flexneri 2a str. 2457T
ugacaauaauugucaacggca

SEQ ID NO: 1897636 - RNA, 17 nt, Shigella flexneri 2a str. 2457T
ugacaaucgcugcggca

SEQ ID NO: 1897637 - RNA, 18 nt, Shigella flexneri 2a str. 2457T
agcugcgcaucaugccac

SEQ ID NO: 1897638 - RNA, 14 nt, Shigella flexneri 2a str. 2457T
agcugccgccaggc

SEQ ID NO: 1897639 - RNA, 19 nt, Shigella flexneri 2a str. 2457T
agcugccgaaccacugaug

SEQ ID NO: 1897640 - RNA, 16 nt, Shigella flexneri 2a str. 2457T
agcugccaguugucgg

SEQ ID NO: 1897641 - RNA, 13 nt, Shigella flexneri 2a str. 2457T
agcugccaguugu

SEQ ID NO: 1897642 - RNA, 22 nt, Shigella flexneri 2a str. 2457T
agcucauccagcguuucgugaa

SEQ ID NO: 1897643 - RNA, 16 nt, Shigella flexneri 2a str. 2457T
agcucgaccgcugccg

SEQ ID NO: 1897644 - RNA, 19 nt, Shigella flexneri 2a str. 2457T
agcucaguuaacggcauaa

SEQ ID NO: 1897645 - RNA, 15 nt, Shigella flexneri 2a str. 2457T
agcuaccacgccgau

SEQ ID NO: 1897646 - RNA, 22 nt, Shigella flexneri 2a str. 2457T
agcguuuuuucaucggcaguuu

SEQ ID NO: 1897647 - RNA, 23 nt, Shigella flexneri 2a str. 2457T
agcguaucccagugcggcaucgc

SEQ ID NO: 1897648 - RNA, 14 nt, Shigella flexneri 2a str. 2457T
agcguauucagcaa

SEQ ID NO: 1897649 - RNA, 17 nt, Shigella flexneri 2a str. 2457T
agcguaauugauccgcg

SEQ ID NO: 1897650 - RNA, 20 nt, Shigella flexneri 2a str. 2457T
agcguaaaggcggcagaaca

SEQ ID NO: 1897651 - RNA, 15 nt, Shigella flexneri 2a str. 2457T
agcguuaccagcaaa

SEQ ID NO: 1897652 - RNA, 13 nt, Shigella flexneri 2a str. 2457T
agcguuaccggcu

SEQ ID NO: 1897653 - RNA, 16 nt, Shigella flexneri 2a str. 2457T
agcguuauagcgcaug

SEQ ID NO: 1897654 - RNA, 17 nt, Shigella flexneri 2a str. 2457T
agcguucaaaacggcug

SEQ ID NO: 1897655 - RNA, 22 nt, Shigella flexneri 2a str. 2457T
agcguuuccagcaccaguucac

SEQ ID NO: 1897656 - RNA, 15 nt, Shigella flexneri 2a str. 2457T
agcgucccacgaccg

SEQ ID NO: 1897657 - RNA, 17 nt, Shigella flexneri 2a str. 2457T
agcgucagcuuucagag

SEQ ID NO: 1897658 - RNA, 20 nt, Shigella flexneri 2a str. 2457T
agcgucggcgucaucgacau

SEQ ID NO: 1897659 - RNA, 21 nt, Shigella flexneri 2a str. 2457T
agcggcgggcuuuaaucaccc

SEQ ID NO: 1897660 - RNA, 15 nt, Shigella flexneri 2a str. 2457T
agcggccgucagauc

SEQ ID NO: 1897661 - RNA, 21 nt, Shigella flexneri 2a str. 2457T
agcgggcagacaaaacauacc

SEQ ID NO: 1897662 - RNA, 15 nt, Shigella flexneri 2a str. 2457T
agcggcguuugcucc

SEQ ID NO: 1897663 - RNA, 23 nt, Shigella flexneri 2a str. 2457T
agcgcugcugcacauacugcauc

SEQ ID NO: 1897664 - RNA, 20 nt, Shigella flexneri 2a str. 2457T
agcggaaacguaacguacug

SEQ ID NO: 1897665 - RNA, 21 nt, Shigella flexneri 2a str. 2457T
agcuggugaacauuuuaaccg

SEQ ID NO: 1897666 - RNA, 20 nt, Shigella flexneri 2a str. 2457T
agcuucaaauagugccuggc

SEQ ID NO: 1897667 - RNA, 14 nt, Shigella flexneri 2a str. 2457T
agcuuacgcugaua

SEQ ID NO: 1897668 - RNA, 12 nt, Shigella flexneri 2a str. 2457T
agcuuucaacgc

SEQ ID NO: 1897669 - RNA, 12 nt, Shigella flexneri 2a str. 2457T
aggaauccgggu

SEQ ID NO: 1897670 - RNA, 19 nt, Shigella flexneri 2a str. 2457T
aggaaucacguaggccuga

SEQ ID NO: 1897671 - RNA, 20 nt, Shigella flexneri 2a str. 2457T
aggaaucacguaggccugau

SEQ ID NO: 1897672 - RNA, 17 nt, Shigella flexneri 2a str. 2457T
aggaaucugauuacuuc

SEQ ID NO: 1897673 - RNA, 19 nt, Shigella flexneri 2a str. 2457T
agcuuuuguaggccugaua

SEQ ID NO: 1897674 - RNA, 18 nt, Shigella flexneri 2a str. 2457T
agcuuucgaccagccagg

SEQ ID NO: 1897675 - RNA, 20 nt, Shigella flexneri 2a str. 2457T
aggaaagcagccacacguua

SEQ ID NO: 1897676 - RNA, 19 nt, Shigella flexneri 2a str. 2457T
aggaaccuccauguccagc

SEQ ID NO: 1897677 - RNA, 22 nt, Shigella flexneri 2a str. 2457T
aggaacaucugaguugccauca

SEQ ID NO: 1897678 - RNA, 21 nt, Shigella flexneri 2a str. 2457T
aggaaauacguaggccugaua

SEQ ID NO: 1897679 - RNA, 14 nt, Shigella flexneri 2a str. 2457T
aggagauaaaccga

SEQ ID NO: 1897680 - RNA, 20 nt, Shigella flexneri 2a str. 2457T
aaacguaaaacugccugaug

SEQ ID NO: 1897681 - RNA, 22 nt, Shigella flexneri 2a str. 2457T
aaacgugacagcauaccuucac

SEQ ID NO: 1897682 - RNA, 12 nt, Shigella flexneri 2a str. 2457T
aaacgugccauu

SEQ ID NO: 1897683 - RNA, 20 nt, Shigella flexneri 2a str. 2457T
aaacguucaucgggcauugc

SEQ ID NO: 1897684 - RNA, 16 nt, Shigella flexneri 2a str. 2457T
aaacguuaugcaccga

SEQ ID NO: 1897685 - RNA, 17 nt, Shigella flexneri 2a str. 2457T
aggagccaucaccaucg

SEQ ID NO: 1897686 - RNA, 14 nt, Shigella flexneri 2a str. 2457T
aggaguucgucaac

SEQ ID NO: 1897687 - RNA, 21 nt, Shigella flexneri 2a str. 2457T
aaacguugcgcggugagcguu

SEQ ID NO: 1897688 - RNA, 22 nt, Shigella flexneri 2a str. 2457T
aggaucuuugccagaucgccug

SEQ ID NO: 1897689 - RNA, 21 nt, Shigella flexneri 2a str. 2457T
aggaugcgggucaggccagga

SEQ ID NO: 1897690 - RNA, 16 nt, Shigella flexneri 2a str. 2457T
aggccaaucagcaaua

SEQ ID NO: 1897691 - RNA, 21 nt, Shigella flexneri 2a str. 2457T
aggccaaccgucagauccgcc

SEQ ID NO: 1897692 - RNA, 18 nt, Shigella flexneri 2a str. 2457T
aggcaauuggcgcaucau

SEQ ID NO: 1897693 - RNA, 17 nt, Shigella flexneri 2a str. 2457T
aggcauucucgccgugg

SEQ ID NO: 1897694 - RNA, 18 nt, Shigella flexneri 2a str. 2457T
agauuacgcucugacgac

SEQ ID NO: 1897695 - RNA, 17 nt, Shigella flexneri 2a str. 2457T
agauuaaucagcagaua

SEQ ID NO: 1897696 - RNA, 18 nt, Shigella flexneri 2a str. 2457T
agauuaaaggcaccaaua

SEQ ID NO: 1897697 - RNA, 20 nt, Shigella flexneri 2a str. 2457T
agauuucaaucuggccugag

SEQ ID NO: 1897698 - RNA, 23 nt, Shigella flexneri 2a str. 2457T
agauucgguaaccauccauucag

SEQ ID NO: 1897699 - RNA, 19 nt, Shigella flexneri 2a str. 2457T
agauuuaugacaaacgcaa

SEQ ID NO: 1897700 - RNA, 13 nt, Shigella flexneri 2a str. 2457T
agcauaauaagcu

SEQ ID NO: 1897701 - RNA, 16 nt, Shigella flexneri 2a str. 2457T
agcaguucugccaggc

SEQ ID NO: 1897702 - RNA, 21 nt, Shigella flexneri 2a str. 2457T
agcagcugcucccagcgcauu

SEQ ID NO: 1897703 - RNA, 21 nt, Shigella flexneri 2a str. 2457T
agccaguuuacccagcgaauc

SEQ ID NO: 1897704 - RNA, 17 nt, Shigella flexneri 2a str. 2457T
agccagugauuaacgcg

SEQ ID NO: 1897705 - RNA, 16 nt, Shigella flexneri 2a str. 2457T
agccagcggcggcaca

SEQ ID NO: 1897706 - RNA, 19 nt, Shigella flexneri 2a str. 2457T
agccacggcuccagcaaug

SEQ ID NO: 1897707 - RNA, 13 nt, Shigella flexneri 2a str. 2457T
agccaaaaugccu

SEQ ID NO: 1897708 - RNA, 21 nt, Shigella flexneri 2a str. 2457T
agccaaagggcuggcaaugac

SEQ ID NO: 1897709 - RNA, 13 nt, Shigella flexneri 2a str. 2457T
agcauuucgcgau

SEQ ID NO: 1897710 - RNA, 22 nt, Shigella flexneri 2a str. 2457T
agccaaaucccgugaugcgguc

SEQ ID NO: 1897711 - RNA, 16 nt, Shigella flexneri 2a str. 2457T
agcaugcaucccgccg

SEQ ID NO: 1897712 - RNA, 18 nt, Shigella flexneri 2a str. 2457T
agcaugggugaacugcuu

SEQ ID NO: 1897713 - RNA, 15 nt, Shigella flexneri 2a str. 2457T
agcccugaacgacgu

SEQ ID NO: 1897714 - RNA, 19 nt, Shigella flexneri 2a str. 2457T
aaacgccacauccggccua

SEQ ID NO: 1897715 - RNA, 23 nt, Shigella flexneri 2a str. 2457T
agccgcgcuuucuucuucgcgac

SEQ ID NO: 1897716 - RNA, 17 nt, Shigella flexneri 2a str. 2457T
agccgcuuuuucugcgc

SEQ ID NO: 1897717 - RNA, 23 nt, Shigella flexneri 2a str. 2457T
agccgcuucugcagcuuuaacga

SEQ ID NO: 1897718 - RNA, 18 nt, Shigella flexneri 2a str. 2457T
agccgucgagggccugaa

SEQ ID NO: 1897719 - RNA, 14 nt, Shigella flexneri 2a str. 2457T
agcgaaaucgccuu

SEQ ID NO: 1897720 - RNA, 14 nt, Shigella flexneri 2a str. 2457T
agccuuuccggcaa

SEQ ID NO: 1897721 - RNA, 21 nt, Shigella flexneri 2a str. 2457T
agccugaacuaaagccuuuug

SEQ ID NO: 1897722 - RNA, 14 nt, Shigella flexneri 2a str. 2457T
agccugcucaguug

SEQ ID NO: 1897723 - RNA, 22 nt, Shigella flexneri 2a str. 2457T
agcgccaccacaaaagcgguga

SEQ ID NO: 1897724 - RNA, 12 nt, Shigella flexneri 2a str. 2457T
agcgccaacggu

SEQ ID NO: 1897725 - RNA, 16 nt, Shigella flexneri 2a str. 2457T
agcgcauuuccaagau

SEQ ID NO: 1897726 - RNA, 18 nt, Shigella flexneri 2a str. 2457T
agcgcccgccagcaccgg

SEQ ID NO: 1897727 - RNA, 22 nt, Shigella flexneri 2a str. 2457T
agcgccauuucuucuccggcau

SEQ ID NO: 1897728 - RNA, 23 nt, Shigella flexneri 2a str. 2457T
agcgaucauguaccguugcugcc

SEQ ID NO: 1897729 - RNA, 23 nt, Shigella flexneri 2a str. 2457T
agcgauacauacugagaaccuuu

SEQ ID NO: 1897730 - RNA, 16 nt, Shigella flexneri 2a str. 2457T
agcgaugagagaucga

SEQ ID NO: 1897731 - RNA, 18 nt, Shigella flexneri 2a str. 2457T
agcgauggguuaacauca

SEQ ID NO: 1897732 - RNA, 13 nt, Shigella flexneri 2a str. 2457T
agcgaccgcuuca

SEQ ID NO: 1897733 - RNA, 14 nt, Shigella flexneri 2a str. 2457T
agcgacuugggcga

SEQ ID NO: 1897734 - RNA, 14 nt, Shigella flexneri 2a str. 2457T
auccccguaucuuc

SEQ ID NO: 1897735 - RNA, 19 nt, Shigella flexneri 2a str. 2457T
aucccagucacgcaacaug

SEQ ID NO: 1897736 - RNA, 16 nt, Shigella flexneri 2a str. 2457T
aucccagugcggcauc

SEQ ID NO: 1897737 - RNA, 21 nt, Shigella flexneri 2a str. 2457T
aucccauuacguccagcgauu

SEQ ID NO: 1897738 - RNA, 16 nt, Shigella flexneri 2a str. 2457T
auccauucaucgccuu

SEQ ID NO: 1897739 - RNA, 23 nt, Shigella flexneri 2a str. 2457T
auccaugauauuggcaucgccag

SEQ ID NO: 1897740 - RNA, 14 nt, Shigella flexneri 2a str. 2457T
auccauaucgccau

SEQ ID NO: 1897741 - RNA, 18 nt, Shigella flexneri 2a str. 2457T
auccauacccggcguuac

SEQ ID NO: 1897742 - RNA, 21 nt, Shigella flexneri 2a str. 2457T
aucccgcgauaugccggcauc

SEQ ID NO: 1897743 - RNA, 21 nt, Shigella flexneri 2a str. 2457T
auccaacccgcgaauaucagc

SEQ ID NO: 1897744 - RNA, 17 nt, Shigella flexneri 2a str. 2457T
aucaugguaucgggcag

SEQ ID NO: 1897745 - RNA, 19 nt, Shigella flexneri 2a str. 2457T
aucauuaaaguuaucgccg

SEQ ID NO: 1897746 - RNA, 21 nt, Shigella flexneri 2a str. 2457T
auccagcuuuuuaaucgccau

SEQ ID NO: 1897747 - RNA, 21 nt, Shigella flexneri 2a str. 2457T
auccaggaagggcauaucagc

SEQ ID NO: 1897748 - RNA, 22 nt, Shigella flexneri 2a str. 2457T
auccaggcagauuuuuuaacug

SEQ ID NO: 1897749 - RNA, 23 nt, Shigella flexneri 2a str. 2457T
auccacuuuuggcccgacgauga

SEQ ID NO: 1897750 - RNA, 23 nt, Shigella flexneri 2a str. 2457T
auccagcacggugaagaagcgga

SEQ ID NO: 1897751 - RNA, 21 nt, Shigella flexneri 2a str. 2457T
auccugaauaacuggcgcgac

SEQ ID NO: 1897752 - RNA, 23 nt, Shigella flexneri 2a str. 2457T
auccugaauaacuggcgcgacaa

SEQ ID NO: 1897753 - RNA, 12 nt, Shigella flexneri 2a str. 2457T
auccugccgcag

SEQ ID NO: 1897754 - RNA, 13 nt, Shigella flexneri 2a str. 2457T
auccugccgcagu

SEQ ID NO: 1897755 - RNA, 19 nt, Shigella flexneri 2a str. 2457T
auccugcgcuuccugcaac

SEQ ID NO: 1897756 - RNA, 21 nt, Shigella flexneri 2a str. 2457T
auccugcugcacgcccugaua

SEQ ID NO: 1897757 - RNA, 23 nt, Shigella flexneri 2a str. 2457T
auccgguagguucaacaaagcgc

SEQ ID NO: 1897758 - RNA, 16 nt, Shigella flexneri 2a str. 2457T
auccguuuuacuggga

SEQ ID NO: 1897759 - RNA, 20 nt, Shigella flexneri 2a str. 2457T
auccuaaaggcaaaaugcca

SEQ ID NO: 1897760 - RNA, 16 nt, Shigella flexneri 2a str. 2457T
auccggcaaguuguau

SEQ ID NO: 1897761 - RNA, 22 nt, Shigella flexneri 2a str. 2457T
auccgcucccuggcccaucgcc

SEQ ID NO: 1897762 - RNA, 13 nt, Shigella flexneri 2a str. 2457T
auccgcgcugaug

SEQ ID NO: 1897763 - RNA, 23 nt, Shigella flexneri 2a str. 2457T
auccggccuacaaauucaauaaa

SEQ ID NO: 1897764 - RNA, 22 nt, Shigella flexneri 2a str. 2457T
auccggcaauuggugcacgaug

SEQ ID NO: 1897765 - RNA, 21 nt, Shigella flexneri 2a str. 2457T
auccggcauucagugcaaaug

SEQ ID NO: 1897766 - RNA, 20 nt, Shigella flexneri 2a str. 2457T
auccggcauuuuacgcauua

SEQ ID NO: 1897767 - RNA, 20 nt, Shigella flexneri 2a str. 2457T
auccggcaucaacaaagugc

SEQ ID NO: 1897768 - RNA, 22 nt, Shigella flexneri 2a str. 2457T
auccggcaucaacaaagugcac

SEQ ID NO: 1897769 - RNA, 20 nt, Shigella flexneri 2a str. 2457T
auccggcaugaacaaagcgc

SEQ ID NO: 1897770 - RNA, 20 nt, Shigella flexneri 2a str. 2457T
auccggcauaaacaaagcgc

SEQ ID NO: 1897771 - RNA, 20 nt, Shigella flexneri 2a str. 2457T
auccggcauaaacaaagugc

SEQ ID NO: 1897772 - RNA, 22 nt, Shigella flexneri 2a str. 2457T
auccggcauaaacaaagugcac

SEQ ID NO: 1897773 - RNA, 20 nt, Shigella flexneri 2a str. 2457T
auccggcauaaacuaagcgc

SEQ ID NO: 1897774 - RNA, 15 nt, Shigella flexneri 2a str. 2457T
auccgcgacuggcau

SEQ ID NO: 1897775 - RNA, 15 nt, Shigella flexneri 2a str. 2457T
auccgcaucacucca

SEQ ID NO: 1897776 - RNA, 15 nt, Shigella flexneri 2a str. 2457T
auccgaagaaccaca

SEQ ID NO: 1897777 - RNA, 19 nt, Shigella flexneri 2a str. 2457T
aucagcgugaccaguugcu

SEQ ID NO: 1897778 - RNA, 22 nt, Shigella flexneri 2a str. 2457T
aucagucuagcccgauggcauc

SEQ ID NO: 1897779 - RNA, 22 nt, Shigella flexneri 2a str. 2457T
aucaguugauuaugaucgccac

SEQ ID NO: 1897780 - RNA, 20 nt, Shigella flexneri 2a str. 2457T
aucagucugagccugccauu

SEQ ID NO: 1897781 - RNA, 15 nt, Shigella flexneri 2a str. 2457T
aucaucacgcaucac

SEQ ID NO: 1897782 - RNA, 17 nt, Shigella flexneri 2a str. 2457T
aucaucgagaucgauac

SEQ ID NO: 1897783 - RNA, 16 nt, Shigella flexneri 2a str. 2457T
aucauccauccggcug

SEQ ID NO: 1897784 - RNA, 14 nt, Shigella flexneri 2a str. 2457T
aucaucaucgccag

SEQ ID NO: 1897785 - RNA, 15 nt, Shigella flexneri 2a str. 2457T
aucaugcacuccgcu

SEQ ID NO: 1897786 - RNA, 19 nt, Shigella flexneri 2a str. 2457T
aucaugccggccagcgcca

SEQ ID NO: 1897787 - RNA, 21 nt, Shigella flexneri 2a str. 2457T
aucaugccugaugcgacgcuu

SEQ ID NO: 1897788 - RNA, 16 nt, Shigella flexneri 2a str. 2457T
aucaucuauccggcau

SEQ ID NO: 1897789 - RNA, 14 nt, Shigella flexneri 2a str. 2457T
aucaucuuccggua

SEQ ID NO: 1897790 - RNA, 18 nt, Shigella flexneri 2a str. 2457T
aucagaccuucgcuauca

SEQ ID NO: 1897791 - RNA, 15 nt, Shigella flexneri 2a str. 2457T
aucagcauccgcacg

SEQ ID NO: 1897792 - RNA, 22 nt, Shigella flexneri 2a str. 2457T
aucagcccaaagcagaguugcu

SEQ ID NO: 1897793 - RNA, 21 nt, Shigella flexneri 2a str. 2457T
aucacgcgguuacgcaccggu

SEQ ID NO: 1897794 - RNA, 18 nt, Shigella flexneri 2a str. 2457T
aucacuuugcgcucgcug

SEQ ID NO: 1897795 - RNA, 13 nt, Shigella flexneri 2a str. 2457T
aucacuuucagac

SEQ ID NO: 1897796 - RNA, 19 nt, Shigella flexneri 2a str. 2457T
aucaccguuuaggcgucac

SEQ ID NO: 1897797 - RNA, 11 nt, Shigella flexneri 2a str. 2457T
aucacgaugca

SEQ ID NO: 1897798 - RNA, 19 nt, Shigella flexneri 2a str. 2457T
aucaccuccagcgaaggau

SEQ ID NO: 1897799 - RNA, 14 nt, Shigella flexneri 2a str. 2457T
aucaauauccaccg

SEQ ID NO: 1897800 - RNA, 16 nt, Shigella flexneri 2a str. 2457T
aucaaucaccgcuuca

SEQ ID NO: 1897801 - RNA, 22 nt, Shigella flexneri 2a str. 2457T
aucaauaacagcgcaaucaccg

SEQ ID NO: 1897802 - RNA, 12 nt, Shigella flexneri 2a str. 2457T
auauuuuaccgu

SEQ ID NO: 1897803 - RNA, 20 nt, Shigella flexneri 2a str. 2457T
auauuuugggaucggugcag

SEQ ID NO: 1897804 - RNA, 13 nt, Shigella flexneri 2a str. 2457T
aucaaaaucauau

SEQ ID NO: 1897805 - RNA, 17 nt, Shigella flexneri 2a str. 2457T
aucaacgccaucgccag

SEQ ID NO: 1897806 - RNA, 15 nt, Shigella flexneri 2a str. 2457T
aucaacgcuggcaug

SEQ ID NO: 1897807 - RNA, 15 nt, Shigella flexneri 2a str. 2457T
aucaacgacagccug

SEQ ID NO: 1897808 - RNA, 18 nt, Shigella flexneri 2a str. 2457T
auauugccgcgauagcaa

SEQ ID NO: 1897809 - RNA, 14 nt, Shigella flexneri 2a str. 2457T
auauccgcgcuaag

SEQ ID NO: 1897810 - RNA, 21 nt, Shigella flexneri 2a str. 2457T
auauccauagucacuaccugu

SEQ ID NO: 1897811 - RNA, 19 nt, Shigella flexneri 2a str. 2457T
auaugcaccuuugucacuu

SEQ ID NO: 1897812 - RNA, 13 nt, Shigella flexneri 2a str. 2457T
auaucaauaguaa

SEQ ID NO: 1897813 - RNA, 13 nt, Shigella flexneri 2a str. 2457T
auauccagcgaua

SEQ ID NO: 1897814 - RNA, 18 nt, Shigella flexneri 2a str. 2457T
auauccaccgcguucagc

SEQ ID NO: 1897815 - RNA, 16 nt, Shigella flexneri 2a str. 2457T
auaguagccagccaga

SEQ ID NO: 1897816 - RNA, 21 nt, Shigella flexneri 2a str. 2457T
auaccaccggaauugugguga

SEQ ID NO: 1897817 - RNA, 21 nt, Shigella flexneri 2a str. 2457T
auacccccaguaaaugacagc

SEQ ID NO: 1897818 - RNA, 17 nt, Shigella flexneri 2a str. 2457T
auagcgucccaguaacg

SEQ ID NO: 1897819 - RNA, 16 nt, Shigella flexneri 2a str. 2457T
auagcgggaaauacug

SEQ ID NO: 1897820 - RNA, 16 nt, Shigella flexneri 2a str. 2457T
auaauugccagcuugc

SEQ ID NO: 1897821 - RNA, 18 nt, Shigella flexneri 2a str. 2457T
auaauuacuucgccggaa

SEQ ID NO: 1897822 - RNA, 20 nt, Shigella flexneri 2a str. 2457T
auaauuccugcgcugcguag

SEQ ID NO: 1897823 - RNA, 13 nt, Shigella flexneri 2a str. 2457T
auaauucuguaau

SEQ ID NO: 1897824 - RNA, 17 nt, Shigella flexneri 2a str. 2457T
auaaugggcgcgggcga

SEQ ID NO: 1897825 - RNA, 14 nt, Shigella flexneri 2a str. 2457T
auaaugaugucauc

SEQ ID NO: 1897826 - RNA, 16 nt, Shigella flexneri 2a str. 2457T
auaaucguaaucagca

SEQ ID NO: 1897827 - RNA, 16 nt, Shigella flexneri 2a str. 2457T
auaaucgaucgcguaa

SEQ ID NO: 1897828 - RNA, 17 nt, Shigella flexneri 2a str. 2457T
auaauccaucacuucau

SEQ ID NO: 1897829 - RNA, 14 nt, Shigella flexneri 2a str. 2457T
auaaggcgcaauaa

SEQ ID NO: 1897830 - RNA, 16 nt, Shigella flexneri 2a str. 2457T
auaagcguuacgcagc

SEQ ID NO: 1897831 - RNA, 17 nt, Shigella flexneri 2a str. 2457T
auaagcguuacgcagca

SEQ ID NO: 1897832 - RNA, 16 nt, Shigella flexneri 2a str. 2457T
aguugcuccagcaaua

SEQ ID NO: 1897833 - RNA, 16 nt, Shigella flexneri 2a str. 2457T
aguucacgcagcuucu

SEQ ID NO: 1897834 - RNA, 15 nt, Shigella flexneri 2a str. 2457T
aguuauaacgacgaa

SEQ ID NO: 1897835 - RNA, 22 nt, Shigella flexneri 2a str. 2457T
aguuauuacaaucccgcuuaca

SEQ ID NO: 1897836 - RNA, 16 nt, Shigella flexneri 2a str. 2457T
auaaauaagaugcgag

SEQ ID NO: 1897837 - RNA, 18 nt, Shigella flexneri 2a str. 2457T
auaaacccaacggcaaac

SEQ ID NO: 1897838 - RNA, 13 nt, Shigella flexneri 2a str. 2457T
auaaacaccagca

SEQ ID NO: 1897839 - RNA, 13 nt, Shigella flexneri 2a str. 2457T
auaaaauuaacga

SEQ ID NO: 1897840 - RNA, 20 nt, Shigella flexneri 2a str. 2457T
auaaaauguacaugucgcug

SEQ ID NO: 1897841 - RNA, 12 nt, Shigella flexneri 2a str. 2457T
auaaacaacgag

SEQ ID NO: 1897842 - RNA, 14 nt, Shigella flexneri 2a str. 2457T
agucgucaccauua

SEQ ID NO: 1897843 - RNA, 13 nt, Shigella flexneri 2a str. 2457T
aguuaccuguggc

SEQ ID NO: 1897844 - RNA, 17 nt, Shigella flexneri 2a str. 2457T
aguguuauucccaacgc

SEQ ID NO: 1897845 - RNA, 17 nt, Shigella flexneri 2a str. 2457T
aguguguauacggcaac

SEQ ID NO: 1897846 - RNA, 23 nt, Shigella flexneri 2a str. 2457T
agugccgcauccugcaccacgac

SEQ ID NO: 1897847 - RNA, 21 nt, Shigella flexneri 2a str. 2457T
agugccggauaugaaauccgg

SEQ ID NO: 1897848 - RNA, 17 nt, Shigella flexneri 2a str. 2457T
aguggcgcagagccuga

SEQ ID NO: 1897849 - RNA, 15 nt, Shigella flexneri 2a str. 2457T
agugccguuccagcc

SEQ ID NO: 1897850 - RNA, 13 nt, Shigella flexneri 2a str. 2457T
aguggcgcagagc

SEQ ID NO: 1897851 - RNA, 23 nt, Shigella flexneri 2a str. 2457T
agucgcgguccgggccgcaaacc

SEQ ID NO: 1897852 - RNA, 12 nt, Shigella flexneri 2a str. 2457T
aguccguugaaa

SEQ ID NO: 1897853 - RNA, 12 nt, Shigella flexneri 2a str. 2457T
agucauaucagc

SEQ ID NO: 1897854 - RNA, 20 nt, Shigella flexneri 2a str. 2457T
agucaguuaucgcauuauca

SEQ ID NO: 1897855 - RNA, 16 nt, Shigella flexneri 2a str. 2457T
aguccaggcugcaaag

SEQ ID NO: 1897856 - RNA, 12 nt, Shigella flexneri 2a str. 2457T
agguuaaugcug

SEQ ID NO: 1897857 - RNA, 15 nt, Shigella flexneri 2a str. 2457T
agguacgcuccagca

SEQ ID NO: 1897858 - RNA, 13 nt, Shigella flexneri 2a str. 2457T
agguacaaagcca

SEQ ID NO: 1897859 - RNA, 19 nt, Shigella flexneri 2a str. 2457T
agguagaacccuaccagcu

SEQ ID NO: 1897860 - RNA, 22 nt, Shigella flexneri 2a str. 2457T
agguagacaccaaggaacugug

SEQ ID NO: 1897861 - RNA, 20 nt, Shigella flexneri 2a str. 2457T
aggucuccgcccagcguacg

SEQ ID NO: 1897862 - RNA, 19 nt, Shigella flexneri 2a str. 2457T
aggcugcgaguccuguugu

SEQ ID NO: 1897863 - RNA, 18 nt, Shigella flexneri 2a str. 2457T
aggcguucacgccgcauc

SEQ ID NO: 1897864 - RNA, 20 nt, Shigella flexneri 2a str. 2457T
aggcguucacgacgcauccg

SEQ ID NO: 1897865 - RNA, 18 nt, Shigella flexneri 2a str. 2457T
aggcguuaacgccgcauc

SEQ ID NO: 1897866 - RNA, 19 nt, Shigella flexneri 2a str. 2457T
aggcuggaucagacgcagc

SEQ ID NO: 1897867 - RNA, 14 nt, Shigella flexneri 2a str. 2457T
aggcuucgacgcuc

SEQ ID NO: 1897868 - RNA, 16 nt, Shigella flexneri 2a str. 2457T
aggcuucgacgcucag

SEQ ID NO: 1897869 - RNA, 13 nt, Shigella flexneri 2a str. 2457T
aggcuucaggugc

SEQ ID NO: 1897870 - RNA, 17 nt, Shigella flexneri 2a str. 2457T
aggcuuuccugauaauc

SEQ ID NO: 1897871 - RNA, 22 nt, Shigella flexneri 2a str. 2457T
agggcaccggcguaacgccacg

SEQ ID NO: 1897872 - RNA, 13 nt, Shigella flexneri 2a str. 2457T
agguaaaaccuga

SEQ ID NO: 1897873 - RNA, 13 nt, Shigella flexneri 2a str. 2457T
aggguugccggau

SEQ ID NO: 1897874 - RNA, 23 nt, Shigella flexneri 2a str. 2457T
auuaaucgauaaaccagcaacca

SEQ ID NO: 1897875 - RNA, 18 nt, Shigella flexneri 2a str. 2457T
augucggaugcggcguga

SEQ ID NO: 1897876 - RNA, 22 nt, Shigella flexneri 2a str. 2457T
auuaaugcgcuuuuacggcuuu

SEQ ID NO: 1897877 - RNA, 12 nt, Shigella flexneri 2a str. 2457T
auuacagcucau

SEQ ID NO: 1897878 - RNA, 23 nt, Shigella flexneri 2a str. 2457T
auuacccugcacguuggcgcaua

SEQ ID NO: 1897879 - RNA, 14 nt, Shigella flexneri 2a str. 2457T
auuaugaucgccac

SEQ ID NO: 1897880 - RNA, 12 nt, Shigella flexneri 2a str. 2457T
auucacauuuaa

SEQ ID NO: 1897881 - RNA, 15 nt, Shigella flexneri 2a str. 2457T
auuauggaucaccau

SEQ ID NO: 1897882 - RNA, 16 nt, Shigella flexneri 2a str. 2457T
auuacgccgagcgcca

SEQ ID NO: 1897883 - RNA, 21 nt, Shigella flexneri 2a str. 2457T
auuacgcucggcaaagcgcug

SEQ ID NO: 1897884 - RNA, 19 nt, Shigella flexneri 2a str. 2457T
auuaccguuaaaaccaucg

SEQ ID NO: 1897885 - RNA, 18 nt, Shigella flexneri 2a str. 2457T
auuaccgcaccaccagca

SEQ ID NO: 1897886 - RNA, 21 nt, Shigella flexneri 2a str. 2457T
auuacgucuuuacuaaacggu

SEQ ID NO: 1897887 - RNA, 15 nt, Shigella flexneri 2a str. 2457T
aaacuaaucgacagu

SEQ ID NO: 1897888 - RNA, 16 nt, Shigella flexneri 2a str. 2457T
auucccgccagcggcc

SEQ ID NO: 1897889 - RNA, 14 nt, Shigella flexneri 2a str. 2457T
aaacuacaggcaac

SEQ ID NO: 1897890 - RNA, 22 nt, Shigella flexneri 2a str. 2457T
auucccauuuauuuuuccucca

SEQ ID NO: 1897891 - RNA, 17 nt, Shigella flexneri 2a str. 2457T
auucauuuauguucagc

SEQ ID NO: 1897892 - RNA, 14 nt, Shigella flexneri 2a str. 2457T
auucagguggcagu

SEQ ID NO: 1897893 - RNA, 16 nt, Shigella flexneri 2a str. 2457T
aaacugagccaaacgc

SEQ ID NO: 1897894 - RNA, 22 nt, Shigella flexneri 2a str. 2457T
auucccugcagucaccugcccu

SEQ ID NO: 1897895 - RNA, 15 nt, Shigella flexneri 2a str. 2457T
auuccgcaccugcca

SEQ ID NO: 1897896 - RNA, 19 nt, Shigella flexneri 2a str. 2457T
auucccugcgccagcggca

SEQ ID NO: 1897897 - RNA, 22 nt, Shigella flexneri 2a str. 2457T
auuccgcaccugccagcgccga

SEQ ID NO: 1897898 - RNA, 13 nt, Shigella flexneri 2a str. 2457T
aaacucugcggca

SEQ ID NO: 1897899 - RNA, 22 nt, Shigella flexneri 2a str. 2457T
aaacuccagcccuuuugacgcg

SEQ ID NO: 1897900 - RNA, 23 nt, Shigella flexneri 2a str. 2457T
aaacucgcguaaauccagcggca

SEQ ID NO: 1897901 - RNA, 22 nt, Shigella flexneri 2a str. 2457T
auucgccagaccuaccaucucc

SEQ ID NO: 1897902 - RNA, 14 nt, Shigella flexneri 2a str. 2457T
auuucgcuaccacc

SEQ ID NO: 1897903 - RNA, 18 nt, Shigella flexneri 2a str. 2457T
auuucgccacccagcgcc

SEQ ID NO: 1897904 - RNA, 15 nt, Shigella flexneri 2a str. 2457T
auuucgaagaaaccg

SEQ ID NO: 1897905 - RNA, 21 nt, Shigella flexneri 2a str. 2457T
auuucggcagcgcgcucgcca

SEQ ID NO: 1897906 - RNA, 13 nt, Shigella flexneri 2a str. 2457T
auuucaucgccag

SEQ ID NO: 1897907 - RNA, 12 nt, Shigella flexneri 2a str. 2457T
auuuacacuuca

SEQ ID NO: 1897908 - RNA, 22 nt, Shigella flexneri 2a str. 2457T
auugugcucacuacggcucagu

SEQ ID NO: 1897909 - RNA, 17 nt, Shigella flexneri 2a str. 2457T
auuuaugaggaugcaga

SEQ ID NO: 1897910 - RNA, 23 nt, Shigella flexneri 2a str. 2457T
auugccauauacgccaucgccag

SEQ ID NO: 1897911 - RNA, 21 nt, Shigella flexneri 2a str. 2457T
auugcgcacaagcuaccagcc

SEQ ID NO: 1897912 - RNA, 16 nt, Shigella flexneri 2a str. 2457T
auugccgaugaacggc

SEQ ID NO: 1897913 - RNA, 15 nt, Shigella flexneri 2a str. 2457T
auugccgcagcgauu

SEQ ID NO: 1897914 - RNA, 15 nt, Shigella flexneri 2a str. 2457T
auucgugacaauauc

SEQ ID NO: 1897915 - RNA, 15 nt, Shigella flexneri 2a str. 2457T
auugucagcuggugg

SEQ ID NO: 1897916 - RNA, 19 nt, Shigella flexneri 2a str. 2457T
auugucagcugguggcgua

SEQ ID NO: 1897917 - RNA, 18 nt, Shigella flexneri 2a str. 2457T
auugucauagcgacuacc

SEQ ID NO: 1897918 - RNA, 20 nt, Shigella flexneri 2a str. 2457T
auugucauucgccugacgca

SEQ ID NO: 1897919 - RNA, 21 nt, Shigella flexneri 2a str. 2457T
auugucuaugaacacgaucuc

SEQ ID NO: 1897920 - RNA, 17 nt, Shigella flexneri 2a str. 2457T
auugucgccacaaacgc

SEQ ID NO: 1897921 - RNA, 16 nt, Shigella flexneri 2a str. 2457T
auugucuccgcugaga

SEQ ID NO: 1897922 - RNA, 21 nt, Shigella flexneri 2a str. 2457T
auugugcgcgauccggcggug

SEQ ID NO: 1897923 - RNA, 16 nt, Shigella flexneri 2a str. 2457T
auugcggaacggcagc

SEQ ID NO: 1897924 - RNA, 22 nt, Shigella flexneri 2a str. 2457T
auugcggcggcgcaaagcgacg

SEQ ID NO: 1897925 - RNA, 13 nt, Shigella flexneri 2a str. 2457T
auuggcaucgcca

SEQ ID NO: 1897926 - RNA, 14 nt, Shigella flexneri 2a str. 2457T
auuggcaucgccag

SEQ ID NO: 1897927 - RNA, 22 nt, Shigella flexneri 2a str. 2457T
auuggcgaagaacgcauugcca

SEQ ID NO: 1897928 - RNA, 23 nt, Shigella flexneri 2a str. 2457T
auuuucaaaauaucgacauucaa

SEQ ID NO: 1897929 - RNA, 18 nt, Shigella flexneri 2a str. 2457T
auuuucaccagcaucgcc

SEQ ID NO: 1897930 - RNA, 16 nt, Shigella flexneri 2a str. 2457T
auuugugcacgugcca

SEQ ID NO: 1897931 - RNA, 16 nt, Shigella flexneri 2a str. 2457T
auuuguaggccggaua

SEQ ID NO: 1897932 - RNA, 20 nt, Shigella flexneri 2a str. 2457T
auuugcuucaauacgcucca

SEQ ID NO: 1897933 - RNA, 13 nt, Shigella flexneri 2a str. 2457T
auuucuuuauccg

SEQ ID NO: 1897934 - RNA, 21 nt, Shigella flexneri 2a str. 2457T
auuugaaaugugguuucacuu

SEQ ID NO: 1897935 - RNA, 20 nt, Shigella flexneri 2a str. 2457T
auuuugcugaugcagcgaug

SEQ ID NO: 1897936 - RNA, 13 nt, Shigella flexneri 2a str. 2457T
auuuugccaguua

SEQ ID NO: 1897937 - RNA, 17 nt, Shigella flexneri 2a str. 2457T
auuuugcagaucgccaa

SEQ ID NO: 1897938 - RNA, 20 nt, Shigella flexneri 2a str. 2457T
auuuugcaucguccacuuga

SEQ ID NO: 1897939 - RNA, 16 nt, Shigella flexneri 2a str. 2457T
auuuuugacuagugau

SEQ ID NO: 1897940 - RNA, 17 nt, Shigella flexneri 2a str. 2457T
caaaaaaacuugauacu

SEQ ID NO: 1897941 - RNA, 12 nt, Shigella flexneri 2a str. 2457T
caaaucgcggca

SEQ ID NO: 1897942 - RNA, 22 nt, Shigella flexneri 2a str. 2457T
caaauuacuggcggcaaaacug

SEQ ID NO: 1897943 - RNA, 17 nt, Shigella flexneri 2a str. 2457T
caaauucuucacggaaa

SEQ ID NO: 1897944 - RNA, 19 nt, Shigella flexneri 2a str. 2457T
caaauucuuuaucgauaaa

SEQ ID NO: 1897945 - RNA, 12 nt, Shigella flexneri 2a str. 2457T
caacaauggcau

SEQ ID NO: 1897946 - RNA, 16 nt, Shigella flexneri 2a str. 2457T
caacagaaacgccauc

SEQ ID NO: 1897947 - RNA, 21 nt, Shigella flexneri 2a str. 2457T
caaagacgacuuuaugcgucu

SEQ ID NO: 1897948 - RNA, 14 nt, Shigella flexneri 2a str. 2457T
caaagcacgccagg

SEQ ID NO: 1897949 - RNA, 18 nt, Shigella flexneri 2a str. 2457T
caaagcugucaccaauca

SEQ ID NO: 1897950 - RNA, 22 nt, Shigella flexneri 2a str. 2457T
caaaucaccauauucagcagca

SEQ ID NO: 1897951 - RNA, 14 nt, Shigella flexneri 2a str. 2457T
caaauccggccagc

SEQ ID NO: 1897952 - RNA, 18 nt, Shigella flexneri 2a str. 2457T
caaauccggccagcgccg

SEQ ID NO: 1897953 - RNA, 23 nt, Shigella flexneri 2a str. 2457T
caaaggcuuugacuaacacuuca

SEQ ID NO: 1897954 - RNA, 18 nt, Shigella flexneri 2a str. 2457T
caaacuuaugcugcgcca

SEQ ID NO: 1897955 - RNA, 23 nt, Shigella flexneri 2a str. 2457T
caaacucgcgcaggcugacauua

SEQ ID NO: 1897956 - RNA, 12 nt, Shigella flexneri 2a str. 2457T
caaacugcugau

SEQ ID NO: 1897957 - RNA, 17 nt, Shigella flexneri 2a str. 2457T
caaacugcucguucagc

SEQ ID NO: 1897958 - RNA, 18 nt, Shigella flexneri 2a str. 2457T
caaacucgcgcaggcuga

SEQ ID NO: 1897959 - RNA, 16 nt, Shigella flexneri 2a str. 2457T
caaacucaauuaccaa

SEQ ID NO: 1897960 - RNA, 22 nt, Shigella flexneri 2a str. 2457T
caaacggaucgcguaaggcuuc

SEQ ID NO: 1897961 - RNA, 14 nt, Shigella flexneri 2a str. 2457T
caaacgguugauaa

SEQ ID NO: 1897962 - RNA, 20 nt, Shigella flexneri 2a str. 2457T
caaacguaaaacugccugau

SEQ ID NO: 1897963 - RNA, 16 nt, Shigella flexneri 2a str. 2457T
caaacgcccguccauc

SEQ ID NO: 1897964 - RNA, 18 nt, Shigella flexneri 2a str. 2457T
caaaccagaugaauagcg

SEQ ID NO: 1897965 - RNA, 16 nt, Shigella flexneri 2a str. 2457T
caaaccaacgcugucc

SEQ ID NO: 1897966 - RNA, 14 nt, Shigella flexneri 2a str. 2457T
caaaagguccuuca

SEQ ID NO: 1897967 - RNA, 20 nt, Shigella flexneri 2a str. 2457T
caaaauagccaaucauuccc

SEQ ID NO: 1897968 - RNA, 21 nt, Shigella flexneri 2a str. 2457T
caaaaugcugcaauugcggca

SEQ ID NO: 1897969 - RNA, 22 nt, Shigella flexneri 2a str. 2457T
caaaaugguggagauaaacucc

SEQ ID NO: 1897970 - RNA, 20 nt, Shigella flexneri 2a str. 2457T
caaacacaaaacugccugau

SEQ ID NO: 1897971 - RNA, 15 nt, Shigella flexneri 2a str. 2457T
caaacaccagcgaau

SEQ ID NO: 1897972 - RNA, 21 nt, Shigella flexneri 2a str. 2457T
caaacacgccgacgggucagc

SEQ ID NO: 1897973 - RNA, 15 nt, Shigella flexneri 2a str. 2457T
caaacaaaagggcga

SEQ ID NO: 1897974 - RNA, 19 nt, Shigella flexneri 2a str. 2457T
caaacacuugcggcaccca

SEQ ID NO: 1897975 - RNA, 11 nt, Shigella flexneri 2a str. 2457T
caaacaggcug

SEQ ID NO: 1897976 - RNA, 15 nt, Shigella flexneri 2a str. 2457T
caaacagcgccagau

SEQ ID NO: 1897977 - RNA, 14 nt, Shigella flexneri 2a str. 2457T
augacaucuccagc

SEQ ID NO: 1897978 - RNA, 12 nt, Shigella flexneri 2a str. 2457T
augaccacucau

SEQ ID NO: 1897979 - RNA, 21 nt, Shigella flexneri 2a str. 2457T
augaccuuucaguuugccgcu

SEQ ID NO: 1897980 - RNA, 16 nt, Shigella flexneri 2a str. 2457T
augaccuuccagcgcc

SEQ ID NO: 1897981 - RNA, 22 nt, Shigella flexneri 2a str. 2457T
augaagccuaccgggaugcuga

SEQ ID NO: 1897982 - RNA, 16 nt, Shigella flexneri 2a str. 2457T
augaagucugccguug

SEQ ID NO: 1897983 - RNA, 15 nt, Shigella flexneri 2a str. 2457T
augaagucugccguu

SEQ ID NO: 1897984 - RNA, 18 nt, Shigella flexneri 2a str. 2457T
augaaaagucauccggcg

SEQ ID NO: 1897985 - RNA, 21 nt, Shigella flexneri 2a str. 2457T
aucuuuaaaaaaagcauuuaa

SEQ ID NO: 1897986 - RNA, 15 nt, Shigella flexneri 2a str. 2457T
aucuucuugcagcuu

SEQ ID NO: 1897987 - RNA, 23 nt, Shigella flexneri 2a str. 2457T
aucuugauaccaaaauggcgcag

SEQ ID NO: 1897988 - RNA, 14 nt, Shigella flexneri 2a str. 2457T
augcacagaaccgg

SEQ ID NO: 1897989 - RNA, 21 nt, Shigella flexneri 2a str. 2457T
augcacgauauaccgugcuga

SEQ ID NO: 1897990 - RNA, 17 nt, Shigella flexneri 2a str. 2457T
augcaccuucaacuugc

SEQ ID NO: 1897991 - RNA, 20 nt, Shigella flexneri 2a str. 2457T
augcacgcagugguuaacaa

SEQ ID NO: 1897992 - RNA, 13 nt, Shigella flexneri 2a str. 2457T
augcagauaaucg

SEQ ID NO: 1897993 - RNA, 14 nt, Shigella flexneri 2a str. 2457T
augcaucggcauaa

SEQ ID NO: 1897994 - RNA, 17 nt, Shigella flexneri 2a str. 2457T
augcaucagaucggcag

SEQ ID NO: 1897995 - RNA, 14 nt, Shigella flexneri 2a str. 2457T
augcauaaugcagc

SEQ ID NO: 1897996 - RNA, 15 nt, Shigella flexneri 2a str. 2457T
augcagugcauccag

SEQ ID NO: 1897997 - RNA, 20 nt, Shigella flexneri 2a str. 2457T
augacuuuguacuuggccgu

SEQ ID NO: 1897998 - RNA, 19 nt, Shigella flexneri 2a str. 2457T
augagauauuucagagcuu

SEQ ID NO: 1897999 - RNA, 13 nt, Shigella flexneri 2a str. 2457T
augagcgcaaaug

SEQ ID NO: 1898000 - RNA, 14 nt, Shigella flexneri 2a str. 2457T
augauugccugaug

SEQ ID NO: 1898001 - RNA, 21 nt, Shigella flexneri 2a str. 2457T
augauuuuuuugaugccguug

SEQ ID NO: 1898002 - RNA, 14 nt, Shigella flexneri 2a str. 2457T
aucgggcaguuuac

SEQ ID NO: 1898003 - RNA, 22 nt, Shigella flexneri 2a str. 2457T
aucgggcuauuuuuauugugcc

SEQ ID NO: 1898004 - RNA, 20 nt, Shigella flexneri 2a str. 2457T
aucggucagaucggcaagug

SEQ ID NO: 1898005 - RNA, 14 nt, Shigella flexneri 2a str. 2457T
aucggucgaugaaa

SEQ ID NO: 1898006 - RNA, 23 nt, Shigella flexneri 2a str. 2457T
aucgaacaugcgggucuuacugg

SEQ ID NO: 1898007 - RNA, 14 nt, Shigella flexneri 2a str. 2457T
aucguaauacccuu

SEQ ID NO: 1898008 - RNA, 13 nt, Shigella flexneri 2a str. 2457T
aucggugcaaaug

SEQ ID NO: 1898009 - RNA, 16 nt, Shigella flexneri 2a str. 2457T
aucggugcaaaugcca

SEQ ID NO: 1898010 - RNA, 14 nt, Shigella flexneri 2a str. 2457T
aucguauccggcau

SEQ ID NO: 1898011 - RNA, 15 nt, Shigella flexneri 2a str. 2457T
aucguauccggcauu

SEQ ID NO: 1898012 - RNA, 22 nt, Shigella flexneri 2a str. 2457T
aucgucgcccgaugcauaaucc

SEQ ID NO: 1898013 - RNA, 17 nt, Shigella flexneri 2a str. 2457T
aucgucggaauggcauc

SEQ ID NO: 1898014 - RNA, 14 nt, Shigella flexneri 2a str. 2457T
aucuccgcuggagc

SEQ ID NO: 1898015 - RNA, 13 nt, Shigella flexneri 2a str. 2457T
aucucauccauca

SEQ ID NO: 1898016 - RNA, 20 nt, Shigella flexneri 2a str. 2457T
aucguggccaugaccgccgc

SEQ ID NO: 1898017 - RNA, 19 nt, Shigella flexneri 2a str. 2457T
aucguggccaugaccgccg

SEQ ID NO: 1898018 - RNA, 21 nt, Shigella flexneri 2a str. 2457T
aucugaguugccaucaucacc

SEQ ID NO: 1898019 - RNA, 19 nt, Shigella flexneri 2a str. 2457T
aucucuggcacgagaucgu

SEQ ID NO: 1898020 - RNA, 15 nt, Shigella flexneri 2a str. 2457T
aucucugcgcuaucc

SEQ ID NO: 1898021 - RNA, 22 nt, Shigella flexneri 2a str. 2457T
aucucugcgcuauccagcgcau

SEQ ID NO: 1898022 - RNA, 14 nt, Shigella flexneri 2a str. 2457T
aucucucgcaucag

SEQ ID NO: 1898023 - RNA, 19 nt, Shigella flexneri 2a str. 2457T
aucuggcaagccugaaaac

SEQ ID NO: 1898024 - RNA, 17 nt, Shigella flexneri 2a str. 2457T
aucugauuugucggcag

SEQ ID NO: 1898025 - RNA, 16 nt, Shigella flexneri 2a str. 2457T
auggcauccgccacuu

SEQ ID NO: 1898026 - RNA, 17 nt, Shigella flexneri 2a str. 2457T
auggcagaguaucgcca

SEQ ID NO: 1898027 - RNA, 23 nt, Shigella flexneri 2a str. 2457T
auggcgcaggauaucguggcacg

SEQ ID NO: 1898028 - RNA, 15 nt, Shigella flexneri 2a str. 2457T
auggauuagcgaccg

SEQ ID NO: 1898029 - RNA, 16 nt, Shigella flexneri 2a str. 2457T
auggauuagcgaccga

SEQ ID NO: 1898030 - RNA, 23 nt, Shigella flexneri 2a str. 2457T
auggauuaucgacugcgcccuga

SEQ ID NO: 1898031 - RNA, 18 nt, Shigella flexneri 2a str. 2457T
augcuggaaccacagcgc

SEQ ID NO: 1898032 - RNA, 14 nt, Shigella flexneri 2a str. 2457T
augcuggaaccaca

SEQ ID NO: 1898033 - RNA, 21 nt, Shigella flexneri 2a str. 2457T
augcucuccguaggccagaua

SEQ ID NO: 1898034 - RNA, 15 nt, Shigella flexneri 2a str. 2457T
auggucagcgccagg

SEQ ID NO: 1898035 - RNA, 20 nt, Shigella flexneri 2a str. 2457T
auggucaguacgccgccguu

SEQ ID NO: 1898036 - RNA, 19 nt, Shigella flexneri 2a str. 2457T
augguguuuuccaccguga

SEQ ID NO: 1898037 - RNA, 17 nt, Shigella flexneri 2a str. 2457T
augguuucauuccagua

SEQ ID NO: 1898038 - RNA, 17 nt, Shigella flexneri 2a str. 2457T
augguuguaauccaccu

SEQ ID NO: 1898039 - RNA, 18 nt, Shigella flexneri 2a str. 2457T
auggcggcuaggacgcac

SEQ ID NO: 1898040 - RNA, 24 nt, Shigella flexneri 2a str. 2457T
auggcggcggcuuuuacgagcauc

SEQ ID NO: 1898041 - RNA, 20 nt, Shigella flexneri 2a str. 2457T
augggcgaauaaaaagccua

SEQ ID NO: 1898042 - RNA, 16 nt, Shigella flexneri 2a str. 2457T
auggguauauuugcca

SEQ ID NO: 1898043 - RNA, 15 nt, Shigella flexneri 2a str. 2457T
augguagccgcccug

SEQ ID NO: 1898044 - RNA, 17 nt, Shigella flexneri 2a str. 2457T
augccaucugccagcaa

SEQ ID NO: 1898045 - RNA, 21 nt, Shigella flexneri 2a str. 2457T
augcccaacaggcgcugguca

SEQ ID NO: 1898046 - RNA, 19 nt, Shigella flexneri 2a str. 2457T
augccccauugcaacgugg

SEQ ID NO: 1898047 - RNA, 20 nt, Shigella flexneri 2a str. 2457T
augcccauucaccgacguga

SEQ ID NO: 1898048 - RNA, 20 nt, Shigella flexneri 2a str. 2457T
augccacgacguuuuccauc

SEQ ID NO: 1898049 - RNA, 21 nt, Shigella flexneri 2a str. 2457T
augccacgacguuuuccaucg

SEQ ID NO: 1898050 - RNA, 22 nt, Shigella flexneri 2a str. 2457T
augccagaugcgacgcugacgc

SEQ ID NO: 1898051 - RNA, 19 nt, Shigella flexneri 2a str. 2457T
augcccgauaagcaaaaug

SEQ ID NO: 1898052 - RNA, 16 nt, Shigella flexneri 2a str. 2457T
augcccgaugaccuug

SEQ ID NO: 1898053 - RNA, 20 nt, Shigella flexneri 2a str. 2457T
augccgccgaggauacagcc

SEQ ID NO: 1898054 - RNA, 16 nt, Shigella flexneri 2a str. 2457T
augcuccgcaccccug

SEQ ID NO: 1898055 - RNA, 17 nt, Shigella flexneri 2a str. 2457T
augcggcguaaaugccu

SEQ ID NO: 1898056 - RNA, 16 nt, Shigella flexneri 2a str. 2457T
augcggcguuaacgcc

SEQ ID NO: 1898057 - RNA, 16 nt, Shigella flexneri 2a str. 2457T
augcggcgacuggaua

SEQ ID NO: 1898058 - RNA, 12 nt, Shigella flexneri 2a str. 2457T
augcgcgucaga

SEQ ID NO: 1898059 - RNA, 21 nt, Shigella flexneri 2a str. 2457T
augcgccagguaacgaagaug

SEQ ID NO: 1898060 - RNA, 23 nt, Shigella flexneri 2a str. 2457T
augccggagucgcauuaacagcc

SEQ ID NO: 1898061 - RNA, 22 nt, Shigella flexneri 2a str. 2457T
augccggaugcgccagcauccg

SEQ ID NO: 1898062 - RNA, 15 nt, Shigella flexneri 2a str. 2457T
augccggaugcggcg

SEQ ID NO: 1898063 - RNA, 18 nt, Shigella flexneri 2a str. 2457T
augccggaugcggcguaa

SEQ ID NO: 1898064 - RNA, 23 nt, Shigella flexneri 2a str. 2457T
augccuguccucuucagcaucaa

SEQ ID NO: 1898065 - RNA, 17 nt, Shigella flexneri 2a str. 2457T
caaguuuuuaggcauga

SEQ ID NO: 1898066 - RNA, 22 nt, Shigella flexneri 2a str. 2457T
caagucucaagagugaacacgu

SEQ ID NO: 1898067 - RNA, 20 nt, Shigella flexneri 2a str. 2457T
caagucgugaaaucugaaau

SEQ ID NO: 1898068 - RNA, 15 nt, Shigella flexneri 2a str. 2457T
caauaauacccagca

SEQ ID NO: 1898069 - RNA, 19 nt, Shigella flexneri 2a str. 2457T
caauaauggaaccuaacgc

SEQ ID NO: 1898070 - RNA, 21 nt, Shigella flexneri 2a str. 2457T
caauaaugaugucaucaagcg

SEQ ID NO: 1898071 - RNA, 19 nt, Shigella flexneri 2a str. 2457T
caauaauauuacuucgcgu

SEQ ID NO: 1898072 - RNA, 18 nt, Shigella flexneri 2a str. 2457T
caauaaauuccccgcagg

SEQ ID NO: 1898073 - RNA, 12 nt, Shigella flexneri 2a str. 2457T
caauaacgcuuu

SEQ ID NO: 1898074 - RNA, 15 nt, Shigella flexneri 2a str. 2457T
caagcgccgccaguc

SEQ ID NO: 1898075 - RNA, 21 nt, Shigella flexneri 2a str. 2457T
caagcgucgcaucaggcauuu

SEQ ID NO: 1898076 - RNA, 14 nt, Shigella flexneri 2a str. 2457T
caagguauccagac

SEQ ID NO: 1898077 - RNA, 14 nt, Shigella flexneri 2a str. 2457T
caacagcaucaucg

SEQ ID NO: 1898078 - RNA, 18 nt, Shigella flexneri 2a str. 2457T
caacuccacuucaccgcg

SEQ ID NO: 1898079 - RNA, 15 nt, Shigella flexneri 2a str. 2457T
caacuccaucaagcu

SEQ ID NO: 1898080 - RNA, 13 nt, Shigella flexneri 2a str. 2457T
caacucgcguucu

SEQ ID NO: 1898081 - RNA, 18 nt, Shigella flexneri 2a str. 2457T
caacuucgauugcgugau

SEQ ID NO: 1898082 - RNA, 23 nt, Shigella flexneri 2a str. 2457T
caacuucgaguacauccacugca

SEQ ID NO: 1898083 - RNA, 19 nt, Shigella flexneri 2a str. 2457T
caagaaucucuucuucgcu

SEQ ID NO: 1898084 - RNA, 18 nt, Shigella flexneri 2a str. 2457T
caagcaggacgcccggua

SEQ ID NO: 1898085 - RNA, 21 nt, Shigella flexneri 2a str. 2457T
caagccaucguuaauuaacgc

SEQ ID NO: 1898086 - RNA, 18 nt, Shigella flexneri 2a str. 2457T
cacaaucauccuaccgcc

SEQ ID NO: 1898087 - RNA, 16 nt, Shigella flexneri 2a str. 2457T
cacaaugucauggcag

SEQ ID NO: 1898088 - RNA, 18 nt, Shigella flexneri 2a str. 2457T
cacacauuauaggccuga

SEQ ID NO: 1898089 - RNA, 22 nt, Shigella flexneri 2a str. 2457T
cacaagcgauaacucgcuuugc

SEQ ID NO: 1898090 - RNA, 23 nt, Shigella flexneri 2a str. 2457T
cacaacuucgcgaacacccgacg

SEQ ID NO: 1898091 - RNA, 22 nt, Shigella flexneri 2a str. 2457T
cacaaucccuuaguaacgccag

SEQ ID NO: 1898092 - RNA, 16 nt, Shigella flexneri 2a str. 2457T
cacaaucagccagaac

SEQ ID NO: 1898093 - RNA, 23 nt, Shigella flexneri 2a str. 2457T
caauugcggcaggucaucgugcg

SEQ ID NO: 1898094 - RNA, 20 nt, Shigella flexneri 2a str. 2457T
caaugugcuccauuguuagc

SEQ ID NO: 1898095 - RNA, 22 nt, Shigella flexneri 2a str. 2457T
caauguaaggugcaucggggaa

SEQ ID NO: 1898096 - RNA, 22 nt, Shigella flexneri 2a str. 2457T
caauuucuucugguuucaguaa

SEQ ID NO: 1898097 - RNA, 16 nt, Shigella flexneri 2a str. 2457T
caauuugcccaccggu

SEQ ID NO: 1898098 - RNA, 16 nt, Shigella flexneri 2a str. 2457T
cacaaccccggcaaau

SEQ ID NO: 1898099 - RNA, 15 nt, Shigella flexneri 2a str. 2457T
caaucgccagcggca

SEQ ID NO: 1898100 - RNA, 18 nt, Shigella flexneri 2a str. 2457T
caauccccgccagcacga

SEQ ID NO: 1898101 - RNA, 16 nt, Shigella flexneri 2a str. 2457T
caauccccucuucagc

SEQ ID NO: 1898102 - RNA, 15 nt, Shigella flexneri 2a str. 2457T
caaucgcauagccag

SEQ ID NO: 1898103 - RNA, 13 nt, Shigella flexneri 2a str. 2457T
caaucgcggcgau

SEQ ID NO: 1898104 - RNA, 19 nt, Shigella flexneri 2a str. 2457T
caaucaucuuguaggccug

SEQ ID NO: 1898105 - RNA, 18 nt, Shigella flexneri 2a str. 2457T
caauccaguacaugaagc

SEQ ID NO: 1898106 - RNA, 12 nt, Shigella flexneri 2a str. 2457T
caauacauagaa

SEQ ID NO: 1898107 - RNA, 17 nt, Shigella flexneri 2a str. 2457T
caauaauuucaacaggu

SEQ ID NO: 1898108 - RNA, 16 nt, Shigella flexneri 2a str. 2457T
caaucagcgcagcacc

SEQ ID NO: 1898109 - RNA, 18 nt, Shigella flexneri 2a str. 2457T
caauacgauuaacgccag

SEQ ID NO: 1898110 - RNA, 17 nt, Shigella flexneri 2a str. 2457T
caauaccgcccagacca

SEQ ID NO: 1898111 - RNA, 23 nt, Shigella flexneri 2a str. 2457T
caauaccgucugcgccgagggaa

SEQ ID NO: 1898112 - RNA, 14 nt, Shigella flexneri 2a str. 2457T
caaucgcugcggca

SEQ ID NO: 1898113 - RNA, 16 nt, Shigella flexneri 2a str. 2457T
caaucgguaacgcuug

SEQ ID NO: 1898114 - RNA, 19 nt, Shigella flexneri 2a str. 2457T
caaugaaacgcaaauacug

SEQ ID NO: 1898115 - RNA, 22 nt, Shigella flexneri 2a str. 2457T
caaucgguaacgcuuguacggc

SEQ ID NO: 1898116 - RNA, 13 nt, Shigella flexneri 2a str. 2457T
caaugacgggcuu

SEQ ID NO: 1898117 - RNA, 22 nt, Shigella flexneri 2a str. 2457T
caaugcgcuguuuagcgcggca

SEQ ID NO: 1898118 - RNA, 13 nt, Shigella flexneri 2a str. 2457T
caauggguaacgg

SEQ ID NO: 1898119 - RNA, 20 nt, Shigella flexneri 2a str. 2457T
caccaucccgguaucaugug

SEQ ID NO: 1898120 - RNA, 23 nt, Shigella flexneri 2a str. 2457T
caccagugcaggcaccagccccu

SEQ ID NO: 1898121 - RNA, 22 nt, Shigella flexneri 2a str. 2457T
caccaggaacgcgccaagauag

SEQ ID NO: 1898122 - RNA, 21 nt, Shigella flexneri 2a str. 2457T
caccaguaaauugucgccgga

SEQ ID NO: 1898123 - RNA, 18 nt, Shigella flexneri 2a str. 2457T
cacccaccgcagcccaga

SEQ ID NO: 1898124 - RNA, 19 nt, Shigella flexneri 2a str. 2457T
cacccacgguuacgcuacc

SEQ ID NO: 1898125 - RNA, 14 nt, Shigella flexneri 2a str. 2457T
cacccaucacuacc

SEQ ID NO: 1898126 - RNA, 15 nt, Shigella flexneri 2a str. 2457T
caccagagugaccgc

SEQ ID NO: 1898127 - RNA, 18 nt, Shigella flexneri 2a str. 2457T
caccagcaacaagccagu

SEQ ID NO: 1898128 - RNA, 23 nt, Shigella flexneri 2a str. 2457T
caccagacaauggcccgccgcau

SEQ ID NO: 1898129 - RNA, 18 nt, Shigella flexneri 2a str. 2457T
caccaccuaacccgcuac

SEQ ID NO: 1898130 - RNA, 13 nt, Shigella flexneri 2a str. 2457T
caccacugcaaug

SEQ ID NO: 1898131 - RNA, 14 nt, Shigella flexneri 2a str. 2457T
caccacugccagau

SEQ ID NO: 1898132 - RNA, 19 nt, Shigella flexneri 2a str. 2457T
caccagcaucaacaacaau

SEQ ID NO: 1898133 - RNA, 13 nt, Shigella flexneri 2a str. 2457T
caccagcaccgcg

SEQ ID NO: 1898134 - RNA, 23 nt, Shigella flexneri 2a str. 2457T
caccagcccacaugccugcauaa

SEQ ID NO: 1898135 - RNA, 15 nt, Shigella flexneri 2a str. 2457T
cacacgacauccgug

SEQ ID NO: 1898136 - RNA, 16 nt, Shigella flexneri 2a str. 2457T
cacaccccgcgccgcu

SEQ ID NO: 1898137 - RNA, 16 nt, Shigella flexneri 2a str. 2457T
cacacccuugccagau

SEQ ID NO: 1898138 - RNA, 18 nt, Shigella flexneri 2a str. 2457T
cacacccgguaucaaacc

SEQ ID NO: 1898139 - RNA, 19 nt, Shigella flexneri 2a str. 2457T
cacaccgaagacaucgcag

SEQ ID NO: 1898140 - RNA, 18 nt, Shigella flexneri 2a str. 2457T
cacacuguaagccaccga

SEQ ID NO: 1898141 - RNA, 15 nt, Shigella flexneri 2a str. 2457T
cacagacauccugcg

SEQ ID NO: 1898142 - RNA, 13 nt, Shigella flexneri 2a str. 2457T
cacacucaugauc

SEQ ID NO: 1898143 - RNA, 18 nt, Shigella flexneri 2a str. 2457T
cacacugaugacaggcua

SEQ ID NO: 1898144 - RNA, 17 nt, Shigella flexneri 2a str. 2457T
cacagcacgcuuuucag

SEQ ID NO: 1898145 - RNA, 12 nt, Shigella flexneri 2a str. 2457T
caccacaggccu

SEQ ID NO: 1898146 - RNA, 13 nt, Shigella flexneri 2a str. 2457T
caccaaucagcgg

SEQ ID NO: 1898147 - RNA, 18 nt, Shigella flexneri 2a str. 2457T
caccaaucagcggcguau

SEQ ID NO: 1898148 - RNA, 19 nt, Shigella flexneri 2a str. 2457T
caccacaacauucccauca

SEQ ID NO: 1898149 - RNA, 13 nt, Shigella flexneri 2a str. 2457T
caccacaauugac

SEQ ID NO: 1898150 - RNA, 19 nt, Shigella flexneri 2a str. 2457T
cacagguuuguagaacgua

SEQ ID NO: 1898151 - RNA, 20 nt, Shigella flexneri 2a str. 2457T
caccaacgauuuuuuccgca

SEQ ID NO: 1898152 - RNA, 16 nt, Shigella flexneri 2a str. 2457T
cacgaccgcagcauug

SEQ ID NO: 1898153 - RNA, 19 nt, Shigella flexneri 2a str. 2457T
cacgaauuccaagcagacg

SEQ ID NO: 1898154 - RNA, 16 nt, Shigella flexneri 2a str. 2457T
cacgacgucuccauca

SEQ ID NO: 1898155 - RNA, 19 nt, Shigella flexneri 2a str. 2457T
cacgaucgcuucggucugc

SEQ ID NO: 1898156 - RNA, 12 nt, Shigella flexneri 2a str. 2457T
caccuuuaaccu

SEQ ID NO: 1898157 - RNA, 18 nt, Shigella flexneri 2a str. 2457T
caccuucauccagcauca

SEQ ID NO: 1898158 - RNA, 15 nt, Shigella flexneri 2a str. 2457T
cacgauuaucaccug

SEQ ID NO: 1898159 - RNA, 20 nt, Shigella flexneri 2a str. 2457T
cacgauuguuaaucacaucg

SEQ ID NO: 1898160 - RNA, 18 nt, Shigella flexneri 2a str. 2457T
cacgcaauaccuggcgca

SEQ ID NO: 1898161 - RNA, 21 nt, Shigella flexneri 2a str. 2457T
cacgcagggugugcuccaguc

SEQ ID NO: 1898162 - RNA, 23 nt, Shigella flexneri 2a str. 2457T
cacgcauccucuauauuucaccg

SEQ ID NO: 1898163 - RNA, 12 nt, Shigella flexneri 2a str. 2457T
cacgccacaaua

SEQ ID NO: 1898164 - RNA, 19 nt, Shigella flexneri 2a str. 2457T
cacgccgaucgaagagacg

SEQ ID NO: 1898165 - RNA, 20 nt, Shigella flexneri 2a str. 2457T
caccguauugcgccgguuua

SEQ ID NO: 1898166 - RNA, 21 nt, Shigella flexneri 2a str. 2457T
caccggcuuucgcuucaacca

SEQ ID NO: 1898167 - RNA, 15 nt, Shigella flexneri 2a str. 2457T
caccugcacaugcaa

SEQ ID NO: 1898168 - RNA, 15 nt, Shigella flexneri 2a str. 2457T
caccugccagcgccg

SEQ ID NO: 1898169 - RNA, 22 nt, Shigella flexneri 2a str. 2457T
caccugccagcgccgacagcag

SEQ ID NO: 1898170 - RNA, 17 nt, Shigella flexneri 2a str. 2457T
caccgcagaucagacca

SEQ ID NO: 1898171 - RNA, 18 nt, Shigella flexneri 2a str. 2457T
caccgcagcaucgucauc

SEQ ID NO: 1898172 - RNA, 22 nt, Shigella flexneri 2a str. 2457T
cagccgcauuuuuucuucaguu

SEQ ID NO: 1898173 - RNA, 13 nt, Shigella flexneri 2a str. 2457T
cagccgccagaca

SEQ ID NO: 1898174 - RNA, 22 nt, Shigella flexneri 2a str. 2457T
cagccacgcgaaugugcguuuu

SEQ ID NO: 1898175 - RNA, 18 nt, Shigella flexneri 2a str. 2457T
cagccaccagguucaaca

SEQ ID NO: 1898176 - RNA, 14 nt, Shigella flexneri 2a str. 2457T
cagcccugccaggu

SEQ ID NO: 1898177 - RNA, 14 nt, Shigella flexneri 2a str. 2457T
cagccgaucauugg

SEQ ID NO: 1898178 - RNA, 19 nt, Shigella flexneri 2a str. 2457T
cagccgaagggaaagagcg

SEQ ID NO: 1898179 - RNA, 13 nt, Shigella flexneri 2a str. 2457T
cagcgaaucagcc

SEQ ID NO: 1898180 - RNA, 17 nt, Shigella flexneri 2a str. 2457T
cagcgcaauucgcgucg

SEQ ID NO: 1898181 - RNA, 20 nt, Shigella flexneri 2a str. 2457T
cagcgauauccagcgauacc

SEQ ID NO: 1898182 - RNA, 17 nt, Shigella flexneri 2a str. 2457T
cagcgaguuuuucaguc

SEQ ID NO: 1898183 - RNA, 23 nt, Shigella flexneri 2a str. 2457T
cagcgcccgcuugcgagacggcg

SEQ ID NO: 1898184 - RNA, 12 nt, Shigella flexneri 2a str. 2457T
cagcgccugaua

SEQ ID NO: 1898185 - RNA, 17 nt, Shigella flexneri 2a str. 2457T
cagcgccugauacagcc

SEQ ID NO: 1898186 - RNA, 22 nt, Shigella flexneri 2a str. 2457T
cagcgcagugacauucaccuca

SEQ ID NO: 1898187 - RNA, 11 nt, Shigella flexneri 2a str. 2457T
cagcgggcgaa

SEQ ID NO: 1898188 - RNA, 14 nt, Shigella flexneri 2a str. 2457T
cagcggucacaugu

SEQ ID NO: 1898189 - RNA, 14 nt, Shigella flexneri 2a str. 2457T
cagcgucucauacc

SEQ ID NO: 1898190 - RNA, 14 nt, Shigella flexneri 2a str. 2457T
cagcgugauccacc

SEQ ID NO: 1898191 - RNA, 19 nt, Shigella flexneri 2a str. 2457T
cagcgguugggcaucggca

SEQ ID NO: 1898192 - RNA, 20 nt, Shigella flexneri 2a str. 2457T
cagcguaccaugauccugca

SEQ ID NO: 1898193 - RNA, 16 nt, Shigella flexneri 2a str. 2457T
cagcggaucgaacucc

SEQ ID NO: 1898194 - RNA, 15 nt, Shigella flexneri 2a str. 2457T
cagcggcaaccagcc

SEQ ID NO: 1898195 - RNA, 12 nt, Shigella flexneri 2a str. 2457T
cagcggcaauuc

SEQ ID NO: 1898196 - RNA, 16 nt, Shigella flexneri 2a str. 2457T
cagcgcgucgucaauc

SEQ ID NO: 1898197 - RNA, 15 nt, Shigella flexneri 2a str. 2457T
cagcgcugacgugau

SEQ ID NO: 1898198 - RNA, 14 nt, Shigella flexneri 2a str. 2457T
cagcgcuucagcga

SEQ ID NO: 1898199 - RNA, 19 nt, Shigella flexneri 2a str. 2457T
cagcgcggugauaaccguu

SEQ ID NO: 1898200 - RNA, 13 nt, Shigella flexneri 2a str. 2457T
cagcgcggcgaag

SEQ ID NO: 1898201 - RNA, 17 nt, Shigella flexneri 2a str. 2457T
cagcgcgggcuggcgua

SEQ ID NO: 1898202 - RNA, 16 nt, Shigella flexneri 2a str. 2457T
cagcgcgccgucgaug

SEQ ID NO: 1898203 - RNA, 16 nt, Shigella flexneri 2a str. 2457T
cagcgcgcuaucggca

SEQ ID NO: 1898204 - RNA, 17 nt, Shigella flexneri 2a str. 2457T
cagaugaaaacgccgga

SEQ ID NO: 1898205 - RNA, 19 nt, Shigella flexneri 2a str. 2457T
cagaucguugaacccggca

SEQ ID NO: 1898206 - RNA, 23 nt, Shigella flexneri 2a str. 2457T
cagaucccguugaaggguauugc

SEQ ID NO: 1898207 - RNA, 15 nt, Shigella flexneri 2a str. 2457T
cagaucccuucaccu

SEQ ID NO: 1898208 - RNA, 18 nt, Shigella flexneri 2a str. 2457T
cagauaaaucacgcuuca

SEQ ID NO: 1898209 - RNA, 15 nt, Shigella flexneri 2a str. 2457T
cagagcguuacgccc

SEQ ID NO: 1898210 - RNA, 21 nt, Shigella flexneri 2a str. 2457T
cagaguggauuaucuucaccg

SEQ ID NO: 1898211 - RNA, 21 nt, Shigella flexneri 2a str. 2457T
cagacaggcgaaacccgcugc

SEQ ID NO: 1898212 - RNA, 22 nt, Shigella flexneri 2a str. 2457T
cagacaggcgaaacccgcugcc

SEQ ID NO: 1898213 - RNA, 20 nt, Shigella flexneri 2a str. 2457T
cagacauaaagccugcuuca

SEQ ID NO: 1898214 - RNA, 23 nt, Shigella flexneri 2a str. 2457T
cagaccaaaacgugcagcugccu

SEQ ID NO: 1898215 - RNA, 14 nt, Shigella flexneri 2a str. 2457T
cagacgcaacagaa

SEQ ID NO: 1898216 - RNA, 16 nt, Shigella flexneri 2a str. 2457T
cagacacgccgccaga

SEQ ID NO: 1898217 - RNA, 22 nt, Shigella flexneri 2a str. 2457T
cagacacauaaugaugccgucu

SEQ ID NO: 1898218 - RNA, 22 nt, Shigella flexneri 2a str. 2457T
cagacaagaaguuccagggcag

SEQ ID NO: 1898219 - RNA, 13 nt, Shigella flexneri 2a str. 2457T
cagacaacgcuuc

SEQ ID NO: 1898220 - RNA, 15 nt, Shigella flexneri 2a str. 2457T
cagaauuacuggcag

SEQ ID NO: 1898221 - RNA, 17 nt, Shigella flexneri 2a str. 2457T
cagaauuuuucgcuaaa

SEQ ID NO: 1898222 - RNA, 14 nt, Shigella flexneri 2a str. 2457T
cagacuccgcuucg

SEQ ID NO: 1898223 - RNA, 16 nt, Shigella flexneri 2a str. 2457T
cagacuauucagcucu

SEQ ID NO: 1898224 - RNA, 23 nt, Shigella flexneri 2a str. 2457T
aaagaaugacacuuucagcgcag

SEQ ID NO: 1898225 - RNA, 16 nt, Shigella flexneri 2a str. 2457T
aaagaucgccacugcu

SEQ ID NO: 1898226 - RNA, 18 nt, Shigella flexneri 2a str. 2457T
cagagauaaccacguuca

SEQ ID NO: 1898227 - RNA, 13 nt, Shigella flexneri 2a str. 2457T
cacugcaucaugg

SEQ ID NO: 1898228 - RNA, 15 nt, Shigella flexneri 2a str. 2457T
cacugcaacgccuuu

SEQ ID NO: 1898229 - RNA, 14 nt, Shigella flexneri 2a str. 2457T
cacuccauccagca

SEQ ID NO: 1898230 - RNA, 14 nt, Shigella flexneri 2a str. 2457T
cacgcgcauauuga

SEQ ID NO: 1898231 - RNA, 22 nt, Shigella flexneri 2a str. 2457T
cacgccuuuaaaucccgcuuca

SEQ ID NO: 1898232 - RNA, 17 nt, Shigella flexneri 2a str. 2457T
cacucaucgcaucgccu

SEQ ID NO: 1898233 - RNA, 15 nt, Shigella flexneri 2a str. 2457T
cacucaccgccguua

SEQ ID NO: 1898234 - RNA, 18 nt, Shigella flexneri 2a str. 2457T
cacucaacaaccagaagg

SEQ ID NO: 1898235 - RNA, 16 nt, Shigella flexneri 2a str. 2457T
cacuauucgccagcac

SEQ ID NO: 1898236 - RNA, 20 nt, Shigella flexneri 2a str. 2457T
cacuaucccaacaacucuuc

SEQ ID NO: 1898237 - RNA, 14 nt, Shigella flexneri 2a str. 2457T
cacguugcugcggc

SEQ ID NO: 1898238 - RNA, 17 nt, Shigella flexneri 2a str. 2457T
cacuuccaccagcggcu

SEQ ID NO: 1898239 - RNA, 15 nt, Shigella flexneri 2a str. 2457T
cacuuccaccagcgg

SEQ ID NO: 1898240 - RNA, 11 nt, Shigella flexneri 2a str. 2457T
cacuuccugcc

SEQ ID NO: 1898241 - RNA, 18 nt, Shigella flexneri 2a str. 2457T
cacuuugcaguuccugcc

SEQ ID NO: 1898242 - RNA, 23 nt, Shigella flexneri 2a str. 2457T
cacuuucaucgcggucagcugcu

SEQ ID NO: 1898243 - RNA, 13 nt, Shigella flexneri 2a str. 2457T
cacuuuacccggu

SEQ ID NO: 1898244 - RNA, 17 nt, Shigella flexneri 2a str. 2457T
cagaaaucggccuucca

SEQ ID NO: 1898245 - RNA, 20 nt, Shigella flexneri 2a str. 2457T
cagaaauggucggugaccug

SEQ ID NO: 1898246 - RNA, 14 nt, Shigella flexneri 2a str. 2457T
cagaacagugccau

SEQ ID NO: 1898247 - RNA, 14 nt, Shigella flexneri 2a str. 2457T
cagaacguaaacgc

SEQ ID NO: 1898248 - RNA, 23 nt, Shigella flexneri 2a str. 2457T
cagaagagagauaauucagcagg

SEQ ID NO: 1898249 - RNA, 14 nt, Shigella flexneri 2a str. 2457T
cagaagacgcucca

SEQ ID NO: 1898250 - RNA, 21 nt, Shigella flexneri 2a str. 2457T
cagcagcagccgguauccagc

SEQ ID NO: 1898251 - RNA, 11 nt, Shigella flexneri 2a str. 2457T
cagcagcagag

SEQ ID NO: 1898252 - RNA, 12 nt, Shigella flexneri 2a str. 2457T
cagcagcagagc

SEQ ID NO: 1898253 - RNA, 17 nt, Shigella flexneri 2a str. 2457T
cagcaguucacgcagcu

SEQ ID NO: 1898254 - RNA, 14 nt, Shigella flexneri 2a str. 2457T
cagcaguugccagu

SEQ ID NO: 1898255 - RNA, 15 nt, Shigella flexneri 2a str. 2457T
cagcaguugccaguc

SEQ ID NO: 1898256 - RNA, 23 nt, Shigella flexneri 2a str. 2457T
cagcauuauuuuuaaacaucaaa

SEQ ID NO: 1898257 - RNA, 19 nt, Shigella flexneri 2a str. 2457T
cagcauuucuuccagcguu

SEQ ID NO: 1898258 - RNA, 15 nt, Shigella flexneri 2a str. 2457T
cagcaucgaccagga

SEQ ID NO: 1898259 - RNA, 21 nt, Shigella flexneri 2a str. 2457T
cagcacgcuuuucagugccag

SEQ ID NO: 1898260 - RNA, 23 nt, Shigella flexneri 2a str. 2457T
cagcacgcuuuucagugccaggu

SEQ ID NO: 1898261 - RNA, 23 nt, Shigella flexneri 2a str. 2457T
cagcacugauuuuuuccaacagg

SEQ ID NO: 1898262 - RNA, 19 nt, Shigella flexneri 2a str. 2457T
cagcacuuaucucuuccgc

SEQ ID NO: 1898263 - RNA, 20 nt, Shigella flexneri 2a str. 2457T
cagcaccugcuugaacgcac

SEQ ID NO: 1898264 - RNA, 19 nt, Shigella flexneri 2a str. 2457T
cagcaccggacuauccgcc

SEQ ID NO: 1898265 - RNA, 14 nt, Shigella flexneri 2a str. 2457T
cagaugacgaucag

SEQ ID NO: 1898266 - RNA, 20 nt, Shigella flexneri 2a str. 2457T
cagauggccaauaacccgcu

SEQ ID NO: 1898267 - RNA, 19 nt, Shigella flexneri 2a str. 2457T
cagaugcggcuucgcuuca

SEQ ID NO: 1898268 - RNA, 18 nt, Shigella flexneri 2a str. 2457T
cagauuugccaguaccga

SEQ ID NO: 1898269 - RNA, 23 nt, Shigella flexneri 2a str. 2457T
cagauggggauagcgcugcugca

SEQ ID NO: 1898270 - RNA, 17 nt, Shigella flexneri 2a str. 2457T
cagaugugccaguugca

SEQ ID NO: 1898271 - RNA, 23 nt, Shigella flexneri 2a str. 2457T
cagcaacugauggcccaucguca

SEQ ID NO: 1898272 - RNA, 20 nt, Shigella flexneri 2a str. 2457T
cagauuucaaucuggccuga

SEQ ID NO: 1898273 - RNA, 14 nt, Shigella flexneri 2a str. 2457T
cagcaaauccagcg

SEQ ID NO: 1898274 - RNA, 22 nt, Shigella flexneri 2a str. 2457T
cagcaaauagauaaaauauggc

SEQ ID NO: 1898275 - RNA, 12 nt, Shigella flexneri 2a str. 2457T
cagcaaauacgu

SEQ ID NO: 1898276 - RNA, 16 nt, Shigella flexneri 2a str. 2457T
cagcaaagugccccca

SEQ ID NO: 1898277 - RNA, 18 nt, Shigella flexneri 2a str. 2457T
cagcaaucgcgccagccg

SEQ ID NO: 1898278 - RNA, 22 nt, Shigella flexneri 2a str. 2457T
cagcaaggguucaccggugagc

SEQ ID NO: 1898279 - RNA, 20 nt, Shigella flexneri 2a str. 2457T
cagcaaggguucaccgguga

SEQ ID NO: 1898280 - RNA, 16 nt, Shigella flexneri 2a str. 2457T
cagcaagggcaucgua

SEQ ID NO: 1898281 - RNA, 13 nt, Shigella flexneri 2a str. 2457T
cagcaacuggcaa

SEQ ID NO: 1898282 - RNA, 21 nt, Shigella flexneri 2a str. 2457T
cagcaagccacuggcgcgaau

SEQ ID NO: 1898283 - RNA, 15 nt, Shigella flexneri 2a str. 2457T
caucguuacgauugg

SEQ ID NO: 1898284 - RNA, 16 nt, Shigella flexneri 2a str. 2457T
caucucuacagcgccc

SEQ ID NO: 1898285 - RNA, 21 nt, Shigella flexneri 2a str. 2457T
caucuauagugaggcuauucc

SEQ ID NO: 1898286 - RNA, 14 nt, Shigella flexneri 2a str. 2457T
caucucauccauca

SEQ ID NO: 1898287 - RNA, 19 nt, Shigella flexneri 2a str. 2457T
caucgggcagcaucgccag

SEQ ID NO: 1898288 - RNA, 13 nt, Shigella flexneri 2a str. 2457T
caucggguaacgg

SEQ ID NO: 1898289 - RNA, 21 nt, Shigella flexneri 2a str. 2457T
caucgggaagaggaucugcuc

SEQ ID NO: 1898290 - RNA, 17 nt, Shigella flexneri 2a str. 2457T
caucguaagcgccagga

SEQ ID NO: 1898291 - RNA, 23 nt, Shigella flexneri 2a str. 2457T
caucguaauacccuugcagacga

SEQ ID NO: 1898292 - RNA, 17 nt, Shigella flexneri 2a str. 2457T
caucggcaaucauuccc

SEQ ID NO: 1898293 - RNA, 20 nt, Shigella flexneri 2a str. 2457T
caugaugauaucacugguga

SEQ ID NO: 1898294 - RNA, 15 nt, Shigella flexneri 2a str. 2457T
caugauccugcaaua

SEQ ID NO: 1898295 - RNA, 14 nt, Shigella flexneri 2a str. 2457T
caugauagcccgga

SEQ ID NO: 1898296 - RNA, 21 nt, Shigella flexneri 2a str. 2457T
caugccacacacgauccugca

SEQ ID NO: 1898297 - RNA, 15 nt, Shigella flexneri 2a str. 2457T
caugcacuccgcugu

SEQ ID NO: 1898298 - RNA, 22 nt, Shigella flexneri 2a str. 2457T
caugcagggcaaacucugagag

SEQ ID NO: 1898299 - RNA, 19 nt, Shigella flexneri 2a str. 2457T
caugcaauuaccgccacca

SEQ ID NO: 1898300 - RNA, 22 nt, Shigella flexneri 2a str. 2457T
caugcaauuaccgccaccagga

SEQ ID NO: 1898301 - RNA, 20 nt, Shigella flexneri 2a str. 2457T
caugauuuuguaggccggau

SEQ ID NO: 1898302 - RNA, 21 nt, Shigella flexneri 2a str. 2457T
caugauuuuguaggccggaua

SEQ ID NO: 1898303 - RNA, 20 nt, Shigella flexneri 2a str. 2457T
caugcacgauauaccgugcu

SEQ ID NO: 1898304 - RNA, 18 nt, Shigella flexneri 2a str. 2457T
caucuuugaaaucacgca

SEQ ID NO: 1898305 - RNA, 15 nt, Shigella flexneri 2a str. 2457T
caugaaacgccagga

SEQ ID NO: 1898306 - RNA, 21 nt, Shigella flexneri 2a str. 2457T
caucuuguucauagugccuga

SEQ ID NO: 1898307 - RNA, 14 nt, Shigella flexneri 2a str. 2457T
caucuugauaccaa

SEQ ID NO: 1898308 - RNA, 21 nt, Shigella flexneri 2a str. 2457T
caucuguugugccacauccag

SEQ ID NO: 1898309 - RNA, 19 nt, Shigella flexneri 2a str. 2457T
caucuucaauccacgguuu

SEQ ID NO: 1898310 - RNA, 23 nt, Shigella flexneri 2a str. 2457T
caucuuccguagcggcucggaau

SEQ ID NO: 1898311 - RNA, 19 nt, Shigella flexneri 2a str. 2457T
caugacgcgcaucacgaca

SEQ ID NO: 1898312 - RNA, 11 nt, Shigella flexneri 2a str. 2457T
caugaccugcc

SEQ ID NO: 1898313 - RNA, 18 nt, Shigella flexneri 2a str. 2457T
caugaccuuccagcgccg

SEQ ID NO: 1898314 - RNA, 22 nt, Shigella flexneri 2a str. 2457T
caugaccuuucaguuugccgcu

SEQ ID NO: 1898315 - RNA, 13 nt, Shigella flexneri 2a str. 2457T
caugaccgccgca

SEQ ID NO: 1898316 - RNA, 17 nt, Shigella flexneri 2a str. 2457T
caugaccgcuccgccau

SEQ ID NO: 1898317 - RNA, 15 nt, Shigella flexneri 2a str. 2457T
cauaacggacgaucu

SEQ ID NO: 1898318 - RNA, 14 nt, Shigella flexneri 2a str. 2457T
cauaacugccggau

SEQ ID NO: 1898319 - RNA, 19 nt, Shigella flexneri 2a str. 2457T
cauaacugccggaugcggc

SEQ ID NO: 1898320 - RNA, 18 nt, Shigella flexneri 2a str. 2457T
cauaacuggucaucaaau

SEQ ID NO: 1898321 - RNA, 14 nt, Shigella flexneri 2a str. 2457T
cauaacgccugcuc

SEQ ID NO: 1898322 - RNA, 15 nt, Shigella flexneri 2a str. 2457T
caguguacagcggca

SEQ ID NO: 1898323 - RNA, 22 nt, Shigella flexneri 2a str. 2457T
cagugucgcaguagccaugcau

SEQ ID NO: 1898324 - RNA, 19 nt, Shigella flexneri 2a str. 2457T
caguuaacgcggauccccu

SEQ ID NO: 1898325 - RNA, 22 nt, Shigella flexneri 2a str. 2457T
caguguuaaacgcagcuccggg

SEQ ID NO: 1898326 - RNA, 15 nt, Shigella flexneri 2a str. 2457T
cauacgguuuaccga

SEQ ID NO: 1898327 - RNA, 16 nt, Shigella flexneri 2a str. 2457T
cauacgguuuaccgag

SEQ ID NO: 1898328 - RNA, 20 nt, Shigella flexneri 2a str. 2457T
cauacggaauagcuuaccgg

SEQ ID NO: 1898329 - RNA, 19 nt, Shigella flexneri 2a str. 2457T
cauacucgaggcauuggca

SEQ ID NO: 1898330 - RNA, 17 nt, Shigella flexneri 2a str. 2457T
cauaccuuccagcgcgu

SEQ ID NO: 1898331 - RNA, 13 nt, Shigella flexneri 2a str. 2457T
cauacaccagcgg

SEQ ID NO: 1898332 - RNA, 18 nt, Shigella flexneri 2a str. 2457T
caucagcauaaucaccag

SEQ ID NO: 1898333 - RNA, 22 nt, Shigella flexneri 2a str. 2457T
caucagaacguaaacgcagcau

SEQ ID NO: 1898334 - RNA, 15 nt, Shigella flexneri 2a str. 2457T
caucacgcgcaucug

SEQ ID NO: 1898335 - RNA, 13 nt, Shigella flexneri 2a str. 2457T
caucagaacguaa

SEQ ID NO: 1898336 - RNA, 14 nt, Shigella flexneri 2a str. 2457T
caucaccacugacg

SEQ ID NO: 1898337 - RNA, 18 nt, Shigella flexneri 2a str. 2457T
cauauucgccgcccugca

SEQ ID NO: 1898338 - RNA, 18 nt, Shigella flexneri 2a str. 2457T
cauauucgcuuucagcga

SEQ ID NO: 1898339 - RNA, 23 nt, Shigella flexneri 2a str. 2457T
caucacaaucauccuaccgccag

SEQ ID NO: 1898340 - RNA, 15 nt, Shigella flexneri 2a str. 2457T
caucaaacgaagccu

SEQ ID NO: 1898341 - RNA, 21 nt, Shigella flexneri 2a str. 2457T
caucaauaccauuaucauuga

SEQ ID NO: 1898342 - RNA, 19 nt, Shigella flexneri 2a str. 2457T
cauccggcacucuuucagc

SEQ ID NO: 1898343 - RNA, 13 nt, Shigella flexneri 2a str. 2457T
cauccggccagua

SEQ ID NO: 1898344 - RNA, 18 nt, Shigella flexneri 2a str. 2457T
cauccggcaugauaccga

SEQ ID NO: 1898345 - RNA, 22 nt, Shigella flexneri 2a str. 2457T
caucccuaugcauaauccugcc

SEQ ID NO: 1898346 - RNA, 21 nt, Shigella flexneri 2a str. 2457T
caucccuguaaaacgcgcccu

SEQ ID NO: 1898347 - RNA, 16 nt, Shigella flexneri 2a str. 2457T
cauccgggcgaacugg

SEQ ID NO: 1898348 - RNA, 16 nt, Shigella flexneri 2a str. 2457T
cauccggcuggucagc

SEQ ID NO: 1898349 - RNA, 20 nt, Shigella flexneri 2a str. 2457T
caucaggcagucugcgcccu

SEQ ID NO: 1898350 - RNA, 13 nt, Shigella flexneri 2a str. 2457T
caucagcgccaac

SEQ ID NO: 1898351 - RNA, 12 nt, Shigella flexneri 2a str. 2457T
caucagcggcac

SEQ ID NO: 1898352 - RNA, 22 nt, Shigella flexneri 2a str. 2457T
cauccagcuuuuagaucacuca

SEQ ID NO: 1898353 - RNA, 21 nt, Shigella flexneri 2a str. 2457T
caucgccagcgaauuccaguu

SEQ ID NO: 1898354 - RNA, 14 nt, Shigella flexneri 2a str. 2457T
caucgcccacauca

SEQ ID NO: 1898355 - RNA, 12 nt, Shigella flexneri 2a str. 2457T
caucgcgccaac

SEQ ID NO: 1898356 - RNA, 15 nt, Shigella flexneri 2a str. 2457T
caucgcgaccaauca

SEQ ID NO: 1898357 - RNA, 13 nt, Shigella flexneri 2a str. 2457T
caggccgccugca

SEQ ID NO: 1898358 - RNA, 19 nt, Shigella flexneri 2a str. 2457T
caggcaucagcaacacgcu

SEQ ID NO: 1898359 - RNA, 23 nt, Shigella flexneri 2a str. 2457T
caggcaucacuuuaccgguuuca

SEQ ID NO: 1898360 - RNA, 22 nt, Shigella flexneri 2a str. 2457T
aaagauuaacgugaccgccaau

SEQ ID NO: 1898361 - RNA, 16 nt, Shigella flexneri 2a str. 2457T
caggccaucagcagcg

SEQ ID NO: 1898362 - RNA, 22 nt, Shigella flexneri 2a str. 2457T
cagcguuaaugauaucccugcu

SEQ ID NO: 1898363 - RNA, 20 nt, Shigella flexneri 2a str. 2457T
cagcguuaucccaucccacu

SEQ ID NO: 1898364 - RNA, 20 nt, Shigella flexneri 2a str. 2457T
caggaccuugacgaauacua

SEQ ID NO: 1898365 - RNA, 22 nt, Shigella flexneri 2a str. 2457T
caggagcuggaugcccaacagg

SEQ ID NO: 1898366 - RNA, 17 nt, Shigella flexneri 2a str. 2457T
caggauaaacuccugca

SEQ ID NO: 1898367 - RNA, 18 nt, Shigella flexneri 2a str. 2457T
caggauugccguggauuu

SEQ ID NO: 1898368 - RNA, 13 nt, Shigella flexneri 2a str. 2457T
caggauuuccagc

SEQ ID NO: 1898369 - RNA, 16 nt, Shigella flexneri 2a str. 2457T
caggcaacgacccgaa

SEQ ID NO: 1898370 - RNA, 20 nt, Shigella flexneri 2a str. 2457T
caggcguaacacucgugcgu

SEQ ID NO: 1898371 - RNA, 13 nt, Shigella flexneri 2a str. 2457T
cagggcaagcgcc

SEQ ID NO: 1898372 - RNA, 16 nt, Shigella flexneri 2a str. 2457T
cagggccgaucaacga

SEQ ID NO: 1898373 - RNA, 12 nt, Shigella flexneri 2a str. 2457T
caggcuucaaca

SEQ ID NO: 1898374 - RNA, 21 nt, Shigella flexneri 2a str. 2457T
cagggaguacguggaggaugg

SEQ ID NO: 1898375 - RNA, 23 nt, Shigella flexneri 2a str. 2457T
caggcuguuaaggaaauccugcc

SEQ ID NO: 1898376 - RNA, 23 nt, Shigella flexneri 2a str. 2457T
caggcugguaacagugcaccgga

SEQ ID NO: 1898377 - RNA, 20 nt, Shigella flexneri 2a str. 2457T
caggccuacaaaaucuugca

SEQ ID NO: 1898378 - RNA, 21 nt, Shigella flexneri 2a str. 2457T
caggcggauugcuucugcuuc

SEQ ID NO: 1898379 - RNA, 18 nt, Shigella flexneri 2a str. 2457T
caguagcgucgccagcag

SEQ ID NO: 1898380 - RNA, 18 nt, Shigella flexneri 2a str. 2457T
cagugauggugauaauca

SEQ ID NO: 1898381 - RNA, 16 nt, Shigella flexneri 2a str. 2457T
cagucuucaucauccu

SEQ ID NO: 1898382 - RNA, 23 nt, Shigella flexneri 2a str. 2457T
cagucuucaucauccucuucagc

SEQ ID NO: 1898383 - RNA, 14 nt, Shigella flexneri 2a str. 2457T
cagugcauccagca

SEQ ID NO: 1898384 - RNA, 13 nt, Shigella flexneri 2a str. 2457T
cagugccaguucu

SEQ ID NO: 1898385 - RNA, 16 nt, Shigella flexneri 2a str. 2457T
cagugcguccgguuua

SEQ ID NO: 1898386 - RNA, 16 nt, Shigella flexneri 2a str. 2457T
cagugcgugcgcugcu

SEQ ID NO: 1898387 - RNA, 17 nt, Shigella flexneri 2a str. 2457T
cagucccgcgacaaucg

SEQ ID NO: 1898388 - RNA, 13 nt, Shigella flexneri 2a str. 2457T
caguccagcgccu

SEQ ID NO: 1898389 - RNA, 15 nt, Shigella flexneri 2a str. 2457T
cagucaugcgagaag

SEQ ID NO: 1898390 - RNA, 23 nt, Shigella flexneri 2a str. 2457T
caggguaauuuguaacugucggg

SEQ ID NO: 1898391 - RNA, 22 nt, Shigella flexneri 2a str. 2457T
cagggcuuuuuuauuucauguu

SEQ ID NO: 1898392 - RNA, 16 nt, Shigella flexneri 2a str. 2457T
cagggcuuucgcgucg

SEQ ID NO: 1898393 - RNA, 19 nt, Shigella flexneri 2a str. 2457T
cagguaccgagauaacguu

SEQ ID NO: 1898394 - RNA, 19 nt, Shigella flexneri 2a str. 2457T
ccgaagauagcgucauuuc

SEQ ID NO: 1898395 - RNA, 18 nt, Shigella flexneri 2a str. 2457T
ccgaagacgugcgccaca

SEQ ID NO: 1898396 - RNA, 12 nt, Shigella flexneri 2a str. 2457T
ccgaagacaucg

SEQ ID NO: 1898397 - RNA, 14 nt, Shigella flexneri 2a str. 2457T
ccgaauaacgcgca

SEQ ID NO: 1898398 - RNA, 14 nt, Shigella flexneri 2a str. 2457T
ccgaaaaaccugac

SEQ ID NO: 1898399 - RNA, 23 nt, Shigella flexneri 2a str. 2457T
cccugcgauggugaagucauuga

SEQ ID NO: 1898400 - RNA, 14 nt, Shigella flexneri 2a str. 2457T
cccuugcucaauga

SEQ ID NO: 1898401 - RNA, 19 nt, Shigella flexneri 2a str. 2457T
cccuucugagaucaaugcg

SEQ ID NO: 1898402 - RNA, 17 nt, Shigella flexneri 2a str. 2457T
cccuucuuuuauuucug

SEQ ID NO: 1898403 - RNA, 15 nt, Shigella flexneri 2a str. 2457T
cccgggucagcgcca

SEQ ID NO: 1898404 - RNA, 16 nt, Shigella flexneri 2a str. 2457T
aaaucuauugcaacau

SEQ ID NO: 1898405 - RNA, 23 nt, Shigella flexneri 2a str. 2457T
cccgucagcaaaauacugaacag

SEQ ID NO: 1898406 - RNA, 15 nt, Shigella flexneri 2a str. 2457T
aaaugaccgggcuug

SEQ ID NO: 1898407 - RNA, 15 nt, Shigella flexneri 2a str. 2457T
aaaugaaacuggaag

SEQ ID NO: 1898408 - RNA, 14 nt, Shigella flexneri 2a str. 2457T
aaaugaacugggca

SEQ ID NO: 1898409 - RNA, 13 nt, Shigella flexneri 2a str. 2457T
ccgacaucgccac

SEQ ID NO: 1898410 - RNA, 12 nt, Shigella flexneri 2a str. 2457T
ccgacaucacgg

SEQ ID NO: 1898411 - RNA, 16 nt, Shigella flexneri 2a str. 2457T
ccgacauggugcgauu

SEQ ID NO: 1898412 - RNA, 14 nt, Shigella flexneri 2a str. 2457T
ccgaauacggucuu

SEQ ID NO: 1898413 - RNA, 16 nt, Shigella flexneri 2a str. 2457T
ccgaauuucauccugu

SEQ ID NO: 1898414 - RNA, 15 nt, Shigella flexneri 2a str. 2457T
ccgacaacgucauuc

SEQ ID NO: 1898415 - RNA, 18 nt, Shigella flexneri 2a str. 2457T
ccgacaaucccgcccgca

SEQ ID NO: 1898416 - RNA, 13 nt, Shigella flexneri 2a str. 2457T
ccgacaaugccac

SEQ ID NO: 1898417 - RNA, 19 nt, Shigella flexneri 2a str. 2457T
ccgacgauguuagcggcga

SEQ ID NO: 1898418 - RNA, 21 nt, Shigella flexneri 2a str. 2457T
ccgagaagauuuuuugccagc

SEQ ID NO: 1898419 - RNA, 11 nt, Shigella flexneri 2a str. 2457T
ccgagcaaacc

SEQ ID NO: 1898420 - RNA, 14 nt, Shigella flexneri 2a str. 2457T
ccgagcacaugcag

SEQ ID NO: 1898421 - RNA, 21 nt, Shigella flexneri 2a str. 2457T
ccgacuccagcagugccgcau

SEQ ID NO: 1898422 - RNA, 16 nt, Shigella flexneri 2a str. 2457T
ccgacgugcagcaucg

SEQ ID NO: 1898423 - RNA, 15 nt, Shigella flexneri 2a str. 2457T
ccgacugcggccuga

SEQ ID NO: 1898424 - RNA, 22 nt, Shigella flexneri 2a str. 2457T
ccgagaaaaauagcauuaaugc

SEQ ID NO: 1898425 - RNA, 20 nt, Shigella flexneri 2a str. 2457T
cccagcagcgccgcgccuau

SEQ ID NO: 1898426 - RNA, 18 nt, Shigella flexneri 2a str. 2457T
cccagagaacuggcggca

SEQ ID NO: 1898427 - RNA, 19 nt, Shigella flexneri 2a str. 2457T
cccagauagcaacagcagc

SEQ ID NO: 1898428 - RNA, 14 nt, Shigella flexneri 2a str. 2457T
cccagcgucagcau

SEQ ID NO: 1898429 - RNA, 12 nt, Shigella flexneri 2a str. 2457T
cccagcggaugu

SEQ ID NO: 1898430 - RNA, 19 nt, Shigella flexneri 2a str. 2457T
cccaucaucgcauccagug

SEQ ID NO: 1898431 - RNA, 15 nt, Shigella flexneri 2a str. 2457T
cccagucauccggcu

SEQ ID NO: 1898432 - RNA, 14 nt, Shigella flexneri 2a str. 2457T
cccagucgcgcaau

SEQ ID NO: 1898433 - RNA, 22 nt, Shigella flexneri 2a str. 2457T
cccagugagucgggaccagcau

SEQ ID NO: 1898434 - RNA, 22 nt, Shigella flexneri 2a str. 2457T
cccagugagucggggccagcau

SEQ ID NO: 1898435 - RNA, 15 nt, Shigella flexneri 2a str. 2457T
cccagugcggcaucg

SEQ ID NO: 1898436 - RNA, 19 nt, Shigella flexneri 2a str. 2457T
cccagugguuucgccagca

SEQ ID NO: 1898437 - RNA, 14 nt, Shigella flexneri 2a str. 2457T
cccagugccugcau

SEQ ID NO: 1898438 - RNA, 17 nt, Shigella flexneri 2a str. 2457T
cccaacuuugugcaauu

SEQ ID NO: 1898439 - RNA, 16 nt, Shigella flexneri 2a str. 2457T
cccaacgaugguguca

SEQ ID NO: 1898440 - RNA, 22 nt, Shigella flexneri 2a str. 2457T
cccaaccgauaaccacgcucag

SEQ ID NO: 1898441 - RNA, 17 nt, Shigella flexneri 2a str. 2457T
ccauuucuucuccggca

SEQ ID NO: 1898442 - RNA, 15 nt, Shigella flexneri 2a str. 2457T
ccauuucaucgccag

SEQ ID NO: 1898443 - RNA, 20 nt, Shigella flexneri 2a str. 2457T
cccacggcggugucgccaga

SEQ ID NO: 1898444 - RNA, 12 nt, Shigella flexneri 2a str. 2457T
cccacggcuacc

SEQ ID NO: 1898445 - RNA, 16 nt, Shigella flexneri 2a str. 2457T
aaaucgaucaucaccu

SEQ ID NO: 1898446 - RNA, 23 nt, Shigella flexneri 2a str. 2457T
ccauuaaacgcaguaagcgccag

SEQ ID NO: 1898447 - RNA, 21 nt, Shigella flexneri 2a str. 2457T
ccaguagacgagccguuccua

SEQ ID NO: 1898448 - RNA, 16 nt, Shigella flexneri 2a str. 2457T
aaaucgaaaucaacau

SEQ ID NO: 1898449 - RNA, 20 nt, Shigella flexneri 2a str. 2457T
ccaugcgcauuaagccauga

SEQ ID NO: 1898450 - RNA, 18 nt, Shigella flexneri 2a str. 2457T
ccccaauccacgcggguu

SEQ ID NO: 1898451 - RNA, 12 nt, Shigella flexneri 2a str. 2457T
ccccagcgcaag

SEQ ID NO: 1898452 - RNA, 18 nt, Shigella flexneri 2a str. 2457T
ccccgguaauugcacguc

SEQ ID NO: 1898453 - RNA, 21 nt, Shigella flexneri 2a str. 2457T
cccgagcggccaaagggagca

SEQ ID NO: 1898454 - RNA, 22 nt, Shigella flexneri 2a str. 2457T
cccgccaaaccacuauuauggc

SEQ ID NO: 1898455 - RNA, 21 nt, Shigella flexneri 2a str. 2457T
ccaguaauugacgcauccgau

SEQ ID NO: 1898456 - RNA, 18 nt, Shigella flexneri 2a str. 2457T
ccaguacgcccacgccag

SEQ ID NO: 1898457 - RNA, 19 nt, Shigella flexneri 2a str. 2457T
ccagguucgauauccgcca

SEQ ID NO: 1898458 - RNA, 16 nt, Shigella flexneri 2a str. 2457T
ccaggcgagaucggca

SEQ ID NO: 1898459 - RNA, 13 nt, Shigella flexneri 2a str. 2457T
ccagggcagcagu

SEQ ID NO: 1898460 - RNA, 22 nt, Shigella flexneri 2a str. 2457T
ccaggcuaauccagucuucgcc

SEQ ID NO: 1898461 - RNA, 17 nt, Shigella flexneri 2a str. 2457T
ccagcuauaacguugcc

SEQ ID NO: 1898462 - RNA, 15 nt, Shigella flexneri 2a str. 2457T
ccagcucaaacgaau

SEQ ID NO: 1898463 - RNA, 19 nt, Shigella flexneri 2a str. 2457T
ccagcguuuccagcaccag

SEQ ID NO: 1898464 - RNA, 19 nt, Shigella flexneri 2a str. 2457T
ccagcuggcuaccgccgca

SEQ ID NO: 1898465 - RNA, 12 nt, Shigella flexneri 2a str. 2457T
ccagcuggcaga

SEQ ID NO: 1898466 - RNA, 15 nt, Shigella flexneri 2a str. 2457T
ccaggcaaaccagua

SEQ ID NO: 1898467 - RNA, 20 nt, Shigella flexneri 2a str. 2457T
ccaggaucagaaugcgcucu

SEQ ID NO: 1898468 - RNA, 17 nt, Shigella flexneri 2a str. 2457T
ccaggaagcgacccggu

SEQ ID NO: 1898469 - RNA, 17 nt, Shigella flexneri 2a str. 2457T
ccaggaacgcgccaaga

SEQ ID NO: 1898470 - RNA, 20 nt, Shigella flexneri 2a str. 2457T
ccagccccagaauucacgca

SEQ ID NO: 1898471 - RNA, 13 nt, Shigella flexneri 2a str. 2457T
ccagcauccggca

SEQ ID NO: 1898472 - RNA, 22 nt, Shigella flexneri 2a str. 2457T
ccagcaguucgcccgcuucauc

SEQ ID NO: 1898473 - RNA, 17 nt, Shigella flexneri 2a str. 2457T
ccagcaguaaaccgcuc

SEQ ID NO: 1898474 - RNA, 16 nt, Shigella flexneri 2a str. 2457T
ccagcaucgcaacaug

SEQ ID NO: 1898475 - RNA, 18 nt, Shigella flexneri 2a str. 2457T
ccagcaucgcauccggca

SEQ ID NO: 1898476 - RNA, 15 nt, Shigella flexneri 2a str. 2457T
ccagcauucccgcca

SEQ ID NO: 1898477 - RNA, 15 nt, Shigella flexneri 2a str. 2457T
ccagccaguauugcc

SEQ ID NO: 1898478 - RNA, 23 nt, Shigella flexneri 2a str. 2457T
ccagcggcugcugauguucgcca

SEQ ID NO: 1898479 - RNA, 15 nt, Shigella flexneri 2a str. 2457T
ccagcggccagcgca

SEQ ID NO: 1898480 - RNA, 15 nt, Shigella flexneri 2a str. 2457T
ccagcggaauaacgc

SEQ ID NO: 1898481 - RNA, 20 nt, Shigella flexneri 2a str. 2457T
ccagcggaauucccgcuucu

SEQ ID NO: 1898482 - RNA, 20 nt, Shigella flexneri 2a str. 2457T
ccagcggcagcucgcguucg

SEQ ID NO: 1898483 - RNA, 13 nt, Shigella flexneri 2a str. 2457T
ccagcggcagcca

SEQ ID NO: 1898484 - RNA, 16 nt, Shigella flexneri 2a str. 2457T
ccagcgccgccagaau

SEQ ID NO: 1898485 - RNA, 20 nt, Shigella flexneri 2a str. 2457T
ccagcgcguaaauaucggca

SEQ ID NO: 1898486 - RNA, 23 nt, Shigella flexneri 2a str. 2457T
ccagcguauucgugacaauaucu

SEQ ID NO: 1898487 - RNA, 21 nt, Shigella flexneri 2a str. 2457T
ccagcguaccaugauccugca

SEQ ID NO: 1898488 - RNA, 21 nt, Shigella flexneri 2a str. 2457T
ccagcgucgcacccggcauuu

SEQ ID NO: 1898489 - RNA, 18 nt, Shigella flexneri 2a str. 2457T
ccagcgucgcaucaggca

SEQ ID NO: 1898490 - RNA, 20 nt, Shigella flexneri 2a str. 2457T
ccagcgucgcaucaggcauc

SEQ ID NO: 1898491 - RNA, 18 nt, Shigella flexneri 2a str. 2457T
ccagcgucgcauccgaca

SEQ ID NO: 1898492 - RNA, 13 nt, Shigella flexneri 2a str. 2457T
ccagcgggcguca

SEQ ID NO: 1898493 - RNA, 20 nt, Shigella flexneri 2a str. 2457T
ccagcggguggugacuggca

SEQ ID NO: 1898494 - RNA, 21 nt, Shigella flexneri 2a str. 2457T
aaauccaccaguggacggcug

SEQ ID NO: 1898495 - RNA, 13 nt, Shigella flexneri 2a str. 2457T
aaauccgccagaa

SEQ ID NO: 1898496 - RNA, 19 nt, Shigella flexneri 2a str. 2457T
aaaucagaaggguugguga

SEQ ID NO: 1898497 - RNA, 14 nt, Shigella flexneri 2a str. 2457T
aaaucacgcuucac

SEQ ID NO: 1898498 - RNA, 17 nt, Shigella flexneri 2a str. 2457T
ccacgcgggaagucacu

SEQ ID NO: 1898499 - RNA, 20 nt, Shigella flexneri 2a str. 2457T
ccacggccacagccagccaa

SEQ ID NO: 1898500 - RNA, 15 nt, Shigella flexneri 2a str. 2457T
aaaguccucucggca

SEQ ID NO: 1898501 - RNA, 13 nt, Shigella flexneri 2a str. 2457T
aaagucaucaauc

SEQ ID NO: 1898502 - RNA, 17 nt, Shigella flexneri 2a str. 2457T
aaaguacggacgcggca

SEQ ID NO: 1898503 - RNA, 23 nt, Shigella flexneri 2a str. 2457T
aaaguagggcugauaaacaagcg

SEQ ID NO: 1898504 - RNA, 14 nt, Shigella flexneri 2a str. 2457T
ccaccuuucucggc

SEQ ID NO: 1898505 - RNA, 22 nt, Shigella flexneri 2a str. 2457T
ccaccugcucgucauccgccag

SEQ ID NO: 1898506 - RNA, 12 nt, Shigella flexneri 2a str. 2457T
aaaggcgaaacc

SEQ ID NO: 1898507 - RNA, 22 nt, Shigella flexneri 2a str. 2457T
aaaggucccugaugcaucaguc

SEQ ID NO: 1898508 - RNA, 22 nt, Shigella flexneri 2a str. 2457T
ccacuccgguaauaucgcgcag

SEQ ID NO: 1898509 - RNA, 11 nt, Shigella flexneri 2a str. 2457T
ccacuccagcu

SEQ ID NO: 1898510 - RNA, 23 nt, Shigella flexneri 2a str. 2457T
ccacgucguuccccauuaccuga

SEQ ID NO: 1898511 - RNA, 18 nt, Shigella flexneri 2a str. 2457T
ccagcaccagcuccggca

SEQ ID NO: 1898512 - RNA, 15 nt, Shigella flexneri 2a str. 2457T
ccagcaacaagccag

SEQ ID NO: 1898513 - RNA, 14 nt, Shigella flexneri 2a str. 2457T
ccagcaaacaggug

SEQ ID NO: 1898514 - RNA, 22 nt, Shigella flexneri 2a str. 2457T
ccagcaaauccacaacggcauu

SEQ ID NO: 1898515 - RNA, 14 nt, Shigella flexneri 2a str. 2457T
ccagcaaaucccag

SEQ ID NO: 1898516 - RNA, 16 nt, Shigella flexneri 2a str. 2457T
ccagcaacaacagcgc

SEQ ID NO: 1898517 - RNA, 15 nt, Shigella flexneri 2a str. 2457T
ccagaugcagcggua

SEQ ID NO: 1898518 - RNA, 18 nt, Shigella flexneri 2a str. 2457T
ccagaugcgacgcuggcc

SEQ ID NO: 1898519 - RNA, 17 nt, Shigella flexneri 2a str. 2457T
ccagauuaccagcgaca

SEQ ID NO: 1898520 - RNA, 18 nt, Shigella flexneri 2a str. 2457T
ccagauccugauccugca

SEQ ID NO: 1898521 - RNA, 18 nt, Shigella flexneri 2a str. 2457T
ccagaucgccugccgcca

SEQ ID NO: 1898522 - RNA, 17 nt, Shigella flexneri 2a str. 2457T
ccagaucccauaaccaa

SEQ ID NO: 1898523 - RNA, 20 nt, Shigella flexneri 2a str. 2457T
ccaccacagacaaucgccag

SEQ ID NO: 1898524 - RNA, 14 nt, Shigella flexneri 2a str. 2457T
ccaccacgccaaga

SEQ ID NO: 1898525 - RNA, 13 nt, Shigella flexneri 2a str. 2457T
ccaccagcgcaau

SEQ ID NO: 1898526 - RNA, 21 nt, Shigella flexneri 2a str. 2457T
ccaccagugcaggcaccagcc

SEQ ID NO: 1898527 - RNA, 17 nt, Shigella flexneri 2a str. 2457T
ccaccaguggacggcug

SEQ ID NO: 1898528 - RNA, 18 nt, Shigella flexneri 2a str. 2457T
aaagcguacccgccugau

SEQ ID NO: 1898529 - RNA, 23 nt, Shigella flexneri 2a str. 2457T
aaaggcaccaauauugacugaug

SEQ ID NO: 1898530 - RNA, 13 nt, Shigella flexneri 2a str. 2457T
aaaggcaaccacg

SEQ ID NO: 1898531 - RNA, 22 nt, Shigella flexneri 2a str. 2457T
aaaggcaccaauauugacugau

SEQ ID NO: 1898532 - RNA, 22 nt, Shigella flexneri 2a str. 2457T
aaaggauguuuaucgccuggua

SEQ ID NO: 1898533 - RNA, 16 nt, Shigella flexneri 2a str. 2457T
ccaccgauuuugagaa

SEQ ID NO: 1898534 - RNA, 16 nt, Shigella flexneri 2a str. 2457T
ccaccgaugaucaaca

SEQ ID NO: 1898535 - RNA, 22 nt, Shigella flexneri 2a str. 2457T
ccaccgcgcguuugaucgacag

SEQ ID NO: 1898536 - RNA, 12 nt, Shigella flexneri 2a str. 2457T
ccaacgcagcaa

SEQ ID NO: 1898537 - RNA, 19 nt, Shigella flexneri 2a str. 2457T
ccaacgcccuuaccgccag

SEQ ID NO: 1898538 - RNA, 22 nt, Shigella flexneri 2a str. 2457T
ccaacgccccguaaaucgucag

SEQ ID NO: 1898539 - RNA, 19 nt, Shigella flexneri 2a str. 2457T
ccaacgcgccaccgaccag

SEQ ID NO: 1898540 - RNA, 18 nt, Shigella flexneri 2a str. 2457T
ccaagaccaauccgccag

SEQ ID NO: 1898541 - RNA, 14 nt, Shigella flexneri 2a str. 2457T
ccaauccgccagcc

SEQ ID NO: 1898542 - RNA, 14 nt, Shigella flexneri 2a str. 2457T
ccaaucaucgcggc

SEQ ID NO: 1898543 - RNA, 16 nt, Shigella flexneri 2a str. 2457T
ccaaucaucgcggcac

SEQ ID NO: 1898544 - RNA, 19 nt, Shigella flexneri 2a str. 2457T
ccaaucagcgcagcaccca

SEQ ID NO: 1898545 - RNA, 20 nt, Shigella flexneri 2a str. 2457T
aaagccggaugaucauccgg

SEQ ID NO: 1898546 - RNA, 14 nt, Shigella flexneri 2a str. 2457T
aaagccgcgugcgc

SEQ ID NO: 1898547 - RNA, 14 nt, Shigella flexneri 2a str. 2457T
ccacaaucagccag

SEQ ID NO: 1898548 - RNA, 15 nt, Shigella flexneri 2a str. 2457T
ccacaagaaugccug

SEQ ID NO: 1898549 - RNA, 17 nt, Shigella flexneri 2a str. 2457T
ccacaaucagccagaac

SEQ ID NO: 1898550 - RNA, 16 nt, Shigella flexneri 2a str. 2457T
ccaaugccguucucug

SEQ ID NO: 1898551 - RNA, 15 nt, Shigella flexneri 2a str. 2457T
ccacaaaaaccgcug

SEQ ID NO: 1898552 - RNA, 23 nt, Shigella flexneri 2a str. 2457T
aaagccuggaccauauuagccgc

SEQ ID NO: 1898553 - RNA, 15 nt, Shigella flexneri 2a str. 2457T
aaagccuuuugccag

SEQ ID NO: 1898554 - RNA, 19 nt, Shigella flexneri 2a str. 2457T
aaagcgcacuuugccagaa

SEQ ID NO: 1898555 - RNA, 18 nt, Shigella flexneri 2a str. 2457T
aaagcgagaguuacagcu

SEQ ID NO: 1898556 - RNA, 19 nt, Shigella flexneri 2a str. 2457T
ccaaugcaggcaucgguga

SEQ ID NO: 1898557 - RNA, 18 nt, Shigella flexneri 2a str. 2457T
cgauucucgccgcccuga

SEQ ID NO: 1898558 - RNA, 14 nt, Shigella flexneri 2a str. 2457T
cgauuaucgguuau

SEQ ID NO: 1898559 - RNA, 13 nt, Shigella flexneri 2a str. 2457T
cgauuaucgucau

SEQ ID NO: 1898560 - RNA, 13 nt, Shigella flexneri 2a str. 2457T
cgauuccaguucg

SEQ ID NO: 1898561 - RNA, 20 nt, Shigella flexneri 2a str. 2457T
cgauucccagucauccggcu

SEQ ID NO: 1898562 - RNA, 17 nt, Shigella flexneri 2a str. 2457T
cgcaaagagagaagcca

SEQ ID NO: 1898563 - RNA, 14 nt, Shigella flexneri 2a str. 2457T
cgcaaccagcguca

SEQ ID NO: 1898564 - RNA, 12 nt, Shigella flexneri 2a str. 2457T
cgcaacaucgca

SEQ ID NO: 1898565 - RNA, 12 nt, Shigella flexneri 2a str. 2457T
cgcaaagcgacg

SEQ ID NO: 1898566 - RNA, 15 nt, Shigella flexneri 2a str. 2457T
cgcaacauugcgccu

SEQ ID NO: 1898567 - RNA, 13 nt, Shigella flexneri 2a str. 2457T
cgauugugcuggu

SEQ ID NO: 1898568 - RNA, 17 nt, Shigella flexneri 2a str. 2457T
cgauugucguguuaagc

SEQ ID NO: 1898569 - RNA, 21 nt, Shigella flexneri 2a str. 2457T
cgauugaucucguugaucacc

SEQ ID NO: 1898570 - RNA, 15 nt, Shigella flexneri 2a str. 2457T
cgauugcucaacgcc

SEQ ID NO: 1898571 - RNA, 19 nt, Shigella flexneri 2a str. 2457T
cgauguacuucaacauaac

SEQ ID NO: 1898572 - RNA, 14 nt, Shigella flexneri 2a str. 2457T
cgauguauccggca

SEQ ID NO: 1898573 - RNA, 23 nt, Shigella flexneri 2a str. 2457T
cgauguccagacgcgcagcuuca

SEQ ID NO: 1898574 - RNA, 18 nt, Shigella flexneri 2a str. 2457T
cgauguguggcaucgucc

SEQ ID NO: 1898575 - RNA, 15 nt, Shigella flexneri 2a str. 2457T
cgaugaucaacagca

SEQ ID NO: 1898576 - RNA, 18 nt, Shigella flexneri 2a str. 2457T
cgaucaaacgccagauca

SEQ ID NO: 1898577 - RNA, 12 nt, Shigella flexneri 2a str. 2457T
cgaucuuccggc

SEQ ID NO: 1898578 - RNA, 13 nt, Shigella flexneri 2a str. 2457T
cgaugcuggcaga

SEQ ID NO: 1898579 - RNA, 21 nt, Shigella flexneri 2a str. 2457T
cgauggcgcagacuuaagauc

SEQ ID NO: 1898580 - RNA, 14 nt, Shigella flexneri 2a str. 2457T
cgcagcugcgcauc

SEQ ID NO: 1898581 - RNA, 22 nt, Shigella flexneri 2a str. 2457T
cgcagcugguguaacugcgcca

SEQ ID NO: 1898582 - RNA, 13 nt, Shigella flexneri 2a str. 2457T
cgcagcuccagcc

SEQ ID NO: 1898583 - RNA, 17 nt, Shigella flexneri 2a str. 2457T
cgcagcucacuucgauc

SEQ ID NO: 1898584 - RNA, 15 nt, Shigella flexneri 2a str. 2457T
cgcagcgucagcacc

SEQ ID NO: 1898585 - RNA, 21 nt, Shigella flexneri 2a str. 2457T
cgcaggaaagauaagcgaaca

SEQ ID NO: 1898586 - RNA, 12 nt, Shigella flexneri 2a str. 2457T
cgcagcuucucg

SEQ ID NO: 1898587 - RNA, 20 nt, Shigella flexneri 2a str. 2457T
cgcaggcgcaauggcgcaau

SEQ ID NO: 1898588 - RNA, 22 nt, Shigella flexneri 2a str. 2457T
cgcagcauugcucaccgccagc

SEQ ID NO: 1898589 - RNA, 22 nt, Shigella flexneri 2a str. 2457T
cgcagccacuccuuauucagcg

SEQ ID NO: 1898590 - RNA, 12 nt, Shigella flexneri 2a str. 2457T
cgcagaauggcg

SEQ ID NO: 1898591 - RNA, 13 nt, Shigella flexneri 2a str. 2457T
cgcaacgacaccg

SEQ ID NO: 1898592 - RNA, 14 nt, Shigella flexneri 2a str. 2457T
cgcacccgccauca

SEQ ID NO: 1898593 - RNA, 20 nt, Shigella flexneri 2a str. 2457T
cgcaccccugauaaccgcau

SEQ ID NO: 1898594 - RNA, 13 nt, Shigella flexneri 2a str. 2457T
cgcacgcuggaga

SEQ ID NO: 1898595 - RNA, 11 nt, Shigella flexneri 2a str. 2457T
cgcacgcucaa

SEQ ID NO: 1898596 - RNA, 18 nt, Shigella flexneri 2a str. 2457T
cgcacggccgcaagcaga

SEQ ID NO: 1898597 - RNA, 13 nt, Shigella flexneri 2a str. 2457T
cgccacggcauga

SEQ ID NO: 1898598 - RNA, 18 nt, Shigella flexneri 2a str. 2457T
cgccacccagcgccgcca

SEQ ID NO: 1898599 - RNA, 13 nt, Shigella flexneri 2a str. 2457T
cgccaccagcuga

SEQ ID NO: 1898600 - RNA, 14 nt, Shigella flexneri 2a str. 2457T
cgccaccccacgau

SEQ ID NO: 1898601 - RNA, 19 nt, Shigella flexneri 2a str. 2457T
cgccaccguguucaugacc

SEQ ID NO: 1898602 - RNA, 23 nt, Shigella flexneri 2a str. 2457T
cgccaaaccgaccaaucacaucg

SEQ ID NO: 1898603 - RNA, 20 nt, Shigella flexneri 2a str. 2457T
cgccaaacccaccagcugau

SEQ ID NO: 1898604 - RNA, 17 nt, Shigella flexneri 2a str. 2457T
cgccaaaacaucuucgg

SEQ ID NO: 1898605 - RNA, 23 nt, Shigella flexneri 2a str. 2457T
cgcauugaacucuucuuccggca

SEQ ID NO: 1898606 - RNA, 20 nt, Shigella flexneri 2a str. 2457T
cgcaggguuugcaucgccau

SEQ ID NO: 1898607 - RNA, 18 nt, Shigella flexneri 2a str. 2457T
cgcauucagcagcagcaa

SEQ ID NO: 1898608 - RNA, 17 nt, Shigella flexneri 2a str. 2457T
cgccaaagaaaccgcgc

SEQ ID NO: 1898609 - RNA, 16 nt, Shigella flexneri 2a str. 2457T
cgccaaagcggcaguu

SEQ ID NO: 1898610 - RNA, 17 nt, Shigella flexneri 2a str. 2457T
cgccaaguucgaacgcc

SEQ ID NO: 1898611 - RNA, 16 nt, Shigella flexneri 2a str. 2457T
cgccaauaaccggcac

SEQ ID NO: 1898612 - RNA, 13 nt, Shigella flexneri 2a str. 2457T
cgccaaucagcgc

SEQ ID NO: 1898613 - RNA, 14 nt, Shigella flexneri 2a str. 2457T
cgccagccgcaguu

SEQ ID NO: 1898614 - RNA, 23 nt, Shigella flexneri 2a str. 2457T
cgccagccaguuuacccagcgaa

SEQ ID NO: 1898615 - RNA, 15 nt, Shigella flexneri 2a str. 2457T
cgccagcagcagcgc

SEQ ID NO: 1898616 - RNA, 15 nt, Shigella flexneri 2a str. 2457T
cgccagcagccauuc

SEQ ID NO: 1898617 - RNA, 19 nt, Shigella flexneri 2a str. 2457T
cgccagcagcagcgccaac

SEQ ID NO: 1898618 - RNA, 15 nt, Shigella flexneri 2a str. 2457T
cgccagcaucgcauc

SEQ ID NO: 1898619 - RNA, 17 nt, Shigella flexneri 2a str. 2457T
cgccagaggcgacaaac

SEQ ID NO: 1898620 - RNA, 20 nt, Shigella flexneri 2a str. 2457T
cgccagauacaucagcgaca

SEQ ID NO: 1898621 - RNA, 18 nt, Shigella flexneri 2a str. 2457T
cgccagagagcggagcaa

SEQ ID NO: 1898622 - RNA, 14 nt, Shigella flexneri 2a str. 2457T
cgccagauuacgcu

SEQ ID NO: 1898623 - RNA, 13 nt, Shigella flexneri 2a str. 2457T
cgccacuaacgca

SEQ ID NO: 1898624 - RNA, 19 nt, Shigella flexneri 2a str. 2457T
cgccacucugacggcgcau

SEQ ID NO: 1898625 - RNA, 14 nt, Shigella flexneri 2a str. 2457T
cgccagaaagcagc

SEQ ID NO: 1898626 - RNA, 19 nt, Shigella flexneri 2a str. 2457T
cgccacuuucacgccgcca

SEQ ID NO: 1898627 - RNA, 15 nt, Shigella flexneri 2a str. 2457T
cgccacuuucacgcc

SEQ ID NO: 1898628 - RNA, 16 nt, Shigella flexneri 2a str. 2457T
cgccaguaccagcagc

SEQ ID NO: 1898629 - RNA, 19 nt, Shigella flexneri 2a str. 2457T
cgccaguguuggcgucaga

SEQ ID NO: 1898630 - RNA, 11 nt, Shigella flexneri 2a str. 2457T
cgccagugauu

SEQ ID NO: 1898631 - RNA, 15 nt, Shigella flexneri 2a str. 2457T
cgccaguucgauauc

SEQ ID NO: 1898632 - RNA, 15 nt, Shigella flexneri 2a str. 2457T
cgccagcgcgcaguu

SEQ ID NO: 1898633 - RNA, 19 nt, Shigella flexneri 2a str. 2457T
cgccagcguguggcgaugg

SEQ ID NO: 1898634 - RNA, 20 nt, Shigella flexneri 2a str. 2457T
cgccaggagacgcgcaaauc

SEQ ID NO: 1898635 - RNA, 19 nt, Shigella flexneri 2a str. 2457T
cgccaggagacgcgcaaau

SEQ ID NO: 1898636 - RNA, 21 nt, Shigella flexneri 2a str. 2457T
cgccaucggcagcaucgcuca

SEQ ID NO: 1898637 - RNA, 14 nt, Shigella flexneri 2a str. 2457T
cgccaucgccagca

SEQ ID NO: 1898638 - RNA, 15 nt, Shigella flexneri 2a str. 2457T
cgccaucgcccaucc

SEQ ID NO: 1898639 - RNA, 17 nt, Shigella flexneri 2a str. 2457T
cgccauaaacagcaggc

SEQ ID NO: 1898640 - RNA, 14 nt, Shigella flexneri 2a str. 2457T
cgccaguuuacugu

SEQ ID NO: 1898641 - RNA, 21 nt, Shigella flexneri 2a str. 2457T
cgccaguuuacugucugcuuc

SEQ ID NO: 1898642 - RNA, 14 nt, Shigella flexneri 2a str. 2457T
cgccaguugcggcu

SEQ ID NO: 1898643 - RNA, 15 nt, Shigella flexneri 2a str. 2457T
cgccaguucuuccag

SEQ ID NO: 1898644 - RNA, 23 nt, Shigella flexneri 2a str. 2457T
cgccaguucuuccaguuccggca

SEQ ID NO: 1898645 - RNA, 23 nt, Shigella flexneri 2a str. 2457T
cgccauauaauacgcaucgacau

SEQ ID NO: 1898646 - RNA, 22 nt, Shigella flexneri 2a str. 2457T
cgccaucagucgaccgacuuua

SEQ ID NO: 1898647 - RNA, 15 nt, Shigella flexneri 2a str. 2457T
cgccaucauacccaa

SEQ ID NO: 1898648 - RNA, 17 nt, Shigella flexneri 2a str. 2457T
cgccauugaaaccgcug

SEQ ID NO: 1898649 - RNA, 20 nt, Shigella flexneri 2a str. 2457T
cgcccaaaccacccagcagc

SEQ ID NO: 1898650 - RNA, 23 nt, Shigella flexneri 2a str. 2457T
cgccauuuugcgcggcauuacgc

SEQ ID NO: 1898651 - RNA, 14 nt, Shigella flexneri 2a str. 2457T
cgcccaauccggcc

SEQ ID NO: 1898652 - RNA, 22 nt, Shigella flexneri 2a str. 2457T
cgcccacgcgcauucccagcgc

SEQ ID NO: 1898653 - RNA, 13 nt, Shigella flexneri 2a str. 2457T
cgaccaggcaaac

SEQ ID NO: 1898654 - RNA, 19 nt, Shigella flexneri 2a str. 2457T
cgaccaggccaucagcagc

SEQ ID NO: 1898655 - RNA, 17 nt, Shigella flexneri 2a str. 2457T
cgacaguuucaccugcu

SEQ ID NO: 1898656 - RNA, 15 nt, Shigella flexneri 2a str. 2457T
cgaccauacagcagc

SEQ ID NO: 1898657 - RNA, 19 nt, Shigella flexneri 2a str. 2457T
cgaccgaagccuuuaccgc

SEQ ID NO: 1898658 - RNA, 15 nt, Shigella flexneri 2a str. 2457T
cgacgcgccagcacc

SEQ ID NO: 1898659 - RNA, 21 nt, Shigella flexneri 2a str. 2457T
cgacgcgcgcgggucaccgcg

SEQ ID NO: 1898660 - RNA, 13 nt, Shigella flexneri 2a str. 2457T
cgacgcgcggugg

SEQ ID NO: 1898661 - RNA, 21 nt, Shigella flexneri 2a str. 2457T
cgaacucauacaccagcggca

SEQ ID NO: 1898662 - RNA, 19 nt, Shigella flexneri 2a str. 2457T
cgaacucauacaccagcgg

SEQ ID NO: 1898663 - RNA, 18 nt, Shigella flexneri 2a str. 2457T
cgaacucauacaccagcg

SEQ ID NO: 1898664 - RNA, 19 nt, Shigella flexneri 2a str. 2457T
ccuguauaaacuauccugu

SEQ ID NO: 1898665 - RNA, 17 nt, Shigella flexneri 2a str. 2457T
cgaagaggaacuguuau

SEQ ID NO: 1898666 - RNA, 13 nt, Shigella flexneri 2a str. 2457T
cgaagacgugcgc

SEQ ID NO: 1898667 - RNA, 20 nt, Shigella flexneri 2a str. 2457T
cgaagauggcauacaacgcc

SEQ ID NO: 1898668 - RNA, 13 nt, Shigella flexneri 2a str. 2457T
cgaaggcggcgaa

SEQ ID NO: 1898669 - RNA, 11 nt, Shigella flexneri 2a str. 2457T
cgaauguuggc

SEQ ID NO: 1898670 - RNA, 15 nt, Shigella flexneri 2a str. 2457T
cgacaguaccagcag

SEQ ID NO: 1898671 - RNA, 21 nt, Shigella flexneri 2a str. 2457T
cgacagcguguuaaugcccau

SEQ ID NO: 1898672 - RNA, 14 nt, Shigella flexneri 2a str. 2457T
cgacagacgccagc

SEQ ID NO: 1898673 - RNA, 20 nt, Shigella flexneri 2a str. 2457T
cgacagauucaggcgcagca

SEQ ID NO: 1898674 - RNA, 13 nt, Shigella flexneri 2a str. 2457T
cgacaauucgcgu

SEQ ID NO: 1898675 - RNA, 17 nt, Shigella flexneri 2a str. 2457T
cgacaaucaaccagcac

SEQ ID NO: 1898676 - RNA, 21 nt, Shigella flexneri 2a str. 2457T
aacaaauaaauagauccagga

SEQ ID NO: 1898677 - RNA, 12 nt, Shigella flexneri 2a str. 2457T
aacaagcgaauu

SEQ ID NO: 1898678 - RNA, 14 nt, Shigella flexneri 2a str. 2457T
cgaguaaucaggcu

SEQ ID NO: 1898679 - RNA, 16 nt, Shigella flexneri 2a str. 2457T
cgagguuuucuucgcc

SEQ ID NO: 1898680 - RNA, 12 nt, Shigella flexneri 2a str. 2457T
cgaguccuucca

SEQ ID NO: 1898681 - RNA, 19 nt, Shigella flexneri 2a str. 2457T
cgauaucuggaucaacgac

SEQ ID NO: 1898682 - RNA, 17 nt, Shigella flexneri 2a str. 2457T
cgauaucggaggccugu

SEQ ID NO: 1898683 - RNA, 14 nt, Shigella flexneri 2a str. 2457T
cgauaucaauauga

SEQ ID NO: 1898684 - RNA, 17 nt, Shigella flexneri 2a str. 2457T
cgauaucgacgaccuga

SEQ ID NO: 1898685 - RNA, 13 nt, Shigella flexneri 2a str. 2457T
cgauaaaucagau

SEQ ID NO: 1898686 - RNA, 15 nt, Shigella flexneri 2a str. 2457T
cgaguuggugcgccg

SEQ ID NO: 1898687 - RNA, 20 nt, Shigella flexneri 2a str. 2457T
cgaggaucuuugccagaucg

SEQ ID NO: 1898688 - RNA, 13 nt, Shigella flexneri 2a str. 2457T
cgaggacagcauc

SEQ ID NO: 1898689 - RNA, 22 nt, Shigella flexneri 2a str. 2457T
cgagccuguaccacaaccugca

SEQ ID NO: 1898690 - RNA, 16 nt, Shigella flexneri 2a str. 2457T
cgacgugcagcaucga

SEQ ID NO: 1898691 - RNA, 16 nt, Shigella flexneri 2a str. 2457T
cgacgugaccuuucag

SEQ ID NO: 1898692 - RNA, 16 nt, Shigella flexneri 2a str. 2457T
cgacgcguaugucgau

SEQ ID NO: 1898693 - RNA, 16 nt, Shigella flexneri 2a str. 2457T
cgagaguuacagcucu

SEQ ID NO: 1898694 - RNA, 17 nt, Shigella flexneri 2a str. 2457T
cgagauacaucaccgcc

SEQ ID NO: 1898695 - RNA, 16 nt, Shigella flexneri 2a str. 2457T
cgacuuucucuucauc

SEQ ID NO: 1898696 - RNA, 20 nt, Shigella flexneri 2a str. 2457T
cgacuuugccuggcggcaga

SEQ ID NO: 1898697 - RNA, 12 nt, Shigella flexneri 2a str. 2457T
cgacuuuaccgc

SEQ ID NO: 1898698 - RNA, 23 nt, Shigella flexneri 2a str. 2457T
cgacuucagauaaaucacgcuuc

SEQ ID NO: 1898699 - RNA, 12 nt, Shigella flexneri 2a str. 2457T
cgacuucauuca

SEQ ID NO: 1898700 - RNA, 16 nt, Shigella flexneri 2a str. 2457T
cgagcacgacuuucuc

SEQ ID NO: 1898701 - RNA, 13 nt, Shigella flexneri 2a str. 2457T
cgagcacgccgcc

SEQ ID NO: 1898702 - RNA, 23 nt, Shigella flexneri 2a str. 2457T
cgagcagagaaacgccagcagca

SEQ ID NO: 1898703 - RNA, 18 nt, Shigella flexneri 2a str. 2457T
cgagcagagaaacgccag

SEQ ID NO: 1898704 - RNA, 16 nt, Shigella flexneri 2a str. 2457T
aacacccgucgcggca

SEQ ID NO: 1898705 - RNA, 18 nt, Shigella flexneri 2a str. 2457T
cgagcauugccagcauug

SEQ ID NO: 1898706 - RNA, 16 nt, Shigella flexneri 2a str. 2457T
cgagcaguacagccgc

SEQ ID NO: 1898707 - RNA, 22 nt, Shigella flexneri 2a str. 2457T
cgagcaguacagccgccagaca

SEQ ID NO: 1898708 - RNA, 14 nt, Shigella flexneri 2a str. 2457T
ccggcuuucugcaa

SEQ ID NO: 1898709 - RNA, 22 nt, Shigella flexneri 2a str. 2457T
ccgggaacuggcaacaauggca

SEQ ID NO: 1898710 - RNA, 15 nt, Shigella flexneri 2a str. 2457T
ccgguaauaaugcag

SEQ ID NO: 1898711 - RNA, 14 nt, Shigella flexneri 2a str. 2457T
ccgguaaucaggca

SEQ ID NO: 1898712 - RNA, 20 nt, Shigella flexneri 2a str. 2457T
ccgguaaagcaaugaagaac

SEQ ID NO: 1898713 - RNA, 13 nt, Shigella flexneri 2a str. 2457T
ccgguaauaaugc

SEQ ID NO: 1898714 - RNA, 14 nt, Shigella flexneri 2a str. 2457T
ccgguaguuucagc

SEQ ID NO: 1898715 - RNA, 20 nt, Shigella flexneri 2a str. 2457T
ccggucagcagcaccaccgc

SEQ ID NO: 1898716 - RNA, 19 nt, Shigella flexneri 2a str. 2457T
ccggucacgcccggaauuu

SEQ ID NO: 1898717 - RNA, 18 nt, Shigella flexneri 2a str. 2457T
ccgugcugugugccgcga

SEQ ID NO: 1898718 - RNA, 10 nt, Shigella flexneri 2a str. 2457T
ccgucgcaug

SEQ ID NO: 1898719 - RNA, 21 nt, Shigella flexneri 2a str. 2457T
ccgucguugagcaucugcaaa

SEQ ID NO: 1898720 - RNA, 12 nt, Shigella flexneri 2a str. 2457T
ccgucaccggca

SEQ ID NO: 1898721 - RNA, 20 nt, Shigella flexneri 2a str. 2457T
ccgucacuucuucgcgaucg

SEQ ID NO: 1898722 - RNA, 13 nt, Shigella flexneri 2a str. 2457T
ccgucaucgacaa

SEQ ID NO: 1898723 - RNA, 19 nt, Shigella flexneri 2a str. 2457T
ccgucagcgaucagcauuu

SEQ ID NO: 1898724 - RNA, 18 nt, Shigella flexneri 2a str. 2457T
ccguagcuucaccgcauc

SEQ ID NO: 1898725 - RNA, 22 nt, Shigella flexneri 2a str. 2457T
ccgguucguugaucacuuucac

SEQ ID NO: 1898726 - RNA, 19 nt, Shigella flexneri 2a str. 2457T
ccgguucgucauacuccag

SEQ ID NO: 1898727 - RNA, 21 nt, Shigella flexneri 2a str. 2457T
ccuccagcgagcuggcgcuga

SEQ ID NO: 1898728 - RNA, 22 nt, Shigella flexneri 2a str. 2457T
ccguggucggcaaaauacauga

SEQ ID NO: 1898729 - RNA, 22 nt, Shigella flexneri 2a str. 2457T
ccucacgaucacagcaguccag

SEQ ID NO: 1898730 - RNA, 16 nt, Shigella flexneri 2a str. 2457T
ccucagcagacugaua

SEQ ID NO: 1898731 - RNA, 14 nt, Shigella flexneri 2a str. 2457T
ccuccaagccugau

SEQ ID NO: 1898732 - RNA, 15 nt, Shigella flexneri 2a str. 2457T
ccucgccguuaauga

SEQ ID NO: 1898733 - RNA, 15 nt, Shigella flexneri 2a str. 2457T
ccucuuccauaaucg

SEQ ID NO: 1898734 - RNA, 15 nt, Shigella flexneri 2a str. 2457T
ccugaacaggucacc

SEQ ID NO: 1898735 - RNA, 13 nt, Shigella flexneri 2a str. 2457T
ccugaaaccauag

SEQ ID NO: 1898736 - RNA, 17 nt, Shigella flexneri 2a str. 2457T
ccugaaaguauuugacu

SEQ ID NO: 1898737 - RNA, 21 nt, Shigella flexneri 2a str. 2457T
ccugaacucgccgcacaggcg

SEQ ID NO: 1898738 - RNA, 14 nt, Shigella flexneri 2a str. 2457T
ccugagaagcgcaa

SEQ ID NO: 1898739 - RNA, 17 nt, Shigella flexneri 2a str. 2457T
ccugaauauacgccaga

SEQ ID NO: 1898740 - RNA, 19 nt, Shigella flexneri 2a str. 2457T
ccugaagguguuugacugu

SEQ ID NO: 1898741 - RNA, 14 nt, Shigella flexneri 2a str. 2457T
ccugcaucgccuga

SEQ ID NO: 1898742 - RNA, 22 nt, Shigella flexneri 2a str. 2457T
ccugcauaaaggaguaacagau

SEQ ID NO: 1898743 - RNA, 16 nt, Shigella flexneri 2a str. 2457T
ccugcauaaacgccgu

SEQ ID NO: 1898744 - RNA, 19 nt, Shigella flexneri 2a str. 2457T
ccugcacaaauagccagca

SEQ ID NO: 1898745 - RNA, 16 nt, Shigella flexneri 2a str. 2457T
ccugcaacagcaccag

SEQ ID NO: 1898746 - RNA, 17 nt, Shigella flexneri 2a str. 2457T
ccugauagcacgucacg

SEQ ID NO: 1898747 - RNA, 15 nt, Shigella flexneri 2a str. 2457T
ccugaucaagcacau

SEQ ID NO: 1898748 - RNA, 18 nt, Shigella flexneri 2a str. 2457T
ccugaugcgcugcgcuua

SEQ ID NO: 1898749 - RNA, 19 nt, Shigella flexneri 2a str. 2457T
ccugaugcgaugcuugacg

SEQ ID NO: 1898750 - RNA, 15 nt, Shigella flexneri 2a str. 2457T
ccugauguacaacca

SEQ ID NO: 1898751 - RNA, 16 nt, Shigella flexneri 2a str. 2457T
ccuggcccaucgccag

SEQ ID NO: 1898752 - RNA, 12 nt, Shigella flexneri 2a str. 2457T
ccuggcgcgaaa

SEQ ID NO: 1898753 - RNA, 21 nt, Shigella flexneri 2a str. 2457T
ccuggcugauugauauccaga

SEQ ID NO: 1898754 - RNA, 14 nt, Shigella flexneri 2a str. 2457T
ccugcugugccgua

SEQ ID NO: 1898755 - RNA, 12 nt, Shigella flexneri 2a str. 2457T
ccugcuggcagu

SEQ ID NO: 1898756 - RNA, 14 nt, Shigella flexneri 2a str. 2457T
ccugcugaacguga

SEQ ID NO: 1898757 - RNA, 17 nt, Shigella flexneri 2a str. 2457T
ccugcugauuauccgca

SEQ ID NO: 1898758 - RNA, 19 nt, Shigella flexneri 2a str. 2457T
ccugcucuuucagcaccgc

SEQ ID NO: 1898759 - RNA, 22 nt, Shigella flexneri 2a str. 2457T
ccugcggguucuuaccggugac

SEQ ID NO: 1898760 - RNA, 22 nt, Shigella flexneri 2a str. 2457T
ccugcguucagcaguucugcca

SEQ ID NO: 1898761 - RNA, 14 nt, Shigella flexneri 2a str. 2457T
ccugcggccagcag

SEQ ID NO: 1898762 - RNA, 19 nt, Shigella flexneri 2a str. 2457T
ccugcggcggcaucgccuu

SEQ ID NO: 1898763 - RNA, 16 nt, Shigella flexneri 2a str. 2457T
ccugccaugcgcaauc

SEQ ID NO: 1898764 - RNA, 14 nt, Shigella flexneri 2a str. 2457T
ccugccaucuggca

SEQ ID NO: 1898765 - RNA, 22 nt, Shigella flexneri 2a str. 2457T
ccugccguuguugccuuauugc

SEQ ID NO: 1898766 - RNA, 13 nt, Shigella flexneri 2a str. 2457T
ccugccgccagca

SEQ ID NO: 1898767 - RNA, 22 nt, Shigella flexneri 2a str. 2457T
ccgccagaaauggagacgguuu

SEQ ID NO: 1898768 - RNA, 15 nt, Shigella flexneri 2a str. 2457T
ccgcauccggcauga

SEQ ID NO: 1898769 - RNA, 15 nt, Shigella flexneri 2a str. 2457T
ccgcauccggcaauu

SEQ ID NO: 1898770 - RNA, 17 nt, Shigella flexneri 2a str. 2457T
ccgccaguucuuccagu

SEQ ID NO: 1898771 - RNA, 12 nt, Shigella flexneri 2a str. 2457T
ccgccagcgcca

SEQ ID NO: 1898772 - RNA, 11 nt, Shigella flexneri 2a str. 2457T
ccgccagcgcg

SEQ ID NO: 1898773 - RNA, 15 nt, Shigella flexneri 2a str. 2457T
ccgccagcgccaucu

SEQ ID NO: 1898774 - RNA, 15 nt, Shigella flexneri 2a str. 2457T
ccgcaguaaagcgca

SEQ ID NO: 1898775 - RNA, 19 nt, Shigella flexneri 2a str. 2457T
ccgcauaugagcgucgaag

SEQ ID NO: 1898776 - RNA, 22 nt, Shigella flexneri 2a str. 2457T
ccgcaguuaaagcaauuccagc

SEQ ID NO: 1898777 - RNA, 23 nt, Shigella flexneri 2a str. 2457T
ccgcaguuaaagcaauuccagcg

SEQ ID NO: 1898778 - RNA, 14 nt, Shigella flexneri 2a str. 2457T
ccgcagccgccaca

SEQ ID NO: 1898779 - RNA, 13 nt, Shigella flexneri 2a str. 2457T
ccgagcaguugcu

SEQ ID NO: 1898780 - RNA, 20 nt, Shigella flexneri 2a str. 2457T
ccgcccguuccaccgcguuu

SEQ ID NO: 1898781 - RNA, 13 nt, Shigella flexneri 2a str. 2457T
ccgcccgcuauga

SEQ ID NO: 1898782 - RNA, 21 nt, Shigella flexneri 2a str. 2457T
ccgcccuguuugguugccagc

SEQ ID NO: 1898783 - RNA, 13 nt, Shigella flexneri 2a str. 2457T
ccgccgccauccu

SEQ ID NO: 1898784 - RNA, 23 nt, Shigella flexneri 2a str. 2457T
ccgccgauuuccugcgucgcuag

SEQ ID NO: 1898785 - RNA, 17 nt, Shigella flexneri 2a str. 2457T
ccgccgaggauacagcc

SEQ ID NO: 1898786 - RNA, 23 nt, Shigella flexneri 2a str. 2457T
ccgcgccugaccauuaucaaaca

SEQ ID NO: 1898787 - RNA, 11 nt, Shigella flexneri 2a str. 2457T
ccgcgccagcg

SEQ ID NO: 1898788 - RNA, 13 nt, Shigella flexneri 2a str. 2457T
ccgcgcaauaugc

SEQ ID NO: 1898789 - RNA, 19 nt, Shigella flexneri 2a str. 2457T
ccgcgaucgccugcagggc

SEQ ID NO: 1898790 - RNA, 18 nt, Shigella flexneri 2a str. 2457T
ccgcgaguaaucacauca

SEQ ID NO: 1898791 - RNA, 14 nt, Shigella flexneri 2a str. 2457T
aaaugcgcaugaug

SEQ ID NO: 1898792 - RNA, 12 nt, Shigella flexneri 2a str. 2457T
aaaugccugaug

SEQ ID NO: 1898793 - RNA, 20 nt, Shigella flexneri 2a str. 2457T
aaaugcagcauugccugaug

SEQ ID NO: 1898794 - RNA, 19 nt, Shigella flexneri 2a str. 2457T
aaaugcaucagugacaaau

SEQ ID NO: 1898795 - RNA, 14 nt, Shigella flexneri 2a str. 2457T
aaaugcaucggcau

SEQ ID NO: 1898796 - RNA, 17 nt, Shigella flexneri 2a str. 2457T
ccgccguaaaucccgcc

SEQ ID NO: 1898797 - RNA, 17 nt, Shigella flexneri 2a str. 2457T
ccgccuucugcgguacg

SEQ ID NO: 1898798 - RNA, 15 nt, Shigella flexneri 2a str. 2457T
ccgccuggcgcugcu

SEQ ID NO: 1898799 - RNA, 14 nt, Shigella flexneri 2a str. 2457T
ccgccuguuccagc

SEQ ID NO: 1898800 - RNA, 21 nt, Shigella flexneri 2a str. 2457T
ccgccguugccgcagcgaugg

SEQ ID NO: 1898801 - RNA, 14 nt, Shigella flexneri 2a str. 2457T
ccgccucaggcaac

SEQ ID NO: 1898802 - RNA, 22 nt, Shigella flexneri 2a str. 2457T
ccgccucaccgccauuugcauc

SEQ ID NO: 1898803 - RNA, 18 nt, Shigella flexneri 2a str. 2457T
ccgccucccuucgcugcu

SEQ ID NO: 1898804 - RNA, 18 nt, Shigella flexneri 2a str. 2457T
ccggaugaaaagucaucc

SEQ ID NO: 1898805 - RNA, 22 nt, Shigella flexneri 2a str. 2457T
ccggcaccaaucaccgccagca

SEQ ID NO: 1898806 - RNA, 22 nt, Shigella flexneri 2a str. 2457T
ccggcacaaagcuguaucccag

SEQ ID NO: 1898807 - RNA, 15 nt, Shigella flexneri 2a str. 2457T
ccggcaaucgccaga

SEQ ID NO: 1898808 - RNA, 17 nt, Shigella flexneri 2a str. 2457T
ccggcaaucgccagauc

SEQ ID NO: 1898809 - RNA, 14 nt, Shigella flexneri 2a str. 2457T
ccggcaaccagcac

SEQ ID NO: 1898810 - RNA, 24 nt, Shigella flexneri 2a str. 2457T
ccggcagucaguguuaucaaauca

SEQ ID NO: 1898811 - RNA, 18 nt, Shigella flexneri 2a str. 2457T
ccggcgacuaacggaauu

SEQ ID NO: 1898812 - RNA, 23 nt, Shigella flexneri 2a str. 2457T
ccggccuguuuauccaucacgcu

SEQ ID NO: 1898813 - RNA, 16 nt, Shigella flexneri 2a str. 2457T
ccggcauccagcguuc

SEQ ID NO: 1898814 - RNA, 14 nt, Shigella flexneri 2a str. 2457T
ccggccauuccagc

SEQ ID NO: 1898815 - RNA, 16 nt, Shigella flexneri 2a str. 2457T
ccgcugauuccugcaa

SEQ ID NO: 1898816 - RNA, 12 nt, Shigella flexneri 2a str. 2457T
ccgcucgcuggu

SEQ ID NO: 1898817 - RNA, 19 nt, Shigella flexneri 2a str. 2457T
ccgcguuuguugcgcuaag

SEQ ID NO: 1898818 - RNA, 14 nt, Shigella flexneri 2a str. 2457T
ccgcgugacgcugg

SEQ ID NO: 1898819 - RNA, 14 nt, Shigella flexneri 2a str. 2457T
ccgcguuuuccagu

SEQ ID NO: 1898820 - RNA, 16 nt, Shigella flexneri 2a str. 2457T
ccgcgugaaaugccaa

SEQ ID NO: 1898821 - RNA, 14 nt, Shigella flexneri 2a str. 2457T
ccgcguaaucaaca

SEQ ID NO: 1898822 - RNA, 16 nt, Shigella flexneri 2a str. 2457T
ccggaccagacgaucg

SEQ ID NO: 1898823 - RNA, 13 nt, Shigella flexneri 2a str. 2457T
ccggacacugcuu

SEQ ID NO: 1898824 - RNA, 17 nt, Shigella flexneri 2a str. 2457T
ccggaagagagcagccg

SEQ ID NO: 1898825 - RNA, 12 nt, Shigella flexneri 2a str. 2457T
ccggaaggcaua

SEQ ID NO: 1898826 - RNA, 14 nt, Shigella flexneri 2a str. 2457T
ccggaacgugcaua

SEQ ID NO: 1898827 - RNA, 21 nt, Shigella flexneri 2a str. 2457T
ccgcugcuuaauuacugccuu

SEQ ID NO: 1898828 - RNA, 20 nt, Shigella flexneri 2a str. 2457T
ccggacgacggcaucgccau

SEQ ID NO: 1898829 - RNA, 12 nt, Shigella flexneri 2a str. 2457T
ccggagacgacg

SEQ ID NO: 1898830 - RNA, 21 nt, Shigella flexneri 2a str. 2457T
ccggauaagguguuuacaccg

SEQ ID NO: 1898831 - RNA, 21 nt, Shigella flexneri 2a str. 2457T
ccggaggucaguaaugagcac

SEQ ID NO: 1898832 - RNA, 22 nt, Shigella flexneri 2a str. 2457T
ccggauaagaugcgccagcauc

SEQ ID NO: 1898833 - RNA, 20 nt, Shigella flexneri 2a str. 2457T
cggccuugcggguaguccgc

SEQ ID NO: 1898834 - RNA, 13 nt, Shigella flexneri 2a str. 2457T
cggcgauaccagu

SEQ ID NO: 1898835 - RNA, 16 nt, Shigella flexneri 2a str. 2457T
cggcgacuggauaaug

SEQ ID NO: 1898836 - RNA, 21 nt, Shigella flexneri 2a str. 2457T
cggcgagaucuuuaucaauca

SEQ ID NO: 1898837 - RNA, 18 nt, Shigella flexneri 2a str. 2457T
cggcgcaucggucgauga

SEQ ID NO: 1898838 - RNA, 17 nt, Shigella flexneri 2a str. 2457T
cggcggaucaccgcguc

SEQ ID NO: 1898839 - RNA, 14 nt, Shigella flexneri 2a str. 2457T
cggcgcuacggcgu

SEQ ID NO: 1898840 - RNA, 17 nt, Shigella flexneri 2a str. 2457T
cggcgcuaauucaacgc

SEQ ID NO: 1898841 - RNA, 13 nt, Shigella flexneri 2a str. 2457T
cggcgcucaaucc

SEQ ID NO: 1898842 - RNA, 22 nt, Shigella flexneri 2a str. 2457T
cggcgcguugccgagaaaaucg

SEQ ID NO: 1898843 - RNA, 17 nt, Shigella flexneri 2a str. 2457T
cggcacuguuucgccag

SEQ ID NO: 1898844 - RNA, 15 nt, Shigella flexneri 2a str. 2457T
cggcacguuccugca

SEQ ID NO: 1898845 - RNA, 23 nt, Shigella flexneri 2a str. 2457T
cggcacucuuucagcaacauggu

SEQ ID NO: 1898846 - RNA, 21 nt, Shigella flexneri 2a str. 2457T
cggcagaucaaauucaaugac

SEQ ID NO: 1898847 - RNA, 17 nt, Shigella flexneri 2a str. 2457T
aacaguucagcagcacu

SEQ ID NO: 1898848 - RNA, 15 nt, Shigella flexneri 2a str. 2457T
aacauagcuuggcag

SEQ ID NO: 1898849 - RNA, 21 nt, Shigella flexneri 2a str. 2457T
cggcagcaauggcacugucga

SEQ ID NO: 1898850 - RNA, 15 nt, Shigella flexneri 2a str. 2457T
cggcagcaaucgacc

SEQ ID NO: 1898851 - RNA, 21 nt, Shigella flexneri 2a str. 2457T
cggcacgcguugcgcaugacc

SEQ ID NO: 1898852 - RNA, 20 nt, Shigella flexneri 2a str. 2457T
cggcaugcaaucuuagcgga

SEQ ID NO: 1898853 - RNA, 14 nt, Shigella flexneri 2a str. 2457T
cggcaugauaccga

SEQ ID NO: 1898854 - RNA, 18 nt, Shigella flexneri 2a str. 2457T
cggcaucgccgcuaucgc

SEQ ID NO: 1898855 - RNA, 22 nt, Shigella flexneri 2a str. 2457T
cggcauaaucauuacaaccgcu

SEQ ID NO: 1898856 - RNA, 19 nt, Shigella flexneri 2a str. 2457T
cggcagugcuuucauuuca

SEQ ID NO: 1898857 - RNA, 15 nt, Shigella flexneri 2a str. 2457T
cggccaaauauccgc

SEQ ID NO: 1898858 - RNA, 14 nt, Shigella flexneri 2a str. 2457T
cggcagcgguucca

SEQ ID NO: 1898859 - RNA, 12 nt, Shigella flexneri 2a str. 2457T
cggcagcgaacc

SEQ ID NO: 1898860 - RNA, 20 nt, Shigella flexneri 2a str. 2457T
aacaucauaauaauugcggc

SEQ ID NO: 1898861 - RNA, 20 nt, Shigella flexneri 2a str. 2457T
cggucgaggcaaccagcacg

SEQ ID NO: 1898862 - RNA, 14 nt, Shigella flexneri 2a str. 2457T
cggucagcagcacc

SEQ ID NO: 1898863 - RNA, 23 nt, Shigella flexneri 2a str. 2457T
cggucagccauugcuaccgcuuc

SEQ ID NO: 1898864 - RNA, 14 nt, Shigella flexneri 2a str. 2457T
cggucacgcccgga

SEQ ID NO: 1898865 - RNA, 14 nt, Shigella flexneri 2a str. 2457T
cgguaauuccggcg

SEQ ID NO: 1898866 - RNA, 17 nt, Shigella flexneri 2a str. 2457T
cgguaaaugcucauacc

SEQ ID NO: 1898867 - RNA, 21 nt, Shigella flexneri 2a str. 2457T
cgguaagcccgugaccagcga

SEQ ID NO: 1898868 - RNA, 18 nt, Shigella flexneri 2a str. 2457T
cgguaaaauggucagcca

SEQ ID NO: 1898869 - RNA, 17 nt, Shigella flexneri 2a str. 2457T
aacccaccaugccgaug

SEQ ID NO: 1898870 - RNA, 21 nt, Shigella flexneri 2a str. 2457T
aacccacuggcaaucaguggc

SEQ ID NO: 1898871 - RNA, 20 nt, Shigella flexneri 2a str. 2457T
cgguagcaugaaccauuauc

SEQ ID NO: 1898872 - RNA, 21 nt, Shigella flexneri 2a str. 2457T
cgguagcagcuuucagcagcg

SEQ ID NO: 1898873 - RNA, 14 nt, Shigella flexneri 2a str. 2457T
cgguauagaucaga

SEQ ID NO: 1898874 - RNA, 17 nt, Shigella flexneri 2a str. 2457T
cgguaguggcaaccagc

SEQ ID NO: 1898875 - RNA, 20 nt, Shigella flexneri 2a str. 2457T
cgguauuaaucugccagcgu

SEQ ID NO: 1898876 - RNA, 17 nt, Shigella flexneri 2a str. 2457T
cgggucaccugccaggg

SEQ ID NO: 1898877 - RNA, 13 nt, Shigella flexneri 2a str. 2457T
aaccacugcgcca

SEQ ID NO: 1898878 - RNA, 18 nt, Shigella flexneri 2a str. 2457T
aaccagcacaaaguggcg

SEQ ID NO: 1898879 - RNA, 16 nt, Shigella flexneri 2a str. 2457T
cggguccgggcaucag

SEQ ID NO: 1898880 - RNA, 17 nt, Shigella flexneri 2a str. 2457T
aaccacacaggcaucgu

SEQ ID NO: 1898881 - RNA, 15 nt, Shigella flexneri 2a str. 2457T
aaccacagauccgga

SEQ ID NO: 1898882 - RNA, 22 nt, Shigella flexneri 2a str. 2457T
aaccacggaaaggcaguucagg

SEQ ID NO: 1898883 - RNA, 15 nt, Shigella flexneri 2a str. 2457T
aaccacggcagcaac

SEQ ID NO: 1898884 - RNA, 14 nt, Shigella flexneri 2a str. 2457T
aaccaccuccacgc

SEQ ID NO: 1898885 - RNA, 19 nt, Shigella flexneri 2a str. 2457T
aaccacgcagcguuggcag

SEQ ID NO: 1898886 - RNA, 13 nt, Shigella flexneri 2a str. 2457T
aaccaacggccuu

SEQ ID NO: 1898887 - RNA, 17 nt, Shigella flexneri 2a str. 2457T
aaccaaacuuaugcagc

SEQ ID NO: 1898888 - RNA, 11 nt, Shigella flexneri 2a str. 2457T
aaccaaagcgu

SEQ ID NO: 1898889 - RNA, 17 nt, Shigella flexneri 2a str. 2457T
aaccaaacagcgccaga

SEQ ID NO: 1898890 - RNA, 17 nt, Shigella flexneri 2a str. 2457T
cggggugcaucgcccug

SEQ ID NO: 1898891 - RNA, 16 nt, Shigella flexneri 2a str. 2457T
cgggucguuuucaguu

SEQ ID NO: 1898892 - RNA, 16 nt, Shigella flexneri 2a str. 2457T
cgggugcaaucaacac

SEQ ID NO: 1898893 - RNA, 14 nt, Shigella flexneri 2a str. 2457T
aaccaggucgcauc

SEQ ID NO: 1898894 - RNA, 18 nt, Shigella flexneri 2a str. 2457T
cggguguccacucgguaa

SEQ ID NO: 1898895 - RNA, 19 nt, Shigella flexneri 2a str. 2457T
cggcgucaucgacaucaac

SEQ ID NO: 1898896 - RNA, 22 nt, Shigella flexneri 2a str. 2457T
cggcgugaacgccuuauccggc

SEQ ID NO: 1898897 - RNA, 21 nt, Shigella flexneri 2a str. 2457T
cggcgucugguaucgcgccag

SEQ ID NO: 1898898 - RNA, 18 nt, Shigella flexneri 2a str. 2457T
cggcguacuaucugcugc

SEQ ID NO: 1898899 - RNA, 22 nt, Shigella flexneri 2a str. 2457T
cggcgucauuuuuucgacauca

SEQ ID NO: 1898900 - RNA, 19 nt, Shigella flexneri 2a str. 2457T
cggcgucauaauccggcaa

SEQ ID NO: 1898901 - RNA, 17 nt, Shigella flexneri 2a str. 2457T
cggcguuaugccuguaa

SEQ ID NO: 1898902 - RNA, 23 nt, Shigella flexneri 2a str. 2457T
cggcguuuuguagagcagcacgc

SEQ ID NO: 1898903 - RNA, 20 nt, Shigella flexneri 2a str. 2457T
cggcguuuucucaucgcugc

SEQ ID NO: 1898904 - RNA, 13 nt, Shigella flexneri 2a str. 2457T
cggcuauuuccgg

SEQ ID NO: 1898905 - RNA, 14 nt, Shigella flexneri 2a str. 2457T
cggcucauugccau

SEQ ID NO: 1898906 - RNA, 20 nt, Shigella flexneri 2a str. 2457T
cggcuucgccuccuguucug

SEQ ID NO: 1898907 - RNA, 19 nt, Shigella flexneri 2a str. 2457T
cggcuggugauuucgucca

SEQ ID NO: 1898908 - RNA, 20 nt, Shigella flexneri 2a str. 2457T
cggcuggugauuucguccag

SEQ ID NO: 1898909 - RNA, 22 nt, Shigella flexneri 2a str. 2457T
cggcuguaguccuaacagagca

SEQ ID NO: 1898910 - RNA, 16 nt, Shigella flexneri 2a str. 2457T
cggcucucaccuugua

SEQ ID NO: 1898911 - RNA, 13 nt, Shigella flexneri 2a str. 2457T
cgggcgacgaaca

SEQ ID NO: 1898912 - RNA, 14 nt, Shigella flexneri 2a str. 2457T
cgggcgaccaauca

SEQ ID NO: 1898913 - RNA, 22 nt, Shigella flexneri 2a str. 2457T
cgggcuaacuucuuuuucgaca

SEQ ID NO: 1898914 - RNA, 15 nt, Shigella flexneri 2a str. 2457T
cgggccaaagcauuc

SEQ ID NO: 1898915 - RNA, 16 nt, Shigella flexneri 2a str. 2457T
cgggcaggcuucaaca

SEQ ID NO: 1898916 - RNA, 15 nt, Shigella flexneri 2a str. 2457T
cgggcaaagcgacgc

SEQ ID NO: 1898917 - RNA, 14 nt, Shigella flexneri 2a str. 2457T
cgggcaaagcgacg

SEQ ID NO: 1898918 - RNA, 17 nt, Shigella flexneri 2a str. 2457T
cgggcacaggcgaugcc

SEQ ID NO: 1898919 - RNA, 17 nt, Shigella flexneri 2a str. 2457T
cgggcacagauuuccaa

SEQ ID NO: 1898920 - RNA, 16 nt, Shigella flexneri 2a str. 2457T
cggcuugaaccagcca

SEQ ID NO: 1898921 - RNA, 14 nt, Shigella flexneri 2a str. 2457T
cgggaccagcauuc

SEQ ID NO: 1898922 - RNA, 13 nt, Shigella flexneri 2a str. 2457T
cgcuggucaguga

SEQ ID NO: 1898923 - RNA, 13 nt, Shigella flexneri 2a str. 2457T
cgcuggcgcaugu

SEQ ID NO: 1898924 - RNA, 16 nt, Shigella flexneri 2a str. 2457T
cgcuggcgucacgccg

SEQ ID NO: 1898925 - RNA, 15 nt, Shigella flexneri 2a str. 2457T
cgcugcugcguaugg

SEQ ID NO: 1898926 - RNA, 23 nt, Shigella flexneri 2a str. 2457T
cgcuggcagcugcuacgccguca

SEQ ID NO: 1898927 - RNA, 19 nt, Shigella flexneri 2a str. 2457T
cgcugcgcaaagaugcgau

SEQ ID NO: 1898928 - RNA, 13 nt, Shigella flexneri 2a str. 2457T
cgcugccgcuucu

SEQ ID NO: 1898929 - RNA, 17 nt, Shigella flexneri 2a str. 2457T
cgcugauaaaucccgcc

SEQ ID NO: 1898930 - RNA, 22 nt, Shigella flexneri 2a str. 2457T
cgcugcaaguuuugucaguucg

SEQ ID NO: 1898931 - RNA, 22 nt, Shigella flexneri 2a str. 2457T
cgcugauuugcuucaauacgcu

SEQ ID NO: 1898932 - RNA, 20 nt, Shigella flexneri 2a str. 2457T
cgcugauuggccccauugcc

SEQ ID NO: 1898933 - RNA, 23 nt, Shigella flexneri 2a str. 2457T
cgcuuucauguuaaauuccggcu

SEQ ID NO: 1898934 - RNA, 15 nt, Shigella flexneri 2a str. 2457T
cgcuuucagugucug

SEQ ID NO: 1898935 - RNA, 14 nt, Shigella flexneri 2a str. 2457T
cgcuuguucgcaua

SEQ ID NO: 1898936 - RNA, 23 nt, Shigella flexneri 2a str. 2457T
cgcuugcguaucgacggcguauu

SEQ ID NO: 1898937 - RNA, 22 nt, Shigella flexneri 2a str. 2457T
cgcuugcuaacgcccgccguga

SEQ ID NO: 1898938 - RNA, 21 nt, Shigella flexneri 2a str. 2457T
cgcuuuuuccaggcuggcagg

SEQ ID NO: 1898939 - RNA, 18 nt, Shigella flexneri 2a str. 2457T
cggaacacucuuccaguc

SEQ ID NO: 1898940 - RNA, 20 nt, Shigella flexneri 2a str. 2457T
cggaaugauauuggucacca

SEQ ID NO: 1898941 - RNA, 17 nt, Shigella flexneri 2a str. 2457T
cggaaugcagucacgcc

SEQ ID NO: 1898942 - RNA, 21 nt, Shigella flexneri 2a str. 2457T
cggaacaucgccugccgcagg

SEQ ID NO: 1898943 - RNA, 17 nt, Shigella flexneri 2a str. 2457T
cggaaggcauaacgacc

SEQ ID NO: 1898944 - RNA, 18 nt, Shigella flexneri 2a str. 2457T
cggaacuugccgggcgca

SEQ ID NO: 1898945 - RNA, 20 nt, Shigella flexneri 2a str. 2457T
cgcugucuggcgucuccugc

SEQ ID NO: 1898946 - RNA, 16 nt, Shigella flexneri 2a str. 2457T
cgcuuacacacccggc

SEQ ID NO: 1898947 - RNA, 15 nt, Shigella flexneri 2a str. 2457T
cgcuuacaucaacuc

SEQ ID NO: 1898948 - RNA, 15 nt, Shigella flexneri 2a str. 2457T
cgcuuacgccugcca

SEQ ID NO: 1898949 - RNA, 21 nt, Shigella flexneri 2a str. 2457T
cgcuguguguaggccagcgau

SEQ ID NO: 1898950 - RNA, 16 nt, Shigella flexneri 2a str. 2457T
cgcuguccggcgcacu

SEQ ID NO: 1898951 - RNA, 13 nt, Shigella flexneri 2a str. 2457T
cgcuucugcguuc

SEQ ID NO: 1898952 - RNA, 14 nt, Shigella flexneri 2a str. 2457T
cgcuucggcgcaua

SEQ ID NO: 1898953 - RNA, 20 nt, Shigella flexneri 2a str. 2457T
cgcuucggcuccagcgcguc

SEQ ID NO: 1898954 - RNA, 23 nt, Shigella flexneri 2a str. 2457T
cgcuucaugcuuaaucaucgacu

SEQ ID NO: 1898955 - RNA, 13 nt, Shigella flexneri 2a str. 2457T
cgcuuauccggcc

SEQ ID NO: 1898956 - RNA, 17 nt, Shigella flexneri 2a str. 2457T
cgcuucaccaaucagaa

SEQ ID NO: 1898957 - RNA, 16 nt, Shigella flexneri 2a str. 2457T
cgcuucagcccgcgau

SEQ ID NO: 1898958 - RNA, 23 nt, Shigella flexneri 2a str. 2457T
cgcuuauuguugucaauauucug

SEQ ID NO: 1898959 - RNA, 20 nt, Shigella flexneri 2a str. 2457T
cgcuucaauacgcucgaaca

SEQ ID NO: 1898960 - RNA, 14 nt, Shigella flexneri 2a str. 2457T
cgcuucaccaauca

SEQ ID NO: 1898961 - RNA, 12 nt, Shigella flexneri 2a str. 2457T
cgcguaccgccg

SEQ ID NO: 1898962 - RNA, 16 nt, Shigella flexneri 2a str. 2457T
cgcgguguauaccagc

SEQ ID NO: 1898963 - RNA, 16 nt, Shigella flexneri 2a str. 2457T
cgcguccgcucgguca

SEQ ID NO: 1898964 - RNA, 19 nt, Shigella flexneri 2a str. 2457T
cgcgguacuucucaccggu

SEQ ID NO: 1898965 - RNA, 15 nt, Shigella flexneri 2a str. 2457T
cgcgguaaacugcau

SEQ ID NO: 1898966 - RNA, 17 nt, Shigella flexneri 2a str. 2457T
cgcgguagcacgucauc

SEQ ID NO: 1898967 - RNA, 19 nt, Shigella flexneri 2a str. 2457T
cgcuaaugcgacccaugca

SEQ ID NO: 1898968 - RNA, 19 nt, Shigella flexneri 2a str. 2457T
cgcuaaggucaccaguuca

SEQ ID NO: 1898969 - RNA, 14 nt, Shigella flexneri 2a str. 2457T
cgcuaacagcagca

SEQ ID NO: 1898970 - RNA, 13 nt, Shigella flexneri 2a str. 2457T
cgcuacauaacgc

SEQ ID NO: 1898971 - RNA, 20 nt, Shigella flexneri 2a str. 2457T
cgcuaccaaaaaaucaaugc

SEQ ID NO: 1898972 - RNA, 13 nt, Shigella flexneri 2a str. 2457T
cgcuacauccgac

SEQ ID NO: 1898973 - RNA, 14 nt, Shigella flexneri 2a str. 2457T
cgcuccgcaccuga

SEQ ID NO: 1898974 - RNA, 18 nt, Shigella flexneri 2a str. 2457T
cgcuaaaaagcgccguuu

SEQ ID NO: 1898975 - RNA, 20 nt, Shigella flexneri 2a str. 2457T
cgcgugauugguuucaaaga

SEQ ID NO: 1898976 - RNA, 18 nt, Shigella flexneri 2a str. 2457T
cgcgugcggcauccggua

SEQ ID NO: 1898977 - RNA, 20 nt, Shigella flexneri 2a str. 2457T
aacagcccaaucaucgcggc

SEQ ID NO: 1898978 - RNA, 16 nt, Shigella flexneri 2a str. 2457T
aacagcagggccugaa

SEQ ID NO: 1898979 - RNA, 15 nt, Shigella flexneri 2a str. 2457T
aacagccacugguga

SEQ ID NO: 1898980 - RNA, 16 nt, Shigella flexneri 2a str. 2457T
aacagcaggcagaucc

SEQ ID NO: 1898981 - RNA, 12 nt, Shigella flexneri 2a str. 2457T
cgcggacgcaca

SEQ ID NO: 1898982 - RNA, 18 nt, Shigella flexneri 2a str. 2457T
cgcggacaaacggcugga

SEQ ID NO: 1898983 - RNA, 20 nt, Shigella flexneri 2a str. 2457T
cgcgcuugcggaagcaaccg

SEQ ID NO: 1898984 - RNA, 14 nt, Shigella flexneri 2a str. 2457T
cgcgcuugccgccg

SEQ ID NO: 1898985 - RNA, 12 nt, Shigella flexneri 2a str. 2457T
cgcggcagcagg

SEQ ID NO: 1898986 - RNA, 13 nt, Shigella flexneri 2a str. 2457T
cgcgaucuuccac

SEQ ID NO: 1898987 - RNA, 20 nt, Shigella flexneri 2a str. 2457T
cgcgaucuuccacgccugca

SEQ ID NO: 1898988 - RNA, 15 nt, Shigella flexneri 2a str. 2457T
cgcgauuucucauca

SEQ ID NO: 1898989 - RNA, 19 nt, Shigella flexneri 2a str. 2457T
cgcgcagaucguucggauc

SEQ ID NO: 1898990 - RNA, 13 nt, Shigella flexneri 2a str. 2457T
cgcgcaucagcuc

SEQ ID NO: 1898991 - RNA, 16 nt, Shigella flexneri 2a str. 2457T
cgcgcaucagcaguuc

SEQ ID NO: 1898992 - RNA, 18 nt, Shigella flexneri 2a str. 2457T
cgcgcaguucgucgcguu

SEQ ID NO: 1898993 - RNA, 16 nt, Shigella flexneri 2a str. 2457T
cgcgcccgccgcuggu

SEQ ID NO: 1898994 - RNA, 12 nt, Shigella flexneri 2a str. 2457T
cgcgacauggcg

SEQ ID NO: 1898995 - RNA, 22 nt, Shigella flexneri 2a str. 2457T
cgcgacaucuucuccagcgaau

SEQ ID NO: 1898996 - RNA, 22 nt, Shigella flexneri 2a str. 2457T
cgcgaccgccucgcgccagcgu

SEQ ID NO: 1898997 - RNA, 12 nt, Shigella flexneri 2a str. 2457T
cgcgaccagcgu

SEQ ID NO: 1898998 - RNA, 23 nt, Shigella flexneri 2a str. 2457T
cgcgacagauuuugccagcauga

SEQ ID NO: 1898999 - RNA, 15 nt, Shigella flexneri 2a str. 2457T
cgcgaagauucguau

SEQ ID NO: 1899000 - RNA, 16 nt, Shigella flexneri 2a str. 2457T
cgcgaauaguuuccgc

SEQ ID NO: 1899001 - RNA, 22 nt, Shigella flexneri 2a str. 2457T
cgccuuuaccgcgcauacggaa

SEQ ID NO: 1899002 - RNA, 22 nt, Shigella flexneri 2a str. 2457T
cgccuuuucaguuggcugacaa

SEQ ID NO: 1899003 - RNA, 13 nt, Shigella flexneri 2a str. 2457T
cgccuuuuccagc

SEQ ID NO: 1899004 - RNA, 14 nt, Shigella flexneri 2a str. 2457T
cgccugaucgcgca

SEQ ID NO: 1899005 - RNA, 19 nt, Shigella flexneri 2a str. 2457T
cgccucguaaugcuccggc

SEQ ID NO: 1899006 - RNA, 21 nt, Shigella flexneri 2a str. 2457T
cgccugccgcauccggugauu

SEQ ID NO: 1899007 - RNA, 18 nt, Shigella flexneri 2a str. 2457T
cgccugcgaguuuuaccu

SEQ ID NO: 1899008 - RNA, 13 nt, Shigella flexneri 2a str. 2457T
cgccugccugcag

SEQ ID NO: 1899009 - RNA, 18 nt, Shigella flexneri 2a str. 2457T
cgccugcaccauugcugc

SEQ ID NO: 1899010 - RNA, 16 nt, Shigella flexneri 2a str. 2457T
cgccucccuucgcugc

SEQ ID NO: 1899011 - RNA, 14 nt, Shigella flexneri 2a str. 2457T
cgccuguuccagca

SEQ ID NO: 1899012 - RNA, 12 nt, Shigella flexneri 2a str. 2457T
cgccuucaacgu

SEQ ID NO: 1899013 - RNA, 19 nt, Shigella flexneri 2a str. 2457T
cgccuuauccggccuaccg

SEQ ID NO: 1899014 - RNA, 23 nt, Shigella flexneri 2a str. 2457T
cgccuuccacuucugcgucgaua

SEQ ID NO: 1899015 - RNA, 17 nt, Shigella flexneri 2a str. 2457T
cgccuuauccggccuac

SEQ ID NO: 1899016 - RNA, 13 nt, Shigella flexneri 2a str. 2457T
cgccgucaucaca

SEQ ID NO: 1899017 - RNA, 16 nt, Shigella flexneri 2a str. 2457T
cgccgucaucacaccg

SEQ ID NO: 1899018 - RNA, 18 nt, Shigella flexneri 2a str. 2457T
cgccguccacaaaccguu

SEQ ID NO: 1899019 - RNA, 16 nt, Shigella flexneri 2a str. 2457T
cgccguaaaucccgcc

SEQ ID NO: 1899020 - RNA, 16 nt, Shigella flexneri 2a str. 2457T
cgccgggcuaaccgcu

SEQ ID NO: 1899021 - RNA, 15 nt, Shigella flexneri 2a str. 2457T
aacacgaucagccau

SEQ ID NO: 1899022 - RNA, 12 nt, Shigella flexneri 2a str. 2457T
aacacgccgaua

SEQ ID NO: 1899023 - RNA, 16 nt, Shigella flexneri 2a str. 2457T
cgccggguucgacgcg

SEQ ID NO: 1899024 - RNA, 16 nt, Shigella flexneri 2a str. 2457T
cgccgggguuauguga

SEQ ID NO: 1899025 - RNA, 19 nt, Shigella flexneri 2a str. 2457T
cgccgccuuuuacgcauuc

SEQ ID NO: 1899026 - RNA, 14 nt, Shigella flexneri 2a str. 2457T
cgccgccaguacgc

SEQ ID NO: 1899027 - RNA, 15 nt, Shigella flexneri 2a str. 2457T
cgccgccauagcgaa

SEQ ID NO: 1899028 - RNA, 23 nt, Shigella flexneri 2a str. 2457T
cgccgauaaucaacgcgccgcca

SEQ ID NO: 1899029 - RNA, 11 nt, Shigella flexneri 2a str. 2457T
cgcccagcaga

SEQ ID NO: 1899030 - RNA, 14 nt, Shigella flexneri 2a str. 2457T
cgccgcacacgccg

SEQ ID NO: 1899031 - RNA, 12 nt, Shigella flexneri 2a str. 2457T
cgccgcacacgc

SEQ ID NO: 1899032 - RNA, 13 nt, Shigella flexneri 2a str. 2457T
cgccgcauccgac

SEQ ID NO: 1899033 - RNA, 14 nt, Shigella flexneri 2a str. 2457T
cgccgcauccggca

SEQ ID NO: 1899034 - RNA, 13 nt, Shigella flexneri 2a str. 2457T
cgccgcauccggu

SEQ ID NO: 1899035 - RNA, 13 nt, Shigella flexneri 2a str. 2457T
gucguucaucgca

SEQ ID NO: 1899036 - RNA, 12 nt, Shigella flexneri 2a str. 2457T
gucgugaaugcc

SEQ ID NO: 1899037 - RNA, 19 nt, Shigella flexneri 2a str. 2457T
gucgcggaccaacaaaaau

SEQ ID NO: 1899038 - RNA, 14 nt, Shigella flexneri 2a str. 2457T
gucggguuuacgug

SEQ ID NO: 1899039 - RNA, 15 nt, Shigella flexneri 2a str. 2457T
gucggggccagcgca

SEQ ID NO: 1899040 - RNA, 20 nt, Shigella flexneri 2a str. 2457T
gugacgcacaguacgcgccc

SEQ ID NO: 1899041 - RNA, 19 nt, Shigella flexneri 2a str. 2457T
gugagaucgcgcgggagca

SEQ ID NO: 1899042 - RNA, 13 nt, Shigella flexneri 2a str. 2457T
gugagaacugcug

SEQ ID NO: 1899043 - RNA, 16 nt, Shigella flexneri 2a str. 2457T
gugagcgguguugccg

SEQ ID NO: 1899044 - RNA, 20 nt, Shigella flexneri 2a str. 2457T
gugaacgccuuauccggucu

SEQ ID NO: 1899045 - RNA, 20 nt, Shigella flexneri 2a str. 2457T
gugaacucaggcugccagau

SEQ ID NO: 1899046 - RNA, 20 nt, Shigella flexneri 2a str. 2457T
gugaacgccuaauccagccu

SEQ ID NO: 1899047 - RNA, 22 nt, Shigella flexneri 2a str. 2457T
gugaaggcaaacuucucgccau

SEQ ID NO: 1899048 - RNA, 17 nt, Shigella flexneri 2a str. 2457T
gugaagguugucaucaa

SEQ ID NO: 1899049 - RNA, 20 nt, Shigella flexneri 2a str. 2457T
gugaccagaacugauccaua

SEQ ID NO: 1899050 - RNA, 18 nt, Shigella flexneri 2a str. 2457T
gugaccaguaccaccgcg

SEQ ID NO: 1899051 - RNA, 16 nt, Shigella flexneri 2a str. 2457T
gugacccgcagccagc

SEQ ID NO: 1899052 - RNA, 19 nt, Shigella flexneri 2a str. 2457T
gugacagauuuugccagca

SEQ ID NO: 1899053 - RNA, 24 nt, Shigella flexneri 2a str. 2457T
gucuucgcgcaccaacgacggcca

SEQ ID NO: 1899054 - RNA, 18 nt, Shigella flexneri 2a str. 2457T
gucuuaucaggccuacaa

SEQ ID NO: 1899055 - RNA, 13 nt, Shigella flexneri 2a str. 2457T
gucuuaauguaau

SEQ ID NO: 1899056 - RNA, 24 nt, Shigella flexneri 2a str. 2457T
gucuuuuuucacuggcaaugacgg

SEQ ID NO: 1899057 - RNA, 16 nt, Shigella flexneri 2a str. 2457T
gucuuuuuaaugacuu

SEQ ID NO: 1899058 - RNA, 13 nt, Shigella flexneri 2a str. 2457T
gucuuuaauggca

SEQ ID NO: 1899059 - RNA, 18 nt, Shigella flexneri 2a str. 2457T
gucuggcguuuguaucga

SEQ ID NO: 1899060 - RNA, 14 nt, Shigella flexneri 2a str. 2457T
gucuggcgcagugg

SEQ ID NO: 1899061 - RNA, 14 nt, Shigella flexneri 2a str. 2457T
gucuguacggcagu

SEQ ID NO: 1899062 - RNA, 16 nt, Shigella flexneri 2a str. 2457T
gucugguaucgcgcca

SEQ ID NO: 1899063 - RNA, 13 nt, Shigella flexneri 2a str. 2457T
gucuaaaucuucc

SEQ ID NO: 1899064 - RNA, 16 nt, Shigella flexneri 2a str. 2457T
gucguuuucaguugcu

SEQ ID NO: 1899065 - RNA, 19 nt, Shigella flexneri 2a str. 2457T
gucuccugccgagcgugcg

SEQ ID NO: 1899066 - RNA, 16 nt, Shigella flexneri 2a str. 2457T
gucugaccgucuuuca

SEQ ID NO: 1899067 - RNA, 14 nt, Shigella flexneri 2a str. 2457T
gucugaaugccgcu

SEQ ID NO: 1899068 - RNA, 17 nt, Shigella flexneri 2a str. 2457T
gucgccugcuuuaucga

SEQ ID NO: 1899069 - RNA, 19 nt, Shigella flexneri 2a str. 2457T
gucgccuguacuuccuguu

SEQ ID NO: 1899070 - RNA, 21 nt, Shigella flexneri 2a str. 2457T
gucgccgauaauuuucagcgu

SEQ ID NO: 1899071 - RNA, 15 nt, Shigella flexneri 2a str. 2457T
gucgccaaguucgaa

SEQ ID NO: 1899072 - RNA, 21 nt, Shigella flexneri 2a str. 2457T
gucgccaaguucgaacgccgc

SEQ ID NO: 1899073 - RNA, 16 nt, Shigella flexneri 2a str. 2457T
guccggcugccagcca

SEQ ID NO: 1899074 - RNA, 18 nt, Shigella flexneri 2a str. 2457T
guccuguugucuuuccag

SEQ ID NO: 1899075 - RNA, 21 nt, Shigella flexneri 2a str. 2457T
guccuuuugccgcccagucac

SEQ ID NO: 1899076 - RNA, 14 nt, Shigella flexneri 2a str. 2457T
gucgaacggguuaa

SEQ ID NO: 1899077 - RNA, 19 nt, Shigella flexneri 2a str. 2457T
gucgaccauaagaaauuuc

SEQ ID NO: 1899078 - RNA, 17 nt, Shigella flexneri 2a str. 2457T
gucgaugaaagcgccau

SEQ ID NO: 1899079 - RNA, 18 nt, Shigella flexneri 2a str. 2457T
gucccuuccgcaauacag

SEQ ID NO: 1899080 - RNA, 14 nt, Shigella flexneri 2a str. 2457T
gucccguacccagc

SEQ ID NO: 1899081 - RNA, 16 nt, Shigella flexneri 2a str. 2457T
guccagccaccgcgug

SEQ ID NO: 1899082 - RNA, 18 nt, Shigella flexneri 2a str. 2457T
guccaggcugcaaagucu

SEQ ID NO: 1899083 - RNA, 23 nt, Shigella flexneri 2a str. 2457T
gucagcuuucagagaagcaccgc

SEQ ID NO: 1899084 - RNA, 13 nt, Shigella flexneri 2a str. 2457T
gucaguucauggu

SEQ ID NO: 1899085 - RNA, 19 nt, Shigella flexneri 2a str. 2457T
gucaguggacgauaagcac

SEQ ID NO: 1899086 - RNA, 21 nt, Shigella flexneri 2a str. 2457T
gucaugcagcuccaccgauuu

SEQ ID NO: 1899087 - RNA, 20 nt, Shigella flexneri 2a str. 2457T
gucauucugcaaggcaaaau

SEQ ID NO: 1899088 - RNA, 21 nt, Shigella flexneri 2a str. 2457T
gggugcaaucaacaccacugc

SEQ ID NO: 1899089 - RNA, 22 nt, Shigella flexneri 2a str. 2457T
gggugcgacaggagccgcagua

SEQ ID NO: 1899090 - RNA, 13 nt, Shigella flexneri 2a str. 2457T
gguacaaagccaa

SEQ ID NO: 1899091 - RNA, 21 nt, Shigella flexneri 2a str. 2457T
gguacaaagccaacagcagcc

SEQ ID NO: 1899092 - RNA, 18 nt, Shigella flexneri 2a str. 2457T
ggguuuugcccagcguua

SEQ ID NO: 1899093 - RNA, 16 nt, Shigella flexneri 2a str. 2457T
ggguuuuugccagcaa

SEQ ID NO: 1899094 - RNA, 14 nt, Shigella flexneri 2a str. 2457T
gguaauugaucuca

SEQ ID NO: 1899095 - RNA, 15 nt, Shigella flexneri 2a str. 2457T
gguacgaauacggau

SEQ ID NO: 1899096 - RNA, 18 nt, Shigella flexneri 2a str. 2457T
ggguuucgccugccagau

SEQ ID NO: 1899097 - RNA, 13 nt, Shigella flexneri 2a str. 2457T
ggguucagcauug

SEQ ID NO: 1899098 - RNA, 16 nt, Shigella flexneri 2a str. 2457T
gguacuucaaucgcca

SEQ ID NO: 1899099 - RNA, 13 nt, Shigella flexneri 2a str. 2457T
gguagaagccagu

SEQ ID NO: 1899100 - RNA, 21 nt, Shigella flexneri 2a str. 2457T
gggucaccgccgauaccgaca

SEQ ID NO: 1899101 - RNA, 20 nt, Shigella flexneri 2a str. 2457T
ggguauaaaacucaccgcgc

SEQ ID NO: 1899102 - RNA, 20 nt, Shigella flexneri 2a str. 2457T
gguagugaugcgcauuaugg

SEQ ID NO: 1899103 - RNA, 13 nt, Shigella flexneri 2a str. 2457T
ggucgcggguucg

SEQ ID NO: 1899104 - RNA, 23 nt, Shigella flexneri 2a str. 2457T
ggucggauaaggcgcucgcgccg

SEQ ID NO: 1899105 - RNA, 16 nt, Shigella flexneri 2a str. 2457T
ggugauaaucauccca

SEQ ID NO: 1899106 - RNA, 19 nt, Shigella flexneri 2a str. 2457T
ggugauaccagaccauaca

SEQ ID NO: 1899107 - RNA, 17 nt, Shigella flexneri 2a str. 2457T
ggugaucacccagacgc

SEQ ID NO: 1899108 - RNA, 17 nt, Shigella flexneri 2a str. 2457T
ggugauacugaucguca

SEQ ID NO: 1899109 - RNA, 22 nt, Shigella flexneri 2a str. 2457T
ggucugauagcguagcgccuca

SEQ ID NO: 1899110 - RNA, 23 nt, Shigella flexneri 2a str. 2457T
ggugaaaguaacaaagccugcac

SEQ ID NO: 1899111 - RNA, 11 nt, Shigella flexneri 2a str. 2457T
guacgcuuuca

SEQ ID NO: 1899112 - RNA, 16 nt, Shigella flexneri 2a str. 2457T
guacgcuuucacccgg

SEQ ID NO: 1899113 - RNA, 13 nt, Shigella flexneri 2a str. 2457T
guacuccagcaga

SEQ ID NO: 1899114 - RNA, 11 nt, Shigella flexneri 2a str. 2457T
guacuccagca

SEQ ID NO: 1899115 - RNA, 15 nt, Shigella flexneri 2a str. 2457T
guacgcuccagcagg

SEQ ID NO: 1899116 - RNA, 21 nt, Shigella flexneri 2a str. 2457T
guacgccgggugcguccuaaa

SEQ ID NO: 1899117 - RNA, 16 nt, Shigella flexneri 2a str. 2457T
guacgcccacgccagc

SEQ ID NO: 1899118 - RNA, 20 nt, Shigella flexneri 2a str. 2457T
guacgcaauuccagcaagcc

SEQ ID NO: 1899119 - RNA, 13 nt, Shigella flexneri 2a str. 2457T
guaccagcaccgu

SEQ ID NO: 1899120 - RNA, 20 nt, Shigella flexneri 2a str. 2457T
guaccaccagaaucgccagc

SEQ ID NO: 1899121 - RNA, 21 nt, Shigella flexneri 2a str. 2457T
guaccgccgcgaaccugugaa

SEQ ID NO: 1899122 - RNA, 17 nt, Shigella flexneri 2a str. 2457T
guaccagcggcuuccag

SEQ ID NO: 1899123 - RNA, 12 nt, Shigella flexneri 2a str. 2457T
gguuucgugcau

SEQ ID NO: 1899124 - RNA, 22 nt, Shigella flexneri 2a str. 2457T
gguuucgggucgaaaauaucgg

SEQ ID NO: 1899125 - RNA, 16 nt, Shigella flexneri 2a str. 2457T
gguuuccggaucgcca

SEQ ID NO: 1899126 - RNA, 14 nt, Shigella flexneri 2a str. 2457T
guaacauuacgugg

SEQ ID NO: 1899127 - RNA, 16 nt, Shigella flexneri 2a str. 2457T
guaaccaaaucuccag

SEQ ID NO: 1899128 - RNA, 17 nt, Shigella flexneri 2a str. 2457T
guaaccacgcagcguug

SEQ ID NO: 1899129 - RNA, 22 nt, Shigella flexneri 2a str. 2457T
guaaccagcgcagacaccagaa

SEQ ID NO: 1899130 - RNA, 15 nt, Shigella flexneri 2a str. 2457T
guaacaaagccugca

SEQ ID NO: 1899131 - RNA, 21 nt, Shigella flexneri 2a str. 2457T
guaaagcccgccaucgcccau

SEQ ID NO: 1899132 - RNA, 20 nt, Shigella flexneri 2a str. 2457T
guaaacgccuuauccggccu

SEQ ID NO: 1899133 - RNA, 23 nt, Shigella flexneri 2a str. 2457T
guaaacugcgucgacauagccau

SEQ ID NO: 1899134 - RNA, 13 nt, Shigella flexneri 2a str. 2457T
guaauucagccau

SEQ ID NO: 1899135 - RNA, 19 nt, Shigella flexneri 2a str. 2457T
guaauguuuagagacgcau

SEQ ID NO: 1899136 - RNA, 22 nt, Shigella flexneri 2a str. 2457T
guaacguuugauuaacgccaga

SEQ ID NO: 1899137 - RNA, 18 nt, Shigella flexneri 2a str. 2457T
guaacccaccaugccgau

SEQ ID NO: 1899138 - RNA, 17 nt, Shigella flexneri 2a str. 2457T
guaacgacugacuuucg

SEQ ID NO: 1899139 - RNA, 19 nt, Shigella flexneri 2a str. 2457T
guaggccugauaagcguag

SEQ ID NO: 1899140 - RNA, 20 nt, Shigella flexneri 2a str. 2457T
guaggccugagaagcgcaac

SEQ ID NO: 1899141 - RNA, 19 nt, Shigella flexneri 2a str. 2457T
guaggccggauaaggcguu

SEQ ID NO: 1899142 - RNA, 20 nt, Shigella flexneri 2a str. 2457T
guaggccagauaagacgcgu

SEQ ID NO: 1899143 - RNA, 19 nt, Shigella flexneri 2a str. 2457T
guaggccagauaaggcguu

SEQ ID NO: 1899144 - RNA, 18 nt, Shigella flexneri 2a str. 2457T
guauaccgaaaucgccau

SEQ ID NO: 1899145 - RNA, 18 nt, Shigella flexneri 2a str. 2457T
guaggcuggauaaggcgu

SEQ ID NO: 1899146 - RNA, 19 nt, Shigella flexneri 2a str. 2457T
guaggcuggauaaggcguu

SEQ ID NO: 1899147 - RNA, 19 nt, Shigella flexneri 2a str. 2457T
guagcuacgcaucaacugc

SEQ ID NO: 1899148 - RNA, 17 nt, Shigella flexneri 2a str. 2457T
guagcgggaaagcguau

SEQ ID NO: 1899149 - RNA, 14 nt, Shigella flexneri 2a str. 2457T
guagcgggcaguaa

SEQ ID NO: 1899150 - RNA, 16 nt, Shigella flexneri 2a str. 2457T
guagcggcucggaaua

SEQ ID NO: 1899151 - RNA, 22 nt, Shigella flexneri 2a str. 2457T
guagacuuuagcgcaaucgcau

SEQ ID NO: 1899152 - RNA, 17 nt, Shigella flexneri 2a str. 2457T
gguguacucaucgcccg

SEQ ID NO: 1899153 - RNA, 18 nt, Shigella flexneri 2a str. 2457T
gguguacugcaacucgcg

SEQ ID NO: 1899154 - RNA, 12 nt, Shigella flexneri 2a str. 2457T
ggugucgauacc

SEQ ID NO: 1899155 - RNA, 22 nt, Shigella flexneri 2a str. 2457T
ggugguagugcccaauagggcu

SEQ ID NO: 1899156 - RNA, 13 nt, Shigella flexneri 2a str. 2457T
gguuucaacugcg

SEQ ID NO: 1899157 - RNA, 21 nt, Shigella flexneri 2a str. 2457T
gguugccccgcacgcuucauc

SEQ ID NO: 1899158 - RNA, 23 nt, Shigella flexneri 2a str. 2457T
gguugccagcgccaacgcaccug

SEQ ID NO: 1899159 - RNA, 13 nt, Shigella flexneri 2a str. 2457T
gguugaacccuuu

SEQ ID NO: 1899160 - RNA, 15 nt, Shigella flexneri 2a str. 2457T
gguguuuaguuucgu

SEQ ID NO: 1899161 - RNA, 20 nt, Shigella flexneri 2a str. 2457T
gguuacgcaccagauaagca

SEQ ID NO: 1899162 - RNA, 20 nt, Shigella flexneri 2a str. 2457T
gguuaagccucacgguucau

SEQ ID NO: 1899163 - RNA, 18 nt, Shigella flexneri 2a str. 2457T
gguuaacaucaugucggc

SEQ ID NO: 1899164 - RNA, 21 nt, Shigella flexneri 2a str. 2457T
gguguguauccguuuuacugg

SEQ ID NO: 1899165 - RNA, 16 nt, Shigella flexneri 2a str. 2457T
gguguucacgccgcau

SEQ ID NO: 1899166 - RNA, 22 nt, Shigella flexneri 2a str. 2457T
gguucaccgcgagcauaggcau

SEQ ID NO: 1899167 - RNA, 23 nt, Shigella flexneri 2a str. 2457T
gguuccccccacaaucagccaga

SEQ ID NO: 1899168 - RNA, 14 nt, Shigella flexneri 2a str. 2457T
ggcuggcaaugacc

SEQ ID NO: 1899169 - RNA, 20 nt, Shigella flexneri 2a str. 2457T
ggcugcugcuguagccgaug

SEQ ID NO: 1899170 - RNA, 23 nt, Shigella flexneri 2a str. 2457T
ggcuguuuuccagcaccacuucc

SEQ ID NO: 1899171 - RNA, 20 nt, Shigella flexneri 2a str. 2457T
ggcuguugaaugccgguucc

SEQ ID NO: 1899172 - RNA, 14 nt, Shigella flexneri 2a str. 2457T
ggcuuauccggcau

SEQ ID NO: 1899173 - RNA, 20 nt, Shigella flexneri 2a str. 2457T
ggcuuuuacgcauugcucac

SEQ ID NO: 1899174 - RNA, 19 nt, Shigella flexneri 2a str. 2457T
ggcuuuuuuauugcuucac

SEQ ID NO: 1899175 - RNA, 18 nt, Shigella flexneri 2a str. 2457T
ggcuuuuuacgcgacaca

SEQ ID NO: 1899176 - RNA, 14 nt, Shigella flexneri 2a str. 2457T
ggcuuuucgacaga

SEQ ID NO: 1899177 - RNA, 17 nt, Shigella flexneri 2a str. 2457T
ggcuuuuacgcauugcu

SEQ ID NO: 1899178 - RNA, 23 nt, Shigella flexneri 2a str. 2457T
ggcuucccgcguuaagacacacu

SEQ ID NO: 1899179 - RNA, 13 nt, Shigella flexneri 2a str. 2457T
ggcugcccaugcc

SEQ ID NO: 1899180 - RNA, 21 nt, Shigella flexneri 2a str. 2457T
ggcugagcaaacaguucugca

SEQ ID NO: 1899181 - RNA, 18 nt, Shigella flexneri 2a str. 2457T
ggcugauaaacaagcgua

SEQ ID NO: 1899182 - RNA, 15 nt, Shigella flexneri 2a str. 2457T
ggcugcgggaaaucg

SEQ ID NO: 1899183 - RNA, 15 nt, Shigella flexneri 2a str. 2457T
ggcgugauuccagac

SEQ ID NO: 1899184 - RNA, 17 nt, Shigella flexneri 2a str. 2457T
ggcgugauuccagacgg

SEQ ID NO: 1899185 - RNA, 14 nt, Shigella flexneri 2a str. 2457T
ggcucagccgauga

SEQ ID NO: 1899186 - RNA, 15 nt, Shigella flexneri 2a str. 2457T
ggcucaccugcacac

SEQ ID NO: 1899187 - RNA, 15 nt, Shigella flexneri 2a str. 2457T
ggcguggucgguuaa

SEQ ID NO: 1899188 - RNA, 21 nt, Shigella flexneri 2a str. 2457T
ggcguucacgccgcauccgac

SEQ ID NO: 1899189 - RNA, 17 nt, Shigella flexneri 2a str. 2457T
ggcguuaugccuguaau

SEQ ID NO: 1899190 - RNA, 15 nt, Shigella flexneri 2a str. 2457T
ggcguuaaaacaggu

SEQ ID NO: 1899191 - RNA, 19 nt, Shigella flexneri 2a str. 2457T
ggcguuaacgccgcauccg

SEQ ID NO: 1899192 - RNA, 14 nt, Shigella flexneri 2a str. 2457T
ggcguuuucuggca

SEQ ID NO: 1899193 - RNA, 15 nt, Shigella flexneri 2a str. 2457T
ggcuaaaaacgccgc

SEQ ID NO: 1899194 - RNA, 17 nt, Shigella flexneri 2a str. 2457T
ggcguugcccaucgcca

SEQ ID NO: 1899195 - RNA, 23 nt, Shigella flexneri 2a str. 2457T
ggcgcuggcagaaggccgcagua

SEQ ID NO: 1899196 - RNA, 16 nt, Shigella flexneri 2a str. 2457T
ggcgcuacgcuaucag

SEQ ID NO: 1899197 - RNA, 21 nt, Shigella flexneri 2a str. 2457T
ggcgggaaaaaucuucgaucu

SEQ ID NO: 1899198 - RNA, 21 nt, Shigella flexneri 2a str. 2457T
ggcgaggaacgaucccagcgu

SEQ ID NO: 1899199 - RNA, 21 nt, Shigella flexneri 2a str. 2457T
ggcgauaaucagcgccagcgc

SEQ ID NO: 1899200 - RNA, 11 nt, Shigella flexneri 2a str. 2457T
ggcgauaaucu

SEQ ID NO: 1899201 - RNA, 15 nt, Shigella flexneri 2a str. 2457T
ggcgauauccagcgc

SEQ ID NO: 1899202 - RNA, 21 nt, Shigella flexneri 2a str. 2457T
ggcgauauuauccccugcgau

SEQ ID NO: 1899203 - RNA, 21 nt, Shigella flexneri 2a str. 2457T
ggcgauuuuccuccauuugcc

SEQ ID NO: 1899204 - RNA, 14 nt, Shigella flexneri 2a str. 2457T
ggcgauucuuugcu

SEQ ID NO: 1899205 - RNA, 11 nt, Shigella flexneri 2a str. 2457T
ggcgcagcgcg

SEQ ID NO: 1899206 - RNA, 13 nt, Shigella flexneri 2a str. 2457T
ggauuagccggau

SEQ ID NO: 1899207 - RNA, 14 nt, Shigella flexneri 2a str. 2457T
ggauuagcgaccga

SEQ ID NO: 1899208 - RNA, 12 nt, Shigella flexneri 2a str. 2457T
ggaugcgccauc

SEQ ID NO: 1899209 - RNA, 16 nt, Shigella flexneri 2a str. 2457T
ggaugcgccgucagag

SEQ ID NO: 1899210 - RNA, 18 nt, Shigella flexneri 2a str. 2457T
ggaugcgcuucgcuuauc

SEQ ID NO: 1899211 - RNA, 19 nt, Shigella flexneri 2a str. 2457T
ggaugcguucgcaccaccg

SEQ ID NO: 1899212 - RNA, 18 nt, Shigella flexneri 2a str. 2457T
ggaugcggcguuaacgcc

SEQ ID NO: 1899213 - RNA, 23 nt, Shigella flexneri 2a str. 2457T
ggaugaucgaagauuacgccggu

SEQ ID NO: 1899214 - RNA, 13 nt, Shigella flexneri 2a str. 2457T
ggaugacgcguca

SEQ ID NO: 1899215 - RNA, 13 nt, Shigella flexneri 2a str. 2457T
ggaucgauaccgu

SEQ ID NO: 1899216 - RNA, 13 nt, Shigella flexneri 2a str. 2457T
ggaaauuaccgca

SEQ ID NO: 1899217 - RNA, 19 nt, Shigella flexneri 2a str. 2457T
ggaaauuauggaucaccau

SEQ ID NO: 1899218 - RNA, 17 nt, Shigella flexneri 2a str. 2457T
ggaaauugcagagcugc

SEQ ID NO: 1899219 - RNA, 13 nt, Shigella flexneri 2a str. 2457T
ggcacccagcgcu

SEQ ID NO: 1899220 - RNA, 16 nt, Shigella flexneri 2a str. 2457T
ggcaaagcugucacca

SEQ ID NO: 1899221 - RNA, 12 nt, Shigella flexneri 2a str. 2457T
ggauuucgcccg

SEQ ID NO: 1899222 - RNA, 20 nt, Shigella flexneri 2a str. 2457T
ggauuuaagucgacgguaua

SEQ ID NO: 1899223 - RNA, 20 nt, Shigella flexneri 2a str. 2457T
ggauugugcaggcgcucaua

SEQ ID NO: 1899224 - RNA, 13 nt, Shigella flexneri 2a str. 2457T
ggcaaacaccgcu

SEQ ID NO: 1899225 - RNA, 17 nt, Shigella flexneri 2a str. 2457T
ggcaaacaggcgcuggg

SEQ ID NO: 1899226 - RNA, 17 nt, Shigella flexneri 2a str. 2457T
ggcaaaagacaccaucg

SEQ ID NO: 1899227 - RNA, 14 nt, Shigella flexneri 2a str. 2457T
ggcaaaagucacca

SEQ ID NO: 1899228 - RNA, 17 nt, Shigella flexneri 2a str. 2457T
ggcaaucuuccucgcca

SEQ ID NO: 1899229 - RNA, 14 nt, Shigella flexneri 2a str. 2457T
ggcaagaucgcgau

SEQ ID NO: 1899230 - RNA, 14 nt, Shigella flexneri 2a str. 2457T
ggcaagaucauacu

SEQ ID NO: 1899231 - RNA, 20 nt, Shigella flexneri 2a str. 2457T
ggcaauguuaccgaucgcca

SEQ ID NO: 1899232 - RNA, 14 nt, Shigella flexneri 2a str. 2457T
ggcauucagauaau

SEQ ID NO: 1899233 - RNA, 14 nt, Shigella flexneri 2a str. 2457T
ggcauacaacgcca

SEQ ID NO: 1899234 - RNA, 18 nt, Shigella flexneri 2a str. 2457T
ggcaucuucuccacgcca

SEQ ID NO: 1899235 - RNA, 18 nt, Shigella flexneri 2a str. 2457T
ggcaguucgggccgauca

SEQ ID NO: 1899236 - RNA, 14 nt, Shigella flexneri 2a str. 2457T
ggcaggcagcgcca

SEQ ID NO: 1899237 - RNA, 21 nt, Shigella flexneri 2a str. 2457T
ggcagauaaauuacugccgcu

SEQ ID NO: 1899238 - RNA, 19 nt, Shigella flexneri 2a str. 2457T
ggccaacgcccauaaugcg

SEQ ID NO: 1899239 - RNA, 19 nt, Shigella flexneri 2a str. 2457T
ggccaacguccauaaugcg

SEQ ID NO: 1899240 - RNA, 14 nt, Shigella flexneri 2a str. 2457T
ggccaacuggcaaa

SEQ ID NO: 1899241 - RNA, 22 nt, Shigella flexneri 2a str. 2457T
ggccaaugccucuacgcccggu

SEQ ID NO: 1899242 - RNA, 19 nt, Shigella flexneri 2a str. 2457T
ggccaauaacccgcuguaa

SEQ ID NO: 1899243 - RNA, 17 nt, Shigella flexneri 2a str. 2457T
ggccacagcgccagaca

SEQ ID NO: 1899244 - RNA, 19 nt, Shigella flexneri 2a str. 2457T
ggcccggauucagauugca

SEQ ID NO: 1899245 - RNA, 13 nt, Shigella flexneri 2a str. 2457T
ggcccaucgccag

SEQ ID NO: 1899246 - RNA, 20 nt, Shigella flexneri 2a str. 2457T
ggccuacaaguccguugaaa

SEQ ID NO: 1899247 - RNA, 15 nt, Shigella flexneri 2a str. 2457T
ggccugagaagcgca

SEQ ID NO: 1899248 - RNA, 20 nt, Shigella flexneri 2a str. 2457T
ggccugauaagcgcagcgca

SEQ ID NO: 1899249 - RNA, 20 nt, Shigella flexneri 2a str. 2457T
ggccugauaagcguagcgca

SEQ ID NO: 1899250 - RNA, 17 nt, Shigella flexneri 2a str. 2457T
gcuucacccgcagcacg

SEQ ID NO: 1899251 - RNA, 16 nt, Shigella flexneri 2a str. 2457T
gcuucaaaguuugcac

SEQ ID NO: 1899252 - RNA, 14 nt, Shigella flexneri 2a str. 2457T
gcuucaaccaacgc

SEQ ID NO: 1899253 - RNA, 22 nt, Shigella flexneri 2a str. 2457T
gcuucaaaucauuacaguuucg

SEQ ID NO: 1899254 - RNA, 15 nt, Shigella flexneri 2a str. 2457T
gcuuacacacccggc

SEQ ID NO: 1899255 - RNA, 22 nt, Shigella flexneri 2a str. 2457T
gcuuaauugcccgaagccaauu

SEQ ID NO: 1899256 - RNA, 21 nt, Shigella flexneri 2a str. 2457T
gcuuaccguccucuucccaga

SEQ ID NO: 1899257 - RNA, 14 nt, Shigella flexneri 2a str. 2457T
gcuuacgccugcca

SEQ ID NO: 1899258 - RNA, 13 nt, Shigella flexneri 2a str. 2457T
gcuuaaauacgcc

SEQ ID NO: 1899259 - RNA, 13 nt, Shigella flexneri 2a str. 2457T
gcuuaaucaccag

SEQ ID NO: 1899260 - RNA, 21 nt, Shigella flexneri 2a str. 2457T
gcuuaaucaauugcaggaagg

SEQ ID NO: 1899261 - RNA, 14 nt, Shigella flexneri 2a str. 2457T
gcuguugaaugccg

SEQ ID NO: 1899262 - RNA, 16 nt, Shigella flexneri 2a str. 2457T
gcuguuggugccagau

SEQ ID NO: 1899263 - RNA, 16 nt, Shigella flexneri 2a str. 2457T
gcuguugcaagacgau

SEQ ID NO: 1899264 - RNA, 24 nt, Shigella flexneri 2a str. 2457T
gcugugaagauggcuaacuaggcg

SEQ ID NO: 1899265 - RNA, 20 nt, Shigella flexneri 2a str. 2457T
gcugucggcugccagccaua

SEQ ID NO: 1899266 - RNA, 15 nt, Shigella flexneri 2a str. 2457T
gcuguaacggugucg

SEQ ID NO: 1899267 - RNA, 16 nt, Shigella flexneri 2a str. 2457T
gcuguaauaccagccu

SEQ ID NO: 1899268 - RNA, 20 nt, Shigella flexneri 2a str. 2457T
gcugguuuugugcgccacau

SEQ ID NO: 1899269 - RNA, 21 nt, Shigella flexneri 2a str. 2457T
gcuguaaauugccgucgauau

SEQ ID NO: 1899270 - RNA, 13 nt, Shigella flexneri 2a str. 2457T
gcuguagccagcu

SEQ ID NO: 1899271 - RNA, 19 nt, Shigella flexneri 2a str. 2457T
gcuguccgcuucaccaccg

SEQ ID NO: 1899272 - RNA, 18 nt, Shigella flexneri 2a str. 2457T
gcugucaacugcgccacu

SEQ ID NO: 1899273 - RNA, 18 nt, Shigella flexneri 2a str. 2457T
gcugucaccgaagcggcc

SEQ ID NO: 1899274 - RNA, 15 nt, Shigella flexneri 2a str. 2457T
gcugguuuucagcga

SEQ ID NO: 1899275 - RNA, 18 nt, Shigella flexneri 2a str. 2457T
gcugguuuuguaggccgg

SEQ ID NO: 1899276 - RNA, 14 nt, Shigella flexneri 2a str. 2457T
gcuggucagcaucg

SEQ ID NO: 1899277 - RNA, 11 nt, Shigella flexneri 2a str. 2457T
gcuggguaaau

SEQ ID NO: 1899278 - RNA, 16 nt, Shigella flexneri 2a str. 2457T
gcugcucuucaguagu

SEQ ID NO: 1899279 - RNA, 22 nt, Shigella flexneri 2a str. 2457T
gcuucgguuuucgcgccagcca

SEQ ID NO: 1899280 - RNA, 14 nt, Shigella flexneri 2a str. 2457T
gcuucggucagcac

SEQ ID NO: 1899281 - RNA, 10 nt, Shigella flexneri 2a str. 2457T
gcuucagcga

SEQ ID NO: 1899282 - RNA, 20 nt, Shigella flexneri 2a str. 2457T
gcuucaggugcccaacauac

SEQ ID NO: 1899283 - RNA, 16 nt, Shigella flexneri 2a str. 2457T
gcuucccacgucagac

SEQ ID NO: 1899284 - RNA, 12 nt, Shigella flexneri 2a str. 2457T
gcuucccaacgc

SEQ ID NO: 1899285 - RNA, 22 nt, Shigella flexneri 2a str. 2457T
gcuucugacauaaccacucacc

SEQ ID NO: 1899286 - RNA, 15 nt, Shigella flexneri 2a str. 2457T
gcuucuuccggcgau

SEQ ID NO: 1899287 - RNA, 12 nt, Shigella flexneri 2a str. 2457T
gcuugccagcag

SEQ ID NO: 1899288 - RNA, 18 nt, Shigella flexneri 2a str. 2457T
gcuugaugcacugggaga

SEQ ID NO: 1899289 - RNA, 22 nt, Shigella flexneri 2a str. 2457T
gcuugcaccggcgacaucccag

SEQ ID NO: 1899290 - RNA, 16 nt, Shigella flexneri 2a str. 2457T
gcuuucauuucagcgu

SEQ ID NO: 1899291 - RNA, 18 nt, Shigella flexneri 2a str. 2457T
gcuuucagagaagcaccg

SEQ ID NO: 1899292 - RNA, 17 nt, Shigella flexneri 2a str. 2457T
gcuuucccuucaggcgu

SEQ ID NO: 1899293 - RNA, 16 nt, Shigella flexneri 2a str. 2457T
gcuuuauagcguugcc

SEQ ID NO: 1899294 - RNA, 18 nt, Shigella flexneri 2a str. 2457T
gcuuuauagggugcaauu

SEQ ID NO: 1899295 - RNA, 12 nt, Shigella flexneri 2a str. 2457T
gcuuuauucgcu

SEQ ID NO: 1899296 - RNA, 13 nt, Shigella flexneri 2a str. 2457T
gcuuucaccgucg

SEQ ID NO: 1899297 - RNA, 20 nt, Shigella flexneri 2a str. 2457T
gcuuucaacguagccugcca

SEQ ID NO: 1899298 - RNA, 15 nt, Shigella flexneri 2a str. 2457T
gcuuugccgucaucu

SEQ ID NO: 1899299 - RNA, 16 nt, Shigella flexneri 2a str. 2457T
gcuuucugaacugaac

SEQ ID NO: 1899300 - RNA, 23 nt, Shigella flexneri 2a str. 2457T
gcuuugacgaugcuccacuccug

SEQ ID NO: 1899301 - RNA, 15 nt, Shigella flexneri 2a str. 2457T
gcuuuugcuugcgau

SEQ ID NO: 1899302 - RNA, 16 nt, Shigella flexneri 2a str. 2457T
gcuuuuaacaccugca

SEQ ID NO: 1899303 - RNA, 17 nt, Shigella flexneri 2a str. 2457T
gcuuuucagugccaggu

SEQ ID NO: 1899304 - RNA, 18 nt, Shigella flexneri 2a str. 2457T
gcuuuguuuaugccggau

SEQ ID NO: 1899305 - RNA, 19 nt, Shigella flexneri 2a str. 2457T
gcuuuggcgugagaucgcg

SEQ ID NO: 1899306 - RNA, 17 nt, Shigella flexneri 2a str. 2457T
ggaaaaaaauuaacgca

SEQ ID NO: 1899307 - RNA, 17 nt, Shigella flexneri 2a str. 2457T
gcuuuuuuuacgucugc

SEQ ID NO: 1899308 - RNA, 20 nt, Shigella flexneri 2a str. 2457T
gcuuuuuuuacgucugcaau

SEQ ID NO: 1899309 - RNA, 19 nt, Shigella flexneri 2a str. 2457T
gcuuuuuuggcgaucuccg

SEQ ID NO: 1899310 - RNA, 18 nt, Shigella flexneri 2a str. 2457T
ggaaaucccgugacggua

SEQ ID NO: 1899311 - RNA, 22 nt, Shigella flexneri 2a str. 2457T
ggaaagccauguugaucauaaa

SEQ ID NO: 1899312 - RNA, 14 nt, Shigella flexneri 2a str. 2457T
ggaaagaucgccac

SEQ ID NO: 1899313 - RNA, 18 nt, Shigella flexneri 2a str. 2457T
gcugcgguuuacgccagg

SEQ ID NO: 1899314 - RNA, 16 nt, Shigella flexneri 2a str. 2457T
gcugccgccaguuuac

SEQ ID NO: 1899315 - RNA, 14 nt, Shigella flexneri 2a str. 2457T
gcugcauccgcgcu

SEQ ID NO: 1899316 - RNA, 18 nt, Shigella flexneri 2a str. 2457T
gcugcauccgcgcuuucu

SEQ ID NO: 1899317 - RNA, 20 nt, Shigella flexneri 2a str. 2457T
gcugaugagcaaaucgcggc

SEQ ID NO: 1899318 - RNA, 14 nt, Shigella flexneri 2a str. 2457T
gcugaugccaggcu

SEQ ID NO: 1899319 - RNA, 23 nt, Shigella flexneri 2a str. 2457T
gcugaugauuaacagcaaacagu

SEQ ID NO: 1899320 - RNA, 13 nt, Shigella flexneri 2a str. 2457T
gcugccgacgcca

SEQ ID NO: 1899321 - RNA, 21 nt, Shigella flexneri 2a str. 2457T
gcugccaaugauaucggaaga

SEQ ID NO: 1899322 - RNA, 21 nt, Shigella flexneri 2a str. 2457T
gcugcauugcccaauacagcg

SEQ ID NO: 1899323 - RNA, 12 nt, Shigella flexneri 2a str. 2457T
gcugcaucgcca

SEQ ID NO: 1899324 - RNA, 14 nt, Shigella flexneri 2a str. 2457T
gcugagaaaugcca

SEQ ID NO: 1899325 - RNA, 23 nt, Shigella flexneri 2a str. 2457T
gcugagaacaagauugccugaug

SEQ ID NO: 1899326 - RNA, 19 nt, Shigella flexneri 2a str. 2457T
gcugacuuugauccagcca

SEQ ID NO: 1899327 - RNA, 21 nt, Shigella flexneri 2a str. 2457T
gcugagauacucaagcagcca

SEQ ID NO: 1899328 - RNA, 20 nt, Shigella flexneri 2a str. 2457T
gcugagaucaaacucuuuca

SEQ ID NO: 1899329 - RNA, 17 nt, Shigella flexneri 2a str. 2457T
gcugacugucgcagcca

SEQ ID NO: 1899330 - RNA, 21 nt, Shigella flexneri 2a str. 2457T
gcugacacuauucgccagcac

SEQ ID NO: 1899331 - RNA, 22 nt, Shigella flexneri 2a str. 2457T
gcugauaaaucccgccgcuuca

SEQ ID NO: 1899332 - RNA, 15 nt, Shigella flexneri 2a str. 2457T
gcugauaugccagac

SEQ ID NO: 1899333 - RNA, 15 nt, Shigella flexneri 2a str. 2457T
gcugacaacgcugaa

SEQ ID NO: 1899334 - RNA, 22 nt, Shigella flexneri 2a str. 2457T
gcugaagggaucuucuuccgcg

SEQ ID NO: 1899335 - RNA, 15 nt, Shigella flexneri 2a str. 2457T
gcugaacgccacgcu

SEQ ID NO: 1899336 - RNA, 20 nt, Shigella flexneri 2a str. 2457T
gcugaaauaacguaggccug

SEQ ID NO: 1899337 - RNA, 13 nt, Shigella flexneri 2a str. 2457T
gcucgacagcgcu

SEQ ID NO: 1899338 - RNA, 22 nt, Shigella flexneri 2a str. 2457T
gcucccugaauaacaccagcca

SEQ ID NO: 1899339 - RNA, 17 nt, Shigella flexneri 2a str. 2457T
gcucccugcggcgauga

SEQ ID NO: 1899340 - RNA, 21 nt, Shigella flexneri 2a str. 2457T
gcucgcggugacgaucguggu

SEQ ID NO: 1899341 - RNA, 15 nt, Shigella flexneri 2a str. 2457T
gcucggcaacaccuc

SEQ ID NO: 1899342 - RNA, 16 nt, Shigella flexneri 2a str. 2457T
gcucgcuucaucugcc

SEQ ID NO: 1899343 - RNA, 16 nt, Shigella flexneri 2a str. 2457T
gcuccagcagguuuaa

SEQ ID NO: 1899344 - RNA, 14 nt, Shigella flexneri 2a str. 2457T
gcucaucguuacgc

SEQ ID NO: 1899345 - RNA, 21 nt, Shigella flexneri 2a str. 2457T
gcucauucuuccuccagcggu

SEQ ID NO: 1899346 - RNA, 22 nt, Shigella flexneri 2a str. 2457T
gcucauuucaucggcuaguaau

SEQ ID NO: 1899347 - RNA, 22 nt, Shigella flexneri 2a str. 2457T
gcuccagcccgcgucguucauc

SEQ ID NO: 1899348 - RNA, 16 nt, Shigella flexneri 2a str. 2457T
gcuccagugcgcuuua

SEQ ID NO: 1899349 - RNA, 14 nt, Shigella flexneri 2a str. 2457T
gcucccagcagaga

SEQ ID NO: 1899350 - RNA, 13 nt, Shigella flexneri 2a str. 2457T
gcucccgcagcca

SEQ ID NO: 1899351 - RNA, 18 nt, Shigella flexneri 2a str. 2457T
gcucauaaaaucacgcgc

SEQ ID NO: 1899352 - RNA, 22 nt, Shigella flexneri 2a str. 2457T
gcguucacgccgcauccggcau

SEQ ID NO: 1899353 - RNA, 20 nt, Shigella flexneri 2a str. 2457T
gcggugccaucgauaaucac

SEQ ID NO: 1899354 - RNA, 16 nt, Shigella flexneri 2a str. 2457T
gcggugaccagcagca

SEQ ID NO: 1899355 - RNA, 23 nt, Shigella flexneri 2a str. 2457T
gcgguaacaggauggcguucgca

SEQ ID NO: 1899356 - RNA, 19 nt, Shigella flexneri 2a str. 2457T
gcgguuaacaauacgccca

SEQ ID NO: 1899357 - RNA, 14 nt, Shigella flexneri 2a str. 2457T
gcggugucgccaga

SEQ ID NO: 1899358 - RNA, 22 nt, Shigella flexneri 2a str. 2457T
gcguaaaacagccagcgcugac

SEQ ID NO: 1899359 - RNA, 16 nt, Shigella flexneri 2a str. 2457T
gcgguugcaggcuauu

SEQ ID NO: 1899360 - RNA, 22 nt, Shigella flexneri 2a str. 2457T
gcgguugacgccccuggcgaug

SEQ ID NO: 1899361 - RNA, 23 nt, Shigella flexneri 2a str. 2457T
gcguaauccugaaagcgugucau

SEQ ID NO: 1899362 - RNA, 12 nt, Shigella flexneri 2a str. 2457T
gcgucuuaucug

SEQ ID NO: 1899363 - RNA, 16 nt, Shigella flexneri 2a str. 2457T
gcgucuuaucuggccu

SEQ ID NO: 1899364 - RNA, 16 nt, Shigella flexneri 2a str. 2457T
gcgucuuaucaggccu

SEQ ID NO: 1899365 - RNA, 14 nt, Shigella flexneri 2a str. 2457T
gcgucuuauccggc

SEQ ID NO: 1899366 - RNA, 16 nt, Shigella flexneri 2a str. 2457T
gcgucuggcccaugcc

SEQ ID NO: 1899367 - RNA, 15 nt, Shigella flexneri 2a str. 2457T
gcgugauggccagau

SEQ ID NO: 1899368 - RNA, 22 nt, Shigella flexneri 2a str. 2457T
gcgugaucuaaaaucgcuucag

SEQ ID NO: 1899369 - RNA, 18 nt, Shigella flexneri 2a str. 2457T
gcgugagaacaccaccug

SEQ ID NO: 1899370 - RNA, 15 nt, Shigella flexneri 2a str. 2457T
gcgucuugccaucau

SEQ ID NO: 1899371 - RNA, 22 nt, Shigella flexneri 2a str. 2457T
gcguucacgacgcauccggcau

SEQ ID NO: 1899372 - RNA, 15 nt, Shigella flexneri 2a str. 2457T
gcguuacauuuccag

SEQ ID NO: 1899373 - RNA, 20 nt, Shigella flexneri 2a str. 2457T
gcguuaccggcacuggcagc

SEQ ID NO: 1899374 - RNA, 13 nt, Shigella flexneri 2a str. 2457T
gcguguucgguaa

SEQ ID NO: 1899375 - RNA, 16 nt, Shigella flexneri 2a str. 2457T
gcgugauuccagacgg

SEQ ID NO: 1899376 - RNA, 21 nt, Shigella flexneri 2a str. 2457T
gcguggaacacuuugccguca

SEQ ID NO: 1899377 - RNA, 21 nt, Shigella flexneri 2a str. 2457T
gcguggcaucaauaccgcgua

SEQ ID NO: 1899378 - RNA, 17 nt, Shigella flexneri 2a str. 2457T
gcgucgcauccggcacu

SEQ ID NO: 1899379 - RNA, 18 nt, Shigella flexneri 2a str. 2457T
gcgucgacauagccaucc

SEQ ID NO: 1899380 - RNA, 13 nt, Shigella flexneri 2a str. 2457T
gcgucgccagcgc

SEQ ID NO: 1899381 - RNA, 14 nt, Shigella flexneri 2a str. 2457T
gcgucaggcgcgug

SEQ ID NO: 1899382 - RNA, 18 nt, Shigella flexneri 2a str. 2457T
gcgucaaggucaacaguu

SEQ ID NO: 1899383 - RNA, 19 nt, Shigella flexneri 2a str. 2457T
gcgucaagcgucgcaucag

SEQ ID NO: 1899384 - RNA, 18 nt, Shigella flexneri 2a str. 2457T
gcguauccgaugaaucac

SEQ ID NO: 1899385 - RNA, 20 nt, Shigella flexneri 2a str. 2457T
gcguaguuaugaaaauagga

SEQ ID NO: 1899386 - RNA, 20 nt, Shigella flexneri 2a str. 2457T
gcggcugcugauguucgcca

SEQ ID NO: 1899387 - RNA, 13 nt, Shigella flexneri 2a str. 2457T
gcggcuguccggc

SEQ ID NO: 1899388 - RNA, 16 nt, Shigella flexneri 2a str. 2457T
gcggcguuccaccgcu

SEQ ID NO: 1899389 - RNA, 14 nt, Shigella flexneri 2a str. 2457T
gcgggccacugacg

SEQ ID NO: 1899390 - RNA, 19 nt, Shigella flexneri 2a str. 2457T
gcggcuguuggugccagau

SEQ ID NO: 1899391 - RNA, 18 nt, Shigella flexneri 2a str. 2457T
aagcguaauugauccgcg

SEQ ID NO: 1899392 - RNA, 17 nt, Shigella flexneri 2a str. 2457T
aagcgucagcuuucaga

SEQ ID NO: 1899393 - RNA, 23 nt, Shigella flexneri 2a str. 2457T
gcggcgucauaauccggcaacaa

SEQ ID NO: 1899394 - RNA, 17 nt, Shigella flexneri 2a str. 2457T
gcggcgugaacgccuua

SEQ ID NO: 1899395 - RNA, 17 nt, Shigella flexneri 2a str. 2457T
gcggcguaucuuccagg

SEQ ID NO: 1899396 - RNA, 22 nt, Shigella flexneri 2a str. 2457T
aagcgagcaguacagccgccag

SEQ ID NO: 1899397 - RNA, 14 nt, Shigella flexneri 2a str. 2457T
aagcgagcaguaca

SEQ ID NO: 1899398 - RNA, 21 nt, Shigella flexneri 2a str. 2457T
aagcgaggcuuauccggcaug

SEQ ID NO: 1899399 - RNA, 21 nt, Shigella flexneri 2a str. 2457T
aagcgauaacgcuggcagcaa

SEQ ID NO: 1899400 - RNA, 17 nt, Shigella flexneri 2a str. 2457T
gcggcaggcguaacacu

SEQ ID NO: 1899401 - RNA, 20 nt, Shigella flexneri 2a str. 2457T
gcggcaggcagcgccacgua

SEQ ID NO: 1899402 - RNA, 18 nt, Shigella flexneri 2a str. 2457T
gcggcaggcagcgccacg

SEQ ID NO: 1899403 - RNA, 13 nt, Shigella flexneri 2a str. 2457T
aagcgcagcgcau

SEQ ID NO: 1899404 - RNA, 15 nt, Shigella flexneri 2a str. 2457T
aagcgcagcgcauca

SEQ ID NO: 1899405 - RNA, 22 nt, Shigella flexneri 2a str. 2457T
aagcgcacguuguuacaauuua

SEQ ID NO: 1899406 - RNA, 12 nt, Shigella flexneri 2a str. 2457T
gcggcaguucgu

SEQ ID NO: 1899407 - RNA, 18 nt, Shigella flexneri 2a str. 2457T
gcggcgaaaacgccacau

SEQ ID NO: 1899408 - RNA, 16 nt, Shigella flexneri 2a str. 2457T
gccuuuuuucgccgca

SEQ ID NO: 1899409 - RNA, 21 nt, Shigella flexneri 2a str. 2457T
gccuuuuucagccgcaaacuc

SEQ ID NO: 1899410 - RNA, 15 nt, Shigella flexneri 2a str. 2457T
gcgaaaaagcguuca

SEQ ID NO: 1899411 - RNA, 21 nt, Shigella flexneri 2a str. 2457T
gccuuguuccugcuuggcgcg

SEQ ID NO: 1899412 - RNA, 13 nt, Shigella flexneri 2a str. 2457T
gccuuugaucuca

SEQ ID NO: 1899413 - RNA, 21 nt, Shigella flexneri 2a str. 2457T
gccuuugaaaucgaacagguu

SEQ ID NO: 1899414 - RNA, 22 nt, Shigella flexneri 2a str. 2457T
gccuuugaaaauaacaucgcca

SEQ ID NO: 1899415 - RNA, 16 nt, Shigella flexneri 2a str. 2457T
gccuugcgcgcagugc

SEQ ID NO: 1899416 - RNA, 16 nt, Shigella flexneri 2a str. 2457T
gccugcagggcuuuca

SEQ ID NO: 1899417 - RNA, 14 nt, Shigella flexneri 2a str. 2457T
gccugugucaggcc

SEQ ID NO: 1899418 - RNA, 12 nt, Shigella flexneri 2a str. 2457T
gccugugcgcgu

SEQ ID NO: 1899419 - RNA, 15 nt, Shigella flexneri 2a str. 2457T
gccugcaucgauagc

SEQ ID NO: 1899420 - RNA, 14 nt, Shigella flexneri 2a str. 2457T
gccuuauccggucu

SEQ ID NO: 1899421 - RNA, 14 nt, Shigella flexneri 2a str. 2457T
gccuuaucuggccu

SEQ ID NO: 1899422 - RNA, 19 nt, Shigella flexneri 2a str. 2457T
gccuuauccggccuacgau

SEQ ID NO: 1899423 - RNA, 20 nt, Shigella flexneri 2a str. 2457T
gcgaaccagacgguacccgc

SEQ ID NO: 1899424 - RNA, 14 nt, Shigella flexneri 2a str. 2457T
gcgaaaguaccauu

SEQ ID NO: 1899425 - RNA, 19 nt, Shigella flexneri 2a str. 2457T
gcgaaauugguagacgcac

SEQ ID NO: 1899426 - RNA, 16 nt, Shigella flexneri 2a str. 2457T
gcgaaguucgccauca

SEQ ID NO: 1899427 - RNA, 14 nt, Shigella flexneri 2a str. 2457T
gcgaaguucgccau

SEQ ID NO: 1899428 - RNA, 21 nt, Shigella flexneri 2a str. 2457T
gcgaauaguuuccgcuucugc

SEQ ID NO: 1899429 - RNA, 19 nt, Shigella flexneri 2a str. 2457T
gcgaagcuggucagcaucg

SEQ ID NO: 1899430 - RNA, 20 nt, Shigella flexneri 2a str. 2457T
gcgaacuuccauacggcguu

SEQ ID NO: 1899431 - RNA, 15 nt, Shigella flexneri 2a str. 2457T
gcgaagacuguagca

SEQ ID NO: 1899432 - RNA, 17 nt, Shigella flexneri 2a str. 2457T
gcgaagacuguagcagg

SEQ ID NO: 1899433 - RNA, 14 nt, Shigella flexneri 2a str. 2457T
gcgaguaaucaggc

SEQ ID NO: 1899434 - RNA, 22 nt, Shigella flexneri 2a str. 2457T
gcgacuuugccuggcggcagau

SEQ ID NO: 1899435 - RNA, 20 nt, Shigella flexneri 2a str. 2457T
gcgagcaaaaucguaagcag

SEQ ID NO: 1899436 - RNA, 17 nt, Shigella flexneri 2a str. 2457T
gcgagaaguucugcagc

SEQ ID NO: 1899437 - RNA, 23 nt, Shigella flexneri 2a str. 2457T
gcgagaaguucugcagcccgaac

SEQ ID NO: 1899438 - RNA, 19 nt, Shigella flexneri 2a str. 2457T
gcgacucucugagccagcu

SEQ ID NO: 1899439 - RNA, 21 nt, Shigella flexneri 2a str. 2457T
gcgacgcugauagcgucuuau

SEQ ID NO: 1899440 - RNA, 20 nt, Shigella flexneri 2a str. 2457T
gcgacgcucacgcgucuuau

SEQ ID NO: 1899441 - RNA, 21 nt, Shigella flexneri 2a str. 2457T
gcgacacuguucgcgucuuau

SEQ ID NO: 1899442 - RNA, 20 nt, Shigella flexneri 2a str. 2457T
gcgacagagauauucagccc

SEQ ID NO: 1899443 - RNA, 19 nt, Shigella flexneri 2a str. 2457T
gcgacagauuuugccagca

SEQ ID NO: 1899444 - RNA, 13 nt, Shigella flexneri 2a str. 2457T
gcgacauggcgaa

SEQ ID NO: 1899445 - RNA, 12 nt, Shigella flexneri 2a str. 2457T
aagcccgccauc

SEQ ID NO: 1899446 - RNA, 14 nt, Shigella flexneri 2a str. 2457T
aagcccgccaucgc

SEQ ID NO: 1899447 - RNA, 17 nt, Shigella flexneri 2a str. 2457T
gcgacaaacgccugaac

SEQ ID NO: 1899448 - RNA, 14 nt, Shigella flexneri 2a str. 2457T
gcgaaucgcuucau

SEQ ID NO: 1899449 - RNA, 16 nt, Shigella flexneri 2a str. 2457T
gcgaauggcaugcucc

SEQ ID NO: 1899450 - RNA, 21 nt, Shigella flexneri 2a str. 2457T
gcgaccggcgucgcauccggc

SEQ ID NO: 1899451 - RNA, 21 nt, Shigella flexneri 2a str. 2457T
gcgacgccggucgcgucuuau

SEQ ID NO: 1899452 - RNA, 15 nt, Shigella flexneri 2a str. 2457T
gcgacgaacagcuca

SEQ ID NO: 1899453 - RNA, 15 nt, Shigella flexneri 2a str. 2457T
gccgguacagccgga

SEQ ID NO: 1899454 - RNA, 14 nt, Shigella flexneri 2a str. 2457T
gccgguagaagcca

SEQ ID NO: 1899455 - RNA, 16 nt, Shigella flexneri 2a str. 2457T
gccgguagaagccagu

SEQ ID NO: 1899456 - RNA, 19 nt, Shigella flexneri 2a str. 2457T
gccggggagauauucccca

SEQ ID NO: 1899457 - RNA, 14 nt, Shigella flexneri 2a str. 2457T
gccgguuaauacgc

SEQ ID NO: 1899458 - RNA, 20 nt, Shigella flexneri 2a str. 2457T
gccguaauauuucucggcaa

SEQ ID NO: 1899459 - RNA, 14 nt, Shigella flexneri 2a str. 2457T
gccguaacugugcc

SEQ ID NO: 1899460 - RNA, 23 nt, Shigella flexneri 2a str. 2457T
gccgguuucacuauuaccgaugu

SEQ ID NO: 1899461 - RNA, 16 nt, Shigella flexneri 2a str. 2457T
gccgggcgugcugccg

SEQ ID NO: 1899462 - RNA, 19 nt, Shigella flexneri 2a str. 2457T
gccgggcgugcugccguuu

SEQ ID NO: 1899463 - RNA, 14 nt, Shigella flexneri 2a str. 2457T
gccgggcgcaguuu

SEQ ID NO: 1899464 - RNA, 14 nt, Shigella flexneri 2a str. 2457T
gccuauuucgucgc

SEQ ID NO: 1899465 - RNA, 20 nt, Shigella flexneri 2a str. 2457T
gccucaguggcugcguuuca

SEQ ID NO: 1899466 - RNA, 16 nt, Shigella flexneri 2a str. 2457T
gccugcaccauugcug

SEQ ID NO: 1899467 - RNA, 21 nt, Shigella flexneri 2a str. 2457T
gccugaugaugagucugaccg

SEQ ID NO: 1899468 - RNA, 15 nt, Shigella flexneri 2a str. 2457T
gccugauaagacgcg

SEQ ID NO: 1899469 - RNA, 20 nt, Shigella flexneri 2a str. 2457T
gccugauaagcguagcgcau

SEQ ID NO: 1899470 - RNA, 17 nt, Shigella flexneri 2a str. 2457T
gccugauacaggaaggc

SEQ ID NO: 1899471 - RNA, 23 nt, Shigella flexneri 2a str. 2457T
gccugauaagcguagcgcaucag

SEQ ID NO: 1899472 - RNA, 16 nt, Shigella flexneri 2a str. 2457T
gccucugucagaaaug

SEQ ID NO: 1899473 - RNA, 16 nt, Shigella flexneri 2a str. 2457T
gccguuuaccgccauc

SEQ ID NO: 1899474 - RNA, 16 nt, Shigella flexneri 2a str. 2457T
gccguuuuagaaagcg

SEQ ID NO: 1899475 - RNA, 16 nt, Shigella flexneri 2a str. 2457T
gccuacgugaggcauc

SEQ ID NO: 1899476 - RNA, 21 nt, Shigella flexneri 2a str. 2457T
gcgcacgucaccgcagcaucg

SEQ ID NO: 1899477 - RNA, 15 nt, Shigella flexneri 2a str. 2457T
gcgaguuugaucucg

SEQ ID NO: 1899478 - RNA, 12 nt, Shigella flexneri 2a str. 2457T
gcgcaguuucga

SEQ ID NO: 1899479 - RNA, 13 nt, Shigella flexneri 2a str. 2457T
gcgcaguugcaac

SEQ ID NO: 1899480 - RNA, 14 nt, Shigella flexneri 2a str. 2457T
gcgcauaacugccg

SEQ ID NO: 1899481 - RNA, 16 nt, Shigella flexneri 2a str. 2457T
gcgcauguuggcgcgg

SEQ ID NO: 1899482 - RNA, 17 nt, Shigella flexneri 2a str. 2457T
gcgcaugacaugcggua

SEQ ID NO: 1899483 - RNA, 18 nt, Shigella flexneri 2a str. 2457T
gcgcaucuuauccggccu

SEQ ID NO: 1899484 - RNA, 14 nt, Shigella flexneri 2a str. 2457T
gcgccaccagcgcc

SEQ ID NO: 1899485 - RNA, 24 nt, Shigella flexneri 2a str. 2457T
gcgccacguaauuauaugccagcc

SEQ ID NO: 1899486 - RNA, 23 nt, Shigella flexneri 2a str. 2457T
gcgcagcguucauaaauacagag

SEQ ID NO: 1899487 - RNA, 21 nt, Shigella flexneri 2a str. 2457T
gcgcaggguuugcaucgccau

SEQ ID NO: 1899488 - RNA, 16 nt, Shigella flexneri 2a str. 2457T
gcgcccgccagcaccg

SEQ ID NO: 1899489 - RNA, 12 nt, Shigella flexneri 2a str. 2457T
gcgcccuuucgc

SEQ ID NO: 1899490 - RNA, 16 nt, Shigella flexneri 2a str. 2457T
gcgccagaagggacaa

SEQ ID NO: 1899491 - RNA, 22 nt, Shigella flexneri 2a str. 2457T
gcgccauuuuucacugcggcaa

SEQ ID NO: 1899492 - RNA, 14 nt, Shigella flexneri 2a str. 2457T
gcgcccaacaguag

SEQ ID NO: 1899493 - RNA, 12 nt, Shigella flexneri 2a str. 2457T
gcgcgagccaua

SEQ ID NO: 1899494 - RNA, 17 nt, Shigella flexneri 2a str. 2457T
gcgcgaauauggcggcg

SEQ ID NO: 1899495 - RNA, 14 nt, Shigella flexneri 2a str. 2457T
gcgcgccaggcgcu

SEQ ID NO: 1899496 - RNA, 15 nt, Shigella flexneri 2a str. 2457T
gcgcgcucagcgcca

SEQ ID NO: 1899497 - RNA, 13 nt, Shigella flexneri 2a str. 2457T
gcgcuacggccgc

SEQ ID NO: 1899498 - RNA, 20 nt, Shigella flexneri 2a str. 2457T
gcgcuacgcuuaucaggccu

SEQ ID NO: 1899499 - RNA, 20 nt, Shigella flexneri 2a str. 2457T
gcgcuacgcucaucaggccu

SEQ ID NO: 1899500 - RNA, 17 nt, Shigella flexneri 2a str. 2457T
gcgcuacggcguuucac

SEQ ID NO: 1899501 - RNA, 23 nt, Shigella flexneri 2a str. 2457T
gcgcuaucaauacuuuccagcau

SEQ ID NO: 1899502 - RNA, 14 nt, Shigella flexneri 2a str. 2457T
gcgcuauccagcgc

SEQ ID NO: 1899503 - RNA, 20 nt, Shigella flexneri 2a str. 2457T
gcgcuccgcuuaucaggccu

SEQ ID NO: 1899504 - RNA, 14 nt, Shigella flexneri 2a str. 2457T
gcgcguccccugcc

SEQ ID NO: 1899505 - RNA, 16 nt, Shigella flexneri 2a str. 2457T
gcgcgucuuguacuuc

SEQ ID NO: 1899506 - RNA, 23 nt, Shigella flexneri 2a str. 2457T
gcgcguugcuggauuuucugugc

SEQ ID NO: 1899507 - RNA, 20 nt, Shigella flexneri 2a str. 2457T
gcgcguuaaagagcauuaca

SEQ ID NO: 1899508 - RNA, 22 nt, Shigella flexneri 2a str. 2457T
gaacaacccggcgaaagagcug

SEQ ID NO: 1899509 - RNA, 20 nt, Shigella flexneri 2a str. 2457T
gaacacagugguuuuaacga

SEQ ID NO: 1899510 - RNA, 15 nt, Shigella flexneri 2a str. 2457T
gaaaucaccaccgca

SEQ ID NO: 1899511 - RNA, 16 nt, Shigella flexneri 2a str. 2457T
gaaaucauccagcacg

SEQ ID NO: 1899512 - RNA, 15 nt, Shigella flexneri 2a str. 2457T
gaaauaccagguugc

SEQ ID NO: 1899513 - RNA, 24 nt, Shigella flexneri 2a str. 2457T
gaaacgggcgcugagguuaugcaa

SEQ ID NO: 1899514 - RNA, 14 nt, Shigella flexneri 2a str. 2457T
gaaacguaacguac

SEQ ID NO: 1899515 - RNA, 19 nt, Shigella flexneri 2a str. 2457T
gaaaaugggagcugggagu

SEQ ID NO: 1899516 - RNA, 22 nt, Shigella flexneri 2a str. 2457T
gaaaccauguccauuuccggau

SEQ ID NO: 1899517 - RNA, 18 nt, Shigella flexneri 2a str. 2457T
gaaaaucauucgccgguu

SEQ ID NO: 1899518 - RNA, 22 nt, Shigella flexneri 2a str. 2457T
gaaaaugcccgccgugcugcca

SEQ ID NO: 1899519 - RNA, 17 nt, Shigella flexneri 2a str. 2457T
gaaaaucacaggcgcga

SEQ ID NO: 1899520 - RNA, 23 nt, Shigella flexneri 2a str. 2457T
aaccuuucagauguuccgccauu

SEQ ID NO: 1899521 - RNA, 19 nt, Shigella flexneri 2a str. 2457T
gaaaaggcguucacgccgc

SEQ ID NO: 1899522 - RNA, 22 nt, Shigella flexneri 2a str. 2457T
gaaaaggcguucacgccgcauc

SEQ ID NO: 1899523 - RNA, 21 nt, Shigella flexneri 2a str. 2457T
aaccugaccguaggccggaua

SEQ ID NO: 1899524 - RNA, 24 nt, Shigella flexneri 2a str. 2457T
aaccugaccuuuuuucagcggugc

SEQ ID NO: 1899525 - RNA, 21 nt, Shigella flexneri 2a str. 2457T
aaccucaaaggccuugaacaa

SEQ ID NO: 1899526 - RNA, 16 nt, Shigella flexneri 2a str. 2457T
gaaccggcuggccgua

SEQ ID NO: 1899527 - RNA, 17 nt, Shigella flexneri 2a str. 2457T
gaaccaugucaucaauu

SEQ ID NO: 1899528 - RNA, 22 nt, Shigella flexneri 2a str. 2457T
gaaccacggaauaaccagcgaa

SEQ ID NO: 1899529 - RNA, 12 nt, Shigella flexneri 2a str. 2457T
gaaccagcugcc

SEQ ID NO: 1899530 - RNA, 24 nt, Shigella flexneri 2a str. 2457T
gaacacucuuccagucgccugcuu

SEQ ID NO: 1899531 - RNA, 22 nt, Shigella flexneri 2a str. 2457T
gaacgugcucugcgccgccuuc

SEQ ID NO: 1899532 - RNA, 14 nt, Shigella flexneri 2a str. 2457T
gaacguaggcugga

SEQ ID NO: 1899533 - RNA, 19 nt, Shigella flexneri 2a str. 2457T
gaacgcguucacugccgua

SEQ ID NO: 1899534 - RNA, 23 nt, Shigella flexneri 2a str. 2457T
gaacggcagauccaaaccgacug

SEQ ID NO: 1899535 - RNA, 18 nt, Shigella flexneri 2a str. 2457T
gaacgggauugccagcau

SEQ ID NO: 1899536 - RNA, 18 nt, Shigella flexneri 2a str. 2457T
gaacggauaucgagaauc

SEQ ID NO: 1899537 - RNA, 22 nt, Shigella flexneri 2a str. 2457T
cuuuuuugagcagcauuaccug

SEQ ID NO: 1899538 - RNA, 20 nt, Shigella flexneri 2a str. 2457T
cuuuuugguaggcguccugc

SEQ ID NO: 1899539 - RNA, 20 nt, Shigella flexneri 2a str. 2457T
cuuuuugugcuuaucgcgau

SEQ ID NO: 1899540 - RNA, 23 nt, Shigella flexneri 2a str. 2457T
cuuuuugaacggguugcgguuuc

SEQ ID NO: 1899541 - RNA, 19 nt, Shigella flexneri 2a str. 2457T
gaaaaaccgaccuucgcgu

SEQ ID NO: 1899542 - RNA, 14 nt, Shigella flexneri 2a str. 2457T
gaaaacccggccug

SEQ ID NO: 1899543 - RNA, 16 nt, Shigella flexneri 2a str. 2457T
gaaaaagcgaagcggc

SEQ ID NO: 1899544 - RNA, 22 nt, Shigella flexneri 2a str. 2457T
gaaaacgccggagugaaaauuc

SEQ ID NO: 1899545 - RNA, 14 nt, Shigella flexneri 2a str. 2457T
cuuuuauuuaaccg

SEQ ID NO: 1899546 - RNA, 15 nt, Shigella flexneri 2a str. 2457T
cuuugucgggcaggc

SEQ ID NO: 1899547 - RNA, 14 nt, Shigella flexneri 2a str. 2457T
cuuugucgguggac

SEQ ID NO: 1899548 - RNA, 16 nt, Shigella flexneri 2a str. 2457T
cuuuuagaucacucac

SEQ ID NO: 1899549 - RNA, 23 nt, Shigella flexneri 2a str. 2457T
cuuuuuagggccgcaucugcgau

SEQ ID NO: 1899550 - RNA, 20 nt, Shigella flexneri 2a str. 2457T
cuuuucguuuugguccuggu

SEQ ID NO: 1899551 - RNA, 19 nt, Shigella flexneri 2a str. 2457T
cuuugcccgcagauccagu

SEQ ID NO: 1899552 - RNA, 20 nt, Shigella flexneri 2a str. 2457T
cuuugcaguuccugccagau

SEQ ID NO: 1899553 - RNA, 17 nt, Shigella flexneri 2a str. 2457T
cuuugauaccgccaaua

SEQ ID NO: 1899554 - RNA, 20 nt, Shigella flexneri 2a str. 2457T
cuuugacgucgaaacugaca

SEQ ID NO: 1899555 - RNA, 13 nt, Shigella flexneri 2a str. 2457T
cuuugccgucauc

SEQ ID NO: 1899556 - RNA, 23 nt, Shigella flexneri 2a str. 2457T
cuuugcugauacuccaugaguaa

SEQ ID NO: 1899557 - RNA, 17 nt, Shigella flexneri 2a str. 2457T
cuuugcuacagccuggu

SEQ ID NO: 1899558 - RNA, 16 nt, Shigella flexneri 2a str. 2457T
cuuuccagguggugca

SEQ ID NO: 1899559 - RNA, 17 nt, Shigella flexneri 2a str. 2457T
cuuuccaugccaucugc

SEQ ID NO: 1899560 - RNA, 20 nt, Shigella flexneri 2a str. 2457T
cuuuccaugccaucugccag

SEQ ID NO: 1899561 - RNA, 22 nt, Shigella flexneri 2a str. 2457T
cuuucauucgguuuucaaucga

SEQ ID NO: 1899562 - RNA, 22 nt, Shigella flexneri 2a str. 2457T
cuuuccggcagaagcaaucauc

SEQ ID NO: 1899563 - RNA, 16 nt, Shigella flexneri 2a str. 2457T
cuuucccuuucgauaa

SEQ ID NO: 1899564 - RNA, 21 nt, Shigella flexneri 2a str. 2457T
cuuucuggcagcugcgcuuuc

SEQ ID NO: 1899565 - RNA, 15 nt, Shigella flexneri 2a str. 2457T
cuuucugcgcaaugc

SEQ ID NO: 1899566 - RNA, 13 nt, Shigella flexneri 2a str. 2457T
cuuucggaucggc

SEQ ID NO: 1899567 - RNA, 22 nt, Shigella flexneri 2a str. 2457T
cuuucggccaugggcgcgauaa

SEQ ID NO: 1899568 - RNA, 23 nt, Shigella flexneri 2a str. 2457T
cuugcguacaccaacaucacgca

SEQ ID NO: 1899569 - RNA, 16 nt, Shigella flexneri 2a str. 2457T
cuugcucgcgcagaua

SEQ ID NO: 1899570 - RNA, 22 nt, Shigella flexneri 2a str. 2457T
cuuggcaccauuaccgccgcua

SEQ ID NO: 1899571 - RNA, 15 nt, Shigella flexneri 2a str. 2457T
cuuuaucugucgaaa

SEQ ID NO: 1899572 - RNA, 20 nt, Shigella flexneri 2a str. 2457T
cuuuaucgauaaauggcgca

SEQ ID NO: 1899573 - RNA, 17 nt, Shigella flexneri 2a str. 2457T
cuuuaugacgaucgcag

SEQ ID NO: 1899574 - RNA, 20 nt, Shigella flexneri 2a str. 2457T
cuuucacgucaggaucgugc

SEQ ID NO: 1899575 - RNA, 22 nt, Shigella flexneri 2a str. 2457T
cuuucacgccgaagugcgcgca

SEQ ID NO: 1899576 - RNA, 22 nt, Shigella flexneri 2a str. 2457T
cuuucagcaccagcccgacgau

SEQ ID NO: 1899577 - RNA, 20 nt, Shigella flexneri 2a str. 2457T
cuuucagauguuccgccauu

SEQ ID NO: 1899578 - RNA, 12 nt, Shigella flexneri 2a str. 2457T
aaccgucagcac

SEQ ID NO: 1899579 - RNA, 13 nt, Shigella flexneri 2a str. 2457T
aaccguaaacgau

SEQ ID NO: 1899580 - RNA, 21 nt, Shigella flexneri 2a str. 2457T
cuuuaauauuaacgccagccu

SEQ ID NO: 1899581 - RNA, 19 nt, Shigella flexneri 2a str. 2457T
cuuuacgcaaaaucagcaa

SEQ ID NO: 1899582 - RNA, 18 nt, Shigella flexneri 2a str. 2457T
cuuuacggcgcgucagau

SEQ ID NO: 1899583 - RNA, 11 nt, Shigella flexneri 2a str. 2457T
cuggcgcacaa

SEQ ID NO: 1899584 - RNA, 13 nt, Shigella flexneri 2a str. 2457T
cuggccgcuucca

SEQ ID NO: 1899585 - RNA, 24 nt, Shigella flexneri 2a str. 2457T
cuggcgagcauuaauacaccgcug

SEQ ID NO: 1899586 - RNA, 20 nt, Shigella flexneri 2a str. 2457T
cuggcgacaugcaucacgcg

SEQ ID NO: 1899587 - RNA, 18 nt, Shigella flexneri 2a str. 2457T
cuggcgaacccaaccgug

SEQ ID NO: 1899588 - RNA, 22 nt, Shigella flexneri 2a str. 2457T
cuggcacgcucuucaucgcuaa

SEQ ID NO: 1899589 - RNA, 16 nt, Shigella flexneri 2a str. 2457T
cuggcaaucgccagcg

SEQ ID NO: 1899590 - RNA, 14 nt, Shigella flexneri 2a str. 2457T
cuggcaccaccugg

SEQ ID NO: 1899591 - RNA, 16 nt, Shigella flexneri 2a str. 2457T
cuggcacgaccuggca

SEQ ID NO: 1899592 - RNA, 20 nt, Shigella flexneri 2a str. 2457T
cugcccuugccaacgcaaac

SEQ ID NO: 1899593 - RNA, 20 nt, Shigella flexneri 2a str. 2457T
cugcccucuuuagcauucag

SEQ ID NO: 1899594 - RNA, 19 nt, Shigella flexneri 2a str. 2457T
cugcccguugccaggaccg

SEQ ID NO: 1899595 - RNA, 17 nt, Shigella flexneri 2a str. 2457T
cuggagagggugaccga

SEQ ID NO: 1899596 - RNA, 12 nt, Shigella flexneri 2a str. 2457T
cuggagcuggac

SEQ ID NO: 1899597 - RNA, 19 nt, Shigella flexneri 2a str. 2457T
cuggcaaaguagagcgaaa

SEQ ID NO: 1899598 - RNA, 23 nt, Shigella flexneri 2a str. 2457T
cuggcaacuuauuaaaauugcau

SEQ ID NO: 1899599 - RNA, 21 nt, Shigella flexneri 2a str. 2457T
cuggcaagaucggugccgcca

SEQ ID NO: 1899600 - RNA, 12 nt, Shigella flexneri 2a str. 2457T
cuggauccaguc

SEQ ID NO: 1899601 - RNA, 19 nt, Shigella flexneri 2a str. 2457T
cuggcuucccggcaaucgc

SEQ ID NO: 1899602 - RNA, 17 nt, Shigella flexneri 2a str. 2457T
cugggccugcauaucgg

SEQ ID NO: 1899603 - RNA, 14 nt, Shigella flexneri 2a str. 2457T
cugguauuuccagu

SEQ ID NO: 1899604 - RNA, 16 nt, Shigella flexneri 2a str. 2457T
cugguauuuugcgcuu

SEQ ID NO: 1899605 - RNA, 16 nt, Shigella flexneri 2a str. 2457T
cuggcgucacgccgac

SEQ ID NO: 1899606 - RNA, 17 nt, Shigella flexneri 2a str. 2457T
cuggcgugggcaucgau

SEQ ID NO: 1899607 - RNA, 17 nt, Shigella flexneri 2a str. 2457T
cuggcggcaaucgccag

SEQ ID NO: 1899608 - RNA, 14 nt, Shigella flexneri 2a str. 2457T
cuggcggcagcagg

SEQ ID NO: 1899609 - RNA, 23 nt, Shigella flexneri 2a str. 2457T
cuggcgcuguucgggaguugcag

SEQ ID NO: 1899610 - RNA, 20 nt, Shigella flexneri 2a str. 2457T
cuggcgcucaccauuuccgg

SEQ ID NO: 1899611 - RNA, 13 nt, Shigella flexneri 2a str. 2457T
cuuaaauaaugcu

SEQ ID NO: 1899612 - RNA, 18 nt, Shigella flexneri 2a str. 2457T
cuuaacuguaaaucgcca

SEQ ID NO: 1899613 - RNA, 14 nt, Shigella flexneri 2a str. 2457T
cuuaagccagcgcc

SEQ ID NO: 1899614 - RNA, 17 nt, Shigella flexneri 2a str. 2457T
cuguggauucagcaccg

SEQ ID NO: 1899615 - RNA, 14 nt, Shigella flexneri 2a str. 2457T
cuguggcagggcag

SEQ ID NO: 1899616 - RNA, 15 nt, Shigella flexneri 2a str. 2457T
cuguuuauccaucac

SEQ ID NO: 1899617 - RNA, 22 nt, Shigella flexneri 2a str. 2457T
cugucggggccagcgcauccau

SEQ ID NO: 1899618 - RNA, 14 nt, Shigella flexneri 2a str. 2457T
cugugcagcgacgu

SEQ ID NO: 1899619 - RNA, 19 nt, Shigella flexneri 2a str. 2457T
cugugauuccgccaguucu

SEQ ID NO: 1899620 - RNA, 12 nt, Shigella flexneri 2a str. 2457T
cuucagcggcag

SEQ ID NO: 1899621 - RNA, 23 nt, Shigella flexneri 2a str. 2457T
cuuaugcaauagcgccugcugcu

SEQ ID NO: 1899622 - RNA, 14 nt, Shigella flexneri 2a str. 2457T
cuucaacgcaagaa

SEQ ID NO: 1899623 - RNA, 15 nt, Shigella flexneri 2a str. 2457T
cuucaaggcgcugca

SEQ ID NO: 1899624 - RNA, 17 nt, Shigella flexneri 2a str. 2457T
cuucaaaaauaaucuga

SEQ ID NO: 1899625 - RNA, 13 nt, Shigella flexneri 2a str. 2457T
cuucaacaauuga

SEQ ID NO: 1899626 - RNA, 17 nt, Shigella flexneri 2a str. 2457T
cuucaacacacugaaua

SEQ ID NO: 1899627 - RNA, 17 nt, Shigella flexneri 2a str. 2457T
cuucaguuccgcugcaa

SEQ ID NO: 1899628 - RNA, 22 nt, Shigella flexneri 2a str. 2457T
cuucauccacauucgaaugccg

SEQ ID NO: 1899629 - RNA, 14 nt, Shigella flexneri 2a str. 2457T
cuucaucaucgcag

SEQ ID NO: 1899630 - RNA, 15 nt, Shigella flexneri 2a str. 2457T
cuucaucacgaugca

SEQ ID NO: 1899631 - RNA, 16 nt, Shigella flexneri 2a str. 2457T
cuucaguuccgcugca

SEQ ID NO: 1899632 - RNA, 14 nt, Shigella flexneri 2a str. 2457T
cuuccacgccugca

SEQ ID NO: 1899633 - RNA, 14 nt, Shigella flexneri 2a str. 2457T
cuuccagauucagu

SEQ ID NO: 1899634 - RNA, 22 nt, Shigella flexneri 2a str. 2457T
cuucgcuuaccaugccaacgcg

SEQ ID NO: 1899635 - RNA, 13 nt, Shigella flexneri 2a str. 2457T
cuucgcugcugga

SEQ ID NO: 1899636 - RNA, 18 nt, Shigella flexneri 2a str. 2457T
cuuccuguucaucgacag

SEQ ID NO: 1899637 - RNA, 19 nt, Shigella flexneri 2a str. 2457T
cuuccagcguucgccaaac

SEQ ID NO: 1899638 - RNA, 13 nt, Shigella flexneri 2a str. 2457T
cuuccagcguuuc

SEQ ID NO: 1899639 - RNA, 19 nt, Shigella flexneri 2a str. 2457T
gacgcgucuuaucuggccu

SEQ ID NO: 1899640 - RNA, 12 nt, Shigella flexneri 2a str. 2457T
gacgcgucuuau

SEQ ID NO: 1899641 - RNA, 19 nt, Shigella flexneri 2a str. 2457T
gacgcguggagagucauca

SEQ ID NO: 1899642 - RNA, 13 nt, Shigella flexneri 2a str. 2457T
gacgcguuagcau

SEQ ID NO: 1899643 - RNA, 20 nt, Shigella flexneri 2a str. 2457T
gacgcgguagcacgucaucu

SEQ ID NO: 1899644 - RNA, 19 nt, Shigella flexneri 2a str. 2457T
gacgcgucaagcgucgcau

SEQ ID NO: 1899645 - RNA, 21 nt, Shigella flexneri 2a str. 2457T
gacgcgucaagcgucgcauca

SEQ ID NO: 1899646 - RNA, 18 nt, Shigella flexneri 2a str. 2457T
gacgcgccagcgucgcau

SEQ ID NO: 1899647 - RNA, 15 nt, Shigella flexneri 2a str. 2457T
gacgcgccagcaccg

SEQ ID NO: 1899648 - RNA, 14 nt, Shigella flexneri 2a str. 2457T
gacgcgcagcgucg

SEQ ID NO: 1899649 - RNA, 17 nt, Shigella flexneri 2a str. 2457T
gacgcgcuauugccgua

SEQ ID NO: 1899650 - RNA, 20 nt, Shigella flexneri 2a str. 2457T
gacgcggcagcgucgcauca

SEQ ID NO: 1899651 - RNA, 14 nt, Shigella flexneri 2a str. 2457T
gacggcaucgccau

SEQ ID NO: 1899652 - RNA, 16 nt, Shigella flexneri 2a str. 2457T
gacggcagcgaagggu

SEQ ID NO: 1899653 - RNA, 20 nt, Shigella flexneri 2a str. 2457T
gacggacguccggugauauc

SEQ ID NO: 1899654 - RNA, 15 nt, Shigella flexneri 2a str. 2457T
gacgcuggcuuugcc

SEQ ID NO: 1899655 - RNA, 15 nt, Shigella flexneri 2a str. 2457T
gacggcuuagcgcau

SEQ ID NO: 1899656 - RNA, 15 nt, Shigella flexneri 2a str. 2457T
gacggcguauugcau

SEQ ID NO: 1899657 - RNA, 20 nt, Shigella flexneri 2a str. 2457T
aacgugcgguuucccggcag

SEQ ID NO: 1899658 - RNA, 22 nt, Shigella flexneri 2a str. 2457T
aacgucggaaaccgcuuugcca

SEQ ID NO: 1899659 - RNA, 20 nt, Shigella flexneri 2a str. 2457T
aacgugccgggaaaguggcg

SEQ ID NO: 1899660 - RNA, 17 nt, Shigella flexneri 2a str. 2457T
gacgggcccauaacgcc

SEQ ID NO: 1899661 - RNA, 19 nt, Shigella flexneri 2a str. 2457T
gacgggcuaaucgucauca

SEQ ID NO: 1899662 - RNA, 15 nt, Shigella flexneri 2a str. 2457T
gacgccuucagcgau

SEQ ID NO: 1899663 - RNA, 22 nt, Shigella flexneri 2a str. 2457T
gacgcgaccaucaagggucggu

SEQ ID NO: 1899664 - RNA, 19 nt, Shigella flexneri 2a str. 2457T
gacgccgccggugucgcac

SEQ ID NO: 1899665 - RNA, 18 nt, Shigella flexneri 2a str. 2457T
gacgcacacguuucaggu

SEQ ID NO: 1899666 - RNA, 18 nt, Shigella flexneri 2a str. 2457T
gacgauugugcuggugau

SEQ ID NO: 1899667 - RNA, 20 nt, Shigella flexneri 2a str. 2457T
gacgccauuuuuuauacacu

SEQ ID NO: 1899668 - RNA, 19 nt, Shigella flexneri 2a str. 2457T
gacgccacaaucugauaau

SEQ ID NO: 1899669 - RNA, 16 nt, Shigella flexneri 2a str. 2457T
gacgccacaaucugau

SEQ ID NO: 1899670 - RNA, 19 nt, Shigella flexneri 2a str. 2457T
gacgcauccgaucgcgcau

SEQ ID NO: 1899671 - RNA, 13 nt, Shigella flexneri 2a str. 2457T
gaccugcagaaaa

SEQ ID NO: 1899672 - RNA, 22 nt, Shigella flexneri 2a str. 2457T
aacggcacggaaagcagcauac

SEQ ID NO: 1899673 - RNA, 20 nt, Shigella flexneri 2a str. 2457T
gaccuguaccuucagcggca

SEQ ID NO: 1899674 - RNA, 14 nt, Shigella flexneri 2a str. 2457T
gaccugcgucacca

SEQ ID NO: 1899675 - RNA, 20 nt, Shigella flexneri 2a str. 2457T
gacgaagcgccuucgauaau

SEQ ID NO: 1899676 - RNA, 17 nt, Shigella flexneri 2a str. 2457T
gaccuugucaugcagcu

SEQ ID NO: 1899677 - RNA, 17 nt, Shigella flexneri 2a str. 2457T
aacguaacacauaacgc

SEQ ID NO: 1899678 - RNA, 19 nt, Shigella flexneri 2a str. 2457T
gacgaugaccgcaucaaug

SEQ ID NO: 1899679 - RNA, 17 nt, Shigella flexneri 2a str. 2457T
aacgguucggcaaucca

SEQ ID NO: 1899680 - RNA, 17 nt, Shigella flexneri 2a str. 2457T
gacgaucuucggcguca

SEQ ID NO: 1899681 - RNA, 19 nt, Shigella flexneri 2a str. 2457T
gacacuauucgccagcacg

SEQ ID NO: 1899682 - RNA, 22 nt, Shigella flexneri 2a str. 2457T
gacagcgucacaucaggccauc

SEQ ID NO: 1899683 - RNA, 19 nt, Shigella flexneri 2a str. 2457T
aacgacgggccaguuucau

SEQ ID NO: 1899684 - RNA, 18 nt, Shigella flexneri 2a str. 2457T
aacgaccaguucacacca

SEQ ID NO: 1899685 - RNA, 14 nt, Shigella flexneri 2a str. 2457T
aacgaccagaaaug

SEQ ID NO: 1899686 - RNA, 22 nt, Shigella flexneri 2a str. 2457T
gacauacucagcgccugcugca

SEQ ID NO: 1899687 - RNA, 22 nt, Shigella flexneri 2a str. 2457T
gacauaaccacucaccgccguu

SEQ ID NO: 1899688 - RNA, 19 nt, Shigella flexneri 2a str. 2457T
gacauaaacaccagcaaua

SEQ ID NO: 1899689 - RNA, 16 nt, Shigella flexneri 2a str. 2457T
gacaucccggcagaga

SEQ ID NO: 1899690 - RNA, 20 nt, Shigella flexneri 2a str. 2457T
gacaucacgguugagggcaa

SEQ ID NO: 1899691 - RNA, 17 nt, Shigella flexneri 2a str. 2457T
gacauaguagccagcca

SEQ ID NO: 1899692 - RNA, 14 nt, Shigella flexneri 2a str. 2457T
gacauacagaucgu

SEQ ID NO: 1899693 - RNA, 18 nt, Shigella flexneri 2a str. 2457T
gacacuaacgcgucuuau

SEQ ID NO: 1899694 - RNA, 19 nt, Shigella flexneri 2a str. 2457T
gacaccguuaaauaacugg

SEQ ID NO: 1899695 - RNA, 18 nt, Shigella flexneri 2a str. 2457T
gacacaacaauucccagu

SEQ ID NO: 1899696 - RNA, 13 nt, Shigella flexneri 2a str. 2457T
gacaauuuaccga

SEQ ID NO: 1899697 - RNA, 17 nt, Shigella flexneri 2a str. 2457T
gacaccagucgugcggu

SEQ ID NO: 1899698 - RNA, 16 nt, Shigella flexneri 2a str. 2457T
gaaucaaucgccccuu

SEQ ID NO: 1899699 - RNA, 18 nt, Shigella flexneri 2a str. 2457T
gaauaacuggcgcgacaa

SEQ ID NO: 1899700 - RNA, 19 nt, Shigella flexneri 2a str. 2457T
gaauaucuuucucgcggca

SEQ ID NO: 1899701 - RNA, 15 nt, Shigella flexneri 2a str. 2457T
gaauauuucaccggu

SEQ ID NO: 1899702 - RNA, 13 nt, Shigella flexneri 2a str. 2457T
gaaguuucagcgc

SEQ ID NO: 1899703 - RNA, 13 nt, Shigella flexneri 2a str. 2457T
gaauaaaacaggc

SEQ ID NO: 1899704 - RNA, 23 nt, Shigella flexneri 2a str. 2457T
gaauaaaguuuuaguugccguuc

SEQ ID NO: 1899705 - RNA, 14 nt, Shigella flexneri 2a str. 2457T
gaauaaccauggca

SEQ ID NO: 1899706 - RNA, 16 nt, Shigella flexneri 2a str. 2457T
gaacugcauugucgga

SEQ ID NO: 1899707 - RNA, 22 nt, Shigella flexneri 2a str. 2457T
gacaacgcaacgccgccggaag

SEQ ID NO: 1899708 - RNA, 19 nt, Shigella flexneri 2a str. 2457T
gacaacaugagaacaguuc

SEQ ID NO: 1899709 - RNA, 13 nt, Shigella flexneri 2a str. 2457T
gacaaucagguaa

SEQ ID NO: 1899710 - RNA, 13 nt, Shigella flexneri 2a str. 2457T
gacaauaaacggc

SEQ ID NO: 1899711 - RNA, 16 nt, Shigella flexneri 2a str. 2457T
gaauuucagcgccuga

SEQ ID NO: 1899712 - RNA, 14 nt, Shigella flexneri 2a str. 2457T
gaaugccugugcga

SEQ ID NO: 1899713 - RNA, 19 nt, Shigella flexneri 2a str. 2457T
gaaugcgcccgacgccguu

SEQ ID NO: 1899714 - RNA, 17 nt, Shigella flexneri 2a str. 2457T
gaauggaaacagcacca

SEQ ID NO: 1899715 - RNA, 16 nt, Shigella flexneri 2a str. 2457T
gaccacugcgccgcuc

SEQ ID NO: 1899716 - RNA, 13 nt, Shigella flexneri 2a str. 2457T
gaccagcagcauu

SEQ ID NO: 1899717 - RNA, 23 nt, Shigella flexneri 2a str. 2457T
aacgccauauucugaucgugcuc

SEQ ID NO: 1899718 - RNA, 22 nt, Shigella flexneri 2a str. 2457T
aacgcccagcuaaucgagccga

SEQ ID NO: 1899719 - RNA, 22 nt, Shigella flexneri 2a str. 2457T
aacgcccaugcguugucgccau

SEQ ID NO: 1899720 - RNA, 23 nt, Shigella flexneri 2a str. 2457T
aacgcccaugcguugucgccauc

SEQ ID NO: 1899721 - RNA, 19 nt, Shigella flexneri 2a str. 2457T
aacgaugacaucgcagcaa

SEQ ID NO: 1899722 - RNA, 15 nt, Shigella flexneri 2a str. 2457T
aacgaugaucgcuau

SEQ ID NO: 1899723 - RNA, 13 nt, Shigella flexneri 2a str. 2457T
aacgccagcagca

SEQ ID NO: 1899724 - RNA, 14 nt, Shigella flexneri 2a str. 2457T
aacgccacgcucac

SEQ ID NO: 1899725 - RNA, 17 nt, Shigella flexneri 2a str. 2457T
aacgccacgcucacuca

SEQ ID NO: 1899726 - RNA, 20 nt, Shigella flexneri 2a str. 2457T
aacgccuaauccagccuaca

SEQ ID NO: 1899727 - RNA, 19 nt, Shigella flexneri 2a str. 2457T
gaccaggccaucagcagcg

SEQ ID NO: 1899728 - RNA, 19 nt, Shigella flexneri 2a str. 2457T
gaccauugcaucaucgaca

SEQ ID NO: 1899729 - RNA, 19 nt, Shigella flexneri 2a str. 2457T
gacccagccagacgccagc

SEQ ID NO: 1899730 - RNA, 17 nt, Shigella flexneri 2a str. 2457T
aacgcuuuugcaucggc

SEQ ID NO: 1899731 - RNA, 15 nt, Shigella flexneri 2a str. 2457T
aacggacgaccgauu

SEQ ID NO: 1899732 - RNA, 21 nt, Shigella flexneri 2a str. 2457T
gacccugcucuuucagcaccg

SEQ ID NO: 1899733 - RNA, 17 nt, Shigella flexneri 2a str. 2457T
gacccugcucuuucagc

SEQ ID NO: 1899734 - RNA, 20 nt, Shigella flexneri 2a str. 2457T
gacccugcucuuucagcacc

SEQ ID NO: 1899735 - RNA, 19 nt, Shigella flexneri 2a str. 2457T
aacgcuaugacgcccuaca

SEQ ID NO: 1899736 - RNA, 23 nt, Shigella flexneri 2a str. 2457T
aacgcguucacugccguacaggc

SEQ ID NO: 1899737 - RNA, 22 nt, Shigella flexneri 2a str. 2457T
gaccgccgauuuccugcgucgc

SEQ ID NO: 1899738 - RNA, 17 nt, Shigella flexneri 2a str. 2457T
aacggacgagucgcuuc

SEQ ID NO: 1899739 - RNA, 19 nt, Shigella flexneri 2a str. 2457T
gaccgauacacaucgucgc

SEQ ID NO: 1899740 - RNA, 16 nt, Shigella flexneri 2a str. 2457T
gaccgauaaugauccc

SEQ ID NO: 1899741 - RNA, 20 nt, Shigella flexneri 2a str. 2457T
cucggcagaugagacguuau

SEQ ID NO: 1899742 - RNA, 16 nt, Shigella flexneri 2a str. 2457T
cucggcaaucuguuau

SEQ ID NO: 1899743 - RNA, 13 nt, Shigella flexneri 2a str. 2457T
cucgcuuuccauu

SEQ ID NO: 1899744 - RNA, 18 nt, Shigella flexneri 2a str. 2457T
cucgcauaucuucaacgc

SEQ ID NO: 1899745 - RNA, 21 nt, Shigella flexneri 2a str. 2457T
cucgaucggcucuuccgcgaa

SEQ ID NO: 1899746 - RNA, 16 nt, Shigella flexneri 2a str. 2457T
cuccggcaggaaaugg

SEQ ID NO: 1899747 - RNA, 15 nt, Shigella flexneri 2a str. 2457T
cuccgcugagacgcg

SEQ ID NO: 1899748 - RNA, 20 nt, Shigella flexneri 2a str. 2457T
cuccaugggagaacgaugcu

SEQ ID NO: 1899749 - RNA, 19 nt, Shigella flexneri 2a str. 2457T
cucccaguagugcuuucag

SEQ ID NO: 1899750 - RNA, 20 nt, Shigella flexneri 2a str. 2457T
cuccuggccgcaguacuggg

SEQ ID NO: 1899751 - RNA, 18 nt, Shigella flexneri 2a str. 2457T
cuccucgaguccuuccag

SEQ ID NO: 1899752 - RNA, 18 nt, Shigella flexneri 2a str. 2457T
cuccguuucacuucucau

SEQ ID NO: 1899753 - RNA, 20 nt, Shigella flexneri 2a str. 2457T
cuccuaucaccagcgguggu

SEQ ID NO: 1899754 - RNA, 13 nt, Shigella flexneri 2a str. 2457T
cuaucaacgacag

SEQ ID NO: 1899755 - RNA, 20 nt, Shigella flexneri 2a str. 2457T
cuaucagcaaacuaucccag

SEQ ID NO: 1899756 - RNA, 22 nt, Shigella flexneri 2a str. 2457T
cuagaugugcaguuccugcaac

SEQ ID NO: 1899757 - RNA, 14 nt, Shigella flexneri 2a str. 2457T
cguugccugcggca

SEQ ID NO: 1899758 - RNA, 16 nt, Shigella flexneri 2a str. 2457T
cuacuauggaacgcuc

SEQ ID NO: 1899759 - RNA, 16 nt, Shigella flexneri 2a str. 2457T
cguugcgaucgaccug

SEQ ID NO: 1899760 - RNA, 16 nt, Shigella flexneri 2a str. 2457T
cguugcgcccaucauc

SEQ ID NO: 1899761 - RNA, 18 nt, Shigella flexneri 2a str. 2457T
cuaucucccugauccaac

SEQ ID NO: 1899762 - RNA, 22 nt, Shigella flexneri 2a str. 2457T
cuaugaacacgaucucacgcug

SEQ ID NO: 1899763 - RNA, 13 nt, Shigella flexneri 2a str. 2457T
cuauggucuugua

SEQ ID NO: 1899764 - RNA, 18 nt, Shigella flexneri 2a str. 2457T
cuaugcauaauccugccg

SEQ ID NO: 1899765 - RNA, 22 nt, Shigella flexneri 2a str. 2457T
cuauuaaagaaaguaaucuaua

SEQ ID NO: 1899766 - RNA, 21 nt, Shigella flexneri 2a str. 2457T
cuauuacuuuaagccuuccgc

SEQ ID NO: 1899767 - RNA, 23 nt, Shigella flexneri 2a str. 2457T
cucaaccagauucggcgcaauga

SEQ ID NO: 1899768 - RNA, 13 nt, Shigella flexneri 2a str. 2457T
cucaauaaucaau

SEQ ID NO: 1899769 - RNA, 19 nt, Shigella flexneri 2a str. 2457T
cucaacaacgcucccggau

SEQ ID NO: 1899770 - RNA, 15 nt, Shigella flexneri 2a str. 2457T
cuccagacgccagau

SEQ ID NO: 1899771 - RNA, 14 nt, Shigella flexneri 2a str. 2457T
cucaggaacuguuu

SEQ ID NO: 1899772 - RNA, 17 nt, Shigella flexneri 2a str. 2457T
cuccaccuugcggaaac

SEQ ID NO: 1899773 - RNA, 21 nt, Shigella flexneri 2a str. 2457T
cuccacgcuauacagcagcca

SEQ ID NO: 1899774 - RNA, 15 nt, Shigella flexneri 2a str. 2457T
cuccacgcugcaucg

SEQ ID NO: 1899775 - RNA, 16 nt, Shigella flexneri 2a str. 2457T
cucagcagacugauau

SEQ ID NO: 1899776 - RNA, 22 nt, Shigella flexneri 2a str. 2457T
cucacuucgcuuacgccugcca

SEQ ID NO: 1899777 - RNA, 13 nt, Shigella flexneri 2a str. 2457T
cucacuaucgcug

SEQ ID NO: 1899778 - RNA, 19 nt, Shigella flexneri 2a str. 2457T
cucaaugacuucgcuuucg

SEQ ID NO: 1899779 - RNA, 19 nt, Shigella flexneri 2a str. 2457T
cucaaucguaugaucaucc

SEQ ID NO: 1899780 - RNA, 19 nt, Shigella flexneri 2a str. 2457T
cugagaucaaugcgccaac

SEQ ID NO: 1899781 - RNA, 18 nt, Shigella flexneri 2a str. 2457T
cugagcaugaugccugau

SEQ ID NO: 1899782 - RNA, 18 nt, Shigella flexneri 2a str. 2457T
cugagcaucggucgcguu

SEQ ID NO: 1899783 - RNA, 16 nt, Shigella flexneri 2a str. 2457T
cugagccugccauugg

SEQ ID NO: 1899784 - RNA, 23 nt, Shigella flexneri 2a str. 2457T
cugagcgaagauuucguuuucua

SEQ ID NO: 1899785 - RNA, 21 nt, Shigella flexneri 2a str. 2457T
cugauaagacgcguaaagcgu

SEQ ID NO: 1899786 - RNA, 14 nt, Shigella flexneri 2a str. 2457T
cugauacaggaagg

SEQ ID NO: 1899787 - RNA, 23 nt, Shigella flexneri 2a str. 2457T
cugauaauccagacuauuugaca

SEQ ID NO: 1899788 - RNA, 20 nt, Shigella flexneri 2a str. 2457T
cugagucgggugcagcgaca

SEQ ID NO: 1899789 - RNA, 18 nt, Shigella flexneri 2a str. 2457T
cugauaacacagaggcag

SEQ ID NO: 1899790 - RNA, 13 nt, Shigella flexneri 2a str. 2457T
cugacgacauaau

SEQ ID NO: 1899791 - RNA, 16 nt, Shigella flexneri 2a str. 2457T
cugacgaggcgucagc

SEQ ID NO: 1899792 - RNA, 12 nt, Shigella flexneri 2a str. 2457T
cugacgccaugc

SEQ ID NO: 1899793 - RNA, 16 nt, Shigella flexneri 2a str. 2457T
cugaccguaggccgga

SEQ ID NO: 1899794 - RNA, 14 nt, Shigella flexneri 2a str. 2457T
cugaccggccagca

SEQ ID NO: 1899795 - RNA, 15 nt, Shigella flexneri 2a str. 2457T
cugacugaaugccac

SEQ ID NO: 1899796 - RNA, 16 nt, Shigella flexneri 2a str. 2457T
cugacugacuucaaca

SEQ ID NO: 1899797 - RNA, 14 nt, Shigella flexneri 2a str. 2457T
cugacugaaugcca

SEQ ID NO: 1899798 - RNA, 20 nt, Shigella flexneri 2a str. 2457T
cugacuaugguguaacgauu

SEQ ID NO: 1899799 - RNA, 22 nt, Shigella flexneri 2a str. 2457T
cugacguuauugaucgccagcg

SEQ ID NO: 1899800 - RNA, 16 nt, Shigella flexneri 2a str. 2457T
cugacuguaggccgga

SEQ ID NO: 1899801 - RNA, 13 nt, Shigella flexneri 2a str. 2457T
cugacuugcccgu

SEQ ID NO: 1899802 - RNA, 13 nt, Shigella flexneri 2a str. 2457T
cugacggcagcga

SEQ ID NO: 1899803 - RNA, 23 nt, Shigella flexneri 2a str. 2457T
cugacgugcgcaaacuucuucag

SEQ ID NO: 1899804 - RNA, 16 nt, Shigella flexneri 2a str. 2457T
cugacacaggcagcaa

SEQ ID NO: 1899805 - RNA, 14 nt, Shigella flexneri 2a str. 2457T
cugacccagaccga

SEQ ID NO: 1899806 - RNA, 20 nt, Shigella flexneri 2a str. 2457T
cugaccagugaauuucacuu

SEQ ID NO: 1899807 - RNA, 14 nt, Shigella flexneri 2a str. 2457T
cugaccaccagcac

SEQ ID NO: 1899808 - RNA, 19 nt, Shigella flexneri 2a str. 2457T
cugaauaacuggcgcgaca

SEQ ID NO: 1899809 - RNA, 17 nt, Shigella flexneri 2a str. 2457T
cugaaguuauaagcguu

SEQ ID NO: 1899810 - RNA, 17 nt, Shigella flexneri 2a str. 2457T
cugaauaaacucgcaaa

SEQ ID NO: 1899811 - RNA, 22 nt, Shigella flexneri 2a str. 2457T
cugaagcauugccgaacgggua

SEQ ID NO: 1899812 - RNA, 15 nt, Shigella flexneri 2a str. 2457T
cugaacgccacgcuc

SEQ ID NO: 1899813 - RNA, 15 nt, Shigella flexneri 2a str. 2457T
cucucaucaauaccu

SEQ ID NO: 1899814 - RNA, 22 nt, Shigella flexneri 2a str. 2457T
cucuauccgaucauuagcugga

SEQ ID NO: 1899815 - RNA, 14 nt, Shigella flexneri 2a str. 2457T
cucuacgguaucgu

SEQ ID NO: 1899816 - RNA, 14 nt, Shigella flexneri 2a str. 2457T
cucuacaccaacgc

SEQ ID NO: 1899817 - RNA, 21 nt, Shigella flexneri 2a str. 2457T
cucuuccacauuuuccaucac

SEQ ID NO: 1899818 - RNA, 14 nt, Shigella flexneri 2a str. 2457T
cucuucauuaccuu

SEQ ID NO: 1899819 - RNA, 18 nt, Shigella flexneri 2a str. 2457T
cucuucagcaucaaugac

SEQ ID NO: 1899820 - RNA, 16 nt, Shigella flexneri 2a str. 2457T
cucuucauacgcggca

SEQ ID NO: 1899821 - RNA, 17 nt, Shigella flexneri 2a str. 2457T
cucugguuuuacaacgu

SEQ ID NO: 1899822 - RNA, 22 nt, Shigella flexneri 2a str. 2457T
cucuuccaggcauuaaauccug

SEQ ID NO: 1899823 - RNA, 11 nt, Shigella flexneri 2a str. 2457T
cucuugccagg

SEQ ID NO: 1899824 - RNA, 18 nt, Shigella flexneri 2a str. 2457T
cugaaaauuaacgggcag

SEQ ID NO: 1899825 - RNA, 19 nt, Shigella flexneri 2a str. 2457T
cugcccacgcgguauccau

SEQ ID NO: 1899826 - RNA, 17 nt, Shigella flexneri 2a str. 2457T
cugccagcguaaauccu

SEQ ID NO: 1899827 - RNA, 23 nt, Shigella flexneri 2a str. 2457T
cugccacgguaugacccagcgcg

SEQ ID NO: 1899828 - RNA, 16 nt, Shigella flexneri 2a str. 2457T
cugccagauucuccaa

SEQ ID NO: 1899829 - RNA, 18 nt, Shigella flexneri 2a str. 2457T
cugccaguaaagcagcga

SEQ ID NO: 1899830 - RNA, 17 nt, Shigella flexneri 2a str. 2457T
cugccauaaacgguuuc

SEQ ID NO: 1899831 - RNA, 14 nt, Shigella flexneri 2a str. 2457T
cugccauccugauu

SEQ ID NO: 1899832 - RNA, 20 nt, Shigella flexneri 2a str. 2457T
cugcagguauugcuucucag

SEQ ID NO: 1899833 - RNA, 22 nt, Shigella flexneri 2a str. 2457T
cugcauacguuucaccagcacu

SEQ ID NO: 1899834 - RNA, 16 nt, Shigella flexneri 2a str. 2457T
cugcauacgacgugcc

SEQ ID NO: 1899835 - RNA, 18 nt, Shigella flexneri 2a str. 2457T
cugcauaaugccgguggu

SEQ ID NO: 1899836 - RNA, 14 nt, Shigella flexneri 2a str. 2457T
cugcauuugaaacg

SEQ ID NO: 1899837 - RNA, 19 nt, Shigella flexneri 2a str. 2457T
cugcauuauccagcgaacc

SEQ ID NO: 1899838 - RNA, 17 nt, Shigella flexneri 2a str. 2457T
cugcauuaugagauuga

SEQ ID NO: 1899839 - RNA, 15 nt, Shigella flexneri 2a str. 2457T
cugcauuauccagcg

SEQ ID NO: 1899840 - RNA, 22 nt, Shigella flexneri 2a str. 2457T
cugccacgguaugacccagcgc

SEQ ID NO: 1899841 - RNA, 14 nt, Shigella flexneri 2a str. 2457T
cugcaucuccggcg

SEQ ID NO: 1899842 - RNA, 23 nt, Shigella flexneri 2a str. 2457T
cugcaucgcgcugaacaucgucu

SEQ ID NO: 1899843 - RNA, 16 nt, Shigella flexneri 2a str. 2457T
cugcauccgcgcuuuc

SEQ ID NO: 1899844 - RNA, 12 nt, Shigella flexneri 2a str. 2457T
cugcaucuuccg

SEQ ID NO: 1899845 - RNA, 21 nt, Shigella flexneri 2a str. 2457T
cugaugcgcuaugcuuaucag

SEQ ID NO: 1899846 - RNA, 21 nt, Shigella flexneri 2a str. 2457T
cugaugcgcuucgcuuaucag

SEQ ID NO: 1899847 - RNA, 22 nt, Shigella flexneri 2a str. 2457T
cugaugaagcaagcgucgccag

SEQ ID NO: 1899848 - RNA, 17 nt, Shigella flexneri 2a str. 2457T
cugaugagaugcuggag

SEQ ID NO: 1899849 - RNA, 16 nt, Shigella flexneri 2a str. 2457T
cugaucguccugcggu

SEQ ID NO: 1899850 - RNA, 18 nt, Shigella flexneri 2a str. 2457T
cugauuacccuucgcccu

SEQ ID NO: 1899851 - RNA, 18 nt, Shigella flexneri 2a str. 2457T
cugauucugauccugcac

SEQ ID NO: 1899852 - RNA, 17 nt, Shigella flexneri 2a str. 2457T
cugauucugauccugca

SEQ ID NO: 1899853 - RNA, 18 nt, Shigella flexneri 2a str. 2457T
cugauucgcgccacguuc

SEQ ID NO: 1899854 - RNA, 15 nt, Shigella flexneri 2a str. 2457T
cugauugcugucggc

SEQ ID NO: 1899855 - RNA, 20 nt, Shigella flexneri 2a str. 2457T
cugcaaaauagccaaucauu

SEQ ID NO: 1899856 - RNA, 22 nt, Shigella flexneri 2a str. 2457T
cugcaacgccuuugucgggcag

SEQ ID NO: 1899857 - RNA, 16 nt, Shigella flexneri 2a str. 2457T
cugcaaaucgaucuca

SEQ ID NO: 1899858 - RNA, 22 nt, Shigella flexneri 2a str. 2457T
cugcaaggccauccgcugcggu

SEQ ID NO: 1899859 - RNA, 21 nt, Shigella flexneri 2a str. 2457T
cugcacuuugugucagcgcca

SEQ ID NO: 1899860 - RNA, 16 nt, Shigella flexneri 2a str. 2457T
cugcagcccgaacggu

SEQ ID NO: 1899861 - RNA, 17 nt, Shigella flexneri 2a str. 2457T
cugcacugcaggccgga

SEQ ID NO: 1899862 - RNA, 19 nt, Shigella flexneri 2a str. 2457T
cugcacggcuucccacguc

SEQ ID NO: 1899863 - RNA, 20 nt, Shigella flexneri 2a str. 2457T
cugcacgucauacugcucag

SEQ ID NO: 1899864 - RNA, 21 nt, Shigella flexneri 2a str. 2457T
cugcacgguuuuuccagcucu

SEQ ID NO: 1899865 - RNA, 22 nt, Shigella flexneri 2a str. 2457T
cugcacggagauauccagcgcc

SEQ ID NO: 1899866 - RNA, 18 nt, Shigella flexneri 2a str. 2457T
cugcaaucuuuaacggcg

SEQ ID NO: 1899867 - RNA, 21 nt, Shigella flexneri 2a str. 2457T
cugcaauaaaauaucuuccac

SEQ ID NO: 1899868 - RNA, 18 nt, Shigella flexneri 2a str. 2457T
cugcacaaauagccagca

SEQ ID NO: 1899869 - RNA, 16 nt, Shigella flexneri 2a str. 2457T
cugcacaccaaccgcu

SEQ ID NO: 1899870 - RNA, 17 nt, Shigella flexneri 2a str. 2457T
cugcaauugcggcaggu

SEQ ID NO: 1899871 - RNA, 14 nt, Shigella flexneri 2a str. 2457T
cgugaaugccugau

SEQ ID NO: 1899872 - RNA, 21 nt, Shigella flexneri 2a str. 2457T
cgugaccaguaccaccgcgaa

SEQ ID NO: 1899873 - RNA, 22 nt, Shigella flexneri 2a str. 2457T
aacccuaaagcacccagcaauc

SEQ ID NO: 1899874 - RNA, 20 nt, Shigella flexneri 2a str. 2457T
aaccgcaccaggcaguuuau

SEQ ID NO: 1899875 - RNA, 21 nt, Shigella flexneri 2a str. 2457T
cgucugggcaaaaucaucacu

SEQ ID NO: 1899876 - RNA, 24 nt, Shigella flexneri 2a str. 2457T
cgucugguaucgcgccagccagua

SEQ ID NO: 1899877 - RNA, 19 nt, Shigella flexneri 2a str. 2457T
cgucuuaucaugccuacaa

SEQ ID NO: 1899878 - RNA, 19 nt, Shigella flexneri 2a str. 2457T
cgucuuaucaggccuacaa

SEQ ID NO: 1899879 - RNA, 13 nt, Shigella flexneri 2a str. 2457T
cgugaacgccuua

SEQ ID NO: 1899880 - RNA, 22 nt, Shigella flexneri 2a str. 2457T
cgugaacgccuuauccggccua

SEQ ID NO: 1899881 - RNA, 16 nt, Shigella flexneri 2a str. 2457T
cgugaaaagcugcaua

SEQ ID NO: 1899882 - RNA, 22 nt, Shigella flexneri 2a str. 2457T
cgugcccacguucaugccgacg

SEQ ID NO: 1899883 - RNA, 14 nt, Shigella flexneri 2a str. 2457T
cgugcagugauuca

SEQ ID NO: 1899884 - RNA, 21 nt, Shigella flexneri 2a str. 2457T
cgugcagaccgcugacggcag

SEQ ID NO: 1899885 - RNA, 23 nt, Shigella flexneri 2a str. 2457T
cgugauuguggcaaucauauuca

SEQ ID NO: 1899886 - RNA, 23 nt, Shigella flexneri 2a str. 2457T
cguugcaaucagcggugccgcga

SEQ ID NO: 1899887 - RNA, 12 nt, Shigella flexneri 2a str. 2457T
cguugaugcagg

SEQ ID NO: 1899888 - RNA, 15 nt, Shigella flexneri 2a str. 2457T
cguugaacccggcau

SEQ ID NO: 1899889 - RNA, 13 nt, Shigella flexneri 2a str. 2457T
cguugaccaguca

SEQ ID NO: 1899890 - RNA, 14 nt, Shigella flexneri 2a str. 2457T
cguugaccaucuga

SEQ ID NO: 1899891 - RNA, 14 nt, Shigella flexneri 2a str. 2457T
cguugaccagcauc

SEQ ID NO: 1899892 - RNA, 14 nt, Shigella flexneri 2a str. 2457T
cguucuucccgccu

SEQ ID NO: 1899893 - RNA, 23 nt, Shigella flexneri 2a str. 2457T
cguugaaaaaucaaaaaacugga

SEQ ID NO: 1899894 - RNA, 22 nt, Shigella flexneri 2a str. 2457T
cguuccccuguugugccagacc

SEQ ID NO: 1899895 - RNA, 14 nt, Shigella flexneri 2a str. 2457T
cguuccccagaugc

SEQ ID NO: 1899896 - RNA, 14 nt, Shigella flexneri 2a str. 2457T
cguuacagcuggag

SEQ ID NO: 1899897 - RNA, 15 nt, Shigella flexneri 2a str. 2457T
cguuaugaucagcaa

SEQ ID NO: 1899898 - RNA, 23 nt, Shigella flexneri 2a str. 2457T
cguucaaacgauucggcaaucac

SEQ ID NO: 1899899 - RNA, 21 nt, Shigella flexneri 2a str. 2457T
cguucacgucgcauccggcau

SEQ ID NO: 1899900 - RNA, 12 nt, Shigella flexneri 2a str. 2457T
cguguuccaguu

SEQ ID NO: 1899901 - RNA, 13 nt, Shigella flexneri 2a str. 2457T
cguguucaugacc

SEQ ID NO: 1899902 - RNA, 16 nt, Shigella flexneri 2a str. 2457T
cguuaacagcgcauuc

SEQ ID NO: 1899903 - RNA, 19 nt, Shigella flexneri 2a str. 2457T
cguguugucagcucaucca

SEQ ID NO: 1899904 - RNA, 12 nt, Shigella flexneri 2a str. 2457T
cguguuucagaa

SEQ ID NO: 1899905 - RNA, 23 nt, Shigella flexneri 2a str. 2457T
cgugccggaagucucuugccggu

SEQ ID NO: 1899906 - RNA, 23 nt, Shigella flexneri 2a str. 2457T
cgugcgaauaaugguaucgacac

SEQ ID NO: 1899907 - RNA, 19 nt, Shigella flexneri 2a str. 2457T
aaccgcaucaacagugcca

SEQ ID NO: 1899908 - RNA, 20 nt, Shigella flexneri 2a str. 2457T
cguggagcaacacgccagcg

SEQ ID NO: 1899909 - RNA, 17 nt, Shigella flexneri 2a str. 2457T
cgugggcaauauuucgc

SEQ ID NO: 1899910 - RNA, 20 nt, Shigella flexneri 2a str. 2457T
cguggcggaaaucuuucauu

SEQ ID NO: 1899911 - RNA, 12 nt, Shigella flexneri 2a str. 2457T
cgucaccaccug

SEQ ID NO: 1899912 - RNA, 18 nt, Shigella flexneri 2a str. 2457T
cguaugaugugcgcuaac

SEQ ID NO: 1899913 - RNA, 16 nt, Shigella flexneri 2a str. 2457T
cgucaaaaaaacggcg

SEQ ID NO: 1899914 - RNA, 11 nt, Shigella flexneri 2a str. 2457T
cguauccggcu

SEQ ID NO: 1899915 - RNA, 16 nt, Shigella flexneri 2a str. 2457T
cguauuuccugccaga

SEQ ID NO: 1899916 - RNA, 19 nt, Shigella flexneri 2a str. 2457T
cguaggccugauaagacgc

SEQ ID NO: 1899917 - RNA, 20 nt, Shigella flexneri 2a str. 2457T
cguaggccggauaaggcguu

SEQ ID NO: 1899918 - RNA, 19 nt, Shigella flexneri 2a str. 2457T
cguaggccugauaagcgua

SEQ ID NO: 1899919 - RNA, 19 nt, Shigella flexneri 2a str. 2457T
cguaggcaauuggcgcauc

SEQ ID NO: 1899920 - RNA, 19 nt, Shigella flexneri 2a str. 2457T
cguagaucauagagcacgg

SEQ ID NO: 1899921 - RNA, 20 nt, Shigella flexneri 2a str. 2457T
aacccaugccggaugcgcca

SEQ ID NO: 1899922 - RNA, 22 nt, Shigella flexneri 2a str. 2457T
aacccgaaggaauuuuacagcc

SEQ ID NO: 1899923 - RNA, 15 nt, Shigella flexneri 2a str. 2457T
cguagcguuaacgcg

SEQ ID NO: 1899924 - RNA, 13 nt, Shigella flexneri 2a str. 2457T
cguacacgccgca

SEQ ID NO: 1899925 - RNA, 16 nt, Shigella flexneri 2a str. 2457T
cguaccaucgccagcc

SEQ ID NO: 1899926 - RNA, 17 nt, Shigella flexneri 2a str. 2457T
cguaccagccuugccag

SEQ ID NO: 1899927 - RNA, 21 nt, Shigella flexneri 2a str. 2457T
cguacaucccgcgaacgagaa

SEQ ID NO: 1899928 - RNA, 22 nt, Shigella flexneri 2a str. 2457T
cguaacgcucaaguacggcaau

SEQ ID NO: 1899929 - RNA, 14 nt, Shigella flexneri 2a str. 2457T
cguaacgaccacca

SEQ ID NO: 1899930 - RNA, 23 nt, Shigella flexneri 2a str. 2457T
cguaacgcaccaggcgaaaacgc

SEQ ID NO: 1899931 - RNA, 17 nt, Shigella flexneri 2a str. 2457T
cguaaccagacggcgua

SEQ ID NO: 1899932 - RNA, 11 nt, Shigella flexneri 2a str. 2457T
cguaacauauu

SEQ ID NO: 1899933 - RNA, 14 nt, Shigella flexneri 2a str. 2457T
cguacuccaucucg

SEQ ID NO: 1899934 - RNA, 18 nt, Shigella flexneri 2a str. 2457T
cguacuggcaaucgccag

SEQ ID NO: 1899935 - RNA, 19 nt, Shigella flexneri 2a str. 2457T
cguacugcauaaugccggu

SEQ ID NO: 1899936 - RNA, 21 nt, Shigella flexneri 2a str. 2457T
cguacuggcaaucgccagcgg

SEQ ID NO: 1899937 - RNA, 23 nt, Shigella flexneri 2a str. 2457T
cguacuggcaaucgccagcggca

SEQ ID NO: 1899938 - RNA, 18 nt, Shigella flexneri 2a str. 2457T
cguaccuuugccuuccag

SEQ ID NO: 1899939 - RNA, 19 nt, Shigella flexneri 2a str. 2457T
cgguucaagucccaacauc

SEQ ID NO: 1899940 - RNA, 23 nt, Shigella flexneri 2a str. 2457T
cgguuauacacgcccgucaugcc

SEQ ID NO: 1899941 - RNA, 14 nt, Shigella flexneri 2a str. 2457T
cgguugauggcagu

SEQ ID NO: 1899942 - RNA, 17 nt, Shigella flexneri 2a str. 2457T
cgguucguaggccagau

SEQ ID NO: 1899943 - RNA, 16 nt, Shigella flexneri 2a str. 2457T
cgguucgccugcacca

SEQ ID NO: 1899944 - RNA, 15 nt, Shigella flexneri 2a str. 2457T
cgguucggccauauc

SEQ ID NO: 1899945 - RNA, 13 nt, Shigella flexneri 2a str. 2457T
cgguuuugccagc

SEQ ID NO: 1899946 - RNA, 17 nt, Shigella flexneri 2a str. 2457T
cguaacacauaacgcca

SEQ ID NO: 1899947 - RNA, 19 nt, Shigella flexneri 2a str. 2457T
cgucgcccacaccagauga

SEQ ID NO: 1899948 - RNA, 19 nt, Shigella flexneri 2a str. 2457T
cgucgcuaacggugcacgc

SEQ ID NO: 1899949 - RNA, 22 nt, Shigella flexneri 2a str. 2457T
cgucgaacgcugcgcgaccauc

SEQ ID NO: 1899950 - RNA, 16 nt, Shigella flexneri 2a str. 2457T
cgucauuaaccagcca

SEQ ID NO: 1899951 - RNA, 14 nt, Shigella flexneri 2a str. 2457T
cgucauuaccgcga

SEQ ID NO: 1899952 - RNA, 17 nt, Shigella flexneri 2a str. 2457T
cguccagcuugaagggu

SEQ ID NO: 1899953 - RNA, 21 nt, Shigella flexneri 2a str. 2457T
gaugccgauuguauacgcugg

SEQ ID NO: 1899954 - RNA, 19 nt, Shigella flexneri 2a str. 2457T
gaugcgaugcuggcgcauc

SEQ ID NO: 1899955 - RNA, 21 nt, Shigella flexneri 2a str. 2457T
gaugcgaugcauccggcaguc

SEQ ID NO: 1899956 - RNA, 15 nt, Shigella flexneri 2a str. 2457T
gaugccugaugcggc

SEQ ID NO: 1899957 - RNA, 18 nt, Shigella flexneri 2a str. 2457T
gaugccugaugugacgcu

SEQ ID NO: 1899958 - RNA, 13 nt, Shigella flexneri 2a str. 2457T
gaugcgacgcuua

SEQ ID NO: 1899959 - RNA, 18 nt, Shigella flexneri 2a str. 2457T
gaugcgacuugucaucau

SEQ ID NO: 1899960 - RNA, 21 nt, Shigella flexneri 2a str. 2457T
gaugccguuccacccagcuca

SEQ ID NO: 1899961 - RNA, 14 nt, Shigella flexneri 2a str. 2457T
gaugaguucaccgu

SEQ ID NO: 1899962 - RNA, 17 nt, Shigella flexneri 2a str. 2457T
gaugaucaagcgcacaa

SEQ ID NO: 1899963 - RNA, 18 nt, Shigella flexneri 2a str. 2457T
aacuggucugcaugacgg

SEQ ID NO: 1899964 - RNA, 16 nt, Shigella flexneri 2a str. 2457T
aacuguaaaucgccau

SEQ ID NO: 1899965 - RNA, 16 nt, Shigella flexneri 2a str. 2457T
gaugauuacgcgcuca

SEQ ID NO: 1899966 - RNA, 18 nt, Shigella flexneri 2a str. 2457T
gaugaugccuacacgcca

SEQ ID NO: 1899967 - RNA, 14 nt, Shigella flexneri 2a str. 2457T
gaugaugauacuga

SEQ ID NO: 1899968 - RNA, 12 nt, Shigella flexneri 2a str. 2457T
gaugaugccaag

SEQ ID NO: 1899969 - RNA, 16 nt, Shigella flexneri 2a str. 2457T
gaugcccccagcagcg

SEQ ID NO: 1899970 - RNA, 15 nt, Shigella flexneri 2a str. 2457T
gaugcccaugccaau

SEQ ID NO: 1899971 - RNA, 17 nt, Shigella flexneri 2a str. 2457T
gaugccacaaacuggcu

SEQ ID NO: 1899972 - RNA, 15 nt, Shigella flexneri 2a str. 2457T
gaugcaucagucacg

SEQ ID NO: 1899973 - RNA, 21 nt, Shigella flexneri 2a str. 2457T
gaugcaucgcauccgacauca

SEQ ID NO: 1899974 - RNA, 13 nt, Shigella flexneri 2a str. 2457T
gaugccagcaccg

SEQ ID NO: 1899975 - RNA, 14 nt, Shigella flexneri 2a str. 2457T
gaugcaggccacca

SEQ ID NO: 1899976 - RNA, 18 nt, Shigella flexneri 2a str. 2457T
aacugucaauaaacgccu

SEQ ID NO: 1899977 - RNA, 16 nt, Shigella flexneri 2a str. 2457T
aacugucaauaaacgc

SEQ ID NO: 1899978 - RNA, 16 nt, Shigella flexneri 2a str. 2457T
aacuguugauccagga

SEQ ID NO: 1899979 - RNA, 19 nt, Shigella flexneri 2a str. 2457T
aacuguugauccaggagcu

SEQ ID NO: 1899980 - RNA, 18 nt, Shigella flexneri 2a str. 2457T
aacugugcacccgcuuca

SEQ ID NO: 1899981 - RNA, 15 nt, Shigella flexneri 2a str. 2457T
gaugcacagcacgcu

SEQ ID NO: 1899982 - RNA, 17 nt, Shigella flexneri 2a str. 2457T
gaucgccguaacgcccu

SEQ ID NO: 1899983 - RNA, 16 nt, Shigella flexneri 2a str. 2457T
gaugagaugcuggaga

SEQ ID NO: 1899984 - RNA, 22 nt, Shigella flexneri 2a str. 2457T
gaugaaaagucauccggcguca

SEQ ID NO: 1899985 - RNA, 14 nt, Shigella flexneri 2a str. 2457T
aacugcugacgcag

SEQ ID NO: 1899986 - RNA, 18 nt, Shigella flexneri 2a str. 2457T
aacugcucguucagcggc

SEQ ID NO: 1899987 - RNA, 20 nt, Shigella flexneri 2a str. 2457T
aacugcgucgacauagccau

SEQ ID NO: 1899988 - RNA, 23 nt, Shigella flexneri 2a str. 2457T
aacugcuggcuuaaaaaacggau

SEQ ID NO: 1899989 - RNA, 22 nt, Shigella flexneri 2a str. 2457T
aacuggaagauuuaccgaaaua

SEQ ID NO: 1899990 - RNA, 22 nt, Shigella flexneri 2a str. 2457T
gaugaauuugugaacagccugu

SEQ ID NO: 1899991 - RNA, 21 nt, Shigella flexneri 2a str. 2457T
gaugacagucuggaagccagu

SEQ ID NO: 1899992 - RNA, 12 nt, Shigella flexneri 2a str. 2457T
gauuacgcaccg

SEQ ID NO: 1899993 - RNA, 19 nt, Shigella flexneri 2a str. 2457T
gauucaagauuagccugaa

SEQ ID NO: 1899994 - RNA, 16 nt, Shigella flexneri 2a str. 2457T
gauucacauccggcca

SEQ ID NO: 1899995 - RNA, 16 nt, Shigella flexneri 2a str. 2457T
gauucauacagcggcc

SEQ ID NO: 1899996 - RNA, 21 nt, Shigella flexneri 2a str. 2457T
gauucauacagcggccagcca

SEQ ID NO: 1899997 - RNA, 12 nt, Shigella flexneri 2a str. 2457T
gauucagcaccg

SEQ ID NO: 1899998 - RNA, 20 nt, Shigella flexneri 2a str. 2457T
gauuaacgcuuguaaaugaa

SEQ ID NO: 1899999 - RNA, 20 nt, Shigella flexneri 2a str. 2457T
gauuaccagcgacaucaccg

SEQ ID NO: 1900000 - RNA, 18 nt, Shigella flexneri 2a str. 2457T
gauguugccacacgccca

SEQ ID NO: 1900001 - RNA, 20 nt, Shigella flexneri 2a str. 2457T
gaugugcuucaucagacgcu

SEQ ID NO: 1900002 - RNA, 20 nt, Shigella flexneri 2a str. 2457T
gauugcaccaccagacgagc

SEQ ID NO: 1900003 - RNA, 12 nt, Shigella flexneri 2a str. 2457T
gauugccgauau

SEQ ID NO: 1900004 - RNA, 20 nt, Shigella flexneri 2a str. 2457T
gauugccccuguaauugccu

SEQ ID NO: 1900005 - RNA, 22 nt, Shigella flexneri 2a str. 2457T
gauugccguggauuuaaugcca

SEQ ID NO: 1900006 - RNA, 23 nt, Shigella flexneri 2a str. 2457T
gauuuaaacaccugggcaauggu

SEQ ID NO: 1900007 - RNA, 16 nt, Shigella flexneri 2a str. 2457T
gauuuaacaucuccac

SEQ ID NO: 1900008 - RNA, 16 nt, Shigella flexneri 2a str. 2457T
gauucggccaguaacc

SEQ ID NO: 1900009 - RNA, 21 nt, Shigella flexneri 2a str. 2457T
gauucggcgcaaugauaucgc

SEQ ID NO: 1900010 - RNA, 17 nt, Shigella flexneri 2a str. 2457T
gauucauauugccgugc

SEQ ID NO: 1900011 - RNA, 20 nt, Shigella flexneri 2a str. 2457T
gauuuucaccagcaucgccg

SEQ ID NO: 1900012 - RNA, 17 nt, Shigella flexneri 2a str. 2457T
gauuuucaccagcaucg

SEQ ID NO: 1900013 - RNA, 13 nt, Shigella flexneri 2a str. 2457T
gauuucaucgccc

SEQ ID NO: 1900014 - RNA, 14 nt, Shigella flexneri 2a str. 2457T
gcaaaccucaccgc

SEQ ID NO: 1900015 - RNA, 14 nt, Shigella flexneri 2a str. 2457T
gcaaaccuggcaac

SEQ ID NO: 1900016 - RNA, 16 nt, Shigella flexneri 2a str. 2457T
gauuuuuugccagcac

SEQ ID NO: 1900017 - RNA, 14 nt, Shigella flexneri 2a str. 2457T
gcaacagaacgcgc

SEQ ID NO: 1900018 - RNA, 17 nt, Shigella flexneri 2a str. 2457T
gcaacagcaauacguuu

SEQ ID NO: 1900019 - RNA, 16 nt, Shigella flexneri 2a str. 2457T
gcaacagaauuacugg

SEQ ID NO: 1900020 - RNA, 21 nt, Shigella flexneri 2a str. 2457T
gcaaauucucuauuucacccg

SEQ ID NO: 1900021 - RNA, 17 nt, Shigella flexneri 2a str. 2457T
gcaaaugccagauaaga

SEQ ID NO: 1900022 - RNA, 12 nt, Shigella flexneri 2a str. 2457T
gcaaauaccgga

SEQ ID NO: 1900023 - RNA, 21 nt, Shigella flexneri 2a str. 2457T
gcaaaucacgcugcugauuaa

SEQ ID NO: 1900024 - RNA, 14 nt, Shigella flexneri 2a str. 2457T
gcaaagacgacuuu

SEQ ID NO: 1900025 - RNA, 15 nt, Shigella flexneri 2a str. 2457T
gaugcuccuggcgaa

SEQ ID NO: 1900026 - RNA, 22 nt, Shigella flexneri 2a str. 2457T
aacuucucuucuuccgcuucaa

SEQ ID NO: 1900027 - RNA, 18 nt, Shigella flexneri 2a str. 2457T
gauggaccgugccggacg

SEQ ID NO: 1900028 - RNA, 18 nt, Shigella flexneri 2a str. 2457T
gauggaguaguugaucgc

SEQ ID NO: 1900029 - RNA, 18 nt, Shigella flexneri 2a str. 2457T
gauggcauacaacgccau

SEQ ID NO: 1900030 - RNA, 13 nt, Shigella flexneri 2a str. 2457T
gaugcgccagcau

SEQ ID NO: 1900031 - RNA, 19 nt, Shigella flexneri 2a str. 2457T
gaugcgcgaacuggaugaa

SEQ ID NO: 1900032 - RNA, 15 nt, Shigella flexneri 2a str. 2457T
aacuucccgcaucca

SEQ ID NO: 1900033 - RNA, 11 nt, Shigella flexneri 2a str. 2457T
aacuucgcgag

SEQ ID NO: 1900034 - RNA, 13 nt, Shigella flexneri 2a str. 2457T
gaugcgcugcgcu

SEQ ID NO: 1900035 - RNA, 17 nt, Shigella flexneri 2a str. 2457T
gaugcgcuacgcucauc

SEQ ID NO: 1900036 - RNA, 15 nt, Shigella flexneri 2a str. 2457T
gaugcgcuacgcuua

SEQ ID NO: 1900037 - RNA, 20 nt, Shigella flexneri 2a str. 2457T
gaugucauaaaucagcguga

SEQ ID NO: 1900038 - RNA, 22 nt, Shigella flexneri 2a str. 2457T
gaugucagcgggaugccaguca

SEQ ID NO: 1900039 - RNA, 21 nt, Shigella flexneri 2a str. 2457T
gauguacuucaacauaacgca

SEQ ID NO: 1900040 - RNA, 23 nt, Shigella flexneri 2a str. 2457T
gauguaaucaacuccgccagcaa

SEQ ID NO: 1900041 - RNA, 23 nt, Shigella flexneri 2a str. 2457T
gaugggcaguugcgcgcgcaccu

SEQ ID NO: 1900042 - RNA, 20 nt, Shigella flexneri 2a str. 2457T
gauggcuguuuucagcacca

SEQ ID NO: 1900043 - RNA, 12 nt, Shigella flexneri 2a str. 2457T
gaucauccggcu

SEQ ID NO: 1900044 - RNA, 14 nt, Shigella flexneri 2a str. 2457T
gaguaacagauugu

SEQ ID NO: 1900045 - RNA, 22 nt, Shigella flexneri 2a str. 2457T
gauaccaauguagccgcggauc

SEQ ID NO: 1900046 - RNA, 19 nt, Shigella flexneri 2a str. 2457T
gauacagccaaaucaucag

SEQ ID NO: 1900047 - RNA, 14 nt, Shigella flexneri 2a str. 2457T
gauauccagcgccg

SEQ ID NO: 1900048 - RNA, 21 nt, Shigella flexneri 2a str. 2457T
gauauccagauccagcaccuu

SEQ ID NO: 1900049 - RNA, 14 nt, Shigella flexneri 2a str. 2457T
gauauccaccgcgu

SEQ ID NO: 1900050 - RNA, 16 nt, Shigella flexneri 2a str. 2457T
gauauuccugaauggu

SEQ ID NO: 1900051 - RNA, 12 nt, Shigella flexneri 2a str. 2457T
gauauugacgau

SEQ ID NO: 1900052 - RNA, 14 nt, Shigella flexneri 2a str. 2457T
gauaugcgucagau

SEQ ID NO: 1900053 - RNA, 14 nt, Shigella flexneri 2a str. 2457T
gauauguaacauac

SEQ ID NO: 1900054 - RNA, 20 nt, Shigella flexneri 2a str. 2457T
gauauguucagaaagcgcca

SEQ ID NO: 1900055 - RNA, 16 nt, Shigella flexneri 2a str. 2457T
gauagcggcugacggu

SEQ ID NO: 1900056 - RNA, 22 nt, Shigella flexneri 2a str. 2457T
gauagcgucauuucuacgggua

SEQ ID NO: 1900057 - RNA, 17 nt, Shigella flexneri 2a str. 2457T
gauaguguuuuauguuc

SEQ ID NO: 1900058 - RNA, 19 nt, Shigella flexneri 2a str. 2457T
gauagcgcacgcgcuucac

SEQ ID NO: 1900059 - RNA, 16 nt, Shigella flexneri 2a str. 2457T
gauagcgcacgcgcuu

SEQ ID NO: 1900060 - RNA, 16 nt, Shigella flexneri 2a str. 2457T
gauauuucaccagcgc

SEQ ID NO: 1900061 - RNA, 14 nt, Shigella flexneri 2a str. 2457T
gaucaaacgccgau

SEQ ID NO: 1900062 - RNA, 13 nt, Shigella flexneri 2a str. 2457T
gaucacaucgccg

SEQ ID NO: 1900063 - RNA, 15 nt, Shigella flexneri 2a str. 2457T
gagcggacugaacgc

SEQ ID NO: 1900064 - RNA, 17 nt, Shigella flexneri 2a str. 2457T
gacgguuuuacgcuccc

SEQ ID NO: 1900065 - RNA, 17 nt, Shigella flexneri 2a str. 2457T
aacucgcugccagcacu

SEQ ID NO: 1900066 - RNA, 15 nt, Shigella flexneri 2a str. 2457T
aacucugcggcauca

SEQ ID NO: 1900067 - RNA, 21 nt, Shigella flexneri 2a str. 2457T
aacugcacaccgcggaacgca

SEQ ID NO: 1900068 - RNA, 18 nt, Shigella flexneri 2a str. 2457T
aacugacugacuucaaca

SEQ ID NO: 1900069 - RNA, 19 nt, Shigella flexneri 2a str. 2457T
aacugccaguaaagcagcg

SEQ ID NO: 1900070 - RNA, 14 nt, Shigella flexneri 2a str. 2457T
aacugcccgaucaa

SEQ ID NO: 1900071 - RNA, 16 nt, Shigella flexneri 2a str. 2457T
aacugccgcgccugaa

SEQ ID NO: 1900072 - RNA, 22 nt, Shigella flexneri 2a str. 2457T
gagcggggaacaccucuggcga

SEQ ID NO: 1900073 - RNA, 20 nt, Shigella flexneri 2a str. 2457T
gaggagcugcacgaugacug

SEQ ID NO: 1900074 - RNA, 20 nt, Shigella flexneri 2a str. 2457T
gaggucaucagcgcgguacg

SEQ ID NO: 1900075 - RNA, 16 nt, Shigella flexneri 2a str. 2457T
gaggggcggcucuccu

SEQ ID NO: 1900076 - RNA, 17 nt, Shigella flexneri 2a str. 2457T
gcagggcggcaggcagc

SEQ ID NO: 1900077 - RNA, 20 nt, Shigella flexneri 2a str. 2457T
gcaggucaugguaggccgga

SEQ ID NO: 1900078 - RNA, 12 nt, Shigella flexneri 2a str. 2457T
aagaacugacuu

SEQ ID NO: 1900079 - RNA, 22 nt, Shigella flexneri 2a str. 2457T
gcaguagaucuuauaugcgucu

SEQ ID NO: 1900080 - RNA, 22 nt, Shigella flexneri 2a str. 2457T
gcaguaccagauaaucaccugc

SEQ ID NO: 1900081 - RNA, 15 nt, Shigella flexneri 2a str. 2457T
gcagguugcgugcac

SEQ ID NO: 1900082 - RNA, 21 nt, Shigella flexneri 2a str. 2457T
gcaguaaaccacccaccagcg

SEQ ID NO: 1900083 - RNA, 23 nt, Shigella flexneri 2a str. 2457T
gcaguaaaccacccaccagcgcc

SEQ ID NO: 1900084 - RNA, 12 nt, Shigella flexneri 2a str. 2457T
gcagggcaaugc

SEQ ID NO: 1900085 - RNA, 18 nt, Shigella flexneri 2a str. 2457T
gcagggauauuucaccgc

SEQ ID NO: 1900086 - RNA, 21 nt, Shigella flexneri 2a str. 2457T
gcaggcuucaacacaggccgg

SEQ ID NO: 1900087 - RNA, 15 nt, Shigella flexneri 2a str. 2457T
gcaggcggcuucgca

SEQ ID NO: 1900088 - RNA, 15 nt, Shigella flexneri 2a str. 2457T
gcaggccugauaagc

SEQ ID NO: 1900089 - RNA, 20 nt, Shigella flexneri 2a str. 2457T
gcaggaugggcaacgcgcau

SEQ ID NO: 1900090 - RNA, 20 nt, Shigella flexneri 2a str. 2457T
gcaggauguuccggcaaagu

SEQ ID NO: 1900091 - RNA, 23 nt, Shigella flexneri 2a str. 2457T
gcaggaugacaaaggugccgccc

SEQ ID NO: 1900092 - RNA, 14 nt, Shigella flexneri 2a str. 2457T
gcagcgccaaucgc

SEQ ID NO: 1900093 - RNA, 22 nt, Shigella flexneri 2a str. 2457T
gcagcugggcgagggcaaaccu

SEQ ID NO: 1900094 - RNA, 17 nt, Shigella flexneri 2a str. 2457T
gcagcuuucagcagcgg

SEQ ID NO: 1900095 - RNA, 23 nt, Shigella flexneri 2a str. 2457T
gcagcuucacaaaggcuugcugc

SEQ ID NO: 1900096 - RNA, 21 nt, Shigella flexneri 2a str. 2457T
gcaggaucgacugcaaaccau

SEQ ID NO: 1900097 - RNA, 20 nt, Shigella flexneri 2a str. 2457T
gcaggaaucacguaggccug

SEQ ID NO: 1900098 - RNA, 20 nt, Shigella flexneri 2a str. 2457T
gcaggaaaagguaggccuga

SEQ ID NO: 1900099 - RNA, 21 nt, Shigella flexneri 2a str. 2457T
gcaggaaauacguaggccuga

SEQ ID NO: 1900100 - RNA, 17 nt, Shigella flexneri 2a str. 2457T
gcacgucuuugccgcgc

SEQ ID NO: 1900101 - RNA, 19 nt, Shigella flexneri 2a str. 2457T
gcacugcaucaaugccgga

SEQ ID NO: 1900102 - RNA, 19 nt, Shigella flexneri 2a str. 2457T
gcacugcgcccgccagcau

SEQ ID NO: 1900103 - RNA, 14 nt, Shigella flexneri 2a str. 2457T
gcacucgcccugac

SEQ ID NO: 1900104 - RNA, 19 nt, Shigella flexneri 2a str. 2457T
gcacuuucgccugcggcgc

SEQ ID NO: 1900105 - RNA, 22 nt, Shigella flexneri 2a str. 2457T
gcacuuugccagaaauccaggc

SEQ ID NO: 1900106 - RNA, 18 nt, Shigella flexneri 2a str. 2457T
gcagaaaaaacaaacggc

SEQ ID NO: 1900107 - RNA, 23 nt, Shigella flexneri 2a str. 2457T
gcagaaauugaccccagccaguu

SEQ ID NO: 1900108 - RNA, 15 nt, Shigella flexneri 2a str. 2457T
gcagaaagcgacuuu

SEQ ID NO: 1900109 - RNA, 16 nt, Shigella flexneri 2a str. 2457T
gcagaacgcuuucgca

SEQ ID NO: 1900110 - RNA, 22 nt, Shigella flexneri 2a str. 2457T
aacuugcguaucgaccagaaua

SEQ ID NO: 1900111 - RNA, 18 nt, Shigella flexneri 2a str. 2457T
gcagaguuguucugcgac

SEQ ID NO: 1900112 - RNA, 15 nt, Shigella flexneri 2a str. 2457T
gcagauuaugccuga

SEQ ID NO: 1900113 - RNA, 21 nt, Shigella flexneri 2a str. 2457T
gcagauucagccacauuugcg

SEQ ID NO: 1900114 - RNA, 17 nt, Shigella flexneri 2a str. 2457T
gcagauacauugccacc

SEQ ID NO: 1900115 - RNA, 14 nt, Shigella flexneri 2a str. 2457T
gcagauagcccgga

SEQ ID NO: 1900116 - RNA, 19 nt, Shigella flexneri 2a str. 2457T
gcagauaucccgccagcac

SEQ ID NO: 1900117 - RNA, 17 nt, Shigella flexneri 2a str. 2457T
gcagcaaucgaccaggc

SEQ ID NO: 1900118 - RNA, 19 nt, Shigella flexneri 2a str. 2457T
gcagcaagccaucguuaau

SEQ ID NO: 1900119 - RNA, 23 nt, Shigella flexneri 2a str. 2457T
gcagcaaggcuauucagcaguuc

SEQ ID NO: 1900120 - RNA, 14 nt, Shigella flexneri 2a str. 2457T
gcagcaagccaucg

SEQ ID NO: 1900121 - RNA, 12 nt, Shigella flexneri 2a str. 2457T
gcacgcuggaga

SEQ ID NO: 1900122 - RNA, 15 nt, Shigella flexneri 2a str. 2457T
gcacgcccugauaaa

SEQ ID NO: 1900123 - RNA, 15 nt, Shigella flexneri 2a str. 2457T
gcacgaaccgucccu

SEQ ID NO: 1900124 - RNA, 19 nt, Shigella flexneri 2a str. 2457T
gcaccugcggaaucaccgg

SEQ ID NO: 1900125 - RNA, 14 nt, Shigella flexneri 2a str. 2457T
gcacccagcaaucc

SEQ ID NO: 1900126 - RNA, 13 nt, Shigella flexneri 2a str. 2457T
gcaccagcaacgc

SEQ ID NO: 1900127 - RNA, 17 nt, Shigella flexneri 2a str. 2457T
gcaccaggcaguuuauc

SEQ ID NO: 1900128 - RNA, 18 nt, Shigella flexneri 2a str. 2457T
gcaccgcacagaccauca

SEQ ID NO: 1900129 - RNA, 22 nt, Shigella flexneri 2a str. 2457T
gcaccagcaacaagccagucca

SEQ ID NO: 1900130 - RNA, 21 nt, Shigella flexneri 2a str. 2457T
gcaccacgacaccuuucacgc

SEQ ID NO: 1900131 - RNA, 19 nt, Shigella flexneri 2a str. 2457T
gcaccacauucugcaucgc

SEQ ID NO: 1900132 - RNA, 20 nt, Shigella flexneri 2a str. 2457T
gcacauugauggcgcuuucg

SEQ ID NO: 1900133 - RNA, 22 nt, Shigella flexneri 2a str. 2457T
gcacaguuauaaaaugauacgc

SEQ ID NO: 1900134 - RNA, 20 nt, Shigella flexneri 2a str. 2457T
gcacauuucccggccacgca

SEQ ID NO: 1900135 - RNA, 14 nt, Shigella flexneri 2a str. 2457T
gcaccaaucaccgc

SEQ ID NO: 1900136 - RNA, 15 nt, Shigella flexneri 2a str. 2457T
gcaccaccagcagcu

SEQ ID NO: 1900137 - RNA, 18 nt, Shigella flexneri 2a str. 2457T
gcaccacauucugcaucg

SEQ ID NO: 1900138 - RNA, 14 nt, Shigella flexneri 2a str. 2457T
gcacacgacauccg

SEQ ID NO: 1900139 - RNA, 13 nt, Shigella flexneri 2a str. 2457T
gcaacauaccgga

SEQ ID NO: 1900140 - RNA, 22 nt, Shigella flexneri 2a str. 2457T
gcaauuggugcacgaugccuga

SEQ ID NO: 1900141 - RNA, 19 nt, Shigella flexneri 2a str. 2457T
gcaauuuuuaccggucagg

SEQ ID NO: 1900142 - RNA, 18 nt, Shigella flexneri 2a str. 2457T
gcaauucuuucucgcuca

SEQ ID NO: 1900143 - RNA, 19 nt, Shigella flexneri 2a str. 2457T
gcaauuggucgcgcaaauu

SEQ ID NO: 1900144 - RNA, 20 nt, Shigella flexneri 2a str. 2457T
gcacaaacauccaucugcuu

SEQ ID NO: 1900145 - RNA, 14 nt, Shigella flexneri 2a str. 2457T
gcacaaaaucacgu

SEQ ID NO: 1900146 - RNA, 12 nt, Shigella flexneri 2a str. 2457T
gcacaaucacgu

SEQ ID NO: 1900147 - RNA, 15 nt, Shigella flexneri 2a str. 2457T
gcacaaucacgucag

SEQ ID NO: 1900148 - RNA, 18 nt, Shigella flexneri 2a str. 2457T
gcaauuuucgccaucuca

SEQ ID NO: 1900149 - RNA, 23 nt, Shigella flexneri 2a str. 2457T
gcacacagggcgcuagccaacuu

SEQ ID NO: 1900150 - RNA, 15 nt, Shigella flexneri 2a str. 2457T
gcacaccaaccgcuu

SEQ ID NO: 1900151 - RNA, 20 nt, Shigella flexneri 2a str. 2457T
aagauggcauacaacgccau

SEQ ID NO: 1900152 - RNA, 15 nt, Shigella flexneri 2a str. 2457T
aagaugcgccagcau

SEQ ID NO: 1900153 - RNA, 21 nt, Shigella flexneri 2a str. 2457T
aagaugcgucagcaucgcauc

SEQ ID NO: 1900154 - RNA, 12 nt, Shigella flexneri 2a str. 2457T
aagauuacugac

SEQ ID NO: 1900155 - RNA, 14 nt, Shigella flexneri 2a str. 2457T
aagauugccugaug

SEQ ID NO: 1900156 - RNA, 20 nt, Shigella flexneri 2a str. 2457T
gccgaggugcucuccacgcu

SEQ ID NO: 1900157 - RNA, 17 nt, Shigella flexneri 2a str. 2457T
gccgaugccagaaagcg

SEQ ID NO: 1900158 - RNA, 18 nt, Shigella flexneri 2a str. 2457T
gccgcacuuacagcaacg

SEQ ID NO: 1900159 - RNA, 19 nt, Shigella flexneri 2a str. 2457T
gccgcauccgacacuggca

SEQ ID NO: 1900160 - RNA, 12 nt, Shigella flexneri 2a str. 2457T
gccgcauccggc

SEQ ID NO: 1900161 - RNA, 17 nt, Shigella flexneri 2a str. 2457T
gccgauggcgcagacuu

SEQ ID NO: 1900162 - RNA, 14 nt, Shigella flexneri 2a str. 2457T
gccgauguugcaug

SEQ ID NO: 1900163 - RNA, 19 nt, Shigella flexneri 2a str. 2457T
aagcacgauuuguaggccg

SEQ ID NO: 1900164 - RNA, 17 nt, Shigella flexneri 2a str. 2457T
aagcaaaaacgcauacg

SEQ ID NO: 1900165 - RNA, 15 nt, Shigella flexneri 2a str. 2457T
gcccucgaucggcuc

SEQ ID NO: 1900166 - RNA, 20 nt, Shigella flexneri 2a str. 2457T
aagauauuucaccagcgcac

SEQ ID NO: 1900167 - RNA, 12 nt, Shigella flexneri 2a str. 2457T
gccgacauggca

SEQ ID NO: 1900168 - RNA, 13 nt, Shigella flexneri 2a str. 2457T
gccgaccgcuuca

SEQ ID NO: 1900169 - RNA, 22 nt, Shigella flexneri 2a str. 2457T
gccgaaaaaggaucaaccgaag

SEQ ID NO: 1900170 - RNA, 18 nt, Shigella flexneri 2a str. 2457T
gccgccuuuuacgcauuc

SEQ ID NO: 1900171 - RNA, 19 nt, Shigella flexneri 2a str. 2457T
gccgcgccaaugccugaug

SEQ ID NO: 1900172 - RNA, 21 nt, Shigella flexneri 2a str. 2457T
gccgcgcaaauccacguucca

SEQ ID NO: 1900173 - RNA, 17 nt, Shigella flexneri 2a str. 2457T
gccgcgaucucgucagc

SEQ ID NO: 1900174 - RNA, 24 nt, Shigella flexneri 2a str. 2457T
gccgccagacguccggcgcugcaa

SEQ ID NO: 1900175 - RNA, 21 nt, Shigella flexneri 2a str. 2457T
gccgccagacaauugccgcca

SEQ ID NO: 1900176 - RNA, 21 nt, Shigella flexneri 2a str. 2457T
gccgccacgcgugagcggaca

SEQ ID NO: 1900177 - RNA, 13 nt, Shigella flexneri 2a str. 2457T
gccgccgcuuucg

SEQ ID NO: 1900178 - RNA, 14 nt, Shigella flexneri 2a str. 2457T
gccgcguaccgcag

SEQ ID NO: 1900179 - RNA, 19 nt, Shigella flexneri 2a str. 2457T
gccgcuaucgcugauauac

SEQ ID NO: 1900180 - RNA, 15 nt, Shigella flexneri 2a str. 2457T
gccgcuaccagcgcg

SEQ ID NO: 1900181 - RNA, 16 nt, Shigella flexneri 2a str. 2457T
gccgcuaacagcagca

SEQ ID NO: 1900182 - RNA, 15 nt, Shigella flexneri 2a str. 2457T
gccgcuaaaaaaggu

SEQ ID NO: 1900183 - RNA, 21 nt, Shigella flexneri 2a str. 2457T
gccccucuaacucuucugaaa

SEQ ID NO: 1900184 - RNA, 19 nt, Shigella flexneri 2a str. 2457T
gccccugaauaaucguaau

SEQ ID NO: 1900185 - RNA, 16 nt, Shigella flexneri 2a str. 2457T
gcccgauagaaaccau

SEQ ID NO: 1900186 - RNA, 20 nt, Shigella flexneri 2a str. 2457T
gcccgaugacuggccggaag

SEQ ID NO: 1900187 - RNA, 22 nt, Shigella flexneri 2a str. 2457T
gcccgcgggcgaauuaucggca

SEQ ID NO: 1900188 - RNA, 13 nt, Shigella flexneri 2a str. 2457T
gcccgcgcguuaa

SEQ ID NO: 1900189 - RNA, 14 nt, Shigella flexneri 2a str. 2457T
aagacgccguccau

SEQ ID NO: 1900190 - RNA, 21 nt, Shigella flexneri 2a str. 2457T
aagacgcgacaagcgucgcau

SEQ ID NO: 1900191 - RNA, 21 nt, Shigella flexneri 2a str. 2457T
aagacgcgaccggcgucgcau

SEQ ID NO: 1900192 - RNA, 20 nt, Shigella flexneri 2a str. 2457T
aagacgcgccagcgucgcau

SEQ ID NO: 1900193 - RNA, 23 nt, Shigella flexneri 2a str. 2457T
gccccaaugcguuccagcauguu

SEQ ID NO: 1900194 - RNA, 13 nt, Shigella flexneri 2a str. 2457T
gcccagcgcagga

SEQ ID NO: 1900195 - RNA, 14 nt, Shigella flexneri 2a str. 2457T
gcccagccgugaau

SEQ ID NO: 1900196 - RNA, 21 nt, Shigella flexneri 2a str. 2457T
gcccagcgucuaaucgcuuua

SEQ ID NO: 1900197 - RNA, 13 nt, Shigella flexneri 2a str. 2457T
gcccagcgcuuca

SEQ ID NO: 1900198 - RNA, 18 nt, Shigella flexneri 2a str. 2457T
gcccaccugcggcaccua

SEQ ID NO: 1900199 - RNA, 18 nt, Shigella flexneri 2a str. 2457T
gcccacgccgcccagaga

SEQ ID NO: 1900200 - RNA, 17 nt, Shigella flexneri 2a str. 2457T
gcccacuccagcuaucg

SEQ ID NO: 1900201 - RNA, 22 nt, Shigella flexneri 2a str. 2457T
gcccagaaaccaguuuuuacgc

SEQ ID NO: 1900202 - RNA, 13 nt, Shigella flexneri 2a str. 2457T
gccauuuaacgca

SEQ ID NO: 1900203 - RNA, 23 nt, Shigella flexneri 2a str. 2457T
gccauugcccgaugcgcaaacuu

SEQ ID NO: 1900204 - RNA, 15 nt, Shigella flexneri 2a str. 2457T
gccauuaccaccgga

SEQ ID NO: 1900205 - RNA, 19 nt, Shigella flexneri 2a str. 2457T
aagaauuucaucgccggua

SEQ ID NO: 1900206 - RNA, 18 nt, Shigella flexneri 2a str. 2457T
gccaugcgugaacguggg

SEQ ID NO: 1900207 - RNA, 22 nt, Shigella flexneri 2a str. 2457T
gcccaccauguucacugccgua

SEQ ID NO: 1900208 - RNA, 22 nt, Shigella flexneri 2a str. 2457T
gcccaacuaaaugcugcagcca

SEQ ID NO: 1900209 - RNA, 19 nt, Shigella flexneri 2a str. 2457T
gcccaaucaucgcggcaca

SEQ ID NO: 1900210 - RNA, 18 nt, Shigella flexneri 2a str. 2457T
gccaccggcaaucugcug

SEQ ID NO: 1900211 - RNA, 20 nt, Shigella flexneri 2a str. 2457T
gccacgcuucaaucugauau

SEQ ID NO: 1900212 - RNA, 18 nt, Shigella flexneri 2a str. 2457T
gccacgcuucaaucugau

SEQ ID NO: 1900213 - RNA, 18 nt, Shigella flexneri 2a str. 2457T
gccacuccacuggagacg

SEQ ID NO: 1900214 - RNA, 13 nt, Shigella flexneri 2a str. 2457T
gccaccccacgau

SEQ ID NO: 1900215 - RNA, 22 nt, Shigella flexneri 2a str. 2457T
gccaccacaccggaccagacga

SEQ ID NO: 1900216 - RNA, 14 nt, Shigella flexneri 2a str. 2457T
gccacaaacgccgu

SEQ ID NO: 1900217 - RNA, 15 nt, Shigella flexneri 2a str. 2457T
gccaacuugcccagg

SEQ ID NO: 1900218 - RNA, 16 nt, Shigella flexneri 2a str. 2457T
gccaacuuugccguga

SEQ ID NO: 1900219 - RNA, 18 nt, Shigella flexneri 2a str. 2457T
gccagcuucgaggccgga

SEQ ID NO: 1900220 - RNA, 16 nt, Shigella flexneri 2a str. 2457T
gccagcgugucgagca

SEQ ID NO: 1900221 - RNA, 15 nt, Shigella flexneri 2a str. 2457T
gccaguaauccggcu

SEQ ID NO: 1900222 - RNA, 12 nt, Shigella flexneri 2a str. 2457T
gccaguaagcag

SEQ ID NO: 1900223 - RNA, 16 nt, Shigella flexneri 2a str. 2457T
gccaguaagcagucca

SEQ ID NO: 1900224 - RNA, 16 nt, Shigella flexneri 2a str. 2457T
gccaggcuuaccgcca

SEQ ID NO: 1900225 - RNA, 22 nt, Shigella flexneri 2a str. 2457T
gccagcauucccgccagcggcc

SEQ ID NO: 1900226 - RNA, 19 nt, Shigella flexneri 2a str. 2457T
gccagcggcuccccgcuau

SEQ ID NO: 1900227 - RNA, 19 nt, Shigella flexneri 2a str. 2457T
gccagcggcguucgcguaa

SEQ ID NO: 1900228 - RNA, 17 nt, Shigella flexneri 2a str. 2457T
gccagcacggcgcugac

SEQ ID NO: 1900229 - RNA, 14 nt, Shigella flexneri 2a str. 2457T
gccacuuucacgcc

SEQ ID NO: 1900230 - RNA, 19 nt, Shigella flexneri 2a str. 2457T
gccagcaucggcagcgcca

SEQ ID NO: 1900231 - RNA, 23 nt, Shigella flexneri 2a str. 2457T
gccagcaucucaaucgcacccgc

SEQ ID NO: 1900232 - RNA, 14 nt, Shigella flexneri 2a str. 2457T
acugcgccgcucag

SEQ ID NO: 1900233 - RNA, 12 nt, Shigella flexneri 2a str. 2457T
acugcgccgcuc

SEQ ID NO: 1900234 - RNA, 19 nt, Shigella flexneri 2a str. 2457T
acugccggaugcaucgcau

SEQ ID NO: 1900235 - RNA, 13 nt, Shigella flexneri 2a str. 2457T
acugcgggauuuc

SEQ ID NO: 1900236 - RNA, 20 nt, Shigella flexneri 2a str. 2457T
acuguuucaccauuugugca

SEQ ID NO: 1900237 - RNA, 20 nt, Shigella flexneri 2a str. 2457T
acuuaacuguaaaucgccau

SEQ ID NO: 1900238 - RNA, 12 nt, Shigella flexneri 2a str. 2457T
acuuaauggucu

SEQ ID NO: 1900239 - RNA, 13 nt, Shigella flexneri 2a str. 2457T
acuguggcaucgg

SEQ ID NO: 1900240 - RNA, 13 nt, Shigella flexneri 2a str. 2457T
acugaauugugau

SEQ ID NO: 1900241 - RNA, 15 nt, Shigella flexneri 2a str. 2457T
acugaccacaaaggc

SEQ ID NO: 1900242 - RNA, 18 nt, Shigella flexneri 2a str. 2457T
acugacugacgugaugau

SEQ ID NO: 1900243 - RNA, 23 nt, Shigella flexneri 2a str. 2457T
acugauaguguuuuauguucaga

SEQ ID NO: 1900244 - RNA, 14 nt, Shigella flexneri 2a str. 2457T
acugaaggcgcauu

SEQ ID NO: 1900245 - RNA, 14 nt, Shigella flexneri 2a str. 2457T
acuauccgccgcuu

SEQ ID NO: 1900246 - RNA, 15 nt, Shigella flexneri 2a str. 2457T
acugcaaaucaccac

SEQ ID NO: 1900247 - RNA, 14 nt, Shigella flexneri 2a str. 2457T
acugcaaaucacca

SEQ ID NO: 1900248 - RNA, 20 nt, Shigella flexneri 2a str. 2457T
acugcaucagcgccuuacca

SEQ ID NO: 1900249 - RNA, 22 nt, Shigella flexneri 2a str. 2457T
acugcaucagcgccuuaccaau

SEQ ID NO: 1900250 - RNA, 18 nt, Shigella flexneri 2a str. 2457T
agaaugccugugcgacag

SEQ ID NO: 1900251 - RNA, 18 nt, Shigella flexneri 2a str. 2457T
agaauuucaucgccggua

SEQ ID NO: 1900252 - RNA, 17 nt, Shigella flexneri 2a str. 2457T
agaauuuguaggccgga

SEQ ID NO: 1900253 - RNA, 14 nt, Shigella flexneri 2a str. 2457T
agaaucacgccaac

SEQ ID NO: 1900254 - RNA, 15 nt, Shigella flexneri 2a str. 2457T
agaaggcgcugacgu

SEQ ID NO: 1900255 - RNA, 13 nt, Shigella flexneri 2a str. 2457T
agaagguugccau

SEQ ID NO: 1900256 - RNA, 19 nt, Shigella flexneri 2a str. 2457T
agaauaguuugauuaacgc

SEQ ID NO: 1900257 - RNA, 13 nt, Shigella flexneri 2a str. 2457T
agaaccacaauga

SEQ ID NO: 1900258 - RNA, 13 nt, Shigella flexneri 2a str. 2457T
agaaccucaacag

SEQ ID NO: 1900259 - RNA, 15 nt, Shigella flexneri 2a str. 2457T
agaaccugaacgccg

SEQ ID NO: 1900260 - RNA, 20 nt, Shigella flexneri 2a str. 2457T
agaagaaagcaaugaaauuc

SEQ ID NO: 1900261 - RNA, 15 nt, Shigella flexneri 2a str. 2457T
agaacuucugcaacg

SEQ ID NO: 1900262 - RNA, 21 nt, Shigella flexneri 2a str. 2457T
agaagcaugaacauugcugcu

SEQ ID NO: 1900263 - RNA, 23 nt, Shigella flexneri 2a str. 2457T
agaagauaccgaacauaccaccg

SEQ ID NO: 1900264 - RNA, 12 nt, Shigella flexneri 2a str. 2457T
agaagcuuaccg

SEQ ID NO: 1900265 - RNA, 13 nt, Shigella flexneri 2a str. 2457T
agaaacucaguug

SEQ ID NO: 1900266 - RNA, 24 nt, Shigella flexneri 2a str. 2457T
agaaagcugcugaccaccagcacg

SEQ ID NO: 1900267 - RNA, 13 nt, Shigella flexneri 2a str. 2457T
agaaaccgcuauu

SEQ ID NO: 1900268 - RNA, 21 nt, Shigella flexneri 2a str. 2457T
acuuugcaguuccugccagau

SEQ ID NO: 1900269 - RNA, 16 nt, Shigella flexneri 2a str. 2457T
acuuccaccagcggcu

SEQ ID NO: 1900270 - RNA, 20 nt, Shigella flexneri 2a str. 2457T
acuuccggacguucagccau

SEQ ID NO: 1900271 - RNA, 16 nt, Shigella flexneri 2a str. 2457T
acuuuuggaccacgga

SEQ ID NO: 1900272 - RNA, 16 nt, Shigella flexneri 2a str. 2457T
agauauuucaccagcg

SEQ ID NO: 1900273 - RNA, 17 nt, Shigella flexneri 2a str. 2457T
agauagcggcugacggu

SEQ ID NO: 1900274 - RNA, 14 nt, Shigella flexneri 2a str. 2457T
agauacggcgcauc

SEQ ID NO: 1900275 - RNA, 20 nt, Shigella flexneri 2a str. 2457T
agauacgauguuguagcauc

SEQ ID NO: 1900276 - RNA, 20 nt, Shigella flexneri 2a str. 2457T
agauacugcauucccaucgc

SEQ ID NO: 1900277 - RNA, 21 nt, Shigella flexneri 2a str. 2457T
agauaauugaagguuuaauac

SEQ ID NO: 1900278 - RNA, 18 nt, Shigella flexneri 2a str. 2457T
agauaauagauuugcgaa

SEQ ID NO: 1900279 - RNA, 17 nt, Shigella flexneri 2a str. 2457T
agauccagcaccuuuug

SEQ ID NO: 1900280 - RNA, 23 nt, Shigella flexneri 2a str. 2457T
agauccauaagguccuccagcuc

SEQ ID NO: 1900281 - RNA, 12 nt, Shigella flexneri 2a str. 2457T
agauccgccauu

SEQ ID NO: 1900282 - RNA, 13 nt, Shigella flexneri 2a str. 2457T
agaggaaucgcug

SEQ ID NO: 1900283 - RNA, 16 nt, Shigella flexneri 2a str. 2457T
agagcuugugcaccag

SEQ ID NO: 1900284 - RNA, 14 nt, Shigella flexneri 2a str. 2457T
agauaaaucacgcu

SEQ ID NO: 1900285 - RNA, 23 nt, Shigella flexneri 2a str. 2457T
agaguucugcgcaucggcgucgu

SEQ ID NO: 1900286 - RNA, 14 nt, Shigella flexneri 2a str. 2457T
agaguugagcaguc

SEQ ID NO: 1900287 - RNA, 21 nt, Shigella flexneri 2a str. 2457T
agagugaggggggauguuggc

SEQ ID NO: 1900288 - RNA, 20 nt, Shigella flexneri 2a str. 2457T
agagugguuagagcacagau

SEQ ID NO: 1900289 - RNA, 16 nt, Shigella flexneri 2a str. 2457T
agaucuaugucgcauc

SEQ ID NO: 1900290 - RNA, 16 nt, Shigella flexneri 2a str. 2457T
agaucgcgcaucagcu

SEQ ID NO: 1900291 - RNA, 15 nt, Shigella flexneri 2a str. 2457T
agauguuccgccauu

SEQ ID NO: 1900292 - RNA, 16 nt, Shigella flexneri 2a str. 2457T
agauguccccugcggu

SEQ ID NO: 1900293 - RNA, 21 nt, Shigella flexneri 2a str. 2457T
agauguacgccagugcucccg

SEQ ID NO: 1900294 - RNA, 20 nt, Shigella flexneri 2a str. 2457T
agaugcgccagcaucgcauc

SEQ ID NO: 1900295 - RNA, 19 nt, Shigella flexneri 2a str. 2457T
agaugcggcgugaacgccu

SEQ ID NO: 1900296 - RNA, 12 nt, Shigella flexneri 2a str. 2457T
agaugccggaug

SEQ ID NO: 1900297 - RNA, 13 nt, Shigella flexneri 2a str. 2457T
agaugcagcggua

SEQ ID NO: 1900298 - RNA, 15 nt, Shigella flexneri 2a str. 2457T
agacuuaauccgggc

SEQ ID NO: 1900299 - RNA, 21 nt, Shigella flexneri 2a str. 2457T
agacuuuuugcggcagcaaug

SEQ ID NO: 1900300 - RNA, 13 nt, Shigella flexneri 2a str. 2457T
agacuuugcugcc

SEQ ID NO: 1900301 - RNA, 14 nt, Shigella flexneri 2a str. 2457T
agacugggcaagau

SEQ ID NO: 1900302 - RNA, 20 nt, Shigella flexneri 2a str. 2457T
agacuuaauccgggcaugau

SEQ ID NO: 1900303 - RNA, 14 nt, Shigella flexneri 2a str. 2457T
agagcaaucaccag

SEQ ID NO: 1900304 - RNA, 15 nt, Shigella flexneri 2a str. 2457T
agagcaaugcgcauc

SEQ ID NO: 1900305 - RNA, 20 nt, Shigella flexneri 2a str. 2457T
agacggcgcaacauccgcuu

SEQ ID NO: 1900306 - RNA, 15 nt, Shigella flexneri 2a str. 2457T
agacgguacccgcug

SEQ ID NO: 1900307 - RNA, 19 nt, Shigella flexneri 2a str. 2457T
agacgcgcagcgucgcauc

SEQ ID NO: 1900308 - RNA, 21 nt, Shigella flexneri 2a str. 2457T
agacgcgaccagcgucgcauc

SEQ ID NO: 1900309 - RNA, 17 nt, Shigella flexneri 2a str. 2457T
agacgcguuagcaucgc

SEQ ID NO: 1900310 - RNA, 20 nt, Shigella flexneri 2a str. 2457T
agacgcgucagcgucgcauc

SEQ ID NO: 1900311 - RNA, 21 nt, Shigella flexneri 2a str. 2457T
agacgcguaaagcgucgcauc

SEQ ID NO: 1900312 - RNA, 21 nt, Shigella flexneri 2a str. 2457T
agacccggcggcgcgccaggc

SEQ ID NO: 1900313 - RNA, 17 nt, Shigella flexneri 2a str. 2457T
agaccaaucccgccaua

SEQ ID NO: 1900314 - RNA, 14 nt, Shigella flexneri 2a str. 2457T
agaccaauccagcc

SEQ ID NO: 1900315 - RNA, 20 nt, Shigella flexneri 2a str. 2457T
agacacuuuaucuaucagga

SEQ ID NO: 1900316 - RNA, 16 nt, Shigella flexneri 2a str. 2457T
agacacugacgcgucu

SEQ ID NO: 1900317 - RNA, 14 nt, Shigella flexneri 2a str. 2457T
agaccaaucaccac

SEQ ID NO: 1900318 - RNA, 17 nt, Shigella flexneri 2a str. 2457T
agacaacaacaucagcg

SEQ ID NO: 1900319 - RNA, 13 nt, Shigella flexneri 2a str. 2457T
agacaaucgccag

SEQ ID NO: 1900320 - RNA, 21 nt, Shigella flexneri 2a str. 2457T
agacaauugccgccagcucac

SEQ ID NO: 1900321 - RNA, 20 nt, Shigella flexneri 2a str. 2457T
agaccgcaucacgacagcac

SEQ ID NO: 1900322 - RNA, 13 nt, Shigella flexneri 2a str. 2457T
acggcacgauaaa

SEQ ID NO: 1900323 - RNA, 21 nt, Shigella flexneri 2a str. 2457T
acggcagaaguaguugcuguc

SEQ ID NO: 1900324 - RNA, 22 nt, Shigella flexneri 2a str. 2457T
acggcaccacauucugcaucgc

SEQ ID NO: 1900325 - RNA, 11 nt, Shigella flexneri 2a str. 2457T
acggcaagauc

SEQ ID NO: 1900326 - RNA, 13 nt, Shigella flexneri 2a str. 2457T
acggcaucgccau

SEQ ID NO: 1900327 - RNA, 22 nt, Shigella flexneri 2a str. 2457T
acggcauuuccgccaaucaaga

SEQ ID NO: 1900328 - RNA, 19 nt, Shigella flexneri 2a str. 2457T
acgcuuaucaggccuacaa

SEQ ID NO: 1900329 - RNA, 14 nt, Shigella flexneri 2a str. 2457T
acgcuuaucaggcc

SEQ ID NO: 1900330 - RNA, 15 nt, Shigella flexneri 2a str. 2457T
acgcuguaauuacca

SEQ ID NO: 1900331 - RNA, 13 nt, Shigella flexneri 2a str. 2457T
acgcuggcccagu

SEQ ID NO: 1900332 - RNA, 22 nt, Shigella flexneri 2a str. 2457T
acgcuguccggcgcacuggugc

SEQ ID NO: 1900333 - RNA, 20 nt, Shigella flexneri 2a str. 2457T
acgcugucggcaagauacug

SEQ ID NO: 1900334 - RNA, 17 nt, Shigella flexneri 2a str. 2457T
acgcugcacaauugcca

SEQ ID NO: 1900335 - RNA, 23 nt, Shigella flexneri 2a str. 2457T
acgcugcugccggcacaggcauc

SEQ ID NO: 1900336 - RNA, 17 nt, Shigella flexneri 2a str. 2457T
acgcuucucccagccgc

SEQ ID NO: 1900337 - RNA, 21 nt, Shigella flexneri 2a str. 2457T
acgcuuucacccggcgcuaau

SEQ ID NO: 1900338 - RNA, 20 nt, Shigella flexneri 2a str. 2457T
acgcuuuacguuccuggcuu

SEQ ID NO: 1900339 - RNA, 13 nt, Shigella flexneri 2a str. 2457T
acggaacguugcc

SEQ ID NO: 1900340 - RNA, 20 nt, Shigella flexneri 2a str. 2457T
acggagauauccagcgccga

SEQ ID NO: 1900341 - RNA, 14 nt, Shigella flexneri 2a str. 2457T
acgcgcagcguuca

SEQ ID NO: 1900342 - RNA, 14 nt, Shigella flexneri 2a str. 2457T
acgcgcauggccgu

SEQ ID NO: 1900343 - RNA, 21 nt, Shigella flexneri 2a str. 2457T
acgcgaccagcgucgcaucag

SEQ ID NO: 1900344 - RNA, 13 nt, Shigella flexneri 2a str. 2457T
acgcgaccggcgu

SEQ ID NO: 1900345 - RNA, 20 nt, Shigella flexneri 2a str. 2457T
acgcgaccaucgcggaucag

SEQ ID NO: 1900346 - RNA, 19 nt, Shigella flexneri 2a str. 2457T
acgcgaccggcgucgcauc

SEQ ID NO: 1900347 - RNA, 17 nt, Shigella flexneri 2a str. 2457T
acgcgauuucucaucaa

SEQ ID NO: 1900348 - RNA, 16 nt, Shigella flexneri 2a str. 2457T
acgccuuuuuucacua

SEQ ID NO: 1900349 - RNA, 22 nt, Shigella flexneri 2a str. 2457T
aaacacgacaugacccggcgua

SEQ ID NO: 1900350 - RNA, 21 nt, Shigella flexneri 2a str. 2457T
acgcgacaagcgucgcaucag

SEQ ID NO: 1900351 - RNA, 21 nt, Shigella flexneri 2a str. 2457T
acgcgaauaguuuccgcuucu

SEQ ID NO: 1900352 - RNA, 16 nt, Shigella flexneri 2a str. 2457T
aaacaggcagcugcca

SEQ ID NO: 1900353 - RNA, 18 nt, Shigella flexneri 2a str. 2457T
aaacagcagggccugaag

SEQ ID NO: 1900354 - RNA, 18 nt, Shigella flexneri 2a str. 2457T
acgcggcuguugccggau

SEQ ID NO: 1900355 - RNA, 14 nt, Shigella flexneri 2a str. 2457T
acgcgggcagcaga

SEQ ID NO: 1900356 - RNA, 18 nt, Shigella flexneri 2a str. 2457T
acgcgggcaaucggcugc

SEQ ID NO: 1900357 - RNA, 11 nt, Shigella flexneri 2a str. 2457T
acgcucggcaa

SEQ ID NO: 1900358 - RNA, 14 nt, Shigella flexneri 2a str. 2457T
acgcucaguauggu

SEQ ID NO: 1900359 - RNA, 20 nt, Shigella flexneri 2a str. 2457T
acgcgguuaucccaaaucgc

SEQ ID NO: 1900360 - RNA, 14 nt, Shigella flexneri 2a str. 2457T
acgcucaucaggcc

SEQ ID NO: 1900361 - RNA, 19 nt, Shigella flexneri 2a str. 2457T
acgcucaucaggccuacaa

SEQ ID NO: 1900362 - RNA, 13 nt, Shigella flexneri 2a str. 2457T
acgucuccaucaa

SEQ ID NO: 1900363 - RNA, 13 nt, Shigella flexneri 2a str. 2457T
acgugcagcaucg

SEQ ID NO: 1900364 - RNA, 17 nt, Shigella flexneri 2a str. 2457T
acgugauuuagcaccga

SEQ ID NO: 1900365 - RNA, 23 nt, Shigella flexneri 2a str. 2457T
acgucgcgcgauguuuggcggau

SEQ ID NO: 1900366 - RNA, 14 nt, Shigella flexneri 2a str. 2457T
acguaggccugaua

SEQ ID NO: 1900367 - RNA, 19 nt, Shigella flexneri 2a str. 2457T
acguuuuaaaccuacgugc

SEQ ID NO: 1900368 - RNA, 23 nt, Shigella flexneri 2a str. 2457T
acguuguuccggcgcaauucccg

SEQ ID NO: 1900369 - RNA, 19 nt, Shigella flexneri 2a str. 2457T
acguuucaccagcacuucu

SEQ ID NO: 1900370 - RNA, 17 nt, Shigella flexneri 2a str. 2457T
acguuucacugccggac

SEQ ID NO: 1900371 - RNA, 15 nt, Shigella flexneri 2a str. 2457T
acguucaugccgguc

SEQ ID NO: 1900372 - RNA, 18 nt, Shigella flexneri 2a str. 2457T
acguugucagcaaccugc

SEQ ID NO: 1900373 - RNA, 13 nt, Shigella flexneri 2a str. 2457T
acguucagcaucu

SEQ ID NO: 1900374 - RNA, 12 nt, Shigella flexneri 2a str. 2457T
acguuagcacga

SEQ ID NO: 1900375 - RNA, 24 nt, Shigella flexneri 2a str. 2457T
acguuauucgcuuccucaaccacu

SEQ ID NO: 1900376 - RNA, 22 nt, Shigella flexneri 2a str. 2457T
acguuaauaaaauuuacaguau

SEQ ID NO: 1900377 - RNA, 15 nt, Shigella flexneri 2a str. 2457T
acguuaacagccuuc

SEQ ID NO: 1900378 - RNA, 15 nt, Shigella flexneri 2a str. 2457T
acuacacuaaacguc

SEQ ID NO: 1900379 - RNA, 20 nt, Shigella flexneri 2a str. 2457T
acuacagaggaaucgcuguu

SEQ ID NO: 1900380 - RNA, 17 nt, Shigella flexneri 2a str. 2457T
acuaaauacauuaguaa

SEQ ID NO: 1900381 - RNA, 16 nt, Shigella flexneri 2a str. 2457T
acuaacggaauugcca

SEQ ID NO: 1900382 - RNA, 17 nt, Shigella flexneri 2a str. 2457T
acuacgggcaccaguaa

SEQ ID NO: 1900383 - RNA, 20 nt, Shigella flexneri 2a str. 2457T
acggcggaaagggccgcagu

SEQ ID NO: 1900384 - RNA, 14 nt, Shigella flexneri 2a str. 2457T
acggcgucaacacc

SEQ ID NO: 1900385 - RNA, 14 nt, Shigella flexneri 2a str. 2457T
acggcguauugcau

SEQ ID NO: 1900386 - RNA, 16 nt, Shigella flexneri 2a str. 2457T
acgguugaugccguuc

SEQ ID NO: 1900387 - RNA, 19 nt, Shigella flexneri 2a str. 2457T
acgguguuaguaaacgcgu

SEQ ID NO: 1900388 - RNA, 23 nt, Shigella flexneri 2a str. 2457T
acgguccgguugcagaguaucca

SEQ ID NO: 1900389 - RNA, 21 nt, Shigella flexneri 2a str. 2457T
acggugaaaaucaaucugcug

SEQ ID NO: 1900390 - RNA, 23 nt, Shigella flexneri 2a str. 2457T
acgguaaggacauuauucagcga

SEQ ID NO: 1900391 - RNA, 16 nt, Shigella flexneri 2a str. 2457T
acgguaauaaaugccg

SEQ ID NO: 1900392 - RNA, 19 nt, Shigella flexneri 2a str. 2457T
acgggugagggcguagaga

SEQ ID NO: 1900393 - RNA, 15 nt, Shigella flexneri 2a str. 2457T
acccgcgacgcgcuu

SEQ ID NO: 1900394 - RNA, 14 nt, Shigella flexneri 2a str. 2457T
acccagcgcgauac

SEQ ID NO: 1900395 - RNA, 12 nt, Shigella flexneri 2a str. 2457T
acccaucgccag

SEQ ID NO: 1900396 - RNA, 15 nt, Shigella flexneri 2a str. 2457T
accauugcugccgcc

SEQ ID NO: 1900397 - RNA, 14 nt, Shigella flexneri 2a str. 2457T
accauuaucaccaa

SEQ ID NO: 1900398 - RNA, 19 nt, Shigella flexneri 2a str. 2457T
acccauuuauccagcggca

SEQ ID NO: 1900399 - RNA, 19 nt, Shigella flexneri 2a str. 2457T
accauacggucugccaguc

SEQ ID NO: 1900400 - RNA, 15 nt, Shigella flexneri 2a str. 2457T
accauaaauuucacg

SEQ ID NO: 1900401 - RNA, 14 nt, Shigella flexneri 2a str. 2457T
aaaaucccggcaac

SEQ ID NO: 1900402 - RNA, 14 nt, Shigella flexneri 2a str. 2457T
accaguuacgugcu

SEQ ID NO: 1900403 - RNA, 14 nt, Shigella flexneri 2a str. 2457T
accaugacgccgaa

SEQ ID NO: 1900404 - RNA, 12 nt, Shigella flexneri 2a str. 2457T
accauccggcau

SEQ ID NO: 1900405 - RNA, 19 nt, Shigella flexneri 2a str. 2457T
accaucgauaccaucgcuu

SEQ ID NO: 1900406 - RNA, 23 nt, Shigella flexneri 2a str. 2457T
accaucaauggcugcaaagcauu

SEQ ID NO: 1900407 - RNA, 16 nt, Shigella flexneri 2a str. 2457T
accaucagcagcggca

SEQ ID NO: 1900408 - RNA, 17 nt, Shigella flexneri 2a str. 2457T
accaguccuacacacgc

SEQ ID NO: 1900409 - RNA, 15 nt, Shigella flexneri 2a str. 2457T
accaguaaagugcgc

SEQ ID NO: 1900410 - RNA, 23 nt, Shigella flexneri 2a str. 2457T
acaguaaagcgcaaaauaccagc

SEQ ID NO: 1900411 - RNA, 19 nt, Shigella flexneri 2a str. 2457T
acaguuucugcagcuccag

SEQ ID NO: 1900412 - RNA, 15 nt, Shigella flexneri 2a str. 2457T
acauaaagucuuucu

SEQ ID NO: 1900413 - RNA, 18 nt, Shigella flexneri 2a str. 2457T
acauaaggaaacuccagc

SEQ ID NO: 1900414 - RNA, 16 nt, Shigella flexneri 2a str. 2457T
acauaaugaugccguc

SEQ ID NO: 1900415 - RNA, 17 nt, Shigella flexneri 2a str. 2457T
accgauauucgccgcga

SEQ ID NO: 1900416 - RNA, 24 nt, Shigella flexneri 2a str. 2457T
accgaauucaaauccuucagacua

SEQ ID NO: 1900417 - RNA, 22 nt, Shigella flexneri 2a str. 2457T
accgaaguguuuaaauuucuug

SEQ ID NO: 1900418 - RNA, 23 nt, Shigella flexneri 2a str. 2457T
acccgcuugaguauuuaccagaa

SEQ ID NO: 1900419 - RNA, 14 nt, Shigella flexneri 2a str. 2457T
accgcaaucgccag

SEQ ID NO: 1900420 - RNA, 14 nt, Shigella flexneri 2a str. 2457T
accgcaccgcccgu

SEQ ID NO: 1900421 - RNA, 15 nt, Shigella flexneri 2a str. 2457T
accgcacgacgaauc

SEQ ID NO: 1900422 - RNA, 22 nt, Shigella flexneri 2a str. 2457T
accgauccccggauucaugcua

SEQ ID NO: 1900423 - RNA, 21 nt, Shigella flexneri 2a str. 2457T
accgauggcaaacaaacugcg

SEQ ID NO: 1900424 - RNA, 22 nt, Shigella flexneri 2a str. 2457T
accgcaucggcaucaaaccauu

SEQ ID NO: 1900425 - RNA, 13 nt, Shigella flexneri 2a str. 2457T
accgcagcccaga

SEQ ID NO: 1900426 - RNA, 20 nt, Shigella flexneri 2a str. 2457T
accgcccuccgguccgccgu

SEQ ID NO: 1900427 - RNA, 18 nt, Shigella flexneri 2a str. 2457T
accgcccugagcaucaau

SEQ ID NO: 1900428 - RNA, 20 nt, Shigella flexneri 2a str. 2457T
accgcgaguaaucacaucaa

SEQ ID NO: 1900429 - RNA, 22 nt, Shigella flexneri 2a str. 2457T
accgccugaaauacccgcucau

SEQ ID NO: 1900430 - RNA, 23 nt, Shigella flexneri 2a str. 2457T
accgcuguccacgccuuaugcca

SEQ ID NO: 1900431 - RNA, 19 nt, Shigella flexneri 2a str. 2457T
accggacgaucggaugauc

SEQ ID NO: 1900432 - RNA, 15 nt, Shigella flexneri 2a str. 2457T
accgcugacggcagc

SEQ ID NO: 1900433 - RNA, 16 nt, Shigella flexneri 2a str. 2457T
accgguagugccuguu

SEQ ID NO: 1900434 - RNA, 22 nt, Shigella flexneri 2a str. 2457T
accgucgggcuuuuggagauca

SEQ ID NO: 1900435 - RNA, 15 nt, Shigella flexneri 2a str. 2457T
accgucaucgacaaa

SEQ ID NO: 1900436 - RNA, 22 nt, Shigella flexneri 2a str. 2457T
accguaugaccggaaaagguga

SEQ ID NO: 1900437 - RNA, 20 nt, Shigella flexneri 2a str. 2457T
accucgcguaaagaguugau

SEQ ID NO: 1900438 - RNA, 23 nt, Shigella flexneri 2a str. 2457T
accuccuggaucacaauccgcuc

SEQ ID NO: 1900439 - RNA, 21 nt, Shigella flexneri 2a str. 2457T
accuaccaucuccugcaacga

SEQ ID NO: 1900440 - RNA, 21 nt, Shigella flexneri 2a str. 2457T
accguugguuaauuuuucaaa

SEQ ID NO: 1900441 - RNA, 12 nt, Shigella flexneri 2a str. 2457T
accguuuccuca

SEQ ID NO: 1900442 - RNA, 19 nt, Shigella flexneri 2a str. 2457T
accguuuacgucauuaccg

SEQ ID NO: 1900443 - RNA, 21 nt, Shigella flexneri 2a str. 2457T
accguuuacgucauuaccgcg

SEQ ID NO: 1900444 - RNA, 18 nt, Shigella flexneri 2a str. 2457T
accuccggcguuucagau

SEQ ID NO: 1900445 - RNA, 15 nt, Shigella flexneri 2a str. 2457T
accgugcaucuguug

SEQ ID NO: 1900446 - RNA, 18 nt, Shigella flexneri 2a str. 2457T
accguuaagaugguuacg

SEQ ID NO: 1900447 - RNA, 18 nt, Shigella flexneri 2a str. 2457T
accguucagcuugcgucc

SEQ ID NO: 1900448 - RNA, 12 nt, Shigella flexneri 2a str. 2457T
accguugccgcg

SEQ ID NO: 1900449 - RNA, 19 nt, Shigella flexneri 2a str. 2457T
accguugaggauggcgucg

SEQ ID NO: 1900450 - RNA, 23 nt, Shigella flexneri 2a str. 2457T
accugauuaccgugaaucaccac

SEQ ID NO: 1900451 - RNA, 23 nt, Shigella flexneri 2a str. 2457T
accugauuaaacgggucaucaaa

SEQ ID NO: 1900452 - RNA, 16 nt, Shigella flexneri 2a str. 2457T
accugauuacgcaccg

SEQ ID NO: 1900453 - RNA, 17 nt, Shigella flexneri 2a str. 2457T
accugcacgaaaccacu

SEQ ID NO: 1900454 - RNA, 23 nt, Shigella flexneri 2a str. 2457T
accugccagcgccgacagcagcc

SEQ ID NO: 1900455 - RNA, 15 nt, Shigella flexneri 2a str. 2457T
accuuuaaucaggcu

SEQ ID NO: 1900456 - RNA, 12 nt, Shigella flexneri 2a str. 2457T
acgaaccauuuc

SEQ ID NO: 1900457 - RNA, 23 nt, Shigella flexneri 2a str. 2457T
acgaacuaccgugcuguacagca

SEQ ID NO: 1900458 - RNA, 12 nt, Shigella flexneri 2a str. 2457T
acgaaauggugu

SEQ ID NO: 1900459 - RNA, 14 nt, Shigella flexneri 2a str. 2457T
accuuugccuucca

SEQ ID NO: 1900460 - RNA, 22 nt, Shigella flexneri 2a str. 2457T
accuuugccuuccagcgaugcc

SEQ ID NO: 1900461 - RNA, 22 nt, Shigella flexneri 2a str. 2457T
acgaccuguaccuucagcggca

SEQ ID NO: 1900462 - RNA, 18 nt, Shigella flexneri 2a str. 2457T
acgaccuccacucucgaa

SEQ ID NO: 1900463 - RNA, 13 nt, Shigella flexneri 2a str. 2457T
acgaccaucagcu

SEQ ID NO: 1900464 - RNA, 23 nt, Shigella flexneri 2a str. 2457T
acgacaccuuucacgccgaagug

SEQ ID NO: 1900465 - RNA, 20 nt, Shigella flexneri 2a str. 2457T
acgacaaucaaccagcacuu

SEQ ID NO: 1900466 - RNA, 16 nt, Shigella flexneri 2a str. 2457T
acgaaucugcaaucaa

SEQ ID NO: 1900467 - RNA, 19 nt, Shigella flexneri 2a str. 2457T
acgaauaguuucagccucu

SEQ ID NO: 1900468 - RNA, 16 nt, Shigella flexneri 2a str. 2457T
acgaaucgccgcauag

SEQ ID NO: 1900469 - RNA, 20 nt, Shigella flexneri 2a str. 2457T
acgcaauccccucuucagcc

SEQ ID NO: 1900470 - RNA, 15 nt, Shigella flexneri 2a str. 2457T
acgauguuugcugcg

SEQ ID NO: 1900471 - RNA, 21 nt, Shigella flexneri 2a str. 2457T
acgcacccguaacauggcggu

SEQ ID NO: 1900472 - RNA, 17 nt, Shigella flexneri 2a str. 2457T
acgcaccucagcaagug

SEQ ID NO: 1900473 - RNA, 16 nt, Shigella flexneri 2a str. 2457T
acgauguauccggcaa

SEQ ID NO: 1900474 - RNA, 14 nt, Shigella flexneri 2a str. 2457T
acgauagccagaag

SEQ ID NO: 1900475 - RNA, 18 nt, Shigella flexneri 2a str. 2457T
acgaguggugucgucaaa

SEQ ID NO: 1900476 - RNA, 17 nt, Shigella flexneri 2a str. 2457T
acgagucaacgcuucag

SEQ ID NO: 1900477 - RNA, 18 nt, Shigella flexneri 2a str. 2457T
acgacgugguaaaagccg

SEQ ID NO: 1900478 - RNA, 15 nt, Shigella flexneri 2a str. 2457T
acgacugcgccugca

SEQ ID NO: 1900479 - RNA, 14 nt, Shigella flexneri 2a str. 2457T
acgacguaccagcg

SEQ ID NO: 1900480 - RNA, 18 nt, Shigella flexneri 2a str. 2457T
aagaauuuguaggccgga

SEQ ID NO: 1900481 - RNA, 14 nt, Shigella flexneri 2a str. 2457T
aagacaauuuaccg

SEQ ID NO: 1900482 - RNA, 16 nt, Shigella flexneri 2a str. 2457T
aagacaucgcccgauu

SEQ ID NO: 1900483 - RNA, 11 nt, Shigella flexneri 2a str. 2457T
aagaagccgcc

SEQ ID NO: 1900484 - RNA, 21 nt, Shigella flexneri 2a str. 2457T
aagaacuccggcgcguugaug

SEQ ID NO: 1900485 - RNA, 13 nt, Shigella flexneri 2a str. 2457T
aagaaaacggaag

SEQ ID NO: 1900486 - RNA, 13 nt, Shigella flexneri 2a str. 2457T
aagaaaccgauga

SEQ ID NO: 1900487 - RNA, 20 nt, Shigella flexneri 2a str. 2457T
aacuuugaagcccaguaccg

SEQ ID NO: 1900488 - RNA, 16 nt, Shigella flexneri 2a str. 2457T
aacuuucgaucaguga

SEQ ID NO: 1900489 - RNA, 20 nt, Shigella flexneri 2a str. 2457T
aacuggcggucaugacgaua

SEQ ID NO: 1900490 - RNA, 19 nt, Shigella flexneri 2a str. 2457T
aacugcucguucagcggcc

SEQ ID NO: 1900491 - RNA, 16 nt, Shigella flexneri 2a str. 2457T
aacuggagcaggaacu

SEQ ID NO: 1900492 - RNA, 23 nt, Shigella flexneri 2a str. 2457T
aacugucuaauggugaacugaca

SEQ ID NO: 1900493 - RNA, 13 nt, Shigella flexneri 2a str. 2457T
aacuggucugcau

SEQ ID NO: 1900494 - RNA, 19 nt, Shigella flexneri 2a str. 2457T
aacuucuucacaccaucaa

SEQ ID NO: 1900495 - RNA, 17 nt, Shigella flexneri 2a str. 2457T
aacuugacucgccugaa

SEQ ID NO: 1900496 - RNA, 17 nt, Shigella flexneri 2a str. 2457T
aacuuccggcagaaaua

SEQ ID NO: 1900497 - RNA, 21 nt, Shigella flexneri 2a str. 2457T
aacugcgcuauaucgcugaua

SEQ ID NO: 1900498 - RNA, 15 nt, Shigella flexneri 2a str. 2457T
aacugcgguuucggc

SEQ ID NO: 1900499 - RNA, 13 nt, Shigella flexneri 2a str. 2457T
aacugcgccucaa

SEQ ID NO: 1900500 - RNA, 21 nt, Shigella flexneri 2a str. 2457T
aacugcgccacucgauaccag

SEQ ID NO: 1900501 - RNA, 12 nt, Shigella flexneri 2a str. 2457T
aacugccugaug

SEQ ID NO: 1900502 - RNA, 14 nt, Shigella flexneri 2a str. 2457T
aacugcacaccgcg

SEQ ID NO: 1900503 - RNA, 18 nt, Shigella flexneri 2a str. 2457T
aacugagcgccgucgcga

SEQ ID NO: 1900504 - RNA, 21 nt, Shigella flexneri 2a str. 2457T
aacucgcuuaagccaucauca

SEQ ID NO: 1900505 - RNA, 20 nt, Shigella flexneri 2a str. 2457T
aacuccacgcgcggacgaga

SEQ ID NO: 1900506 - RNA, 19 nt, Shigella flexneri 2a str. 2457T
aacucauacaccagcggca

SEQ ID NO: 1900507 - RNA, 21 nt, Shigella flexneri 2a str. 2457T
aacggcgcauugccagagccc

SEQ ID NO: 1900508 - RNA, 21 nt, Shigella flexneri 2a str. 2457T
aacuaucccagccuauaacga

SEQ ID NO: 1900509 - RNA, 16 nt, Shigella flexneri 2a str. 2457T
aacucaauaccugaug

SEQ ID NO: 1900510 - RNA, 22 nt, Shigella flexneri 2a str. 2457T
aacucaccgaugaucgccauca

SEQ ID NO: 1900511 - RNA, 17 nt, Shigella flexneri 2a str. 2457T
aacggccaaaguacgga

SEQ ID NO: 1900512 - RNA, 18 nt, Shigella flexneri 2a str. 2457T
aacggccaaauauccgcg

SEQ ID NO: 1900513 - RNA, 17 nt, Shigella flexneri 2a str. 2457T
aacgacauuuucugccc

SEQ ID NO: 1900514 - RNA, 18 nt, Shigella flexneri 2a str. 2457T
aaccuguugaaauuauug

SEQ ID NO: 1900515 - RNA, 14 nt, Shigella flexneri 2a str. 2457T
aacgccacauccgg

SEQ ID NO: 1900516 - RNA, 13 nt, Shigella flexneri 2a str. 2457T
aacgccagacucg

SEQ ID NO: 1900517 - RNA, 16 nt, Shigella flexneri 2a str. 2457T
aacgccuaauccagcc

SEQ ID NO: 1900518 - RNA, 20 nt, Shigella flexneri 2a str. 2457T
aacgccgucaucacaccgcg

SEQ ID NO: 1900519 - RNA, 14 nt, Shigella flexneri 2a str. 2457T
aacgccaucgccag

SEQ ID NO: 1900520 - RNA, 15 nt, Shigella flexneri 2a str. 2457T
aacgcccguccauca

SEQ ID NO: 1900521 - RNA, 15 nt, Shigella flexneri 2a str. 2457T
aacgcguucacugcc

SEQ ID NO: 1900522 - RNA, 19 nt, Shigella flexneri 2a str. 2457T
aacgcgucuuaucuggccu

SEQ ID NO: 1900523 - RNA, 15 nt, Shigella flexneri 2a str. 2457T
aacgcugaauggcga

SEQ ID NO: 1900524 - RNA, 18 nt, Shigella flexneri 2a str. 2457T
aacggcacgacacugcug

SEQ ID NO: 1900525 - RNA, 13 nt, Shigella flexneri 2a str. 2457T
aacggcagagaaa

SEQ ID NO: 1900526 - RNA, 22 nt, Shigella flexneri 2a str. 2457T
aacggcagagaaaccacaucaa

SEQ ID NO: 1900527 - RNA, 14 nt, Shigella flexneri 2a str. 2457T
aacgcggcccaggc

SEQ ID NO: 1900528 - RNA, 17 nt, Shigella flexneri 2a str. 2457T
aacgccugcucuuauua

SEQ ID NO: 1900529 - RNA, 19 nt, Shigella flexneri 2a str. 2457T
aacgccugcuuaucgcccu

SEQ ID NO: 1900530 - RNA, 22 nt, Shigella flexneri 2a str. 2457T
aacgccuuauccggccuggaug

SEQ ID NO: 1900531 - RNA, 21 nt, Shigella flexneri 2a str. 2457T
aacgccuuauccggccuaccg

SEQ ID NO: 1900532 - RNA, 17 nt, Shigella flexneri 2a str. 2457T
aacgcgguugccagaua

SEQ ID NO: 1900533 - RNA, 21 nt, Shigella flexneri 2a str. 2457T
aaccguugaggauggcgucga

SEQ ID NO: 1900534 - RNA, 14 nt, Shigella flexneri 2a str. 2457T
aaccguacgcauca

SEQ ID NO: 1900535 - RNA, 23 nt, Shigella flexneri 2a str. 2457T
aaccugugcgccaggauaagcgc

SEQ ID NO: 1900536 - RNA, 19 nt, Shigella flexneri 2a str. 2457T
aaccugauuacgcaccggg

SEQ ID NO: 1900537 - RNA, 17 nt, Shigella flexneri 2a str. 2457T
aaccuacgugcgcaaua

SEQ ID NO: 1900538 - RNA, 20 nt, Shigella flexneri 2a str. 2457T
aacacggcagcaaccgcuuc

SEQ ID NO: 1900539 - RNA, 20 nt, Shigella flexneri 2a str. 2457T
aacacgaucucacgcugaaa

SEQ ID NO: 1900540 - RNA, 15 nt, Shigella flexneri 2a str. 2457T
aacaccuguugcgcg

SEQ ID NO: 1900541 - RNA, 16 nt, Shigella flexneri 2a str. 2457T
aacaccuggcaccagu

SEQ ID NO: 1900542 - RNA, 15 nt, Shigella flexneri 2a str. 2457T
aacaccuaccggcug

SEQ ID NO: 1900543 - RNA, 13 nt, Shigella flexneri 2a str. 2457T
aacacucgcugug

SEQ ID NO: 1900544 - RNA, 22 nt, Shigella flexneri 2a str. 2457T
aacacucgugcgucgcauccgg

SEQ ID NO: 1900545 - RNA, 18 nt, Shigella flexneri 2a str. 2457T
aaccgcuuugccacggua

SEQ ID NO: 1900546 - RNA, 15 nt, Shigella flexneri 2a str. 2457T
aaucaacaaacgcug

SEQ ID NO: 1900547 - RNA, 22 nt, Shigella flexneri 2a str. 2457T
aaucaagcgccgccagucgaau

SEQ ID NO: 1900548 - RNA, 13 nt, Shigella flexneri 2a str. 2457T
aauaucuccagcu

SEQ ID NO: 1900549 - RNA, 22 nt, Shigella flexneri 2a str. 2457T
aauauacaggcggguaaucuuu

SEQ ID NO: 1900550 - RNA, 17 nt, Shigella flexneri 2a str. 2457T
aauacgcgaggcgcuaa

SEQ ID NO: 1900551 - RNA, 17 nt, Shigella flexneri 2a str. 2457T
aauacguaggccugaua

SEQ ID NO: 1900552 - RNA, 15 nt, Shigella flexneri 2a str. 2457T
aauacguaggccuga

SEQ ID NO: 1900553 - RNA, 14 nt, Shigella flexneri 2a str. 2457T
aauaacaucgccag

SEQ ID NO: 1900554 - RNA, 15 nt, Shigella flexneri 2a str. 2457T
aauaacacgcggcuu

SEQ ID NO: 1900555 - RNA, 21 nt, Shigella flexneri 2a str. 2457T
aaguucugcccugaauggugc

SEQ ID NO: 1900556 - RNA, 19 nt, Shigella flexneri 2a str. 2457T
aaguugccggauguguugc

SEQ ID NO: 1900557 - RNA, 18 nt, Shigella flexneri 2a str. 2457T
aauaaccauggcagaagc

SEQ ID NO: 1900558 - RNA, 24 nt, Shigella flexneri 2a str. 2457T
aauaaucucuuuacccagcggaug

SEQ ID NO: 1900559 - RNA, 19 nt, Shigella flexneri 2a str. 2457T
aaguuaauccacagcaaug

SEQ ID NO: 1900560 - RNA, 13 nt, Shigella flexneri 2a str. 2457T
aaggugcgcgaug

SEQ ID NO: 1900561 - RNA, 19 nt, Shigella flexneri 2a str. 2457T
aagguguucacgccgcauc

SEQ ID NO: 1900562 - RNA, 21 nt, Shigella flexneri 2a str. 2457T
aagacgcgucaagcgucgcau

SEQ ID NO: 1900563 - RNA, 20 nt, Shigella flexneri 2a str. 2457T
aagacgcguuagcaucgcau

SEQ ID NO: 1900564 - RNA, 20 nt, Shigella flexneri 2a str. 2457T
aagacgcgucagcgucgcau

SEQ ID NO: 1900565 - RNA, 21 nt, Shigella flexneri 2a str. 2457T
aagacgcgaccagcgucgcau

SEQ ID NO: 1900566 - RNA, 19 nt, Shigella flexneri 2a str. 2457T
aagaccugccgggcugaug

SEQ ID NO: 1900567 - RNA, 21 nt, Shigella flexneri 2a str. 2457T
aagacgcguaaagcgucgcau

SEQ ID NO: 1900568 - RNA, 20 nt, Shigella flexneri 2a str. 2457T
aagacgcggcagcgucgcau

SEQ ID NO: 1900569 - RNA, 19 nt, Shigella flexneri 2a str. 2457T
aagacgcgcagcgucgcau

SEQ ID NO: 1900570 - RNA, 21 nt, Shigella flexneri 2a str. 2457T
aagccacgcuugcuaacgccc

SEQ ID NO: 1900571 - RNA, 19 nt, Shigella flexneri 2a str. 2457T
aagccacaaucgcagcgca

SEQ ID NO: 1900572 - RNA, 20 nt, Shigella flexneri 2a str. 2457T
aagccacaaucgcagcgcaa

SEQ ID NO: 1900573 - RNA, 17 nt, Shigella flexneri 2a str. 2457T
aagccaccgcgccacga

SEQ ID NO: 1900574 - RNA, 15 nt, Shigella flexneri 2a str. 2457T
aagccaccgcccaga

SEQ ID NO: 1900575 - RNA, 16 nt, Shigella flexneri 2a str. 2457T
aagccaccgcccagag

SEQ ID NO: 1900576 - RNA, 14 nt, Shigella flexneri 2a str. 2457T
aagccaccgccgcu

SEQ ID NO: 1900577 - RNA, 21 nt, Shigella flexneri 2a str. 2457T
aagccagucacaucagcgauc

SEQ ID NO: 1900578 - RNA, 16 nt, Shigella flexneri 2a str. 2457T
aagccaagcgccgccu

SEQ ID NO: 1900579 - RNA, 18 nt, Shigella flexneri 2a str. 2457T
aagccaagcgccgccuca

SEQ ID NO: 1900580 - RNA, 16 nt, Shigella flexneri 2a str. 2457T
aagcauugcgccugca

SEQ ID NO: 1900581 - RNA, 13 nt, Shigella flexneri 2a str. 2457T
aagccaugcccgu

SEQ ID NO: 1900582 - RNA, 15 nt, Shigella flexneri 2a str. 2457T
aagcgcacaauggcg

SEQ ID NO: 1900583 - RNA, 16 nt, Shigella flexneri 2a str. 2457T
aagcgcaaaauaccag

SEQ ID NO: 1900584 - RNA, 14 nt, Shigella flexneri 2a str. 2457T
aagcgaugcugaug

SEQ ID NO: 1900585 - RNA, 23 nt, Shigella flexneri 2a str. 2457T
aagcggcggugucuaacgaugcc

SEQ ID NO: 1900586 - RNA, 22 nt, Shigella flexneri 2a str. 2457T
aagcguaaaaccucacgcaucc

SEQ ID NO: 1900587 - RNA, 15 nt, Shigella flexneri 2a str. 2457T
aagcggugcgaugcc

SEQ ID NO: 1900588 - RNA, 18 nt, Shigella flexneri 2a str. 2457T
aaggcauuuacgccgcau

SEQ ID NO: 1900589 - RNA, 16 nt, Shigella flexneri 2a str. 2457T
aaggcauuaaacgcau

SEQ ID NO: 1900590 - RNA, 19 nt, Shigella flexneri 2a str. 2457T
aaggcauuaaacgcauaca

SEQ ID NO: 1900591 - RNA, 16 nt, Shigella flexneri 2a str. 2457T
aaggauuagccggaua

SEQ ID NO: 1900592 - RNA, 11 nt, Shigella flexneri 2a str. 2457T
aaggauuaucc

SEQ ID NO: 1900593 - RNA, 18 nt, Shigella flexneri 2a str. 2457T
aaggcguuuucgccgcau

SEQ ID NO: 1900594 - RNA, 18 nt, Shigella flexneri 2a str. 2457T
aaggcguuuacgccgcau

SEQ ID NO: 1900595 - RNA, 23 nt, Shigella flexneri 2a str. 2457T
aaggcguuggugauaaaacgcag

SEQ ID NO: 1900596 - RNA, 14 nt, Shigella flexneri 2a str. 2457T
aaggcgaaacgccu

SEQ ID NO: 1900597 - RNA, 19 nt, Shigella flexneri 2a str. 2457T
aaggcuguuguagaccgga

SEQ ID NO: 1900598 - RNA, 13 nt, Shigella flexneri 2a str. 2457T
aaggcuguuccca

SEQ ID NO: 1900599 - RNA, 18 nt, Shigella flexneri 2a str. 2457T
aaggcuucguaaguggcg

SEQ ID NO: 1900600 - RNA, 22 nt, Shigella flexneri 2a str. 2457T
aaggcuucguaaguggcguuua

SEQ ID NO: 1900601 - RNA, 17 nt, Shigella flexneri 2a str. 2457T
acagauuuugccagcau

SEQ ID NO: 1900602 - RNA, 15 nt, Shigella flexneri 2a str. 2457T
acagaccgacuuuca

SEQ ID NO: 1900603 - RNA, 13 nt, Shigella flexneri 2a str. 2457T
acagacgacgaac

SEQ ID NO: 1900604 - RNA, 15 nt, Shigella flexneri 2a str. 2457T
acagaccagcaccgg

SEQ ID NO: 1900605 - RNA, 18 nt, Shigella flexneri 2a str. 2457T
acagcacaucagccagau

SEQ ID NO: 1900606 - RNA, 16 nt, Shigella flexneri 2a str. 2457T
acagcaccauccgccc

SEQ ID NO: 1900607 - RNA, 19 nt, Shigella flexneri 2a str. 2457T
acagcaccauccgcccaca

SEQ ID NO: 1900608 - RNA, 17 nt, Shigella flexneri 2a str. 2457T
acagcacgccccggcug

SEQ ID NO: 1900609 - RNA, 16 nt, Shigella flexneri 2a str. 2457T
acagcagcaacgauga

SEQ ID NO: 1900610 - RNA, 18 nt, Shigella flexneri 2a str. 2457T
acagcagcccuugugccg

SEQ ID NO: 1900611 - RNA, 19 nt, Shigella flexneri 2a str. 2457T
acagcacgcuuuucagugc

SEQ ID NO: 1900612 - RNA, 17 nt, Shigella flexneri 2a str. 2457T
acagaacagugccaugc

SEQ ID NO: 1900613 - RNA, 15 nt, Shigella flexneri 2a str. 2457T
acagaaucgggcuga

SEQ ID NO: 1900614 - RNA, 19 nt, Shigella flexneri 2a str. 2457T
acacuuugccgucagccac

SEQ ID NO: 1900615 - RNA, 19 nt, Shigella flexneri 2a str. 2457T
acacucgugcgucgcaucc

SEQ ID NO: 1900616 - RNA, 14 nt, Shigella flexneri 2a str. 2457T
acacucaaugacuu

SEQ ID NO: 1900617 - RNA, 15 nt, Shigella flexneri 2a str. 2457T
acagcaggccaagau

SEQ ID NO: 1900618 - RNA, 15 nt, Shigella flexneri 2a str. 2457T
acagcgcauucggca

SEQ ID NO: 1900619 - RNA, 15 nt, Shigella flexneri 2a str. 2457T
acagcuuagcgccuu

SEQ ID NO: 1900620 - RNA, 14 nt, Shigella flexneri 2a str. 2457T
acaggcgaaacccg

SEQ ID NO: 1900621 - RNA, 19 nt, Shigella flexneri 2a str. 2457T
acagguggcguuugccacc

SEQ ID NO: 1900622 - RNA, 17 nt, Shigella flexneri 2a str. 2457T
acaggugcucgcauauc

SEQ ID NO: 1900623 - RNA, 16 nt, Shigella flexneri 2a str. 2457T
acaccgucgcaauacc

SEQ ID NO: 1900624 - RNA, 20 nt, Shigella flexneri 2a str. 2457T
acaccuucucaggccuacaa

SEQ ID NO: 1900625 - RNA, 17 nt, Shigella flexneri 2a str. 2457T
acaccugacgauguggu

SEQ ID NO: 1900626 - RNA, 23 nt, Shigella flexneri 2a str. 2457T
aaaauaacagcggcaaccagccc

SEQ ID NO: 1900627 - RNA, 15 nt, Shigella flexneri 2a str. 2457T
acaccacugccagau

SEQ ID NO: 1900628 - RNA, 16 nt, Shigella flexneri 2a str. 2457T
acacaucaccuccagc

SEQ ID NO: 1900629 - RNA, 17 nt, Shigella flexneri 2a str. 2457T
acacaggcagcaaucac

SEQ ID NO: 1900630 - RNA, 16 nt, Shigella flexneri 2a str. 2457T
acaccagccagaauua

SEQ ID NO: 1900631 - RNA, 23 nt, Shigella flexneri 2a str. 2457T
acaccagcuuucgcuuaacgccc

SEQ ID NO: 1900632 - RNA, 15 nt, Shigella flexneri 2a str. 2457T
acaccaugccgguga

SEQ ID NO: 1900633 - RNA, 14 nt, Shigella flexneri 2a str. 2457T
acaccaucaguggc

SEQ ID NO: 1900634 - RNA, 22 nt, Shigella flexneri 2a str. 2457T
acacccgacgugcagcaucgau

SEQ ID NO: 1900635 - RNA, 17 nt, Shigella flexneri 2a str. 2457T
aauuucagcgccugaua

SEQ ID NO: 1900636 - RNA, 14 nt, Shigella flexneri 2a str. 2457T
aauuguucgacagu

SEQ ID NO: 1900637 - RNA, 18 nt, Shigella flexneri 2a str. 2457T
aauugguagaccagagcu

SEQ ID NO: 1900638 - RNA, 19 nt, Shigella flexneri 2a str. 2457T
aauugcguuaaaaucagcg

SEQ ID NO: 1900639 - RNA, 23 nt, Shigella flexneri 2a str. 2457T
aauugcugguuuuguaggccgga

SEQ ID NO: 1900640 - RNA, 23 nt, Shigella flexneri 2a str. 2457T
aauugcagacccguuaagcguuc

SEQ ID NO: 1900641 - RNA, 13 nt, Shigella flexneri 2a str. 2457T
aauugcagcagcu

SEQ ID NO: 1900642 - RNA, 22 nt, Shigella flexneri 2a str. 2457T
aauguugccguuuaccgccauc

SEQ ID NO: 1900643 - RNA, 17 nt, Shigella flexneri 2a str. 2457T
aauuccggugcgccaga

SEQ ID NO: 1900644 - RNA, 20 nt, Shigella flexneri 2a str. 2457T
aauucccugcgccagcggca

SEQ ID NO: 1900645 - RNA, 16 nt, Shigella flexneri 2a str. 2457T
aauuccccgcaggaug

SEQ ID NO: 1900646 - RNA, 18 nt, Shigella flexneri 2a str. 2457T
aaugaacucaacgccuuc

SEQ ID NO: 1900647 - RNA, 20 nt, Shigella flexneri 2a str. 2457T
aaucuuguucucagcacauu

SEQ ID NO: 1900648 - RNA, 15 nt, Shigella flexneri 2a str. 2457T
aaucuucuucucagc

SEQ ID NO: 1900649 - RNA, 19 nt, Shigella flexneri 2a str. 2457T
aaucaccaggucaccagac

SEQ ID NO: 1900650 - RNA, 20 nt, Shigella flexneri 2a str. 2457T
aaucacaucaucaucgccag

SEQ ID NO: 1900651 - RNA, 14 nt, Shigella flexneri 2a str. 2457T
aaucacaucaccau

SEQ ID NO: 1900652 - RNA, 17 nt, Shigella flexneri 2a str. 2457T
aaucacagcggcgaaug

SEQ ID NO: 1900653 - RNA, 15 nt, Shigella flexneri 2a str. 2457T
aaucaccuuuaaccu

SEQ ID NO: 1900654 - RNA, 15 nt, Shigella flexneri 2a str. 2457T
aaucacccagcgaag

SEQ ID NO: 1900655 - RNA, 22 nt, Shigella flexneri 2a str. 2457T
aaugcauccgcuuacucaucca

SEQ ID NO: 1900656 - RNA, 17 nt, Shigella flexneri 2a str. 2457T
aaugagauauuucagag

SEQ ID NO: 1900657 - RNA, 20 nt, Shigella flexneri 2a str. 2457T
aaugacuccaacuuacugau

SEQ ID NO: 1900658 - RNA, 19 nt, Shigella flexneri 2a str. 2457T
aaugcaggcgcgccuggug

SEQ ID NO: 1900659 - RNA, 13 nt, Shigella flexneri 2a str. 2457T
aaugcaucggcau

SEQ ID NO: 1900660 - RNA, 21 nt, Shigella flexneri 2a str. 2457T
aaugcccaucacuaucgccau

SEQ ID NO: 1900661 - RNA, 15 nt, Shigella flexneri 2a str. 2457T
aaugcugcagccagg

SEQ ID NO: 1900662 - RNA, 12 nt, Shigella flexneri 2a str. 2457T
aauggcgcuaac

SEQ ID NO: 1900663 - RNA, 18 nt, Shigella flexneri 2a str. 2457T
aaugcgccgaaaucgcau

SEQ ID NO: 1900664 - RNA, 13 nt, Shigella flexneri 2a str. 2457T
aaugcgcgagcca

SEQ ID NO: 1900665 - RNA, 17 nt, Shigella flexneri 2a str. 2457T
acaaucucaaccgcuuc

SEQ ID NO: 1900666 - RNA, 20 nt, Shigella flexneri 2a str. 2457T
acaaucccugcauaucggua

SEQ ID NO: 1900667 - RNA, 20 nt, Shigella flexneri 2a str. 2457T
acaauggagcuaaacagcgc

SEQ ID NO: 1900668 - RNA, 22 nt, Shigella flexneri 2a str. 2457T
acaaugucauggcagucuuaau

SEQ ID NO: 1900669 - RNA, 18 nt, Shigella flexneri 2a str. 2457T
acaauuuacguuuuaaac

SEQ ID NO: 1900670 - RNA, 20 nt, Shigella flexneri 2a str. 2457T
acaauugccccccauaacgc

SEQ ID NO: 1900671 - RNA, 23 nt, Shigella flexneri 2a str. 2457T
acaauuugcccauguaguacccg

SEQ ID NO: 1900672 - RNA, 21 nt, Shigella flexneri 2a str. 2457T
acacacccggccuaucaacgu

SEQ ID NO: 1900673 - RNA, 15 nt, Shigella flexneri 2a str. 2457T
acacaaugccugaug

SEQ ID NO: 1900674 - RNA, 12 nt, Shigella flexneri 2a str. 2457T
acaaucagccag

SEQ ID NO: 1900675 - RNA, 17 nt, Shigella flexneri 2a str. 2457T
acaauaugcucuccacc

SEQ ID NO: 1900676 - RNA, 15 nt, Shigella flexneri 2a str. 2457T
acaauacaaaugccu

SEQ ID NO: 1900677 - RNA, 21 nt, Shigella flexneri 2a str. 2457T
acaaguaaaaggagauaaacc

SEQ ID NO: 1900678 - RNA, 18 nt, Shigella flexneri 2a str. 2457T
acaagaaauauacaggcg

SEQ ID NO: 1900679 - RNA, 15 nt, Shigella flexneri 2a str. 2457T
acaagauacugccga

SEQ ID NO: 1900680 - RNA, 14 nt, Shigella flexneri 2a str. 2457T
acaacgguccgguu

SEQ ID NO: 1900681 - RNA, 19 nt, Shigella flexneri 2a str. 2457T
acaacauuccugcugacgg

SEQ ID NO: 1900682 - RNA, 18 nt, Shigella flexneri 2a str. 2457T
acaaccaaucgcggcgau

SEQ ID NO: 1900683 - RNA, 15 nt, Shigella flexneri 2a str. 2457T
acaacacccggucag

SEQ ID NO: 1900684 - RNA, 15 nt, Shigella flexneri 2a str. 2457T
acaacaacaucagcg

SEQ ID NO: 1900685 - RNA, 14 nt, Shigella flexneri 2a str. 2457T
aauuuccgucgcau

SEQ ID NO: 1900686 - RNA, 18 nt, Shigella flexneri 2a str. 2457T
aauuucguuaagcucaga

SEQ ID NO: 1900687 - RNA, 18 nt, Shigella flexneri 2a str. 2457T
aauuucuccgccggaauc

SEQ ID NO: 1900688 - RNA, 16 nt, Shigella flexneri 2a str. 2457T
acaaaaaagccaauca

SEQ ID NO: 1900689 - RNA, 12 nt, Shigella flexneri 2a str. 2457T
aaaucaucaauc

SEQ ID NO: 1900690 - RNA, 14 nt, Shigella flexneri 2a str. 2457T
aaaucagcgugaug

SEQ ID NO: 1900691 - RNA, 17 nt, Shigella flexneri 2a str. 2457T
aaauaacaucgccagaa

SEQ ID NO: 1900692 - RNA, 23 nt, Shigella flexneri 2a str. 2457T
aaaaccguauucgcggugcuuca

SEQ ID NO: 1900693 - RNA, 22 nt, Shigella flexneri 2a str. 2457T
aaaaccgcaccguauugcgccg

SEQ ID NO: 1900694 - RNA, 13 nt, Shigella flexneri 2a str. 2457T
aaaaccgcugauu

SEQ ID NO: 1900695 - RNA, 20 nt, Shigella flexneri 2a str. 2457T
aaaacagccagcgcugacgu

SEQ ID NO: 1900696 - RNA, 13 nt, Shigella flexneri 2a str. 2457T
aaaacaucuucgg

SEQ ID NO: 1900697 - RNA, 12 nt, Shigella flexneri 2a str. 2457T
aaaacaaacggc

SEQ ID NO: 1900698 - RNA, 12 nt, Shigella flexneri 2a str. 2457T
aaaucauccgcu

SEQ ID NO: 1900699 - RNA, 17 nt, Shigella flexneri 2a str. 2457T
aaaucccagugccugca

SEQ ID NO: 1900700 - RNA, 13 nt, Shigella flexneri 2a str. 2457T
aaaucccgccauu

SEQ ID NO: 1900701 - RNA, 13 nt, Shigella flexneri 2a str. 2457T
aaaucccgccgcu

SEQ ID NO: 1900702 - RNA, 12 nt, Shigella flexneri 2a str. 2457T
aaauccgccauc

SEQ ID NO: 1900703 - RNA, 13 nt, Shigella flexneri 2a str. 2457T
aaauccgccacuu

SEQ ID NO: 1900704 - RNA, 20 nt, Shigella flexneri 2a str. 2457T
aaauccagcgguugggcauc

SEQ ID NO: 1900705 - RNA, 20 nt, Shigella flexneri 2a str. 2457T
aaauccuucacuuuugccag

SEQ ID NO: 1900706 - RNA, 14 nt, Shigella flexneri 2a str. 2457T
aaauccugccgcag

SEQ ID NO: 1900707 - RNA, 14 nt, Shigella flexneri 2a str. 2457T
aaaugcaucaguga

SEQ ID NO: 1900708 - RNA, 19 nt, Shigella flexneri 2a str. 2457T
aaaugcagcauugccugau

SEQ ID NO: 1900709 - RNA, 17 nt, Shigella flexneri 2a str. 2457T
aaaugcaaacgcaucgc

SEQ ID NO: 1900710 - RNA, 16 nt, Shigella flexneri 2a str. 2457T
aacacauccaguggcg

SEQ ID NO: 1900711 - RNA, 13 nt, Shigella flexneri 2a str. 2457T
aacacacauuuau

SEQ ID NO: 1900712 - RNA, 13 nt, Shigella flexneri 2a str. 2457T
aacacaacgcuuu

SEQ ID NO: 1900713 - RNA, 14 nt, Shigella flexneri 2a str. 2457T
aacaauguuauccg

SEQ ID NO: 1900714 - RNA, 18 nt, Shigella flexneri 2a str. 2457T
aacaauguuauccggcua

SEQ ID NO: 1900715 - RNA, 17 nt, Shigella flexneri 2a str. 2457T
aacaaugcguuuagccg

SEQ ID NO: 1900716 - RNA, 13 nt, Shigella flexneri 2a str. 2457T
aacaaauccgcuu

SEQ ID NO: 1900717 - RNA, 14 nt, Shigella flexneri 2a str. 2457T
aacaaccacaaugu

SEQ ID NO: 1900718 - RNA, 22 nt, Shigella flexneri 2a str. 2457T
aacaaagcgacccgccuugaua

SEQ ID NO: 1900719 - RNA, 19 nt, Shigella flexneri 2a str. 2457T
aaaagacaccaucgcgcug

SEQ ID NO: 1900720 - RNA, 16 nt, Shigella flexneri 2a str. 2457T
aaauuuugcaucgucc

SEQ ID NO: 1900721 - RNA, 21 nt, Shigella flexneri 2a str. 2457T
aaaacgccuuauccggccuac

SEQ ID NO: 1900722 - RNA, 16 nt, Shigella flexneri 2a str. 2457T
aaaacggucacggcug

SEQ ID NO: 1900723 - RNA, 23 nt, Shigella flexneri 2a str. 2457T
aaaccgucguuacugucgcgcag

SEQ ID NO: 1900724 - RNA, 21 nt, Shigella flexneri 2a str. 2457T
aaaccugaacaggucgaugcg

SEQ ID NO: 1900725 - RNA, 18 nt, Shigella flexneri 2a str. 2457T
aaaccucuuccagcagau

SEQ ID NO: 1900726 - RNA, 20 nt, Shigella flexneri 2a str. 2457T
aaaccccgggaacagaggca

SEQ ID NO: 1900727 - RNA, 14 nt, Shigella flexneri 2a str. 2457T
aaacccgcaggcgc

SEQ ID NO: 1900728 - RNA, 12 nt, Shigella flexneri 2a str. 2457T
aaaccagcgcau

SEQ ID NO: 1900729 - RNA, 19 nt, Shigella flexneri 2a str. 2457T
aaacccggccacagcgcca

SEQ ID NO: 1900730 - RNA, 20 nt, Shigella flexneri 2a str. 2457T
aaacccugaaacggaaucgc

SEQ ID NO: 1900731 - RNA, 20 nt, Shigella flexneri 2a str. 2457T
aaaccgacaauauugaugcu

SEQ ID NO: 1900732 - RNA, 18 nt, Shigella flexneri 2a str. 2457T
aaaccgagaagcagcaac

SEQ ID NO: 1900733 - RNA, 20 nt, Shigella flexneri 2a str. 2457T
aaacacaaaacugccugaug

SEQ ID NO: 1900734 - RNA, 23 nt, Shigella flexneri 2a str. 2457T
aaacaauguucaucugcauuccg

SEQ ID NO: 1900735 - RNA, 14 nt, Shigella flexneri 2a str. 2457T
aaacaccgucgcaa

SEQ ID NO: 1900736 - RNA, 14 nt, Shigella flexneri 2a str. 2457T
aaacagccagcagc

SEQ ID NO: 1900737 - RNA, 21 nt, Shigella flexneri 2a str. 2457T
aaacagcagaacgaccagcgc

SEQ ID NO: 1900738 - RNA, 13 nt, Shigella flexneri 2a str. 2457T
aaacaggaucugg

SEQ ID NO: 1900739 - RNA, 18 nt, Shigella flexneri 2a str. 2457T
aaacagucuggagcaaaa

SEQ ID NO: 1900740 - RNA, 16 nt, Shigella flexneri 2a str. 2457T
aaacauuucagggaug

SEQ ID NO: 1900741 - RNA, 13 nt, Shigella flexneri 2a str. 2457T
aaagcgagcagua

SEQ ID NO: 1900742 - RNA, 19 nt, Shigella flexneri 2a str. 2457T
aaagcgcaaaauaccagca

SEQ ID NO: 1900743 - RNA, 14 nt, Shigella flexneri 2a str. 2457T
aaagcgcaccugau

SEQ ID NO: 1900744 - RNA, 16 nt, Shigella flexneri 2a str. 2457T
aaagcgacgcgcagua

SEQ ID NO: 1900745 - RNA, 20 nt, Shigella flexneri 2a str. 2457T
aaagcccccgcaacauugcg

SEQ ID NO: 1900746 - RNA, 13 nt, Shigella flexneri 2a str. 2457T
aaagcccgccauc

SEQ ID NO: 1900747 - RNA, 16 nt, Shigella flexneri 2a str. 2457T
aaagccgccaucucuu

SEQ ID NO: 1900748 - RNA, 18 nt, Shigella flexneri 2a str. 2457T
aaaguaagauugccugau

SEQ ID NO: 1900749 - RNA, 18 nt, Shigella flexneri 2a str. 2457T
aaagcggcucauugccau

SEQ ID NO: 1900750 - RNA, 19 nt, Shigella flexneri 2a str. 2457T
aaagaagucucugaaauuc

SEQ ID NO: 1900751 - RNA, 20 nt, Shigella flexneri 2a str. 2457T
aaacggcacgaugagcaaau

SEQ ID NO: 1900752 - RNA, 19 nt, Shigella flexneri 2a str. 2457T
aaagcauucguaaugaaug

SEQ ID NO: 1900753 - RNA, 18 nt, Shigella flexneri 2a str. 2457T
aaagaggcguuugcaggu

SEQ ID NO: 1900754 - RNA, 21 nt, Shigella flexneri 2a str. 2457T
aaagagucggcgcugaaauuc

SEQ ID NO: 1900755 - RNA, 22 nt, Shigella flexneri 2a str. 2457T
aaagcagcauguagaugccggu

SEQ ID NO: 1900756 - RNA, 21 nt, Shigella flexneri 2a str. 2457T
aaacgcccgaauugaagccaa

SEQ ID NO: 1900757 - RNA, 23 nt, Shigella flexneri 2a str. 2457T
aaacgcccguccaucaacaagcg

SEQ ID NO: 1900758 - RNA, 18 nt, Shigella flexneri 2a str. 2457T
aaacgcccuuaccuuuac

SEQ ID NO: 1900759 - RNA, 17 nt, Shigella flexneri 2a str. 2457T
aaacggauggccugaug

SEQ ID NO: 1900760 - RNA, 14 nt, Shigella flexneri 2a str. 2457T
aaacgggcgcugag

SEQ ID NO: 1900761 - RNA, 20 nt, Shigella flexneri 2a str. 2457T
aaaaauauucaccaaacgcc

SEQ ID NO: 1900762 - RNA, 18 nt, Shigella flexneri 2a str. 2457T
aaaaaccgggugcagagc

SEQ ID NO: 1900763 - RNA, 19 nt, Shigella flexneri 2a str. 2457T
aaaacuuuauucaguggca

SEQ ID NO: 1900764 - RNA, 23 nt, Shigella flexneri 2a str. 2457T
aaaacuaaacguuagcacgaacc

SEQ ID NO: 1900765 - RNA, 14 nt, Shigella flexneri 2a str. 2457T
aaaacgaaugacug

SEQ ID NO: 1900766 - RNA, 14 nt, Shigella flexneri 2a str. 2457T
aaaacgcucgacgu

SEQ ID NO: 1900767 - RNA, 13 nt, Shigella flexneri 2a str. 2457T
aaaaauggcgcac

SEQ ID NO: 1900768 - RNA, 18 nt, Shigella flexneri 2a str. 2457T
aaaaauucagaugaugau

SEQ ID NO: 1900769 - RNA, 23 nt, Shigella flexneri 2a str. 2457T
aaaacccggccugcucccgaacc

SEQ ID NO: 1900770 - RNA, 13 nt, Shigella flexneri 2a str. 2457T
aaaacccgcuucg

SEQ ID NO: 1900771 - RNA, 11 nt, Shigella flexneri 2a str. 2457T
aaaaaaucgcc

SEQ ID NO: 1900772 - RNA, 13 nt, Shigella flexneri 2a str. 2457T
aaaaaaaaugccc

SEQ ID NO: 1900773 - RNA, 22 nt, Shigella flexneri 2a str. 2457T
aaaaacccgccccugacaggcg

SEQ ID NO: 1900774 - RNA, 20 nt, Shigella flexneri 2a str. 2457T
aaaaacgcgguugccagaua

SEQ ID NO: 1900775 - RNA, 16 nt, Shigella flexneri 2a str. 2457T
aaaaacccgccgaagc

SEQ ID NO: 1900776 - RNA, 17 nt, Shigella flexneri 2a str. 2457T
aaaaacccugcagaaac

SEQ ID NO: 1900777 - RNA, 14 nt, Shigella flexneri 2a str. 2457T
aaaaacuugauacu

SEQ ID NO: 1900778 - RNA, 16 nt, Shigella flexneri 2a str. 2457T
aaaaacucauaaauuc

SEQ ID NO: 1900779 - RNA, 20 nt, Shigella flexneri 2a str. 2457T
aaaauuacggauuacaugga

SEQ ID NO: 1900780 - RNA, 17 nt, Shigella flexneri 2a str. 2457T
aaaaaacguugucgccg

SEQ ID NO: 1900781 - RNA, 15 nt, Shigella flexneri 2a str. 2457T
aaaaucucauuugca

SEQ ID NO: 1900782 - RNA, 12 nt, Shigella flexneri 2a str. 2457T
aaaaucggcaac

SEQ ID NO: 1900783 - RNA, 13 nt, Shigella flexneri 2a str. 2457T
aaaaugccugaug

SEQ ID NO: 1900784 - RNA, 18 nt, Shigella flexneri 2a str. 2457T
aaaaucgcuucagccgga

SEQ ID NO: 1900785 - RNA, 19 nt, Shigella flexneri 2a str. 2457T
aaaagauccguaaugccug

SEQ ID NO: 1900786 - RNA, 22 nt, Shigella flexneri 2a str. 2457T
aaaagccgcuuaacgguguuua

SEQ ID NO: 1900787 - RNA, 11 nt, Shigella flexneri 2a str. 2457T
uuuuuucacau

SEQ ID NO: 1900788 - RNA, 19 nt, Shigella flexneri 2a str. 2457T
uuuuucaucgcuaauaaua

SEQ ID NO: 1900789 - RNA, 23 nt, Shigella flexneri 2a str. 2457T
uuuuucaucgcuaauaauaagcc

SEQ ID NO: 1900790 - RNA, 13 nt, Shigella flexneri 2a str. 2457T
uuuuuuauuuuuu

SEQ ID NO: 1900791 - RNA, 16 nt, Shigella flexneri 2a str. 2457T
uuuuuugccaaauauc

SEQ ID NO: 1900792 - RNA, 11 nt, Shigella flexneri 2a str. 2457T
uuuuuuugcca

SEQ ID NO: 1900793 - RNA, 11 nt, Shigella flexneri 2a str. 2457T
uuuuuuuaugc

SEQ ID NO: 1900794 - RNA, 17 nt, Shigella flexneri 2a str. 2457T
uuuuccuugaaaaagag

SEQ ID NO: 1900795 - RNA, 20 nt, Shigella flexneri 2a str. 2457T
uuuucaguagacucaagcag

SEQ ID NO: 1900796 - RNA, 16 nt, Shigella flexneri 2a str. 2457T
uuuucagccaucaucc

SEQ ID NO: 1900797 - RNA, 22 nt, Shigella flexneri 2a str. 2457T
uuuucagcaaccggaggucagu

SEQ ID NO: 1900798 - RNA, 17 nt, Shigella flexneri 2a str. 2457T
uuuaccuugcucaucca

SEQ ID NO: 1900799 - RNA, 14 nt, Shigella flexneri 2a str. 2457T
uuuaccuucauuug

SEQ ID NO: 1900800 - RNA, 16 nt, Shigella flexneri 2a str. 2457T
uuuucaccaucgccau

SEQ ID NO: 1900801 - RNA, 19 nt, Shigella flexneri 2a str. 2457T
uuuucacccacacuucaau

SEQ ID NO: 1900802 - RNA, 12 nt, Shigella flexneri 2a str. 2457T
uuuucaccaguu

SEQ ID NO: 1900803 - RNA, 17 nt, Shigella flexneri 2a str. 2457T
uuuugcaacgcuuugcu

SEQ ID NO: 1900804 - RNA, 22 nt, Shigella flexneri 2a str. 2457T
uuuugcaaucagauaaaauaca

SEQ ID NO: 1900805 - RNA, 20 nt, Shigella flexneri 2a str. 2457T
uuuugcaggaaaaacugccc

SEQ ID NO: 1900806 - RNA, 17 nt, Shigella flexneri 2a str. 2457T
uuuugcagaaacauaau

SEQ ID NO: 1900807 - RNA, 21 nt, Shigella flexneri 2a str. 2457T
uuuucgcuugaucuuccugau

SEQ ID NO: 1900808 - RNA, 21 nt, Shigella flexneri 2a str. 2457T
uuuucgaucuguuuuagagaa

SEQ ID NO: 1900809 - RNA, 20 nt, Shigella flexneri 2a str. 2457T
uuuucgaucacuuuuaaauu

SEQ ID NO: 1900810 - RNA, 11 nt, Shigella flexneri 2a str. 2457T
uuuucucuauc

SEQ ID NO: 1900811 - RNA, 15 nt, Shigella flexneri 2a str. 2457T
uuuucuggcacaacu

SEQ ID NO: 1900812 - RNA, 14 nt, Shigella flexneri 2a str. 2457T
uuuuuaguuagcaa

SEQ ID NO: 1900813 - RNA, 23 nt, Shigella flexneri 2a str. 2457T
uuuuuaguuguaaucauauuaaa

SEQ ID NO: 1900814 - RNA, 21 nt, Shigella flexneri 2a str. 2457T
uuuuucaacauguugaaauuc

SEQ ID NO: 1900815 - RNA, 19 nt, Shigella flexneri 2a str. 2457T
uuuuuacaucaucagaaau

SEQ ID NO: 1900816 - RNA, 11 nt, Shigella flexneri 2a str. 2457T
uuuuuaaacau

SEQ ID NO: 1900817 - RNA, 14 nt, Shigella flexneri 2a str. 2457T
uuuuuaaacauuaa

SEQ ID NO: 1900818 - RNA, 22 nt, Shigella flexneri 2a str. 2457T
uuuuuaaaauaucgcugcuuau

SEQ ID NO: 1900819 - RNA, 15 nt, Shigella flexneri 2a str. 2457T
uuuuuaaauuuccca

SEQ ID NO: 1900820 - RNA, 19 nt, Shigella flexneri 2a str. 2457T
uuuuuaaggguauuuuucu

SEQ ID NO: 1900821 - RNA, 23 nt, Shigella flexneri 2a str. 2457T
uuuugcugcaaaauuauuccguu

SEQ ID NO: 1900822 - RNA, 11 nt, Shigella flexneri 2a str. 2457T
uuuugcugccg

SEQ ID NO: 1900823 - RNA, 21 nt, Shigella flexneri 2a str. 2457T
uuuugccgcccagucacggcu

SEQ ID NO: 1900824 - RNA, 23 nt, Shigella flexneri 2a str. 2457T
uuuugguccuggucugaugaaug

SEQ ID NO: 1900825 - RNA, 18 nt, Shigella flexneri 2a str. 2457T
uuuuggagaucacgccac

SEQ ID NO: 1900826 - RNA, 16 nt, Shigella flexneri 2a str. 2457T
uuuuguuuaaauaucu

SEQ ID NO: 1900827 - RNA, 12 nt, Shigella flexneri 2a str. 2457T
uuuuguagaccu

SEQ ID NO: 1900828 - RNA, 18 nt, Shigella flexneri 2a str. 2457T
uuuuguaucgaacaagau

SEQ ID NO: 1900829 - RNA, 13 nt, Shigella flexneri 2a str. 2457T
uuuuguccccuca

SEQ ID NO: 1900830 - RNA, 20 nt, Shigella flexneri 2a str. 2457T
uucguguggaaaagcaguaa

SEQ ID NO: 1900831 - RNA, 23 nt, Shigella flexneri 2a str. 2457T
uucguuagguucucucagucuuu

SEQ ID NO: 1900832 - RNA, 17 nt, Shigella flexneri 2a str. 2457T
uucuaaauguucaauaa

SEQ ID NO: 1900833 - RNA, 22 nt, Shigella flexneri 2a str. 2457T
uucgucguaguaguucaucccc

SEQ ID NO: 1900834 - RNA, 13 nt, Shigella flexneri 2a str. 2457T
uucgugagcguuu

SEQ ID NO: 1900835 - RNA, 15 nt, Shigella flexneri 2a str. 2457T
uucgugacaauaucu

SEQ ID NO: 1900836 - RNA, 20 nt, Shigella flexneri 2a str. 2457T
uucguaauaauucacggccc

SEQ ID NO: 1900837 - RNA, 21 nt, Shigella flexneri 2a str. 2457T
uucgucccagucgucauccca

SEQ ID NO: 1900838 - RNA, 15 nt, Shigella flexneri 2a str. 2457T
uucgguucaaguccc

SEQ ID NO: 1900839 - RNA, 20 nt, Shigella flexneri 2a str. 2457T
uucggcauacauaaucaaua

SEQ ID NO: 1900840 - RNA, 16 nt, Shigella flexneri 2a str. 2457T
uucuaacucauuuuuu

SEQ ID NO: 1900841 - RNA, 21 nt, Shigella flexneri 2a str. 2457T
uucuccuuucuuucuggaaau

SEQ ID NO: 1900842 - RNA, 16 nt, Shigella flexneri 2a str. 2457T
uucuccuucacucuau

SEQ ID NO: 1900843 - RNA, 19 nt, Shigella flexneri 2a str. 2457T
uucuccacaccguugccgc

SEQ ID NO: 1900844 - RNA, 16 nt, Shigella flexneri 2a str. 2457T
uucuccucccuugucu

SEQ ID NO: 1900845 - RNA, 17 nt, Shigella flexneri 2a str. 2457T
uucucagcgguaauggu

SEQ ID NO: 1900846 - RNA, 15 nt, Shigella flexneri 2a str. 2457T
uucucagcaguuuuu

SEQ ID NO: 1900847 - RNA, 19 nt, Shigella flexneri 2a str. 2457T
uucuuaccccugauuuugu

SEQ ID NO: 1900848 - RNA, 17 nt, Shigella flexneri 2a str. 2457T
uucugguuauauuuccc

SEQ ID NO: 1900849 - RNA, 19 nt, Shigella flexneri 2a str. 2457T
uucuucaaguguggccgcc

SEQ ID NO: 1900850 - RNA, 16 nt, Shigella flexneri 2a str. 2457T
uucuucaacgaagaaa

SEQ ID NO: 1900851 - RNA, 21 nt, Shigella flexneri 2a str. 2457T
uucuucaagccaggcuuuaaa

SEQ ID NO: 1900852 - RNA, 18 nt, Shigella flexneri 2a str. 2457T
uucuucacggaaaauauu

SEQ ID NO: 1900853 - RNA, 21 nt, Shigella flexneri 2a str. 2457T
uucuucacaccaucaaagaag

SEQ ID NO: 1900854 - RNA, 17 nt, Shigella flexneri 2a str. 2457T
uucuucaagccaggcuu

SEQ ID NO: 1900855 - RNA, 17 nt, Shigella flexneri 2a str. 2457T
uucuucaacaauugaag

SEQ ID NO: 1900856 - RNA, 20 nt, Shigella flexneri 2a str. 2457T
uucuuccucgucccaaaagc

SEQ ID NO: 1900857 - RNA, 22 nt, Shigella flexneri 2a str. 2457T
uucuucagcguccgggaaaucc

SEQ ID NO: 1900858 - RNA, 14 nt, Shigella flexneri 2a str. 2457T
uucuucacugacgc

SEQ ID NO: 1900859 - RNA, 16 nt, Shigella flexneri 2a str. 2457T
uucugaacugaacaaa

SEQ ID NO: 1900860 - RNA, 18 nt, Shigella flexneri 2a str. 2457T
uucugaacugaacaaaaa

SEQ ID NO: 1900861 - RNA, 22 nt, Shigella flexneri 2a str. 2457T
uucugaacugaacaaaaaagag

SEQ ID NO: 1900862 - RNA, 22 nt, Shigella flexneri 2a str. 2457T
uucugaaaaucauacauccucu

SEQ ID NO: 1900863 - RNA, 16 nt, Shigella flexneri 2a str. 2457T
uucucgauaaaaccuu

SEQ ID NO: 1900864 - RNA, 17 nt, Shigella flexneri 2a str. 2457T
uucucgauaaaaccuuc

SEQ ID NO: 1900865 - RNA, 13 nt, Shigella flexneri 2a str. 2457T
uucucgccaccgg

SEQ ID NO: 1900866 - RNA, 18 nt, Shigella flexneri 2a str. 2457T
uucucgcggacugccugg

SEQ ID NO: 1900867 - RNA, 18 nt, Shigella flexneri 2a str. 2457T
uucucgcgaaccgccugg

SEQ ID NO: 1900868 - RNA, 18 nt, Shigella flexneri 2a str. 2457T
uucucggugaacgccugc

SEQ ID NO: 1900869 - RNA, 21 nt, Shigella flexneri 2a str. 2457T
uucugagucaauuucugcaaa

SEQ ID NO: 1900870 - RNA, 19 nt, Shigella flexneri 2a str. 2457T
uucugagaucaaugcgcca

SEQ ID NO: 1900871 - RNA, 20 nt, Shigella flexneri 2a str. 2457T
uucugagcggccuuuuccuu

SEQ ID NO: 1900872 - RNA, 19 nt, Shigella flexneri 2a str. 2457T
uucuggaaguaaucacgaa

SEQ ID NO: 1900873 - RNA, 18 nt, Shigella flexneri 2a str. 2457T
uucugcuuuucccuccac

SEQ ID NO: 1900874 - RNA, 13 nt, Shigella flexneri 2a str. 2457T
uucuggcaccagu

SEQ ID NO: 1900875 - RNA, 14 nt, Shigella flexneri 2a str. 2457T
uucuggaugccauc

SEQ ID NO: 1900876 - RNA, 21 nt, Shigella flexneri 2a str. 2457T
uucuggcugacauaaacacca

SEQ ID NO: 1900877 - RNA, 16 nt, Shigella flexneri 2a str. 2457T
uugauuuucgaauagc

SEQ ID NO: 1900878 - RNA, 12 nt, Shigella flexneri 2a str. 2457T
uugauuuuauug

SEQ ID NO: 1900879 - RNA, 19 nt, Shigella flexneri 2a str. 2457T
uugauuuuuuugauaaacc

SEQ ID NO: 1900880 - RNA, 19 nt, Shigella flexneri 2a str. 2457T
uugcaagccuguaguacaa

SEQ ID NO: 1900881 - RNA, 19 nt, Shigella flexneri 2a str. 2457T
uugcaauuucccugacauu

SEQ ID NO: 1900882 - RNA, 17 nt, Shigella flexneri 2a str. 2457T
uugaugaaaaaaccaga

SEQ ID NO: 1900883 - RNA, 19 nt, Shigella flexneri 2a str. 2457T
uugaugaaaaaaccagaaa

SEQ ID NO: 1900884 - RNA, 14 nt, Shigella flexneri 2a str. 2457T
uugaugcacaccau

SEQ ID NO: 1900885 - RNA, 14 nt, Shigella flexneri 2a str. 2457T
uugaugccguucca

SEQ ID NO: 1900886 - RNA, 14 nt, Shigella flexneri 2a str. 2457T
uugauucuguucag

SEQ ID NO: 1900887 - RNA, 15 nt, Shigella flexneri 2a str. 2457T
uugagcaucugcaaa

SEQ ID NO: 1900888 - RNA, 16 nt, Shigella flexneri 2a str. 2457T
uugagcgaaaacgaau

SEQ ID NO: 1900889 - RNA, 16 nt, Shigella flexneri 2a str. 2457T
uugaguauuuaccaga

SEQ ID NO: 1900890 - RNA, 19 nt, Shigella flexneri 2a str. 2457T
uugaguggcgcaucuucau

SEQ ID NO: 1900891 - RNA, 15 nt, Shigella flexneri 2a str. 2457T
uugaguucacugccg

SEQ ID NO: 1900892 - RNA, 19 nt, Shigella flexneri 2a str. 2457T
uugaguuuuucaucccucu

SEQ ID NO: 1900893 - RNA, 12 nt, Shigella flexneri 2a str. 2457T
uugauaaaaaaa

SEQ ID NO: 1900894 - RNA, 13 nt, Shigella flexneri 2a str. 2457T
uugauaaaaaaaa

SEQ ID NO: 1900895 - RNA, 21 nt, Shigella flexneri 2a str. 2457T
uucuugcuccacguucagaga

SEQ ID NO: 1900896 - RNA, 16 nt, Shigella flexneri 2a str. 2457T
uucuugcuguuugcga

SEQ ID NO: 1900897 - RNA, 14 nt, Shigella flexneri 2a str. 2457T
uucuugccuuuccu

SEQ ID NO: 1900898 - RNA, 21 nt, Shigella flexneri 2a str. 2457T
uucuuugagcuucgccuggac

SEQ ID NO: 1900899 - RNA, 19 nt, Shigella flexneri 2a str. 2457T
uucuuuguagaugauuuuu

SEQ ID NO: 1900900 - RNA, 13 nt, Shigella flexneri 2a str. 2457T
uucuuugacaaau

SEQ ID NO: 1900901 - RNA, 23 nt, Shigella flexneri 2a str. 2457T
uugaaacgaaaucuuguuuuuuu

SEQ ID NO: 1900902 - RNA, 19 nt, Shigella flexneri 2a str. 2457T
uugaacauaucagcgcaaa

SEQ ID NO: 1900903 - RNA, 11 nt, Shigella flexneri 2a str. 2457T
uugacaacauc

SEQ ID NO: 1900904 - RNA, 12 nt, Shigella flexneri 2a str. 2457T
uugaccugaaua

SEQ ID NO: 1900905 - RNA, 21 nt, Shigella flexneri 2a str. 2457T
uugacgcgucuuaucaggccu

SEQ ID NO: 1900906 - RNA, 12 nt, Shigella flexneri 2a str. 2457T
uugagaaaaacc

SEQ ID NO: 1900907 - RNA, 13 nt, Shigella flexneri 2a str. 2457T
uugagaaaaaccu

SEQ ID NO: 1900908 - RNA, 15 nt, Shigella flexneri 2a str. 2457T
uugaauugcucagua

SEQ ID NO: 1900909 - RNA, 21 nt, Shigella flexneri 2a str. 2457T
uugaaccuaagcuuucgagca

SEQ ID NO: 1900910 - RNA, 15 nt, Shigella flexneri 2a str. 2457T
uugaacucugaaucg

SEQ ID NO: 1900911 - RNA, 16 nt, Shigella flexneri 2a str. 2457T
uugaacuuuaagcuga

SEQ ID NO: 1900912 - RNA, 14 nt, Shigella flexneri 2a str. 2457T
uuguugauaaggaa

SEQ ID NO: 1900913 - RNA, 15 nt, Shigella flexneri 2a str. 2457T
uuguugcaggaacag

SEQ ID NO: 1900914 - RNA, 16 nt, Shigella flexneri 2a str. 2457T
uuguuuaugccggaug

SEQ ID NO: 1900915 - RNA, 19 nt, Shigella flexneri 2a str. 2457T
uuguugccgcccguuuucu

SEQ ID NO: 1900916 - RNA, 23 nt, Shigella flexneri 2a str. 2457T
uuguugcgcugaaacuuuaccaa

SEQ ID NO: 1900917 - RNA, 16 nt, Shigella flexneri 2a str. 2457T
uuguugcuauggggaa

SEQ ID NO: 1900918 - RNA, 11 nt, Shigella flexneri 2a str. 2457T
uugugaugcaa

SEQ ID NO: 1900919 - RNA, 20 nt, Shigella flexneri 2a str. 2457T
uugugaacgagaaaaugacg

SEQ ID NO: 1900920 - RNA, 15 nt, Shigella flexneri 2a str. 2457T
uuguguaaguuuaac

SEQ ID NO: 1900921 - RNA, 16 nt, Shigella flexneri 2a str. 2457T
uuguguuuauuuaaug

SEQ ID NO: 1900922 - RNA, 11 nt, Shigella flexneri 2a str. 2457T
uugucuucaau

SEQ ID NO: 1900923 - RNA, 19 nt, Shigella flexneri 2a str. 2457T
uugucgcacauuucaauca

SEQ ID NO: 1900924 - RNA, 17 nt, Shigella flexneri 2a str. 2457T
uugucgauaaacaguuu

SEQ ID NO: 1900925 - RNA, 15 nt, Shigella flexneri 2a str. 2457T
uugucgaaguuacca

SEQ ID NO: 1900926 - RNA, 14 nt, Shigella flexneri 2a str. 2457T
uuguccucaaugau

SEQ ID NO: 1900927 - RNA, 18 nt, Shigella flexneri 2a str. 2457T
uugucaacgacguaccaa

SEQ ID NO: 1900928 - RNA, 21 nt, Shigella flexneri 2a str. 2457T
uuguagccaauaaaugccacc

SEQ ID NO: 1900929 - RNA, 13 nt, Shigella flexneri 2a str. 2457T
uuguagagcagca

SEQ ID NO: 1900930 - RNA, 23 nt, Shigella flexneri 2a str. 2457T
uuguaggcggauaaggcguuuuc

SEQ ID NO: 1900931 - RNA, 11 nt, Shigella flexneri 2a str. 2457T
uuguauuuaaa

SEQ ID NO: 1900932 - RNA, 15 nt, Shigella flexneri 2a str. 2457T
uuguaguuugauaau

SEQ ID NO: 1900933 - RNA, 12 nt, Shigella flexneri 2a str. 2457T
uuguaaaugaac

SEQ ID NO: 1900934 - RNA, 23 nt, Shigella flexneri 2a str. 2457T
uuguaacaauccgauaaucccuu

SEQ ID NO: 1900935 - RNA, 13 nt, Shigella flexneri 2a str. 2457T
uuguagaccugau

SEQ ID NO: 1900936 - RNA, 19 nt, Shigella flexneri 2a str. 2457T
uuguaaagaccauugaugc

SEQ ID NO: 1900937 - RNA, 19 nt, Shigella flexneri 2a str. 2457T
uuuaccaccgucaaaaaaa

SEQ ID NO: 1900938 - RNA, 21 nt, Shigella flexneri 2a str. 2457T
uuuaccaccgucaaaaaaacg

SEQ ID NO: 1900939 - RNA, 13 nt, Shigella flexneri 2a str. 2457T
uuuaccaauauaa

SEQ ID NO: 1900940 - RNA, 13 nt, Shigella flexneri 2a str. 2457T
uuuaccagcagcc

SEQ ID NO: 1900941 - RNA, 14 nt, Shigella flexneri 2a str. 2457T
uuuacauccggcaa

SEQ ID NO: 1900942 - RNA, 21 nt, Shigella flexneri 2a str. 2457T
uuuacaucaucagaaaugcca

SEQ ID NO: 1900943 - RNA, 22 nt, Shigella flexneri 2a str. 2457T
uuuacauuaucgcgucuaaauu

SEQ ID NO: 1900944 - RNA, 16 nt, Shigella flexneri 2a str. 2457T
uuuacccaauccccca

SEQ ID NO: 1900945 - RNA, 14 nt, Shigella flexneri 2a str. 2457T
uuuacccagcagca

SEQ ID NO: 1900946 - RNA, 11 nt, Shigella flexneri 2a str. 2457T
uuuacccagcg

SEQ ID NO: 1900947 - RNA, 18 nt, Shigella flexneri 2a str. 2457T
uuuacccaggccugccca

SEQ ID NO: 1900948 - RNA, 15 nt, Shigella flexneri 2a str. 2457T
uuuacaagcaacuug

SEQ ID NO: 1900949 - RNA, 12 nt, Shigella flexneri 2a str. 2457T
uuuaauuuuuca

SEQ ID NO: 1900950 - RNA, 15 nt, Shigella flexneri 2a str. 2457T
uuuaauauuaaacca

SEQ ID NO: 1900951 - RNA, 16 nt, Shigella flexneri 2a str. 2457T
uuuaauauuaaaccac

SEQ ID NO: 1900952 - RNA, 18 nt, Shigella flexneri 2a str. 2457T
uuuaaugccacauuagau

SEQ ID NO: 1900953 - RNA, 16 nt, Shigella flexneri 2a str. 2457T
uuuaaugccaaucuuc

SEQ ID NO: 1900954 - RNA, 18 nt, Shigella flexneri 2a str. 2457T
uuuaagcuggguaaaugc

SEQ ID NO: 1900955 - RNA, 15 nt, Shigella flexneri 2a str. 2457T
uuuaaggguauuuuu

SEQ ID NO: 1900956 - RNA, 20 nt, Shigella flexneri 2a str. 2457T
uuuaauauccggugcauuca

SEQ ID NO: 1900957 - RNA, 12 nt, Shigella flexneri 2a str. 2457T
uuuaaacauuaa

SEQ ID NO: 1900958 - RNA, 19 nt, Shigella flexneri 2a str. 2457T
uuuaaacagagauuacuuu

SEQ ID NO: 1900959 - RNA, 20 nt, Shigella flexneri 2a str. 2457T
uuuaaagagacagaaucagg

SEQ ID NO: 1900960 - RNA, 22 nt, Shigella flexneri 2a str. 2457T
uuuaacuucgcguucuguggca

SEQ ID NO: 1900961 - RNA, 14 nt, Shigella flexneri 2a str. 2457T
uuuaacuuuaauuu

SEQ ID NO: 1900962 - RNA, 15 nt, Shigella flexneri 2a str. 2457T
uuuaagaaaaaagau

SEQ ID NO: 1900963 - RNA, 16 nt, Shigella flexneri 2a str. 2457T
uugguccuggucugau

SEQ ID NO: 1900964 - RNA, 17 nt, Shigella flexneri 2a str. 2457T
uugguaacaugcucuuu

SEQ ID NO: 1900965 - RNA, 18 nt, Shigella flexneri 2a str. 2457T
uugguaaaugcgaauagc

SEQ ID NO: 1900966 - RNA, 15 nt, Shigella flexneri 2a str. 2457T
uuggguuucgaauua

SEQ ID NO: 1900967 - RNA, 22 nt, Shigella flexneri 2a str. 2457T
uuggugauauucauggugaaua

SEQ ID NO: 1900968 - RNA, 14 nt, Shigella flexneri 2a str. 2457T
uuggucgaaauaau

SEQ ID NO: 1900969 - RNA, 13 nt, Shigella flexneri 2a str. 2457T
uuguaaaagaagg

SEQ ID NO: 1900970 - RNA, 16 nt, Shigella flexneri 2a str. 2457T
uugguuucgaggaucc

SEQ ID NO: 1900971 - RNA, 15 nt, Shigella flexneri 2a str. 2457T
uuggcaccaucccua

SEQ ID NO: 1900972 - RNA, 17 nt, Shigella flexneri 2a str. 2457T
uuggcuucguguacaaa

SEQ ID NO: 1900973 - RNA, 20 nt, Shigella flexneri 2a str. 2457T
uuggggcauauuaucagcaa

SEQ ID NO: 1900974 - RNA, 23 nt, Shigella flexneri 2a str. 2457T
uuggggaggggucguuuuuuauu

SEQ ID NO: 1900975 - RNA, 14 nt, Shigella flexneri 2a str. 2457T
uugcuucaccagca

SEQ ID NO: 1900976 - RNA, 18 nt, Shigella flexneri 2a str. 2457T
uugcuggacgcauugcau

SEQ ID NO: 1900977 - RNA, 20 nt, Shigella flexneri 2a str. 2457T
uugcuggauaagaugcuaca

SEQ ID NO: 1900978 - RNA, 15 nt, Shigella flexneri 2a str. 2457T
uugcugcugaagcaa

SEQ ID NO: 1900979 - RNA, 15 nt, Shigella flexneri 2a str. 2457T
uugcuuguucgaugc

SEQ ID NO: 1900980 - RNA, 16 nt, Shigella flexneri 2a str. 2457T
uuggcaaucagcggca

SEQ ID NO: 1900981 - RNA, 16 nt, Shigella flexneri 2a str. 2457T
uuggcaagauaggcau

SEQ ID NO: 1900982 - RNA, 23 nt, Shigella flexneri 2a str. 2457T
uuggauaggcaccgccaaagaua

SEQ ID NO: 1900983 - RNA, 18 nt, Shigella flexneri 2a str. 2457T
uuggaucuguugcuggcu

SEQ ID NO: 1900984 - RNA, 16 nt, Shigella flexneri 2a str. 2457T
uuggauaggcaccgcc

SEQ ID NO: 1900985 - RNA, 18 nt, Shigella flexneri 2a str. 2457T
uugccagaaauccaggcc

SEQ ID NO: 1900986 - RNA, 22 nt, Shigella flexneri 2a str. 2457T
uugccacugcccgagaacagca

SEQ ID NO: 1900987 - RNA, 14 nt, Shigella flexneri 2a str. 2457T
uugccacugccggu

SEQ ID NO: 1900988 - RNA, 18 nt, Shigella flexneri 2a str. 2457T
uugcauagcggcgacuug

SEQ ID NO: 1900989 - RNA, 19 nt, Shigella flexneri 2a str. 2457T
uugccaguccuaaaaacag

SEQ ID NO: 1900990 - RNA, 15 nt, Shigella flexneri 2a str. 2457T
uugccagauaaacau

SEQ ID NO: 1900991 - RNA, 14 nt, Shigella flexneri 2a str. 2457T
uugccagauaaaua

SEQ ID NO: 1900992 - RNA, 20 nt, Shigella flexneri 2a str. 2457T
uugccagaucgccugccgcc

SEQ ID NO: 1900993 - RNA, 12 nt, Shigella flexneri 2a str. 2457T
uugccagcgcca

SEQ ID NO: 1900994 - RNA, 12 nt, Shigella flexneri 2a str. 2457T
uugcaggaucag

SEQ ID NO: 1900995 - RNA, 22 nt, Shigella flexneri 2a str. 2457T
uugcaguuccugccagauuugc

SEQ ID NO: 1900996 - RNA, 22 nt, Shigella flexneri 2a str. 2457T
uugcauaaaugccgcaaugugc

SEQ ID NO: 1900997 - RNA, 22 nt, Shigella flexneri 2a str. 2457T
uugcauaaugguggaguggccc

SEQ ID NO: 1900998 - RNA, 18 nt, Shigella flexneri 2a str. 2457T
uugccagugaaaguuuuc

SEQ ID NO: 1900999 - RNA, 18 nt, Shigella flexneri 2a str. 2457T
uugccgggcgugcugccg

SEQ ID NO: 1901000 - RNA, 19 nt, Shigella flexneri 2a str. 2457T
uugccguccggcaucgcaa

SEQ ID NO: 1901001 - RNA, 13 nt, Shigella flexneri 2a str. 2457T
uugccgugugccg

SEQ ID NO: 1901002 - RNA, 22 nt, Shigella flexneri 2a str. 2457T
uugccguuaaaacuaaaaacag

SEQ ID NO: 1901003 - RNA, 18 nt, Shigella flexneri 2a str. 2457T
uugccucguucuucccuc

SEQ ID NO: 1901004 - RNA, 16 nt, Shigella flexneri 2a str. 2457T
uugcuccugcucauca

SEQ ID NO: 1901005 - RNA, 13 nt, Shigella flexneri 2a str. 2457T
uugcuccauccau

SEQ ID NO: 1901006 - RNA, 16 nt, Shigella flexneri 2a str. 2457T
uugcucucgggcagua

SEQ ID NO: 1901007 - RNA, 20 nt, Shigella flexneri 2a str. 2457T
uugcucugguucaccauucu

SEQ ID NO: 1901008 - RNA, 20 nt, Shigella flexneri 2a str. 2457T
uugcugcgccccacaccacc

SEQ ID NO: 1901009 - RNA, 20 nt, Shigella flexneri 2a str. 2457T
uugcugcgcccgcagcggcg

SEQ ID NO: 1901010 - RNA, 20 nt, Shigella flexneri 2a str. 2457T
uugcugcggcguuccccagu

SEQ ID NO: 1901011 - RNA, 15 nt, Shigella flexneri 2a str. 2457T
uugcugcguggaauu

SEQ ID NO: 1901012 - RNA, 19 nt, Shigella flexneri 2a str. 2457T
uugcgguaagcugaugacg

SEQ ID NO: 1901013 - RNA, 12 nt, Shigella flexneri 2a str. 2457T
uugcguaacuga

SEQ ID NO: 1901014 - RNA, 16 nt, Shigella flexneri 2a str. 2457T
uugcuaauuuagugac

SEQ ID NO: 1901015 - RNA, 19 nt, Shigella flexneri 2a str. 2457T
uugcuaaccaacaaugcaa

SEQ ID NO: 1901016 - RNA, 19 nt, Shigella flexneri 2a str. 2457T
uugcuaacuggaaaggaau

SEQ ID NO: 1901017 - RNA, 17 nt, Shigella flexneri 2a str. 2457T
uugcuaccgcgaugacc

SEQ ID NO: 1901018 - RNA, 23 nt, Shigella flexneri 2a str. 2457T
uugcuaccgcuucgcucacauca

SEQ ID NO: 1901019 - RNA, 23 nt, Shigella flexneri 2a str. 2457T
uugcuaccccugagacaguuauu

SEQ ID NO: 1901020 - RNA, 19 nt, Shigella flexneri 2a str. 2457T
uugcuaucgcgaaucccua

SEQ ID NO: 1901021 - RNA, 15 nt, Shigella flexneri 2a str. 2457T
uugcuaucgggaaua

SEQ ID NO: 1901022 - RNA, 18 nt, Shigella flexneri 2a str. 2457T
uugccugugcaaccuuuu

SEQ ID NO: 1901023 - RNA, 15 nt, Shigella flexneri 2a str. 2457T
uugccugugcaaccu

SEQ ID NO: 1901024 - RNA, 20 nt, Shigella flexneri 2a str. 2457T
uugccugauggccugcucaa

SEQ ID NO: 1901025 - RNA, 21 nt, Shigella flexneri 2a str. 2457T
uugccugugacuuucugagau

SEQ ID NO: 1901026 - RNA, 16 nt, Shigella flexneri 2a str. 2457T
uugccugauuuuauuu

SEQ ID NO: 1901027 - RNA, 19 nt, Shigella flexneri 2a str. 2457T
uugccugcgaagcucuuuc

SEQ ID NO: 1901028 - RNA, 19 nt, Shigella flexneri 2a str. 2457T
uugcggaaacugucaauaa

SEQ ID NO: 1901029 - RNA, 16 nt, Shigella flexneri 2a str. 2457T
uugcggcuauauucaa

SEQ ID NO: 1901030 - RNA, 18 nt, Shigella flexneri 2a str. 2457T
uugcgggccaaagaccag

SEQ ID NO: 1901031 - RNA, 24 nt, Shigella flexneri 2a str. 2457T
uuccucuucgcguaacugaagcau

SEQ ID NO: 1901032 - RNA, 14 nt, Shigella flexneri 2a str. 2457T
uuccugaagcgcug

SEQ ID NO: 1901033 - RNA, 18 nt, Shigella flexneri 2a str. 2457T
uuccucgucccaaaagcu

SEQ ID NO: 1901034 - RNA, 18 nt, Shigella flexneri 2a str. 2457T
uuccuccugucuucccug

SEQ ID NO: 1901035 - RNA, 20 nt, Shigella flexneri 2a str. 2457T
uuccuccugucuucccugcu

SEQ ID NO: 1901036 - RNA, 21 nt, Shigella flexneri 2a str. 2457T
uuccuccggcaccgggcuuug

SEQ ID NO: 1901037 - RNA, 16 nt, Shigella flexneri 2a str. 2457T
uuccucccuuucaccc

SEQ ID NO: 1901038 - RNA, 13 nt, Shigella flexneri 2a str. 2457T
uuccuccauugaa

SEQ ID NO: 1901039 - RNA, 18 nt, Shigella flexneri 2a str. 2457T
uuccuaucuucauggaga

SEQ ID NO: 1901040 - RNA, 17 nt, Shigella flexneri 2a str. 2457T
uuccggcguccaccugc

SEQ ID NO: 1901041 - RNA, 23 nt, Shigella flexneri 2a str. 2457T
uuccggcagaagcaaucauccca

SEQ ID NO: 1901042 - RNA, 15 nt, Shigella flexneri 2a str. 2457T
uuccggccaucgccu

SEQ ID NO: 1901043 - RNA, 16 nt, Shigella flexneri 2a str. 2457T
uuccggcaacaaugcc

SEQ ID NO: 1901044 - RNA, 18 nt, Shigella flexneri 2a str. 2457T
uuccgggagcaauuugua

SEQ ID NO: 1901045 - RNA, 20 nt, Shigella flexneri 2a str. 2457T
uuccgggguaaauuucuucc

SEQ ID NO: 1901046 - RNA, 14 nt, Shigella flexneri 2a str. 2457T
uuccuaaaguuguu

SEQ ID NO: 1901047 - RNA, 14 nt, Shigella flexneri 2a str. 2457T
uuccugcaucgccu

SEQ ID NO: 1901048 - RNA, 17 nt, Shigella flexneri 2a str. 2457T
uuccugcgcuuccagcu

SEQ ID NO: 1901049 - RNA, 22 nt, Shigella flexneri 2a str. 2457T
uuccugcggagcaaccugcacg

SEQ ID NO: 1901050 - RNA, 23 nt, Shigella flexneri 2a str. 2457T
uuccugcggcagacgcucgccau

SEQ ID NO: 1901051 - RNA, 20 nt, Shigella flexneri 2a str. 2457T
uuccugauaaccuuccagcu

SEQ ID NO: 1901052 - RNA, 15 nt, Shigella flexneri 2a str. 2457T
uuccugagugaauau

SEQ ID NO: 1901053 - RNA, 16 nt, Shigella flexneri 2a str. 2457T
uuccugcaacuucucu

SEQ ID NO: 1901054 - RNA, 18 nt, Shigella flexneri 2a str. 2457T
uuccugccagauuugcug

SEQ ID NO: 1901055 - RNA, 15 nt, Shigella flexneri 2a str. 2457T
uuccuuaacauccau

SEQ ID NO: 1901056 - RNA, 20 nt, Shigella flexneri 2a str. 2457T
uuccugggauaugagcgauu

SEQ ID NO: 1901057 - RNA, 15 nt, Shigella flexneri 2a str. 2457T
uuccuggagcaggag

SEQ ID NO: 1901058 - RNA, 15 nt, Shigella flexneri 2a str. 2457T
uuccuugaaaaagag

SEQ ID NO: 1901059 - RNA, 17 nt, Shigella flexneri 2a str. 2457T
uuccuuguuuaaggaaa

SEQ ID NO: 1901060 - RNA, 20 nt, Shigella flexneri 2a str. 2457T
uuccuucgcuuccuguauau

SEQ ID NO: 1901061 - RNA, 18 nt, Shigella flexneri 2a str. 2457T
uuccuucacgugacaaaa

SEQ ID NO: 1901062 - RNA, 17 nt, Shigella flexneri 2a str. 2457T
uuccuuucccuauuuuu

SEQ ID NO: 1901063 - RNA, 20 nt, Shigella flexneri 2a str. 2457T
uucgaaaauggccucggcua

SEQ ID NO: 1901064 - RNA, 14 nt, Shigella flexneri 2a str. 2457T
uucgaaaaucucau

SEQ ID NO: 1901065 - RNA, 16 nt, Shigella flexneri 2a str. 2457T
uucgaaaaucucauau

SEQ ID NO: 1901066 - RNA, 15 nt, Shigella flexneri 2a str. 2457T
uucgacaacugcuga

SEQ ID NO: 1901067 - RNA, 17 nt, Shigella flexneri 2a str. 2457T
uucgaccggguuucuua

SEQ ID NO: 1901068 - RNA, 17 nt, Shigella flexneri 2a str. 2457T
uucgacgacaacgcggc

SEQ ID NO: 1901069 - RNA, 20 nt, Shigella flexneri 2a str. 2457T
uucgacgacaacgcggcaca

SEQ ID NO: 1901070 - RNA, 22 nt, Shigella flexneri 2a str. 2457T
uucgaaugccgucgaggaacau

SEQ ID NO: 1901071 - RNA, 18 nt, Shigella flexneri 2a str. 2457T
uucgaauauucugaagca

SEQ ID NO: 1901072 - RNA, 22 nt, Shigella flexneri 2a str. 2457T
uucgagcaucacaucaaauccc

SEQ ID NO: 1901073 - RNA, 15 nt, Shigella flexneri 2a str. 2457T
uucgagauucuuaaa

SEQ ID NO: 1901074 - RNA, 22 nt, Shigella flexneri 2a str. 2457T
uucgagucauauucugaaauau

SEQ ID NO: 1901075 - RNA, 14 nt, Shigella flexneri 2a str. 2457T
uucgacggcaucag

SEQ ID NO: 1901076 - RNA, 12 nt, Shigella flexneri 2a str. 2457T
uucgacuucauc

SEQ ID NO: 1901077 - RNA, 13 nt, Shigella flexneri 2a str. 2457T
uucgacuuuaccg

SEQ ID NO: 1901078 - RNA, 17 nt, Shigella flexneri 2a str. 2457T
uucgacuuuaccgccuu

SEQ ID NO: 1901079 - RNA, 19 nt, Shigella flexneri 2a str. 2457T
uucgaugaugccggaauca

SEQ ID NO: 1901080 - RNA, 16 nt, Shigella flexneri 2a str. 2457T
uucgaugcggcucagc

SEQ ID NO: 1901081 - RNA, 17 nt, Shigella flexneri 2a str. 2457T
uucgauaaacucaauca

SEQ ID NO: 1901082 - RNA, 20 nt, Shigella flexneri 2a str. 2457T
uucgcacaccgcugacuuuc

SEQ ID NO: 1901083 - RNA, 20 nt, Shigella flexneri 2a str. 2457T
uucgcacgaaccguaaaagc

SEQ ID NO: 1901084 - RNA, 15 nt, Shigella flexneri 2a str. 2457T
uucgcaaaaaaccau

SEQ ID NO: 1901085 - RNA, 19 nt, Shigella flexneri 2a str. 2457T
uucgcaaaaaaccaucccu

SEQ ID NO: 1901086 - RNA, 19 nt, Shigella flexneri 2a str. 2457T
uucgccgguuccagcuuca

SEQ ID NO: 1901087 - RNA, 19 nt, Shigella flexneri 2a str. 2457T
uucgcgaaucgccacaacu

SEQ ID NO: 1901088 - RNA, 16 nt, Shigella flexneri 2a str. 2457T
uucgcggaauuucaga

SEQ ID NO: 1901089 - RNA, 21 nt, Shigella flexneri 2a str. 2457T
uucgcuaccugagucaucaac

SEQ ID NO: 1901090 - RNA, 15 nt, Shigella flexneri 2a str. 2457T
uucgcuaccuuucag

SEQ ID NO: 1901091 - RNA, 18 nt, Shigella flexneri 2a str. 2457T
uucgcguaguaaagccuu

SEQ ID NO: 1901092 - RNA, 16 nt, Shigella flexneri 2a str. 2457T
uucgcugccacaccau

SEQ ID NO: 1901093 - RNA, 21 nt, Shigella flexneri 2a str. 2457T
uucgcuccccugcaaauuauu

SEQ ID NO: 1901094 - RNA, 15 nt, Shigella flexneri 2a str. 2457T
uucgcugacaguacc

SEQ ID NO: 1901095 - RNA, 17 nt, Shigella flexneri 2a str. 2457T
uucgcugaaaggcgauu

SEQ ID NO: 1901096 - RNA, 13 nt, Shigella flexneri 2a str. 2457T
uucgcuucuucag

SEQ ID NO: 1901097 - RNA, 17 nt, Shigella flexneri 2a str. 2457T
uucgcugaauaccgauu

SEQ ID NO: 1901098 - RNA, 14 nt, Shigella flexneri 2a str. 2457T
uucgcuuucacuca

SEQ ID NO: 1901099 - RNA, 18 nt, Shigella flexneri 2a str. 2457T
uucgcuugaucuuccuga

SEQ ID NO: 1901100 - RNA, 20 nt, Shigella flexneri 2a str. 2457T
uucgccuccuguucugugcg

SEQ ID NO: 1901101 - RNA, 14 nt, Shigella flexneri 2a str. 2457T
uucgccguuuucuu

SEQ ID NO: 1901102 - RNA, 15 nt, Shigella flexneri 2a str. 2457T
uucgccugaaauaau

SEQ ID NO: 1901103 - RNA, 23 nt, Shigella flexneri 2a str. 2457T
uucgccgcugcgaucgcaaaucc

SEQ ID NO: 1901104 - RNA, 15 nt, Shigella flexneri 2a str. 2457T
uucgcccgccagcgu

SEQ ID NO: 1901105 - RNA, 20 nt, Shigella flexneri 2a str. 2457T
uucgcagcuuauuucuguga

SEQ ID NO: 1901106 - RNA, 20 nt, Shigella flexneri 2a str. 2457T
uucgccaaaugucaccagcc

SEQ ID NO: 1901107 - RNA, 13 nt, Shigella flexneri 2a str. 2457T
uucgccaguuuuu

SEQ ID NO: 1901108 - RNA, 16 nt, Shigella flexneri 2a str. 2457T
uucgccaggacagaga

SEQ ID NO: 1901109 - RNA, 13 nt, Shigella flexneri 2a str. 2457T
uucgccaggcacu

SEQ ID NO: 1901110 - RNA, 18 nt, Shigella flexneri 2a str. 2457T
uucgccaggcacuuucag

SEQ ID NO: 1901111 - RNA, 15 nt, Shigella flexneri 2a str. 2457T
uuccgcaccugccag

SEQ ID NO: 1901112 - RNA, 20 nt, Shigella flexneri 2a str. 2457T
uuccgcaccugccagcgccg

SEQ ID NO: 1901113 - RNA, 23 nt, Shigella flexneri 2a str. 2457T
uuccgaccaggcguucugccugg

SEQ ID NO: 1901114 - RNA, 13 nt, Shigella flexneri 2a str. 2457T
uuccgaugagcga

SEQ ID NO: 1901115 - RNA, 14 nt, Shigella flexneri 2a str. 2457T
uuccgcgaaacagg

SEQ ID NO: 1901116 - RNA, 19 nt, Shigella flexneri 2a str. 2457T
uuccgcgucaaucugcccg

SEQ ID NO: 1901117 - RNA, 16 nt, Shigella flexneri 2a str. 2457T
uuccgcgccaaacauu

SEQ ID NO: 1901118 - RNA, 14 nt, Shigella flexneri 2a str. 2457T
uucccggaauaauu

SEQ ID NO: 1901119 - RNA, 17 nt, Shigella flexneri 2a str. 2457T
uucccgccguugccgca

SEQ ID NO: 1901120 - RNA, 20 nt, Shigella flexneri 2a str. 2457T
uucccggaauaauugcgguu

SEQ ID NO: 1901121 - RNA, 14 nt, Shigella flexneri 2a str. 2457T
uucccgggcuucuc

SEQ ID NO: 1901122 - RNA, 18 nt, Shigella flexneri 2a str. 2457T
uucccucccguuucccug

SEQ ID NO: 1901123 - RNA, 13 nt, Shigella flexneri 2a str. 2457T
uucccugacaaau

SEQ ID NO: 1901124 - RNA, 21 nt, Shigella flexneri 2a str. 2457T
uucccugcagucaccugcccu

SEQ ID NO: 1901125 - RNA, 11 nt, Shigella flexneri 2a str. 2457T
uucccuuucag

SEQ ID NO: 1901126 - RNA, 22 nt, Shigella flexneri 2a str. 2457T
uucccuggcguucgguauuaau

SEQ ID NO: 1901127 - RNA, 22 nt, Shigella flexneri 2a str. 2457T
uucccgcagguugggcaauuca

SEQ ID NO: 1901128 - RNA, 16 nt, Shigella flexneri 2a str. 2457T
uucccgcagauaaaua

SEQ ID NO: 1901129 - RNA, 23 nt, Shigella flexneri 2a str. 2457T
uucccgagcggccaaagggagca

SEQ ID NO: 1901130 - RNA, 20 nt, Shigella flexneri 2a str. 2457T
uuccccggaaccugaacucg

SEQ ID NO: 1901131 - RNA, 12 nt, Shigella flexneri 2a str. 2457T
uuccccucugcg

SEQ ID NO: 1901132 - RNA, 15 nt, Shigella flexneri 2a str. 2457T
uuccccuaacucuuu

SEQ ID NO: 1901133 - RNA, 23 nt, Shigella flexneri 2a str. 2457T
uuccccuguugugccagaccaaa

SEQ ID NO: 1901134 - RNA, 17 nt, Shigella flexneri 2a str. 2457T
uuccccccacaaucagc

SEQ ID NO: 1901135 - RNA, 14 nt, Shigella flexneri 2a str. 2457T
uucccccugccaga

SEQ ID NO: 1901136 - RNA, 12 nt, Shigella flexneri 2a str. 2457T
uucccaggcacc

SEQ ID NO: 1901137 - RNA, 18 nt, Shigella flexneri 2a str. 2457T
uucccaucucaauauuag

SEQ ID NO: 1901138 - RNA, 14 nt, Shigella flexneri 2a str. 2457T
uuccaucuccagcu

SEQ ID NO: 1901139 - RNA, 13 nt, Shigella flexneri 2a str. 2457T
uuccauggcagga

SEQ ID NO: 1901140 - RNA, 13 nt, Shigella flexneri 2a str. 2457T
uuccauugccguu

SEQ ID NO: 1901141 - RNA, 22 nt, Shigella flexneri 2a str. 2457T
uuccauugagaaagcccuggcg

SEQ ID NO: 1901142 - RNA, 17 nt, Shigella flexneri 2a str. 2457T
uucccaacaacagcgcg

SEQ ID NO: 1901143 - RNA, 14 nt, Shigella flexneri 2a str. 2457T
uucccaacaacagc

SEQ ID NO: 1901144 - RNA, 16 nt, Shigella flexneri 2a str. 2457T
uuccauuucaucgcca

SEQ ID NO: 1901145 - RNA, 18 nt, Shigella flexneri 2a str. 2457T
uuccagcucggcaaucug

SEQ ID NO: 1901146 - RNA, 12 nt, Shigella flexneri 2a str. 2457T
uuccagcucuua

SEQ ID NO: 1901147 - RNA, 19 nt, Shigella flexneri 2a str. 2457T
uuccagcuucgcuaccuga

SEQ ID NO: 1901148 - RNA, 23 nt, Shigella flexneri 2a str. 2457T
uuccagcuucaaauuagccgcag

SEQ ID NO: 1901149 - RNA, 13 nt, Shigella flexneri 2a str. 2457T
uuccagcuucaaa

SEQ ID NO: 1901150 - RNA, 16 nt, Shigella flexneri 2a str. 2457T
uuccagcauuucuucc

SEQ ID NO: 1901151 - RNA, 14 nt, Shigella flexneri 2a str. 2457T
uuccagcaguucgc

SEQ ID NO: 1901152 - RNA, 19 nt, Shigella flexneri 2a str. 2457T
uuccagcagauauugcccc

SEQ ID NO: 1901153 - RNA, 13 nt, Shigella flexneri 2a str. 2457T
uuccagcacaccc

SEQ ID NO: 1901154 - RNA, 16 nt, Shigella flexneri 2a str. 2457T
uuccagcagaccagca

SEQ ID NO: 1901155 - RNA, 13 nt, Shigella flexneri 2a str. 2457T
uuccagauggaca

SEQ ID NO: 1901156 - RNA, 15 nt, Shigella flexneri 2a str. 2457T
uuccagcaagccacu

SEQ ID NO: 1901157 - RNA, 18 nt, Shigella flexneri 2a str. 2457T
uuccagacucaacaggcc

SEQ ID NO: 1901158 - RNA, 21 nt, Shigella flexneri 2a str. 2457T
uuccagucggcguaauccuga

SEQ ID NO: 1901159 - RNA, 18 nt, Shigella flexneri 2a str. 2457T
uuccaguuccggcaucga

SEQ ID NO: 1901160 - RNA, 17 nt, Shigella flexneri 2a str. 2457T
uuccaguagauucaaca

SEQ ID NO: 1901161 - RNA, 18 nt, Shigella flexneri 2a str. 2457T
uuccagucuucuugcucc

SEQ ID NO: 1901162 - RNA, 20 nt, Shigella flexneri 2a str. 2457T
uuccagucuucuugcuccac

SEQ ID NO: 1901163 - RNA, 19 nt, Shigella flexneri 2a str. 2457T
uuccaguuugcucaaaucc

SEQ ID NO: 1901164 - RNA, 18 nt, Shigella flexneri 2a str. 2457T
uuccaguuccggcauuaa

SEQ ID NO: 1901165 - RNA, 17 nt, Shigella flexneri 2a str. 2457T
uuccaguugcacgccac

SEQ ID NO: 1901166 - RNA, 15 nt, Shigella flexneri 2a str. 2457T
uuccauaugaauucc

SEQ ID NO: 1901167 - RNA, 22 nt, Shigella flexneri 2a str. 2457T
uuccaucgaccaaccuugcgcc

SEQ ID NO: 1901168 - RNA, 17 nt, Shigella flexneri 2a str. 2457T
uuccaucagauucagca

SEQ ID NO: 1901169 - RNA, 16 nt, Shigella flexneri 2a str. 2457T
uuccauaccuaaaaaa

SEQ ID NO: 1901170 - RNA, 17 nt, Shigella flexneri 2a str. 2457T
uuccagaaaagagacgc

SEQ ID NO: 1901171 - RNA, 17 nt, Shigella flexneri 2a str. 2457T
uuccacuuucacgccca

SEQ ID NO: 1901172 - RNA, 19 nt, Shigella flexneri 2a str. 2457T
uuccacucuuucagcacca

SEQ ID NO: 1901173 - RNA, 19 nt, Shigella flexneri 2a str. 2457T
uuccacggaauauuucacc

SEQ ID NO: 1901174 - RNA, 18 nt, Shigella flexneri 2a str. 2457T
uuccacggaauauuucac

SEQ ID NO: 1901175 - RNA, 14 nt, Shigella flexneri 2a str. 2457T
uuccaccucccccu

SEQ ID NO: 1901176 - RNA, 17 nt, Shigella flexneri 2a str. 2457T
uuccacagcucacggcc

SEQ ID NO: 1901177 - RNA, 12 nt, Shigella flexneri 2a str. 2457T
uucacucacgcc

SEQ ID NO: 1901178 - RNA, 13 nt, Shigella flexneri 2a str. 2457T
uucacucacgccg

SEQ ID NO: 1901179 - RNA, 22 nt, Shigella flexneri 2a str. 2457T
uucacugccaccagcagcguuu

SEQ ID NO: 1901180 - RNA, 16 nt, Shigella flexneri 2a str. 2457T
uucacugacgcccguu

SEQ ID NO: 1901181 - RNA, 20 nt, Shigella flexneri 2a str. 2457T
uucacugggcgauuaauaaa

SEQ ID NO: 1901182 - RNA, 15 nt, Shigella flexneri 2a str. 2457T
uucacguucacccau

SEQ ID NO: 1901183 - RNA, 16 nt, Shigella flexneri 2a str. 2457T
uucacgguauuauuca

SEQ ID NO: 1901184 - RNA, 21 nt, Shigella flexneri 2a str. 2457T
uucacggcgauaccaguaaua

SEQ ID NO: 1901185 - RNA, 19 nt, Shigella flexneri 2a str. 2457T
uucacgcuuugcaggcugg

SEQ ID NO: 1901186 - RNA, 21 nt, Shigella flexneri 2a str. 2457T
uucacguugacgcauacagcc

SEQ ID NO: 1901187 - RNA, 23 nt, Shigella flexneri 2a str. 2457T
uucaccgcguaugcccagcgcag

SEQ ID NO: 1901188 - RNA, 15 nt, Shigella flexneri 2a str. 2457T
uucacccauugccgc

SEQ ID NO: 1901189 - RNA, 12 nt, Shigella flexneri 2a str. 2457T
uucaccggugag

SEQ ID NO: 1901190 - RNA, 16 nt, Shigella flexneri 2a str. 2457T
uucaccggugagcugc

SEQ ID NO: 1901191 - RNA, 23 nt, Shigella flexneri 2a str. 2457T
uucacgaaucuauucauuuaugu

SEQ ID NO: 1901192 - RNA, 23 nt, Shigella flexneri 2a str. 2457T
uucacgacauaaacauuccacuu

SEQ ID NO: 1901193 - RNA, 18 nt, Shigella flexneri 2a str. 2457T
uucacgcuaaaagcgauu

SEQ ID NO: 1901194 - RNA, 17 nt, Shigella flexneri 2a str. 2457T
uucacgcaggcgagaau

SEQ ID NO: 1901195 - RNA, 15 nt, Shigella flexneri 2a str. 2457T
uucacgcaaggcaca

SEQ ID NO: 1901196 - RNA, 12 nt, Shigella flexneri 2a str. 2457T
uucagaaaguaa

SEQ ID NO: 1901197 - RNA, 23 nt, Shigella flexneri 2a str. 2457T
uucagaaagcccgaaucaguaau

SEQ ID NO: 1901198 - RNA, 13 nt, Shigella flexneri 2a str. 2457T
uucacuucgucag

SEQ ID NO: 1901199 - RNA, 17 nt, Shigella flexneri 2a str. 2457T
uucacuucuucaauaaa

SEQ ID NO: 1901200 - RNA, 13 nt, Shigella flexneri 2a str. 2457T
uucacuuucugaa

SEQ ID NO: 1901201 - RNA, 17 nt, Shigella flexneri 2a str. 2457T
uucacuuuugcugcaaa

SEQ ID NO: 1901202 - RNA, 19 nt, Shigella flexneri 2a str. 2457T
uucacuuuugcugcaaaau

SEQ ID NO: 1901203 - RNA, 18 nt, Shigella flexneri 2a str. 2457T
uucagaauagacaaaaau

SEQ ID NO: 1901204 - RNA, 16 nt, Shigella flexneri 2a str. 2457T
uucagaauagacaaaa

SEQ ID NO: 1901205 - RNA, 15 nt, Shigella flexneri 2a str. 2457T
uucagaagcugaagc

SEQ ID NO: 1901206 - RNA, 17 nt, Shigella flexneri 2a str. 2457T
uucagaauauucgaaau

SEQ ID NO: 1901207 - RNA, 23 nt, Shigella flexneri 2a str. 2457T
uucagcaauucucucuucagcuu

SEQ ID NO: 1901208 - RNA, 11 nt, Shigella flexneri 2a str. 2457T
uucagcaccag

SEQ ID NO: 1901209 - RNA, 12 nt, Shigella flexneri 2a str. 2457T
uucagcaccaga

SEQ ID NO: 1901210 - RNA, 17 nt, Shigella flexneri 2a str. 2457T
uucagcaaucucuucaa

SEQ ID NO: 1901211 - RNA, 22 nt, Shigella flexneri 2a str. 2457T
uucagcaagcgauaauuuaugc

SEQ ID NO: 1901212 - RNA, 22 nt, Shigella flexneri 2a str. 2457T
uucagcaccgcgcuauuuuccu

SEQ ID NO: 1901213 - RNA, 20 nt, Shigella flexneri 2a str. 2457T
uucagcagcucaucaagcug

SEQ ID NO: 1901214 - RNA, 17 nt, Shigella flexneri 2a str. 2457T
uucagcaguucugccag

SEQ ID NO: 1901215 - RNA, 18 nt, Shigella flexneri 2a str. 2457T
uucagccaguugaucucu

SEQ ID NO: 1901216 - RNA, 21 nt, Shigella flexneri 2a str. 2457T
uucagccauacguugcauaaa

SEQ ID NO: 1901217 - RNA, 21 nt, Shigella flexneri 2a str. 2457T
uucagcaucuggaaagucuga

SEQ ID NO: 1901218 - RNA, 22 nt, Shigella flexneri 2a str. 2457T
uucagcaugcauuuaagaaaaa

SEQ ID NO: 1901219 - RNA, 20 nt, Shigella flexneri 2a str. 2457T
uucagauugcagacaaagug

SEQ ID NO: 1901220 - RNA, 21 nt, Shigella flexneri 2a str. 2457T
uucagcaaaccacugauaagc

SEQ ID NO: 1901221 - RNA, 23 nt, Shigella flexneri 2a str. 2457T
uucagauuaugucgcucaaugug

SEQ ID NO: 1901222 - RNA, 13 nt, Shigella flexneri 2a str. 2457T
uucagauguuccg

SEQ ID NO: 1901223 - RNA, 21 nt, Shigella flexneri 2a str. 2457T
uucagauuguugacaaagugc

SEQ ID NO: 1901224 - RNA, 20 nt, Shigella flexneri 2a str. 2457T
uucagauucagcgucgucag

SEQ ID NO: 1901225 - RNA, 13 nt, Shigella flexneri 2a str. 2457T
uucagaucuuuca

SEQ ID NO: 1901226 - RNA, 15 nt, Shigella flexneri 2a str. 2457T
uucagauaaugcccg

SEQ ID NO: 1901227 - RNA, 23 nt, Shigella flexneri 2a str. 2457T
uucagauaauccccaaugaccuu

SEQ ID NO: 1901228 - RNA, 16 nt, Shigella flexneri 2a str. 2457T
uucaccagcaucgccg

SEQ ID NO: 1901229 - RNA, 18 nt, Shigella flexneri 2a str. 2457T
uucaccagcacuucacug

SEQ ID NO: 1901230 - RNA, 23 nt, Shigella flexneri 2a str. 2457T
uucaccagaccugaaaccgccuu

SEQ ID NO: 1901231 - RNA, 14 nt, Shigella flexneri 2a str. 2457T
uucaccagcgcacg

SEQ ID NO: 1901232 - RNA, 13 nt, Shigella flexneri 2a str. 2457T
uucaccauuuuuu

SEQ ID NO: 1901233 - RNA, 12 nt, Shigella flexneri 2a str. 2457T
uucacaucauca

SEQ ID NO: 1901234 - RNA, 20 nt, Shigella flexneri 2a str. 2457T
uucacaucaccauagccuaa

SEQ ID NO: 1901235 - RNA, 23 nt, Shigella flexneri 2a str. 2457T
uucacaggccgccaggcagagcu

SEQ ID NO: 1901236 - RNA, 23 nt, Shigella flexneri 2a str. 2457T
uucacaguaaugauuuaaaacca

SEQ ID NO: 1901237 - RNA, 17 nt, Shigella flexneri 2a str. 2457T
uucacagaaggccagga

SEQ ID NO: 1901238 - RNA, 11 nt, Shigella flexneri 2a str. 2457T
uucacauguuc

SEQ ID NO: 1901239 - RNA, 15 nt, Shigella flexneri 2a str. 2457T
uucacauuuaaacaa

SEQ ID NO: 1901240 - RNA, 14 nt, Shigella flexneri 2a str. 2457T
uucaauuuguucua

SEQ ID NO: 1901241 - RNA, 20 nt, Shigella flexneri 2a str. 2457T
uucaauucacgaauauuucc

SEQ ID NO: 1901242 - RNA, 16 nt, Shigella flexneri 2a str. 2457T
uucacaaacagcgccu

SEQ ID NO: 1901243 - RNA, 21 nt, Shigella flexneri 2a str. 2457T
uucacaaagacgccaucaauu

SEQ ID NO: 1901244 - RNA, 19 nt, Shigella flexneri 2a str. 2457T
uucacaaccgggcauuuuu

SEQ ID NO: 1901245 - RNA, 17 nt, Shigella flexneri 2a str. 2457T
uucacaaaggcuugcug

SEQ ID NO: 1901246 - RNA, 15 nt, Shigella flexneri 2a str. 2457T
uucacaaguuguccc

SEQ ID NO: 1901247 - RNA, 20 nt, Shigella flexneri 2a str. 2457T
uucacacugaugacaggcua

SEQ ID NO: 1901248 - RNA, 18 nt, Shigella flexneri 2a str. 2457T
uucaaucccgccaaugca

SEQ ID NO: 1901249 - RNA, 18 nt, Shigella flexneri 2a str. 2457T
uucaauauggaaguuuug

SEQ ID NO: 1901250 - RNA, 17 nt, Shigella flexneri 2a str. 2457T
uucaaugcauuaucaga

SEQ ID NO: 1901251 - RNA, 23 nt, Shigella flexneri 2a str. 2457T
uucaaugcugccgggguaaagcg

SEQ ID NO: 1901252 - RNA, 14 nt, Shigella flexneri 2a str. 2457T
uucaauguaucucu

SEQ ID NO: 1901253 - RNA, 19 nt, Shigella flexneri 2a str. 2457T
uucaauaaccugcaaaaua

SEQ ID NO: 1901254 - RNA, 22 nt, Shigella flexneri 2a str. 2457T
uucaauaccgccugcaaauaaa

SEQ ID NO: 1901255 - RNA, 22 nt, Shigella flexneri 2a str. 2457T
uucaauacgcuccaguaccugc

SEQ ID NO: 1901256 - RNA, 17 nt, Shigella flexneri 2a str. 2457T
uucaauacgcucgaaca

SEQ ID NO: 1901257 - RNA, 21 nt, Shigella flexneri 2a str. 2457T
uucaaggagggaucgacagau

SEQ ID NO: 1901258 - RNA, 13 nt, Shigella flexneri 2a str. 2457T
uucaaguaauuca

SEQ ID NO: 1901259 - RNA, 20 nt, Shigella flexneri 2a str. 2457T
uucaugccuguauugguuuc

SEQ ID NO: 1901260 - RNA, 20 nt, Shigella flexneri 2a str. 2457T
uucaugauuuaaaugaagau

SEQ ID NO: 1901261 - RNA, 14 nt, Shigella flexneri 2a str. 2457T
uucaugcacuuggu

SEQ ID NO: 1901262 - RNA, 16 nt, Shigella flexneri 2a str. 2457T
uucauggugcaagaaa

SEQ ID NO: 1901263 - RNA, 17 nt, Shigella flexneri 2a str. 2457T
uucaugcuauuccuuga

SEQ ID NO: 1901264 - RNA, 19 nt, Shigella flexneri 2a str. 2457T
uucauuaugaucaaaauca

SEQ ID NO: 1901265 - RNA, 20 nt, Shigella flexneri 2a str. 2457T
uucauguucagauuguugau

SEQ ID NO: 1901266 - RNA, 20 nt, Shigella flexneri 2a str. 2457T
uucauuaagaacuccugaaa

SEQ ID NO: 1901267 - RNA, 16 nt, Shigella flexneri 2a str. 2457T
uucauuacaccaauac

SEQ ID NO: 1901268 - RNA, 13 nt, Shigella flexneri 2a str. 2457T
uucauuaauauca

SEQ ID NO: 1901269 - RNA, 13 nt, Shigella flexneri 2a str. 2457T
uucauuuacauca

SEQ ID NO: 1901270 - RNA, 12 nt, Shigella flexneri 2a str. 2457T
uucauuguugac

SEQ ID NO: 1901271 - RNA, 15 nt, Shigella flexneri 2a str. 2457T
uucauucaggccaaa

SEQ ID NO: 1901272 - RNA, 18 nt, Shigella flexneri 2a str. 2457T
uucauucaauuaauaaca

SEQ ID NO: 1901273 - RNA, 21 nt, Shigella flexneri 2a str. 2457T
uucauugagcgcaaaugguga

SEQ ID NO: 1901274 - RNA, 20 nt, Shigella flexneri 2a str. 2457T
uucauccguuucucuguuca

SEQ ID NO: 1901275 - RNA, 22 nt, Shigella flexneri 2a str. 2457T
uucauccguuucucuguucagc

SEQ ID NO: 1901276 - RNA, 22 nt, Shigella flexneri 2a str. 2457T
uucaucccgguuauuaaaacga

SEQ ID NO: 1901277 - RNA, 18 nt, Shigella flexneri 2a str. 2457T
uucaucccgaccaaugca

SEQ ID NO: 1901278 - RNA, 17 nt, Shigella flexneri 2a str. 2457T
uucauccuggcacagca

SEQ ID NO: 1901279 - RNA, 19 nt, Shigella flexneri 2a str. 2457T
uucauccuguacgacaaaa

SEQ ID NO: 1901280 - RNA, 23 nt, Shigella flexneri 2a str. 2457T
uucauccuguacgacaaaagaau

SEQ ID NO: 1901281 - RNA, 13 nt, Shigella flexneri 2a str. 2457T
uucaucgcccaca

SEQ ID NO: 1901282 - RNA, 19 nt, Shigella flexneri 2a str. 2457T
uucaucgccuucuugaacc

SEQ ID NO: 1901283 - RNA, 18 nt, Shigella flexneri 2a str. 2457T
uucaucacgaaaaucauu

SEQ ID NO: 1901284 - RNA, 14 nt, Shigella flexneri 2a str. 2457T
uucaucaccagcuc

SEQ ID NO: 1901285 - RNA, 15 nt, Shigella flexneri 2a str. 2457T
uucaucucuucuucc

SEQ ID NO: 1901286 - RNA, 17 nt, Shigella flexneri 2a str. 2457T
uucaucgugcucgcuuu

SEQ ID NO: 1901287 - RNA, 15 nt, Shigella flexneri 2a str. 2457T
uucaucgcuaaaaua

SEQ ID NO: 1901288 - RNA, 17 nt, Shigella flexneri 2a str. 2457T
uucaucgcuaaaauacu

SEQ ID NO: 1901289 - RNA, 19 nt, Shigella flexneri 2a str. 2457T
uucaugaucuuuuuugucg

SEQ ID NO: 1901290 - RNA, 16 nt, Shigella flexneri 2a str. 2457T
uucauaaggaaaauaa

SEQ ID NO: 1901291 - RNA, 23 nt, Shigella flexneri 2a str. 2457T
uucaguguccagcggcauaaaac

SEQ ID NO: 1901292 - RNA, 19 nt, Shigella flexneri 2a str. 2457T
uucagugacuucugccagc

SEQ ID NO: 1901293 - RNA, 18 nt, Shigella flexneri 2a str. 2457T
uucagugacuucugccag

SEQ ID NO: 1901294 - RNA, 15 nt, Shigella flexneri 2a str. 2457T
uucagugcaaaugcc

SEQ ID NO: 1901295 - RNA, 19 nt, Shigella flexneri 2a str. 2457T
uucaguggcuuaucuuccu

SEQ ID NO: 1901296 - RNA, 15 nt, Shigella flexneri 2a str. 2457T
uucaucaaaaaauga

SEQ ID NO: 1901297 - RNA, 16 nt, Shigella flexneri 2a str. 2457T
uucaucaaaaaaugaa

SEQ ID NO: 1901298 - RNA, 20 nt, Shigella flexneri 2a str. 2457T
uucauauuccugacccagca

SEQ ID NO: 1901299 - RNA, 12 nt, Shigella flexneri 2a str. 2457T
uucauauugccg

SEQ ID NO: 1901300 - RNA, 19 nt, Shigella flexneri 2a str. 2457T
uucauaguaagcagauucu

SEQ ID NO: 1901301 - RNA, 22 nt, Shigella flexneri 2a str. 2457T
uucauacggcacuuucaucgcg

SEQ ID NO: 1901302 - RNA, 16 nt, Shigella flexneri 2a str. 2457T
uucagcucaagaaucu

SEQ ID NO: 1901303 - RNA, 21 nt, Shigella flexneri 2a str. 2457T
uucaggaacaccgcacgcaga

SEQ ID NO: 1901304 - RNA, 16 nt, Shigella flexneri 2a str. 2457T
uucaggaaauaaauaa

SEQ ID NO: 1901305 - RNA, 14 nt, Shigella flexneri 2a str. 2457T
uucaggaaauaaau

SEQ ID NO: 1901306 - RNA, 16 nt, Shigella flexneri 2a str. 2457T
uucaggaauucagaaa

SEQ ID NO: 1901307 - RNA, 19 nt, Shigella flexneri 2a str. 2457T
uucaggaauucagaaaaau

SEQ ID NO: 1901308 - RNA, 20 nt, Shigella flexneri 2a str. 2457T
uucagccugacagcacgccc

SEQ ID NO: 1901309 - RNA, 16 nt, Shigella flexneri 2a str. 2457T
uucagcgaucguuuuu

SEQ ID NO: 1901310 - RNA, 14 nt, Shigella flexneri 2a str. 2457T
uucagccccagcac

SEQ ID NO: 1901311 - RNA, 17 nt, Shigella flexneri 2a str. 2457T
uucagccggaauaauca

SEQ ID NO: 1901312 - RNA, 15 nt, Shigella flexneri 2a str. 2457T
uucagccgucaucca

SEQ ID NO: 1901313 - RNA, 11 nt, Shigella flexneri 2a str. 2457T
uucagcggcag

SEQ ID NO: 1901314 - RNA, 21 nt, Shigella flexneri 2a str. 2457T
uucagcggcgcaacccccaca

SEQ ID NO: 1901315 - RNA, 14 nt, Shigella flexneri 2a str. 2457T
uucagccucugccg

SEQ ID NO: 1901316 - RNA, 20 nt, Shigella flexneri 2a str. 2457T
uucaggagaagcaucagccc

SEQ ID NO: 1901317 - RNA, 13 nt, Shigella flexneri 2a str. 2457T
uucaggaugguau

SEQ ID NO: 1901318 - RNA, 17 nt, Shigella flexneri 2a str. 2457T
uucaggaugguauugga

SEQ ID NO: 1901319 - RNA, 10 nt, Shigella flexneri 2a str. 2457T
uucaggucag

SEQ ID NO: 1901320 - RNA, 15 nt, Shigella flexneri 2a str. 2457T
uucagguaauuaaca

SEQ ID NO: 1901321 - RNA, 21 nt, Shigella flexneri 2a str. 2457T
uucaguacguucacgcagcuc

SEQ ID NO: 1901322 - RNA, 18 nt, Shigella flexneri 2a str. 2457T
uucaguacgaaauaacug

SEQ ID NO: 1901323 - RNA, 19 nt, Shigella flexneri 2a str. 2457T
uggcugacugucgcagcca

SEQ ID NO: 1901324 - RNA, 21 nt, Shigella flexneri 2a str. 2457T
uggcugacugucgcagccagc

SEQ ID NO: 1901325 - RNA, 22 nt, Shigella flexneri 2a str. 2457T
uggcugacacuauucgccagca

SEQ ID NO: 1901326 - RNA, 14 nt, Shigella flexneri 2a str. 2457T
uggcugacugucgc

SEQ ID NO: 1901327 - RNA, 23 nt, Shigella flexneri 2a str. 2457T
uggcugagcaaacaguucugcag

SEQ ID NO: 1901328 - RNA, 15 nt, Shigella flexneri 2a str. 2457T
uggcugagcacuauc

SEQ ID NO: 1901329 - RNA, 21 nt, Shigella flexneri 2a str. 2457T
uggcugauuaacguuuccauu

SEQ ID NO: 1901330 - RNA, 16 nt, Shigella flexneri 2a str. 2457T
uggcugcaaagcauuu

SEQ ID NO: 1901331 - RNA, 20 nt, Shigella flexneri 2a str. 2457T
uggcugcaaagcauuuuuuc

SEQ ID NO: 1901332 - RNA, 19 nt, Shigella flexneri 2a str. 2457T
uggcugcgcgaaaacccuc

SEQ ID NO: 1901333 - RNA, 20 nt, Shigella flexneri 2a str. 2457T
uggcugcgcgaaaacccucg

SEQ ID NO: 1901334 - RNA, 21 nt, Shigella flexneri 2a str. 2457T
uggcugccgagcaaaucgcgg

SEQ ID NO: 1901335 - RNA, 13 nt, Shigella flexneri 2a str. 2457T
uggcugugcuauu

SEQ ID NO: 1901336 - RNA, 15 nt, Shigella flexneri 2a str. 2457T
uggcuguucugccuc

SEQ ID NO: 1901337 - RNA, 19 nt, Shigella flexneri 2a str. 2457T
uggcuggccccgucagcaa

SEQ ID NO: 1901338 - RNA, 12 nt, Shigella flexneri 2a str. 2457T
uggcuuuauucg

SEQ ID NO: 1901339 - RNA, 14 nt, Shigella flexneri 2a str. 2457T
ugggaaaugacauu

SEQ ID NO: 1901340 - RNA, 20 nt, Shigella flexneri 2a str. 2457T
uggcuucuuccccggaugag

SEQ ID NO: 1901341 - RNA, 17 nt, Shigella flexneri 2a str. 2457T
uggcuugcgucauccag

SEQ ID NO: 1901342 - RNA, 18 nt, Shigella flexneri 2a str. 2457T
uggcuucgguuuuuauuu

SEQ ID NO: 1901343 - RNA, 15 nt, Shigella flexneri 2a str. 2457T
ugggccagaaaaaac

SEQ ID NO: 1901344 - RNA, 13 nt, Shigella flexneri 2a str. 2457T
ugggcgaugcugg

SEQ ID NO: 1901345 - RNA, 15 nt, Shigella flexneri 2a str. 2457T
ugggcgauuuccuuc

SEQ ID NO: 1901346 - RNA, 21 nt, Shigella flexneri 2a str. 2457T
ugggcgauacgggcucgggca

SEQ ID NO: 1901347 - RNA, 13 nt, Shigella flexneri 2a str. 2457T
ugggcgaggucca

SEQ ID NO: 1901348 - RNA, 16 nt, Shigella flexneri 2a str. 2457T
ugggccagaaaaaacg

SEQ ID NO: 1901349 - RNA, 14 nt, Shigella flexneri 2a str. 2457T
ugggcgcugcugua

SEQ ID NO: 1901350 - RNA, 15 nt, Shigella flexneri 2a str. 2457T
ugggcguagcugggu

SEQ ID NO: 1901351 - RNA, 20 nt, Shigella flexneri 2a str. 2457T
ugggcggcauaucagcgagu

SEQ ID NO: 1901352 - RNA, 19 nt, Shigella flexneri 2a str. 2457T
uggggacaaucaccaugcc

SEQ ID NO: 1901353 - RNA, 12 nt, Shigella flexneri 2a str. 2457T
uggggcuggcgg

SEQ ID NO: 1901354 - RNA, 18 nt, Shigella flexneri 2a str. 2457T
uggggauagcgcugcugc

SEQ ID NO: 1901355 - RNA, 18 nt, Shigella flexneri 2a str. 2457T
ugggcguuacagcuggag

SEQ ID NO: 1901356 - RNA, 14 nt, Shigella flexneri 2a str. 2457T
uggcgucuccugcc

SEQ ID NO: 1901357 - RNA, 19 nt, Shigella flexneri 2a str. 2457T
uggcgucuccugccgagcg

SEQ ID NO: 1901358 - RNA, 20 nt, Shigella flexneri 2a str. 2457T
uggcguccggaaauccucaa

SEQ ID NO: 1901359 - RNA, 23 nt, Shigella flexneri 2a str. 2457T
uggcgucagaccggcaaccagca

SEQ ID NO: 1901360 - RNA, 20 nt, Shigella flexneri 2a str. 2457T
uggcguuacauuuccaggaa

SEQ ID NO: 1901361 - RNA, 16 nt, Shigella flexneri 2a str. 2457T
uggcguucagcgacgu

SEQ ID NO: 1901362 - RNA, 20 nt, Shigella flexneri 2a str. 2457T
uggcguuuccagcaguucca

SEQ ID NO: 1901363 - RNA, 22 nt, Shigella flexneri 2a str. 2457T
uggcguuugaccaacaccggua

SEQ ID NO: 1901364 - RNA, 20 nt, Shigella flexneri 2a str. 2457T
uggcucaucgccuuccagcg

SEQ ID NO: 1901365 - RNA, 19 nt, Shigella flexneri 2a str. 2457T
uggcucaaucgccaccacc

SEQ ID NO: 1901366 - RNA, 13 nt, Shigella flexneri 2a str. 2457T
uggcucaccagca

SEQ ID NO: 1901367 - RNA, 23 nt, Shigella flexneri 2a str. 2457T
uggcuauuuaccaauauaauucc

SEQ ID NO: 1901368 - RNA, 23 nt, Shigella flexneri 2a str. 2457T
uggcuauaaucacucaaaauauc

SEQ ID NO: 1901369 - RNA, 20 nt, Shigella flexneri 2a str. 2457T
uggcgcugauaaaucccgcc

SEQ ID NO: 1901370 - RNA, 22 nt, Shigella flexneri 2a str. 2457T
uggcgcucugguagauaagcaa

SEQ ID NO: 1901371 - RNA, 17 nt, Shigella flexneri 2a str. 2457T
uggcgcuaugcuggaug

SEQ ID NO: 1901372 - RNA, 13 nt, Shigella flexneri 2a str. 2457T
uggcgcguuauca

SEQ ID NO: 1901373 - RNA, 17 nt, Shigella flexneri 2a str. 2457T
uggcgcguuaucagcaa

SEQ ID NO: 1901374 - RNA, 13 nt, Shigella flexneri 2a str. 2457T
uggaaaagaaaac

SEQ ID NO: 1901375 - RNA, 19 nt, Shigella flexneri 2a str. 2457T
uggcgcgaccaaugucagg

SEQ ID NO: 1901376 - RNA, 17 nt, Shigella flexneri 2a str. 2457T
uggcguaaagccuuuua

SEQ ID NO: 1901377 - RNA, 18 nt, Shigella flexneri 2a str. 2457T
uggcggcguugagaaaac

SEQ ID NO: 1901378 - RNA, 16 nt, Shigella flexneri 2a str. 2457T
uggcggaauaccgaca

SEQ ID NO: 1901379 - RNA, 21 nt, Shigella flexneri 2a str. 2457T
uggcggggagggaauccagca

SEQ ID NO: 1901380 - RNA, 22 nt, Shigella flexneri 2a str. 2457T
ugguuaacaaucacaauagaaa

SEQ ID NO: 1901381 - RNA, 21 nt, Shigella flexneri 2a str. 2457T
ugguuagagcacaucacucau

SEQ ID NO: 1901382 - RNA, 15 nt, Shigella flexneri 2a str. 2457T
ugguuacgcagauau

SEQ ID NO: 1901383 - RNA, 12 nt, Shigella flexneri 2a str. 2457T
ugguuacacggg

SEQ ID NO: 1901384 - RNA, 22 nt, Shigella flexneri 2a str. 2457T
ugguucggcaaaaucuuccaga

SEQ ID NO: 1901385 - RNA, 18 nt, Shigella flexneri 2a str. 2457T
ugguucgacggccaguca

SEQ ID NO: 1901386 - RNA, 15 nt, Shigella flexneri 2a str. 2457T
ugguucgcaacggcu

SEQ ID NO: 1901387 - RNA, 18 nt, Shigella flexneri 2a str. 2457T
ugguucccaacaacagcg

SEQ ID NO: 1901388 - RNA, 16 nt, Shigella flexneri 2a str. 2457T
ugguuccgguuuaucc

SEQ ID NO: 1901389 - RNA, 21 nt, Shigella flexneri 2a str. 2457T
ugguuccgguuuauccauccc

SEQ ID NO: 1901390 - RNA, 20 nt, Shigella flexneri 2a str. 2457T
ugguugccagccacaccugg

SEQ ID NO: 1901391 - RNA, 14 nt, Shigella flexneri 2a str. 2457T
ugguugcaugauga

SEQ ID NO: 1901392 - RNA, 14 nt, Shigella flexneri 2a str. 2457T
ugguugucaccgcc

SEQ ID NO: 1901393 - RNA, 15 nt, Shigella flexneri 2a str. 2457T
ugguuuccagcaucg

SEQ ID NO: 1901394 - RNA, 15 nt, Shigella flexneri 2a str. 2457T
ugguuuaugcaauau

SEQ ID NO: 1901395 - RNA, 22 nt, Shigella flexneri 2a str. 2457T
ugguuuuaaagaaucgggcaac

SEQ ID NO: 1901396 - RNA, 17 nt, Shigella flexneri 2a str. 2457T
ugguuugauagcaauac

SEQ ID NO: 1901397 - RNA, 14 nt, Shigella flexneri 2a str. 2457T
ugguuuggaucugu

SEQ ID NO: 1901398 - RNA, 23 nt, Shigella flexneri 2a str. 2457T
uguaaguaaugacaaaauugcug

SEQ ID NO: 1901399 - RNA, 17 nt, Shigella flexneri 2a str. 2457T
ugguuuugcuuuauuaa

SEQ ID NO: 1901400 - RNA, 13 nt, Shigella flexneri 2a str. 2457T
uguaaaugcugcu

SEQ ID NO: 1901401 - RNA, 16 nt, Shigella flexneri 2a str. 2457T
uguaagucggucacag

SEQ ID NO: 1901402 - RNA, 20 nt, Shigella flexneri 2a str. 2457T
uguaaguggggguuuuauuu

SEQ ID NO: 1901403 - RNA, 11 nt, Shigella flexneri 2a str. 2457T
uguaaucaacu

SEQ ID NO: 1901404 - RNA, 15 nt, Shigella flexneri 2a str. 2457T
uguaaucauauuaaa

SEQ ID NO: 1901405 - RNA, 18 nt, Shigella flexneri 2a str. 2457T
uguaaucauauuaaauuu

SEQ ID NO: 1901406 - RNA, 19 nt, Shigella flexneri 2a str. 2457T
uguaaugagaauaaucacc

SEQ ID NO: 1901407 - RNA, 19 nt, Shigella flexneri 2a str. 2457T
ugggguauuuccagggccu

SEQ ID NO: 1901408 - RNA, 18 nt, Shigella flexneri 2a str. 2457T
ugguaacgccccacaaac

SEQ ID NO: 1901409 - RNA, 19 nt, Shigella flexneri 2a str. 2457T
ugguaacgccccacaaacc

SEQ ID NO: 1901410 - RNA, 16 nt, Shigella flexneri 2a str. 2457T
ugguagauaagcaagg

SEQ ID NO: 1901411 - RNA, 22 nt, Shigella flexneri 2a str. 2457T
uggucaucacuuuugaaaucaa

SEQ ID NO: 1901412 - RNA, 12 nt, Shigella flexneri 2a str. 2457T
uggucaccacgg

SEQ ID NO: 1901413 - RNA, 16 nt, Shigella flexneri 2a str. 2457T
ugguauuggaagguua

SEQ ID NO: 1901414 - RNA, 19 nt, Shigella flexneri 2a str. 2457T
ugguauuggaagguuaaua

SEQ ID NO: 1901415 - RNA, 18 nt, Shigella flexneri 2a str. 2457T
ugguauuuccaguccagc

SEQ ID NO: 1901416 - RNA, 23 nt, Shigella flexneri 2a str. 2457T
ugguggucuccacgcuuaacaac

SEQ ID NO: 1901417 - RNA, 23 nt, Shigella flexneri 2a str. 2457T
uggucugacgcugaauacgcacc

SEQ ID NO: 1901418 - RNA, 13 nt, Shigella flexneri 2a str. 2457T
uggucugccauca

SEQ ID NO: 1901419 - RNA, 14 nt, Shigella flexneri 2a str. 2457T
uggugaagcuuauc

SEQ ID NO: 1901420 - RNA, 19 nt, Shigella flexneri 2a str. 2457T
uggugaugagcugaccaga

SEQ ID NO: 1901421 - RNA, 23 nt, Shigella flexneri 2a str. 2457T
uggugauggacaacgcuuuuugg

SEQ ID NO: 1901422 - RNA, 20 nt, Shigella flexneri 2a str. 2457T
uggugauugccggaauggug

SEQ ID NO: 1901423 - RNA, 22 nt, Shigella flexneri 2a str. 2457T
uggugcaaauugcaccauccau

SEQ ID NO: 1901424 - RNA, 19 nt, Shigella flexneri 2a str. 2457T
uggugaugguauuguccug

SEQ ID NO: 1901425 - RNA, 19 nt, Shigella flexneri 2a str. 2457T
uggugcaauuucagcgucc

SEQ ID NO: 1901426 - RNA, 20 nt, Shigella flexneri 2a str. 2457T
uggugcaagaaaugacagag

SEQ ID NO: 1901427 - RNA, 16 nt, Shigella flexneri 2a str. 2457T
uguucuggucacucuc

SEQ ID NO: 1901428 - RNA, 21 nt, Shigella flexneri 2a str. 2457T
uguucugauaguuaaaauuca

SEQ ID NO: 1901429 - RNA, 17 nt, Shigella flexneri 2a str. 2457T
uguucauagugccugau

SEQ ID NO: 1901430 - RNA, 22 nt, Shigella flexneri 2a str. 2457T
uguucaucugcauuccggugua

SEQ ID NO: 1901431 - RNA, 22 nt, Shigella flexneri 2a str. 2457T
uguucgcccacgcgcauuccca

SEQ ID NO: 1901432 - RNA, 21 nt, Shigella flexneri 2a str. 2457T
uguucgcucuauucauugacu

SEQ ID NO: 1901433 - RNA, 17 nt, Shigella flexneri 2a str. 2457T
uguugauggggguccug

SEQ ID NO: 1901434 - RNA, 15 nt, Shigella flexneri 2a str. 2457T
uguugccauuucugc

SEQ ID NO: 1901435 - RNA, 17 nt, Shigella flexneri 2a str. 2457T
uguugcccaugcuucug

SEQ ID NO: 1901436 - RNA, 15 nt, Shigella flexneri 2a str. 2457T
uguugaggaagcgca

SEQ ID NO: 1901437 - RNA, 15 nt, Shigella flexneri 2a str. 2457T
uguugaaugccgguu

SEQ ID NO: 1901438 - RNA, 22 nt, Shigella flexneri 2a str. 2457T
uguuagaugugggcaaucucac

SEQ ID NO: 1901439 - RNA, 20 nt, Shigella flexneri 2a str. 2457T
uguguuuacgcguuuuucag

SEQ ID NO: 1901440 - RNA, 23 nt, Shigella flexneri 2a str. 2457T
uguguugaggaucacaaaacgaa

SEQ ID NO: 1901441 - RNA, 21 nt, Shigella flexneri 2a str. 2457T
uguguugcauccggcauggca

SEQ ID NO: 1901442 - RNA, 17 nt, Shigella flexneri 2a str. 2457T
uguuacuuauuucuaua

SEQ ID NO: 1901443 - RNA, 21 nt, Shigella flexneri 2a str. 2457T
ugugguuggcguguuucagcu

SEQ ID NO: 1901444 - RNA, 23 nt, Shigella flexneri 2a str. 2457T
ugugguguaacgagacaaugcaa

SEQ ID NO: 1901445 - RNA, 17 nt, Shigella flexneri 2a str. 2457T
uguggugaucacccaga

SEQ ID NO: 1901446 - RNA, 17 nt, Shigella flexneri 2a str. 2457T
uguggugagauugcugc

SEQ ID NO: 1901447 - RNA, 17 nt, Shigella flexneri 2a str. 2457T
uguggaucgauuucaau

SEQ ID NO: 1901448 - RNA, 23 nt, Shigella flexneri 2a str. 2457T
ugugcuuucaguucuagaacuaa

SEQ ID NO: 1901449 - RNA, 20 nt, Shigella flexneri 2a str. 2457T
ugugcuuuacaccaugccac

SEQ ID NO: 1901450 - RNA, 16 nt, Shigella flexneri 2a str. 2457T
ugugcugugacagauu

SEQ ID NO: 1901451 - RNA, 20 nt, Shigella flexneri 2a str. 2457T
ugugcuggauaacgacaccu

SEQ ID NO: 1901452 - RNA, 18 nt, Shigella flexneri 2a str. 2457T
ugugccgcgaugauuggg

SEQ ID NO: 1901453 - RNA, 16 nt, Shigella flexneri 2a str. 2457T
ugugcccguaaaaaau

SEQ ID NO: 1901454 - RNA, 20 nt, Shigella flexneri 2a str. 2457T
ugugcccguaaaaaauggcu

SEQ ID NO: 1901455 - RNA, 12 nt, Shigella flexneri 2a str. 2457T
ugugccagaacc

SEQ ID NO: 1901456 - RNA, 18 nt, Shigella flexneri 2a str. 2457T
ugugccagcucgugcaga

SEQ ID NO: 1901457 - RNA, 15 nt, Shigella flexneri 2a str. 2457T
ugugcaaccuuuucc

SEQ ID NO: 1901458 - RNA, 19 nt, Shigella flexneri 2a str. 2457T
ugugauaaaaaucggcagg

SEQ ID NO: 1901459 - RNA, 15 nt, Shigella flexneri 2a str. 2457T
ugugaucuuuuucgc

SEQ ID NO: 1901460 - RNA, 12 nt, Shigella flexneri 2a str. 2457T
ugugauggaccg

SEQ ID NO: 1901461 - RNA, 14 nt, Shigella flexneri 2a str. 2457T
ugugauggcuauua

SEQ ID NO: 1901462 - RNA, 13 nt, Shigella flexneri 2a str. 2457T
ugugacagagcca

SEQ ID NO: 1901463 - RNA, 14 nt, Shigella flexneri 2a str. 2457T
ugugaaccucacag

SEQ ID NO: 1901464 - RNA, 22 nt, Shigella flexneri 2a str. 2457T
ugugaaaacucuuagcaaacag

SEQ ID NO: 1901465 - RNA, 17 nt, Shigella flexneri 2a str. 2457T
ugucuuuuuacucccgc

SEQ ID NO: 1901466 - RNA, 23 nt, Shigella flexneri 2a str. 2457T
ugucuuuugaucugcuaaacgua

SEQ ID NO: 1901467 - RNA, 14 nt, Shigella flexneri 2a str. 2457T
ugucuucccugcug

SEQ ID NO: 1901468 - RNA, 16 nt, Shigella flexneri 2a str. 2457T
ugucuuccuguggugc

SEQ ID NO: 1901469 - RNA, 15 nt, Shigella flexneri 2a str. 2457T
ugucuuaucaggccu

SEQ ID NO: 1901470 - RNA, 16 nt, Shigella flexneri 2a str. 2457T
ugucuuaucuggcauu

SEQ ID NO: 1901471 - RNA, 16 nt, Shigella flexneri 2a str. 2457T
ugucugccgcaggaaa

SEQ ID NO: 1901472 - RNA, 17 nt, Shigella flexneri 2a str. 2457T
ugucugcuucugccugg

SEQ ID NO: 1901473 - RNA, 23 nt, Shigella flexneri 2a str. 2457T
ugucuggacgcucaggcuacuuu

SEQ ID NO: 1901474 - RNA, 19 nt, Shigella flexneri 2a str. 2457T
ugucuguacggcagugaac

SEQ ID NO: 1901475 - RNA, 16 nt, Shigella flexneri 2a str. 2457T
ugucuauuuccacccg

SEQ ID NO: 1901476 - RNA, 15 nt, Shigella flexneri 2a str. 2457T
ugucuaccagcaccu

SEQ ID NO: 1901477 - RNA, 20 nt, Shigella flexneri 2a str. 2457T
ugucuacgccuuguuucuuc

SEQ ID NO: 1901478 - RNA, 17 nt, Shigella flexneri 2a str. 2457T
ugucguuaaugcgccaa

SEQ ID NO: 1901479 - RNA, 22 nt, Shigella flexneri 2a str. 2457T
ugucguucaggcgcugaaagaa

SEQ ID NO: 1901480 - RNA, 18 nt, Shigella flexneri 2a str. 2457T
ugucguuuccauggacga

SEQ ID NO: 1901481 - RNA, 13 nt, Shigella flexneri 2a str. 2457T
ugucugagccgaa

SEQ ID NO: 1901482 - RNA, 18 nt, Shigella flexneri 2a str. 2457T
ugucucccgcccaaucga

SEQ ID NO: 1901483 - RNA, 14 nt, Shigella flexneri 2a str. 2457T
ugucgcgccaggcg

SEQ ID NO: 1901484 - RNA, 20 nt, Shigella flexneri 2a str. 2457T
ugucggcacugaccaccacc

SEQ ID NO: 1901485 - RNA, 13 nt, Shigella flexneri 2a str. 2457T
ugucggcacugac

SEQ ID NO: 1901486 - RNA, 17 nt, Shigella flexneri 2a str. 2457T
ugucggcccgcauuauu

SEQ ID NO: 1901487 - RNA, 17 nt, Shigella flexneri 2a str. 2457T
ugucgggcaggcuucaa

SEQ ID NO: 1901488 - RNA, 12 nt, Shigella flexneri 2a str. 2457T
ugucgggcauca

SEQ ID NO: 1901489 - RNA, 19 nt, Shigella flexneri 2a str. 2457T
ugucggugguguuaucacc

SEQ ID NO: 1901490 - RNA, 16 nt, Shigella flexneri 2a str. 2457T
ugucgugcgaggaaaa

SEQ ID NO: 1901491 - RNA, 22 nt, Shigella flexneri 2a str. 2457T
ugucgcauccggcaauuggugc

SEQ ID NO: 1901492 - RNA, 15 nt, Shigella flexneri 2a str. 2457T
ugucgcauccggcaa

SEQ ID NO: 1901493 - RNA, 22 nt, Shigella flexneri 2a str. 2457T
ugucgcauccgacaaggcauca

SEQ ID NO: 1901494 - RNA, 21 nt, Shigella flexneri 2a str. 2457T
ugucgaucaucaggcccgcau

SEQ ID NO: 1901495 - RNA, 17 nt, Shigella flexneri 2a str. 2457T
ugucgaucgcauggccu

SEQ ID NO: 1901496 - RNA, 19 nt, Shigella flexneri 2a str. 2457T
ugucgacggaauaaaccca

SEQ ID NO: 1901497 - RNA, 21 nt, Shigella flexneri 2a str. 2457T
ugucgaggccaauuuggcugc

SEQ ID NO: 1901498 - RNA, 19 nt, Shigella flexneri 2a str. 2457T
ugucgacuaaccugagagu

SEQ ID NO: 1901499 - RNA, 18 nt, Shigella flexneri 2a str. 2457T
uguccucgccguuuucug

SEQ ID NO: 1901500 - RNA, 18 nt, Shigella flexneri 2a str. 2457T
uguccgccaauuucauca

SEQ ID NO: 1901501 - RNA, 19 nt, Shigella flexneri 2a str. 2457T
uguccgccaauuucaucac

SEQ ID NO: 1901502 - RNA, 18 nt, Shigella flexneri 2a str. 2457T
uguccggcgcacuggugc

SEQ ID NO: 1901503 - RNA, 16 nt, Shigella flexneri 2a str. 2457T
uguccgcuucaccacc

SEQ ID NO: 1901504 - RNA, 13 nt, Shigella flexneri 2a str. 2457T
ugucccgcuggug

SEQ ID NO: 1901505 - RNA, 16 nt, Shigella flexneri 2a str. 2457T
uguccauuauuucaau

SEQ ID NO: 1901506 - RNA, 20 nt, Shigella flexneri 2a str. 2457T
uguccauggugucugaugag

SEQ ID NO: 1901507 - RNA, 17 nt, Shigella flexneri 2a str. 2457T
uguccaccacgcugcau

SEQ ID NO: 1901508 - RNA, 12 nt, Shigella flexneri 2a str. 2457T
uguccacuuccg

SEQ ID NO: 1901509 - RNA, 16 nt, Shigella flexneri 2a str. 2457T
uguccagguuauuaaa

SEQ ID NO: 1901510 - RNA, 21 nt, Shigella flexneri 2a str. 2457T
ugucauuaaagccgccaaacg

SEQ ID NO: 1901511 - RNA, 22 nt, Shigella flexneri 2a str. 2457T
uguccaaauccuucagcaacuu

SEQ ID NO: 1901512 - RNA, 16 nt, Shigella flexneri 2a str. 2457T
ugucaugcagcuccac

SEQ ID NO: 1901513 - RNA, 20 nt, Shigella flexneri 2a str. 2457T
ugucaugaguaaacuuuugg

SEQ ID NO: 1901514 - RNA, 18 nt, Shigella flexneri 2a str. 2457T
ugucaugacuacacuaaa

SEQ ID NO: 1901515 - RNA, 21 nt, Shigella flexneri 2a str. 2457T
ugucauauuugaguguauuua

SEQ ID NO: 1901516 - RNA, 20 nt, Shigella flexneri 2a str. 2457T
uguacaggauauauuucauc

SEQ ID NO: 1901517 - RNA, 21 nt, Shigella flexneri 2a str. 2457T
uguacaggauauauuucauca

SEQ ID NO: 1901518 - RNA, 18 nt, Shigella flexneri 2a str. 2457T
uguaugccgaauaaagca

SEQ ID NO: 1901519 - RNA, 16 nt, Shigella flexneri 2a str. 2457T
ugucaguggacgauaa

SEQ ID NO: 1901520 - RNA, 14 nt, Shigella flexneri 2a str. 2457T
ugucaguuggcugu

SEQ ID NO: 1901521 - RNA, 20 nt, Shigella flexneri 2a str. 2457T
ugucauaacuggucaucaaa

SEQ ID NO: 1901522 - RNA, 23 nt, Shigella flexneri 2a str. 2457T
ugucacaaauaaaaaaugagaau

SEQ ID NO: 1901523 - RNA, 16 nt, Shigella flexneri 2a str. 2457T
ugucagcucauccagc

SEQ ID NO: 1901524 - RNA, 14 nt, Shigella flexneri 2a str. 2457T
ugucaauaaucuga

SEQ ID NO: 1901525 - RNA, 14 nt, Shigella flexneri 2a str. 2457T
ugucaauaaacgcc

SEQ ID NO: 1901526 - RNA, 18 nt, Shigella flexneri 2a str. 2457T
ugucaaacgggcuucuaa

SEQ ID NO: 1901527 - RNA, 11 nt, Shigella flexneri 2a str. 2457T
ugucaaaucca

SEQ ID NO: 1901528 - RNA, 13 nt, Shigella flexneri 2a str. 2457T
uuauaaaagaaaa

SEQ ID NO: 1901529 - RNA, 15 nt, Shigella flexneri 2a str. 2457T
uuauaaauaaaaaga

SEQ ID NO: 1901530 - RNA, 24 nt, Shigella flexneri 2a str. 2457T
uuauacacucuuucaauauugcac

SEQ ID NO: 1901531 - RNA, 16 nt, Shigella flexneri 2a str. 2457T
uuauaaucuuuaaaaa

SEQ ID NO: 1901532 - RNA, 18 nt, Shigella flexneri 2a str. 2457T
uuauaaucuuuaaaaaaa

SEQ ID NO: 1901533 - RNA, 19 nt, Shigella flexneri 2a str. 2457T
uuauaaucuuuaaaaaaag

SEQ ID NO: 1901534 - RNA, 15 nt, Shigella flexneri 2a str. 2457T
uuauauaauaugcau

SEQ ID NO: 1901535 - RNA, 19 nt, Shigella flexneri 2a str. 2457T
uuauagcaguaauugcagc

SEQ ID NO: 1901536 - RNA, 20 nt, Shigella flexneri 2a str. 2457T
uuauagccguaacuguaagc

SEQ ID NO: 1901537 - RNA, 18 nt, Shigella flexneri 2a str. 2457T
uuauagacuaaauuucac

SEQ ID NO: 1901538 - RNA, 22 nt, Shigella flexneri 2a str. 2457T
uuauagacaucuuuauaugcaa

SEQ ID NO: 1901539 - RNA, 15 nt, Shigella flexneri 2a str. 2457T
uuauacaucgcuuuc

SEQ ID NO: 1901540 - RNA, 12 nt, Shigella flexneri 2a str. 2457T
uuauacuuuuuc

SEQ ID NO: 1901541 - RNA, 13 nt, Shigella flexneri 2a str. 2457T
uuaucaaaucacc

SEQ ID NO: 1901542 - RNA, 14 nt, Shigella flexneri 2a str. 2457T
uuauaucccauuuu

SEQ ID NO: 1901543 - RNA, 22 nt, Shigella flexneri 2a str. 2457T
uuauauagaacaagugccacgc

SEQ ID NO: 1901544 - RNA, 19 nt, Shigella flexneri 2a str. 2457T
uuaucaauuccuauuuugu

SEQ ID NO: 1901545 - RNA, 15 nt, Shigella flexneri 2a str. 2457T
uuaucaucgggcuga

SEQ ID NO: 1901546 - RNA, 15 nt, Shigella flexneri 2a str. 2457T
uuaucaggccugcaa

SEQ ID NO: 1901547 - RNA, 21 nt, Shigella flexneri 2a str. 2457T
uuaucaggccuacauuggugc

SEQ ID NO: 1901548 - RNA, 16 nt, Shigella flexneri 2a str. 2457T
uuaucccucauauuua

SEQ ID NO: 1901549 - RNA, 16 nt, Shigella flexneri 2a str. 2457T
uuaucccuguuaaaac

SEQ ID NO: 1901550 - RNA, 22 nt, Shigella flexneri 2a str. 2457T
uuaucccaucccacucaucgca

SEQ ID NO: 1901551 - RNA, 13 nt, Shigella flexneri 2a str. 2457T
uuauccggcuaua

SEQ ID NO: 1901552 - RNA, 12 nt, Shigella flexneri 2a str. 2457T
uuauccggugag

SEQ ID NO: 1901553 - RNA, 16 nt, Shigella flexneri 2a str. 2457T
uuauccguccuacgaa

SEQ ID NO: 1901554 - RNA, 17 nt, Shigella flexneri 2a str. 2457T
uuauccggcaugaaaac

SEQ ID NO: 1901555 - RNA, 17 nt, Shigella flexneri 2a str. 2457T
uuauccggccuacaaaa

SEQ ID NO: 1901556 - RNA, 18 nt, Shigella flexneri 2a str. 2457T
uuauccggccuacaaaau

SEQ ID NO: 1901557 - RNA, 15 nt, Shigella flexneri 2a str. 2457T
uuauccaguuaucaa

SEQ ID NO: 1901558 - RNA, 22 nt, Shigella flexneri 2a str. 2457T
uuauccagccuacaaaaacuca

SEQ ID NO: 1901559 - RNA, 21 nt, Shigella flexneri 2a str. 2457T
uuauccaccgaaauaaucaga

SEQ ID NO: 1901560 - RNA, 19 nt, Shigella flexneri 2a str. 2457T
uuaugcagccuuuuuuauu

SEQ ID NO: 1901561 - RNA, 22 nt, Shigella flexneri 2a str. 2457T
uuaugccgaucaucauccagca

SEQ ID NO: 1901562 - RNA, 13 nt, Shigella flexneri 2a str. 2457T
uuaugaucaucaa

SEQ ID NO: 1901563 - RNA, 14 nt, Shigella flexneri 2a str. 2457T
uuaugcaauauauu

SEQ ID NO: 1901564 - RNA, 22 nt, Shigella flexneri 2a str. 2457T
uuaugaugucaaaaucaaaaua

SEQ ID NO: 1901565 - RNA, 11 nt, Shigella flexneri 2a str. 2457T
uuaugaauaac

SEQ ID NO: 1901566 - RNA, 13 nt, Shigella flexneri 2a str. 2457T
uuauggugcuagu

SEQ ID NO: 1901567 - RNA, 23 nt, Shigella flexneri 2a str. 2457T
uuaugugcuucuaccaugaugau

SEQ ID NO: 1901568 - RNA, 18 nt, Shigella flexneri 2a str. 2457T
uuaugguagugccgucag

SEQ ID NO: 1901569 - RNA, 23 nt, Shigella flexneri 2a str. 2457T
uuauggguaugucacugaugaca

SEQ ID NO: 1901570 - RNA, 19 nt, Shigella flexneri 2a str. 2457T
uuauggcaaucguggucug

SEQ ID NO: 1901571 - RNA, 14 nt, Shigella flexneri 2a str. 2457T
uuauggcuauaaca

SEQ ID NO: 1901572 - RNA, 23 nt, Shigella flexneri 2a str. 2457T
uuaucuucgagauucuuaaaguc

SEQ ID NO: 1901573 - RNA, 16 nt, Shigella flexneri 2a str. 2457T
uuaucuuacccuuccu

SEQ ID NO: 1901574 - RNA, 15 nt, Shigella flexneri 2a str. 2457T
uuaucuucccagccc

SEQ ID NO: 1901575 - RNA, 19 nt, Shigella flexneri 2a str. 2457T
uuaucuggccuacagauga

SEQ ID NO: 1901576 - RNA, 17 nt, Shigella flexneri 2a str. 2457T
uuaucuggcauuugcac

SEQ ID NO: 1901577 - RNA, 19 nt, Shigella flexneri 2a str. 2457T
uuaucuggaguuauagcug

SEQ ID NO: 1901578 - RNA, 17 nt, Shigella flexneri 2a str. 2457T
uuaucuggauccacgau

SEQ ID NO: 1901579 - RNA, 15 nt, Shigella flexneri 2a str. 2457T
uuaucugcaauuacu

SEQ ID NO: 1901580 - RNA, 17 nt, Shigella flexneri 2a str. 2457T
uuaucugaucaauauag

SEQ ID NO: 1901581 - RNA, 23 nt, Shigella flexneri 2a str. 2457T
uuaucugaucaauauagauauca

SEQ ID NO: 1901582 - RNA, 16 nt, Shigella flexneri 2a str. 2457T
uuaucucuugccaggc

SEQ ID NO: 1901583 - RNA, 13 nt, Shigella flexneri 2a str. 2457T
uuaucuccuugcu

SEQ ID NO: 1901584 - RNA, 19 nt, Shigella flexneri 2a str. 2457T
uuaucucccuguaucccag

SEQ ID NO: 1901585 - RNA, 18 nt, Shigella flexneri 2a str. 2457T
uuaucuauuaauuaugau

SEQ ID NO: 1901586 - RNA, 17 nt, Shigella flexneri 2a str. 2457T
uuaucuauaacaaaacu

SEQ ID NO: 1901587 - RNA, 13 nt, Shigella flexneri 2a str. 2457T
uuaucgccuacca

SEQ ID NO: 1901588 - RNA, 19 nt, Shigella flexneri 2a str. 2457T
uuaucgcgauacaccagau

SEQ ID NO: 1901589 - RNA, 18 nt, Shigella flexneri 2a str. 2457T
uuaucgcgaugauuuucg

SEQ ID NO: 1901590 - RNA, 15 nt, Shigella flexneri 2a str. 2457T
uuaucgcgcaaaaaa

SEQ ID NO: 1901591 - RNA, 15 nt, Shigella flexneri 2a str. 2457T
uuaucgcgccaucaa

SEQ ID NO: 1901592 - RNA, 20 nt, Shigella flexneri 2a str. 2457T
uuaucgcauuaucaaagaug

SEQ ID NO: 1901593 - RNA, 19 nt, Shigella flexneri 2a str. 2457T
uuaucggcucgaucuggug

SEQ ID NO: 1901594 - RNA, 17 nt, Shigella flexneri 2a str. 2457T
uuaucgcgcugaauaau

SEQ ID NO: 1901595 - RNA, 20 nt, Shigella flexneri 2a str. 2457T
uuaucgugaauucacucuau

SEQ ID NO: 1901596 - RNA, 24 nt, Shigella flexneri 2a str. 2457T
uuaucgugccuacacauuaucuca

SEQ ID NO: 1901597 - RNA, 14 nt, Shigella flexneri 2a str. 2457T
uuauccucuguaaa

SEQ ID NO: 1901598 - RNA, 19 nt, Shigella flexneri 2a str. 2457T
uuaucgauuuucaaaauau

SEQ ID NO: 1901599 - RNA, 18 nt, Shigella flexneri 2a str. 2457T
uuaucgcagggagccaca

SEQ ID NO: 1901600 - RNA, 19 nt, Shigella flexneri 2a str. 2457T
uucaagccaggcuuuaaau

SEQ ID NO: 1901601 - RNA, 22 nt, Shigella flexneri 2a str. 2457T
uucaagccaaaacgcgcaacca

SEQ ID NO: 1901602 - RNA, 22 nt, Shigella flexneri 2a str. 2457T
uucaagacgaauaccuucuucc

SEQ ID NO: 1901603 - RNA, 18 nt, Shigella flexneri 2a str. 2457T
uucaagaauuaaaauauc

SEQ ID NO: 1901604 - RNA, 21 nt, Shigella flexneri 2a str. 2457T
uucaagacaucaauaaacaau

SEQ ID NO: 1901605 - RNA, 15 nt, Shigella flexneri 2a str. 2457T
uucaacgaagaaaac

SEQ ID NO: 1901606 - RNA, 14 nt, Shigella flexneri 2a str. 2457T
uucaacuggauaaa

SEQ ID NO: 1901607 - RNA, 16 nt, Shigella flexneri 2a str. 2457T
uucaacuggauaaaau

SEQ ID NO: 1901608 - RNA, 18 nt, Shigella flexneri 2a str. 2457T
uucaacuggauaaaauua

SEQ ID NO: 1901609 - RNA, 18 nt, Shigella flexneri 2a str. 2457T
uucaaccauccuaaaaaa

SEQ ID NO: 1901610 - RNA, 21 nt, Shigella flexneri 2a str. 2457T
uucaaccauccuaaaaaagca

SEQ ID NO: 1901611 - RNA, 18 nt, Shigella flexneri 2a str. 2457T
uucaacauauccuucaca

SEQ ID NO: 1901612 - RNA, 23 nt, Shigella flexneri 2a str. 2457T
uucaacagguuuuguugcccagc

SEQ ID NO: 1901613 - RNA, 16 nt, Shigella flexneri 2a str. 2457T
uucaacaguaaacucg

SEQ ID NO: 1901614 - RNA, 22 nt, Shigella flexneri 2a str. 2457T
uucaacaguaaacucgacuuuc

SEQ ID NO: 1901615 - RNA, 13 nt, Shigella flexneri 2a str. 2457T
uucaacaguuuuc

SEQ ID NO: 1901616 - RNA, 13 nt, Shigella flexneri 2a str. 2457T
uucaacagauuuc

SEQ ID NO: 1901617 - RNA, 19 nt, Shigella flexneri 2a str. 2457T
uucaacagauuacauuaaa

SEQ ID NO: 1901618 - RNA, 18 nt, Shigella flexneri 2a str. 2457T
uucaacacacugaauaaa

SEQ ID NO: 1901619 - RNA, 14 nt, Shigella flexneri 2a str. 2457T
uucaaauccuucag

SEQ ID NO: 1901620 - RNA, 14 nt, Shigella flexneri 2a str. 2457T
uucaaauuaugucu

SEQ ID NO: 1901621 - RNA, 21 nt, Shigella flexneri 2a str. 2457T
uucaaaucgacgcgugaaaau

SEQ ID NO: 1901622 - RNA, 21 nt, Shigella flexneri 2a str. 2457T
uucaaaguucugugucuuauu

SEQ ID NO: 1901623 - RNA, 12 nt, Shigella flexneri 2a str. 2457T
uuauuuuuaaac

SEQ ID NO: 1901624 - RNA, 15 nt, Shigella flexneri 2a str. 2457T
uucaaaaacaaagaa

SEQ ID NO: 1901625 - RNA, 16 nt, Shigella flexneri 2a str. 2457T
uucaaaaacuaauuca

SEQ ID NO: 1901626 - RNA, 20 nt, Shigella flexneri 2a str. 2457T
uucaaaaacuaauucaccuu

SEQ ID NO: 1901627 - RNA, 14 nt, Shigella flexneri 2a str. 2457T
uuauuauuuacuug

SEQ ID NO: 1901628 - RNA, 15 nt, Shigella flexneri 2a str. 2457T
uuauucagcagacca

SEQ ID NO: 1901629 - RNA, 22 nt, Shigella flexneri 2a str. 2457T
uuauucaugccuguauugguuu

SEQ ID NO: 1901630 - RNA, 12 nt, Shigella flexneri 2a str. 2457T
uuauugauaacc

SEQ ID NO: 1901631 - RNA, 14 nt, Shigella flexneri 2a str. 2457T
uuauuaauucuaaa

SEQ ID NO: 1901632 - RNA, 15 nt, Shigella flexneri 2a str. 2457T
uuauuaacuucccac

SEQ ID NO: 1901633 - RNA, 19 nt, Shigella flexneri 2a str. 2457T
uuauuaagaauuuuauacu

SEQ ID NO: 1901634 - RNA, 16 nt, Shigella flexneri 2a str. 2457T
uuauuaaauuuaauaa

SEQ ID NO: 1901635 - RNA, 18 nt, Shigella flexneri 2a str. 2457T
uuauuaaauuuaauaaua

SEQ ID NO: 1901636 - RNA, 13 nt, Shigella flexneri 2a str. 2457T
uuauuaaauuuaa

SEQ ID NO: 1901637 - RNA, 14 nt, Shigella flexneri 2a str. 2457T
uuauuacugcguau

SEQ ID NO: 1901638 - RNA, 11 nt, Shigella flexneri 2a str. 2457T
uuauuaucagg

SEQ ID NO: 1901639 - RNA, 16 nt, Shigella flexneri 2a str. 2457T
uuauuguuugucauga

SEQ ID NO: 1901640 - RNA, 19 nt, Shigella flexneri 2a str. 2457T
uuauuucaaugcauuauca

SEQ ID NO: 1901641 - RNA, 23 nt, Shigella flexneri 2a str. 2457T
uuauuuacuugggaaaacagcgc

SEQ ID NO: 1901642 - RNA, 19 nt, Shigella flexneri 2a str. 2457T
uuauugggcgaaagaaaag

SEQ ID NO: 1901643 - RNA, 15 nt, Shigella flexneri 2a str. 2457T
uuauugauuaaagga

SEQ ID NO: 1901644 - RNA, 14 nt, Shigella flexneri 2a str. 2457T
uuauuucuguauua

SEQ ID NO: 1901645 - RNA, 23 nt, Shigella flexneri 2a str. 2457T
uuauuucaacagauuacauuaaa

SEQ ID NO: 1901646 - RNA, 16 nt, Shigella flexneri 2a str. 2457T
uuaacacacaauuacc

SEQ ID NO: 1901647 - RNA, 17 nt, Shigella flexneri 2a str. 2457T
uuaacaaucacaauaga

SEQ ID NO: 1901648 - RNA, 16 nt, Shigella flexneri 2a str. 2457T
uuaacagguauagaau

SEQ ID NO: 1901649 - RNA, 19 nt, Shigella flexneri 2a str. 2457T
uuaaccaaaaauuuccaca

SEQ ID NO: 1901650 - RNA, 14 nt, Shigella flexneri 2a str. 2457T
uuaaccaacaauaa

SEQ ID NO: 1901651 - RNA, 15 nt, Shigella flexneri 2a str. 2457T
uuaaccaacaauaaa

SEQ ID NO: 1901652 - RNA, 15 nt, Shigella flexneri 2a str. 2457T
uuaaccagcaccagc

SEQ ID NO: 1901653 - RNA, 20 nt, Shigella flexneri 2a str. 2457T
uuaaccagcacguugaacug

SEQ ID NO: 1901654 - RNA, 23 nt, Shigella flexneri 2a str. 2457T
uuaaccaccaguaaauugucgcc

SEQ ID NO: 1901655 - RNA, 19 nt, Shigella flexneri 2a str. 2457T
uuaacgcgaucgacgcguc

SEQ ID NO: 1901656 - RNA, 15 nt, Shigella flexneri 2a str. 2457T
uuaacgggcagguca

SEQ ID NO: 1901657 - RNA, 21 nt, Shigella flexneri 2a str. 2457T
uuaacgccuucccuuucagca

SEQ ID NO: 1901658 - RNA, 12 nt, Shigella flexneri 2a str. 2457T
uuaacccauuuu

SEQ ID NO: 1901659 - RNA, 21 nt, Shigella flexneri 2a str. 2457T
uuaacgacacucucuucaaca

SEQ ID NO: 1901660 - RNA, 13 nt, Shigella flexneri 2a str. 2457T
uuaagcaaaaaaa

SEQ ID NO: 1901661 - RNA, 14 nt, Shigella flexneri 2a str. 2457T
uuaagcaaaaaaac

SEQ ID NO: 1901662 - RNA, 15 nt, Shigella flexneri 2a str. 2457T
uuaagcaaaaaaaca

SEQ ID NO: 1901663 - RNA, 18 nt, Shigella flexneri 2a str. 2457T
uuaagcaaaaaaacauaa

SEQ ID NO: 1901664 - RNA, 19 nt, Shigella flexneri 2a str. 2457T
uuaagcaaaaaaacauaau

SEQ ID NO: 1901665 - RNA, 22 nt, Shigella flexneri 2a str. 2457T
uuaagcaagugcaaucuacaaa

SEQ ID NO: 1901666 - RNA, 20 nt, Shigella flexneri 2a str. 2457T
uuaagcaauaccgcgaauca

SEQ ID NO: 1901667 - RNA, 20 nt, Shigella flexneri 2a str. 2457T
uuaagccaguucucaccaaa

SEQ ID NO: 1901668 - RNA, 18 nt, Shigella flexneri 2a str. 2457T
uuaagccaguucucacca

SEQ ID NO: 1901669 - RNA, 22 nt, Shigella flexneri 2a str. 2457T
uuaagcgcaucgacgccaucau

SEQ ID NO: 1901670 - RNA, 21 nt, Shigella flexneri 2a str. 2457T
uuaagagcuggcaucagcaaa

SEQ ID NO: 1901671 - RNA, 14 nt, Shigella flexneri 2a str. 2457T
uuaagaaaaaagau

SEQ ID NO: 1901672 - RNA, 17 nt, Shigella flexneri 2a str. 2457T
uuaauaacacauauauu

SEQ ID NO: 1901673 - RNA, 18 nt, Shigella flexneri 2a str. 2457T
uuaauaacacauauauua

SEQ ID NO: 1901674 - RNA, 14 nt, Shigella flexneri 2a str. 2457T
uuaagccgcugugu

SEQ ID NO: 1901675 - RNA, 13 nt, Shigella flexneri 2a str. 2457T
uuaagcucagaaa

SEQ ID NO: 1901676 - RNA, 14 nt, Shigella flexneri 2a str. 2457T
uuaauaaacaucag

SEQ ID NO: 1901677 - RNA, 23 nt, Shigella flexneri 2a str. 2457T
uuaaauauuaaggguaaaaggau

SEQ ID NO: 1901678 - RNA, 15 nt, Shigella flexneri 2a str. 2457T
uuaaauaucaucaaa

SEQ ID NO: 1901679 - RNA, 17 nt, Shigella flexneri 2a str. 2457T
uuaaauaucaucaaaau

SEQ ID NO: 1901680 - RNA, 12 nt, Shigella flexneri 2a str. 2457T
uuaaauauaaaa

SEQ ID NO: 1901681 - RNA, 15 nt, Shigella flexneri 2a str. 2457T
uuaaauauaaaacaa

SEQ ID NO: 1901682 - RNA, 13 nt, Shigella flexneri 2a str. 2457T
uuaaauacaccuu

SEQ ID NO: 1901683 - RNA, 12 nt, Shigella flexneri 2a str. 2457T
uuaaauuaauaa

SEQ ID NO: 1901684 - RNA, 22 nt, Shigella flexneri 2a str. 2457T
uuaaauucgcugcggacaaaac

SEQ ID NO: 1901685 - RNA, 15 nt, Shigella flexneri 2a str. 2457T
uuaaauugucuuaaa

SEQ ID NO: 1901686 - RNA, 18 nt, Shigella flexneri 2a str. 2457T
uuaaauuuauauuuuuua

SEQ ID NO: 1901687 - RNA, 18 nt, Shigella flexneri 2a str. 2457T
uuaaauuucuuguauuaa

SEQ ID NO: 1901688 - RNA, 18 nt, Shigella flexneri 2a str. 2457T
uuaaacgggcguauaaca

SEQ ID NO: 1901689 - RNA, 13 nt, Shigella flexneri 2a str. 2457T
uuaaagaaaauaa

SEQ ID NO: 1901690 - RNA, 18 nt, Shigella flexneri 2a str. 2457T
uuaaacgggucaucaaaa

SEQ ID NO: 1901691 - RNA, 17 nt, Shigella flexneri 2a str. 2457T
uuaaagagacagaauca

SEQ ID NO: 1901692 - RNA, 22 nt, Shigella flexneri 2a str. 2457T
uuaaagagacagaaucaggcca

SEQ ID NO: 1901693 - RNA, 13 nt, Shigella flexneri 2a str. 2457T
uuaaagaaaguaa

SEQ ID NO: 1901694 - RNA, 22 nt, Shigella flexneri 2a str. 2457T
uuaaaguacucuuugaacagcc

SEQ ID NO: 1901695 - RNA, 17 nt, Shigella flexneri 2a str. 2457T
uuaaauacagcuuaauc

SEQ ID NO: 1901696 - RNA, 12 nt, Shigella flexneri 2a str. 2457T
uuaaaggaaagu

SEQ ID NO: 1901697 - RNA, 20 nt, Shigella flexneri 2a str. 2457T
uguugcguaauggugguguu

SEQ ID NO: 1901698 - RNA, 22 nt, Shigella flexneri 2a str. 2457T
uguugccgccgugugcaauauc

SEQ ID NO: 1901699 - RNA, 22 nt, Shigella flexneri 2a str. 2457T
uuaaacccuacccggcaaguaa

SEQ ID NO: 1901700 - RNA, 17 nt, Shigella flexneri 2a str. 2457T
uuaaacccgcucaaaca

SEQ ID NO: 1901701 - RNA, 15 nt, Shigella flexneri 2a str. 2457T
uuaaaccuaaaaaga

SEQ ID NO: 1901702 - RNA, 18 nt, Shigella flexneri 2a str. 2457T
uuaaacacgggguuaaau

SEQ ID NO: 1901703 - RNA, 23 nt, Shigella flexneri 2a str. 2457T
uuaaacaugagcgaauaaaaaaa

SEQ ID NO: 1901704 - RNA, 15 nt, Shigella flexneri 2a str. 2457T
uuaaacauuaaaauu

SEQ ID NO: 1901705 - RNA, 18 nt, Shigella flexneri 2a str. 2457T
uuaaacaagguuugaaaa

SEQ ID NO: 1901706 - RNA, 22 nt, Shigella flexneri 2a str. 2457T
uuaaacaauuucagaauagaca

SEQ ID NO: 1901707 - RNA, 23 nt, Shigella flexneri 2a str. 2457T
uuacggagcaggcguuaaaacag

SEQ ID NO: 1901708 - RNA, 14 nt, Shigella flexneri 2a str. 2457T
uuacggcacuccuc

SEQ ID NO: 1901709 - RNA, 19 nt, Shigella flexneri 2a str. 2457T
uuacgcggaucgagaaucu

SEQ ID NO: 1901710 - RNA, 16 nt, Shigella flexneri 2a str. 2457T
uuacgcucuuccacgc

SEQ ID NO: 1901711 - RNA, 16 nt, Shigella flexneri 2a str. 2457T
uuacgcucaccaaaac

SEQ ID NO: 1901712 - RNA, 16 nt, Shigella flexneri 2a str. 2457T
uuacgcucacugcaaa

SEQ ID NO: 1901713 - RNA, 17 nt, Shigella flexneri 2a str. 2457T
uuacuaaguacauuaag

SEQ ID NO: 1901714 - RNA, 15 nt, Shigella flexneri 2a str. 2457T
uuacguuacccagca

SEQ ID NO: 1901715 - RNA, 17 nt, Shigella flexneri 2a str. 2457T
uuacguuuacgcaucug

SEQ ID NO: 1901716 - RNA, 17 nt, Shigella flexneri 2a str. 2457T
uuacguuuccgcuauca

SEQ ID NO: 1901717 - RNA, 16 nt, Shigella flexneri 2a str. 2457T
uuacguuuuaaaccua

SEQ ID NO: 1901718 - RNA, 16 nt, Shigella flexneri 2a str. 2457T
uuacgccgagcgccag

SEQ ID NO: 1901719 - RNA, 18 nt, Shigella flexneri 2a str. 2457T
uuacgccgcauccggcaa

SEQ ID NO: 1901720 - RNA, 20 nt, Shigella flexneri 2a str. 2457T
uuacgccgcauccggcauaa

SEQ ID NO: 1901721 - RNA, 20 nt, Shigella flexneri 2a str. 2457T
uuacgccgcaucuggcauaa

SEQ ID NO: 1901722 - RNA, 23 nt, Shigella flexneri 2a str. 2457T
uuacgccgagcgccagccauuca

SEQ ID NO: 1901723 - RNA, 17 nt, Shigella flexneri 2a str. 2457T
uuacgccgcauccaaca

SEQ ID NO: 1901724 - RNA, 17 nt, Shigella flexneri 2a str. 2457T
uuacgccccaacacaau

SEQ ID NO: 1901725 - RNA, 20 nt, Shigella flexneri 2a str. 2457T
uuacgccccgguuucucuuc

SEQ ID NO: 1901726 - RNA, 16 nt, Shigella flexneri 2a str. 2457T
uuacgccaccagcuga

SEQ ID NO: 1901727 - RNA, 13 nt, Shigella flexneri 2a str. 2457T
uuacgccaggcau

SEQ ID NO: 1901728 - RNA, 20 nt, Shigella flexneri 2a str. 2457T
uuacgcaaaaccucuuccag

SEQ ID NO: 1901729 - RNA, 17 nt, Shigella flexneri 2a str. 2457T
uuacgcagcgguauaau

SEQ ID NO: 1901730 - RNA, 21 nt, Shigella flexneri 2a str. 2457T
uuacgcagcauuggguaaaau

SEQ ID NO: 1901731 - RNA, 22 nt, Shigella flexneri 2a str. 2457T
uuaccccacgucaucugucaua

SEQ ID NO: 1901732 - RNA, 13 nt, Shigella flexneri 2a str. 2457T
uuacccaggccug

SEQ ID NO: 1901733 - RNA, 13 nt, Shigella flexneri 2a str. 2457T
uuacgauagaaua

SEQ ID NO: 1901734 - RNA, 21 nt, Shigella flexneri 2a str. 2457T
uuacgacucaaccccagccau

SEQ ID NO: 1901735 - RNA, 13 nt, Shigella flexneri 2a str. 2457T
uuacccagcagca

SEQ ID NO: 1901736 - RNA, 13 nt, Shigella flexneri 2a str. 2457T
uuacccagauaau

SEQ ID NO: 1901737 - RNA, 15 nt, Shigella flexneri 2a str. 2457T
uuagaaacaaaaaaa

SEQ ID NO: 1901738 - RNA, 14 nt, Shigella flexneri 2a str. 2457T
uuacugucugcuuc

SEQ ID NO: 1901739 - RNA, 16 nt, Shigella flexneri 2a str. 2457T
uuacugucgcgcagca

SEQ ID NO: 1901740 - RNA, 15 nt, Shigella flexneri 2a str. 2457T
uuacugucugcuucu

SEQ ID NO: 1901741 - RNA, 12 nt, Shigella flexneri 2a str. 2457T
uuacuuuccuua

SEQ ID NO: 1901742 - RNA, 15 nt, Shigella flexneri 2a str. 2457T
uuacuuuauuuauau

SEQ ID NO: 1901743 - RNA, 12 nt, Shigella flexneri 2a str. 2457T
uuacuuuauuua

SEQ ID NO: 1901744 - RNA, 16 nt, Shigella flexneri 2a str. 2457T
uuacuccacuuccugc

SEQ ID NO: 1901745 - RNA, 20 nt, Shigella flexneri 2a str. 2457T
uuacucccgugccagagcau

SEQ ID NO: 1901746 - RNA, 13 nt, Shigella flexneri 2a str. 2457T
uuacugacugucc

SEQ ID NO: 1901747 - RNA, 19 nt, Shigella flexneri 2a str. 2457T
uuacugacaucaaacccuu

SEQ ID NO: 1901748 - RNA, 12 nt, Shigella flexneri 2a str. 2457T
uuacugcauuca

SEQ ID NO: 1901749 - RNA, 18 nt, Shigella flexneri 2a str. 2457T
uuacugacaauuugccca

SEQ ID NO: 1901750 - RNA, 13 nt, Shigella flexneri 2a str. 2457T
uuacucuccugcg

SEQ ID NO: 1901751 - RNA, 17 nt, Shigella flexneri 2a str. 2457T
uuacucucgccuuugca

SEQ ID NO: 1901752 - RNA, 22 nt, Shigella flexneri 2a str. 2457T
uuaauaccaucggcagcgccaa

SEQ ID NO: 1901753 - RNA, 15 nt, Shigella flexneri 2a str. 2457T
uuaauaccugccugg

SEQ ID NO: 1901754 - RNA, 18 nt, Shigella flexneri 2a str. 2457T
uuaaugcaaucaaaaaug

SEQ ID NO: 1901755 - RNA, 23 nt, Shigella flexneri 2a str. 2457T
uuaaugaucgcgccgccgcccau

SEQ ID NO: 1901756 - RNA, 16 nt, Shigella flexneri 2a str. 2457T
uuaauuauuaacaaaa

SEQ ID NO: 1901757 - RNA, 19 nt, Shigella flexneri 2a str. 2457T
uuaauggcgacauaaaaua

SEQ ID NO: 1901758 - RNA, 20 nt, Shigella flexneri 2a str. 2457T
uuaauggcgauaaucgaacc

SEQ ID NO: 1901759 - RNA, 19 nt, Shigella flexneri 2a str. 2457T
uuaauggucugaaagguau

SEQ ID NO: 1901760 - RNA, 17 nt, Shigella flexneri 2a str. 2457T
uuaaugcgcuuccugca

SEQ ID NO: 1901761 - RNA, 15 nt, Shigella flexneri 2a str. 2457T
uuaaugcgcccagcg

SEQ ID NO: 1901762 - RNA, 16 nt, Shigella flexneri 2a str. 2457T
uuacaacacauuauua

SEQ ID NO: 1901763 - RNA, 16 nt, Shigella flexneri 2a str. 2457T
uuacaagcaacuugca

SEQ ID NO: 1901764 - RNA, 22 nt, Shigella flexneri 2a str. 2457T
uuacaucagcguaggacacaga

SEQ ID NO: 1901765 - RNA, 11 nt, Shigella flexneri 2a str. 2457T
uuacaucauca

SEQ ID NO: 1901766 - RNA, 15 nt, Shigella flexneri 2a str. 2457T
uuacaucaucagaaa

SEQ ID NO: 1901767 - RNA, 16 nt, Shigella flexneri 2a str. 2457T
uuacaucaucagaaau

SEQ ID NO: 1901768 - RNA, 21 nt, Shigella flexneri 2a str. 2457T
uuacagcaacgggcugaagaa

SEQ ID NO: 1901769 - RNA, 13 nt, Shigella flexneri 2a str. 2457T
uuacagcaccuua

SEQ ID NO: 1901770 - RNA, 18 nt, Shigella flexneri 2a str. 2457T
uuacaugcgcgacaaaaa

SEQ ID NO: 1901771 - RNA, 18 nt, Shigella flexneri 2a str. 2457T
uuaccaaauuggcaaaau

SEQ ID NO: 1901772 - RNA, 20 nt, Shigella flexneri 2a str. 2457T
uuaccaaauuggcaaaauuu

SEQ ID NO: 1901773 - RNA, 15 nt, Shigella flexneri 2a str. 2457T
ugccgcuuuuuccag

SEQ ID NO: 1901774 - RNA, 21 nt, Shigella flexneri 2a str. 2457T
ugccggaaggcagccuuucuc

SEQ ID NO: 1901775 - RNA, 19 nt, Shigella flexneri 2a str. 2457T
ugccggaagagagcagccg

SEQ ID NO: 1901776 - RNA, 18 nt, Shigella flexneri 2a str. 2457T
ugccggaacuauuggucu

SEQ ID NO: 1901777 - RNA, 17 nt, Shigella flexneri 2a str. 2457T
ugccggacaugcugccu

SEQ ID NO: 1901778 - RNA, 16 nt, Shigella flexneri 2a str. 2457T
ugccggccagcgccac

SEQ ID NO: 1901779 - RNA, 21 nt, Shigella flexneri 2a str. 2457T
ugccgcguaaucaacauauuc

SEQ ID NO: 1901780 - RNA, 16 nt, Shigella flexneri 2a str. 2457T
ugccgcguaaucaaca

SEQ ID NO: 1901781 - RNA, 14 nt, Shigella flexneri 2a str. 2457T
ugccgcuacaucac

SEQ ID NO: 1901782 - RNA, 22 nt, Shigella flexneri 2a str. 2457T
ugccgcugguguugcugaccaa

SEQ ID NO: 1901783 - RNA, 13 nt, Shigella flexneri 2a str. 2457T
ugccgcuuccagc

SEQ ID NO: 1901784 - RNA, 18 nt, Shigella flexneri 2a str. 2457T
ugccugggcgauuuccuu

SEQ ID NO: 1901785 - RNA, 21 nt, Shigella flexneri 2a str. 2457T
ugccugggcgauuuccuucag

SEQ ID NO: 1901786 - RNA, 20 nt, Shigella flexneri 2a str. 2457T
ugccuggguuuucacagaag

SEQ ID NO: 1901787 - RNA, 22 nt, Shigella flexneri 2a str. 2457T
ugccugggcgauuuccuucagc

SEQ ID NO: 1901788 - RNA, 21 nt, Shigella flexneri 2a str. 2457T
ugccucuccccagcggaaaau

SEQ ID NO: 1901789 - RNA, 17 nt, Shigella flexneri 2a str. 2457T
ugccucugcgcccagca

SEQ ID NO: 1901790 - RNA, 17 nt, Shigella flexneri 2a str. 2457T
ugccucguuggucagcu

SEQ ID NO: 1901791 - RNA, 14 nt, Shigella flexneri 2a str. 2457T
ugccucguucuucc

SEQ ID NO: 1901792 - RNA, 19 nt, Shigella flexneri 2a str. 2457T
ugccucgggauccaugcac

SEQ ID NO: 1901793 - RNA, 19 nt, Shigella flexneri 2a str. 2457T
ugccuaauaaaucuaaaac

SEQ ID NO: 1901794 - RNA, 19 nt, Shigella flexneri 2a str. 2457T
ugccuacacaaugccugau

SEQ ID NO: 1901795 - RNA, 22 nt, Shigella flexneri 2a str. 2457T
ugccuacacaaugccugaugcg

SEQ ID NO: 1901796 - RNA, 23 nt, Shigella flexneri 2a str. 2457T
ugccgguucgacggcuggacaaa

SEQ ID NO: 1901797 - RNA, 18 nt, Shigella flexneri 2a str. 2457T
ugccgguggaagggcuuu

SEQ ID NO: 1901798 - RNA, 21 nt, Shigella flexneri 2a str. 2457T
ugccguaaaucccagugccug

SEQ ID NO: 1901799 - RNA, 14 nt, Shigella flexneri 2a str. 2457T
ugccggugaugccg

SEQ ID NO: 1901800 - RNA, 12 nt, Shigella flexneri 2a str. 2457T
ugccgugcagca

SEQ ID NO: 1901801 - RNA, 19 nt, Shigella flexneri 2a str. 2457T
ugccguggcgauacacuga

SEQ ID NO: 1901802 - RNA, 19 nt, Shigella flexneri 2a str. 2457T
ugccguuauacaucgcuuu

SEQ ID NO: 1901803 - RNA, 22 nt, Shigella flexneri 2a str. 2457T
ugccguugcuugaugcacuggg

SEQ ID NO: 1901804 - RNA, 13 nt, Shigella flexneri 2a str. 2457T
ugccguuaaaacu

SEQ ID NO: 1901805 - RNA, 22 nt, Shigella flexneri 2a str. 2457T
ugcccccaacuuugugcaauug

SEQ ID NO: 1901806 - RNA, 18 nt, Shigella flexneri 2a str. 2457T
ugccccauugcugaugca

SEQ ID NO: 1901807 - RNA, 16 nt, Shigella flexneri 2a str. 2457T
ugccauuugccagacu

SEQ ID NO: 1901808 - RNA, 14 nt, Shigella flexneri 2a str. 2457T
ugccccagugggcu

SEQ ID NO: 1901809 - RNA, 13 nt, Shigella flexneri 2a str. 2457T
ugccccaguuccu

SEQ ID NO: 1901810 - RNA, 13 nt, Shigella flexneri 2a str. 2457T
ugcccgaagccaa

SEQ ID NO: 1901811 - RNA, 14 nt, Shigella flexneri 2a str. 2457T
ugcccgaagccaau

SEQ ID NO: 1901812 - RNA, 15 nt, Shigella flexneri 2a str. 2457T
ugccauuaaaccaac

SEQ ID NO: 1901813 - RNA, 16 nt, Shigella flexneri 2a str. 2457T
ugccauguucaucaag

SEQ ID NO: 1901814 - RNA, 14 nt, Shigella flexneri 2a str. 2457T
ugccauuccacaaa

SEQ ID NO: 1901815 - RNA, 16 nt, Shigella flexneri 2a str. 2457T
ugcccguugccaggac

SEQ ID NO: 1901816 - RNA, 17 nt, Shigella flexneri 2a str. 2457T
ugcccucaauaucuuuc

SEQ ID NO: 1901817 - RNA, 16 nt, Shigella flexneri 2a str. 2457T
ugcccguuaaccauaa

SEQ ID NO: 1901818 - RNA, 14 nt, Shigella flexneri 2a str. 2457T
ugcccgugaugcaa

SEQ ID NO: 1901819 - RNA, 14 nt, Shigella flexneri 2a str. 2457T
ugcccgugcugaca

SEQ ID NO: 1901820 - RNA, 19 nt, Shigella flexneri 2a str. 2457T
ugcccgagauacaucaccg

SEQ ID NO: 1901821 - RNA, 16 nt, Shigella flexneri 2a str. 2457T
ugcccgaccacuucau

SEQ ID NO: 1901822 - RNA, 19 nt, Shigella flexneri 2a str. 2457T
ugcccgaccagauaagaac

SEQ ID NO: 1901823 - RNA, 18 nt, Shigella flexneri 2a str. 2457T
ugcccgaugaccuuguca

SEQ ID NO: 1901824 - RNA, 16 nt, Shigella flexneri 2a str. 2457T
ugcccugcugguuagc

SEQ ID NO: 1901825 - RNA, 15 nt, Shigella flexneri 2a str. 2457T
ugcccugcuaugcaa

SEQ ID NO: 1901826 - RNA, 18 nt, Shigella flexneri 2a str. 2457T
ugccgaucaauuucacag

SEQ ID NO: 1901827 - RNA, 18 nt, Shigella flexneri 2a str. 2457T
ugccgaucaccacggaaa

SEQ ID NO: 1901828 - RNA, 14 nt, Shigella flexneri 2a str. 2457T
ugccgauaaauaca

SEQ ID NO: 1901829 - RNA, 17 nt, Shigella flexneri 2a str. 2457T
ugccgcccuaaagggcg

SEQ ID NO: 1901830 - RNA, 20 nt, Shigella flexneri 2a str. 2457T
ugccgcccuaaagggcggca

SEQ ID NO: 1901831 - RNA, 20 nt, Shigella flexneri 2a str. 2457T
ugccgcagaagaucagaaau

SEQ ID NO: 1901832 - RNA, 22 nt, Shigella flexneri 2a str. 2457T
ugccgcagcuucuguuauucca

SEQ ID NO: 1901833 - RNA, 13 nt, Shigella flexneri 2a str. 2457T
ugccgcagcuucu

SEQ ID NO: 1901834 - RNA, 15 nt, Shigella flexneri 2a str. 2457T
ugccgcauccggcau

SEQ ID NO: 1901835 - RNA, 13 nt, Shigella flexneri 2a str. 2457T
ugccgccucugcc

SEQ ID NO: 1901836 - RNA, 16 nt, Shigella flexneri 2a str. 2457T
ugccgccucugccgca

SEQ ID NO: 1901837 - RNA, 22 nt, Shigella flexneri 2a str. 2457T
ugccagacgaauaaaacagaaa

SEQ ID NO: 1901838 - RNA, 23 nt, Shigella flexneri 2a str. 2457T
ugccagaauuaacgcugacaccc

SEQ ID NO: 1901839 - RNA, 18 nt, Shigella flexneri 2a str. 2457T
ugccagacaacaugagaa

SEQ ID NO: 1901840 - RNA, 17 nt, Shigella flexneri 2a str. 2457T
ugccagauucuccaaca

SEQ ID NO: 1901841 - RNA, 22 nt, Shigella flexneri 2a str. 2457T
ugccagcccuaaucccgugccg

SEQ ID NO: 1901842 - RNA, 20 nt, Shigella flexneri 2a str. 2457T
ugccagauuuaacggcagca

SEQ ID NO: 1901843 - RNA, 14 nt, Shigella flexneri 2a str. 2457T
ugccagauagccag

SEQ ID NO: 1901844 - RNA, 16 nt, Shigella flexneri 2a str. 2457T
ugccagauaaauauua

SEQ ID NO: 1901845 - RNA, 21 nt, Shigella flexneri 2a str. 2457T
ugccagaggagccaucaccau

SEQ ID NO: 1901846 - RNA, 16 nt, Shigella flexneri 2a str. 2457T
ugccagauaagacacu

SEQ ID NO: 1901847 - RNA, 20 nt, Shigella flexneri 2a str. 2457T
ugccagggcuuuuuuauuuc

SEQ ID NO: 1901848 - RNA, 23 nt, Shigella flexneri 2a str. 2457T
ugccaggguggcucaaucgccac

SEQ ID NO: 1901849 - RNA, 21 nt, Shigella flexneri 2a str. 2457T
ugccagguaaacaccuucauc

SEQ ID NO: 1901850 - RNA, 22 nt, Shigella flexneri 2a str. 2457T
ugccaggucaucauugcaguca

SEQ ID NO: 1901851 - RNA, 15 nt, Shigella flexneri 2a str. 2457T
ugccagcgccgacgg

SEQ ID NO: 1901852 - RNA, 16 nt, Shigella flexneri 2a str. 2457T
ugccagcgaagaagug

SEQ ID NO: 1901853 - RNA, 19 nt, Shigella flexneri 2a str. 2457T
ugccaucgcauagcgcaau

SEQ ID NO: 1901854 - RNA, 23 nt, Shigella flexneri 2a str. 2457T
ugccaucgcauagcgcaauaaca

SEQ ID NO: 1901855 - RNA, 15 nt, Shigella flexneri 2a str. 2457T
ugccaucgggcuaga

SEQ ID NO: 1901856 - RNA, 18 nt, Shigella flexneri 2a str. 2457T
ugccaucugccagcaagc

SEQ ID NO: 1901857 - RNA, 19 nt, Shigella flexneri 2a str. 2457T
ugccaugaccgcuccgcca

SEQ ID NO: 1901858 - RNA, 16 nt, Shigella flexneri 2a str. 2457T
ugccaucaucaccaga

SEQ ID NO: 1901859 - RNA, 14 nt, Shigella flexneri 2a str. 2457T
ugccauccagcuuu

SEQ ID NO: 1901860 - RNA, 19 nt, Shigella flexneri 2a str. 2457T
ugccaguaauccggcuucc

SEQ ID NO: 1901861 - RNA, 23 nt, Shigella flexneri 2a str. 2457T
ugccaguacgccaaucugcaaaa

SEQ ID NO: 1901862 - RNA, 19 nt, Shigella flexneri 2a str. 2457T
ugccaguacgccaaucugc

SEQ ID NO: 1901863 - RNA, 16 nt, Shigella flexneri 2a str. 2457T
ugccacguucugaucu

SEQ ID NO: 1901864 - RNA, 15 nt, Shigella flexneri 2a str. 2457T
ugccaccugugcaau

SEQ ID NO: 1901865 - RNA, 22 nt, Shigella flexneri 2a str. 2457T
ugccacgcacaggugcaaaaaa

SEQ ID NO: 1901866 - RNA, 23 nt, Shigella flexneri 2a str. 2457T
ugccacgcacaggugcaaaaaaa

SEQ ID NO: 1901867 - RNA, 19 nt, Shigella flexneri 2a str. 2457T
ugccaccuccaagccugau

SEQ ID NO: 1901868 - RNA, 19 nt, Shigella flexneri 2a str. 2457T
ugccacacgcucuuccagg

SEQ ID NO: 1901869 - RNA, 15 nt, Shigella flexneri 2a str. 2457T
ugccaaauauuucuu

SEQ ID NO: 1901870 - RNA, 20 nt, Shigella flexneri 2a str. 2457T
ugccaaauauuucuuuauca

SEQ ID NO: 1901871 - RNA, 21 nt, Shigella flexneri 2a str. 2457T
ugccacacaggccauuucccc

SEQ ID NO: 1901872 - RNA, 11 nt, Shigella flexneri 2a str. 2457T
ugccacaaacg

SEQ ID NO: 1901873 - RNA, 22 nt, Shigella flexneri 2a str. 2457T
ugcauuccaguccacaucaacc

SEQ ID NO: 1901874 - RNA, 18 nt, Shigella flexneri 2a str. 2457T
ugcauugauggaguaguu

SEQ ID NO: 1901875 - RNA, 18 nt, Shigella flexneri 2a str. 2457T
ugcauuuccauaaauugc

SEQ ID NO: 1901876 - RNA, 20 nt, Shigella flexneri 2a str. 2457T
ugcauuucgcuaccaccaaa

SEQ ID NO: 1901877 - RNA, 14 nt, Shigella flexneri 2a str. 2457T
ugccaaagucauca

SEQ ID NO: 1901878 - RNA, 18 nt, Shigella flexneri 2a str. 2457T
ugccaaagucaucaaucg

SEQ ID NO: 1901879 - RNA, 18 nt, Shigella flexneri 2a str. 2457T
ugccaaacgcguccauca

SEQ ID NO: 1901880 - RNA, 15 nt, Shigella flexneri 2a str. 2457T
ugccaaaaugcugga

SEQ ID NO: 1901881 - RNA, 11 nt, Shigella flexneri 2a str. 2457T
ugcaucaacca

SEQ ID NO: 1901882 - RNA, 18 nt, Shigella flexneri 2a str. 2457T
ugcaucacgcgcaucugu

SEQ ID NO: 1901883 - RNA, 22 nt, Shigella flexneri 2a str. 2457T
ugcaucacauccggcaauauuc

SEQ ID NO: 1901884 - RNA, 23 nt, Shigella flexneri 2a str. 2457T
ugcauaucaguuggggaaaaguu

SEQ ID NO: 1901885 - RNA, 16 nt, Shigella flexneri 2a str. 2457T
ugcauacggugaaagu

SEQ ID NO: 1901886 - RNA, 15 nt, Shigella flexneri 2a str. 2457T
ugcauagcgauaaga

SEQ ID NO: 1901887 - RNA, 16 nt, Shigella flexneri 2a str. 2457T
ugcauagcgauaagaa

SEQ ID NO: 1901888 - RNA, 23 nt, Shigella flexneri 2a str. 2457T
ugcauaaucgcaacgccuuccgu

SEQ ID NO: 1901889 - RNA, 16 nt, Shigella flexneri 2a str. 2457T
ugcauacaguacgugu

SEQ ID NO: 1901890 - RNA, 15 nt, Shigella flexneri 2a str. 2457T
ugcaguuccugcaac

SEQ ID NO: 1901891 - RNA, 17 nt, Shigella flexneri 2a str. 2457T
ugcaguuccugcaacuu

SEQ ID NO: 1901892 - RNA, 13 nt, Shigella flexneri 2a str. 2457T
ugcaguuccugcc

SEQ ID NO: 1901893 - RNA, 17 nt, Shigella flexneri 2a str. 2457T
ugcaguuccugccagau

SEQ ID NO: 1901894 - RNA, 17 nt, Shigella flexneri 2a str. 2457T
ugcacucgcauccucuu

SEQ ID NO: 1901895 - RNA, 19 nt, Shigella flexneri 2a str. 2457T
ugcagugcauccagcagcc

SEQ ID NO: 1901896 - RNA, 17 nt, Shigella flexneri 2a str. 2457T
ugcagugccgcugcucg

SEQ ID NO: 1901897 - RNA, 15 nt, Shigella flexneri 2a str. 2457T
ugcaguuaaaauagg

SEQ ID NO: 1901898 - RNA, 17 nt, Shigella flexneri 2a str. 2457T
ugcauggucgauucuua

SEQ ID NO: 1901899 - RNA, 19 nt, Shigella flexneri 2a str. 2457T
ugcauggucgauucuuaua

SEQ ID NO: 1901900 - RNA, 16 nt, Shigella flexneri 2a str. 2457T
ugcauccacuuugguu

SEQ ID NO: 1901901 - RNA, 13 nt, Shigella flexneri 2a str. 2457T
ugcaucagucacg

SEQ ID NO: 1901902 - RNA, 15 nt, Shigella flexneri 2a str. 2457T
ugcaucauggaagca

SEQ ID NO: 1901903 - RNA, 15 nt, Shigella flexneri 2a str. 2457T
ugcauccgcugcgca

SEQ ID NO: 1901904 - RNA, 20 nt, Shigella flexneri 2a str. 2457T
ugcauccgcuuacucaucca

SEQ ID NO: 1901905 - RNA, 23 nt, Shigella flexneri 2a str. 2457T
ugcauccggucagacaacuuccc

SEQ ID NO: 1901906 - RNA, 17 nt, Shigella flexneri 2a str. 2457T
ugcaucgacagcgccuu

SEQ ID NO: 1901907 - RNA, 15 nt, Shigella flexneri 2a str. 2457T
ugcaucaugaaaacc

SEQ ID NO: 1901908 - RNA, 13 nt, Shigella flexneri 2a str. 2457T
ugcauccagcucg

SEQ ID NO: 1901909 - RNA, 17 nt, Shigella flexneri 2a str. 2457T
ugcaucgcgaccaauca

SEQ ID NO: 1901910 - RNA, 14 nt, Shigella flexneri 2a str. 2457T
ugcaucgccaaucu

SEQ ID NO: 1901911 - RNA, 23 nt, Shigella flexneri 2a str. 2457T
ugcaucgccauaauaagcgccau

SEQ ID NO: 1901912 - RNA, 22 nt, Shigella flexneri 2a str. 2457T
ugcaucgucuguuuuaucuccc

SEQ ID NO: 1901913 - RNA, 18 nt, Shigella flexneri 2a str. 2457T
ugcaucguauugguacau

SEQ ID NO: 1901914 - RNA, 14 nt, Shigella flexneri 2a str. 2457T
ugcaucggcauaau

SEQ ID NO: 1901915 - RNA, 11 nt, Shigella flexneri 2a str. 2457T
ugcaucggcaa

SEQ ID NO: 1901916 - RNA, 15 nt, Shigella flexneri 2a str. 2457T
ugcaucggugcgcug

SEQ ID NO: 1901917 - RNA, 15 nt, Shigella flexneri 2a str. 2457T
ugcaucuccugacac

SEQ ID NO: 1901918 - RNA, 13 nt, Shigella flexneri 2a str. 2457T
ugcaucugaaacu

SEQ ID NO: 1901919 - RNA, 12 nt, Shigella flexneri 2a str. 2457T
ugcaucugaaac

SEQ ID NO: 1901920 - RNA, 17 nt, Shigella flexneri 2a str. 2457T
ugcgcuaaacaggaucu

SEQ ID NO: 1901921 - RNA, 16 nt, Shigella flexneri 2a str. 2457T
ugcgcuaaauguuuag

SEQ ID NO: 1901922 - RNA, 14 nt, Shigella flexneri 2a str. 2457T
ugcgcgugcagugg

SEQ ID NO: 1901923 - RNA, 18 nt, Shigella flexneri 2a str. 2457T
ugcgcuuucgcaccaaca

SEQ ID NO: 1901924 - RNA, 15 nt, Shigella flexneri 2a str. 2457T
ugcgcuuucuuaaau

SEQ ID NO: 1901925 - RNA, 16 nt, Shigella flexneri 2a str. 2457T
ugcgcuuuauucagau

SEQ ID NO: 1901926 - RNA, 16 nt, Shigella flexneri 2a str. 2457T
ugcggacaaaacguga

SEQ ID NO: 1901927 - RNA, 22 nt, Shigella flexneri 2a str. 2457T
ugcggacaaaacgugacagcau

SEQ ID NO: 1901928 - RNA, 19 nt, Shigella flexneri 2a str. 2457T
ugcggaagucgcagcugcc

SEQ ID NO: 1901929 - RNA, 17 nt, Shigella flexneri 2a str. 2457T
ugcggaacccagcgcga

SEQ ID NO: 1901930 - RNA, 14 nt, Shigella flexneri 2a str. 2457T
ugcggaaauuccag

SEQ ID NO: 1901931 - RNA, 17 nt, Shigella flexneri 2a str. 2457T
ugcggaaauuccagcgg

SEQ ID NO: 1901932 - RNA, 19 nt, Shigella flexneri 2a str. 2457T
ugcggagacucaaaccccg

SEQ ID NO: 1901933 - RNA, 18 nt, Shigella flexneri 2a str. 2457T
ugcggagguuucuuuuua

SEQ ID NO: 1901934 - RNA, 13 nt, Shigella flexneri 2a str. 2457T
ugcggaucugcuc

SEQ ID NO: 1901935 - RNA, 14 nt, Shigella flexneri 2a str. 2457T
ugcggcgaggaauc

SEQ ID NO: 1901936 - RNA, 12 nt, Shigella flexneri 2a str. 2457T
ugcggccagcag

SEQ ID NO: 1901937 - RNA, 16 nt, Shigella flexneri 2a str. 2457T
ugcggcauucccagcc

SEQ ID NO: 1901938 - RNA, 17 nt, Shigella flexneri 2a str. 2457T
ugcggcaucuucuccac

SEQ ID NO: 1901939 - RNA, 14 nt, Shigella flexneri 2a str. 2457T
ugcggccagcagcu

SEQ ID NO: 1901940 - RNA, 16 nt, Shigella flexneri 2a str. 2457T
ugcgugaguuuuuguc

SEQ ID NO: 1901941 - RNA, 15 nt, Shigella flexneri 2a str. 2457T
ugcgucuuccgugcc

SEQ ID NO: 1901942 - RNA, 15 nt, Shigella flexneri 2a str. 2457T
ugcguugcgcuucuc

SEQ ID NO: 1901943 - RNA, 16 nt, Shigella flexneri 2a str. 2457T
ugcguaaucgccgaac

SEQ ID NO: 1901944 - RNA, 21 nt, Shigella flexneri 2a str. 2457T
ugcguaaucuuuucauauuau

SEQ ID NO: 1901945 - RNA, 13 nt, Shigella flexneri 2a str. 2457T
ugcgguggaguua

SEQ ID NO: 1901946 - RNA, 22 nt, Shigella flexneri 2a str. 2457T
ugcggcgcaagcggcgacugag

SEQ ID NO: 1901947 - RNA, 19 nt, Shigella flexneri 2a str. 2457T
ugcggcgcaugcauuuuca

SEQ ID NO: 1901948 - RNA, 15 nt, Shigella flexneri 2a str. 2457T
ugcgggcgaaaacau

SEQ ID NO: 1901949 - RNA, 23 nt, Shigella flexneri 2a str. 2457T
ugcggucguaaucgcccgcuucc

SEQ ID NO: 1901950 - RNA, 20 nt, Shigella flexneri 2a str. 2457T
ugcggucguaugcuggaagc

SEQ ID NO: 1901951 - RNA, 22 nt, Shigella flexneri 2a str. 2457T
ugcggucguaugcuggaagcgc

SEQ ID NO: 1901952 - RNA, 19 nt, Shigella flexneri 2a str. 2457T
ugcggugccauuaaaccaa

SEQ ID NO: 1901953 - RNA, 18 nt, Shigella flexneri 2a str. 2457T
ugcgcgcaaucagcaccg

SEQ ID NO: 1901954 - RNA, 20 nt, Shigella flexneri 2a str. 2457T
ugcgccuacggcauucugca

SEQ ID NO: 1901955 - RNA, 16 nt, Shigella flexneri 2a str. 2457T
ugcgccguuuuuuuuc

SEQ ID NO: 1901956 - RNA, 17 nt, Shigella flexneri 2a str. 2457T
ugcgcgacuucauucag

SEQ ID NO: 1901957 - RNA, 17 nt, Shigella flexneri 2a str. 2457T
ugcgcgacucccugacu

SEQ ID NO: 1901958 - RNA, 21 nt, Shigella flexneri 2a str. 2457T
ugcgcgaccaacugcaaggcc

SEQ ID NO: 1901959 - RNA, 16 nt, Shigella flexneri 2a str. 2457T
ugcgccaugcuucaau

SEQ ID NO: 1901960 - RNA, 21 nt, Shigella flexneri 2a str. 2457T
ugcgccauuuuuuugucugcu

SEQ ID NO: 1901961 - RNA, 23 nt, Shigella flexneri 2a str. 2457T
ugcgcccgaaugcgaaaauccuc

SEQ ID NO: 1901962 - RNA, 21 nt, Shigella flexneri 2a str. 2457T
ugcgccccacaccaccaugcu

SEQ ID NO: 1901963 - RNA, 19 nt, Shigella flexneri 2a str. 2457T
ugcgccgccucugcgcuuu

SEQ ID NO: 1901964 - RNA, 21 nt, Shigella flexneri 2a str. 2457T
ugcgcccugggcuucauccag

SEQ ID NO: 1901965 - RNA, 13 nt, Shigella flexneri 2a str. 2457T
ugccuuccauccc

SEQ ID NO: 1901966 - RNA, 14 nt, Shigella flexneri 2a str. 2457T
ugccuuccaucccu

SEQ ID NO: 1901967 - RNA, 20 nt, Shigella flexneri 2a str. 2457T
ugccuucggcgucuccaccu

SEQ ID NO: 1901968 - RNA, 11 nt, Shigella flexneri 2a str. 2457T
ugccuuccagc

SEQ ID NO: 1901969 - RNA, 20 nt, Shigella flexneri 2a str. 2457T
ugccuuccagcgaugcccag

SEQ ID NO: 1901970 - RNA, 12 nt, Shigella flexneri 2a str. 2457T
ugcgccacaucc

SEQ ID NO: 1901971 - RNA, 21 nt, Shigella flexneri 2a str. 2457T
ugcgccaggauaagcgccgcu

SEQ ID NO: 1901972 - RNA, 13 nt, Shigella flexneri 2a str. 2457T
ugcgccagcgcgc

SEQ ID NO: 1901973 - RNA, 17 nt, Shigella flexneri 2a str. 2457T
ugcgccaguagggcguc

SEQ ID NO: 1901974 - RNA, 19 nt, Shigella flexneri 2a str. 2457T
ugcuuuauacgaugccugc

SEQ ID NO: 1901975 - RNA, 15 nt, Shigella flexneri 2a str. 2457T
ugcuuuaaguucagc

SEQ ID NO: 1901976 - RNA, 15 nt, Shigella flexneri 2a str. 2457T
ugcuuuaaucgccuu

SEQ ID NO: 1901977 - RNA, 19 nt, Shigella flexneri 2a str. 2457T
ugcuuugguggucaccaug

SEQ ID NO: 1901978 - RNA, 15 nt, Shigella flexneri 2a str. 2457T
ugcuuuucccuccac

SEQ ID NO: 1901979 - RNA, 20 nt, Shigella flexneri 2a str. 2457T
ugcuuuuaccauacuggauu

SEQ ID NO: 1901980 - RNA, 23 nt, Shigella flexneri 2a str. 2457T
ugcuuaucgcccugcuccagcaa

SEQ ID NO: 1901981 - RNA, 14 nt, Shigella flexneri 2a str. 2457T
ugcuuauccucugu

SEQ ID NO: 1901982 - RNA, 19 nt, Shigella flexneri 2a str. 2457T
ugcuucaauuuccugacgu

SEQ ID NO: 1901983 - RNA, 13 nt, Shigella flexneri 2a str. 2457T
ugcuucaccagca

SEQ ID NO: 1901984 - RNA, 16 nt, Shigella flexneri 2a str. 2457T
ugcuucaccagcagcg

SEQ ID NO: 1901985 - RNA, 18 nt, Shigella flexneri 2a str. 2457T
ugcuugacgugucuuauc

SEQ ID NO: 1901986 - RNA, 23 nt, Shigella flexneri 2a str. 2457T
ugcuugcacaaccggaaccagcg

SEQ ID NO: 1901987 - RNA, 12 nt, Shigella flexneri 2a str. 2457T
ugcuugaggcug

SEQ ID NO: 1901988 - RNA, 14 nt, Shigella flexneri 2a str. 2457T
ugcuugaagggcug

SEQ ID NO: 1901989 - RNA, 18 nt, Shigella flexneri 2a str. 2457T
ugcuugaagggcuggcug

SEQ ID NO: 1901990 - RNA, 14 nt, Shigella flexneri 2a str. 2457T
ugcuugacaacuua

SEQ ID NO: 1901991 - RNA, 19 nt, Shigella flexneri 2a str. 2457T
ugcuucacgcccagaucca

SEQ ID NO: 1901992 - RNA, 19 nt, Shigella flexneri 2a str. 2457T
ugcuucaggacuucuuugc

SEQ ID NO: 1901993 - RNA, 15 nt, Shigella flexneri 2a str. 2457T
ugcuguugaugcgua

SEQ ID NO: 1901994 - RNA, 20 nt, Shigella flexneri 2a str. 2457T
ugcuguucgguuuugcccac

SEQ ID NO: 1901995 - RNA, 22 nt, Shigella flexneri 2a str. 2457T
ugcuguuacgccagaacagcua

SEQ ID NO: 1901996 - RNA, 19 nt, Shigella flexneri 2a str. 2457T
ugcuguucgagcaucacau

SEQ ID NO: 1901997 - RNA, 21 nt, Shigella flexneri 2a str. 2457T
ugcuguaauuucacaccauca

SEQ ID NO: 1901998 - RNA, 16 nt, Shigella flexneri 2a str. 2457T
ugcuguguucaauauc

SEQ ID NO: 1901999 - RNA, 15 nt, Shigella flexneri 2a str. 2457T
ugcugugguuugccc

SEQ ID NO: 1902000 - RNA, 17 nt, Shigella flexneri 2a str. 2457T
ugcuguacauauccagu

SEQ ID NO: 1902001 - RNA, 14 nt, Shigella flexneri 2a str. 2457T
ugcuguaauuucac

SEQ ID NO: 1902002 - RNA, 18 nt, Shigella flexneri 2a str. 2457T
ugcugguuuugugcgcca

SEQ ID NO: 1902003 - RNA, 16 nt, Shigella flexneri 2a str. 2457T
ugcuggggccgucauu

SEQ ID NO: 1902004 - RNA, 15 nt, Shigella flexneri 2a str. 2457T
ugcugcugauccagc

SEQ ID NO: 1902005 - RNA, 18 nt, Shigella flexneri 2a str. 2457T
ugcugcugauccagcuuc

SEQ ID NO: 1902006 - RNA, 12 nt, Shigella flexneri 2a str. 2457T
ugcugcucugaa

SEQ ID NO: 1902007 - RNA, 16 nt, Shigella flexneri 2a str. 2457T
ugcugccgccaguucu

SEQ ID NO: 1902008 - RNA, 16 nt, Shigella flexneri 2a str. 2457T
ugcugccgauggcaca

SEQ ID NO: 1902009 - RNA, 18 nt, Shigella flexneri 2a str. 2457T
ugcugcuuuaucagauca

SEQ ID NO: 1902010 - RNA, 15 nt, Shigella flexneri 2a str. 2457T
ugcuggaagcuggca

SEQ ID NO: 1902011 - RNA, 19 nt, Shigella flexneri 2a str. 2457T
ugcuggaacaaacugccgc

SEQ ID NO: 1902012 - RNA, 18 nt, Shigella flexneri 2a str. 2457T
ugcucgcccuggaugcag

SEQ ID NO: 1902013 - RNA, 16 nt, Shigella flexneri 2a str. 2457T
ugcucguaaguuaacu

SEQ ID NO: 1902014 - RNA, 20 nt, Shigella flexneri 2a str. 2457T
ugcucgccacgucacucuuu

SEQ ID NO: 1902015 - RNA, 16 nt, Shigella flexneri 2a str. 2457T
ugcucgcaggcugaga

SEQ ID NO: 1902016 - RNA, 22 nt, Shigella flexneri 2a str. 2457T
ugcuccggguagagguuauaaa

SEQ ID NO: 1902017 - RNA, 22 nt, Shigella flexneri 2a str. 2457T
ugcucgaacauccccacagaaa

SEQ ID NO: 1902018 - RNA, 23 nt, Shigella flexneri 2a str. 2457T
ugcuccgccgcagccgcauuuuu

SEQ ID NO: 1902019 - RNA, 14 nt, Shigella flexneri 2a str. 2457T
ugcuccacuccugc

SEQ ID NO: 1902020 - RNA, 22 nt, Shigella flexneri 2a str. 2457T
ugcucacagaguauuuccagcu

SEQ ID NO: 1902021 - RNA, 15 nt, Shigella flexneri 2a str. 2457T
ugcucauaaaaugau

SEQ ID NO: 1902022 - RNA, 16 nt, Shigella flexneri 2a str. 2457T
ugcucaaugagcaccu

SEQ ID NO: 1902023 - RNA, 13 nt, Shigella flexneri 2a str. 2457T
ugcucaaugaguu

SEQ ID NO: 1902024 - RNA, 23 nt, Shigella flexneri 2a str. 2457T
ugcucaauugacaguuuauuuuc

SEQ ID NO: 1902025 - RNA, 18 nt, Shigella flexneri 2a str. 2457T
ugcucauucuuccuccag

SEQ ID NO: 1902026 - RNA, 23 nt, Shigella flexneri 2a str. 2457T
ugcucauagaccauugcaucauc

SEQ ID NO: 1902027 - RNA, 14 nt, Shigella flexneri 2a str. 2457T
ugcucaucagcccg

SEQ ID NO: 1902028 - RNA, 22 nt, Shigella flexneri 2a str. 2457T
ugcucaucagcgguaaaacgcc

SEQ ID NO: 1902029 - RNA, 17 nt, Shigella flexneri 2a str. 2457T
ugcucaaucaucacgau

SEQ ID NO: 1902030 - RNA, 14 nt, Shigella flexneri 2a str. 2457T
ugcucaacugccag

SEQ ID NO: 1902031 - RNA, 19 nt, Shigella flexneri 2a str. 2457T
ugcugccaaagugacacaa

SEQ ID NO: 1902032 - RNA, 19 nt, Shigella flexneri 2a str. 2457T
ugcugccgacaaaugcagu

SEQ ID NO: 1902033 - RNA, 14 nt, Shigella flexneri 2a str. 2457T
ugcugcacgaaauu

SEQ ID NO: 1902034 - RNA, 23 nt, Shigella flexneri 2a str. 2457T
ugcugauacuccaugaguaacag

SEQ ID NO: 1902035 - RNA, 14 nt, Shigella flexneri 2a str. 2457T
ugcugaugcacgau

SEQ ID NO: 1902036 - RNA, 17 nt, Shigella flexneri 2a str. 2457T
ugcugcacauacugcau

SEQ ID NO: 1902037 - RNA, 21 nt, Shigella flexneri 2a str. 2457T
ugcugcaccaacaucaugcca

SEQ ID NO: 1902038 - RNA, 19 nt, Shigella flexneri 2a str. 2457T
ugcugauuaucggcaucac

SEQ ID NO: 1902039 - RNA, 16 nt, Shigella flexneri 2a str. 2457T
ugcucuuuucuuuauc

SEQ ID NO: 1902040 - RNA, 13 nt, Shigella flexneri 2a str. 2457T
ugcugaaaucaca

SEQ ID NO: 1902041 - RNA, 16 nt, Shigella flexneri 2a str. 2457T
ugcucuuuuugcauaa

SEQ ID NO: 1902042 - RNA, 22 nt, Shigella flexneri 2a str. 2457T
ugcucguuauucagccugacag

SEQ ID NO: 1902043 - RNA, 14 nt, Shigella flexneri 2a str. 2457T
ugcucguucagcgg

SEQ ID NO: 1902044 - RNA, 12 nt, Shigella flexneri 2a str. 2457T
ugcucuuucagc

SEQ ID NO: 1902045 - RNA, 16 nt, Shigella flexneri 2a str. 2457T
ugcucuuucagcaccg

SEQ ID NO: 1902046 - RNA, 19 nt, Shigella flexneri 2a str. 2457T
ugcugaacagcuuuuuccu

SEQ ID NO: 1902047 - RNA, 20 nt, Shigella flexneri 2a str. 2457T
ugcugacgcagauccugauu

SEQ ID NO: 1902048 - RNA, 17 nt, Shigella flexneri 2a str. 2457T
ugcugacgcaucuucuc

SEQ ID NO: 1902049 - RNA, 15 nt, Shigella flexneri 2a str. 2457T
ugcugacggcacuac

SEQ ID NO: 1902050 - RNA, 19 nt, Shigella flexneri 2a str. 2457T
ugcugacuuugauccagcc

SEQ ID NO: 1902051 - RNA, 21 nt, Shigella flexneri 2a str. 2457T
ugcugagcggcguaccuucag

SEQ ID NO: 1902052 - RNA, 17 nt, Shigella flexneri 2a str. 2457T
ugaauagcggaaaucuc

SEQ ID NO: 1902053 - RNA, 19 nt, Shigella flexneri 2a str. 2457T
ugaauagcgcaaaauuaug

SEQ ID NO: 1902054 - RNA, 17 nt, Shigella flexneri 2a str. 2457T
ugaauauucggcuccag

SEQ ID NO: 1902055 - RNA, 21 nt, Shigella flexneri 2a str. 2457T
ugaauauaccauggaagaaaa

SEQ ID NO: 1902056 - RNA, 22 nt, Shigella flexneri 2a str. 2457T
ugaauauugccggaugugaugc

SEQ ID NO: 1902057 - RNA, 16 nt, Shigella flexneri 2a str. 2457T
ugaauaacaccagcca

SEQ ID NO: 1902058 - RNA, 18 nt, Shigella flexneri 2a str. 2457T
ugaauaacaccagccaga

SEQ ID NO: 1902059 - RNA, 20 nt, Shigella flexneri 2a str. 2457T
ugaauaaaguuuuaguugcc

SEQ ID NO: 1902060 - RNA, 15 nt, Shigella flexneri 2a str. 2457T
ugaauaauacacaca

SEQ ID NO: 1902061 - RNA, 22 nt, Shigella flexneri 2a str. 2457T
ugaagugugcaaacgauaaaag

SEQ ID NO: 1902062 - RNA, 20 nt, Shigella flexneri 2a str. 2457T
ugaagugagaauuuuucacu

SEQ ID NO: 1902063 - RNA, 22 nt, Shigella flexneri 2a str. 2457T
ugaagucuuuuuucaacuuuau

SEQ ID NO: 1902064 - RNA, 18 nt, Shigella flexneri 2a str. 2457T
ugaagucgcgcucaucag

SEQ ID NO: 1902065 - RNA, 17 nt, Shigella flexneri 2a str. 2457T
ugaagucucaauuagua

SEQ ID NO: 1902066 - RNA, 21 nt, Shigella flexneri 2a str. 2457T
ugaagucagggucuuccagca

SEQ ID NO: 1902067 - RNA, 13 nt, Shigella flexneri 2a str. 2457T
ugaaguagccagu

SEQ ID NO: 1902068 - RNA, 21 nt, Shigella flexneri 2a str. 2457T
ugaaguacgaaaaaaccggga

SEQ ID NO: 1902069 - RNA, 23 nt, Shigella flexneri 2a str. 2457T
ugaagugugcaaacgauaaaagu

SEQ ID NO: 1902070 - RNA, 15 nt, Shigella flexneri 2a str. 2457T
ugaauuacuucucuu

SEQ ID NO: 1902071 - RNA, 21 nt, Shigella flexneri 2a str. 2457T
ugaauuaaacacgggguuaaa

SEQ ID NO: 1902072 - RNA, 15 nt, Shigella flexneri 2a str. 2457T
ugaauuugcaugacu

SEQ ID NO: 1902073 - RNA, 18 nt, Shigella flexneri 2a str. 2457T
ugaauuucuaucaaggcg

SEQ ID NO: 1902074 - RNA, 17 nt, Shigella flexneri 2a str. 2457T
ugaauuugucgauuucc

SEQ ID NO: 1902075 - RNA, 21 nt, Shigella flexneri 2a str. 2457T
ugacaauaauugucaacggca

SEQ ID NO: 1902076 - RNA, 13 nt, Shigella flexneri 2a str. 2457T
ugaaucaacacca

SEQ ID NO: 1902077 - RNA, 17 nt, Shigella flexneri 2a str. 2457T
ugaaucaccacaggccu

SEQ ID NO: 1902078 - RNA, 20 nt, Shigella flexneri 2a str. 2457T
ugaauggggcuaucucaccc

SEQ ID NO: 1902079 - RNA, 19 nt, Shigella flexneri 2a str. 2457T
ugaaugccguaggcccagc

SEQ ID NO: 1902080 - RNA, 13 nt, Shigella flexneri 2a str. 2457T
ugaaugcggcagg

SEQ ID NO: 1902081 - RNA, 17 nt, Shigella flexneri 2a str. 2457T
ugaaugcggcaggcaca

SEQ ID NO: 1902082 - RNA, 21 nt, Shigella flexneri 2a str. 2457T
ugaagauggucuguaccacca

SEQ ID NO: 1902083 - RNA, 20 nt, Shigella flexneri 2a str. 2457T
ugaagccaaccgggccgcag

SEQ ID NO: 1902084 - RNA, 14 nt, Shigella flexneri 2a str. 2457T
ugaagcgcugggga

SEQ ID NO: 1902085 - RNA, 14 nt, Shigella flexneri 2a str. 2457T
ugaagggcuggcug

SEQ ID NO: 1902086 - RNA, 22 nt, Shigella flexneri 2a str. 2457T
ugaagguuucugcauuauccag

SEQ ID NO: 1902087 - RNA, 22 nt, Shigella flexneri 2a str. 2457T
ugaagguuguuaaccaccagua

SEQ ID NO: 1902088 - RNA, 19 nt, Shigella flexneri 2a str. 2457T
ugaagcuggcagaaguugu

SEQ ID NO: 1902089 - RNA, 20 nt, Shigella flexneri 2a str. 2457T
ugaagcuggcagaaguuguc

SEQ ID NO: 1902090 - RNA, 16 nt, Shigella flexneri 2a str. 2457T
ugaaggcaaacuucuc

SEQ ID NO: 1902091 - RNA, 20 nt, Shigella flexneri 2a str. 2457T
ugaaggaugaaacugccgga

SEQ ID NO: 1902092 - RNA, 12 nt, Shigella flexneri 2a str. 2457T
ugaagaaaucag

SEQ ID NO: 1902093 - RNA, 18 nt, Shigella flexneri 2a str. 2457T
ugaagaaccgcaccaggc

SEQ ID NO: 1902094 - RNA, 16 nt, Shigella flexneri 2a str. 2457T
ugaacugggcgcggcc

SEQ ID NO: 1902095 - RNA, 22 nt, Shigella flexneri 2a str. 2457T
ugaacuucgcagccgugacugg

SEQ ID NO: 1902096 - RNA, 16 nt, Shigella flexneri 2a str. 2457T
ugaagaauuuuugcgg

SEQ ID NO: 1902097 - RNA, 17 nt, Shigella flexneri 2a str. 2457T
ugaagaguuugaucaug

SEQ ID NO: 1902098 - RNA, 18 nt, Shigella flexneri 2a str. 2457T
ugaagaggaacaaauuuu

SEQ ID NO: 1902099 - RNA, 14 nt, Shigella flexneri 2a str. 2457T
ugaacgccuuaucc

SEQ ID NO: 1902100 - RNA, 15 nt, Shigella flexneri 2a str. 2457T
ugaacgggugauuaa

SEQ ID NO: 1902101 - RNA, 14 nt, Shigella flexneri 2a str. 2457T
ugaacgugcaaaau

SEQ ID NO: 1902102 - RNA, 14 nt, Shigella flexneri 2a str. 2457T
ugaacguggccaug

SEQ ID NO: 1902103 - RNA, 19 nt, Shigella flexneri 2a str. 2457T
ugaacugggccugcauauc

SEQ ID NO: 1902104 - RNA, 20 nt, Shigella flexneri 2a str. 2457T
ugaacuggcuuuuuucaauu

SEQ ID NO: 1902105 - RNA, 22 nt, Shigella flexneri 2a str. 2457T
ugaacuggcuuuuuucaauuaa

SEQ ID NO: 1902106 - RNA, 20 nt, Shigella flexneri 2a str. 2457T
ugaacucgccgcacaggcgu

SEQ ID NO: 1902107 - RNA, 17 nt, Shigella flexneri 2a str. 2457T
ugaacugaacaaaaaag

SEQ ID NO: 1902108 - RNA, 14 nt, Shigella flexneri 2a str. 2457T
ugaacugaauacga

SEQ ID NO: 1902109 - RNA, 20 nt, Shigella flexneri 2a str. 2457T
ugaacucaacgccuucuucg

SEQ ID NO: 1902110 - RNA, 17 nt, Shigella flexneri 2a str. 2457T
ugacgcgggcagcagaa

SEQ ID NO: 1902111 - RNA, 21 nt, Shigella flexneri 2a str. 2457T
ugacgcgcauacucuccucca

SEQ ID NO: 1902112 - RNA, 20 nt, Shigella flexneri 2a str. 2457T
ugacgcccguuaaccgcucu

SEQ ID NO: 1902113 - RNA, 15 nt, Shigella flexneri 2a str. 2457T
ugacgcccccaaacu

SEQ ID NO: 1902114 - RNA, 20 nt, Shigella flexneri 2a str. 2457T
ugacgcagauccugauuuaa

SEQ ID NO: 1902115 - RNA, 23 nt, Shigella flexneri 2a str. 2457T
ugacgcauccgaucgcgcaucag

SEQ ID NO: 1902116 - RNA, 18 nt, Shigella flexneri 2a str. 2457T
ugaccgccgcagcaaccg

SEQ ID NO: 1902117 - RNA, 22 nt, Shigella flexneri 2a str. 2457T
ugaccgcccgcuaugagcagau

SEQ ID NO: 1902118 - RNA, 16 nt, Shigella flexneri 2a str. 2457T
ugaccgcgccauccau

SEQ ID NO: 1902119 - RNA, 18 nt, Shigella flexneri 2a str. 2457T
ugaccuugucaugcagcu

SEQ ID NO: 1902120 - RNA, 16 nt, Shigella flexneri 2a str. 2457T
ugaccuuccagcgccg

SEQ ID NO: 1902121 - RNA, 13 nt, Shigella flexneri 2a str. 2457T
ugaccuucuucag

SEQ ID NO: 1902122 - RNA, 19 nt, Shigella flexneri 2a str. 2457T
ugacaucgugcugguagaa

SEQ ID NO: 1902123 - RNA, 17 nt, Shigella flexneri 2a str. 2457T
ugacaucuccagcgcau

SEQ ID NO: 1902124 - RNA, 16 nt, Shigella flexneri 2a str. 2457T
ugacacaaucaaaucc

SEQ ID NO: 1902125 - RNA, 13 nt, Shigella flexneri 2a str. 2457T
ugacauuaucugg

SEQ ID NO: 1902126 - RNA, 20 nt, Shigella flexneri 2a str. 2457T
ugacauucugacuggucagu

SEQ ID NO: 1902127 - RNA, 21 nt, Shigella flexneri 2a str. 2457T
ugacauuaaccaaccaccaaa

SEQ ID NO: 1902128 - RNA, 17 nt, Shigella flexneri 2a str. 2457T
ugaccaguaccaccgcg

SEQ ID NO: 1902129 - RNA, 20 nt, Shigella flexneri 2a str. 2457T
ugaccaggacuuugaaagcg

SEQ ID NO: 1902130 - RNA, 14 nt, Shigella flexneri 2a str. 2457T
ugaccagacuggag

SEQ ID NO: 1902131 - RNA, 18 nt, Shigella flexneri 2a str. 2457T
ugacccucucggcauaua

SEQ ID NO: 1902132 - RNA, 19 nt, Shigella flexneri 2a str. 2457T
ugaccgaaugcagucgcgu

SEQ ID NO: 1902133 - RNA, 19 nt, Shigella flexneri 2a str. 2457T
ugaccgaaccuguuuucac

SEQ ID NO: 1902134 - RNA, 14 nt, Shigella flexneri 2a str. 2457T
ugagauaauucugu

SEQ ID NO: 1902135 - RNA, 15 nt, Shigella flexneri 2a str. 2457T
ugagagcaugaaaug

SEQ ID NO: 1902136 - RNA, 21 nt, Shigella flexneri 2a str. 2457T
ugagaauuccggcagagaaag

SEQ ID NO: 1902137 - RNA, 18 nt, Shigella flexneri 2a str. 2457T
ugagacaacaacaucagc

SEQ ID NO: 1902138 - RNA, 22 nt, Shigella flexneri 2a str. 2457T
ugagaacaagauugccugaugc

SEQ ID NO: 1902139 - RNA, 13 nt, Shigella flexneri 2a str. 2457T
ugagaacaccacc

SEQ ID NO: 1902140 - RNA, 21 nt, Shigella flexneri 2a str. 2457T
ugagaaauuaacgucaccauc

SEQ ID NO: 1902141 - RNA, 15 nt, Shigella flexneri 2a str. 2457T
ugacuuauaagucuc

SEQ ID NO: 1902142 - RNA, 15 nt, Shigella flexneri 2a str. 2457T
ugacuuccacuuccu

SEQ ID NO: 1902143 - RNA, 14 nt, Shigella flexneri 2a str. 2457T
ugagaaaauuucau

SEQ ID NO: 1902144 - RNA, 17 nt, Shigella flexneri 2a str. 2457T
ugacuucugccagcugc

SEQ ID NO: 1902145 - RNA, 19 nt, Shigella flexneri 2a str. 2457T
ugagaaacucaguugauuc

SEQ ID NO: 1902146 - RNA, 14 nt, Shigella flexneri 2a str. 2457T
ugacugaagaaauc

SEQ ID NO: 1902147 - RNA, 13 nt, Shigella flexneri 2a str. 2457T
ugacgugauuuag

SEQ ID NO: 1902148 - RNA, 14 nt, Shigella flexneri 2a str. 2457T
ugacgucuggccuc

SEQ ID NO: 1902149 - RNA, 14 nt, Shigella flexneri 2a str. 2457T
ugacguuccuuucu

SEQ ID NO: 1902150 - RNA, 14 nt, Shigella flexneri 2a str. 2457T
ugacguucaguuca

SEQ ID NO: 1902151 - RNA, 14 nt, Shigella flexneri 2a str. 2457T
ugacguuaagaaaa

SEQ ID NO: 1902152 - RNA, 13 nt, Shigella flexneri 2a str. 2457T
ugacuaaaacccu

SEQ ID NO: 1902153 - RNA, 18 nt, Shigella flexneri 2a str. 2457T
ugacguaucaccgagaca

SEQ ID NO: 1902154 - RNA, 18 nt, Shigella flexneri 2a str. 2457T
ugacgucgaaacugacau

SEQ ID NO: 1902155 - RNA, 17 nt, Shigella flexneri 2a str. 2457T
ugacguccuguacuguu

SEQ ID NO: 1902156 - RNA, 19 nt, Shigella flexneri 2a str. 2457T
ugacguagcagcuccgcca

SEQ ID NO: 1902157 - RNA, 16 nt, Shigella flexneri 2a str. 2457T
ugacggugauaaucau

SEQ ID NO: 1902158 - RNA, 14 nt, Shigella flexneri 2a str. 2457T
ugcaaauucaauau

SEQ ID NO: 1902159 - RNA, 22 nt, Shigella flexneri 2a str. 2457T
ugcaaauucucuauuucacccg

SEQ ID NO: 1902160 - RNA, 18 nt, Shigella flexneri 2a str. 2457T
ugcaacaacugaaaaaaa

SEQ ID NO: 1902161 - RNA, 20 nt, Shigella flexneri 2a str. 2457T
ugcaacaacugaaaaaaaau

SEQ ID NO: 1902162 - RNA, 22 nt, Shigella flexneri 2a str. 2457T
ugcaacaacugaaaaaaaauua

SEQ ID NO: 1902163 - RNA, 13 nt, Shigella flexneri 2a str. 2457T
ugcaacgagugca

SEQ ID NO: 1902164 - RNA, 14 nt, Shigella flexneri 2a str. 2457T
ugcaacgaacgcau

SEQ ID NO: 1902165 - RNA, 22 nt, Shigella flexneri 2a str. 2457T
ugcaacgaaucaaaucccugau

SEQ ID NO: 1902166 - RNA, 12 nt, Shigella flexneri 2a str. 2457T
ugcaaccacaca

SEQ ID NO: 1902167 - RNA, 18 nt, Shigella flexneri 2a str. 2457T
ugcaacauguugaaucuu

SEQ ID NO: 1902168 - RNA, 13 nt, Shigella flexneri 2a str. 2457T
ugcaaucagauaa

SEQ ID NO: 1902169 - RNA, 16 nt, Shigella flexneri 2a str. 2457T
ugcaaucacuuccuca

SEQ ID NO: 1902170 - RNA, 12 nt, Shigella flexneri 2a str. 2457T
ugcaaucagcgg

SEQ ID NO: 1902171 - RNA, 19 nt, Shigella flexneri 2a str. 2457T
ugcaaugucaucagcauuc

SEQ ID NO: 1902172 - RNA, 16 nt, Shigella flexneri 2a str. 2457T
ugcaauaucaaccuga

SEQ ID NO: 1902173 - RNA, 15 nt, Shigella flexneri 2a str. 2457T
ugcaaucaaauauuc

SEQ ID NO: 1902174 - RNA, 15 nt, Shigella flexneri 2a str. 2457T
ugcaauaugcuggca

SEQ ID NO: 1902175 - RNA, 23 nt, Shigella flexneri 2a str. 2457T
ugcaauaccauggcucaccagca

SEQ ID NO: 1902176 - RNA, 20 nt, Shigella flexneri 2a str. 2457T
ugcaauagcgccugcugcug

SEQ ID NO: 1902177 - RNA, 21 nt, Shigella flexneri 2a str. 2457T
ugcaauagauugaauuagcaa

SEQ ID NO: 1902178 - RNA, 13 nt, Shigella flexneri 2a str. 2457T
ugcaagauguuaa

SEQ ID NO: 1902179 - RNA, 18 nt, Shigella flexneri 2a str. 2457T
ugcaagaggaaauaagca

SEQ ID NO: 1902180 - RNA, 21 nt, Shigella flexneri 2a str. 2457T
ugcaagacgaugacauuaucu

SEQ ID NO: 1902181 - RNA, 15 nt, Shigella flexneri 2a str. 2457T
ugcaagauagcgcgu

SEQ ID NO: 1902182 - RNA, 20 nt, Shigella flexneri 2a str. 2457T
ugcaagaucgcgcaucagcu

SEQ ID NO: 1902183 - RNA, 12 nt, Shigella flexneri 2a str. 2457T
ugcaagaaauga

SEQ ID NO: 1902184 - RNA, 18 nt, Shigella flexneri 2a str. 2457T
ugcaacuucucuuucggc

SEQ ID NO: 1902185 - RNA, 12 nt, Shigella flexneri 2a str. 2457T
ugcaauugcucc

SEQ ID NO: 1902186 - RNA, 14 nt, Shigella flexneri 2a str. 2457T
ugcaauuuauugau

SEQ ID NO: 1902187 - RNA, 17 nt, Shigella flexneri 2a str. 2457T
ugcaccagcuggcuguc

SEQ ID NO: 1902188 - RNA, 12 nt, Shigella flexneri 2a str. 2457T
ugcacgcccuga

SEQ ID NO: 1902189 - RNA, 15 nt, Shigella flexneri 2a str. 2457T
ugcaccucugcugcu

SEQ ID NO: 1902190 - RNA, 15 nt, Shigella flexneri 2a str. 2457T
ugcaccgauuucgag

SEQ ID NO: 1902191 - RNA, 14 nt, Shigella flexneri 2a str. 2457T
ugcaccgaguucuu

SEQ ID NO: 1902192 - RNA, 23 nt, Shigella flexneri 2a str. 2457T
ugcaccgaguucuucacugacgc

SEQ ID NO: 1902193 - RNA, 14 nt, Shigella flexneri 2a str. 2457T
ugauuaacaggcug

SEQ ID NO: 1902194 - RNA, 15 nt, Shigella flexneri 2a str. 2457T
ugaugccguuuaugc

SEQ ID NO: 1902195 - RNA, 21 nt, Shigella flexneri 2a str. 2457T
ugaugcgacgcuugacgcguc

SEQ ID NO: 1902196 - RNA, 14 nt, Shigella flexneri 2a str. 2457T
ugaugcgacuuguc

SEQ ID NO: 1902197 - RNA, 18 nt, Shigella flexneri 2a str. 2457T
ugauuacgguauugcuau

SEQ ID NO: 1902198 - RNA, 15 nt, Shigella flexneri 2a str. 2457T
ugauuacuaaaugug

SEQ ID NO: 1902199 - RNA, 16 nt, Shigella flexneri 2a str. 2457T
ugauuaccaauaucaa

SEQ ID NO: 1902200 - RNA, 15 nt, Shigella flexneri 2a str. 2457T
ugauuccauuauuca

SEQ ID NO: 1902201 - RNA, 20 nt, Shigella flexneri 2a str. 2457T
ugauuccggcaaauaacaga

SEQ ID NO: 1902202 - RNA, 20 nt, Shigella flexneri 2a str. 2457T
ugauucauaguaagcagauu

SEQ ID NO: 1902203 - RNA, 20 nt, Shigella flexneri 2a str. 2457T
ugauucauaaagcagccuau

SEQ ID NO: 1902204 - RNA, 19 nt, Shigella flexneri 2a str. 2457T
ugauucauggcauuuucuc

SEQ ID NO: 1902205 - RNA, 19 nt, Shigella flexneri 2a str. 2457T
ugauucaucucuucuuccg

SEQ ID NO: 1902206 - RNA, 13 nt, Shigella flexneri 2a str. 2457T
ugauucaggauau

SEQ ID NO: 1902207 - RNA, 20 nt, Shigella flexneri 2a str. 2457T
ugauucacuuucugaaggau

SEQ ID NO: 1902208 - RNA, 15 nt, Shigella flexneri 2a str. 2457T
ugauucacguucgug

SEQ ID NO: 1902209 - RNA, 22 nt, Shigella flexneri 2a str. 2457T
ugauugagauaaacugccgaca

SEQ ID NO: 1902210 - RNA, 15 nt, Shigella flexneri 2a str. 2457T
ugauugaagaaauca

SEQ ID NO: 1902211 - RNA, 14 nt, Shigella flexneri 2a str. 2457T
ugauugaacugugg

SEQ ID NO: 1902212 - RNA, 16 nt, Shigella flexneri 2a str. 2457T
ugauuggcaucaucag

SEQ ID NO: 1902213 - RNA, 23 nt, Shigella flexneri 2a str. 2457T
ugauuuaucccaaccuaaaaagu

SEQ ID NO: 1902214 - RNA, 12 nt, Shigella flexneri 2a str. 2457T
ugauuuauagau

SEQ ID NO: 1902215 - RNA, 14 nt, Shigella flexneri 2a str. 2457T
ugauuuauagauuu

SEQ ID NO: 1902216 - RNA, 17 nt, Shigella flexneri 2a str. 2457T
ugauuuugauggaagaa

SEQ ID NO: 1902217 - RNA, 16 nt, Shigella flexneri 2a str. 2457T
ugauuuugcauuuuaa

SEQ ID NO: 1902218 - RNA, 17 nt, Shigella flexneri 2a str. 2457T
ugauuuugcauuuuaaa

SEQ ID NO: 1902219 - RNA, 17 nt, Shigella flexneri 2a str. 2457T
ugcaaauaaauaccguu

SEQ ID NO: 1902220 - RNA, 18 nt, Shigella flexneri 2a str. 2457T
ugcaaaucacgcugcuga

SEQ ID NO: 1902221 - RNA, 14 nt, Shigella flexneri 2a str. 2457T
ugcaaauauuaaua

SEQ ID NO: 1902222 - RNA, 13 nt, Shigella flexneri 2a str. 2457T
ugcaaaugccaga

SEQ ID NO: 1902223 - RNA, 17 nt, Shigella flexneri 2a str. 2457T
ugcaaaugccagauaag

SEQ ID NO: 1902224 - RNA, 17 nt, Shigella flexneri 2a str. 2457T
ugcaaaauaccaauaau

SEQ ID NO: 1902225 - RNA, 16 nt, Shigella flexneri 2a str. 2457T
ugcaaaauaccaauaa

SEQ ID NO: 1902226 - RNA, 22 nt, Shigella flexneri 2a str. 2457T
ugcaaaauuuucauugccgcau

SEQ ID NO: 1902227 - RNA, 16 nt, Shigella flexneri 2a str. 2457T
ugcaaaaccugguugg

SEQ ID NO: 1902228 - RNA, 13 nt, Shigella flexneri 2a str. 2457T
ugaucucuuucca

SEQ ID NO: 1902229 - RNA, 19 nt, Shigella flexneri 2a str. 2457T
ugaucugaccgaaugcagu

SEQ ID NO: 1902230 - RNA, 18 nt, Shigella flexneri 2a str. 2457T
ugaucuccuuuguaccag

SEQ ID NO: 1902231 - RNA, 18 nt, Shigella flexneri 2a str. 2457T
ugaucuaccgcuucccuu

SEQ ID NO: 1902232 - RNA, 22 nt, Shigella flexneri 2a str. 2457T
ugaucuuaauggacgaacuggc

SEQ ID NO: 1902233 - RNA, 23 nt, Shigella flexneri 2a str. 2457T
ugaucuaaaaucgcuucagccgg

SEQ ID NO: 1902234 - RNA, 23 nt, Shigella flexneri 2a str. 2457T
ugaucgugccaggaccauucaca

SEQ ID NO: 1902235 - RNA, 17 nt, Shigella flexneri 2a str. 2457T
ugaucauaaaaauuaaa

SEQ ID NO: 1902236 - RNA, 23 nt, Shigella flexneri 2a str. 2457T
ugaucauccgccucuaacagauc

SEQ ID NO: 1902237 - RNA, 11 nt, Shigella flexneri 2a str. 2457T
ugaucaucauu

SEQ ID NO: 1902238 - RNA, 16 nt, Shigella flexneri 2a str. 2457T
ugaugauuaacagcaa

SEQ ID NO: 1902239 - RNA, 21 nt, Shigella flexneri 2a str. 2457T
ugaugccgccagacugcgaga

SEQ ID NO: 1902240 - RNA, 21 nt, Shigella flexneri 2a str. 2457T
ugaugccgauuguauacgcug

SEQ ID NO: 1902241 - RNA, 16 nt, Shigella flexneri 2a str. 2457T
ugaugagcgauaaaca

SEQ ID NO: 1902242 - RNA, 18 nt, Shigella flexneri 2a str. 2457T
ugaucuuuaucacacaga

SEQ ID NO: 1902243 - RNA, 13 nt, Shigella flexneri 2a str. 2457T
ugaugaaaacgaa

SEQ ID NO: 1902244 - RNA, 13 nt, Shigella flexneri 2a str. 2457T
ugaugaaaaaacc

SEQ ID NO: 1902245 - RNA, 13 nt, Shigella flexneri 2a str. 2457T
ugaugaaaaaagu

SEQ ID NO: 1902246 - RNA, 19 nt, Shigella flexneri 2a str. 2457T
ugaugaaaaaaguuuuauu

SEQ ID NO: 1902247 - RNA, 18 nt, Shigella flexneri 2a str. 2457T
ugauacugaacaacuuaa

SEQ ID NO: 1902248 - RNA, 22 nt, Shigella flexneri 2a str. 2457T
ugauagcaauaccaucaccaac

SEQ ID NO: 1902249 - RNA, 13 nt, Shigella flexneri 2a str. 2457T
ugauagugcugcc

SEQ ID NO: 1902250 - RNA, 14 nt, Shigella flexneri 2a str. 2457T
ugauaguuaaaauu

SEQ ID NO: 1902251 - RNA, 19 nt, Shigella flexneri 2a str. 2457T
ugauaguguuuuauguuca

SEQ ID NO: 1902252 - RNA, 17 nt, Shigella flexneri 2a str. 2457T
ugauaucggccaucugu

SEQ ID NO: 1902253 - RNA, 12 nt, Shigella flexneri 2a str. 2457T
ugauauggucaa

SEQ ID NO: 1902254 - RNA, 15 nt, Shigella flexneri 2a str. 2457T
ugauauguuuauuag

SEQ ID NO: 1902255 - RNA, 12 nt, Shigella flexneri 2a str. 2457T
ugauauguuuau

SEQ ID NO: 1902256 - RNA, 20 nt, Shigella flexneri 2a str. 2457T
ugaucaaaucaugccugcga

SEQ ID NO: 1902257 - RNA, 12 nt, Shigella flexneri 2a str. 2457T
ugaucaccagua

SEQ ID NO: 1902258 - RNA, 14 nt, Shigella flexneri 2a str. 2457T
ugaucaaauacuuc

SEQ ID NO: 1902259 - RNA, 15 nt, Shigella flexneri 2a str. 2457T
ugaucaacagcauca

SEQ ID NO: 1902260 - RNA, 12 nt, Shigella flexneri 2a str. 2457T
ugauaaaaaacc

SEQ ID NO: 1902261 - RNA, 14 nt, Shigella flexneri 2a str. 2457T
ugauaaaucaccug

SEQ ID NO: 1902262 - RNA, 17 nt, Shigella flexneri 2a str. 2457T
ugauaaacaaacagcgc

SEQ ID NO: 1902263 - RNA, 11 nt, Shigella flexneri 2a str. 2457T
ugaguuuucag

SEQ ID NO: 1902264 - RNA, 14 nt, Shigella flexneri 2a str. 2457T
ugaguucacugccg

SEQ ID NO: 1902265 - RNA, 14 nt, Shigella flexneri 2a str. 2457T
ugaguuaagcaaaa

SEQ ID NO: 1902266 - RNA, 22 nt, Shigella flexneri 2a str. 2457T
ugaguuaagcaaaaaaacauaa

SEQ ID NO: 1902267 - RNA, 19 nt, Shigella flexneri 2a str. 2457T
ugagucgggaccagcauuc

SEQ ID NO: 1902268 - RNA, 16 nt, Shigella flexneri 2a str. 2457T
ugagucaauuucugca

SEQ ID NO: 1902269 - RNA, 15 nt, Shigella flexneri 2a str. 2457T
ugagucacauuuuua

SEQ ID NO: 1902270 - RNA, 18 nt, Shigella flexneri 2a str. 2457T
ugagcaguuuucacccuu

SEQ ID NO: 1902271 - RNA, 19 nt, Shigella flexneri 2a str. 2457T
ugauacgggaggucaucag

SEQ ID NO: 1902272 - RNA, 19 nt, Shigella flexneri 2a str. 2457T
ugauaccgggcuguucacu

SEQ ID NO: 1902273 - RNA, 15 nt, Shigella flexneri 2a str. 2457T
ugauaauuauuauaa

SEQ ID NO: 1902274 - RNA, 23 nt, Shigella flexneri 2a str. 2457T
ugauaauuguuaucguuugcauu

SEQ ID NO: 1902275 - RNA, 23 nt, Shigella flexneri 2a str. 2457T
ugauaauguuauuuaauuacuga

SEQ ID NO: 1902276 - RNA, 17 nt, Shigella flexneri 2a str. 2457T
ugauacaucaagucaga

SEQ ID NO: 1902277 - RNA, 14 nt, Shigella flexneri 2a str. 2457T
ugauaaucagaagg

SEQ ID NO: 1902278 - RNA, 14 nt, Shigella flexneri 2a str. 2457T
ugauaaucauccca

SEQ ID NO: 1902279 - RNA, 19 nt, Shigella flexneri 2a str. 2457T
ugauaauccaucacuucau

SEQ ID NO: 1902280 - RNA, 22 nt, Shigella flexneri 2a str. 2457T
ugauaauccaucacuucaucau

SEQ ID NO: 1902281 - RNA, 12 nt, Shigella flexneri 2a str. 2457T
ugauaaggaaau

SEQ ID NO: 1902282 - RNA, 17 nt, Shigella flexneri 2a str. 2457T
ugauaaggaaauucagc

SEQ ID NO: 1902283 - RNA, 14 nt, Shigella flexneri 2a str. 2457T
ugauaacuucuacc

SEQ ID NO: 1902284 - RNA, 15 nt, Shigella flexneri 2a str. 2457T
ugauaacgccugggc

SEQ ID NO: 1902285 - RNA, 12 nt, Shigella flexneri 2a str. 2457T
ugauaacgcuua

SEQ ID NO: 1902286 - RNA, 18 nt, Shigella flexneri 2a str. 2457T
ugauaacgugcagcuuuc

SEQ ID NO: 1902287 - RNA, 22 nt, Shigella flexneri 2a str. 2457T
ucgccauuccuggggucaucag

SEQ ID NO: 1902288 - RNA, 14 nt, Shigella flexneri 2a str. 2457T
ucgccauuuuucag

SEQ ID NO: 1902289 - RNA, 17 nt, Shigella flexneri 2a str. 2457T
ucgccaugaacgcgaag

SEQ ID NO: 1902290 - RNA, 18 nt, Shigella flexneri 2a str. 2457T
ucgccaucugccagaccc

SEQ ID NO: 1902291 - RNA, 23 nt, Shigella flexneri 2a str. 2457T
ucgccaaguucgaacgccgccag

SEQ ID NO: 1902292 - RNA, 15 nt, Shigella flexneri 2a str. 2457T
ucgccaucaaaggcu

SEQ ID NO: 1902293 - RNA, 15 nt, Shigella flexneri 2a str. 2457T
ucgccaucaaaucac

SEQ ID NO: 1902294 - RNA, 21 nt, Shigella flexneri 2a str. 2457T
ucgccaaugaaguggcauccg

SEQ ID NO: 1902295 - RNA, 23 nt, Shigella flexneri 2a str. 2457T
ucgccauccgaauucacuuaauc

SEQ ID NO: 1902296 - RNA, 16 nt, Shigella flexneri 2a str. 2457T
ucgccaacaaucucuu

SEQ ID NO: 1902297 - RNA, 23 nt, Shigella flexneri 2a str. 2457T
ucgcaucaggcauuugcuccaga

SEQ ID NO: 1902298 - RNA, 19 nt, Shigella flexneri 2a str. 2457T
ucgcaucaggcauugugca

SEQ ID NO: 1902299 - RNA, 20 nt, Shigella flexneri 2a str. 2457T
ucgcaucaggcauuugcucc

SEQ ID NO: 1902300 - RNA, 18 nt, Shigella flexneri 2a str. 2457T
ucgcauaaaccacagacc

SEQ ID NO: 1902301 - RNA, 16 nt, Shigella flexneri 2a str. 2457T
ucgcaguagccaugca

SEQ ID NO: 1902302 - RNA, 15 nt, Shigella flexneri 2a str. 2457T
ucgcauaccauccag

SEQ ID NO: 1902303 - RNA, 17 nt, Shigella flexneri 2a str. 2457T
ucgccccucccccagca

SEQ ID NO: 1902304 - RNA, 17 nt, Shigella flexneri 2a str. 2457T
ucgccccugcccuuuca

SEQ ID NO: 1902305 - RNA, 16 nt, Shigella flexneri 2a str. 2457T
ucgcccauuuuucaug

SEQ ID NO: 1902306 - RNA, 13 nt, Shigella flexneri 2a str. 2457T
ucgcccagcagac

SEQ ID NO: 1902307 - RNA, 17 nt, Shigella flexneri 2a str. 2457T
ucgcccacgccagagau

SEQ ID NO: 1902308 - RNA, 23 nt, Shigella flexneri 2a str. 2457T
ucgcccacuucuuucgcccagcg

SEQ ID NO: 1902309 - RNA, 13 nt, Shigella flexneri 2a str. 2457T
ucgcccacaucau

SEQ ID NO: 1902310 - RNA, 13 nt, Shigella flexneri 2a str. 2457T
ucgcccagcgcgu

SEQ ID NO: 1902311 - RNA, 18 nt, Shigella flexneri 2a str. 2457T
ucgcccugccaaaucagu

SEQ ID NO: 1902312 - RNA, 22 nt, Shigella flexneri 2a str. 2457T
ucgcccuggacaacauuccugc

SEQ ID NO: 1902313 - RNA, 15 nt, Shigella flexneri 2a str. 2457T
ucgcccguucauccg

SEQ ID NO: 1902314 - RNA, 15 nt, Shigella flexneri 2a str. 2457T
ucgcccggauaucca

SEQ ID NO: 1902315 - RNA, 15 nt, Shigella flexneri 2a str. 2457T
ucgcccgaggagggc

SEQ ID NO: 1902316 - RNA, 15 nt, Shigella flexneri 2a str. 2457T
ucgccgucaggcaag

SEQ ID NO: 1902317 - RNA, 20 nt, Shigella flexneri 2a str. 2457T
ucgccggaugaaaagucauc

SEQ ID NO: 1902318 - RNA, 20 nt, Shigella flexneri 2a str. 2457T
ucgccuuccggcaguuucau

SEQ ID NO: 1902319 - RNA, 19 nt, Shigella flexneri 2a str. 2457T
ucgccuucagguuuuucag

SEQ ID NO: 1902320 - RNA, 24 nt, Shigella flexneri 2a str. 2457T
ucgcgcacgaggaacagcgcgcug

SEQ ID NO: 1902321 - RNA, 18 nt, Shigella flexneri 2a str. 2457T
ucgccuggaccagcgggu

SEQ ID NO: 1902322 - RNA, 12 nt, Shigella flexneri 2a str. 2457T
ucgccuuaauaa

SEQ ID NO: 1902323 - RNA, 21 nt, Shigella flexneri 2a str. 2457T
ucgccuuaugcugcuucauug

SEQ ID NO: 1902324 - RNA, 21 nt, Shigella flexneri 2a str. 2457T
ucgccgaacacacauuuaucc

SEQ ID NO: 1902325 - RNA, 18 nt, Shigella flexneri 2a str. 2457T
ucgccgcugugauuucag

SEQ ID NO: 1902326 - RNA, 22 nt, Shigella flexneri 2a str. 2457T
ucgccggaauuucuuucagcag

SEQ ID NO: 1902327 - RNA, 22 nt, Shigella flexneri 2a str. 2457T
ucgccgcguagagaaaaccaau

SEQ ID NO: 1902328 - RNA, 20 nt, Shigella flexneri 2a str. 2457T
ucgccgccagcgucugagca

SEQ ID NO: 1902329 - RNA, 19 nt, Shigella flexneri 2a str. 2457T
ucgcaacgccuuccgucag

SEQ ID NO: 1902330 - RNA, 12 nt, Shigella flexneri 2a str. 2457T
ucgcaaccagcg

SEQ ID NO: 1902331 - RNA, 21 nt, Shigella flexneri 2a str. 2457T
ucgcaauaaucaucucuccuu

SEQ ID NO: 1902332 - RNA, 18 nt, Shigella flexneri 2a str. 2457T
ucgcaagccacgccgaac

SEQ ID NO: 1902333 - RNA, 15 nt, Shigella flexneri 2a str. 2457T
ucgauuuucaaaaua

SEQ ID NO: 1902334 - RNA, 13 nt, Shigella flexneri 2a str. 2457T
ucgaucuguuuua

SEQ ID NO: 1902335 - RNA, 20 nt, Shigella flexneri 2a str. 2457T
ucgauugcacauucccugca

SEQ ID NO: 1902336 - RNA, 15 nt, Shigella flexneri 2a str. 2457T
ucgcagacugggcaa

SEQ ID NO: 1902337 - RNA, 16 nt, Shigella flexneri 2a str. 2457T
ucgcacuuaccuucac

SEQ ID NO: 1902338 - RNA, 13 nt, Shigella flexneri 2a str. 2457T
ucgcagaagccac

SEQ ID NO: 1902339 - RNA, 17 nt, Shigella flexneri 2a str. 2457T
ucgcagaagccacgcgu

SEQ ID NO: 1902340 - RNA, 19 nt, Shigella flexneri 2a str. 2457T
ucgcacguugucagcaacu

SEQ ID NO: 1902341 - RNA, 17 nt, Shigella flexneri 2a str. 2457T
ucgcacuaaguucugcc

SEQ ID NO: 1902342 - RNA, 16 nt, Shigella flexneri 2a str. 2457T
ucgcacgccuggcagu

SEQ ID NO: 1902343 - RNA, 16 nt, Shigella flexneri 2a str. 2457T
ucgcaccaaacgggca

SEQ ID NO: 1902344 - RNA, 21 nt, Shigella flexneri 2a str. 2457T
ucgcaauccgccgauguugca

SEQ ID NO: 1902345 - RNA, 20 nt, Shigella flexneri 2a str. 2457T
ucgcaauacccugacccaga

SEQ ID NO: 1902346 - RNA, 15 nt, Shigella flexneri 2a str. 2457T
ucgauaugaccauug

SEQ ID NO: 1902347 - RNA, 13 nt, Shigella flexneri 2a str. 2457T
ucgauaucaagcc

SEQ ID NO: 1902348 - RNA, 20 nt, Shigella flexneri 2a str. 2457T
ucgauaaccaucuucuucac

SEQ ID NO: 1902349 - RNA, 21 nt, Shigella flexneri 2a str. 2457T
ucgaucacuucgcgcaaccag

SEQ ID NO: 1902350 - RNA, 16 nt, Shigella flexneri 2a str. 2457T
ucgagugaauaauuga

SEQ ID NO: 1902351 - RNA, 14 nt, Shigella flexneri 2a str. 2457T
ucgauaaaccagca

SEQ ID NO: 1902352 - RNA, 23 nt, Shigella flexneri 2a str. 2457T
ucgauaaacgccggaugacacau

SEQ ID NO: 1902353 - RNA, 17 nt, Shigella flexneri 2a str. 2457T
ucgaguccuuccagguc

SEQ ID NO: 1902354 - RNA, 19 nt, Shigella flexneri 2a str. 2457T
ucgagucauauucugaaau

SEQ ID NO: 1902355 - RNA, 19 nt, Shigella flexneri 2a str. 2457T
ucgaguagcaaucggcuuu

SEQ ID NO: 1902356 - RNA, 16 nt, Shigella flexneri 2a str. 2457T
ucgaguaaaaauauuu

SEQ ID NO: 1902357 - RNA, 17 nt, Shigella flexneri 2a str. 2457T
ucgaggcaauccguaau

SEQ ID NO: 1902358 - RNA, 23 nt, Shigella flexneri 2a str. 2457T
ucgaggccaauuuggcugccaug

SEQ ID NO: 1902359 - RNA, 18 nt, Shigella flexneri 2a str. 2457T
ucgagguacgcuccagca

SEQ ID NO: 1902360 - RNA, 19 nt, Shigella flexneri 2a str. 2457T
ucgacggaauaaacccaca

SEQ ID NO: 1902361 - RNA, 14 nt, Shigella flexneri 2a str. 2457T
ucgacgcugcugcg

SEQ ID NO: 1902362 - RNA, 12 nt, Shigella flexneri 2a str. 2457T
ucgacgcgcgca

SEQ ID NO: 1902363 - RNA, 20 nt, Shigella flexneri 2a str. 2457T
uccuuuuaccacuacaucaa

SEQ ID NO: 1902364 - RNA, 17 nt, Shigella flexneri 2a str. 2457T
uccuuuccuuaagccag

SEQ ID NO: 1902365 - RNA, 18 nt, Shigella flexneri 2a str. 2457T
uccuuggauauuuuaauc

SEQ ID NO: 1902366 - RNA, 14 nt, Shigella flexneri 2a str. 2457T
ucgaaaaucugccc

SEQ ID NO: 1902367 - RNA, 19 nt, Shigella flexneri 2a str. 2457T
ucgaaaauggccucggcua

SEQ ID NO: 1902368 - RNA, 17 nt, Shigella flexneri 2a str. 2457T
ucgaaaucaacauguuc

SEQ ID NO: 1902369 - RNA, 24 nt, Shigella flexneri 2a str. 2457T
ucgaaauccauguugcuggaagau

SEQ ID NO: 1902370 - RNA, 17 nt, Shigella flexneri 2a str. 2457T
ucgaauauaucagccug

SEQ ID NO: 1902371 - RNA, 15 nt, Shigella flexneri 2a str. 2457T
ucgacaccaaacaga

SEQ ID NO: 1902372 - RNA, 18 nt, Shigella flexneri 2a str. 2457T
ucgaccggguuucuuauu

SEQ ID NO: 1902373 - RNA, 16 nt, Shigella flexneri 2a str. 2457T
ucgacgauugcuuuua

SEQ ID NO: 1902374 - RNA, 12 nt, Shigella flexneri 2a str. 2457T
ucgacagcagcc

SEQ ID NO: 1902375 - RNA, 17 nt, Shigella flexneri 2a str. 2457T
ucgacccgacagaugcu

SEQ ID NO: 1902376 - RNA, 17 nt, Shigella flexneri 2a str. 2457T
ucgaacauacacaagcc

SEQ ID NO: 1902377 - RNA, 20 nt, Shigella flexneri 2a str. 2457T
ucgaagaaaacauggcgugg

SEQ ID NO: 1902378 - RNA, 17 nt, Shigella flexneri 2a str. 2457T
ucgaaguuuuccucagu

SEQ ID NO: 1902379 - RNA, 13 nt, Shigella flexneri 2a str. 2457T
ucgaaguuuuccu

SEQ ID NO: 1902380 - RNA, 21 nt, Shigella flexneri 2a str. 2457T
ucgaaccuuggucgaagcuuc

SEQ ID NO: 1902381 - RNA, 22 nt, Shigella flexneri 2a str. 2457T
ucgaacggguuaaauccugucu

SEQ ID NO: 1902382 - RNA, 17 nt, Shigella flexneri 2a str. 2457T
ucgaacgguaacaggaa

SEQ ID NO: 1902383 - RNA, 18 nt, Shigella flexneri 2a str. 2457T
ucgaacgguaacaggaag

SEQ ID NO: 1902384 - RNA, 17 nt, Shigella flexneri 2a str. 2457T
ucgaacucauacaccag

SEQ ID NO: 1902385 - RNA, 19 nt, Shigella flexneri 2a str. 2457T
ucgaacucauacaccagcg

SEQ ID NO: 1902386 - RNA, 14 nt, Shigella flexneri 2a str. 2457T
uccugucuucccug

SEQ ID NO: 1902387 - RNA, 15 nt, Shigella flexneri 2a str. 2457T
uccugucuucccugc

SEQ ID NO: 1902388 - RNA, 16 nt, Shigella flexneri 2a str. 2457T
uccugucuucccugcu

SEQ ID NO: 1902389 - RNA, 20 nt, Shigella flexneri 2a str. 2457T
uccuguggacgcagcucaua

SEQ ID NO: 1902390 - RNA, 14 nt, Shigella flexneri 2a str. 2457T
uccuuaauaaaaau

SEQ ID NO: 1902391 - RNA, 15 nt, Shigella flexneri 2a str. 2457T
uccuuaauaaaaauu

SEQ ID NO: 1902392 - RNA, 17 nt, Shigella flexneri 2a str. 2457T
uccuuaauaaaaauuuu

SEQ ID NO: 1902393 - RNA, 13 nt, Shigella flexneri 2a str. 2457T
uccuguagcguua

SEQ ID NO: 1902394 - RNA, 18 nt, Shigella flexneri 2a str. 2457T
uccuguagcuggaaaauc

SEQ ID NO: 1902395 - RNA, 18 nt, Shigella flexneri 2a str. 2457T
uccuguauuguuccacuc

SEQ ID NO: 1902396 - RNA, 15 nt, Shigella flexneri 2a str. 2457T
uccuguaugacccgg

SEQ ID NO: 1902397 - RNA, 13 nt, Shigella flexneri 2a str. 2457T
uccugcuccuguc

SEQ ID NO: 1902398 - RNA, 19 nt, Shigella flexneri 2a str. 2457T
uccugcugcacgcccugau

SEQ ID NO: 1902399 - RNA, 19 nt, Shigella flexneri 2a str. 2457T
uccuggauuuccucggcug

SEQ ID NO: 1902400 - RNA, 19 nt, Shigella flexneri 2a str. 2457T
uccuggaucacaauccgcu

SEQ ID NO: 1902401 - RNA, 16 nt, Shigella flexneri 2a str. 2457T
ucagcgaucagcauuu

SEQ ID NO: 1902402 - RNA, 23 nt, Shigella flexneri 2a str. 2457T
ucagcgaucguuuuuaaccccag

SEQ ID NO: 1902403 - RNA, 19 nt, Shigella flexneri 2a str. 2457T
ucagcgcaaagagugaagu

SEQ ID NO: 1902404 - RNA, 14 nt, Shigella flexneri 2a str. 2457T
ucagcgcaaagagu

SEQ ID NO: 1902405 - RNA, 22 nt, Shigella flexneri 2a str. 2457T
ucagcgagacgugcguaccauu

SEQ ID NO: 1902406 - RNA, 21 nt, Shigella flexneri 2a str. 2457T
ucagcgaguuuuucaguccac

SEQ ID NO: 1902407 - RNA, 15 nt, Shigella flexneri 2a str. 2457T
uccugcacuuucagc

SEQ ID NO: 1902408 - RNA, 15 nt, Shigella flexneri 2a str. 2457T
uccugcagcguugcc

SEQ ID NO: 1902409 - RNA, 18 nt, Shigella flexneri 2a str. 2457T
uccugcauugacucgccu

SEQ ID NO: 1902410 - RNA, 19 nt, Shigella flexneri 2a str. 2457T
uccugcauugacucgccuu

SEQ ID NO: 1902411 - RNA, 16 nt, Shigella flexneri 2a str. 2457T
uccugcgcuuccagcu

SEQ ID NO: 1902412 - RNA, 18 nt, Shigella flexneri 2a str. 2457T
uccugcucaaguaauaaa

SEQ ID NO: 1902413 - RNA, 20 nt, Shigella flexneri 2a str. 2457T
uccugcggaugcgccaucca

SEQ ID NO: 1902414 - RNA, 17 nt, Shigella flexneri 2a str. 2457T
uccugcggcgacaaaug

SEQ ID NO: 1902415 - RNA, 23 nt, Shigella flexneri 2a str. 2457T
uccugcgggagcgcuuuuuuccu

SEQ ID NO: 1902416 - RNA, 18 nt, Shigella flexneri 2a str. 2457T
uccuugcguacaccaaca

SEQ ID NO: 1902417 - RNA, 14 nt, Shigella flexneri 2a str. 2457T
uccuugaaaaagag

SEQ ID NO: 1902418 - RNA, 19 nt, Shigella flexneri 2a str. 2457T
uccuucgcagacugggcaa

SEQ ID NO: 1902419 - RNA, 17 nt, Shigella flexneri 2a str. 2457T
uccuucggauuuccguu

SEQ ID NO: 1902420 - RNA, 17 nt, Shigella flexneri 2a str. 2457T
uccuucuguucuuauaa

SEQ ID NO: 1902421 - RNA, 16 nt, Shigella flexneri 2a str. 2457T
uccuucugucaugauu

SEQ ID NO: 1902422 - RNA, 13 nt, Shigella flexneri 2a str. 2457T
uccuucaacccgc

SEQ ID NO: 1902423 - RNA, 20 nt, Shigella flexneri 2a str. 2457T
uccuucaaacguuuugcaau

SEQ ID NO: 1902424 - RNA, 15 nt, Shigella flexneri 2a str. 2457T
uccuuacugcccccg

SEQ ID NO: 1902425 - RNA, 15 nt, Shigella flexneri 2a str. 2457T
uccuucccccaccac

SEQ ID NO: 1902426 - RNA, 21 nt, Shigella flexneri 2a str. 2457T
uccuucgauaaaagccauccc

SEQ ID NO: 1902427 - RNA, 18 nt, Shigella flexneri 2a str. 2457T
uccuucaggaucaaccgc

SEQ ID NO: 1902428 - RNA, 15 nt, Shigella flexneri 2a str. 2457T
ucguuccugcaauuu

SEQ ID NO: 1902429 - RNA, 13 nt, Shigella flexneri 2a str. 2457T
ucguucgcugcau

SEQ ID NO: 1902430 - RNA, 12 nt, Shigella flexneri 2a str. 2457T
ucguucuucccu

SEQ ID NO: 1902431 - RNA, 12 nt, Shigella flexneri 2a str. 2457T
ucguucagaucu

SEQ ID NO: 1902432 - RNA, 22 nt, Shigella flexneri 2a str. 2457T
ucguucauaccacgccaucaac

SEQ ID NO: 1902433 - RNA, 23 nt, Shigella flexneri 2a str. 2457T
ucgugaagagauggaucaacuug

SEQ ID NO: 1902434 - RNA, 16 nt, Shigella flexneri 2a str. 2457T
ucguuaaauucuaaug

SEQ ID NO: 1902435 - RNA, 19 nt, Shigella flexneri 2a str. 2457T
ucguuaacaacaacuucua

SEQ ID NO: 1902436 - RNA, 16 nt, Shigella flexneri 2a str. 2457T
ucguuaaacucugccg

SEQ ID NO: 1902437 - RNA, 18 nt, Shigella flexneri 2a str. 2457T
ucguuaagcgauucagca

SEQ ID NO: 1902438 - RNA, 22 nt, Shigella flexneri 2a str. 2457T
ucguuacgccccgguuucucuu

SEQ ID NO: 1902439 - RNA, 12 nt, Shigella flexneri 2a str. 2457T
ucguuauauaga

SEQ ID NO: 1902440 - RNA, 21 nt, Shigella flexneri 2a str. 2457T
ucguuauauagaacaagugcc

SEQ ID NO: 1902441 - RNA, 15 nt, Shigella flexneri 2a str. 2457T
ucuacaaaagauuau

SEQ ID NO: 1902442 - RNA, 15 nt, Shigella flexneri 2a str. 2457T
ucuaaauguucaaua

SEQ ID NO: 1902443 - RNA, 16 nt, Shigella flexneri 2a str. 2457T
ucuaacucuucugaaa

SEQ ID NO: 1902444 - RNA, 15 nt, Shigella flexneri 2a str. 2457T
ucuaacucuucugaa

SEQ ID NO: 1902445 - RNA, 15 nt, Shigella flexneri 2a str. 2457T
ucgucgcgcacgccc

SEQ ID NO: 1902446 - RNA, 14 nt, Shigella flexneri 2a str. 2457T
ucgucgccagacca

SEQ ID NO: 1902447 - RNA, 15 nt, Shigella flexneri 2a str. 2457T
ucguccgcguccagc

SEQ ID NO: 1902448 - RNA, 18 nt, Shigella flexneri 2a str. 2457T
ucgucgguguccacuucc

SEQ ID NO: 1902449 - RNA, 16 nt, Shigella flexneri 2a str. 2457T
ucgucguacugaccgu

SEQ ID NO: 1902450 - RNA, 21 nt, Shigella flexneri 2a str. 2457T
ucgugaagcuggcagaaguug

SEQ ID NO: 1902451 - RNA, 22 nt, Shigella flexneri 2a str. 2457T
ucgugaagcuggcagaaguugu

SEQ ID NO: 1902452 - RNA, 17 nt, Shigella flexneri 2a str. 2457T
ucguccacgucaucaaa

SEQ ID NO: 1902453 - RNA, 19 nt, Shigella flexneri 2a str. 2457T
ucguaccaucauuggagag

SEQ ID NO: 1902454 - RNA, 17 nt, Shigella flexneri 2a str. 2457T
ucguaaugcuccggcuc

SEQ ID NO: 1902455 - RNA, 15 nt, Shigella flexneri 2a str. 2457T
ucguacucaccagac

SEQ ID NO: 1902456 - RNA, 16 nt, Shigella flexneri 2a str. 2457T
ucguacucaccagaca

SEQ ID NO: 1902457 - RNA, 14 nt, Shigella flexneri 2a str. 2457T
ucggucagcacgcg

SEQ ID NO: 1902458 - RNA, 15 nt, Shigella flexneri 2a str. 2457T
ucggucagacccagu

SEQ ID NO: 1902459 - RNA, 14 nt, Shigella flexneri 2a str. 2457T
ucggucaaguaauu

SEQ ID NO: 1902460 - RNA, 17 nt, Shigella flexneri 2a str. 2457T
ucgguauuuccauuuuu

SEQ ID NO: 1902461 - RNA, 16 nt, Shigella flexneri 2a str. 2457T
ucgguagcagcuuuca

SEQ ID NO: 1902462 - RNA, 15 nt, Shigella flexneri 2a str. 2457T
ucggugcgcugugug

SEQ ID NO: 1902463 - RNA, 18 nt, Shigella flexneri 2a str. 2457T
ucggugcgacaucaucag

SEQ ID NO: 1902464 - RNA, 16 nt, Shigella flexneri 2a str. 2457T
ucgguggaaaauagca

SEQ ID NO: 1902465 - RNA, 12 nt, Shigella flexneri 2a str. 2457T
ucggugauaacu

SEQ ID NO: 1902466 - RNA, 15 nt, Shigella flexneri 2a str. 2457T
ucggugcaaaugcca

SEQ ID NO: 1902467 - RNA, 17 nt, Shigella flexneri 2a str. 2457T
ucggugcaaaugccaga

SEQ ID NO: 1902468 - RNA, 19 nt, Shigella flexneri 2a str. 2457T
ucggugcacuguaugaaac

SEQ ID NO: 1902469 - RNA, 21 nt, Shigella flexneri 2a str. 2457T
ucggugcacaauugccggaug

SEQ ID NO: 1902470 - RNA, 14 nt, Shigella flexneri 2a str. 2457T
ucgguuuucaaucg

SEQ ID NO: 1902471 - RNA, 12 nt, Shigella flexneri 2a str. 2457T
ucguaaguaagc

SEQ ID NO: 1902472 - RNA, 21 nt, Shigella flexneri 2a str. 2457T
ucgggcguuucgccaggacag

SEQ ID NO: 1902473 - RNA, 16 nt, Shigella flexneri 2a str. 2457T
ucgggccgucuggcug

SEQ ID NO: 1902474 - RNA, 17 nt, Shigella flexneri 2a str. 2457T
ucggggcuguuuuccag

SEQ ID NO: 1902475 - RNA, 20 nt, Shigella flexneri 2a str. 2457T
ucggggcggcuaucccaaag

SEQ ID NO: 1902476 - RNA, 22 nt, Shigella flexneri 2a str. 2457T
ucgggaaggcccuuucccuucu

SEQ ID NO: 1902477 - RNA, 22 nt, Shigella flexneri 2a str. 2457T
ucgggaaaaucugcgggaacau

SEQ ID NO: 1902478 - RNA, 14 nt, Shigella flexneri 2a str. 2457T
ucgggaaccggcug

SEQ ID NO: 1902479 - RNA, 17 nt, Shigella flexneri 2a str. 2457T
ucgggccgaucauacga

SEQ ID NO: 1902480 - RNA, 21 nt, Shigella flexneri 2a str. 2457T
ucgggcaacguugaccaguca

SEQ ID NO: 1902481 - RNA, 20 nt, Shigella flexneri 2a str. 2457T
ucgggcaauggcuccgggug

SEQ ID NO: 1902482 - RNA, 15 nt, Shigella flexneri 2a str. 2457T
ucggcgcugaaauuc

SEQ ID NO: 1902483 - RNA, 22 nt, Shigella flexneri 2a str. 2457T
ucggcgcggcgguugacgcccc

SEQ ID NO: 1902484 - RNA, 13 nt, Shigella flexneri 2a str. 2457T
ucggcggcgugcc

SEQ ID NO: 1902485 - RNA, 16 nt, Shigella flexneri 2a str. 2457T
ucggcgcagguuuaau

SEQ ID NO: 1902486 - RNA, 13 nt, Shigella flexneri 2a str. 2457T
ucggcgcaaucgc

SEQ ID NO: 1902487 - RNA, 22 nt, Shigella flexneri 2a str. 2457T
ucggcgugaacgcgcucgacuu

SEQ ID NO: 1902488 - RNA, 19 nt, Shigella flexneri 2a str. 2457T
ucggcguaauccugaaagc

SEQ ID NO: 1902489 - RNA, 12 nt, Shigella flexneri 2a str. 2457T
ucgcuuucucuu

SEQ ID NO: 1902490 - RNA, 13 nt, Shigella flexneri 2a str. 2457T
ucgcuuuccaggu

SEQ ID NO: 1902491 - RNA, 21 nt, Shigella flexneri 2a str. 2457T
ucgcuuuccagucguuaugca

SEQ ID NO: 1902492 - RNA, 20 nt, Shigella flexneri 2a str. 2457T
ucgcuuuuucugcaucaacc

SEQ ID NO: 1902493 - RNA, 18 nt, Shigella flexneri 2a str. 2457T
ucgcuugcucgcgcaccu

SEQ ID NO: 1902494 - RNA, 17 nt, Shigella flexneri 2a str. 2457T
ucgcuuaacgcccaugc

SEQ ID NO: 1902495 - RNA, 19 nt, Shigella flexneri 2a str. 2457T
ucgcgcagauagagcgccu

SEQ ID NO: 1902496 - RNA, 23 nt, Shigella flexneri 2a str. 2457T
ucgcugcgcucuaaaaucaucac

SEQ ID NO: 1902497 - RNA, 15 nt, Shigella flexneri 2a str. 2457T
ucgcugcuggaucug

SEQ ID NO: 1902498 - RNA, 22 nt, Shigella flexneri 2a str. 2457T
ucgcugcuaauuuaucggcguu

SEQ ID NO: 1902499 - RNA, 13 nt, Shigella flexneri 2a str. 2457T
ucgcuggcaggcc

SEQ ID NO: 1902500 - RNA, 13 nt, Shigella flexneri 2a str. 2457T
ucgcuggucagcg

SEQ ID NO: 1902501 - RNA, 17 nt, Shigella flexneri 2a str. 2457T
ucgcuguguaaacccag

SEQ ID NO: 1902502 - RNA, 14 nt, Shigella flexneri 2a str. 2457T
ucgcuguuaauguu

SEQ ID NO: 1902503 - RNA, 15 nt, Shigella flexneri 2a str. 2457T
ucgcugugcugcuga

SEQ ID NO: 1902504 - RNA, 16 nt, Shigella flexneri 2a str. 2457T
ucgcugucgccauccc

SEQ ID NO: 1902505 - RNA, 18 nt, Shigella flexneri 2a str. 2457T
ucggcaacaccucagcca

SEQ ID NO: 1902506 - RNA, 14 nt, Shigella flexneri 2a str. 2457T
ucggauguuagucu

SEQ ID NO: 1902507 - RNA, 14 nt, Shigella flexneri 2a str. 2457T
ucggcaaagcgcug

SEQ ID NO: 1902508 - RNA, 19 nt, Shigella flexneri 2a str. 2457T
ucggcaaagcgcugaagaa

SEQ ID NO: 1902509 - RNA, 19 nt, Shigella flexneri 2a str. 2457T
ucggcaaaauacaugaccg

SEQ ID NO: 1902510 - RNA, 16 nt, Shigella flexneri 2a str. 2457T
ucggcaaaaucuucca

SEQ ID NO: 1902511 - RNA, 22 nt, Shigella flexneri 2a str. 2457T
ucggauuggucgcucgcgccgc

SEQ ID NO: 1902512 - RNA, 19 nt, Shigella flexneri 2a str. 2457T
ucuuuuucauuaugaucaa

SEQ ID NO: 1902513 - RNA, 21 nt, Shigella flexneri 2a str. 2457T
ucuuuuucauuaugaucaaaa

SEQ ID NO: 1902514 - RNA, 23 nt, Shigella flexneri 2a str. 2457T
ucuuuugcuaucgggaauauuaa

SEQ ID NO: 1902515 - RNA, 14 nt, Shigella flexneri 2a str. 2457T
ucuuuugcagcagc

SEQ ID NO: 1902516 - RNA, 20 nt, Shigella flexneri 2a str. 2457T
ucuuuugcuugacaaaaaga

SEQ ID NO: 1902517 - RNA, 13 nt, Shigella flexneri 2a str. 2457T
ucuuuuccuuucg

SEQ ID NO: 1902518 - RNA, 13 nt, Shigella flexneri 2a str. 2457T
ugaaaaaauagaa

SEQ ID NO: 1902519 - RNA, 15 nt, Shigella flexneri 2a str. 2457T
ugaaaaaaccagaaa

SEQ ID NO: 1902520 - RNA, 15 nt, Shigella flexneri 2a str. 2457T
ugaaaaaaccugcac

SEQ ID NO: 1902521 - RNA, 12 nt, Shigella flexneri 2a str. 2457T
ugaaaaaaguuu

SEQ ID NO: 1902522 - RNA, 19 nt, Shigella flexneri 2a str. 2457T
ucuuuuuuuauuaaaugug

SEQ ID NO: 1902523 - RNA, 14 nt, Shigella flexneri 2a str. 2457T
ucuuuuuuccgcuu

SEQ ID NO: 1902524 - RNA, 15 nt, Shigella flexneri 2a str. 2457T
ucuuuuuucacuggc

SEQ ID NO: 1902525 - RNA, 19 nt, Shigella flexneri 2a str. 2457T
ucuuuguauuuauuuucag

SEQ ID NO: 1902526 - RNA, 22 nt, Shigella flexneri 2a str. 2457T
ucuuugcccgcagauccagugc

SEQ ID NO: 1902527 - RNA, 12 nt, Shigella flexneri 2a str. 2457T
ucuuugccugau

SEQ ID NO: 1902528 - RNA, 17 nt, Shigella flexneri 2a str. 2457T
ucuuugcagcuuugcug

SEQ ID NO: 1902529 - RNA, 17 nt, Shigella flexneri 2a str. 2457T
ucuuugacaaauuccgu

SEQ ID NO: 1902530 - RNA, 15 nt, Shigella flexneri 2a str. 2457T
ucuuuaucuauuaau

SEQ ID NO: 1902531 - RNA, 11 nt, Shigella flexneri 2a str. 2457T
ucuuuaucugc

SEQ ID NO: 1902532 - RNA, 13 nt, Shigella flexneri 2a str. 2457T
ucuuuauccugac

SEQ ID NO: 1902533 - RNA, 23 nt, Shigella flexneri 2a str. 2457T
ucuuuaucaccaaugauaaguuu

SEQ ID NO: 1902534 - RNA, 13 nt, Shigella flexneri 2a str. 2457T
ucuuuaucaauca

SEQ ID NO: 1902535 - RNA, 13 nt, Shigella flexneri 2a str. 2457T
ucuuuacacacaa

SEQ ID NO: 1902536 - RNA, 12 nt, Shigella flexneri 2a str. 2457T
ucuuuaaugaca

SEQ ID NO: 1902537 - RNA, 22 nt, Shigella flexneri 2a str. 2457T
ucuuuaucggucuuagcaaagg

SEQ ID NO: 1902538 - RNA, 17 nt, Shigella flexneri 2a str. 2457T
ucuuucagcaccgcgaa

SEQ ID NO: 1902539 - RNA, 12 nt, Shigella flexneri 2a str. 2457T
ucuuucagcaac

SEQ ID NO: 1902540 - RNA, 17 nt, Shigella flexneri 2a str. 2457T
ucuuucaccucuucauu

SEQ ID NO: 1902541 - RNA, 18 nt, Shigella flexneri 2a str. 2457T
ucuuucacgaacacagug

SEQ ID NO: 1902542 - RNA, 17 nt, Shigella flexneri 2a str. 2457T
ucuuucacgcccagucc

SEQ ID NO: 1902543 - RNA, 22 nt, Shigella flexneri 2a str. 2457T
ucuuuccagacucaacaggccc

SEQ ID NO: 1902544 - RNA, 20 nt, Shigella flexneri 2a str. 2457T
ucuuucgacggcaucagaaa

SEQ ID NO: 1902545 - RNA, 14 nt, Shigella flexneri 2a str. 2457T
ucuuucucaaucug

SEQ ID NO: 1902546 - RNA, 11 nt, Shigella flexneri 2a str. 2457T
ucuuucucauc

SEQ ID NO: 1902547 - RNA, 15 nt, Shigella flexneri 2a str. 2457T
ucuuucuaugagaaa

SEQ ID NO: 1902548 - RNA, 17 nt, Shigella flexneri 2a str. 2457T
ucuuucgugcuauucga

SEQ ID NO: 1902549 - RNA, 15 nt, Shigella flexneri 2a str. 2457T
ucuuccaucacaaag

SEQ ID NO: 1902550 - RNA, 11 nt, Shigella flexneri 2a str. 2457T
ucuucccagcc

SEQ ID NO: 1902551 - RNA, 18 nt, Shigella flexneri 2a str. 2457T
ucuucccagccaaugcag

SEQ ID NO: 1902552 - RNA, 20 nt, Shigella flexneri 2a str. 2457T
ucuuccagugccucaagaau

SEQ ID NO: 1902553 - RNA, 22 nt, Shigella flexneri 2a str. 2457T
ucuuccagcguuucaaguguac

SEQ ID NO: 1902554 - RNA, 15 nt, Shigella flexneri 2a str. 2457T
ucuucccgccuguca

SEQ ID NO: 1902555 - RNA, 22 nt, Shigella flexneri 2a str. 2457T
ucuucccgagacauuccuuuac

SEQ ID NO: 1902556 - RNA, 23 nt, Shigella flexneri 2a str. 2457T
ucuucccgagacauuccuuuacu

SEQ ID NO: 1902557 - RNA, 13 nt, Shigella flexneri 2a str. 2457T
ucuucccgcagcc

SEQ ID NO: 1902558 - RNA, 23 nt, Shigella flexneri 2a str. 2457T
ucuugcuggcauuacaagaauca

SEQ ID NO: 1902559 - RNA, 13 nt, Shigella flexneri 2a str. 2457T
ucuugcuggaugc

SEQ ID NO: 1902560 - RNA, 18 nt, Shigella flexneri 2a str. 2457T
ucuugcugauacuccuca

SEQ ID NO: 1902561 - RNA, 15 nt, Shigella flexneri 2a str. 2457T
ucuuggguauaaaac

SEQ ID NO: 1902562 - RNA, 15 nt, Shigella flexneri 2a str. 2457T
ucuuggcugcucauu

SEQ ID NO: 1902563 - RNA, 14 nt, Shigella flexneri 2a str. 2457T
ucuuguugaacagg

SEQ ID NO: 1902564 - RNA, 20 nt, Shigella flexneri 2a str. 2457T
ugaaauacccgcucauucgu

SEQ ID NO: 1902565 - RNA, 16 nt, Shigella flexneri 2a str. 2457T
ugaaaucgaacagguu

SEQ ID NO: 1902566 - RNA, 23 nt, Shigella flexneri 2a str. 2457T
ugaaauccggcaccugucagacu

SEQ ID NO: 1902567 - RNA, 15 nt, Shigella flexneri 2a str. 2457T
ugaaaucagcacaua

SEQ ID NO: 1902568 - RNA, 16 nt, Shigella flexneri 2a str. 2457T
ugaaaucugaaaucau

SEQ ID NO: 1902569 - RNA, 19 nt, Shigella flexneri 2a str. 2457T
ugaaaucugaaaucaucaa

SEQ ID NO: 1902570 - RNA, 18 nt, Shigella flexneri 2a str. 2457T
ugaaaugaaaaucaccau

SEQ ID NO: 1902571 - RNA, 22 nt, Shigella flexneri 2a str. 2457T
ugaaaugugccggaugcaucac

SEQ ID NO: 1902572 - RNA, 14 nt, Shigella flexneri 2a str. 2457T
ugaaauuccaucac

SEQ ID NO: 1902573 - RNA, 19 nt, Shigella flexneri 2a str. 2457T
ugaaauuacuuuccaucuu

SEQ ID NO: 1902574 - RNA, 13 nt, Shigella flexneri 2a str. 2457T
ugaacaaacaauu

SEQ ID NO: 1902575 - RNA, 22 nt, Shigella flexneri 2a str. 2457T
ugaaauuuaugcgcuaaauguu

SEQ ID NO: 1902576 - RNA, 19 nt, Shigella flexneri 2a str. 2457T
ugaaauugugauaaaaauc

SEQ ID NO: 1902577 - RNA, 14 nt, Shigella flexneri 2a str. 2457T
ugaaauugcugguu

SEQ ID NO: 1902578 - RNA, 18 nt, Shigella flexneri 2a str. 2457T
ugaacacguuuucucaag

SEQ ID NO: 1902579 - RNA, 13 nt, Shigella flexneri 2a str. 2457T
ugaacaagcaaga

SEQ ID NO: 1902580 - RNA, 21 nt, Shigella flexneri 2a str. 2457T
ugaacaacuuaacuugcuuaa

SEQ ID NO: 1902581 - RNA, 23 nt, Shigella flexneri 2a str. 2457T
ugaacaacuuaacuugcuuaaaa

SEQ ID NO: 1902582 - RNA, 12 nt, Shigella flexneri 2a str. 2457T
ugaacaaccaga

SEQ ID NO: 1902583 - RNA, 21 nt, Shigella flexneri 2a str. 2457T
ugaaccgugucgccaucaaag

SEQ ID NO: 1902584 - RNA, 22 nt, Shigella flexneri 2a str. 2457T
ugaacgaccuccacucucgaaa

SEQ ID NO: 1902585 - RNA, 18 nt, Shigella flexneri 2a str. 2457T
ugaacgccaaauucuuua

SEQ ID NO: 1902586 - RNA, 17 nt, Shigella flexneri 2a str. 2457T
ugaacgccaaauucuuu

SEQ ID NO: 1902587 - RNA, 15 nt, Shigella flexneri 2a str. 2457T
ugaacgcccccucac

SEQ ID NO: 1902588 - RNA, 20 nt, Shigella flexneri 2a str. 2457T
ugaacgccaaauucuuuauc

SEQ ID NO: 1902589 - RNA, 14 nt, Shigella flexneri 2a str. 2457T
ugaacauugcugcu

SEQ ID NO: 1902590 - RNA, 23 nt, Shigella flexneri 2a str. 2457T
ugaacaucgcagggaaaauuaac

SEQ ID NO: 1902591 - RNA, 16 nt, Shigella flexneri 2a str. 2457T
ugaaccgaaauggcug

SEQ ID NO: 1902592 - RNA, 16 nt, Shigella flexneri 2a str. 2457T
ugaaccgcacagguug

SEQ ID NO: 1902593 - RNA, 19 nt, Shigella flexneri 2a str. 2457T
ugaaaacgcauaccagucu

SEQ ID NO: 1902594 - RNA, 14 nt, Shigella flexneri 2a str. 2457T
ugaaaaaccaaucu

SEQ ID NO: 1902595 - RNA, 14 nt, Shigella flexneri 2a str. 2457T
ugaaaaaucaaaaa

SEQ ID NO: 1902596 - RNA, 18 nt, Shigella flexneri 2a str. 2457T
ugaaaaaucaaaaaacug

SEQ ID NO: 1902597 - RNA, 15 nt, Shigella flexneri 2a str. 2457T
ugaaaacccugcgca

SEQ ID NO: 1902598 - RNA, 14 nt, Shigella flexneri 2a str. 2457T
ugaaaaucauacau

SEQ ID NO: 1902599 - RNA, 18 nt, Shigella flexneri 2a str. 2457T
ugaaaaguccaggcugca

SEQ ID NO: 1902600 - RNA, 15 nt, Shigella flexneri 2a str. 2457T
ugaaaauaaccauau

SEQ ID NO: 1902601 - RNA, 23 nt, Shigella flexneri 2a str. 2457T
ugaaacaagaaguuauccuggua

SEQ ID NO: 1902602 - RNA, 14 nt, Shigella flexneri 2a str. 2457T
ugaaaaugcugguu

SEQ ID NO: 1902603 - RNA, 19 nt, Shigella flexneri 2a str. 2457T
ugaaaauucgcggcauggg

SEQ ID NO: 1902604 - RNA, 15 nt, Shigella flexneri 2a str. 2457T
ugaaagggcaaauaa

SEQ ID NO: 1902605 - RNA, 20 nt, Shigella flexneri 2a str. 2457T
ugaaagagccgucauucugc

SEQ ID NO: 1902606 - RNA, 17 nt, Shigella flexneri 2a str. 2457T
ugaaagccccaccagca

SEQ ID NO: 1902607 - RNA, 22 nt, Shigella flexneri 2a str. 2457T
ugaaagccccaccagcaaauau

SEQ ID NO: 1902608 - RNA, 18 nt, Shigella flexneri 2a str. 2457T
ugaaaguucaugauuuaa

SEQ ID NO: 1902609 - RNA, 22 nt, Shigella flexneri 2a str. 2457T
ugaaacgucaaauaauuccugc

SEQ ID NO: 1902610 - RNA, 22 nt, Shigella flexneri 2a str. 2457T
ugaaacgcuuuacguuccuggc

SEQ ID NO: 1902611 - RNA, 17 nt, Shigella flexneri 2a str. 2457T
ugaaacucgcugccagc

SEQ ID NO: 1902612 - RNA, 14 nt, Shigella flexneri 2a str. 2457T
ugaaacucacgcag

SEQ ID NO: 1902613 - RNA, 22 nt, Shigella flexneri 2a str. 2457T
ugaaagaaaaucaauccagugu

SEQ ID NO: 1902614 - RNA, 21 nt, Shigella flexneri 2a str. 2457T
ugaaagaagcggugaaaaaau

SEQ ID NO: 1902615 - RNA, 14 nt, Shigella flexneri 2a str. 2457T
ugaaacuggaagau

SEQ ID NO: 1902616 - RNA, 19 nt, Shigella flexneri 2a str. 2457T
ugaaacucagcauggaaau

SEQ ID NO: 1902617 - RNA, 13 nt, Shigella flexneri 2a str. 2457T
ugaaacuguuaau

SEQ ID NO: 1902618 - RNA, 13 nt, Shigella flexneri 2a str. 2457T
ucuucaucaccga

SEQ ID NO: 1902619 - RNA, 12 nt, Shigella flexneri 2a str. 2457T
ucuucaucaucc

SEQ ID NO: 1902620 - RNA, 13 nt, Shigella flexneri 2a str. 2457T
ucuucaucauccu

SEQ ID NO: 1902621 - RNA, 15 nt, Shigella flexneri 2a str. 2457T
ucuucaucauccucu

SEQ ID NO: 1902622 - RNA, 16 nt, Shigella flexneri 2a str. 2457T
ucuuccacgccugcau

SEQ ID NO: 1902623 - RNA, 19 nt, Shigella flexneri 2a str. 2457T
ucuuccagaauaaacaacu

SEQ ID NO: 1902624 - RNA, 16 nt, Shigella flexneri 2a str. 2457T
ucuucagccccuccac

SEQ ID NO: 1902625 - RNA, 21 nt, Shigella flexneri 2a str. 2457T
ucuucacguuuuucgaaaauc

SEQ ID NO: 1902626 - RNA, 13 nt, Shigella flexneri 2a str. 2457T
ucuucacggaaaa

SEQ ID NO: 1902627 - RNA, 19 nt, Shigella flexneri 2a str. 2457T
ucuucacguuuuucgaaaa

SEQ ID NO: 1902628 - RNA, 18 nt, Shigella flexneri 2a str. 2457T
ucuucacgcgcagaucgu

SEQ ID NO: 1902629 - RNA, 15 nt, Shigella flexneri 2a str. 2457T
ucuucacgcccgccc

SEQ ID NO: 1902630 - RNA, 13 nt, Shigella flexneri 2a str. 2457T
ucuuauuucacua

SEQ ID NO: 1902631 - RNA, 22 nt, Shigella flexneri 2a str. 2457T
ucuucaaccgcagugauuucaa

SEQ ID NO: 1902632 - RNA, 20 nt, Shigella flexneri 2a str. 2457T
ucuucaaccgucaccagccc

SEQ ID NO: 1902633 - RNA, 22 nt, Shigella flexneri 2a str. 2457T
ucuucaacacacugaauaaaaa

SEQ ID NO: 1902634 - RNA, 16 nt, Shigella flexneri 2a str. 2457T
ucuucaacgaagaaaa

SEQ ID NO: 1902635 - RNA, 15 nt, Shigella flexneri 2a str. 2457T
ucuucacaucaucau

SEQ ID NO: 1902636 - RNA, 17 nt, Shigella flexneri 2a str. 2457T
ucuuaucaugccuacau

SEQ ID NO: 1902637 - RNA, 21 nt, Shigella flexneri 2a str. 2457T
ucuuaucaugccuacauauuu

SEQ ID NO: 1902638 - RNA, 19 nt, Shigella flexneri 2a str. 2457T
ucuuauccggccuuccugu

SEQ ID NO: 1902639 - RNA, 22 nt, Shigella flexneri 2a str. 2457T
ucuuauccggccuacguguguu

SEQ ID NO: 1902640 - RNA, 21 nt, Shigella flexneri 2a str. 2457T
ucuuaucaggccuacaacucc

SEQ ID NO: 1902641 - RNA, 16 nt, Shigella flexneri 2a str. 2457T
ucuuaucuaacaaccu

SEQ ID NO: 1902642 - RNA, 21 nt, Shigella flexneri 2a str. 2457T
ucuuaucuggccuacuuuaau

SEQ ID NO: 1902643 - RNA, 19 nt, Shigella flexneri 2a str. 2457T
ucuuauccagcugcgcgcg

SEQ ID NO: 1902644 - RNA, 13 nt, Shigella flexneri 2a str. 2457T
ucuuauaugauga

SEQ ID NO: 1902645 - RNA, 16 nt, Shigella flexneri 2a str. 2457T
ucuuaucaggccaggu

SEQ ID NO: 1902646 - RNA, 20 nt, Shigella flexneri 2a str. 2457T
ucuuacuucaacacauaacc

SEQ ID NO: 1902647 - RNA, 13 nt, Shigella flexneri 2a str. 2457T
ucuuacuuuuaau

SEQ ID NO: 1902648 - RNA, 23 nt, Shigella flexneri 2a str. 2457T
ucuuacuguguugccgcauuuuc

SEQ ID NO: 1902649 - RNA, 18 nt, Shigella flexneri 2a str. 2457T
ucuuacguaauuuauaau

SEQ ID NO: 1902650 - RNA, 21 nt, Shigella flexneri 2a str. 2457T
ucuuaccggucccuucaaucu

SEQ ID NO: 1902651 - RNA, 14 nt, Shigella flexneri 2a str. 2457T
ucuguuccggcgua

SEQ ID NO: 1902652 - RNA, 17 nt, Shigella flexneri 2a str. 2457T
ucuuaccgcuucaauua

SEQ ID NO: 1902653 - RNA, 18 nt, Shigella flexneri 2a str. 2457T
ucugcguuccuggggaaa

SEQ ID NO: 1902654 - RNA, 19 nt, Shigella flexneri 2a str. 2457T
ucugcguuccuggggaaaa

SEQ ID NO: 1902655 - RNA, 14 nt, Shigella flexneri 2a str. 2457T
ucugcucgcaggcu

SEQ ID NO: 1902656 - RNA, 15 nt, Shigella flexneri 2a str. 2457T
ucugcugauuaaccc

SEQ ID NO: 1902657 - RNA, 12 nt, Shigella flexneri 2a str. 2457T
ucugcugccuga

SEQ ID NO: 1902658 - RNA, 20 nt, Shigella flexneri 2a str. 2457T
ucuggaaauuaaacggcaaa

SEQ ID NO: 1902659 - RNA, 20 nt, Shigella flexneri 2a str. 2457T
ucuggaacuggcugccagcg

SEQ ID NO: 1902660 - RNA, 13 nt, Shigella flexneri 2a str. 2457T
ucuggaagcaaaa

SEQ ID NO: 1902661 - RNA, 14 nt, Shigella flexneri 2a str. 2457T
ucuggaagccaguc

SEQ ID NO: 1902662 - RNA, 18 nt, Shigella flexneri 2a str. 2457T
ucuggaagccagucacau

SEQ ID NO: 1902663 - RNA, 14 nt, Shigella flexneri 2a str. 2457T
ucugcgcgugcagu

SEQ ID NO: 1902664 - RNA, 13 nt, Shigella flexneri 2a str. 2457T
ucugcgcuugguu

SEQ ID NO: 1902665 - RNA, 18 nt, Shigella flexneri 2a str. 2457T
ucugcagcgcggcgagag

SEQ ID NO: 1902666 - RNA, 22 nt, Shigella flexneri 2a str. 2457T
ucugcgguacggauagccgccc

SEQ ID NO: 1902667 - RNA, 15 nt, Shigella flexneri 2a str. 2457T
ucugcguaauguuua

SEQ ID NO: 1902668 - RNA, 14 nt, Shigella flexneri 2a str. 2457T
ucugcggcaucaua

SEQ ID NO: 1902669 - RNA, 12 nt, Shigella flexneri 2a str. 2457T
ucugcaaggcga

SEQ ID NO: 1902670 - RNA, 19 nt, Shigella flexneri 2a str. 2457T
ucugcaagguucuuugcug

SEQ ID NO: 1902671 - RNA, 16 nt, Shigella flexneri 2a str. 2457T
ucugcaauuacugcau

SEQ ID NO: 1902672 - RNA, 15 nt, Shigella flexneri 2a str. 2457T
ucugcaauuuaccuu

SEQ ID NO: 1902673 - RNA, 20 nt, Shigella flexneri 2a str. 2457T
ucugcacguuuugcugaugc

SEQ ID NO: 1902674 - RNA, 19 nt, Shigella flexneri 2a str. 2457T
ucuggcucaucgccuucca

SEQ ID NO: 1902675 - RNA, 16 nt, Shigella flexneri 2a str. 2457T
ucuggcggaagcucca

SEQ ID NO: 1902676 - RNA, 14 nt, Shigella flexneri 2a str. 2457T
ucuggaagaggcug

SEQ ID NO: 1902677 - RNA, 10 nt, Shigella flexneri 2a str. 2457T
ucuggaauuc

SEQ ID NO: 1902678 - RNA, 20 nt, Shigella flexneri 2a str. 2457T
ucuggacaaagagcuuucau

SEQ ID NO: 1902679 - RNA, 20 nt, Shigella flexneri 2a str. 2457T
ucuggaguuauagcuggauu

SEQ ID NO: 1902680 - RNA, 16 nt, Shigella flexneri 2a str. 2457T
ucuggaguuccuggau

SEQ ID NO: 1902681 - RNA, 18 nt, Shigella flexneri 2a str. 2457T
ucuggaguuccuggauga

SEQ ID NO: 1902682 - RNA, 15 nt, Shigella flexneri 2a str. 2457T
ucuggcuucccggca

SEQ ID NO: 1902683 - RNA, 16 nt, Shigella flexneri 2a str. 2457T
ucuggcuugccagcag

SEQ ID NO: 1902684 - RNA, 16 nt, Shigella flexneri 2a str. 2457T
ucuggugcuuuuucaa

SEQ ID NO: 1902685 - RNA, 22 nt, Shigella flexneri 2a str. 2457T
ucugguggacaaccauaaauuu

SEQ ID NO: 1902686 - RNA, 17 nt, Shigella flexneri 2a str. 2457T
ucuggcuugccagcagg

SEQ ID NO: 1902687 - RNA, 15 nt, Shigella flexneri 2a str. 2457T
ucugguggaaaagaa

SEQ ID NO: 1902688 - RNA, 20 nt, Shigella flexneri 2a str. 2457T
ucuggugggugcuuuaaaaa

SEQ ID NO: 1902689 - RNA, 22 nt, Shigella flexneri 2a str. 2457T
ucuggugggugcuuuaaaaaag

SEQ ID NO: 1902690 - RNA, 20 nt, Shigella flexneri 2a str. 2457T
ucugguucgccaaaugucac

SEQ ID NO: 1902691 - RNA, 22 nt, Shigella flexneri 2a str. 2457T
ucugguucgccaaaugucacca

SEQ ID NO: 1902692 - RNA, 19 nt, Shigella flexneri 2a str. 2457T
ucugguguggagugcagca

SEQ ID NO: 1902693 - RNA, 14 nt, Shigella flexneri 2a str. 2457T
ucugguuguggugg

SEQ ID NO: 1902694 - RNA, 15 nt, Shigella flexneri 2a str. 2457T
ucugucagaaaugau

SEQ ID NO: 1902695 - RNA, 15 nt, Shigella flexneri 2a str. 2457T
ucugucagguaacaa

SEQ ID NO: 1902696 - RNA, 14 nt, Shigella flexneri 2a str. 2457T
ucugucgcucugcu

SEQ ID NO: 1902697 - RNA, 21 nt, Shigella flexneri 2a str. 2457T
ucuguaauugaaggcuuauaa

SEQ ID NO: 1902698 - RNA, 21 nt, Shigella flexneri 2a str. 2457T
ucuguaaauugaugugaaaac

SEQ ID NO: 1902699 - RNA, 18 nt, Shigella flexneri 2a str. 2457T
ucuguaacgcacuggugg

SEQ ID NO: 1902700 - RNA, 14 nt, Shigella flexneri 2a str. 2457T
ucugguuucaagau

SEQ ID NO: 1902701 - RNA, 20 nt, Shigella flexneri 2a str. 2457T
ucugguuugccacguucuga

SEQ ID NO: 1902702 - RNA, 21 nt, Shigella flexneri 2a str. 2457T
ucucauuccaccgaaacuuuu

SEQ ID NO: 1902703 - RNA, 18 nt, Shigella flexneri 2a str. 2457T
ucuccagcgcaucgaucu

SEQ ID NO: 1902704 - RNA, 13 nt, Shigella flexneri 2a str. 2457T
ucuccucccuugu

SEQ ID NO: 1902705 - RNA, 17 nt, Shigella flexneri 2a str. 2457T
ucuccgcuggagcgggg

SEQ ID NO: 1902706 - RNA, 11 nt, Shigella flexneri 2a str. 2457T
ucuccggcguu

SEQ ID NO: 1902707 - RNA, 20 nt, Shigella flexneri 2a str. 2457T
ucuccggcgcauccaugaua

SEQ ID NO: 1902708 - RNA, 20 nt, Shigella flexneri 2a str. 2457T
ucucccucgcucuguaggga

SEQ ID NO: 1902709 - RNA, 20 nt, Shigella flexneri 2a str. 2457T
ucucccuacagagcgaggga

SEQ ID NO: 1902710 - RNA, 14 nt, Shigella flexneri 2a str. 2457T
ucucccgccagcga

SEQ ID NO: 1902711 - RNA, 22 nt, Shigella flexneri 2a str. 2457T
ucucccgauaaccuucuucauu

SEQ ID NO: 1902712 - RNA, 22 nt, Shigella flexneri 2a str. 2457T
ucuccugcaacagguugcgcug

SEQ ID NO: 1902713 - RNA, 23 nt, Shigella flexneri 2a str. 2457T
ucuccuggcgcaccuuuuuuuau

SEQ ID NO: 1902714 - RNA, 21 nt, Shigella flexneri 2a str. 2457T
ucuccugcgccucuccacacg

SEQ ID NO: 1902715 - RNA, 22 nt, Shigella flexneri 2a str. 2457T
ucucggcaauaauuuuuucgcc

SEQ ID NO: 1902716 - RNA, 16 nt, Shigella flexneri 2a str. 2457T
ucucgcagcucaucaa

SEQ ID NO: 1902717 - RNA, 14 nt, Shigella flexneri 2a str. 2457T
ucucgggaaggccc

SEQ ID NO: 1902718 - RNA, 21 nt, Shigella flexneri 2a str. 2457T
ucucggucggcauuuuucggc

SEQ ID NO: 1902719 - RNA, 22 nt, Shigella flexneri 2a str. 2457T
ucucgggcaguaaaucaauauc

SEQ ID NO: 1902720 - RNA, 21 nt, Shigella flexneri 2a str. 2457T
ucucgucgguaauuucacaag

SEQ ID NO: 1902721 - RNA, 13 nt, Shigella flexneri 2a str. 2457T
ucucgucucccgu

SEQ ID NO: 1902722 - RNA, 17 nt, Shigella flexneri 2a str. 2457T
ucucgugccaccagugc

SEQ ID NO: 1902723 - RNA, 20 nt, Shigella flexneri 2a str. 2457T
ucucgugccaccagugcagg

SEQ ID NO: 1902724 - RNA, 13 nt, Shigella flexneri 2a str. 2457T
ucucgugccgcca

SEQ ID NO: 1902725 - RNA, 17 nt, Shigella flexneri 2a str. 2457T
ucucguugaucacccac

SEQ ID NO: 1902726 - RNA, 18 nt, Shigella flexneri 2a str. 2457T
ucucuacgacuugaaaaa

SEQ ID NO: 1902727 - RNA, 14 nt, Shigella flexneri 2a str. 2457T
ucucuacaccauua

SEQ ID NO: 1902728 - RNA, 23 nt, Shigella flexneri 2a str. 2457T
ucucuugcuggcauuacaagaau

SEQ ID NO: 1902729 - RNA, 18 nt, Shigella flexneri 2a str. 2457T
ucucuugccgguuuugca

SEQ ID NO: 1902730 - RNA, 18 nt, Shigella flexneri 2a str. 2457T
ucucuuucaacauccugu

SEQ ID NO: 1902731 - RNA, 15 nt, Shigella flexneri 2a str. 2457T
ucucuuccggcuccc

SEQ ID NO: 1902732 - RNA, 17 nt, Shigella flexneri 2a str. 2457T
ucucuucgccugccugc

SEQ ID NO: 1902733 - RNA, 21 nt, Shigella flexneri 2a str. 2457T
ucucuucacgcuuugcaggcu

SEQ ID NO: 1902734 - RNA, 14 nt, Shigella flexneri 2a str. 2457T
ucucuuccagugcc

SEQ ID NO: 1902735 - RNA, 24 nt, Shigella flexneri 2a str. 2457T
ucucuucaacacggcgcauugcca

SEQ ID NO: 1902736 - RNA, 17 nt, Shigella flexneri 2a str. 2457T
ucucucuugcuaucacc

SEQ ID NO: 1902737 - RNA, 15 nt, Shigella flexneri 2a str. 2457T
ucucuauuucaccca

SEQ ID NO: 1902738 - RNA, 13 nt, Shigella flexneri 2a str. 2457T
ucucucagcacac

SEQ ID NO: 1902739 - RNA, 22 nt, Shigella flexneri 2a str. 2457T
ucucuggccgcuuccagcauuu

SEQ ID NO: 1902740 - RNA, 19 nt, Shigella flexneri 2a str. 2457T
ucucuggcccgcuuuucau

SEQ ID NO: 1902741 - RNA, 23 nt, Shigella flexneri 2a str. 2457T
ucucuggcccgcuuuucauuauc

SEQ ID NO: 1902742 - RNA, 12 nt, Shigella flexneri 2a str. 2457T
ucucuggaagag

SEQ ID NO: 1902743 - RNA, 11 nt, Shigella flexneri 2a str. 2457T
ucucugaaauu

SEQ ID NO: 1902744 - RNA, 17 nt, Shigella flexneri 2a str. 2457T
ucucugcaaaaaacuua

SEQ ID NO: 1902745 - RNA, 19 nt, Shigella flexneri 2a str. 2457T
ucugaaguagccaguacca

SEQ ID NO: 1902746 - RNA, 21 nt, Shigella flexneri 2a str. 2457T
ucugaauauucggcuccagau

SEQ ID NO: 1902747 - RNA, 19 nt, Shigella flexneri 2a str. 2457T
ucugacgcgcauacucucc

SEQ ID NO: 1902748 - RNA, 22 nt, Shigella flexneri 2a str. 2457T
ucugacgugcgcaaacuucuuc

SEQ ID NO: 1902749 - RNA, 20 nt, Shigella flexneri 2a str. 2457T
ucugauagugauccaucagg

SEQ ID NO: 1902750 - RNA, 23 nt, Shigella flexneri 2a str. 2457T
ucugauaguuaaaauucaagaca

SEQ ID NO: 1902751 - RNA, 19 nt, Shigella flexneri 2a str. 2457T
ucugagagcaugaaaugaa

SEQ ID NO: 1902752 - RNA, 20 nt, Shigella flexneri 2a str. 2457T
ucugagccagcuucccaaag

SEQ ID NO: 1902753 - RNA, 20 nt, Shigella flexneri 2a str. 2457T
ucugagcaucacauaaucga

SEQ ID NO: 1902754 - RNA, 20 nt, Shigella flexneri 2a str. 2457T
ucugagcaugaugccugaug

SEQ ID NO: 1902755 - RNA, 15 nt, Shigella flexneri 2a str. 2457T
ucugaugcauaaaaa

SEQ ID NO: 1902756 - RNA, 22 nt, Shigella flexneri 2a str. 2457T
ucugcaaaauaccaauaaucaa

SEQ ID NO: 1902757 - RNA, 20 nt, Shigella flexneri 2a str. 2457T
ucugcaaaauagccaaucau

SEQ ID NO: 1902758 - RNA, 21 nt, Shigella flexneri 2a str. 2457T
ucugcaagaggaaauaagcau

SEQ ID NO: 1902759 - RNA, 17 nt, Shigella flexneri 2a str. 2457T
ucugcaagcaucauaaa

SEQ ID NO: 1902760 - RNA, 17 nt, Shigella flexneri 2a str. 2457T
ucugaugauauuuuucc

SEQ ID NO: 1902761 - RNA, 14 nt, Shigella flexneri 2a str. 2457T
ucugaugauauuuu

SEQ ID NO: 1902762 - RNA, 12 nt, Shigella flexneri 2a str. 2457T
ucugauccugca

SEQ ID NO: 1902763 - RNA, 15 nt, Shigella flexneri 2a str. 2457T
ggugucacaugcagc

SEQ ID NO: 1902764 - RNA, 18 nt, Shigella flexneri 2a str. 2457T
gguguaucuucagcugca

SEQ ID NO: 1902765 - RNA, 20 nt, Shigella flexneri 2a str. 2457T
gguguucagauggccaauaa

SEQ ID NO: 1902766 - RNA, 22 nt, Shigella flexneri 2a str. 2457T
gguguucauccuggcacagcag

SEQ ID NO: 1902767 - RNA, 22 nt, Shigella flexneri 2a str. 2457T
ggugguaaaaauugcccgccgu

SEQ ID NO: 1902768 - RNA, 21 nt, Shigella flexneri 2a str. 2457T
gguguaaugccagucaguuaa

SEQ ID NO: 1902769 - RNA, 18 nt, Shigella flexneri 2a str. 2457T
ggugcuuuaaaaaagaau

SEQ ID NO: 1902770 - RNA, 22 nt, Shigella flexneri 2a str. 2457T
ggugcuuuaacgaaagcgccuc

SEQ ID NO: 1902771 - RNA, 18 nt, Shigella flexneri 2a str. 2457T
gguuaccgacugcggccu

SEQ ID NO: 1902772 - RNA, 17 nt, Shigella flexneri 2a str. 2457T
gguuaauuaccuuauca

SEQ ID NO: 1902773 - RNA, 16 nt, Shigella flexneri 2a str. 2457T
gguguuuaaccaacac

SEQ ID NO: 1902774 - RNA, 13 nt, Shigella flexneri 2a str. 2457T
gguuauauuuccc

SEQ ID NO: 1902775 - RNA, 17 nt, Shigella flexneri 2a str. 2457T
gguuagucugcauuuuc

SEQ ID NO: 1902776 - RNA, 21 nt, Shigella flexneri 2a str. 2457T
gguuagucugcauuuucucgc

SEQ ID NO: 1902777 - RNA, 14 nt, Shigella flexneri 2a str. 2457T
gguuaguaugaaga

SEQ ID NO: 1902778 - RNA, 22 nt, Shigella flexneri 2a str. 2457T
gguuaguaugaagaacaaguuc

SEQ ID NO: 1902779 - RNA, 11 nt, Shigella flexneri 2a str. 2457T
gguuauugguu

SEQ ID NO: 1902780 - RNA, 14 nt, Shigella flexneri 2a str. 2457T
gguucaaaguaaua

SEQ ID NO: 1902781 - RNA, 19 nt, Shigella flexneri 2a str. 2457T
gguucaaauagcaaugucu

SEQ ID NO: 1902782 - RNA, 16 nt, Shigella flexneri 2a str. 2457T
gguucgcacuaaguuc

SEQ ID NO: 1902783 - RNA, 21 nt, Shigella flexneri 2a str. 2457T
gguuccccccacaaucagcca

SEQ ID NO: 1902784 - RNA, 20 nt, Shigella flexneri 2a str. 2457T
gguuccacuucugcggguga

SEQ ID NO: 1902785 - RNA, 20 nt, Shigella flexneri 2a str. 2457T
gguucauuggguucaucuga

SEQ ID NO: 1902786 - RNA, 13 nt, Shigella flexneri 2a str. 2457T
gguucaccgguga

SEQ ID NO: 1902787 - RNA, 16 nt, Shigella flexneri 2a str. 2457T
gguucaauaucuuccu

SEQ ID NO: 1902788 - RNA, 21 nt, Shigella flexneri 2a str. 2457T
gguugccauuaauaaccgaau

SEQ ID NO: 1902789 - RNA, 18 nt, Shigella flexneri 2a str. 2457T
gguugcuggaaagagaaa

SEQ ID NO: 1902790 - RNA, 16 nt, Shigella flexneri 2a str. 2457T
gguugcucauaaaaug

SEQ ID NO: 1902791 - RNA, 14 nt, Shigella flexneri 2a str. 2457T
gguuuaaacagaga

SEQ ID NO: 1902792 - RNA, 21 nt, Shigella flexneri 2a str. 2457T
gguuuaaacagagauuacuuu

SEQ ID NO: 1902793 - RNA, 14 nt, Shigella flexneri 2a str. 2457T
gguuggcucaucaa

SEQ ID NO: 1902794 - RNA, 13 nt, Shigella flexneri 2a str. 2457T
gguuggagcgcgu

SEQ ID NO: 1902795 - RNA, 16 nt, Shigella flexneri 2a str. 2457T
gguugguacuguggca

SEQ ID NO: 1902796 - RNA, 20 nt, Shigella flexneri 2a str. 2457T
gguucucuuuuauuucugcu

SEQ ID NO: 1902797 - RNA, 21 nt, Shigella flexneri 2a str. 2457T
gguucguaagcgauaaccgca

SEQ ID NO: 1902798 - RNA, 13 nt, Shigella flexneri 2a str. 2457T
gguugacugcuga

SEQ ID NO: 1902799 - RNA, 14 nt, Shigella flexneri 2a str. 2457T
gguugacgccccug

SEQ ID NO: 1902800 - RNA, 21 nt, Shigella flexneri 2a str. 2457T
gguucuuuggucaggcgcuga

SEQ ID NO: 1902801 - RNA, 11 nt, Shigella flexneri 2a str. 2457T
gguucuuuuaa

SEQ ID NO: 1902802 - RNA, 20 nt, Shigella flexneri 2a str. 2457T
gguuuuuguuuugagcacuc

SEQ ID NO: 1902803 - RNA, 20 nt, Shigella flexneri 2a str. 2457T
gguuuuuuauuuaagcuggg

SEQ ID NO: 1902804 - RNA, 22 nt, Shigella flexneri 2a str. 2457T
gguuuuuugaacagaccacauu

SEQ ID NO: 1902805 - RNA, 12 nt, Shigella flexneri 2a str. 2457T
guaaaaagaaag

SEQ ID NO: 1902806 - RNA, 15 nt, Shigella flexneri 2a str. 2457T
guaaaaagaaaguuu

SEQ ID NO: 1902807 - RNA, 16 nt, Shigella flexneri 2a str. 2457T
guaaaaacgcauuuau

SEQ ID NO: 1902808 - RNA, 18 nt, Shigella flexneri 2a str. 2457T
guaaaaacgcauuuaucu

SEQ ID NO: 1902809 - RNA, 18 nt, Shigella flexneri 2a str. 2457T
guaaaaccugacaacaaa

SEQ ID NO: 1902810 - RNA, 18 nt, Shigella flexneri 2a str. 2457T
gguuucacguaccagaug

SEQ ID NO: 1902811 - RNA, 14 nt, Shigella flexneri 2a str. 2457T
gguuucacccacgg

SEQ ID NO: 1902812 - RNA, 14 nt, Shigella flexneri 2a str. 2457T
gguuucaauuuccc

SEQ ID NO: 1902813 - RNA, 23 nt, Shigella flexneri 2a str. 2457T
gguuucaaagauuuuaccaaugg

SEQ ID NO: 1902814 - RNA, 20 nt, Shigella flexneri 2a str. 2457T
gguuucaagauuagcccccg

SEQ ID NO: 1902815 - RNA, 19 nt, Shigella flexneri 2a str. 2457T
gguuucgugaaacucagca

SEQ ID NO: 1902816 - RNA, 15 nt, Shigella flexneri 2a str. 2457T
gguuucgccugccag

SEQ ID NO: 1902817 - RNA, 18 nt, Shigella flexneri 2a str. 2457T
gguuucccgccguaacug

SEQ ID NO: 1902818 - RNA, 18 nt, Shigella flexneri 2a str. 2457T
gguuucgccacggcgcag

SEQ ID NO: 1902819 - RNA, 19 nt, Shigella flexneri 2a str. 2457T
gguuugacauaaauuccgc

SEQ ID NO: 1902820 - RNA, 14 nt, Shigella flexneri 2a str. 2457T
gguuuguuauccac

SEQ ID NO: 1902821 - RNA, 14 nt, Shigella flexneri 2a str. 2457T
gguuuggcggcggc

SEQ ID NO: 1902822 - RNA, 15 nt, Shigella flexneri 2a str. 2457T
gguuuggcggcggcu

SEQ ID NO: 1902823 - RNA, 11 nt, Shigella flexneri 2a str. 2457T
gguuuuaucca

SEQ ID NO: 1902824 - RNA, 12 nt, Shigella flexneri 2a str. 2457T
gguuuucaaucg

SEQ ID NO: 1902825 - RNA, 16 nt, Shigella flexneri 2a str. 2457T
gguccgggcaucagca

SEQ ID NO: 1902826 - RNA, 15 nt, Shigella flexneri 2a str. 2457T
ggucccugaugcauc

SEQ ID NO: 1902827 - RNA, 19 nt, Shigella flexneri 2a str. 2457T
gguccuaacaaccaucccc

SEQ ID NO: 1902828 - RNA, 23 nt, Shigella flexneri 2a str. 2457T
ggucgcucgcgccgcauccgaca

SEQ ID NO: 1902829 - RNA, 15 nt, Shigella flexneri 2a str. 2457T
ggucuaucaucagca

SEQ ID NO: 1902830 - RNA, 17 nt, Shigella flexneri 2a str. 2457T
ggucuggaacuggcugc

SEQ ID NO: 1902831 - RNA, 18 nt, Shigella flexneri 2a str. 2457T
ggucugcggaucauggua

SEQ ID NO: 1902832 - RNA, 17 nt, Shigella flexneri 2a str. 2457T
ggugacaaagugccugu

SEQ ID NO: 1902833 - RNA, 13 nt, Shigella flexneri 2a str. 2457T
ggucuggcgacgg

SEQ ID NO: 1902834 - RNA, 22 nt, Shigella flexneri 2a str. 2457T
ggugaagguaaguuguugauaa

SEQ ID NO: 1902835 - RNA, 22 nt, Shigella flexneri 2a str. 2457T
ggugcaucggggaauugugcuu

SEQ ID NO: 1902836 - RNA, 20 nt, Shigella flexneri 2a str. 2457T
ggugccauugaccagcugcc

SEQ ID NO: 1902837 - RNA, 23 nt, Shigella flexneri 2a str. 2457T
ggugauuuugccugugcaaccuu

SEQ ID NO: 1902838 - RNA, 14 nt, Shigella flexneri 2a str. 2457T
ggugaugguuucau

SEQ ID NO: 1902839 - RNA, 16 nt, Shigella flexneri 2a str. 2457T
ggugauuaaagaaaau

SEQ ID NO: 1902840 - RNA, 13 nt, Shigella flexneri 2a str. 2457T
ggugcaaaaaaac

SEQ ID NO: 1902841 - RNA, 20 nt, Shigella flexneri 2a str. 2457T
ggucaucaaucauuuuuuga

SEQ ID NO: 1902842 - RNA, 20 nt, Shigella flexneri 2a str. 2457T
ggucaucacaucccagcaga

SEQ ID NO: 1902843 - RNA, 22 nt, Shigella flexneri 2a str. 2457T
ggucagcaggagcagccccugc

SEQ ID NO: 1902844 - RNA, 23 nt, Shigella flexneri 2a str. 2457T
ggucagcagcuuucuuuauaucu

SEQ ID NO: 1902845 - RNA, 14 nt, Shigella flexneri 2a str. 2457T
ggucagaucagcca

SEQ ID NO: 1902846 - RNA, 13 nt, Shigella flexneri 2a str. 2457T
ggucagagaaucg

SEQ ID NO: 1902847 - RNA, 13 nt, Shigella flexneri 2a str. 2457T
ggucagacccagu

SEQ ID NO: 1902848 - RNA, 17 nt, Shigella flexneri 2a str. 2457T
ggucacugacaccagca

SEQ ID NO: 1902849 - RNA, 19 nt, Shigella flexneri 2a str. 2457T
ggucauggcauuaauaugc

SEQ ID NO: 1902850 - RNA, 20 nt, Shigella flexneri 2a str. 2457T
ggucauuuucuucagcaguu

SEQ ID NO: 1902851 - RNA, 13 nt, Shigella flexneri 2a str. 2457T
gguaucaaacaca

SEQ ID NO: 1902852 - RNA, 12 nt, Shigella flexneri 2a str. 2457T
gguagcggguga

SEQ ID NO: 1902853 - RNA, 18 nt, Shigella flexneri 2a str. 2457T
gguauagaagccauccag

SEQ ID NO: 1902854 - RNA, 15 nt, Shigella flexneri 2a str. 2457T
gguauagaucagacg

SEQ ID NO: 1902855 - RNA, 14 nt, Shigella flexneri 2a str. 2457T
ggucaaaagcugca

SEQ ID NO: 1902856 - RNA, 21 nt, Shigella flexneri 2a str. 2457T
ggucaaaauccauuuucuauu

SEQ ID NO: 1902857 - RNA, 12 nt, Shigella flexneri 2a str. 2457T
gguauuuuucua

SEQ ID NO: 1902858 - RNA, 19 nt, Shigella flexneri 2a str. 2457T
ggucaaaaaaugaaacugg

SEQ ID NO: 1902859 - RNA, 13 nt, Shigella flexneri 2a str. 2457T
gguauuggcggca

SEQ ID NO: 1902860 - RNA, 15 nt, Shigella flexneri 2a str. 2457T
gguaucaaacacagg

SEQ ID NO: 1902861 - RNA, 11 nt, Shigella flexneri 2a str. 2457T
gguaucaaacc

SEQ ID NO: 1902862 - RNA, 16 nt, Shigella flexneri 2a str. 2457T
ggucaacgucaacuuu

SEQ ID NO: 1902863 - RNA, 22 nt, Shigella flexneri 2a str. 2457T
ggucaauuccuucugggcgcgg

SEQ ID NO: 1902864 - RNA, 19 nt, Shigella flexneri 2a str. 2457T
ggggcacugaaagccgcag

SEQ ID NO: 1902865 - RNA, 16 nt, Shigella flexneri 2a str. 2457T
ggggccaauugcugug

SEQ ID NO: 1902866 - RNA, 14 nt, Shigella flexneri 2a str. 2457T
ggggauaagaauau

SEQ ID NO: 1902867 - RNA, 23 nt, Shigella flexneri 2a str. 2457T
ggggauuuucacugugcuuuaca

SEQ ID NO: 1902868 - RNA, 14 nt, Shigella flexneri 2a str. 2457T
ggggaugcugaaaa

SEQ ID NO: 1902869 - RNA, 15 nt, Shigella flexneri 2a str. 2457T
gggccugaacaagca

SEQ ID NO: 1902870 - RNA, 12 nt, Shigella flexneri 2a str. 2457T
gggccugaacaa

SEQ ID NO: 1902871 - RNA, 15 nt, Shigella flexneri 2a str. 2457T
gggccuccugcagcg

SEQ ID NO: 1902872 - RNA, 11 nt, Shigella flexneri 2a str. 2457T
gggccgucccc

SEQ ID NO: 1902873 - RNA, 19 nt, Shigella flexneri 2a str. 2457T
gggccgucaggugacacuu

SEQ ID NO: 1902874 - RNA, 15 nt, Shigella flexneri 2a str. 2457T
gggccguaauauuuc

SEQ ID NO: 1902875 - RNA, 20 nt, Shigella flexneri 2a str. 2457T
gggcuauauacccuucucag

SEQ ID NO: 1902876 - RNA, 14 nt, Shigella flexneri 2a str. 2457T
gggcuaaugccagu

SEQ ID NO: 1902877 - RNA, 13 nt, Shigella flexneri 2a str. 2457T
gggguuacgaccu

SEQ ID NO: 1902878 - RNA, 12 nt, Shigella flexneri 2a str. 2457T
ggggugucggug

SEQ ID NO: 1902879 - RNA, 12 nt, Shigella flexneri 2a str. 2457T
ggguaaaaggau

SEQ ID NO: 1902880 - RNA, 22 nt, Shigella flexneri 2a str. 2457T
gggguuuucucuuuccagcaac

SEQ ID NO: 1902881 - RNA, 13 nt, Shigella flexneri 2a str. 2457T
ggguaagcgccac

SEQ ID NO: 1902882 - RNA, 15 nt, Shigella flexneri 2a str. 2457T
ggguaauuucauuaa

SEQ ID NO: 1902883 - RNA, 17 nt, Shigella flexneri 2a str. 2457T
gggucgccagaagguga

SEQ ID NO: 1902884 - RNA, 14 nt, Shigella flexneri 2a str. 2457T
gggucaggccagga

SEQ ID NO: 1902885 - RNA, 23 nt, Shigella flexneri 2a str. 2457T
gggugcaaucaacaccacugcca

SEQ ID NO: 1902886 - RNA, 20 nt, Shigella flexneri 2a str. 2457T
gggugauuguucgcaccggu

SEQ ID NO: 1902887 - RNA, 12 nt, Shigella flexneri 2a str. 2457T
ggggcugaaaau

SEQ ID NO: 1902888 - RNA, 13 nt, Shigella flexneri 2a str. 2457T
ggggucagcaggu

SEQ ID NO: 1902889 - RNA, 20 nt, Shigella flexneri 2a str. 2457T
ggggucagggcuucaaaguu

SEQ ID NO: 1902890 - RNA, 20 nt, Shigella flexneri 2a str. 2457T
gggauguguaaguaaugaca

SEQ ID NO: 1902891 - RNA, 15 nt, Shigella flexneri 2a str. 2457T
gggauguuggcgaau

SEQ ID NO: 1902892 - RNA, 20 nt, Shigella flexneri 2a str. 2457T
gggauuaaaaaguaagaauu

SEQ ID NO: 1902893 - RNA, 19 nt, Shigella flexneri 2a str. 2457T
gggauuaaagcgcuccaga

SEQ ID NO: 1902894 - RNA, 22 nt, Shigella flexneri 2a str. 2457T
gggagcaggcuaguaaaaagca

SEQ ID NO: 1902895 - RNA, 17 nt, Shigella flexneri 2a str. 2457T
gggagaccucacugaaa

SEQ ID NO: 1902896 - RNA, 22 nt, Shigella flexneri 2a str. 2457T
gggcagacgccacaaucucacc

SEQ ID NO: 1902897 - RNA, 16 nt, Shigella flexneri 2a str. 2457T
gggcaacuggagcagg

SEQ ID NO: 1902898 - RNA, 21 nt, Shigella flexneri 2a str. 2457T
gggcaagcgccuaaauccacc

SEQ ID NO: 1902899 - RNA, 22 nt, Shigella flexneri 2a str. 2457T
gggcacguucggcggaugcagg

SEQ ID NO: 1902900 - RNA, 18 nt, Shigella flexneri 2a str. 2457T
gggccgaacaucagauaa

SEQ ID NO: 1902901 - RNA, 16 nt, Shigella flexneri 2a str. 2457T
gggccauucaggcagu

SEQ ID NO: 1902902 - RNA, 15 nt, Shigella flexneri 2a str. 2457T
ggcuugccagcaggg

SEQ ID NO: 1902903 - RNA, 12 nt, Shigella flexneri 2a str. 2457T
ggcuucucgccu

SEQ ID NO: 1902904 - RNA, 14 nt, Shigella flexneri 2a str. 2457T
ggcuucugccuuau

SEQ ID NO: 1902905 - RNA, 23 nt, Shigella flexneri 2a str. 2457T
ggcuucaucccgguuauuaaaac

SEQ ID NO: 1902906 - RNA, 22 nt, Shigella flexneri 2a str. 2457T
ggcuucauccagcagugacuca

SEQ ID NO: 1902907 - RNA, 22 nt, Shigella flexneri 2a str. 2457T
ggcuucaucuuuccaaaccuca

SEQ ID NO: 1902908 - RNA, 21 nt, Shigella flexneri 2a str. 2457T
ggccgcaggcuguuaccccug

SEQ ID NO: 1902909 - RNA, 17 nt, Shigella flexneri 2a str. 2457T
gggaauaaaagccagga

SEQ ID NO: 1902910 - RNA, 22 nt, Shigella flexneri 2a str. 2457T
gggaauagcguuaauggcagau

SEQ ID NO: 1902911 - RNA, 13 nt, Shigella flexneri 2a str. 2457T
gggaaggucaggu

SEQ ID NO: 1902912 - RNA, 17 nt, Shigella flexneri 2a str. 2457T
gggaaggucagguuuga

SEQ ID NO: 1902913 - RNA, 15 nt, Shigella flexneri 2a str. 2457T
gggaagggagcgccg

SEQ ID NO: 1902914 - RNA, 14 nt, Shigella flexneri 2a str. 2457T
gggaagaauggaaa

SEQ ID NO: 1902915 - RNA, 18 nt, Shigella flexneri 2a str. 2457T
gggaagcgcaccaauuca

SEQ ID NO: 1902916 - RNA, 12 nt, Shigella flexneri 2a str. 2457T
ggcuuuuuaauu

SEQ ID NO: 1902917 - RNA, 15 nt, Shigella flexneri 2a str. 2457T
gggacgcagacugga

SEQ ID NO: 1902918 - RNA, 22 nt, Shigella flexneri 2a str. 2457T
gggacgguccgugcgcuuuuua

SEQ ID NO: 1902919 - RNA, 17 nt, Shigella flexneri 2a str. 2457T
gggaauugugcuuucag

SEQ ID NO: 1902920 - RNA, 18 nt, Shigella flexneri 2a str. 2457T
gggaauucgaagcuguag

SEQ ID NO: 1902921 - RNA, 13 nt, Shigella flexneri 2a str. 2457T
gggacaugauuca

SEQ ID NO: 1902922 - RNA, 19 nt, Shigella flexneri 2a str. 2457T
gucuaacgaugccagcacc

SEQ ID NO: 1902923 - RNA, 19 nt, Shigella flexneri 2a str. 2457T
gucuacgccuuguuucuuc

SEQ ID NO: 1902924 - RNA, 14 nt, Shigella flexneri 2a str. 2457T
gucguuuagacguu

SEQ ID NO: 1902925 - RNA, 23 nt, Shigella flexneri 2a str. 2457T
gucuaacaugagguccagcgagc

SEQ ID NO: 1902926 - RNA, 15 nt, Shigella flexneri 2a str. 2457T
gucuaaauuuugcau

SEQ ID NO: 1902927 - RNA, 15 nt, Shigella flexneri 2a str. 2457T
gucguucaggcgcug

SEQ ID NO: 1902928 - RNA, 22 nt, Shigella flexneri 2a str. 2457T
gucguugcaaucagcggugccg

SEQ ID NO: 1902929 - RNA, 18 nt, Shigella flexneri 2a str. 2457T
gucuccaccuuaucgaca

SEQ ID NO: 1902930 - RNA, 16 nt, Shigella flexneri 2a str. 2457T
gucucccacaugcugg

SEQ ID NO: 1902931 - RNA, 16 nt, Shigella flexneri 2a str. 2457T
gucucaggugucuggc

SEQ ID NO: 1902932 - RNA, 15 nt, Shigella flexneri 2a str. 2457T
gucucagauucagau

SEQ ID NO: 1902933 - RNA, 12 nt, Shigella flexneri 2a str. 2457T
gucucaaaccgg

SEQ ID NO: 1902934 - RNA, 19 nt, Shigella flexneri 2a str. 2457T
gucucaauuaguaaugaua

SEQ ID NO: 1902935 - RNA, 17 nt, Shigella flexneri 2a str. 2457T
gucgguguccacuuccg

SEQ ID NO: 1902936 - RNA, 18 nt, Shigella flexneri 2a str. 2457T
gucggugcucaucagccc

SEQ ID NO: 1902937 - RNA, 15 nt, Shigella flexneri 2a str. 2457T
gucgguaauuucaca

SEQ ID NO: 1902938 - RNA, 14 nt, Shigella flexneri 2a str. 2457T
gucguaucaccacg

SEQ ID NO: 1902939 - RNA, 18 nt, Shigella flexneri 2a str. 2457T
gucguauuucagccccag

SEQ ID NO: 1902940 - RNA, 16 nt, Shigella flexneri 2a str. 2457T
gucguaugcuggaagc

SEQ ID NO: 1902941 - RNA, 21 nt, Shigella flexneri 2a str. 2457T
gucguauucucaauaaaagga

SEQ ID NO: 1902942 - RNA, 15 nt, Shigella flexneri 2a str. 2457T
gucguaaacaacugg

SEQ ID NO: 1902943 - RNA, 19 nt, Shigella flexneri 2a str. 2457T
gucguaaacaacuggcgcu

SEQ ID NO: 1902944 - RNA, 14 nt, Shigella flexneri 2a str. 2457T
gucguaagccaccg

SEQ ID NO: 1902945 - RNA, 22 nt, Shigella flexneri 2a str. 2457T
gucguccgguacgacaaucuca

SEQ ID NO: 1902946 - RNA, 12 nt, Shigella flexneri 2a str. 2457T
gucguggcaaaa

SEQ ID NO: 1902947 - RNA, 21 nt, Shigella flexneri 2a str. 2457T
gucguggcaaucguagcccag

SEQ ID NO: 1902948 - RNA, 13 nt, Shigella flexneri 2a str. 2457T
gucguuauauaaa

SEQ ID NO: 1902949 - RNA, 21 nt, Shigella flexneri 2a str. 2457T
gucgucugucgggaacacuuu

SEQ ID NO: 1902950 - RNA, 21 nt, Shigella flexneri 2a str. 2457T
gucgugaaugccguaggccca

SEQ ID NO: 1902951 - RNA, 16 nt, Shigella flexneri 2a str. 2457T
gucggcgcugaaauuc

SEQ ID NO: 1902952 - RNA, 18 nt, Shigella flexneri 2a str. 2457T
gucggcgucagcgccauc

SEQ ID NO: 1902953 - RNA, 24 nt, Shigella flexneri 2a str. 2457T
gucgggcuuuuggagaucacgcca

SEQ ID NO: 1902954 - RNA, 18 nt, Shigella flexneri 2a str. 2457T
gucgcuaggaaggcaaga

SEQ ID NO: 1902955 - RNA, 22 nt, Shigella flexneri 2a str. 2457T
gucgcgguugcugucggcggcg

SEQ ID NO: 1902956 - RNA, 20 nt, Shigella flexneri 2a str. 2457T
gucggaaaauuauuuuaaau

SEQ ID NO: 1902957 - RNA, 16 nt, Shigella flexneri 2a str. 2457T
gucggaaccacaacuc

SEQ ID NO: 1902958 - RNA, 13 nt, Shigella flexneri 2a str. 2457T
gucggcagauaac

SEQ ID NO: 1902959 - RNA, 19 nt, Shigella flexneri 2a str. 2457T
gucggcaguaccugaccag

SEQ ID NO: 1902960 - RNA, 15 nt, Shigella flexneri 2a str. 2457T
gucggcaaagcgggc

SEQ ID NO: 1902961 - RNA, 18 nt, Shigella flexneri 2a str. 2457T
gucgcgcaauugccagac

SEQ ID NO: 1902962 - RNA, 13 nt, Shigella flexneri 2a str. 2457T
gucgcgcagcacu

SEQ ID NO: 1902963 - RNA, 14 nt, Shigella flexneri 2a str. 2457T
gucgaugugccgga

SEQ ID NO: 1902964 - RNA, 15 nt, Shigella flexneri 2a str. 2457T
gucgcgcccuccugc

SEQ ID NO: 1902965 - RNA, 22 nt, Shigella flexneri 2a str. 2457T
gucgaugaugcagccagugauu

SEQ ID NO: 1902966 - RNA, 22 nt, Shigella flexneri 2a str. 2457T
gucgaugcgcaauuaaauaaag

SEQ ID NO: 1902967 - RNA, 14 nt, Shigella flexneri 2a str. 2457T
gucgaugcgcuggc

SEQ ID NO: 1902968 - RNA, 18 nt, Shigella flexneri 2a str. 2457T
gucgaugcgcuggcggcu

SEQ ID NO: 1902969 - RNA, 14 nt, Shigella flexneri 2a str. 2457T
guccgcuucaccac

SEQ ID NO: 1902970 - RNA, 12 nt, Shigella flexneri 2a str. 2457T
guccuccagcuc

SEQ ID NO: 1902971 - RNA, 22 nt, Shigella flexneri 2a str. 2457T
guccgguuucgugaaacucagc

SEQ ID NO: 1902972 - RNA, 23 nt, Shigella flexneri 2a str. 2457T
guccgcuauuucuugugcauggc

SEQ ID NO: 1902973 - RNA, 22 nt, Shigella flexneri 2a str. 2457T
guccgcgucuuaucaggccuac

SEQ ID NO: 1902974 - RNA, 14 nt, Shigella flexneri 2a str. 2457T
gucccguccuucau

SEQ ID NO: 1902975 - RNA, 11 nt, Shigella flexneri 2a str. 2457T
gucccucccug

SEQ ID NO: 1902976 - RNA, 14 nt, Shigella flexneri 2a str. 2457T
guccauuaccgaua

SEQ ID NO: 1902977 - RNA, 22 nt, Shigella flexneri 2a str. 2457T
gucccggcaagauuccagugcc

SEQ ID NO: 1902978 - RNA, 16 nt, Shigella flexneri 2a str. 2457T
gucgaacgcuaugacg

SEQ ID NO: 1902979 - RNA, 11 nt, Shigella flexneri 2a str. 2457T
gucgaaauaau

SEQ ID NO: 1902980 - RNA, 15 nt, Shigella flexneri 2a str. 2457T
gucgaacauacacaa

SEQ ID NO: 1902981 - RNA, 21 nt, Shigella flexneri 2a str. 2457T
gucgagauacacggugcucca

SEQ ID NO: 1902982 - RNA, 15 nt, Shigella flexneri 2a str. 2457T
gucgagaucgcggca

SEQ ID NO: 1902983 - RNA, 16 nt, Shigella flexneri 2a str. 2457T
gucgagcagagaaacg

SEQ ID NO: 1902984 - RNA, 12 nt, Shigella flexneri 2a str. 2457T
gucgacagcagc

SEQ ID NO: 1902985 - RNA, 13 nt, Shigella flexneri 2a str. 2457T
gucgacagcagcc

SEQ ID NO: 1902986 - RNA, 12 nt, Shigella flexneri 2a str. 2457T
guccagcgccug

SEQ ID NO: 1902987 - RNA, 23 nt, Shigella flexneri 2a str. 2457T
guccagcuuuucgauaacccggc

SEQ ID NO: 1902988 - RNA, 16 nt, Shigella flexneri 2a str. 2457T
guccaguuugccuuca

SEQ ID NO: 1902989 - RNA, 22 nt, Shigella flexneri 2a str. 2457T
guccaggcugcaaagucugggc

SEQ ID NO: 1902990 - RNA, 23 nt, Shigella flexneri 2a str. 2457T
guccacuugaaaauuauaucuua

SEQ ID NO: 1902991 - RNA, 19 nt, Shigella flexneri 2a str. 2457T
guccagacgcgcagcuuca

SEQ ID NO: 1902992 - RNA, 12 nt, Shigella flexneri 2a str. 2457T
guccagcaggcg

SEQ ID NO: 1902993 - RNA, 16 nt, Shigella flexneri 2a str. 2457T
guccaccgcgaugcug

SEQ ID NO: 1902994 - RNA, 13 nt, Shigella flexneri 2a str. 2457T
gucaucaaaauca

SEQ ID NO: 1902995 - RNA, 21 nt, Shigella flexneri 2a str. 2457T
gucaucaccggcuucucgccu

SEQ ID NO: 1902996 - RNA, 18 nt, Shigella flexneri 2a str. 2457T
gucaucauagacuucccu

SEQ ID NO: 1902997 - RNA, 21 nt, Shigella flexneri 2a str. 2457T
gucaucagcauaaucaccagu

SEQ ID NO: 1902998 - RNA, 22 nt, Shigella flexneri 2a str. 2457T
gucaucccccaguggcagcaau

SEQ ID NO: 1902999 - RNA, 16 nt, Shigella flexneri 2a str. 2457T
gucaucccagucuuca

SEQ ID NO: 1903000 - RNA, 14 nt, Shigella flexneri 2a str. 2457T
gucauccaggaacu

SEQ ID NO: 1903001 - RNA, 16 nt, Shigella flexneri 2a str. 2457T
gucauccaggaacucc

SEQ ID NO: 1903002 - RNA, 12 nt, Shigella flexneri 2a str. 2457T
gucauccauacc

SEQ ID NO: 1903003 - RNA, 22 nt, Shigella flexneri 2a str. 2457T
gucauccauaccacgaccucaa

SEQ ID NO: 1903004 - RNA, 14 nt, Shigella flexneri 2a str. 2457T
gucauccagcacuu

SEQ ID NO: 1903005 - RNA, 14 nt, Shigella flexneri 2a str. 2457T
gucauccagcagcg

SEQ ID NO: 1903006 - RNA, 20 nt, Shigella flexneri 2a str. 2457T
gucauccggcacgcuaccau

SEQ ID NO: 1903007 - RNA, 22 nt, Shigella flexneri 2a str. 2457T
gucauccuaaacgcuggcagga

SEQ ID NO: 1903008 - RNA, 17 nt, Shigella flexneri 2a str. 2457T
gucaucgaugagaugac

SEQ ID NO: 1903009 - RNA, 22 nt, Shigella flexneri 2a str. 2457T
gucauccguggcgacagaggug

SEQ ID NO: 1903010 - RNA, 16 nt, Shigella flexneri 2a str. 2457T
gucaucgacagcaaau

SEQ ID NO: 1903011 - RNA, 14 nt, Shigella flexneri 2a str. 2457T
gucaucgacaucaa

SEQ ID NO: 1903012 - RNA, 13 nt, Shigella flexneri 2a str. 2457T
guccacaggaaaa

SEQ ID NO: 1903013 - RNA, 23 nt, Shigella flexneri 2a str. 2457T
guccacaggaaaacuacacacug

SEQ ID NO: 1903014 - RNA, 14 nt, Shigella flexneri 2a str. 2457T
guccaaucagcaca

SEQ ID NO: 1903015 - RNA, 15 nt, Shigella flexneri 2a str. 2457T
gucaugguaaugauc

SEQ ID NO: 1903016 - RNA, 15 nt, Shigella flexneri 2a str. 2457T
gucauggcugacugu

SEQ ID NO: 1903017 - RNA, 21 nt, Shigella flexneri 2a str. 2457T
gucaucggaucauuagucaca

SEQ ID NO: 1903018 - RNA, 13 nt, Shigella flexneri 2a str. 2457T
guauuuuggcuua

SEQ ID NO: 1903019 - RNA, 23 nt, Shigella flexneri 2a str. 2457T
guauuuugucagcccuuuuggca

SEQ ID NO: 1903020 - RNA, 17 nt, Shigella flexneri 2a str. 2457T
guauuuccaguccagcu

SEQ ID NO: 1903021 - RNA, 16 nt, Shigella flexneri 2a str. 2457T
guauuugauauuuauu

SEQ ID NO: 1903022 - RNA, 22 nt, Shigella flexneri 2a str. 2457T
guauuuaaagugcaaaaauuca

SEQ ID NO: 1903023 - RNA, 17 nt, Shigella flexneri 2a str. 2457T
guauugccaugcacgca

SEQ ID NO: 1903024 - RNA, 22 nt, Shigella flexneri 2a str. 2457T
guauucacuuucaaauccggcc

SEQ ID NO: 1903025 - RNA, 17 nt, Shigella flexneri 2a str. 2457T
guauucaugcccugccc

SEQ ID NO: 1903026 - RNA, 14 nt, Shigella flexneri 2a str. 2457T
guauucauugccug

SEQ ID NO: 1903027 - RNA, 14 nt, Shigella flexneri 2a str. 2457T
guauuauauauaau

SEQ ID NO: 1903028 - RNA, 14 nt, Shigella flexneri 2a str. 2457T
guauucaaccguuu

SEQ ID NO: 1903029 - RNA, 23 nt, Shigella flexneri 2a str. 2457T
guauuaguggcaaccacaaccgc

SEQ ID NO: 1903030 - RNA, 17 nt, Shigella flexneri 2a str. 2457T
gucaccuucuggcgacc

SEQ ID NO: 1903031 - RNA, 16 nt, Shigella flexneri 2a str. 2457T
gucaccuucuggcgac

SEQ ID NO: 1903032 - RNA, 17 nt, Shigella flexneri 2a str. 2457T
gucacaucaccaacacc

SEQ ID NO: 1903033 - RNA, 19 nt, Shigella flexneri 2a str. 2457T
gucacagugaauggggcua

SEQ ID NO: 1903034 - RNA, 12 nt, Shigella flexneri 2a str. 2457T
gucacaucuucc

SEQ ID NO: 1903035 - RNA, 16 nt, Shigella flexneri 2a str. 2457T
gucacauguuccaggg

SEQ ID NO: 1903036 - RNA, 17 nt, Shigella flexneri 2a str. 2457T
gucaccagcaucaacaa

SEQ ID NO: 1903037 - RNA, 16 nt, Shigella flexneri 2a str. 2457T
gucaccacauccagcu

SEQ ID NO: 1903038 - RNA, 21 nt, Shigella flexneri 2a str. 2457T
gucaauauucuggguagucca

SEQ ID NO: 1903039 - RNA, 16 nt, Shigella flexneri 2a str. 2457T
gucacaggccaucaca

SEQ ID NO: 1903040 - RNA, 16 nt, Shigella flexneri 2a str. 2457T
gucacagccgcaggcc

SEQ ID NO: 1903041 - RNA, 16 nt, Shigella flexneri 2a str. 2457T
gucacaccuuauuuac

SEQ ID NO: 1903042 - RNA, 14 nt, Shigella flexneri 2a str. 2457T
gucacagaagagag

SEQ ID NO: 1903043 - RNA, 21 nt, Shigella flexneri 2a str. 2457T
gucaaaguaaccuuugaacaa

SEQ ID NO: 1903044 - RNA, 23 nt, Shigella flexneri 2a str. 2457T
gucaaaugaccgggcuuuccgcu

SEQ ID NO: 1903045 - RNA, 16 nt, Shigella flexneri 2a str. 2457T
guaucuggcaagcagg

SEQ ID NO: 1903046 - RNA, 19 nt, Shigella flexneri 2a str. 2457T
guaucuucccagccaaugc

SEQ ID NO: 1903047 - RNA, 12 nt, Shigella flexneri 2a str. 2457T
guaucugcagau

SEQ ID NO: 1903048 - RNA, 15 nt, Shigella flexneri 2a str. 2457T
guaucucguccaguu

SEQ ID NO: 1903049 - RNA, 12 nt, Shigella flexneri 2a str. 2457T
guaucuauucau

SEQ ID NO: 1903050 - RNA, 17 nt, Shigella flexneri 2a str. 2457T
guaucgaguggcgcagu

SEQ ID NO: 1903051 - RNA, 15 nt, Shigella flexneri 2a str. 2457T
guaucgcugaaagau

SEQ ID NO: 1903052 - RNA, 16 nt, Shigella flexneri 2a str. 2457T
guaucgggcaguuuac

SEQ ID NO: 1903053 - RNA, 18 nt, Shigella flexneri 2a str. 2457T
guaucuaccacugccuga

SEQ ID NO: 1903054 - RNA, 20 nt, Shigella flexneri 2a str. 2457T
guaugcgccacaggucagca

SEQ ID NO: 1903055 - RNA, 18 nt, Shigella flexneri 2a str. 2457T
guauggaucccucuuucu

SEQ ID NO: 1903056 - RNA, 15 nt, Shigella flexneri 2a str. 2457T
guauggaaaucaccc

SEQ ID NO: 1903057 - RNA, 14 nt, Shigella flexneri 2a str. 2457T
guaugccucuuuca

SEQ ID NO: 1903058 - RNA, 18 nt, Shigella flexneri 2a str. 2457T
guaugccuggcauuucug

SEQ ID NO: 1903059 - RNA, 17 nt, Shigella flexneri 2a str. 2457T
guaugguuacugucguu

SEQ ID NO: 1903060 - RNA, 12 nt, Shigella flexneri 2a str. 2457T
guauuacagagg

SEQ ID NO: 1903061 - RNA, 23 nt, Shigella flexneri 2a str. 2457T
guauuaaucugccagcguaaauc

SEQ ID NO: 1903062 - RNA, 18 nt, Shigella flexneri 2a str. 2457T
guauccguuuuacuggga

SEQ ID NO: 1903063 - RNA, 21 nt, Shigella flexneri 2a str. 2457T
guauccuguuuuuaagugaug

SEQ ID NO: 1903064 - RNA, 13 nt, Shigella flexneri 2a str. 2457T
guauccaugcgca

SEQ ID NO: 1903065 - RNA, 22 nt, Shigella flexneri 2a str. 2457T
guaucaugcaguaccagauaau

SEQ ID NO: 1903066 - RNA, 23 nt, Shigella flexneri 2a str. 2457T
guauacgucccggugaagcgccc

SEQ ID NO: 1903067 - RNA, 20 nt, Shigella flexneri 2a str. 2457T
guaggagccaccuuaugagu

SEQ ID NO: 1903068 - RNA, 22 nt, Shigella flexneri 2a str. 2457T
guaucaacaauaaaaccaguaa

SEQ ID NO: 1903069 - RNA, 13 nt, Shigella flexneri 2a str. 2457T
guaucaaacacag

SEQ ID NO: 1903070 - RNA, 20 nt, Shigella flexneri 2a str. 2457T
guagccaugaugaacaaccc

SEQ ID NO: 1903071 - RNA, 17 nt, Shigella flexneri 2a str. 2457T
guagccauuugauucac

SEQ ID NO: 1903072 - RNA, 23 nt, Shigella flexneri 2a str. 2457T
guagccaauaaaugccaccacac

SEQ ID NO: 1903073 - RNA, 13 nt, Shigella flexneri 2a str. 2457T
guagcaugaacca

SEQ ID NO: 1903074 - RNA, 19 nt, Shigella flexneri 2a str. 2457T
guagcagcuuucagcagcg

SEQ ID NO: 1903075 - RNA, 19 nt, Shigella flexneri 2a str. 2457T
guagcagguaaucugccau

SEQ ID NO: 1903076 - RNA, 22 nt, Shigella flexneri 2a str. 2457T
guagcagguaaucugccauauu

SEQ ID NO: 1903077 - RNA, 18 nt, Shigella flexneri 2a str. 2457T
guagauggggccaugauu

SEQ ID NO: 1903078 - RNA, 19 nt, Shigella flexneri 2a str. 2457T
guagauugcacuugcuuaa

SEQ ID NO: 1903079 - RNA, 18 nt, Shigella flexneri 2a str. 2457T
guagaauuucugacugag

SEQ ID NO: 1903080 - RNA, 17 nt, Shigella flexneri 2a str. 2457T
guagaagccagucagcu

SEQ ID NO: 1903081 - RNA, 15 nt, Shigella flexneri 2a str. 2457T
guagaacccuaccag

SEQ ID NO: 1903082 - RNA, 15 nt, Shigella flexneri 2a str. 2457T
guagaaaaucucaau

SEQ ID NO: 1903083 - RNA, 18 nt, Shigella flexneri 2a str. 2457T
guaccagauacaaaaaag

SEQ ID NO: 1903084 - RNA, 17 nt, Shigella flexneri 2a str. 2457T
guaccagacgcgggcaa

SEQ ID NO: 1903085 - RNA, 12 nt, Shigella flexneri 2a str. 2457T
guaccugaauua

SEQ ID NO: 1903086 - RNA, 21 nt, Shigella flexneri 2a str. 2457T
guaccacgcacagcccgccgc

SEQ ID NO: 1903087 - RNA, 11 nt, Shigella flexneri 2a str. 2457T
guaccaccgga

SEQ ID NO: 1903088 - RNA, 19 nt, Shigella flexneri 2a str. 2457T
guaccaccagaaucgccag

SEQ ID NO: 1903089 - RNA, 19 nt, Shigella flexneri 2a str. 2457T
guaccugugaagugaaaaa

SEQ ID NO: 1903090 - RNA, 13 nt, Shigella flexneri 2a str. 2457T
guacgaaauaacu

SEQ ID NO: 1903091 - RNA, 13 nt, Shigella flexneri 2a str. 2457T
guacgacaagucu

SEQ ID NO: 1903092 - RNA, 15 nt, Shigella flexneri 2a str. 2457T
guacgcaggcggcug

SEQ ID NO: 1903093 - RNA, 16 nt, Shigella flexneri 2a str. 2457T
guacgauacagaagca

SEQ ID NO: 1903094 - RNA, 23 nt, Shigella flexneri 2a str. 2457T
guacuuuuuccuuaaacaccugg

SEQ ID NO: 1903095 - RNA, 12 nt, Shigella flexneri 2a str. 2457T
guacuuucaaca

SEQ ID NO: 1903096 - RNA, 22 nt, Shigella flexneri 2a str. 2457T
guacucggcuacgaaccgagcg

SEQ ID NO: 1903097 - RNA, 15 nt, Shigella flexneri 2a str. 2457T
guacacuuuccuggu

SEQ ID NO: 1903098 - RNA, 23 nt, Shigella flexneri 2a str. 2457T
guacagagguaagauguucuauc

SEQ ID NO: 1903099 - RNA, 20 nt, Shigella flexneri 2a str. 2457T
guacauagccaucugccuga

SEQ ID NO: 1903100 - RNA, 12 nt, Shigella flexneri 2a str. 2457T
guacaggcagcu

SEQ ID NO: 1903101 - RNA, 16 nt, Shigella flexneri 2a str. 2457T
guacaggcagcuuaga

SEQ ID NO: 1903102 - RNA, 18 nt, Shigella flexneri 2a str. 2457T
guacaggauauauuucau

SEQ ID NO: 1903103 - RNA, 14 nt, Shigella flexneri 2a str. 2457T
guaauuucacaagu

SEQ ID NO: 1903104 - RNA, 11 nt, Shigella flexneri 2a str. 2457T
guaauuucaau

SEQ ID NO: 1903105 - RNA, 23 nt, Shigella flexneri 2a str. 2457T
guaauuugccguuaaucccagac

SEQ ID NO: 1903106 - RNA, 21 nt, Shigella flexneri 2a str. 2457T
guacaaaauuagaaagggaag

SEQ ID NO: 1903107 - RNA, 12 nt, Shigella flexneri 2a str. 2457T
guaauuuuuaua

SEQ ID NO: 1903108 - RNA, 20 nt, Shigella flexneri 2a str. 2457T
guacaaagccaacagcagcc

SEQ ID NO: 1903109 - RNA, 13 nt, Shigella flexneri 2a str. 2457T
guacaacuuucuc

SEQ ID NO: 1903110 - RNA, 18 nt, Shigella flexneri 2a str. 2457T
guacaaccgcaaagguug

SEQ ID NO: 1903111 - RNA, 11 nt, Shigella flexneri 2a str. 2457T
guacaccaaca

SEQ ID NO: 1903112 - RNA, 14 nt, Shigella flexneri 2a str. 2457T
guacaccaacauca

SEQ ID NO: 1903113 - RNA, 18 nt, Shigella flexneri 2a str. 2457T
guacaagaguaacccacg

SEQ ID NO: 1903114 - RNA, 21 nt, Shigella flexneri 2a str. 2457T
guaaugaacuccggagaguau

SEQ ID NO: 1903115 - RNA, 22 nt, Shigella flexneri 2a str. 2457T
guaaugcgguauccaacccgcg

SEQ ID NO: 1903116 - RNA, 23 nt, Shigella flexneri 2a str. 2457T
guaaugcggucguaaucgcccgc

SEQ ID NO: 1903117 - RNA, 21 nt, Shigella flexneri 2a str. 2457T
guaaugccugggcgauuuccu

SEQ ID NO: 1903118 - RNA, 15 nt, Shigella flexneri 2a str. 2457T
guaauuaacauucau

SEQ ID NO: 1903119 - RNA, 22 nt, Shigella flexneri 2a str. 2457T
guaauuaagcgcaaaggccagc

SEQ ID NO: 1903120 - RNA, 14 nt, Shigella flexneri 2a str. 2457T
guaaugauguaaaa

SEQ ID NO: 1903121 - RNA, 17 nt, Shigella flexneri 2a str. 2457T
guaauuaguggcuaacc

SEQ ID NO: 1903122 - RNA, 15 nt, Shigella flexneri 2a str. 2457T
guaauugagaaccac

SEQ ID NO: 1903123 - RNA, 22 nt, Shigella flexneri 2a str. 2457T
guaauugcuuuuaccauacugg

SEQ ID NO: 1903124 - RNA, 13 nt, Shigella flexneri 2a str. 2457T
guaaaaggagaua

SEQ ID NO: 1903125 - RNA, 22 nt, Shigella flexneri 2a str. 2457T
guaaaacggauaugauuuaaaa

SEQ ID NO: 1903126 - RNA, 17 nt, Shigella flexneri 2a str. 2457T
guaauaccagccuucuu

SEQ ID NO: 1903127 - RNA, 15 nt, Shigella flexneri 2a str. 2457T
guaaaaggauguuua

SEQ ID NO: 1903128 - RNA, 17 nt, Shigella flexneri 2a str. 2457T
guaauaauuacuuacau

SEQ ID NO: 1903129 - RNA, 21 nt, Shigella flexneri 2a str. 2457T
guaauccucuuugcuuccuga

SEQ ID NO: 1903130 - RNA, 16 nt, Shigella flexneri 2a str. 2457T
guaaucauauugcucu

SEQ ID NO: 1903131 - RNA, 16 nt, Shigella flexneri 2a str. 2457T
guaauacggcucucac

SEQ ID NO: 1903132 - RNA, 18 nt, Shigella flexneri 2a str. 2457T
guaaucaccacccauuuu

SEQ ID NO: 1903133 - RNA, 13 nt, Shigella flexneri 2a str. 2457T
guaaucaccaccc

SEQ ID NO: 1903134 - RNA, 14 nt, Shigella flexneri 2a str. 2457T
guggcguggcgcuc

SEQ ID NO: 1903135 - RNA, 13 nt, Shigella flexneri 2a str. 2457T
gugggcaggagaa

SEQ ID NO: 1903136 - RNA, 18 nt, Shigella flexneri 2a str. 2457T
gugggauuccagcgccgc

SEQ ID NO: 1903137 - RNA, 18 nt, Shigella flexneri 2a str. 2457T
gugcgcaauacguugcaa

SEQ ID NO: 1903138 - RNA, 19 nt, Shigella flexneri 2a str. 2457T
gugcgcaaacuucuucagu

SEQ ID NO: 1903139 - RNA, 16 nt, Shigella flexneri 2a str. 2457T
guggaaaaggcggcgc

SEQ ID NO: 1903140 - RNA, 15 nt, Shigella flexneri 2a str. 2457T
guggaaacagugauu

SEQ ID NO: 1903141 - RNA, 19 nt, Shigella flexneri 2a str. 2457T
guggaacaaauagacacaa

SEQ ID NO: 1903142 - RNA, 17 nt, Shigella flexneri 2a str. 2457T
guggcagggaaucagau

SEQ ID NO: 1903143 - RNA, 12 nt, Shigella flexneri 2a str. 2457T
guggauaaagca

SEQ ID NO: 1903144 - RNA, 22 nt, Shigella flexneri 2a str. 2457T
guggaucccagaagaauaucaa

SEQ ID NO: 1903145 - RNA, 24 nt, Shigella flexneri 2a str. 2457T
guggacauagcucugccacugguu

SEQ ID NO: 1903146 - RNA, 19 nt, Shigella flexneri 2a str. 2457T
guggagcaacacgccagcg

SEQ ID NO: 1903147 - RNA, 19 nt, Shigella flexneri 2a str. 2457T
guuaauccgcaaauaacgu

SEQ ID NO: 1903148 - RNA, 12 nt, Shigella flexneri 2a str. 2457T
guuaagaagauc

SEQ ID NO: 1903149 - RNA, 17 nt, Shigella flexneri 2a str. 2457T
guuaagcccaguucagc

SEQ ID NO: 1903150 - RNA, 15 nt, Shigella flexneri 2a str. 2457T
guuaagcaaaaaaac

SEQ ID NO: 1903151 - RNA, 16 nt, Shigella flexneri 2a str. 2457T
guuaagcaaaaaaaca

SEQ ID NO: 1903152 - RNA, 19 nt, Shigella flexneri 2a str. 2457T
guuaauccacagcaaugca

SEQ ID NO: 1903153 - RNA, 15 nt, Shigella flexneri 2a str. 2457T
guuaacucccccuuu

SEQ ID NO: 1903154 - RNA, 16 nt, Shigella flexneri 2a str. 2457T
guuaacgcgucuuuga

SEQ ID NO: 1903155 - RNA, 15 nt, Shigella flexneri 2a str. 2457T
guuaagaaaacggaa

SEQ ID NO: 1903156 - RNA, 18 nt, Shigella flexneri 2a str. 2457T
guuaaccccaguaauuca

SEQ ID NO: 1903157 - RNA, 23 nt, Shigella flexneri 2a str. 2457T
guuaacaccaccgccgacuguca

SEQ ID NO: 1903158 - RNA, 12 nt, Shigella flexneri 2a str. 2457T
guuaacaacaac

SEQ ID NO: 1903159 - RNA, 17 nt, Shigella flexneri 2a str. 2457T
guuaaaacuuuuagcau

SEQ ID NO: 1903160 - RNA, 19 nt, Shigella flexneri 2a str. 2457T
guguuuuuuuaugguagug

SEQ ID NO: 1903161 - RNA, 16 nt, Shigella flexneri 2a str. 2457T
gugugggcacucgaag

SEQ ID NO: 1903162 - RNA, 18 nt, Shigella flexneri 2a str. 2457T
guguucaauaucgaaaug

SEQ ID NO: 1903163 - RNA, 14 nt, Shigella flexneri 2a str. 2457T
guguuccagagaac

SEQ ID NO: 1903164 - RNA, 14 nt, Shigella flexneri 2a str. 2457T
guguuccucugcuc

SEQ ID NO: 1903165 - RNA, 13 nt, Shigella flexneri 2a str. 2457T
guguuccucugcc

SEQ ID NO: 1903166 - RNA, 13 nt, Shigella flexneri 2a str. 2457T
gugucccacuggu

SEQ ID NO: 1903167 - RNA, 12 nt, Shigella flexneri 2a str. 2457T
gugugcuccagu

SEQ ID NO: 1903168 - RNA, 17 nt, Shigella flexneri 2a str. 2457T
gugugcuacggucugcc

SEQ ID NO: 1903169 - RNA, 17 nt, Shigella flexneri 2a str. 2457T
guguggcaucguccguc

SEQ ID NO: 1903170 - RNA, 16 nt, Shigella flexneri 2a str. 2457T
guguggagugcagcau

SEQ ID NO: 1903171 - RNA, 17 nt, Shigella flexneri 2a str. 2457T
guuccuugcgcuuucuu

SEQ ID NO: 1903172 - RNA, 15 nt, Shigella flexneri 2a str. 2457T
guucgagaaaaccga

SEQ ID NO: 1903173 - RNA, 17 nt, Shigella flexneri 2a str. 2457T
guuccggcguacgggca

SEQ ID NO: 1903174 - RNA, 13 nt, Shigella flexneri 2a str. 2457T
guucgagcaucac

SEQ ID NO: 1903175 - RNA, 20 nt, Shigella flexneri 2a str. 2457T
guucgguauuaaucugccag

SEQ ID NO: 1903176 - RNA, 16 nt, Shigella flexneri 2a str. 2457T
guucgucauacuccag

SEQ ID NO: 1903177 - RNA, 23 nt, Shigella flexneri 2a str. 2457T
guucucaucgccaucaauaacca

SEQ ID NO: 1903178 - RNA, 21 nt, Shigella flexneri 2a str. 2457T
guucugccuggcgcagcaaag

SEQ ID NO: 1903179 - RNA, 15 nt, Shigella flexneri 2a str. 2457T
guucugccucugaaa

SEQ ID NO: 1903180 - RNA, 16 nt, Shigella flexneri 2a str. 2457T
guucugccuggcgcag

SEQ ID NO: 1903181 - RNA, 18 nt, Shigella flexneri 2a str. 2457T
guucugcggcguaacgca

SEQ ID NO: 1903182 - RNA, 22 nt, Shigella flexneri 2a str. 2457T
guucugcggguuagucugcauu

SEQ ID NO: 1903183 - RNA, 16 nt, Shigella flexneri 2a str. 2457T
guucugcacuuuucug

SEQ ID NO: 1903184 - RNA, 16 nt, Shigella flexneri 2a str. 2457T
guucugccguccagcc

SEQ ID NO: 1903185 - RNA, 16 nt, Shigella flexneri 2a str. 2457T
guucugauaguuaaaa

SEQ ID NO: 1903186 - RNA, 14 nt, Shigella flexneri 2a str. 2457T
guucugaucuuucu

SEQ ID NO: 1903187 - RNA, 16 nt, Shigella flexneri 2a str. 2457T
guucugaucuuucuuc

SEQ ID NO: 1903188 - RNA, 15 nt, Shigella flexneri 2a str. 2457T
guucugaccggccag

SEQ ID NO: 1903189 - RNA, 22 nt, Shigella flexneri 2a str. 2457T
guucacggcgauaccaguaaua

SEQ ID NO: 1903190 - RNA, 22 nt, Shigella flexneri 2a str. 2457T
guucacgccaucaucggcaaac

SEQ ID NO: 1903191 - RNA, 14 nt, Shigella flexneri 2a str. 2457T
guucacgcagcuuc

SEQ ID NO: 1903192 - RNA, 15 nt, Shigella flexneri 2a str. 2457T
guuccacucuuucag

SEQ ID NO: 1903193 - RNA, 18 nt, Shigella flexneri 2a str. 2457T
guuccagaccauauuuuc

SEQ ID NO: 1903194 - RNA, 13 nt, Shigella flexneri 2a str. 2457T
guucaucugacca

SEQ ID NO: 1903195 - RNA, 14 nt, Shigella flexneri 2a str. 2457T
guuccaguggcuga

SEQ ID NO: 1903196 - RNA, 17 nt, Shigella flexneri 2a str. 2457T
guuccauaaucgccuga

SEQ ID NO: 1903197 - RNA, 22 nt, Shigella flexneri 2a str. 2457T
guuccauaaucgccugaccgau

SEQ ID NO: 1903198 - RNA, 17 nt, Shigella flexneri 2a str. 2457T
guuccagcaucuccugc

SEQ ID NO: 1903199 - RNA, 21 nt, Shigella flexneri 2a str. 2457T
guuccagccaguguuaaccag

SEQ ID NO: 1903200 - RNA, 14 nt, Shigella flexneri 2a str. 2457T
guuccagcaucucc

SEQ ID NO: 1903201 - RNA, 15 nt, Shigella flexneri 2a str. 2457T
guuccaucaccagau

SEQ ID NO: 1903202 - RNA, 14 nt, Shigella flexneri 2a str. 2457T
guuccauucaaacg

SEQ ID NO: 1903203 - RNA, 13 nt, Shigella flexneri 2a str. 2457T
guuccauucaaac

SEQ ID NO: 1903204 - RNA, 15 nt, Shigella flexneri 2a str. 2457T
guuccgcaaagcgcc

SEQ ID NO: 1903205 - RNA, 13 nt, Shigella flexneri 2a str. 2457T
guuccgauaaguu

SEQ ID NO: 1903206 - RNA, 18 nt, Shigella flexneri 2a str. 2457T
guuagcggcgguaaaauc

SEQ ID NO: 1903207 - RNA, 20 nt, Shigella flexneri 2a str. 2457T
guuaguccacacgccaggcc

SEQ ID NO: 1903208 - RNA, 17 nt, Shigella flexneri 2a str. 2457T
guuagugucuuaucugg

SEQ ID NO: 1903209 - RNA, 23 nt, Shigella flexneri 2a str. 2457T
guuagucgcuuucauucagaaca

SEQ ID NO: 1903210 - RNA, 17 nt, Shigella flexneri 2a str. 2457T
guuagucugcauuuucu

SEQ ID NO: 1903211 - RNA, 23 nt, Shigella flexneri 2a str. 2457T
guuagucaucaucaggaacaucc

SEQ ID NO: 1903212 - RNA, 15 nt, Shigella flexneri 2a str. 2457T
guuaccccuucaucc

SEQ ID NO: 1903213 - RNA, 21 nt, Shigella flexneri 2a str. 2457T
guuaccgacugcggccugagu

SEQ ID NO: 1903214 - RNA, 20 nt, Shigella flexneri 2a str. 2457T
guuaccccucuauccagcuc

SEQ ID NO: 1903215 - RNA, 14 nt, Shigella flexneri 2a str. 2457T
guuauaccagucca

SEQ ID NO: 1903216 - RNA, 15 nt, Shigella flexneri 2a str. 2457T
guuauacagaguguu

SEQ ID NO: 1903217 - RNA, 21 nt, Shigella flexneri 2a str. 2457T
guuauaaacgcucggcaacac

SEQ ID NO: 1903218 - RNA, 19 nt, Shigella flexneri 2a str. 2457T
guuauccugauaaaaacca

SEQ ID NO: 1903219 - RNA, 21 nt, Shigella flexneri 2a str. 2457T
guuauccugaucaagcacaug

SEQ ID NO: 1903220 - RNA, 13 nt, Shigella flexneri 2a str. 2457T
guuaucaaauuca

SEQ ID NO: 1903221 - RNA, 23 nt, Shigella flexneri 2a str. 2457T
guuaucagaaccgcccagaccug

SEQ ID NO: 1903222 - RNA, 19 nt, Shigella flexneri 2a str. 2457T
guuaucagcaacuggcaaa

SEQ ID NO: 1903223 - RNA, 20 nt, Shigella flexneri 2a str. 2457T
guuaucagcaacuggcaaaa

SEQ ID NO: 1903224 - RNA, 22 nt, Shigella flexneri 2a str. 2457T
guuauuacugcguauuuccugc

SEQ ID NO: 1903225 - RNA, 16 nt, Shigella flexneri 2a str. 2457T
guuauuauucauaaau

SEQ ID NO: 1903226 - RNA, 15 nt, Shigella flexneri 2a str. 2457T
guuauucgcuuccuc

SEQ ID NO: 1903227 - RNA, 16 nt, Shigella flexneri 2a str. 2457T
guuaucgucugcgcca

SEQ ID NO: 1903228 - RNA, 18 nt, Shigella flexneri 2a str. 2457T
guuaucguaccaggcgac

SEQ ID NO: 1903229 - RNA, 13 nt, Shigella flexneri 2a str. 2457T
guuaugccucaac

SEQ ID NO: 1903230 - RNA, 23 nt, Shigella flexneri 2a str. 2457T
guucaacaauauuaaucccugcu

SEQ ID NO: 1903231 - RNA, 17 nt, Shigella flexneri 2a str. 2457T
guucaaaguaauauuca

SEQ ID NO: 1903232 - RNA, 11 nt, Shigella flexneri 2a str. 2457T
guuauuuccag

SEQ ID NO: 1903233 - RNA, 18 nt, Shigella flexneri 2a str. 2457T
guuauuuguucagcaaau

SEQ ID NO: 1903234 - RNA, 22 nt, Shigella flexneri 2a str. 2457T
guucaauacgcaguuuugucuu

SEQ ID NO: 1903235 - RNA, 17 nt, Shigella flexneri 2a str. 2457T
guucaauacccacugcg

SEQ ID NO: 1903236 - RNA, 19 nt, Shigella flexneri 2a str. 2457T
guucaauacccacugcgca

SEQ ID NO: 1903237 - RNA, 13 nt, Shigella flexneri 2a str. 2457T
guucaauuuccag

SEQ ID NO: 1903238 - RNA, 20 nt, Shigella flexneri 2a str. 2457T
guucaauuuccaguuucaca

SEQ ID NO: 1903239 - RNA, 23 nt, Shigella flexneri 2a str. 2457T
gugcagccggagcuucacccgca

SEQ ID NO: 1903240 - RNA, 19 nt, Shigella flexneri 2a str. 2457T
gugcacgaaccagagacag

SEQ ID NO: 1903241 - RNA, 15 nt, Shigella flexneri 2a str. 2457T
gugcacgugccagau

SEQ ID NO: 1903242 - RNA, 22 nt, Shigella flexneri 2a str. 2457T
gugauuuccgccgccagcagac

SEQ ID NO: 1903243 - RNA, 13 nt, Shigella flexneri 2a str. 2457T
gugcaaaaucaaa

SEQ ID NO: 1903244 - RNA, 17 nt, Shigella flexneri 2a str. 2457T
gugcaaaaccugguugg

SEQ ID NO: 1903245 - RNA, 12 nt, Shigella flexneri 2a str. 2457T
gugcaaaaaaac

SEQ ID NO: 1903246 - RNA, 11 nt, Shigella flexneri 2a str. 2457T
gugcaaaugcc

SEQ ID NO: 1903247 - RNA, 15 nt, Shigella flexneri 2a str. 2457T
gugcaucaacauaua

SEQ ID NO: 1903248 - RNA, 19 nt, Shigella flexneri 2a str. 2457T
gugcaucuccugacacaac

SEQ ID NO: 1903249 - RNA, 22 nt, Shigella flexneri 2a str. 2457T
gugcaucggugcgcugugugug

SEQ ID NO: 1903250 - RNA, 15 nt, Shigella flexneri 2a str. 2457T
gugcauccagcagcc

SEQ ID NO: 1903251 - RNA, 21 nt, Shigella flexneri 2a str. 2457T
gugcaggcaccagccccugga

SEQ ID NO: 1903252 - RNA, 17 nt, Shigella flexneri 2a str. 2457T
gugcaggcaccagcccc

SEQ ID NO: 1903253 - RNA, 20 nt, Shigella flexneri 2a str. 2457T
gugccgcacauagcaccacc

SEQ ID NO: 1903254 - RNA, 14 nt, Shigella flexneri 2a str. 2457T
gugccgcagcccca

SEQ ID NO: 1903255 - RNA, 15 nt, Shigella flexneri 2a str. 2457T
gugccggcaacaaua

SEQ ID NO: 1903256 - RNA, 19 nt, Shigella flexneri 2a str. 2457T
gugccgcuggcauacaguu

SEQ ID NO: 1903257 - RNA, 18 nt, Shigella flexneri 2a str. 2457T
gugccauugaccagcugc

SEQ ID NO: 1903258 - RNA, 19 nt, Shigella flexneri 2a str. 2457T
gugccgagaguaacacauu

SEQ ID NO: 1903259 - RNA, 16 nt, Shigella flexneri 2a str. 2457T
gugccgguggaagggc

SEQ ID NO: 1903260 - RNA, 19 nt, Shigella flexneri 2a str. 2457T
gugccggucugaauacgcc

SEQ ID NO: 1903261 - RNA, 19 nt, Shigella flexneri 2a str. 2457T
gugccgucugccccgccgc

SEQ ID NO: 1903262 - RNA, 20 nt, Shigella flexneri 2a str. 2457T
gugccucguucacauauugc

SEQ ID NO: 1903263 - RNA, 13 nt, Shigella flexneri 2a str. 2457T
gugccucaagaau

SEQ ID NO: 1903264 - RNA, 16 nt, Shigella flexneri 2a str. 2457T
gugacaccaaccgcgg

SEQ ID NO: 1903265 - RNA, 18 nt, Shigella flexneri 2a str. 2457T
gugacacaaucaaauccu

SEQ ID NO: 1903266 - RNA, 13 nt, Shigella flexneri 2a str. 2457T
gugacagcgguga

SEQ ID NO: 1903267 - RNA, 18 nt, Shigella flexneri 2a str. 2457T
gugacagcccggcauguu

SEQ ID NO: 1903268 - RNA, 23 nt, Shigella flexneri 2a str. 2457T
gugacaucgugcugguagaagcu

SEQ ID NO: 1903269 - RNA, 18 nt, Shigella flexneri 2a str. 2457T
gugaccaguugcuccagc

SEQ ID NO: 1903270 - RNA, 17 nt, Shigella flexneri 2a str. 2457T
gugaccagcagcauuuc

SEQ ID NO: 1903271 - RNA, 13 nt, Shigella flexneri 2a str. 2457T
gugacauuaacca

SEQ ID NO: 1903272 - RNA, 18 nt, Shigella flexneri 2a str. 2457T
gugacccgcagccagcac

SEQ ID NO: 1903273 - RNA, 19 nt, Shigella flexneri 2a str. 2457T
gugaccgaaauggagccga

SEQ ID NO: 1903274 - RNA, 23 nt, Shigella flexneri 2a str. 2457T
gugaccgaaggugcacuagacga

SEQ ID NO: 1903275 - RNA, 15 nt, Shigella flexneri 2a str. 2457T
gugaccuguccugua

SEQ ID NO: 1903276 - RNA, 17 nt, Shigella flexneri 2a str. 2457T
gugaccuuucagugggu

SEQ ID NO: 1903277 - RNA, 16 nt, Shigella flexneri 2a str. 2457T
gugacgcgggcagcag

SEQ ID NO: 1903278 - RNA, 18 nt, Shigella flexneri 2a str. 2457T
gugacgaaacugcucaaa

SEQ ID NO: 1903279 - RNA, 17 nt, Shigella flexneri 2a str. 2457T
gugacgacaccaucucu

SEQ ID NO: 1903280 - RNA, 15 nt, Shigella flexneri 2a str. 2457T
gugacuucugccagc

SEQ ID NO: 1903281 - RNA, 16 nt, Shigella flexneri 2a str. 2457T
gugacuggaaaucaaa

SEQ ID NO: 1903282 - RNA, 21 nt, Shigella flexneri 2a str. 2457T
gugacucaauggcauccgcca

SEQ ID NO: 1903283 - RNA, 20 nt, Shigella flexneri 2a str. 2457T
gugacuucugccagcugcug

SEQ ID NO: 1903284 - RNA, 16 nt, Shigella flexneri 2a str. 2457T
gugagagauaauaaaa

SEQ ID NO: 1903285 - RNA, 21 nt, Shigella flexneri 2a str. 2457T
gugauccgccgcugucgcagc

SEQ ID NO: 1903286 - RNA, 19 nt, Shigella flexneri 2a str. 2457T
gugaucccaauauagacaa

SEQ ID NO: 1903287 - RNA, 18 nt, Shigella flexneri 2a str. 2457T
gugauccgccgcgcggug

SEQ ID NO: 1903288 - RNA, 13 nt, Shigella flexneri 2a str. 2457T
gugauacuucuuc

SEQ ID NO: 1903289 - RNA, 17 nt, Shigella flexneri 2a str. 2457T
gugaucaaaucaugccu

SEQ ID NO: 1903290 - RNA, 18 nt, Shigella flexneri 2a str. 2457T
gugauauuucgaauuuuc

SEQ ID NO: 1903291 - RNA, 15 nt, Shigella flexneri 2a str. 2457T
gugagcagggcacuu

SEQ ID NO: 1903292 - RNA, 12 nt, Shigella flexneri 2a str. 2457T
gugagcgugcgg

SEQ ID NO: 1903293 - RNA, 17 nt, Shigella flexneri 2a str. 2457T
gugagcuacacgggcau

SEQ ID NO: 1903294 - RNA, 21 nt, Shigella flexneri 2a str. 2457T
gugagccgaaauauggcgcug

SEQ ID NO: 1903295 - RNA, 21 nt, Shigella flexneri 2a str. 2457T
gugaguaugauacguuuauua

SEQ ID NO: 1903296 - RNA, 22 nt, Shigella flexneri 2a str. 2457T
gugaggggaacccguuggcaca

SEQ ID NO: 1903297 - RNA, 18 nt, Shigella flexneri 2a str. 2457T
gugaggcgaugccugcuu

SEQ ID NO: 1903298 - RNA, 14 nt, Shigella flexneri 2a str. 2457T
gugaaucacuccau

SEQ ID NO: 1903299 - RNA, 15 nt, Shigella flexneri 2a str. 2457T
gugaaucacuccauc

SEQ ID NO: 1903300 - RNA, 13 nt, Shigella flexneri 2a str. 2457T
gugaaugccuuau

SEQ ID NO: 1903301 - RNA, 17 nt, Shigella flexneri 2a str. 2457T
gugaaugguggcgauga

SEQ ID NO: 1903302 - RNA, 20 nt, Shigella flexneri 2a str. 2457T
gugaaucgggcgugauucca

SEQ ID NO: 1903303 - RNA, 12 nt, Shigella flexneri 2a str. 2457T
gugacacaauca

SEQ ID NO: 1903304 - RNA, 13 nt, Shigella flexneri 2a str. 2457T
gugaaaguaaaaa

SEQ ID NO: 1903305 - RNA, 16 nt, Shigella flexneri 2a str. 2457T
gugaaauacaguuauc

SEQ ID NO: 1903306 - RNA, 22 nt, Shigella flexneri 2a str. 2457T
gugaagagugacuucgccguga

SEQ ID NO: 1903307 - RNA, 18 nt, Shigella flexneri 2a str. 2457T
gugaagagauccaccagc

SEQ ID NO: 1903308 - RNA, 21 nt, Shigella flexneri 2a str. 2457T
gugaacugccacacaggccau

SEQ ID NO: 1903309 - RNA, 20 nt, Shigella flexneri 2a str. 2457T
gugaacgagaaaaugacgau

SEQ ID NO: 1903310 - RNA, 22 nt, Shigella flexneri 2a str. 2457T
gugaacgagaaaaugacgauga

SEQ ID NO: 1903311 - RNA, 13 nt, Shigella flexneri 2a str. 2457T
gugaacgccuuau

SEQ ID NO: 1903312 - RNA, 15 nt, Shigella flexneri 2a str. 2457T
gucuuguuacuggcu

SEQ ID NO: 1903313 - RNA, 16 nt, Shigella flexneri 2a str. 2457T
gucuuuacuaaacggu

SEQ ID NO: 1903314 - RNA, 16 nt, Shigella flexneri 2a str. 2457T
gucuuugcguuccauc

SEQ ID NO: 1903315 - RNA, 21 nt, Shigella flexneri 2a str. 2457T
gugaaagagccgucauucugc

SEQ ID NO: 1903316 - RNA, 23 nt, Shigella flexneri 2a str. 2457T
gugaaaccuuuaugcagcucggu

SEQ ID NO: 1903317 - RNA, 22 nt, Shigella flexneri 2a str. 2457T
gugaaaacgacgcgguauuggu

SEQ ID NO: 1903318 - RNA, 18 nt, Shigella flexneri 2a str. 2457T
gugaaaaauggcgcccau

SEQ ID NO: 1903319 - RNA, 14 nt, Shigella flexneri 2a str. 2457T
gugaaaaucgaguu

SEQ ID NO: 1903320 - RNA, 14 nt, Shigella flexneri 2a str. 2457T
gugaaaauguggua

SEQ ID NO: 1903321 - RNA, 14 nt, Shigella flexneri 2a str. 2457T
gucuuuuuucacug

SEQ ID NO: 1903322 - RNA, 21 nt, Shigella flexneri 2a str. 2457T
gugaaaaaccaaucucccagc

SEQ ID NO: 1903323 - RNA, 12 nt, Shigella flexneri 2a str. 2457T
gucuuccugugg

SEQ ID NO: 1903324 - RNA, 11 nt, Shigella flexneri 2a str. 2457T
gucuucccugc

SEQ ID NO: 1903325 - RNA, 19 nt, Shigella flexneri 2a str. 2457T
gucuucugugauuccgcca

SEQ ID NO: 1903326 - RNA, 20 nt, Shigella flexneri 2a str. 2457T
gucuucugcagucaccugcg

SEQ ID NO: 1903327 - RNA, 18 nt, Shigella flexneri 2a str. 2457T
gucuucucaccgccgccu

SEQ ID NO: 1903328 - RNA, 14 nt, Shigella flexneri 2a str. 2457T
gucuuguacuuccg

SEQ ID NO: 1903329 - RNA, 19 nt, Shigella flexneri 2a str. 2457T
gucuuggguauaaaacuca

SEQ ID NO: 1903330 - RNA, 19 nt, Shigella flexneri 2a str. 2457T
gucuuaucaggccuacaac

SEQ ID NO: 1903331 - RNA, 21 nt, Shigella flexneri 2a str. 2457T
gucuuaucaggccuacaaguc

SEQ ID NO: 1903332 - RNA, 15 nt, Shigella flexneri 2a str. 2457T
gucuguuuuaucucc

SEQ ID NO: 1903333 - RNA, 18 nt, Shigella flexneri 2a str. 2457T
gucuguuuuaucucccug

SEQ ID NO: 1903334 - RNA, 19 nt, Shigella flexneri 2a str. 2457T
gucuguucgccccaaaaaa

SEQ ID NO: 1903335 - RNA, 14 nt, Shigella flexneri 2a str. 2457T
gucuucccagcccc

SEQ ID NO: 1903336 - RNA, 20 nt, Shigella flexneri 2a str. 2457T
gucuucaucauccucuucag

SEQ ID NO: 1903337 - RNA, 20 nt, Shigella flexneri 2a str. 2457T
gucuuauccggccuuccugu

SEQ ID NO: 1903338 - RNA, 14 nt, Shigella flexneri 2a str. 2457T
gucuucaaccgcag

SEQ ID NO: 1903339 - RNA, 15 nt, Shigella flexneri 2a str. 2457T
gucuggcguugcugg

SEQ ID NO: 1903340 - RNA, 22 nt, Shigella flexneri 2a str. 2457T
gucuggauuuggcugccgagca

SEQ ID NO: 1903341 - RNA, 16 nt, Shigella flexneri 2a str. 2457T
gucuggauuuggcugc

SEQ ID NO: 1903342 - RNA, 14 nt, Shigella flexneri 2a str. 2457T
gucugcuucugccu

SEQ ID NO: 1903343 - RNA, 14 nt, Shigella flexneri 2a str. 2457T
gucuggaacggcag

SEQ ID NO: 1903344 - RNA, 14 nt, Shigella flexneri 2a str. 2457T
gucuggugaccugg

SEQ ID NO: 1903345 - RNA, 12 nt, Shigella flexneri 2a str. 2457T
gucuguacggca

SEQ ID NO: 1903346 - RNA, 13 nt, Shigella flexneri 2a str. 2457T
gucuguaugacaa

SEQ ID NO: 1903347 - RNA, 18 nt, Shigella flexneri 2a str. 2457T
gucuguaccaccagaauc

SEQ ID NO: 1903348 - RNA, 22 nt, Shigella flexneri 2a str. 2457T
gucucgauguagauauacugca

SEQ ID NO: 1903349 - RNA, 19 nt, Shigella flexneri 2a str. 2457T
gucucgauacgcccuggau

SEQ ID NO: 1903350 - RNA, 21 nt, Shigella flexneri 2a str. 2457T
gucugaaagguauuggcggca

SEQ ID NO: 1903351 - RNA, 17 nt, Shigella flexneri 2a str. 2457T
gucucuuuucguuuugg

SEQ ID NO: 1903352 - RNA, 15 nt, Shigella flexneri 2a str. 2457T
gucucuucaugccuc

SEQ ID NO: 1903353 - RNA, 14 nt, Shigella flexneri 2a str. 2457T
gucucuuccggcuc

SEQ ID NO: 1903354 - RNA, 18 nt, Shigella flexneri 2a str. 2457T
gucucuggcuucccggca

SEQ ID NO: 1903355 - RNA, 16 nt, Shigella flexneri 2a str. 2457T
gucugauaaaaaaccc

SEQ ID NO: 1903356 - RNA, 22 nt, Shigella flexneri 2a str. 2457T
gucugcauuuucucgcggacug

SEQ ID NO: 1903357 - RNA, 17 nt, Shigella flexneri 2a str. 2457T
gucugccgguacuucac

SEQ ID NO: 1903358 - RNA, 20 nt, Shigella flexneri 2a str. 2457T
gucugccgguacuucaccag

SEQ ID NO: 1903359 - RNA, 18 nt, Shigella flexneri 2a str. 2457T
gucugccgggaagcucuc

SEQ ID NO: 1903360 - RNA, 18 nt, Shigella flexneri 2a str. 2457T
gucugccaucauggcauc

SEQ ID NO: 1903361 - RNA, 14 nt, Shigella flexneri 2a str. 2457T
gucugccccgccgc

SEQ ID NO: 1903362 - RNA, 15 nt, Shigella flexneri 2a str. 2457T
uaaaucuguucaucu

SEQ ID NO: 1903363 - RNA, 20 nt, Shigella flexneri 2a str. 2457T
uaaaucacgcuuaucgcccu

SEQ ID NO: 1903364 - RNA, 16 nt, Shigella flexneri 2a str. 2457T
uaaauaucaucaaaau

SEQ ID NO: 1903365 - RNA, 11 nt, Shigella flexneri 2a str. 2457T
uaaaucaaacc

SEQ ID NO: 1903366 - RNA, 16 nt, Shigella flexneri 2a str. 2457T
uaaaugacagcgaaug

SEQ ID NO: 1903367 - RNA, 16 nt, Shigella flexneri 2a str. 2457T
uaaaucuuugcccgca

SEQ ID NO: 1903368 - RNA, 22 nt, Shigella flexneri 2a str. 2457T
uaaauggcgaacgggauaaacg

SEQ ID NO: 1903369 - RNA, 15 nt, Shigella flexneri 2a str. 2457T
uaaaugcugcagcca

SEQ ID NO: 1903370 - RNA, 17 nt, Shigella flexneri 2a str. 2457T
uaaaugcugcagccagg

SEQ ID NO: 1903371 - RNA, 16 nt, Shigella flexneri 2a str. 2457T
uaaauagaggaaucug

SEQ ID NO: 1903372 - RNA, 18 nt, Shigella flexneri 2a str. 2457T
uaaauaaaaagagauugu

SEQ ID NO: 1903373 - RNA, 18 nt, Shigella flexneri 2a str. 2457T
uaaaguacgcuuucccuu

SEQ ID NO: 1903374 - RNA, 18 nt, Shigella flexneri 2a str. 2457T
uaaaguugcucucaaaga

SEQ ID NO: 1903375 - RNA, 17 nt, Shigella flexneri 2a str. 2457T
uaaaguacucuuugaac

SEQ ID NO: 1903376 - RNA, 12 nt, Shigella flexneri 2a str. 2457T
uaaaguuguuuu

SEQ ID NO: 1903377 - RNA, 15 nt, Shigella flexneri 2a str. 2457T
uaaaguuguuuucuu

SEQ ID NO: 1903378 - RNA, 18 nt, Shigella flexneri 2a str. 2457T
uaaaguuuggcugugccc

SEQ ID NO: 1903379 - RNA, 15 nt, Shigella flexneri 2a str. 2457T
uaaagaccauaaaua

SEQ ID NO: 1903380 - RNA, 22 nt, Shigella flexneri 2a str. 2457T
uaaagaccauugaugcucuccg

SEQ ID NO: 1903381 - RNA, 22 nt, Shigella flexneri 2a str. 2457T
uaaagacguuaacuacaaucac

SEQ ID NO: 1903382 - RNA, 12 nt, Shigella flexneri 2a str. 2457T
uaaacuuggcua

SEQ ID NO: 1903383 - RNA, 21 nt, Shigella flexneri 2a str. 2457T
uaaagaagauaccgaacauac

SEQ ID NO: 1903384 - RNA, 21 nt, Shigella flexneri 2a str. 2457T
uaaagccugcuucaaacgcug

SEQ ID NO: 1903385 - RNA, 22 nt, Shigella flexneri 2a str. 2457T
uaaagccggugcggucaggcau

SEQ ID NO: 1903386 - RNA, 23 nt, Shigella flexneri 2a str. 2457T
uaaagccguggguauauuucagg

SEQ ID NO: 1903387 - RNA, 14 nt, Shigella flexneri 2a str. 2457T
uaaaggucaucaca

SEQ ID NO: 1903388 - RNA, 15 nt, Shigella flexneri 2a str. 2457T
uaaagaguaaauugc

SEQ ID NO: 1903389 - RNA, 22 nt, Shigella flexneri 2a str. 2457T
uaaagagcauuacacgcggcug

SEQ ID NO: 1903390 - RNA, 21 nt, Shigella flexneri 2a str. 2457T
uaaagcccucaccgaagcgag

SEQ ID NO: 1903391 - RNA, 19 nt, Shigella flexneri 2a str. 2457T
uaaagcccauaccacagca

SEQ ID NO: 1903392 - RNA, 19 nt, Shigella flexneri 2a str. 2457T
uaaagcccccgcaacauug

SEQ ID NO: 1903393 - RNA, 17 nt, Shigella flexneri 2a str. 2457T
uaaaccaacaaaacuca

SEQ ID NO: 1903394 - RNA, 19 nt, Shigella flexneri 2a str. 2457T
uaaaccggacaauaaaaaa

SEQ ID NO: 1903395 - RNA, 21 nt, Shigella flexneri 2a str. 2457T
uaaaccgucagcaccagggaa

SEQ ID NO: 1903396 - RNA, 21 nt, Shigella flexneri 2a str. 2457T
uaaaaugacucgccgcugugg

SEQ ID NO: 1903397 - RNA, 13 nt, Shigella flexneri 2a str. 2457T
uaaacuucaccag

SEQ ID NO: 1903398 - RNA, 14 nt, Shigella flexneri 2a str. 2457T
uaaacguuuaaaaa

SEQ ID NO: 1903399 - RNA, 21 nt, Shigella flexneri 2a str. 2457T
uaaacguggggucucugcaaa

SEQ ID NO: 1903400 - RNA, 21 nt, Shigella flexneri 2a str. 2457T
uaacaaaaucgugaaaaauca

SEQ ID NO: 1903401 - RNA, 19 nt, Shigella flexneri 2a str. 2457T
uaaauuugcuuuucauaca

SEQ ID NO: 1903402 - RNA, 17 nt, Shigella flexneri 2a str. 2457T
uaaauuuaucaaugcau

SEQ ID NO: 1903403 - RNA, 20 nt, Shigella flexneri 2a str. 2457T
uaaauuuauagucaucggua

SEQ ID NO: 1903404 - RNA, 22 nt, Shigella flexneri 2a str. 2457T
uaaauuucuuaccacugccgca

SEQ ID NO: 1903405 - RNA, 17 nt, Shigella flexneri 2a str. 2457T
uaaauuugcuuuucaua

SEQ ID NO: 1903406 - RNA, 17 nt, Shigella flexneri 2a str. 2457T
uaaauuugccaucucug

SEQ ID NO: 1903407 - RNA, 19 nt, Shigella flexneri 2a str. 2457T
uaacacagaggcagcaucu

SEQ ID NO: 1903408 - RNA, 12 nt, Shigella flexneri 2a str. 2457T
uaacacaugcaa

SEQ ID NO: 1903409 - RNA, 15 nt, Shigella flexneri 2a str. 2457T
uaacaaagccugcac

SEQ ID NO: 1903410 - RNA, 19 nt, Shigella flexneri 2a str. 2457T
uaacaaaugugccauuaau

SEQ ID NO: 1903411 - RNA, 20 nt, Shigella flexneri 2a str. 2457T
uaacaauguugucgccagua

SEQ ID NO: 1903412 - RNA, 20 nt, Shigella flexneri 2a str. 2457T
uaacaauucccgauagucuu

SEQ ID NO: 1903413 - RNA, 18 nt, Shigella flexneri 2a str. 2457T
uaaauuaccuguaaagua

SEQ ID NO: 1903414 - RNA, 21 nt, Shigella flexneri 2a str. 2457T
uaaauucaaugaauuaaaaaa

SEQ ID NO: 1903415 - RNA, 23 nt, Shigella flexneri 2a str. 2457T
uaaauuaacugcgcgauuaucau

SEQ ID NO: 1903416 - RNA, 17 nt, Shigella flexneri 2a str. 2457T
uaaauugagcugcgcga

SEQ ID NO: 1903417 - RNA, 19 nt, Shigella flexneri 2a str. 2457T
uaaauugaugugaaaacuc

SEQ ID NO: 1903418 - RNA, 15 nt, Shigella flexneri 2a str. 2457T
uaaauugcagcacac

SEQ ID NO: 1903419 - RNA, 15 nt, Shigella flexneri 2a str. 2457T
uaaauugcagcgauu

SEQ ID NO: 1903420 - RNA, 17 nt, Shigella flexneri 2a str. 2457T
uaaauucucaauaucau

SEQ ID NO: 1903421 - RNA, 18 nt, Shigella flexneri 2a str. 2457T
uaaauuccuaaaguuguu

SEQ ID NO: 1903422 - RNA, 17 nt, Shigella flexneri 2a str. 2457T
uaaauucuaauguuaaa

SEQ ID NO: 1903423 - RNA, 21 nt, Shigella flexneri 2a str. 2457T
uaaauugcaaaccucaggaau

SEQ ID NO: 1903424 - RNA, 22 nt, Shigella flexneri 2a str. 2457T
uaaauugcaggacuuauucauu

SEQ ID NO: 1903425 - RNA, 23 nt, Shigella flexneri 2a str. 2457T
uaaauuuacguucuuacauuccg

SEQ ID NO: 1903426 - RNA, 14 nt, Shigella flexneri 2a str. 2457T
uaaauuuaauaaua

SEQ ID NO: 1903427 - RNA, 13 nt, Shigella flexneri 2a str. 2457T
uaacccuuccaga

SEQ ID NO: 1903428 - RNA, 23 nt, Shigella flexneri 2a str. 2457T
uaaccgcuucgcuggcagcugcu

SEQ ID NO: 1903429 - RNA, 12 nt, Shigella flexneri 2a str. 2457T
uaaccgcuuuuu

SEQ ID NO: 1903430 - RNA, 17 nt, Shigella flexneri 2a str. 2457T
uaaccgcugcaaaaaau

SEQ ID NO: 1903431 - RNA, 19 nt, Shigella flexneri 2a str. 2457T
uaaccgggguuucacccac

SEQ ID NO: 1903432 - RNA, 14 nt, Shigella flexneri 2a str. 2457T
uaaccuuuaaucag

SEQ ID NO: 1903433 - RNA, 14 nt, Shigella flexneri 2a str. 2457T
uaaccuaaaugcuc

SEQ ID NO: 1903434 - RNA, 15 nt, Shigella flexneri 2a str. 2457T
uaaccgcuuuuccag

SEQ ID NO: 1903435 - RNA, 18 nt, Shigella flexneri 2a str. 2457T
uaaccgugggaaacagua

SEQ ID NO: 1903436 - RNA, 14 nt, Shigella flexneri 2a str. 2457T
uaacgaacgcagug

SEQ ID NO: 1903437 - RNA, 20 nt, Shigella flexneri 2a str. 2457T
uaaccuuugcgguuaaaaau

SEQ ID NO: 1903438 - RNA, 15 nt, Shigella flexneri 2a str. 2457T
uaacgacauuuucug

SEQ ID NO: 1903439 - RNA, 14 nt, Shigella flexneri 2a str. 2457T
uaacgaugccagca

SEQ ID NO: 1903440 - RNA, 17 nt, Shigella flexneri 2a str. 2457T
uaacgaugccagcaccg

SEQ ID NO: 1903441 - RNA, 16 nt, Shigella flexneri 2a str. 2457T
uaacgcuucucccagc

SEQ ID NO: 1903442 - RNA, 14 nt, Shigella flexneri 2a str. 2457T
uaacagcagcagcg

SEQ ID NO: 1903443 - RNA, 20 nt, Shigella flexneri 2a str. 2457T
uaacaccagccagaauuacc

SEQ ID NO: 1903444 - RNA, 13 nt, Shigella flexneri 2a str. 2457T
uaacaccauccau

SEQ ID NO: 1903445 - RNA, 21 nt, Shigella flexneri 2a str. 2457T
uaacaccgauuuuguaaaaga

SEQ ID NO: 1903446 - RNA, 16 nt, Shigella flexneri 2a str. 2457T
uaacagcaucgcauca

SEQ ID NO: 1903447 - RNA, 16 nt, Shigella flexneri 2a str. 2457T
uaaccaguccauuacc

SEQ ID NO: 1903448 - RNA, 23 nt, Shigella flexneri 2a str. 2457T
uaacauuuuacuuacuucagcaa

SEQ ID NO: 1903449 - RNA, 16 nt, Shigella flexneri 2a str. 2457T
uaaccaucaaaacgcu

SEQ ID NO: 1903450 - RNA, 20 nt, Shigella flexneri 2a str. 2457T
uaaccauccauauuuggcau

SEQ ID NO: 1903451 - RNA, 12 nt, Shigella flexneri 2a str. 2457T
uaaccaucagcu

SEQ ID NO: 1903452 - RNA, 21 nt, Shigella flexneri 2a str. 2457T
uaaccauauaugauaauuauu

SEQ ID NO: 1903453 - RNA, 21 nt, Shigella flexneri 2a str. 2457T
uaaccauccauauuuggcaug

SEQ ID NO: 1903454 - RNA, 21 nt, Shigella flexneri 2a str. 2457T
uaacccggcaccaacaaagcc

SEQ ID NO: 1903455 - RNA, 20 nt, Shigella flexneri 2a str. 2457T
uaacccuccguuucacuucu

SEQ ID NO: 1903456 - RNA, 17 nt, Shigella flexneri 2a str. 2457T
guuuuuacccagcagca

SEQ ID NO: 1903457 - RNA, 13 nt, Shigella flexneri 2a str. 2457T
guuuuuacagauu

SEQ ID NO: 1903458 - RNA, 22 nt, Shigella flexneri 2a str. 2457T
guuuuguugcccagcgcaucag

SEQ ID NO: 1903459 - RNA, 12 nt, Shigella flexneri 2a str. 2457T
guuuuucuuuuu

SEQ ID NO: 1903460 - RNA, 16 nt, Shigella flexneri 2a str. 2457T
guuuuugcuguuguuc

SEQ ID NO: 1903461 - RNA, 11 nt, Shigella flexneri 2a str. 2457T
guuuucucucu

SEQ ID NO: 1903462 - RNA, 15 nt, Shigella flexneri 2a str. 2457T
guuuucuggcugaca

SEQ ID NO: 1903463 - RNA, 14 nt, Shigella flexneri 2a str. 2457T
guuuucucaucgcu

SEQ ID NO: 1903464 - RNA, 18 nt, Shigella flexneri 2a str. 2457T
guuuucucgcuccauucc

SEQ ID NO: 1903465 - RNA, 17 nt, Shigella flexneri 2a str. 2457T
guuuugcggcgugaccu

SEQ ID NO: 1903466 - RNA, 20 nt, Shigella flexneri 2a str. 2457T
guuuugcccacucaacgguu

SEQ ID NO: 1903467 - RNA, 17 nt, Shigella flexneri 2a str. 2457T
uaaaaaagaaggaaaau

SEQ ID NO: 1903468 - RNA, 18 nt, Shigella flexneri 2a str. 2457T
uaaaaaagaaggaaaaua

SEQ ID NO: 1903469 - RNA, 19 nt, Shigella flexneri 2a str. 2457T
uaaaaaagaaggaaaauac

SEQ ID NO: 1903470 - RNA, 17 nt, Shigella flexneri 2a str. 2457T
uaaaaaagggugcugca

SEQ ID NO: 1903471 - RNA, 18 nt, Shigella flexneri 2a str. 2457T
uaaaaaaagcauuuaaua

SEQ ID NO: 1903472 - RNA, 11 nt, Shigella flexneri 2a str. 2457T
uaaaaaaagaa

SEQ ID NO: 1903473 - RNA, 21 nt, Shigella flexneri 2a str. 2457T
uaaaaaaaacgccagcaacac

SEQ ID NO: 1903474 - RNA, 12 nt, Shigella flexneri 2a str. 2457T
guuuuuuauucc

SEQ ID NO: 1903475 - RNA, 23 nt, Shigella flexneri 2a str. 2457T
guuuuuuuauaucucagauaaau

SEQ ID NO: 1903476 - RNA, 20 nt, Shigella flexneri 2a str. 2457T
guuuuuuuauaucucagaua

SEQ ID NO: 1903477 - RNA, 21 nt, Shigella flexneri 2a str. 2457T
uaaaaucaucacgcgguuacg

SEQ ID NO: 1903478 - RNA, 13 nt, Shigella flexneri 2a str. 2457T
uaaaagccaggag

SEQ ID NO: 1903479 - RNA, 21 nt, Shigella flexneri 2a str. 2457T
uaaaagcauagccccagcgca

SEQ ID NO: 1903480 - RNA, 21 nt, Shigella flexneri 2a str. 2457T
uaaaagcgugaaacaaaucac

SEQ ID NO: 1903481 - RNA, 14 nt, Shigella flexneri 2a str. 2457T
uaaaaacagccagc

SEQ ID NO: 1903482 - RNA, 15 nt, Shigella flexneri 2a str. 2457T
uaaaaacagccagca

SEQ ID NO: 1903483 - RNA, 21 nt, Shigella flexneri 2a str. 2457T
uaaaaacagcaucaauaauca

SEQ ID NO: 1903484 - RNA, 14 nt, Shigella flexneri 2a str. 2457T
uaaaaacaucauga

SEQ ID NO: 1903485 - RNA, 20 nt, Shigella flexneri 2a str. 2457T
uaaaacgcagucuucccagc

SEQ ID NO: 1903486 - RNA, 12 nt, Shigella flexneri 2a str. 2457T
uaaaagcaaaaa

SEQ ID NO: 1903487 - RNA, 12 nt, Shigella flexneri 2a str. 2457T
uaaaagaaaaaa

SEQ ID NO: 1903488 - RNA, 16 nt, Shigella flexneri 2a str. 2457T
uaaaacuuuauucagu

SEQ ID NO: 1903489 - RNA, 14 nt, Shigella flexneri 2a str. 2457T
guuuuaucccgcuc

SEQ ID NO: 1903490 - RNA, 16 nt, Shigella flexneri 2a str. 2457T
guuuuaucuccauccg

SEQ ID NO: 1903491 - RNA, 16 nt, Shigella flexneri 2a str. 2457T
guuuuauuauuccauc

SEQ ID NO: 1903492 - RNA, 17 nt, Shigella flexneri 2a str. 2457T
guuuuacuuugccuuuc

SEQ ID NO: 1903493 - RNA, 21 nt, Shigella flexneri 2a str. 2457T
guuuuacuuuuuaacuuuaau

SEQ ID NO: 1903494 - RNA, 14 nt, Shigella flexneri 2a str. 2457T
guuuuauaaucgca

SEQ ID NO: 1903495 - RNA, 14 nt, Shigella flexneri 2a str. 2457T
guuuuacuccaacu

SEQ ID NO: 1903496 - RNA, 21 nt, Shigella flexneri 2a str. 2457T
guuuuacuggaguuauucauu

SEQ ID NO: 1903497 - RNA, 15 nt, Shigella flexneri 2a str. 2457T
guuuuacaacguauu

SEQ ID NO: 1903498 - RNA, 17 nt, Shigella flexneri 2a str. 2457T
guuuuaaagcaaaaaaa

SEQ ID NO: 1903499 - RNA, 11 nt, Shigella flexneri 2a str. 2457T
guuuucaacgg

SEQ ID NO: 1903500 - RNA, 12 nt, Shigella flexneri 2a str. 2457T
guuuucaccagu

SEQ ID NO: 1903501 - RNA, 17 nt, Shigella flexneri 2a str. 2457T
guuuucacccuuucguu

SEQ ID NO: 1903502 - RNA, 20 nt, Shigella flexneri 2a str. 2457T
guuuucaccgcggauuucac

SEQ ID NO: 1903503 - RNA, 18 nt, Shigella flexneri 2a str. 2457T
guuuucaguugcucugca

SEQ ID NO: 1903504 - RNA, 16 nt, Shigella flexneri 2a str. 2457T
guuuucagaugaaaac

SEQ ID NO: 1903505 - RNA, 17 nt, Shigella flexneri 2a str. 2457T
guuuuccagugccagaa

SEQ ID NO: 1903506 - RNA, 18 nt, Shigella flexneri 2a str. 2457T
guuuuccagugccagaac

SEQ ID NO: 1903507 - RNA, 16 nt, Shigella flexneri 2a str. 2457T
guuuucgcugccacac

SEQ ID NO: 1903508 - RNA, 12 nt, Shigella flexneri 2a str. 2457T
guuuuccuucag

SEQ ID NO: 1903509 - RNA, 17 nt, Shigella flexneri 2a str. 2457T
guuuucuaacucauuuu

SEQ ID NO: 1903510 - RNA, 20 nt, Shigella flexneri 2a str. 2457T
guuuucuaacucauuuuuua

SEQ ID NO: 1903511 - RNA, 23 nt, Shigella flexneri 2a str. 2457T
guuuucucaagucuggguauuca

SEQ ID NO: 1903512 - RNA, 21 nt, Shigella flexneri 2a str. 2457T
guuugucauaaaucucagccc

SEQ ID NO: 1903513 - RNA, 13 nt, Shigella flexneri 2a str. 2457T
guuuguagcagaa

SEQ ID NO: 1903514 - RNA, 13 nt, Shigella flexneri 2a str. 2457T
guuuggcaaauac

SEQ ID NO: 1903515 - RNA, 22 nt, Shigella flexneri 2a str. 2457T
guuuggccgcgccaaugccuga

SEQ ID NO: 1903516 - RNA, 19 nt, Shigella flexneri 2a str. 2457T
guuugcugccuucacggcu

SEQ ID NO: 1903517 - RNA, 20 nt, Shigella flexneri 2a str. 2457T
guuucuuuaggauuugucuc

SEQ ID NO: 1903518 - RNA, 16 nt, Shigella flexneri 2a str. 2457T
guuucuuccagcgcca

SEQ ID NO: 1903519 - RNA, 16 nt, Shigella flexneri 2a str. 2457T
guuucugcgcuucugc

SEQ ID NO: 1903520 - RNA, 21 nt, Shigella flexneri 2a str. 2457T
guuugcgcagccaguuaaccu

SEQ ID NO: 1903521 - RNA, 12 nt, Shigella flexneri 2a str. 2457T
guuugcugcaug

SEQ ID NO: 1903522 - RNA, 18 nt, Shigella flexneri 2a str. 2457T
guuugcgguguguggcug

SEQ ID NO: 1903523 - RNA, 21 nt, Shigella flexneri 2a str. 2457T
guuugcagugaucgugugcca

SEQ ID NO: 1903524 - RNA, 14 nt, Shigella flexneri 2a str. 2457T
guuugcauccagcu

SEQ ID NO: 1903525 - RNA, 15 nt, Shigella flexneri 2a str. 2457T
guuugcauccagcuc

SEQ ID NO: 1903526 - RNA, 16 nt, Shigella flexneri 2a str. 2457T
guuugccaccugugca

SEQ ID NO: 1903527 - RNA, 23 nt, Shigella flexneri 2a str. 2457T
guuugccaugacuuucuggcacg

SEQ ID NO: 1903528 - RNA, 22 nt, Shigella flexneri 2a str. 2457T
guuugccaugcauauccaggcu

SEQ ID NO: 1903529 - RNA, 16 nt, Shigella flexneri 2a str. 2457T
guuugccccggcugcg

SEQ ID NO: 1903530 - RNA, 22 nt, Shigella flexneri 2a str. 2457T
guuugccagugccguuccagcc

SEQ ID NO: 1903531 - RNA, 15 nt, Shigella flexneri 2a str. 2457T
guugucauuacaaca

SEQ ID NO: 1903532 - RNA, 18 nt, Shigella flexneri 2a str. 2457T
guugucaucggucagauc

SEQ ID NO: 1903533 - RNA, 23 nt, Shigella flexneri 2a str. 2457T
guugucaggaagccccagcuuuu

SEQ ID NO: 1903534 - RNA, 16 nt, Shigella flexneri 2a str. 2457T
guugucgcuguaaugu

SEQ ID NO: 1903535 - RNA, 16 nt, Shigella flexneri 2a str. 2457T
guugucgccgcuggug

SEQ ID NO: 1903536 - RNA, 17 nt, Shigella flexneri 2a str. 2457T
guugucuuuccagacuc

SEQ ID NO: 1903537 - RNA, 14 nt, Shigella flexneri 2a str. 2457T
guugucucagauuc

SEQ ID NO: 1903538 - RNA, 17 nt, Shigella flexneri 2a str. 2457T
guucuggccguacccag

SEQ ID NO: 1903539 - RNA, 20 nt, Shigella flexneri 2a str. 2457T
guucugcuucaacauacccu

SEQ ID NO: 1903540 - RNA, 22 nt, Shigella flexneri 2a str. 2457T
guucugcguuaagacuuuuuuc

SEQ ID NO: 1903541 - RNA, 21 nt, Shigella flexneri 2a str. 2457T
guucuguggcagggcagcgau

SEQ ID NO: 1903542 - RNA, 15 nt, Shigella flexneri 2a str. 2457T
guuuacgcagcucac

SEQ ID NO: 1903543 - RNA, 22 nt, Shigella flexneri 2a str. 2457T
guuuacgcguuuuucagaacuu

SEQ ID NO: 1903544 - RNA, 21 nt, Shigella flexneri 2a str. 2457T
guuuacugucugcuucugccu

SEQ ID NO: 1903545 - RNA, 16 nt, Shigella flexneri 2a str. 2457T
guuguuaaccaccagu

SEQ ID NO: 1903546 - RNA, 11 nt, Shigella flexneri 2a str. 2457T
guugugccaga

SEQ ID NO: 1903547 - RNA, 22 nt, Shigella flexneri 2a str. 2457T
guugugccagaccaaacagcau

SEQ ID NO: 1903548 - RNA, 14 nt, Shigella flexneri 2a str. 2457T
guuuaaggaaaaac

SEQ ID NO: 1903549 - RNA, 20 nt, Shigella flexneri 2a str. 2457T
guuguuaaccaccaguaaau

SEQ ID NO: 1903550 - RNA, 14 nt, Shigella flexneri 2a str. 2457T
guuuauuauagaca

SEQ ID NO: 1903551 - RNA, 15 nt, Shigella flexneri 2a str. 2457T
guuuauuaugccaca

SEQ ID NO: 1903552 - RNA, 16 nt, Shigella flexneri 2a str. 2457T
guuucaaacaggcugc

SEQ ID NO: 1903553 - RNA, 14 nt, Shigella flexneri 2a str. 2457T
guuucaaacaggcu

SEQ ID NO: 1903554 - RNA, 22 nt, Shigella flexneri 2a str. 2457T
guuucaccagcaguaaaccgcu

SEQ ID NO: 1903555 - RNA, 18 nt, Shigella flexneri 2a str. 2457T
guuucaauauccgguuca

SEQ ID NO: 1903556 - RNA, 15 nt, Shigella flexneri 2a str. 2457T
guuucaauccaggua

SEQ ID NO: 1903557 - RNA, 16 nt, Shigella flexneri 2a str. 2457T
guuucaaugcucugca

SEQ ID NO: 1903558 - RNA, 19 nt, Shigella flexneri 2a str. 2457T
guuucaaugauaagccuuc

SEQ ID NO: 1903559 - RNA, 23 nt, Shigella flexneri 2a str. 2457T
guuucaacggaccaauaaacgcc

SEQ ID NO: 1903560 - RNA, 13 nt, Shigella flexneri 2a str. 2457T
guuuccagauuuu

SEQ ID NO: 1903561 - RNA, 21 nt, Shigella flexneri 2a str. 2457T
guuuccagcaucgaccaggau

SEQ ID NO: 1903562 - RNA, 12 nt, Shigella flexneri 2a str. 2457T
guuuccagcacc

SEQ ID NO: 1903563 - RNA, 18 nt, Shigella flexneri 2a str. 2457T
guuucggcaucagcagaa

SEQ ID NO: 1903564 - RNA, 18 nt, Shigella flexneri 2a str. 2457T
guuucguggauaacaccg

SEQ ID NO: 1903565 - RNA, 15 nt, Shigella flexneri 2a str. 2457T
guuucgugcaucaug

SEQ ID NO: 1903566 - RNA, 16 nt, Shigella flexneri 2a str. 2457T
guuucacguaccagau

SEQ ID NO: 1903567 - RNA, 20 nt, Shigella flexneri 2a str. 2457T
guuucagccccaucaacgcc

SEQ ID NO: 1903568 - RNA, 19 nt, Shigella flexneri 2a str. 2457T
guuucaguaauccuuucuc

SEQ ID NO: 1903569 - RNA, 17 nt, Shigella flexneri 2a str. 2457T
guuucauagcgucccag

SEQ ID NO: 1903570 - RNA, 22 nt, Shigella flexneri 2a str. 2457T
guuucauagugcaaauccacuc

SEQ ID NO: 1903571 - RNA, 16 nt, Shigella flexneri 2a str. 2457T
guuucauaucugccag

SEQ ID NO: 1903572 - RNA, 13 nt, Shigella flexneri 2a str. 2457T
ucaaaaagcugua

SEQ ID NO: 1903573 - RNA, 21 nt, Shigella flexneri 2a str. 2457T
ucaaaaaaugaaacuggaaga

SEQ ID NO: 1903574 - RNA, 15 nt, Shigella flexneri 2a str. 2457T
ucaaaaacaaagaac

SEQ ID NO: 1903575 - RNA, 14 nt, Shigella flexneri 2a str. 2457T
ucaaaaacaaagaa

SEQ ID NO: 1903576 - RNA, 16 nt, Shigella flexneri 2a str. 2457T
ucaaaaacuaauucac

SEQ ID NO: 1903577 - RNA, 16 nt, Shigella flexneri 2a str. 2457T
ucaaaaaaacggcgcu

SEQ ID NO: 1903578 - RNA, 12 nt, Shigella flexneri 2a str. 2457T
ucaaaaaacugg

SEQ ID NO: 1903579 - RNA, 17 nt, Shigella flexneri 2a str. 2457T
ucaaaaaacuggaaaaa

SEQ ID NO: 1903580 - RNA, 20 nt, Shigella flexneri 2a str. 2457T
ucaaaaaacuggaaaaauaa

SEQ ID NO: 1903581 - RNA, 14 nt, Shigella flexneri 2a str. 2457T
ucaaaaaagucaga

SEQ ID NO: 1903582 - RNA, 15 nt, Shigella flexneri 2a str. 2457T
ucaaaagauugaauu

SEQ ID NO: 1903583 - RNA, 19 nt, Shigella flexneri 2a str. 2457T
ucaaaagauugaauuauuc

SEQ ID NO: 1903584 - RNA, 20 nt, Shigella flexneri 2a str. 2457T
ucaaaagauugaauuauuca

SEQ ID NO: 1903585 - RNA, 19 nt, Shigella flexneri 2a str. 2457T
ucaaaacggugaucaaaac

SEQ ID NO: 1903586 - RNA, 15 nt, Shigella flexneri 2a str. 2457T
ucaaaacaaaaaccg

SEQ ID NO: 1903587 - RNA, 12 nt, Shigella flexneri 2a str. 2457T
uauuuuuaaaua

SEQ ID NO: 1903588 - RNA, 17 nt, Shigella flexneri 2a str. 2457T
uauuuuuaaacaucaaa

SEQ ID NO: 1903589 - RNA, 20 nt, Shigella flexneri 2a str. 2457T
uauuuuuaaauauaaaacaa

SEQ ID NO: 1903590 - RNA, 20 nt, Shigella flexneri 2a str. 2457T
uauuuuuaaccguauuuugg

SEQ ID NO: 1903591 - RNA, 13 nt, Shigella flexneri 2a str. 2457T
uauuuuucccuga

SEQ ID NO: 1903592 - RNA, 20 nt, Shigella flexneri 2a str. 2457T
uauuuuuguugaaauaauac

SEQ ID NO: 1903593 - RNA, 15 nt, Shigella flexneri 2a str. 2457T
uauuuugaauuugca

SEQ ID NO: 1903594 - RNA, 17 nt, Shigella flexneri 2a str. 2457T
uauuuugguaaugacuc

SEQ ID NO: 1903595 - RNA, 20 nt, Shigella flexneri 2a str. 2457T
uauuuugcccugcuaugcaa

SEQ ID NO: 1903596 - RNA, 20 nt, Shigella flexneri 2a str. 2457T
uauuuugccggacgcugagc

SEQ ID NO: 1903597 - RNA, 21 nt, Shigella flexneri 2a str. 2457T
uauuuuccgagguuaauauuu

SEQ ID NO: 1903598 - RNA, 20 nt, Shigella flexneri 2a str. 2457T
uauuuuccgagguuaauauu

SEQ ID NO: 1903599 - RNA, 23 nt, Shigella flexneri 2a str. 2457T
ucaaaauauccguagugaaaaag

SEQ ID NO: 1903600 - RNA, 15 nt, Shigella flexneri 2a str. 2457T
ucaaaauuaacaccu

SEQ ID NO: 1903601 - RNA, 21 nt, Shigella flexneri 2a str. 2457T
ucaaacacaaaguccugaccu

SEQ ID NO: 1903602 - RNA, 13 nt, Shigella flexneri 2a str. 2457T
ucaaacaauuuuc

SEQ ID NO: 1903603 - RNA, 17 nt, Shigella flexneri 2a str. 2457T
ucaaaccacuuaauuau

SEQ ID NO: 1903604 - RNA, 15 nt, Shigella flexneri 2a str. 2457T
ucaaaccacuuaauu

SEQ ID NO: 1903605 - RNA, 18 nt, Shigella flexneri 2a str. 2457T
ucaaaccacuuaauuauu

SEQ ID NO: 1903606 - RNA, 21 nt, Shigella flexneri 2a str. 2457T
ucaaaccacuuaauuauuaac

SEQ ID NO: 1903607 - RNA, 19 nt, Shigella flexneri 2a str. 2457T
ucaaaccauucccugcuuu

SEQ ID NO: 1903608 - RNA, 17 nt, Shigella flexneri 2a str. 2457T
ucaaacccuucuucaau

SEQ ID NO: 1903609 - RNA, 12 nt, Shigella flexneri 2a str. 2457T
ucaaacccuucc

SEQ ID NO: 1903610 - RNA, 13 nt, Shigella flexneri 2a str. 2457T
ucaaacaggcugc

SEQ ID NO: 1903611 - RNA, 22 nt, Shigella flexneri 2a str. 2457T
ucaaacagggcaauuaaaaauu

SEQ ID NO: 1903612 - RNA, 18 nt, Shigella flexneri 2a str. 2457T
ucaaacaguucuggaaga

SEQ ID NO: 1903613 - RNA, 20 nt, Shigella flexneri 2a str. 2457T
ucaaaccaauggcauuggca

SEQ ID NO: 1903614 - RNA, 18 nt, Shigella flexneri 2a str. 2457T
ucaaacggcguuuucuca

SEQ ID NO: 1903615 - RNA, 19 nt, Shigella flexneri 2a str. 2457T
ucaaacggcguuuucucau

SEQ ID NO: 1903616 - RNA, 16 nt, Shigella flexneri 2a str. 2457T
ucaaacgccagaucac

SEQ ID NO: 1903617 - RNA, 20 nt, Shigella flexneri 2a str. 2457T
ucaaacgcugacggugccag

SEQ ID NO: 1903618 - RNA, 16 nt, Shigella flexneri 2a str. 2457T
ucaaacgaagcggcug

SEQ ID NO: 1903619 - RNA, 14 nt, Shigella flexneri 2a str. 2457T
ucaaacgccacagc

SEQ ID NO: 1903620 - RNA, 16 nt, Shigella flexneri 2a str. 2457T
ucaaacucuucacacc

SEQ ID NO: 1903621 - RNA, 14 nt, Shigella flexneri 2a str. 2457T
ucaaacucuucaca

SEQ ID NO: 1903622 - RNA, 18 nt, Shigella flexneri 2a str. 2457T
ucaaacuuuaauuuuuca

SEQ ID NO: 1903623 - RNA, 21 nt, Shigella flexneri 2a str. 2457T
ucaaacuucgucacagcggcu

SEQ ID NO: 1903624 - RNA, 15 nt, Shigella flexneri 2a str. 2457T
ucaaacuuuuaaauu

SEQ ID NO: 1903625 - RNA, 23 nt, Shigella flexneri 2a str. 2457T
ucaaacuggguuuugaucuccag

SEQ ID NO: 1903626 - RNA, 20 nt, Shigella flexneri 2a str. 2457T
ucaaagauuguuggcaaaaa

SEQ ID NO: 1903627 - RNA, 23 nt, Shigella flexneri 2a str. 2457T
ucaaagauuguuggcaaaaaaau

SEQ ID NO: 1903628 - RNA, 23 nt, Shigella flexneri 2a str. 2457T
ucaaagaugcaggaguagaacgg

SEQ ID NO: 1903629 - RNA, 19 nt, Shigella flexneri 2a str. 2457T
ucaaaguguugcaggaaaa

SEQ ID NO: 1903630 - RNA, 22 nt, Shigella flexneri 2a str. 2457T
ucaaaguuugcaccucugcugc

SEQ ID NO: 1903631 - RNA, 23 nt, Shigella flexneri 2a str. 2457T
ucaaaggcauuaaacgcauacau

SEQ ID NO: 1903632 - RNA, 20 nt, Shigella flexneri 2a str. 2457T
ucaaaggccgacagcaggcu

SEQ ID NO: 1903633 - RNA, 15 nt, Shigella flexneri 2a str. 2457T
ucaaaggcuucaacg

SEQ ID NO: 1903634 - RNA, 15 nt, Shigella flexneri 2a str. 2457T
ucaaagcugcuuuuc

SEQ ID NO: 1903635 - RNA, 14 nt, Shigella flexneri 2a str. 2457T
ucaaaguaauauuc

SEQ ID NO: 1903636 - RNA, 19 nt, Shigella flexneri 2a str. 2457T
ucaaagucgagaugaaacu

SEQ ID NO: 1903637 - RNA, 16 nt, Shigella flexneri 2a str. 2457T
ucaacauacaaauagc

SEQ ID NO: 1903638 - RNA, 14 nt, Shigella flexneri 2a str. 2457T
ucaacaugaaaaua

SEQ ID NO: 1903639 - RNA, 20 nt, Shigella flexneri 2a str. 2457T
ucaacauguuccugccaguc

SEQ ID NO: 1903640 - RNA, 19 nt, Shigella flexneri 2a str. 2457T
ucaaccaccggcaccacuu

SEQ ID NO: 1903641 - RNA, 13 nt, Shigella flexneri 2a str. 2457T
ucaaccagcacuu

SEQ ID NO: 1903642 - RNA, 15 nt, Shigella flexneri 2a str. 2457T
ucaaccaacgcaccg

SEQ ID NO: 1903643 - RNA, 19 nt, Shigella flexneri 2a str. 2457T
ucaacccuuuuuuaaacau

SEQ ID NO: 1903644 - RNA, 23 nt, Shigella flexneri 2a str. 2457T
ucaaccauaucgcauaccaucca

SEQ ID NO: 1903645 - RNA, 17 nt, Shigella flexneri 2a str. 2457T
ucaacaccaugacaaau

SEQ ID NO: 1903646 - RNA, 15 nt, Shigella flexneri 2a str. 2457T
ucaacaccgaugcaa

SEQ ID NO: 1903647 - RNA, 22 nt, Shigella flexneri 2a str. 2457T
ucaacacagugaugaaaacgaa

SEQ ID NO: 1903648 - RNA, 20 nt, Shigella flexneri 2a str. 2457T
ucaacacacugaauaaaaau

SEQ ID NO: 1903649 - RNA, 18 nt, Shigella flexneri 2a str. 2457T
ucaacagauuacauuaaa

SEQ ID NO: 1903650 - RNA, 23 nt, Shigella flexneri 2a str. 2457T
ucaacagcggcauuacgcgcccc

SEQ ID NO: 1903651 - RNA, 15 nt, Shigella flexneri 2a str. 2457T
ucaacagcaucaucg

SEQ ID NO: 1903652 - RNA, 16 nt, Shigella flexneri 2a str. 2457T
ucaacagcguuucuuc

SEQ ID NO: 1903653 - RNA, 18 nt, Shigella flexneri 2a str. 2457T
ucaacagggcagacauuc

SEQ ID NO: 1903654 - RNA, 18 nt, Shigella flexneri 2a str. 2457T
ucaacagguuuuguugcc

SEQ ID NO: 1903655 - RNA, 13 nt, Shigella flexneri 2a str. 2457T
ucaacaguaaacu

SEQ ID NO: 1903656 - RNA, 13 nt, Shigella flexneri 2a str. 2457T
ucaacaguucaug

SEQ ID NO: 1903657 - RNA, 11 nt, Shigella flexneri 2a str. 2457T
ucaacaaacca

SEQ ID NO: 1903658 - RNA, 18 nt, Shigella flexneri 2a str. 2457T
ucaacaaaccaaaaccgc

SEQ ID NO: 1903659 - RNA, 16 nt, Shigella flexneri 2a str. 2457T
ucaacaaccuugcguu

SEQ ID NO: 1903660 - RNA, 18 nt, Shigella flexneri 2a str. 2457T
ucaacaauacaaaugccu

SEQ ID NO: 1903661 - RNA, 16 nt, Shigella flexneri 2a str. 2457T
ucaacaauacgcaccg

SEQ ID NO: 1903662 - RNA, 16 nt, Shigella flexneri 2a str. 2457T
ucaacaacaauuucac

SEQ ID NO: 1903663 - RNA, 17 nt, Shigella flexneri 2a str. 2457T
ucaacaaccagaaggug

SEQ ID NO: 1903664 - RNA, 20 nt, Shigella flexneri 2a str. 2457T
ucaaauuacgauccaccacc

SEQ ID NO: 1903665 - RNA, 23 nt, Shigella flexneri 2a str. 2457T
ucaaauuugucgccaacuucaug

SEQ ID NO: 1903666 - RNA, 23 nt, Shigella flexneri 2a str. 2457T
ucaaaucaccauauucagcagca

SEQ ID NO: 1903667 - RNA, 23 nt, Shigella flexneri 2a str. 2457T
ucaaaucaugccugcgacaagaa

SEQ ID NO: 1903668 - RNA, 14 nt, Shigella flexneri 2a str. 2457T
ucaaauaucugccg

SEQ ID NO: 1903669 - RNA, 15 nt, Shigella flexneri 2a str. 2457T
ucaaauacuucaaua

SEQ ID NO: 1903670 - RNA, 20 nt, Shigella flexneri 2a str. 2457T
ucaaauguugcguucaucag

SEQ ID NO: 1903671 - RNA, 19 nt, Shigella flexneri 2a str. 2457T
ucaaauuacgauccaccac

SEQ ID NO: 1903672 - RNA, 24 nt, Shigella flexneri 2a str. 2457T
ucaaauuacagcaccuuaugcggg

SEQ ID NO: 1903673 - RNA, 23 nt, Shigella flexneri 2a str. 2457T
ucaaaucuuauaugaugaaacug

SEQ ID NO: 1903674 - RNA, 17 nt, Shigella flexneri 2a str. 2457T
ucaacugcguucugucg

SEQ ID NO: 1903675 - RNA, 23 nt, Shigella flexneri 2a str. 2457T
ucaacuccccgcauuuacucuca

SEQ ID NO: 1903676 - RNA, 21 nt, Shigella flexneri 2a str. 2457T
ucaacggcaacaauucccgca

SEQ ID NO: 1903677 - RNA, 16 nt, Shigella flexneri 2a str. 2457T
ucaacgucugcgccuu

SEQ ID NO: 1903678 - RNA, 21 nt, Shigella flexneri 2a str. 2457T
ucaacgucacuggguucaaaa

SEQ ID NO: 1903679 - RNA, 14 nt, Shigella flexneri 2a str. 2457T
ucaacgugucuuuu

SEQ ID NO: 1903680 - RNA, 22 nt, Shigella flexneri 2a str. 2457T
ucaacguucagcaucuggaaag

SEQ ID NO: 1903681 - RNA, 19 nt, Shigella flexneri 2a str. 2457T
ucaaccgcgccugaccauu

SEQ ID NO: 1903682 - RNA, 17 nt, Shigella flexneri 2a str. 2457T
ucaaccgcagugauuuc

SEQ ID NO: 1903683 - RNA, 21 nt, Shigella flexneri 2a str. 2457T
ucaaccgugacguaugaaaau

SEQ ID NO: 1903684 - RNA, 20 nt, Shigella flexneri 2a str. 2457T
ucaaccgucgcgcccuccug

SEQ ID NO: 1903685 - RNA, 14 nt, Shigella flexneri 2a str. 2457T
ucaacgaagaaaac

SEQ ID NO: 1903686 - RNA, 14 nt, Shigella flexneri 2a str. 2457T
ucaaccugaggcuc

SEQ ID NO: 1903687 - RNA, 20 nt, Shigella flexneri 2a str. 2457T
ucaacgccauacggcuauga

SEQ ID NO: 1903688 - RNA, 20 nt, Shigella flexneri 2a str. 2457T
ucaacgauuucucagcagac

SEQ ID NO: 1903689 - RNA, 14 nt, Shigella flexneri 2a str. 2457T
ucaacgcgccgcca

SEQ ID NO: 1903690 - RNA, 16 nt, Shigella flexneri 2a str. 2457T
ucaacgccgcuaucag

SEQ ID NO: 1903691 - RNA, 21 nt, Shigella flexneri 2a str. 2457T
ucaacgccgcuaucagauucg

SEQ ID NO: 1903692 - RNA, 19 nt, Shigella flexneri 2a str. 2457T
ucaacggauauuguuugcu

SEQ ID NO: 1903693 - RNA, 14 nt, Shigella flexneri 2a str. 2457T
ucaagaucaucaaa

SEQ ID NO: 1903694 - RNA, 20 nt, Shigella flexneri 2a str. 2457T
ucaagauagggaaugagcug

SEQ ID NO: 1903695 - RNA, 18 nt, Shigella flexneri 2a str. 2457T
ucaagauauuucaccagc

SEQ ID NO: 1903696 - RNA, 19 nt, Shigella flexneri 2a str. 2457T
ucaagauauuucaccagcg

SEQ ID NO: 1903697 - RNA, 15 nt, Shigella flexneri 2a str. 2457T
ucaagccauagcgcc

SEQ ID NO: 1903698 - RNA, 19 nt, Shigella flexneri 2a str. 2457T
ucaagccccagcaggaugu

SEQ ID NO: 1903699 - RNA, 20 nt, Shigella flexneri 2a str. 2457T
ucaagcccugguaacugcca

SEQ ID NO: 1903700 - RNA, 20 nt, Shigella flexneri 2a str. 2457T
ucaagcaguugguuaaucuu

SEQ ID NO: 1903701 - RNA, 19 nt, Shigella flexneri 2a str. 2457T
ucaagauuagcgacgaaca

SEQ ID NO: 1903702 - RNA, 16 nt, Shigella flexneri 2a str. 2457T
ucaacuucagcagcag

SEQ ID NO: 1903703 - RNA, 15 nt, Shigella flexneri 2a str. 2457T
ucaacuuaagucucc

SEQ ID NO: 1903704 - RNA, 18 nt, Shigella flexneri 2a str. 2457T
ucaacuuggcugggauag

SEQ ID NO: 1903705 - RNA, 23 nt, Shigella flexneri 2a str. 2457T
ucaacuuuaccuucauccuggua

SEQ ID NO: 1903706 - RNA, 13 nt, Shigella flexneri 2a str. 2457T
ucaagaauacugu

SEQ ID NO: 1903707 - RNA, 16 nt, Shigella flexneri 2a str. 2457T
ucaagaaacagcaguu

SEQ ID NO: 1903708 - RNA, 12 nt, Shigella flexneri 2a str. 2457T
ucaagaaaugca

SEQ ID NO: 1903709 - RNA, 17 nt, Shigella flexneri 2a str. 2457T
ucaagaauacuguccau

SEQ ID NO: 1903710 - RNA, 13 nt, Shigella flexneri 2a str. 2457T
uauugagaucgcu

SEQ ID NO: 1903711 - RNA, 12 nt, Shigella flexneri 2a str. 2457T
uauugaugcuca

SEQ ID NO: 1903712 - RNA, 14 nt, Shigella flexneri 2a str. 2457T
uauugaugcucacu

SEQ ID NO: 1903713 - RNA, 17 nt, Shigella flexneri 2a str. 2457T
uauugauuuaacagcaa

SEQ ID NO: 1903714 - RNA, 20 nt, Shigella flexneri 2a str. 2457T
uauugcacaguauagcauca

SEQ ID NO: 1903715 - RNA, 21 nt, Shigella flexneri 2a str. 2457T
uauugcaucgcuugaaaaggu

SEQ ID NO: 1903716 - RNA, 22 nt, Shigella flexneri 2a str. 2457T
uauugcauuggguguaaacguu

SEQ ID NO: 1903717 - RNA, 22 nt, Shigella flexneri 2a str. 2457T
uauugccaucuaaauguauucu

SEQ ID NO: 1903718 - RNA, 13 nt, Shigella flexneri 2a str. 2457T
uauugccccacac

SEQ ID NO: 1903719 - RNA, 21 nt, Shigella flexneri 2a str. 2457T
uauugcgcacaucaauuugcc

SEQ ID NO: 1903720 - RNA, 22 nt, Shigella flexneri 2a str. 2457T
uauugcuaugguccguucucac

SEQ ID NO: 1903721 - RNA, 17 nt, Shigella flexneri 2a str. 2457T
uauugcugaaauaacgu

SEQ ID NO: 1903722 - RNA, 15 nt, Shigella flexneri 2a str. 2457T
uauugguguugugaa

SEQ ID NO: 1903723 - RNA, 16 nt, Shigella flexneri 2a str. 2457T
uauuggugaauugcac

SEQ ID NO: 1903724 - RNA, 15 nt, Shigella flexneri 2a str. 2457T
uauugcuucucaggu

SEQ ID NO: 1903725 - RNA, 15 nt, Shigella flexneri 2a str. 2457T
uauugcuucaccagc

SEQ ID NO: 1903726 - RNA, 16 nt, Shigella flexneri 2a str. 2457T
uauuguugaauuccga

SEQ ID NO: 1903727 - RNA, 22 nt, Shigella flexneri 2a str. 2457T
uauuuaaaugauuacucguauu

SEQ ID NO: 1903728 - RNA, 13 nt, Shigella flexneri 2a str. 2457T
uauuguuaaauau

SEQ ID NO: 1903729 - RNA, 19 nt, Shigella flexneri 2a str. 2457T
uauuguuauucgccagacc

SEQ ID NO: 1903730 - RNA, 21 nt, Shigella flexneri 2a str. 2457T
uauuuaauggcgacauaaaau

SEQ ID NO: 1903731 - RNA, 23 nt, Shigella flexneri 2a str. 2457T
uauuuaauggcgacauaaaauaa

SEQ ID NO: 1903732 - RNA, 20 nt, Shigella flexneri 2a str. 2457T
uauuuaccgcaugcucacag

SEQ ID NO: 1903733 - RNA, 15 nt, Shigella flexneri 2a str. 2457T
uauuuaccaauauaa

SEQ ID NO: 1903734 - RNA, 16 nt, Shigella flexneri 2a str. 2457T
uauuuaccaauauaau

SEQ ID NO: 1903735 - RNA, 13 nt, Shigella flexneri 2a str. 2457T
uauuuagguaaug

SEQ ID NO: 1903736 - RNA, 19 nt, Shigella flexneri 2a str. 2457T
uauuucuucauacuaccug

SEQ ID NO: 1903737 - RNA, 14 nt, Shigella flexneri 2a str. 2457T
uauuucuugugcau

SEQ ID NO: 1903738 - RNA, 22 nt, Shigella flexneri 2a str. 2457T
uauuucuuuguagaugauuuuu

SEQ ID NO: 1903739 - RNA, 21 nt, Shigella flexneri 2a str. 2457T
uauuugcaccuaaagcgcgca

SEQ ID NO: 1903740 - RNA, 23 nt, Shigella flexneri 2a str. 2457T
uauuugccuaauaaaucuaaaac

SEQ ID NO: 1903741 - RNA, 15 nt, Shigella flexneri 2a str. 2457T
uauuuuagaaaaacu

SEQ ID NO: 1903742 - RNA, 14 nt, Shigella flexneri 2a str. 2457T
uauuuguucagcaa

SEQ ID NO: 1903743 - RNA, 19 nt, Shigella flexneri 2a str. 2457T
uauuucacauaacugccuc

SEQ ID NO: 1903744 - RNA, 13 nt, Shigella flexneri 2a str. 2457T
uauuucagcccca

SEQ ID NO: 1903745 - RNA, 22 nt, Shigella flexneri 2a str. 2457T
uauuucauagauuaauuuccca

SEQ ID NO: 1903746 - RNA, 17 nt, Shigella flexneri 2a str. 2457T
uauuuccaccucccccu

SEQ ID NO: 1903747 - RNA, 20 nt, Shigella flexneri 2a str. 2457T
uauuuccagcucaaccagau

SEQ ID NO: 1903748 - RNA, 24 nt, Shigella flexneri 2a str. 2457T
uauuucccggccaacgauaauuca

SEQ ID NO: 1903749 - RNA, 22 nt, Shigella flexneri 2a str. 2457T
uauuuccuuccuuggauauuuu

SEQ ID NO: 1903750 - RNA, 19 nt, Shigella flexneri 2a str. 2457T
uauuuccuucgcuuuaauu

SEQ ID NO: 1903751 - RNA, 16 nt, Shigella flexneri 2a str. 2457T
uauuucgaauuuucca

SEQ ID NO: 1903752 - RNA, 21 nt, Shigella flexneri 2a str. 2457T
uauuucucggcaaauucauua

SEQ ID NO: 1903753 - RNA, 16 nt, Shigella flexneri 2a str. 2457T
uauuucuauauccuca

SEQ ID NO: 1903754 - RNA, 14 nt, Shigella flexneri 2a str. 2457T
uauuucgucagcau

SEQ ID NO: 1903755 - RNA, 13 nt, Shigella flexneri 2a str. 2457T
uauuuauuuucag

SEQ ID NO: 1903756 - RNA, 15 nt, Shigella flexneri 2a str. 2457T
uauuucaaugcauua

SEQ ID NO: 1903757 - RNA, 16 nt, Shigella flexneri 2a str. 2457T
uauuucacauaacugc

SEQ ID NO: 1903758 - RNA, 21 nt, Shigella flexneri 2a str. 2457T
uauuuauauuacgaauauaaa

SEQ ID NO: 1903759 - RNA, 21 nt, Shigella flexneri 2a str. 2457T
uauuuauaggguaaauuaccu

SEQ ID NO: 1903760 - RNA, 14 nt, Shigella flexneri 2a str. 2457T
uauuuauacaguga

SEQ ID NO: 1903761 - RNA, 16 nt, Shigella flexneri 2a str. 2457T
uauuuauucaaaccaa

SEQ ID NO: 1903762 - RNA, 22 nt, Shigella flexneri 2a str. 2457T
uauuuauguggauauuauuaau

SEQ ID NO: 1903763 - RNA, 17 nt, Shigella flexneri 2a str. 2457T
uauuaguggcaaccaca

SEQ ID NO: 1903764 - RNA, 21 nt, Shigella flexneri 2a str. 2457T
uauuacguuccuuuacgguga

SEQ ID NO: 1903765 - RNA, 20 nt, Shigella flexneri 2a str. 2457T
uauuacugcguauuuccugc

SEQ ID NO: 1903766 - RNA, 14 nt, Shigella flexneri 2a str. 2457T
uauuauauauaauu

SEQ ID NO: 1903767 - RNA, 21 nt, Shigella flexneri 2a str. 2457T
uauuaagcagacggcucaucu

SEQ ID NO: 1903768 - RNA, 15 nt, Shigella flexneri 2a str. 2457T
uauuaacuuaauaaa

SEQ ID NO: 1903769 - RNA, 19 nt, Shigella flexneri 2a str. 2457T
uauuaacucagcauuauuu

SEQ ID NO: 1903770 - RNA, 18 nt, Shigella flexneri 2a str. 2457T
uauuaacgaacucuuugc

SEQ ID NO: 1903771 - RNA, 21 nt, Shigella flexneri 2a str. 2457T
uauuaacccgcaacagcaaua

SEQ ID NO: 1903772 - RNA, 22 nt, Shigella flexneri 2a str. 2457T
uauuaauccagggaucaacauu

SEQ ID NO: 1903773 - RNA, 17 nt, Shigella flexneri 2a str. 2457T
uauuaaucgugaaaagc

SEQ ID NO: 1903774 - RNA, 15 nt, Shigella flexneri 2a str. 2457T
uauucucaaaauaca

SEQ ID NO: 1903775 - RNA, 15 nt, Shigella flexneri 2a str. 2457T
uauucggcuccagau

SEQ ID NO: 1903776 - RNA, 15 nt, Shigella flexneri 2a str. 2457T
uauucgggauugcca

SEQ ID NO: 1903777 - RNA, 16 nt, Shigella flexneri 2a str. 2457T
uauucgacaccaucuu

SEQ ID NO: 1903778 - RNA, 19 nt, Shigella flexneri 2a str. 2457T
uauucgcagcgauaacauc

SEQ ID NO: 1903779 - RNA, 15 nt, Shigella flexneri 2a str. 2457T
uauucgcugauuuuu

SEQ ID NO: 1903780 - RNA, 19 nt, Shigella flexneri 2a str. 2457T
uauugaauuagcaauauuu

SEQ ID NO: 1903781 - RNA, 17 nt, Shigella flexneri 2a str. 2457T
uauugaagauguugcca

SEQ ID NO: 1903782 - RNA, 21 nt, Shigella flexneri 2a str. 2457T
uauugaagauguugccacacg

SEQ ID NO: 1903783 - RNA, 12 nt, Shigella flexneri 2a str. 2457T
uauugaagcuca

SEQ ID NO: 1903784 - RNA, 17 nt, Shigella flexneri 2a str. 2457T
uauucuuacuucaacac

SEQ ID NO: 1903785 - RNA, 23 nt, Shigella flexneri 2a str. 2457T
uauucuugcugauacuccucauu

SEQ ID NO: 1903786 - RNA, 17 nt, Shigella flexneri 2a str. 2457T
uauucuuauuaaauugu

SEQ ID NO: 1903787 - RNA, 16 nt, Shigella flexneri 2a str. 2457T
uauucuuauaaagaaa

SEQ ID NO: 1903788 - RNA, 21 nt, Shigella flexneri 2a str. 2457T
uauucuuauaaagaaaaucug

SEQ ID NO: 1903789 - RNA, 21 nt, Shigella flexneri 2a str. 2457T
uauucaggcguugaaaaauca

SEQ ID NO: 1903790 - RNA, 13 nt, Shigella flexneri 2a str. 2457T
uauucagcuuauu

SEQ ID NO: 1903791 - RNA, 14 nt, Shigella flexneri 2a str. 2457T
uauucagcaugcau

SEQ ID NO: 1903792 - RNA, 11 nt, Shigella flexneri 2a str. 2457T
uauucagcaga

SEQ ID NO: 1903793 - RNA, 17 nt, Shigella flexneri 2a str. 2457T
uauucaaucucuucaca

SEQ ID NO: 1903794 - RNA, 22 nt, Shigella flexneri 2a str. 2457T
uauucacgaaucuauucauuua

SEQ ID NO: 1903795 - RNA, 11 nt, Shigella flexneri 2a str. 2457T
uauuccccaga

SEQ ID NO: 1903796 - RNA, 21 nt, Shigella flexneri 2a str. 2457T
uauucccaacgcgccaccgac

SEQ ID NO: 1903797 - RNA, 17 nt, Shigella flexneri 2a str. 2457T
uauuccauccugcucaa

SEQ ID NO: 1903798 - RNA, 16 nt, Shigella flexneri 2a str. 2457T
uauuccugacccagca

SEQ ID NO: 1903799 - RNA, 10 nt, Shigella flexneri 2a str. 2457T
uauuccuuag

SEQ ID NO: 1903800 - RNA, 15 nt, Shigella flexneri 2a str. 2457T
uauuccuuuaucauu

SEQ ID NO: 1903801 - RNA, 14 nt, Shigella flexneri 2a str. 2457T
uauuccuuaugguu

SEQ ID NO: 1903802 - RNA, 17 nt, Shigella flexneri 2a str. 2457T
uauuccuuaugguucac

SEQ ID NO: 1903803 - RNA, 14 nt, Shigella flexneri 2a str. 2457T
uauuccauccugcu

SEQ ID NO: 1903804 - RNA, 18 nt, Shigella flexneri 2a str. 2457T
uauucauuguucucccau

SEQ ID NO: 1903805 - RNA, 14 nt, Shigella flexneri 2a str. 2457T
uauucauuuauguu

SEQ ID NO: 1903806 - RNA, 14 nt, Shigella flexneri 2a str. 2457T
uauucauaaaugcu

SEQ ID NO: 1903807 - RNA, 23 nt, Shigella flexneri 2a str. 2457T
uauucaguggcauuuagaucuau

SEQ ID NO: 1903808 - RNA, 23 nt, Shigella flexneri 2a str. 2457T
ucacaauggcacaaauggcaaug

SEQ ID NO: 1903809 - RNA, 18 nt, Shigella flexneri 2a str. 2457T
ucacaaucggcuuucacc

SEQ ID NO: 1903810 - RNA, 12 nt, Shigella flexneri 2a str. 2457T
ucacacacaucg

SEQ ID NO: 1903811 - RNA, 15 nt, Shigella flexneri 2a str. 2457T
ucacacaaccaugca

SEQ ID NO: 1903812 - RNA, 23 nt, Shigella flexneri 2a str. 2457T
ucacaaauucuggcggcaauaac

SEQ ID NO: 1903813 - RNA, 18 nt, Shigella flexneri 2a str. 2457T
ucacacccgguaucaaac

SEQ ID NO: 1903814 - RNA, 19 nt, Shigella flexneri 2a str. 2457T
ucacacccgguaucaaacc

SEQ ID NO: 1903815 - RNA, 20 nt, Shigella flexneri 2a str. 2457T
ucacaccauugauaauccau

SEQ ID NO: 1903816 - RNA, 18 nt, Shigella flexneri 2a str. 2457T
ucacaccgcgaucuucca

SEQ ID NO: 1903817 - RNA, 19 nt, Shigella flexneri 2a str. 2457T
ucacaccgcgaucuuccac

SEQ ID NO: 1903818 - RNA, 18 nt, Shigella flexneri 2a str. 2457T
ucacaccgcgcgucccug

SEQ ID NO: 1903819 - RNA, 18 nt, Shigella flexneri 2a str. 2457T
ucacacugaugacaggcu

SEQ ID NO: 1903820 - RNA, 19 nt, Shigella flexneri 2a str. 2457T
ucacacucaugauccugga

SEQ ID NO: 1903821 - RNA, 16 nt, Shigella flexneri 2a str. 2457T
ucacagaagugaagca

SEQ ID NO: 1903822 - RNA, 18 nt, Shigella flexneri 2a str. 2457T
ucacagaggggaaguuuu

SEQ ID NO: 1903823 - RNA, 22 nt, Shigella flexneri 2a str. 2457T
ucacagcuaaucaucaucagug

SEQ ID NO: 1903824 - RNA, 17 nt, Shigella flexneri 2a str. 2457T
ucacaggcacaccgccg

SEQ ID NO: 1903825 - RNA, 16 nt, Shigella flexneri 2a str. 2457T
ucacagcggcuuccac

SEQ ID NO: 1903826 - RNA, 21 nt, Shigella flexneri 2a str. 2457T
ucacagcuaaucaucaucagu

SEQ ID NO: 1903827 - RNA, 20 nt, Shigella flexneri 2a str. 2457T
ucacagcgagccuggcugga

SEQ ID NO: 1903828 - RNA, 15 nt, Shigella flexneri 2a str. 2457T
ucacauauugcagcu

SEQ ID NO: 1903829 - RNA, 15 nt, Shigella flexneri 2a str. 2457T
ucacaucaaaucccc

SEQ ID NO: 1903830 - RNA, 17 nt, Shigella flexneri 2a str. 2457T
ucacauaacggcccggc

SEQ ID NO: 1903831 - RNA, 12 nt, Shigella flexneri 2a str. 2457T
ucacauaaauuc

SEQ ID NO: 1903832 - RNA, 23 nt, Shigella flexneri 2a str. 2457T
ucacaucagcgcauuuaccaggc

SEQ ID NO: 1903833 - RNA, 14 nt, Shigella flexneri 2a str. 2457T
ucacaucagcgcau

SEQ ID NO: 1903834 - RNA, 21 nt, Shigella flexneri 2a str. 2457T
ucacauccggcaauauucauu

SEQ ID NO: 1903835 - RNA, 17 nt, Shigella flexneri 2a str. 2457T
ucacaugaguugcugga

SEQ ID NO: 1903836 - RNA, 21 nt, Shigella flexneri 2a str. 2457T
ucacaugcuggaaccacagcg

SEQ ID NO: 1903837 - RNA, 16 nt, Shigella flexneri 2a str. 2457T
ucacauuuaaacaauu

SEQ ID NO: 1903838 - RNA, 16 nt, Shigella flexneri 2a str. 2457T
ucaccaaucagaaagg

SEQ ID NO: 1903839 - RNA, 15 nt, Shigella flexneri 2a str. 2457T
ucaccacauccagcu

SEQ ID NO: 1903840 - RNA, 21 nt, Shigella flexneri 2a str. 2457T
ucaccaaugauaaguuucacu

SEQ ID NO: 1903841 - RNA, 12 nt, Shigella flexneri 2a str. 2457T
ucaccaaaggca

SEQ ID NO: 1903842 - RNA, 22 nt, Shigella flexneri 2a str. 2457T
ucaccaacaguacgguaaagcc

SEQ ID NO: 1903843 - RNA, 15 nt, Shigella flexneri 2a str. 2457T
ucaccagcacuucac

SEQ ID NO: 1903844 - RNA, 17 nt, Shigella flexneri 2a str. 2457T
ucaccagaugucccauc

SEQ ID NO: 1903845 - RNA, 21 nt, Shigella flexneri 2a str. 2457T
ucaccagaugucccaucugau

SEQ ID NO: 1903846 - RNA, 15 nt, Shigella flexneri 2a str. 2457T
ucaccagcgcacgca

SEQ ID NO: 1903847 - RNA, 12 nt, Shigella flexneri 2a str. 2457T
ucaccagcagcg

SEQ ID NO: 1903848 - RNA, 18 nt, Shigella flexneri 2a str. 2457T
ucaccagacaauggcccg

SEQ ID NO: 1903849 - RNA, 18 nt, Shigella flexneri 2a str. 2457T
ucaccacuucggcaaaaa

SEQ ID NO: 1903850 - RNA, 22 nt, Shigella flexneri 2a str. 2457T
ucaccacuucggcaaaaaaguc

SEQ ID NO: 1903851 - RNA, 20 nt, Shigella flexneri 2a str. 2457T
ucaccacgcugagagaagca

SEQ ID NO: 1903852 - RNA, 22 nt, Shigella flexneri 2a str. 2457T
ucaccauuggugauccgaggcc

SEQ ID NO: 1903853 - RNA, 13 nt, Shigella flexneri 2a str. 2457T
ucacccacaucag

SEQ ID NO: 1903854 - RNA, 13 nt, Shigella flexneri 2a str. 2457T
ucaccaucuucac

SEQ ID NO: 1903855 - RNA, 14 nt, Shigella flexneri 2a str. 2457T
ucaccaucuucacu

SEQ ID NO: 1903856 - RNA, 20 nt, Shigella flexneri 2a str. 2457T
ucaccaucuucacuguccgc

SEQ ID NO: 1903857 - RNA, 19 nt, Shigella flexneri 2a str. 2457T
ucaccauuacggugaaaau

SEQ ID NO: 1903858 - RNA, 14 nt, Shigella flexneri 2a str. 2457T
ucaccauccacgga

SEQ ID NO: 1903859 - RNA, 13 nt, Shigella flexneri 2a str. 2457T
ucaccauaaauca

SEQ ID NO: 1903860 - RNA, 16 nt, Shigella flexneri 2a str. 2457T
ucaccauauucagcag

SEQ ID NO: 1903861 - RNA, 17 nt, Shigella flexneri 2a str. 2457T
ucaccauauucagcagc

SEQ ID NO: 1903862 - RNA, 17 nt, Shigella flexneri 2a str. 2457T
ucaccguucacugccac

SEQ ID NO: 1903863 - RNA, 16 nt, Shigella flexneri 2a str. 2457T
ucaccgugauccccac

SEQ ID NO: 1903864 - RNA, 20 nt, Shigella flexneri 2a str. 2457T
ucaccgggcuuggcaccauu

SEQ ID NO: 1903865 - RNA, 21 nt, Shigella flexneri 2a str. 2457T
ucaccgggcuuggcaccauua

SEQ ID NO: 1903866 - RNA, 21 nt, Shigella flexneri 2a str. 2457T
ucaccgcgucuucgcugcuuu

SEQ ID NO: 1903867 - RNA, 12 nt, Shigella flexneri 2a str. 2457T
ucaccgccgccu

SEQ ID NO: 1903868 - RNA, 20 nt, Shigella flexneri 2a str. 2457T
ucaccgccgagacauccacu

SEQ ID NO: 1903869 - RNA, 21 nt, Shigella flexneri 2a str. 2457T
ucaccgccgccuuuuacgcau

SEQ ID NO: 1903870 - RNA, 16 nt, Shigella flexneri 2a str. 2457T
ucaccgccugaucaug

SEQ ID NO: 1903871 - RNA, 21 nt, Shigella flexneri 2a str. 2457T
ucaccgcgguguauaccagcu

SEQ ID NO: 1903872 - RNA, 21 nt, Shigella flexneri 2a str. 2457T
ucaccgcguaugcccagcgca

SEQ ID NO: 1903873 - RNA, 15 nt, Shigella flexneri 2a str. 2457T
ucaccggcaaagcca

SEQ ID NO: 1903874 - RNA, 14 nt, Shigella flexneri 2a str. 2457T
ucaccgccagcaag

SEQ ID NO: 1903875 - RNA, 15 nt, Shigella flexneri 2a str. 2457T
ucaccgccaccagcg

SEQ ID NO: 1903876 - RNA, 19 nt, Shigella flexneri 2a str. 2457T
ucaccgcaaacauaauccc

SEQ ID NO: 1903877 - RNA, 23 nt, Shigella flexneri 2a str. 2457T
ucaccgcagcaucgucaucagcu

SEQ ID NO: 1903878 - RNA, 17 nt, Shigella flexneri 2a str. 2457T
ucaccgaugaucgccau

SEQ ID NO: 1903879 - RNA, 19 nt, Shigella flexneri 2a str. 2457T
ucaccgaugcacagaaccg

SEQ ID NO: 1903880 - RNA, 19 nt, Shigella flexneri 2a str. 2457T
ucacccugugcgccaccgc

SEQ ID NO: 1903881 - RNA, 19 nt, Shigella flexneri 2a str. 2457T
ucacccggaucaauuaauc

SEQ ID NO: 1903882 - RNA, 20 nt, Shigella flexneri 2a str. 2457T
ucacccggaggaaagcaccu

SEQ ID NO: 1903883 - RNA, 20 nt, Shigella flexneri 2a str. 2457T
ucaccccuuucucgcccagc

SEQ ID NO: 1903884 - RNA, 23 nt, Shigella flexneri 2a str. 2457T
ucaauuaauucuccgcucucaau

SEQ ID NO: 1903885 - RNA, 13 nt, Shigella flexneri 2a str. 2457T
ucaauucucuaau

SEQ ID NO: 1903886 - RNA, 17 nt, Shigella flexneri 2a str. 2457T
ucaauugccaccaugca

SEQ ID NO: 1903887 - RNA, 17 nt, Shigella flexneri 2a str. 2457T
ucaauugcgcaccagcu

SEQ ID NO: 1903888 - RNA, 23 nt, Shigella flexneri 2a str. 2457T
ucaauugcuaguaaguuacauuu

SEQ ID NO: 1903889 - RNA, 18 nt, Shigella flexneri 2a str. 2457T
ucaauuuccaguuucaca

SEQ ID NO: 1903890 - RNA, 14 nt, Shigella flexneri 2a str. 2457T
ucaauuucacagua

SEQ ID NO: 1903891 - RNA, 10 nt, Shigella flexneri 2a str. 2457T
ucacaaaaag

SEQ ID NO: 1903892 - RNA, 14 nt, Shigella flexneri 2a str. 2457T
ucacaaauaaaaaa

SEQ ID NO: 1903893 - RNA, 20 nt, Shigella flexneri 2a str. 2457T
ucacaaagacgccaucaauu

SEQ ID NO: 1903894 - RNA, 19 nt, Shigella flexneri 2a str. 2457T
ucaaucauccauauuuuca

SEQ ID NO: 1903895 - RNA, 12 nt, Shigella flexneri 2a str. 2457T
ucaaucauuuuu

SEQ ID NO: 1903896 - RNA, 20 nt, Shigella flexneri 2a str. 2457T
ucaauccaguguaaaacagc

SEQ ID NO: 1903897 - RNA, 21 nt, Shigella flexneri 2a str. 2457T
ucaaucuuuuucaugcuauuc

SEQ ID NO: 1903898 - RNA, 13 nt, Shigella flexneri 2a str. 2457T
ucaaucuucucuu

SEQ ID NO: 1903899 - RNA, 18 nt, Shigella flexneri 2a str. 2457T
ucaaucucuucacagaca

SEQ ID NO: 1903900 - RNA, 14 nt, Shigella flexneri 2a str. 2457T
ucaaucucuucaca

SEQ ID NO: 1903901 - RNA, 14 nt, Shigella flexneri 2a str. 2457T
ucaaucucagcaag

SEQ ID NO: 1903902 - RNA, 18 nt, Shigella flexneri 2a str. 2457T
ucaaucguaugaucaucc

SEQ ID NO: 1903903 - RNA, 15 nt, Shigella flexneri 2a str. 2457T
ucaaucgccaccaca

SEQ ID NO: 1903904 - RNA, 18 nt, Shigella flexneri 2a str. 2457T
ucaaugccgucaccagca

SEQ ID NO: 1903905 - RNA, 17 nt, Shigella flexneri 2a str. 2457T
ucaaugcauuaaauugu

SEQ ID NO: 1903906 - RNA, 17 nt, Shigella flexneri 2a str. 2457T
ucaaugauuucugccag

SEQ ID NO: 1903907 - RNA, 18 nt, Shigella flexneri 2a str. 2457T
ucaaugauuucugccagc

SEQ ID NO: 1903908 - RNA, 21 nt, Shigella flexneri 2a str. 2457T
ucaaugauaguucaacagauu

SEQ ID NO: 1903909 - RNA, 12 nt, Shigella flexneri 2a str. 2457T
ucaaugcgaucu

SEQ ID NO: 1903910 - RNA, 20 nt, Shigella flexneri 2a str. 2457T
ucaaugguggcaaucugaau

SEQ ID NO: 1903911 - RNA, 18 nt, Shigella flexneri 2a str. 2457T
ucaauaaagugauauuuc

SEQ ID NO: 1903912 - RNA, 13 nt, Shigella flexneri 2a str. 2457T
ucaauaaacggga

SEQ ID NO: 1903913 - RNA, 13 nt, Shigella flexneri 2a str. 2457T
ucaauaaaaauac

SEQ ID NO: 1903914 - RNA, 18 nt, Shigella flexneri 2a str. 2457T
ucaagugcuuucaucaaa

SEQ ID NO: 1903915 - RNA, 20 nt, Shigella flexneri 2a str. 2457T
ucaaggauugcagcacugau

SEQ ID NO: 1903916 - RNA, 23 nt, Shigella flexneri 2a str. 2457T
ucaaggcauauaccacacccgca

SEQ ID NO: 1903917 - RNA, 19 nt, Shigella flexneri 2a str. 2457T
ucaagcgguaaccauccau

SEQ ID NO: 1903918 - RNA, 15 nt, Shigella flexneri 2a str. 2457T
ucaagcgucgcauca

SEQ ID NO: 1903919 - RNA, 21 nt, Shigella flexneri 2a str. 2457T
ucaagcgucgcaucaggcaug

SEQ ID NO: 1903920 - RNA, 18 nt, Shigella flexneri 2a str. 2457T
ucaagcugugccugaaua

SEQ ID NO: 1903921 - RNA, 16 nt, Shigella flexneri 2a str. 2457T
ucaagcuguucuuccc

SEQ ID NO: 1903922 - RNA, 13 nt, Shigella flexneri 2a str. 2457T
ucaauaaguuauc

SEQ ID NO: 1903923 - RNA, 15 nt, Shigella flexneri 2a str. 2457T
ucaauaacagcgcaa

SEQ ID NO: 1903924 - RNA, 14 nt, Shigella flexneri 2a str. 2457T
ucaauacuuuccag

SEQ ID NO: 1903925 - RNA, 16 nt, Shigella flexneri 2a str. 2457T
ucaauacuuuccagca

SEQ ID NO: 1903926 - RNA, 22 nt, Shigella flexneri 2a str. 2457T
ucaauacuuuccagcauauguu

SEQ ID NO: 1903927 - RNA, 19 nt, Shigella flexneri 2a str. 2457T
ucaauacuuucacaaaaau

SEQ ID NO: 1903928 - RNA, 20 nt, Shigella flexneri 2a str. 2457T
ucaauaccgccugcaaauaa

SEQ ID NO: 1903929 - RNA, 22 nt, Shigella flexneri 2a str. 2457T
ucaauaccgccugcaaauaaau

SEQ ID NO: 1903930 - RNA, 13 nt, Shigella flexneri 2a str. 2457T
ucaauaaucaacg

SEQ ID NO: 1903931 - RNA, 14 nt, Shigella flexneri 2a str. 2457T
ucaauaucaucauu

SEQ ID NO: 1903932 - RNA, 18 nt, Shigella flexneri 2a str. 2457T
ucaauaucaucauuugca

SEQ ID NO: 1903933 - RNA, 19 nt, Shigella flexneri 2a str. 2457T
ucaauauccugaccuuuac

SEQ ID NO: 1903934 - RNA, 20 nt, Shigella flexneri 2a str. 2457T
ucaauauuaagaaucucuga

SEQ ID NO: 1903935 - RNA, 17 nt, Shigella flexneri 2a str. 2457T
ucaauaugauaaaccuc

SEQ ID NO: 1903936 - RNA, 16 nt, Shigella flexneri 2a str. 2457T
ucaauauuuucaaucu

SEQ ID NO: 1903937 - RNA, 13 nt, Shigella flexneri 2a str. 2457T
ucaaucacaucau

SEQ ID NO: 1903938 - RNA, 15 nt, Shigella flexneri 2a str. 2457T
ucaaucaccgcuuca

SEQ ID NO: 1903939 - RNA, 17 nt, Shigella flexneri 2a str. 2457T
ucaaucaccgcuucacu

SEQ ID NO: 1903940 - RNA, 16 nt, Shigella flexneri 2a str. 2457T
ucacugugcuuuacau

SEQ ID NO: 1903941 - RNA, 21 nt, Shigella flexneri 2a str. 2457T
ucacuguucugauaguuaaaa

SEQ ID NO: 1903942 - RNA, 19 nt, Shigella flexneri 2a str. 2457T
ucacugugcuuuacaucag

SEQ ID NO: 1903943 - RNA, 18 nt, Shigella flexneri 2a str. 2457T
ucacugguagugcauccg

SEQ ID NO: 1903944 - RNA, 20 nt, Shigella flexneri 2a str. 2457T
ucacuggguucaaaaacuaa

SEQ ID NO: 1903945 - RNA, 15 nt, Shigella flexneri 2a str. 2457T
ucacuggcaaaagcc

SEQ ID NO: 1903946 - RNA, 14 nt, Shigella flexneri 2a str. 2457T
ucacuggcgucaug

SEQ ID NO: 1903947 - RNA, 23 nt, Shigella flexneri 2a str. 2457T
ucacugaugugauggccgcgcag

SEQ ID NO: 1903948 - RNA, 16 nt, Shigella flexneri 2a str. 2457T
ucacugacaccagcau

SEQ ID NO: 1903949 - RNA, 15 nt, Shigella flexneri 2a str. 2457T
ucacugccugcugau

SEQ ID NO: 1903950 - RNA, 21 nt, Shigella flexneri 2a str. 2457T
ucacugcaaauacccaaaaaa

SEQ ID NO: 1903951 - RNA, 23 nt, Shigella flexneri 2a str. 2457T
ucacugcgaaagcgucagcuuuc

SEQ ID NO: 1903952 - RNA, 16 nt, Shigella flexneri 2a str. 2457T
ucacugcuuaauauua

SEQ ID NO: 1903953 - RNA, 23 nt, Shigella flexneri 2a str. 2457T
ucacugcuuuggcucuucgcucc

SEQ ID NO: 1903954 - RNA, 12 nt, Shigella flexneri 2a str. 2457T
ucacuggcaaug

SEQ ID NO: 1903955 - RNA, 23 nt, Shigella flexneri 2a str. 2457T
ucacuucugaguucggcaugggg

SEQ ID NO: 1903956 - RNA, 18 nt, Shigella flexneri 2a str. 2457T
ucacuucgucagaaaugg

SEQ ID NO: 1903957 - RNA, 18 nt, Shigella flexneri 2a str. 2457T
ucacuuccaguacgcgca

SEQ ID NO: 1903958 - RNA, 17 nt, Shigella flexneri 2a str. 2457T
ucacuucgauccaguga

SEQ ID NO: 1903959 - RNA, 18 nt, Shigella flexneri 2a str. 2457T
ucacuuucgagcaauuuu

SEQ ID NO: 1903960 - RNA, 18 nt, Shigella flexneri 2a str. 2457T
ucacuuucggugacagaa

SEQ ID NO: 1903961 - RNA, 18 nt, Shigella flexneri 2a str. 2457T
ucacuuuuggugcuuuug

SEQ ID NO: 1903962 - RNA, 20 nt, Shigella flexneri 2a str. 2457T
ucacuuuuggugcuuuugcu

SEQ ID NO: 1903963 - RNA, 12 nt, Shigella flexneri 2a str. 2457T
ucacuugcuacc

SEQ ID NO: 1903964 - RNA, 14 nt, Shigella flexneri 2a str. 2457T
ucacuugcuguaau

SEQ ID NO: 1903965 - RNA, 20 nt, Shigella flexneri 2a str. 2457T
ucacucugcugccacauucc

SEQ ID NO: 1903966 - RNA, 16 nt, Shigella flexneri 2a str. 2457T
ucacucgacagcaccg

SEQ ID NO: 1903967 - RNA, 14 nt, Shigella flexneri 2a str. 2457T
ucacuccggccaga

SEQ ID NO: 1903968 - RNA, 16 nt, Shigella flexneri 2a str. 2457T
ucacuccacaccauau

SEQ ID NO: 1903969 - RNA, 17 nt, Shigella flexneri 2a str. 2457T
ucacucaccgcagaaua

SEQ ID NO: 1903970 - RNA, 13 nt, Shigella flexneri 2a str. 2457T
ucacucaaaauau

SEQ ID NO: 1903971 - RNA, 14 nt, Shigella flexneri 2a str. 2457T
ucacuauuaaagaa

SEQ ID NO: 1903972 - RNA, 23 nt, Shigella flexneri 2a str. 2457T
ucacuauccgccccauuuuuaac

SEQ ID NO: 1903973 - RNA, 21 nt, Shigella flexneri 2a str. 2457T
ucacuacaaccgggaucaccg

SEQ ID NO: 1903974 - RNA, 16 nt, Shigella flexneri 2a str. 2457T
ucacuaccuucuuccc

SEQ ID NO: 1903975 - RNA, 23 nt, Shigella flexneri 2a str. 2457T
ucacuacgcgaccgugggcaauu

SEQ ID NO: 1903976 - RNA, 15 nt, Shigella flexneri 2a str. 2457T
ucacgucucaucagg

SEQ ID NO: 1903977 - RNA, 16 nt, Shigella flexneri 2a str. 2457T
ucacgugacaaaaauu

SEQ ID NO: 1903978 - RNA, 14 nt, Shigella flexneri 2a str. 2457T
ucacguaggccuga

SEQ ID NO: 1903979 - RNA, 16 nt, Shigella flexneri 2a str. 2457T
ucacguaggccugaua

SEQ ID NO: 1903980 - RNA, 19 nt, Shigella flexneri 2a str. 2457T
ucacuaaggguaaaacgac

SEQ ID NO: 1903981 - RNA, 21 nt, Shigella flexneri 2a str. 2457T
ucacuaaacccgaccacuucc

SEQ ID NO: 1903982 - RNA, 18 nt, Shigella flexneri 2a str. 2457T
ucacgaaucuauucauuu

SEQ ID NO: 1903983 - RNA, 14 nt, Shigella flexneri 2a str. 2457T
ucacgaugcuaaaa

SEQ ID NO: 1903984 - RNA, 15 nt, Shigella flexneri 2a str. 2457T
ucacgauagccagaa

SEQ ID NO: 1903985 - RNA, 15 nt, Shigella flexneri 2a str. 2457T
ucacgaacacagugg

SEQ ID NO: 1903986 - RNA, 16 nt, Shigella flexneri 2a str. 2457T
ucacgaauccgcacca

SEQ ID NO: 1903987 - RNA, 15 nt, Shigella flexneri 2a str. 2457T
ucacgaaucuauuca

SEQ ID NO: 1903988 - RNA, 15 nt, Shigella flexneri 2a str. 2457T
ucacgaauauuuccc

SEQ ID NO: 1903989 - RNA, 14 nt, Shigella flexneri 2a str. 2457T
ucacgaauccgcac

SEQ ID NO: 1903990 - RNA, 22 nt, Shigella flexneri 2a str. 2457T
ucaccuugcucgcccuggaugc

SEQ ID NO: 1903991 - RNA, 13 nt, Shigella flexneri 2a str. 2457T
ucaccuuuaaccu

SEQ ID NO: 1903992 - RNA, 15 nt, Shigella flexneri 2a str. 2457T
ucaccuuuaaccucc

SEQ ID NO: 1903993 - RNA, 13 nt, Shigella flexneri 2a str. 2457T
ucaccuuuucggu

SEQ ID NO: 1903994 - RNA, 22 nt, Shigella flexneri 2a str. 2457T
ucaccugugacgacuuuuucca

SEQ ID NO: 1903995 - RNA, 23 nt, Shigella flexneri 2a str. 2457T
ucaccuuacggcacuccucuuca

SEQ ID NO: 1903996 - RNA, 13 nt, Shigella flexneri 2a str. 2457T
ucaccuuccagua

SEQ ID NO: 1903997 - RNA, 15 nt, Shigella flexneri 2a str. 2457T
ucaccugcccuccgg

SEQ ID NO: 1903998 - RNA, 13 nt, Shigella flexneri 2a str. 2457T
ucaccugcacaug

SEQ ID NO: 1903999 - RNA, 22 nt, Shigella flexneri 2a str. 2457T
ucaccucugucgaugcgcucug

SEQ ID NO: 1904000 - RNA, 22 nt, Shigella flexneri 2a str. 2457T
ucaccucuucagcguccaucca

SEQ ID NO: 1904001 - RNA, 14 nt, Shigella flexneri 2a str. 2457T
ucaccucugucgau

SEQ ID NO: 1904002 - RNA, 14 nt, Shigella flexneri 2a str. 2457T
ucaccucuuuggcg

SEQ ID NO: 1904003 - RNA, 19 nt, Shigella flexneri 2a str. 2457T
ucaccucuucauuaaacca

SEQ ID NO: 1904004 - RNA, 21 nt, Shigella flexneri 2a str. 2457T
ucaccuccagcgaaggaucac

SEQ ID NO: 1904005 - RNA, 14 nt, Shigella flexneri 2a str. 2457T
ucacgcaauaccug

SEQ ID NO: 1904006 - RNA, 13 nt, Shigella flexneri 2a str. 2457T
ucacgcaaccaca

SEQ ID NO: 1904007 - RNA, 12 nt, Shigella flexneri 2a str. 2457T
ucacgcauggac

SEQ ID NO: 1904008 - RNA, 16 nt, Shigella flexneri 2a str. 2457T
ucacgcagcgucagca

SEQ ID NO: 1904009 - RNA, 13 nt, Shigella flexneri 2a str. 2457T
ucacgccaaccag

SEQ ID NO: 1904010 - RNA, 15 nt, Shigella flexneri 2a str. 2457T
ucacgccaauaaucg

SEQ ID NO: 1904011 - RNA, 22 nt, Shigella flexneri 2a str. 2457T
ucacgccagucgcacacaacag

SEQ ID NO: 1904012 - RNA, 15 nt, Shigella flexneri 2a str. 2457T
ucacgccgcaucugg

SEQ ID NO: 1904013 - RNA, 21 nt, Shigella flexneri 2a str. 2457T
ucacgccgggaaauuuuuccg

SEQ ID NO: 1904014 - RNA, 18 nt, Shigella flexneri 2a str. 2457T
ucacgcccggaauuucaa

SEQ ID NO: 1904015 - RNA, 15 nt, Shigella flexneri 2a str. 2457T
ucacgcccgccccag

SEQ ID NO: 1904016 - RNA, 23 nt, Shigella flexneri 2a str. 2457T
ucacgccgcauccgacauuugca

SEQ ID NO: 1904017 - RNA, 14 nt, Shigella flexneri 2a str. 2457T
ucacggcaccagcc

SEQ ID NO: 1904018 - RNA, 18 nt, Shigella flexneri 2a str. 2457T
ucacggcugcuaauauuu

SEQ ID NO: 1904019 - RNA, 15 nt, Shigella flexneri 2a str. 2457T
ucacggcgcaugccu

SEQ ID NO: 1904020 - RNA, 14 nt, Shigella flexneri 2a str. 2457T
ucacgcucauccug

SEQ ID NO: 1904021 - RNA, 12 nt, Shigella flexneri 2a str. 2457T
ucacgcuaaaag

SEQ ID NO: 1904022 - RNA, 20 nt, Shigella flexneri 2a str. 2457T
ucagaauauauaaagauuca

SEQ ID NO: 1904023 - RNA, 21 nt, Shigella flexneri 2a str. 2457T
ucagaaucacgccaacaaaca

SEQ ID NO: 1904024 - RNA, 13 nt, Shigella flexneri 2a str. 2457T
ucagaauacgcug

SEQ ID NO: 1904025 - RNA, 20 nt, Shigella flexneri 2a str. 2457T
ucagaauagacaaaaauucu

SEQ ID NO: 1904026 - RNA, 18 nt, Shigella flexneri 2a str. 2457T
ucagaacacuucuucugu

SEQ ID NO: 1904027 - RNA, 20 nt, Shigella flexneri 2a str. 2457T
ucagaacgguucuugaaaau

SEQ ID NO: 1904028 - RNA, 14 nt, Shigella flexneri 2a str. 2457T
ucagaacguaaacg

SEQ ID NO: 1904029 - RNA, 21 nt, Shigella flexneri 2a str. 2457T
ucagaacguaaacgcagcauc

SEQ ID NO: 1904030 - RNA, 15 nt, Shigella flexneri 2a str. 2457T
ucagaagacgcucca

SEQ ID NO: 1904031 - RNA, 22 nt, Shigella flexneri 2a str. 2457T
ucagaaauuuggcuccucugac

SEQ ID NO: 1904032 - RNA, 20 nt, Shigella flexneri 2a str. 2457T
ucagaaaguaauuacacccu

SEQ ID NO: 1904033 - RNA, 17 nt, Shigella flexneri 2a str. 2457T
ucagaaaguaauaugug

SEQ ID NO: 1904034 - RNA, 19 nt, Shigella flexneri 2a str. 2457T
ucagaaaggcguuguccuu

SEQ ID NO: 1904035 - RNA, 19 nt, Shigella flexneri 2a str. 2457T
ucagaaacuguaauugaga

SEQ ID NO: 1904036 - RNA, 22 nt, Shigella flexneri 2a str. 2457T
ucagaaacgcucauaaauugca

SEQ ID NO: 1904037 - RNA, 14 nt, Shigella flexneri 2a str. 2457T
ucagaaacacacuu

SEQ ID NO: 1904038 - RNA, 17 nt, Shigella flexneri 2a str. 2457T
ucagaaacacacuuucc

SEQ ID NO: 1904039 - RNA, 19 nt, Shigella flexneri 2a str. 2457T
ucagaaaaauacaauucuc

SEQ ID NO: 1904040 - RNA, 19 nt, Shigella flexneri 2a str. 2457T
ucagacacgccgccagacc

SEQ ID NO: 1904041 - RNA, 17 nt, Shigella flexneri 2a str. 2457T
ucagaccgcuucugcgu

SEQ ID NO: 1904042 - RNA, 19 nt, Shigella flexneri 2a str. 2457T
ucagacccugcucuuucag

SEQ ID NO: 1904043 - RNA, 22 nt, Shigella flexneri 2a str. 2457T
ucagaccaauccagccggcaaa

SEQ ID NO: 1904044 - RNA, 15 nt, Shigella flexneri 2a str. 2457T
ucagacacaauaauu

SEQ ID NO: 1904045 - RNA, 16 nt, Shigella flexneri 2a str. 2457T
ucagacacaauaauuu

SEQ ID NO: 1904046 - RNA, 16 nt, Shigella flexneri 2a str. 2457T
ucagacaacuucccug

SEQ ID NO: 1904047 - RNA, 20 nt, Shigella flexneri 2a str. 2457T
ucagacaaaugucacugcuu

SEQ ID NO: 1904048 - RNA, 16 nt, Shigella flexneri 2a str. 2457T
ucagaccuuuuaauuu

SEQ ID NO: 1904049 - RNA, 18 nt, Shigella flexneri 2a str. 2457T
ucagacggcugucuuccu

SEQ ID NO: 1904050 - RNA, 19 nt, Shigella flexneri 2a str. 2457T
ucagacggcugucuuccug

SEQ ID NO: 1904051 - RNA, 13 nt, Shigella flexneri 2a str. 2457T
ucagacguucuuc

SEQ ID NO: 1904052 - RNA, 19 nt, Shigella flexneri 2a str. 2457T
ucagacguucuuccugugg

SEQ ID NO: 1904053 - RNA, 20 nt, Shigella flexneri 2a str. 2457T
ucagacucauauaaaaaccg

SEQ ID NO: 1904054 - RNA, 15 nt, Shigella flexneri 2a str. 2457T
ucagaggcuguuccg

SEQ ID NO: 1904055 - RNA, 14 nt, Shigella flexneri 2a str. 2457T
ucagagagccagcc

SEQ ID NO: 1904056 - RNA, 22 nt, Shigella flexneri 2a str. 2457T
ucagagagccagccccacagca

SEQ ID NO: 1904057 - RNA, 17 nt, Shigella flexneri 2a str. 2457T
ucagagauucuuuuccu

SEQ ID NO: 1904058 - RNA, 20 nt, Shigella flexneri 2a str. 2457T
ucagauaaaucacgcuucac

SEQ ID NO: 1904059 - RNA, 15 nt, Shigella flexneri 2a str. 2457T
ucagauaaaauacac

SEQ ID NO: 1904060 - RNA, 18 nt, Shigella flexneri 2a str. 2457T
ucagauaauccccaauga

SEQ ID NO: 1904061 - RNA, 16 nt, Shigella flexneri 2a str. 2457T
ucagagugccgaagaa

SEQ ID NO: 1904062 - RNA, 18 nt, Shigella flexneri 2a str. 2457T
ucagagugccgaagaaca

SEQ ID NO: 1904063 - RNA, 12 nt, Shigella flexneri 2a str. 2457T
ucagauaaaaua

SEQ ID NO: 1904064 - RNA, 15 nt, Shigella flexneri 2a str. 2457T
ucagauaaaaaguuu

SEQ ID NO: 1904065 - RNA, 22 nt, Shigella flexneri 2a str. 2457T
ucagauaaugcccgaugaccuu

SEQ ID NO: 1904066 - RNA, 21 nt, Shigella flexneri 2a str. 2457T
ucagauaauccccaaugaccu

SEQ ID NO: 1904067 - RNA, 22 nt, Shigella flexneri 2a str. 2457T
ucagauaauccccaaugaccuu

SEQ ID NO: 1904068 - RNA, 16 nt, Shigella flexneri 2a str. 2457T
ucagauuguugauuaa

SEQ ID NO: 1904069 - RNA, 21 nt, Shigella flexneri 2a str. 2457T
ucagauuaugucgcucaaugu

SEQ ID NO: 1904070 - RNA, 15 nt, Shigella flexneri 2a str. 2457T
ucagauucaaauuau

SEQ ID NO: 1904071 - RNA, 23 nt, Shigella flexneri 2a str. 2457T
ucagauuguugauuaacaggcug

SEQ ID NO: 1904072 - RNA, 18 nt, Shigella flexneri 2a str. 2457T
ucagcaaauagauaaaau

SEQ ID NO: 1904073 - RNA, 21 nt, Shigella flexneri 2a str. 2457T
ucagauguuccgccauuuuaa

SEQ ID NO: 1904074 - RNA, 22 nt, Shigella flexneri 2a str. 2457T
ucagaucguucgcaccaaaucc

SEQ ID NO: 1904075 - RNA, 18 nt, Shigella flexneri 2a str. 2457T
ucagaucuuucacgaaca

SEQ ID NO: 1904076 - RNA, 23 nt, Shigella flexneri 2a str. 2457T
ucagaugaugauacugacauuaa

SEQ ID NO: 1904077 - RNA, 15 nt, Shigella flexneri 2a str. 2457T
ucagaucauccugcg

SEQ ID NO: 1904078 - RNA, 17 nt, Shigella flexneri 2a str. 2457T
ucagauccgcacccgca

SEQ ID NO: 1904079 - RNA, 23 nt, Shigella flexneri 2a str. 2457T
ucagauccgccaguuuguagcca

SEQ ID NO: 1904080 - RNA, 16 nt, Shigella flexneri 2a str. 2457T
ucagaucguugaccug

SEQ ID NO: 1904081 - RNA, 17 nt, Shigella flexneri 2a str. 2457T
ucagaucguucgcacca

SEQ ID NO: 1904082 - RNA, 19 nt, Shigella flexneri 2a str. 2457T
ucagaucgguuuuuuucga

SEQ ID NO: 1904083 - RNA, 15 nt, Shigella flexneri 2a str. 2457T
ucagccagcuggcag

SEQ ID NO: 1904084 - RNA, 17 nt, Shigella flexneri 2a str. 2457T
ucagccagcuggcagaa

SEQ ID NO: 1904085 - RNA, 17 nt, Shigella flexneri 2a str. 2457T
ucagccagaaagaaccg

SEQ ID NO: 1904086 - RNA, 18 nt, Shigella flexneri 2a str. 2457T
ucagcccacauccaugug

SEQ ID NO: 1904087 - RNA, 13 nt, Shigella flexneri 2a str. 2457T
ucagcccagcccu

SEQ ID NO: 1904088 - RNA, 13 nt, Shigella flexneri 2a str. 2457T
ucagccccuccac

SEQ ID NO: 1904089 - RNA, 15 nt, Shigella flexneri 2a str. 2457T
ucagcccaacaaagc

SEQ ID NO: 1904090 - RNA, 13 nt, Shigella flexneri 2a str. 2457T
ucagcccaaccac

SEQ ID NO: 1904091 - RNA, 19 nt, Shigella flexneri 2a str. 2457T
ucagcccaaagcagaguug

SEQ ID NO: 1904092 - RNA, 15 nt, Shigella flexneri 2a str. 2457T
ucagcaugacaaaaa

SEQ ID NO: 1904093 - RNA, 22 nt, Shigella flexneri 2a str. 2457T
ucagcaucccaccugaaauggu

SEQ ID NO: 1904094 - RNA, 19 nt, Shigella flexneri 2a str. 2457T
ucagcauccauaucgccau

SEQ ID NO: 1904095 - RNA, 20 nt, Shigella flexneri 2a str. 2457T
ucagcauuucgcgauauugc

SEQ ID NO: 1904096 - RNA, 20 nt, Shigella flexneri 2a str. 2457T
ucagcauuuucuauuucuga

SEQ ID NO: 1904097 - RNA, 14 nt, Shigella flexneri 2a str. 2457T
ucagcaucuggaaa

SEQ ID NO: 1904098 - RNA, 15 nt, Shigella flexneri 2a str. 2457T
ucagcauuauuuuua

SEQ ID NO: 1904099 - RNA, 16 nt, Shigella flexneri 2a str. 2457T
ucagccaaauccagcg

SEQ ID NO: 1904100 - RNA, 22 nt, Shigella flexneri 2a str. 2457T
ucagccgcccgcgauaaaaauc

SEQ ID NO: 1904101 - RNA, 15 nt, Shigella flexneri 2a str. 2457T
ucagccgcacaccug

SEQ ID NO: 1904102 - RNA, 12 nt, Shigella flexneri 2a str. 2457T
ucagcaccagau

SEQ ID NO: 1904103 - RNA, 17 nt, Shigella flexneri 2a str. 2457T
ucagcaaucgcgccagc

SEQ ID NO: 1904104 - RNA, 18 nt, Shigella flexneri 2a str. 2457T
ucagcaaucgcgccagcc

SEQ ID NO: 1904105 - RNA, 16 nt, Shigella flexneri 2a str. 2457T
ucagcaaucucuucaa

SEQ ID NO: 1904106 - RNA, 16 nt, Shigella flexneri 2a str. 2457T
ucagcaauguuucucu

SEQ ID NO: 1904107 - RNA, 24 nt, Shigella flexneri 2a str. 2457T
ucagcaauaaucagauggcggcug

SEQ ID NO: 1904108 - RNA, 17 nt, Shigella flexneri 2a str. 2457T
ucagcaagcgauaauuu

SEQ ID NO: 1904109 - RNA, 18 nt, Shigella flexneri 2a str. 2457T
ucagcaagugaauaaauu

SEQ ID NO: 1904110 - RNA, 14 nt, Shigella flexneri 2a str. 2457T
ucagcagcaccacc

SEQ ID NO: 1904111 - RNA, 19 nt, Shigella flexneri 2a str. 2457T
ucagcagcagcaagauauu

SEQ ID NO: 1904112 - RNA, 22 nt, Shigella flexneri 2a str. 2457T
ucagcagcagcaagauauugau

SEQ ID NO: 1904113 - RNA, 17 nt, Shigella flexneri 2a str. 2457T
ucagcagcagacagccu

SEQ ID NO: 1904114 - RNA, 22 nt, Shigella flexneri 2a str. 2457T
ucagcagacggccaaaaucucu

SEQ ID NO: 1904115 - RNA, 23 nt, Shigella flexneri 2a str. 2457T
ucagcagcggcucggucagaccc

SEQ ID NO: 1904116 - RNA, 15 nt, Shigella flexneri 2a str. 2457T
ucagcagcucaucaa

SEQ ID NO: 1904117 - RNA, 20 nt, Shigella flexneri 2a str. 2457T
ucagcaggaauguuguccag

SEQ ID NO: 1904118 - RNA, 18 nt, Shigella flexneri 2a str. 2457T
ucagcauaaucaccagua

SEQ ID NO: 1904119 - RNA, 14 nt, Shigella flexneri 2a str. 2457T
ucagcaguucagca

SEQ ID NO: 1904120 - RNA, 16 nt, Shigella flexneri 2a str. 2457T
ucagcaguucugccag

SEQ ID NO: 1904121 - RNA, 17 nt, Shigella flexneri 2a str. 2457T
ucagcaguucugccagg

SEQ ID NO: 1904122 - RNA, 15 nt, Shigella flexneri 2a str. 2457T
ucagcauaaaaauau

SEQ ID NO: 1904123 - RNA, 20 nt, Shigella flexneri 2a str. 2457T
uagauggggccaugauuuga

SEQ ID NO: 1904124 - RNA, 16 nt, Shigella flexneri 2a str. 2457T
uagaugugcaguuccu

SEQ ID NO: 1904125 - RNA, 18 nt, Shigella flexneri 2a str. 2457T
uagaugugggcaaucuca

SEQ ID NO: 1904126 - RNA, 18 nt, Shigella flexneri 2a str. 2457T
uagaugugcaguuccugc

SEQ ID NO: 1904127 - RNA, 22 nt, Shigella flexneri 2a str. 2457T
uagaugcccggcguauagcuga

SEQ ID NO: 1904128 - RNA, 15 nt, Shigella flexneri 2a str. 2457T
uagaucuugauuuac

SEQ ID NO: 1904129 - RNA, 19 nt, Shigella flexneri 2a str. 2457T
uagaaaauaaaaaacauuc

SEQ ID NO: 1904130 - RNA, 14 nt, Shigella flexneri 2a str. 2457T
uagauucaacauaa

SEQ ID NO: 1904131 - RNA, 13 nt, Shigella flexneri 2a str. 2457T
uagauuuuuaaug

SEQ ID NO: 1904132 - RNA, 15 nt, Shigella flexneri 2a str. 2457T
uagcccggauagcgu

SEQ ID NO: 1904133 - RNA, 20 nt, Shigella flexneri 2a str. 2457T
uagcaucgcaucaggcaaug

SEQ ID NO: 1904134 - RNA, 21 nt, Shigella flexneri 2a str. 2457T
uagcaucuuaucacgaugcua

SEQ ID NO: 1904135 - RNA, 13 nt, Shigella flexneri 2a str. 2457T
uagcaucccaaua

SEQ ID NO: 1904136 - RNA, 14 nt, Shigella flexneri 2a str. 2457T
uagcaacaggccag

SEQ ID NO: 1904137 - RNA, 13 nt, Shigella flexneri 2a str. 2457T
uagcaaaguaaua

SEQ ID NO: 1904138 - RNA, 16 nt, Shigella flexneri 2a str. 2457T
uagcagcacaccacau

SEQ ID NO: 1904139 - RNA, 18 nt, Shigella flexneri 2a str. 2457T
uagcagcuuucagcagcg

SEQ ID NO: 1904140 - RNA, 20 nt, Shigella flexneri 2a str. 2457T
uagcuucagccgggaagaau

SEQ ID NO: 1904141 - RNA, 15 nt, Shigella flexneri 2a str. 2457T
uagcuauauuuugcc

SEQ ID NO: 1904142 - RNA, 18 nt, Shigella flexneri 2a str. 2457T
uaggcaaaaaaaaugccc

SEQ ID NO: 1904143 - RNA, 18 nt, Shigella flexneri 2a str. 2457T
uaggcaauuggcgcauca

SEQ ID NO: 1904144 - RNA, 23 nt, Shigella flexneri 2a str. 2457T
uaggcaauuggcgcaucaugccu

SEQ ID NO: 1904145 - RNA, 17 nt, Shigella flexneri 2a str. 2457T
uaggcaggauaaggcgu

SEQ ID NO: 1904146 - RNA, 14 nt, Shigella flexneri 2a str. 2457T
uaggcaucagcaau

SEQ ID NO: 1904147 - RNA, 19 nt, Shigella flexneri 2a str. 2457T
uaggcaucccgcaccagcg

SEQ ID NO: 1904148 - RNA, 18 nt, Shigella flexneri 2a str. 2457T
uagcgccucuuuauaaau

SEQ ID NO: 1904149 - RNA, 17 nt, Shigella flexneri 2a str. 2457T
uagcgcccgaacggaaa

SEQ ID NO: 1904150 - RNA, 22 nt, Shigella flexneri 2a str. 2457T
uagcgccggguuuuuuauuaau

SEQ ID NO: 1904151 - RNA, 15 nt, Shigella flexneri 2a str. 2457T
uagcgccguuuuuau

SEQ ID NO: 1904152 - RNA, 23 nt, Shigella flexneri 2a str. 2457T
uagccgaccgcaaggaagccuga

SEQ ID NO: 1904153 - RNA, 16 nt, Shigella flexneri 2a str. 2457T
uagcgcauaagccacc

SEQ ID NO: 1904154 - RNA, 20 nt, Shigella flexneri 2a str. 2457T
uagcccugucgaggccaauu

SEQ ID NO: 1904155 - RNA, 19 nt, Shigella flexneri 2a str. 2457T
uagcccuuuguaggccaga

SEQ ID NO: 1904156 - RNA, 16 nt, Shigella flexneri 2a str. 2457T
uagcgugacaccagca

SEQ ID NO: 1904157 - RNA, 18 nt, Shigella flexneri 2a str. 2457T
uagcguccggcugccagc

SEQ ID NO: 1904158 - RNA, 19 nt, Shigella flexneri 2a str. 2457T
uagcgucauuaaccagcca

SEQ ID NO: 1904159 - RNA, 17 nt, Shigella flexneri 2a str. 2457T
uagcggucgaugaugau

SEQ ID NO: 1904160 - RNA, 15 nt, Shigella flexneri 2a str. 2457T
uagcguaaggauuau

SEQ ID NO: 1904161 - RNA, 23 nt, Shigella flexneri 2a str. 2457T
uagcggcgacuugcucaggagua

SEQ ID NO: 1904162 - RNA, 16 nt, Shigella flexneri 2a str. 2457T
uagcggcggcagauug

SEQ ID NO: 1904163 - RNA, 21 nt, Shigella flexneri 2a str. 2457T
uagcggaaaucuccagauaau

SEQ ID NO: 1904164 - RNA, 21 nt, Shigella flexneri 2a str. 2457T
uagcggacucaccgagcagca

SEQ ID NO: 1904165 - RNA, 19 nt, Shigella flexneri 2a str. 2457T
uagcggcaggaaaaaagcg

SEQ ID NO: 1904166 - RNA, 17 nt, Shigella flexneri 2a str. 2457T
uaguacccgaucacaac

SEQ ID NO: 1904167 - RNA, 13 nt, Shigella flexneri 2a str. 2457T
uaguaauuuugaa

SEQ ID NO: 1904168 - RNA, 13 nt, Shigella flexneri 2a str. 2457T
uaguacaaauuuu

SEQ ID NO: 1904169 - RNA, 16 nt, Shigella flexneri 2a str. 2457T
uaguaagauuauauaa

SEQ ID NO: 1904170 - RNA, 17 nt, Shigella flexneri 2a str. 2457T
uaguaagauuauauaau

SEQ ID NO: 1904171 - RNA, 18 nt, Shigella flexneri 2a str. 2457T
uaguaaauucacugccug

SEQ ID NO: 1904172 - RNA, 14 nt, Shigella flexneri 2a str. 2457T
uaggcuggaucaga

SEQ ID NO: 1904173 - RNA, 23 nt, Shigella flexneri 2a str. 2457T
uaggucuuugacgucgaaacuga

SEQ ID NO: 1904174 - RNA, 15 nt, Shigella flexneri 2a str. 2457T
uagguggcaccugac

SEQ ID NO: 1904175 - RNA, 21 nt, Shigella flexneri 2a str. 2457T
uagugaugccauacuucauaa

SEQ ID NO: 1904176 - RNA, 13 nt, Shigella flexneri 2a str. 2457T
uagucaucaucag

SEQ ID NO: 1904177 - RNA, 18 nt, Shigella flexneri 2a str. 2457T
uagucaucaucaggaaca

SEQ ID NO: 1904178 - RNA, 20 nt, Shigella flexneri 2a str. 2457T
uaguccacacgccaggccac

SEQ ID NO: 1904179 - RNA, 12 nt, Shigella flexneri 2a str. 2457T
uaguaucuauuc

SEQ ID NO: 1904180 - RNA, 16 nt, Shigella flexneri 2a str. 2457T
uaguaucgcucaauau

SEQ ID NO: 1904181 - RNA, 13 nt, Shigella flexneri 2a str. 2457T
uaguauuaagcca

SEQ ID NO: 1904182 - RNA, 23 nt, Shigella flexneri 2a str. 2457T
uaguauuuucuuugacaaauucc

SEQ ID NO: 1904183 - RNA, 16 nt, Shigella flexneri 2a str. 2457T
uaguauuguuaaauau

SEQ ID NO: 1904184 - RNA, 21 nt, Shigella flexneri 2a str. 2457T
uaguaguucauccccucuucc

SEQ ID NO: 1904185 - RNA, 13 nt, Shigella flexneri 2a str. 2457T
uaguagaagagga

SEQ ID NO: 1904186 - RNA, 14 nt, Shigella flexneri 2a str. 2457T
uaguagaagaggaa

SEQ ID NO: 1904187 - RNA, 13 nt, Shigella flexneri 2a str. 2457T
uauaacugcgguc

SEQ ID NO: 1904188 - RNA, 12 nt, Shigella flexneri 2a str. 2457T
uauaagcucaau

SEQ ID NO: 1904189 - RNA, 16 nt, Shigella flexneri 2a str. 2457T
uauaagcguuacgcag

SEQ ID NO: 1904190 - RNA, 18 nt, Shigella flexneri 2a str. 2457T
uauaaccggcaacagaac

SEQ ID NO: 1904191 - RNA, 22 nt, Shigella flexneri 2a str. 2457T
uauaacccccuccuuuuaucau

SEQ ID NO: 1904192 - RNA, 16 nt, Shigella flexneri 2a str. 2457T
uauaaccugaauauua

SEQ ID NO: 1904193 - RNA, 15 nt, Shigella flexneri 2a str. 2457T
uauaacauuuuucuc

SEQ ID NO: 1904194 - RNA, 11 nt, Shigella flexneri 2a str. 2457T
uauaaaaaccg

SEQ ID NO: 1904195 - RNA, 19 nt, Shigella flexneri 2a str. 2457T
uaguuuacuucuauaauga

SEQ ID NO: 1904196 - RNA, 16 nt, Shigella flexneri 2a str. 2457T
uaguuuaaacauuuuu

SEQ ID NO: 1904197 - RNA, 16 nt, Shigella flexneri 2a str. 2457T
uaguuguaaucauauu

SEQ ID NO: 1904198 - RNA, 22 nt, Shigella flexneri 2a str. 2457T
uagugccgaggguucccccuca

SEQ ID NO: 1904199 - RNA, 17 nt, Shigella flexneri 2a str. 2457T
uagugccgcacuugcca

SEQ ID NO: 1904200 - RNA, 22 nt, Shigella flexneri 2a str. 2457T
uaguucauccccucuuccauuu

SEQ ID NO: 1904201 - RNA, 19 nt, Shigella flexneri 2a str. 2457T
uaguucauccccucuucca

SEQ ID NO: 1904202 - RNA, 13 nt, Shigella flexneri 2a str. 2457T
uaguucauccccu

SEQ ID NO: 1904203 - RNA, 17 nt, Shigella flexneri 2a str. 2457T
uaguugauuaauuucau

SEQ ID NO: 1904204 - RNA, 17 nt, Shigella flexneri 2a str. 2457T
uaguucgcguaacugcu

SEQ ID NO: 1904205 - RNA, 13 nt, Shigella flexneri 2a str. 2457T
uaucggcaucgcu

SEQ ID NO: 1904206 - RNA, 21 nt, Shigella flexneri 2a str. 2457T
uaucgcugauauacccuucau

SEQ ID NO: 1904207 - RNA, 23 nt, Shigella flexneri 2a str. 2457T
uaucgcugauauacccuucauca

SEQ ID NO: 1904208 - RNA, 23 nt, Shigella flexneri 2a str. 2457T
uaucgccucuaaaguauguaaua

SEQ ID NO: 1904209 - RNA, 22 nt, Shigella flexneri 2a str. 2457T
uaucgcgucaacagggcagaca

SEQ ID NO: 1904210 - RNA, 18 nt, Shigella flexneri 2a str. 2457T
uaucgcgccaucaaaucu

SEQ ID NO: 1904211 - RNA, 15 nt, Shigella flexneri 2a str. 2457T
uaucgcgcagaaauu

SEQ ID NO: 1904212 - RNA, 16 nt, Shigella flexneri 2a str. 2457T
uaucgcgaugauuuuc

SEQ ID NO: 1904213 - RNA, 18 nt, Shigella flexneri 2a str. 2457T
uaucgcgaaaaaaagaug

SEQ ID NO: 1904214 - RNA, 14 nt, Shigella flexneri 2a str. 2457T
uauccugauaaaaa

SEQ ID NO: 1904215 - RNA, 20 nt, Shigella flexneri 2a str. 2457T
uauccugcccacuccagcua

SEQ ID NO: 1904216 - RNA, 15 nt, Shigella flexneri 2a str. 2457T
uaucgccagcgccac

SEQ ID NO: 1904217 - RNA, 20 nt, Shigella flexneri 2a str. 2457T
uauccuguggacgcagcuca

SEQ ID NO: 1904218 - RNA, 24 nt, Shigella flexneri 2a str. 2457T
uaucgugccuacacauuaucucaa

SEQ ID NO: 1904219 - RNA, 19 nt, Shigella flexneri 2a str. 2457T
uaucgugacaauaauaccc

SEQ ID NO: 1904220 - RNA, 23 nt, Shigella flexneri 2a str. 2457T
uaucguagccccagucuuccugc

SEQ ID NO: 1904221 - RNA, 13 nt, Shigella flexneri 2a str. 2457T
uaucggguuuguu

SEQ ID NO: 1904222 - RNA, 14 nt, Shigella flexneri 2a str. 2457T
uaucuccucugcuu

SEQ ID NO: 1904223 - RNA, 18 nt, Shigella flexneri 2a str. 2457T
uaucucagauaaaugcaa

SEQ ID NO: 1904224 - RNA, 13 nt, Shigella flexneri 2a str. 2457T
uaucucaaaaauu

SEQ ID NO: 1904225 - RNA, 17 nt, Shigella flexneri 2a str. 2457T
uaucuauuucaggucaa

SEQ ID NO: 1904226 - RNA, 12 nt, Shigella flexneri 2a str. 2457T
uaucuauucauc

SEQ ID NO: 1904227 - RNA, 14 nt, Shigella flexneri 2a str. 2457T
uaucagaccgcuuc

SEQ ID NO: 1904228 - RNA, 17 nt, Shigella flexneri 2a str. 2457T
uaucagaagauuaagag

SEQ ID NO: 1904229 - RNA, 20 nt, Shigella flexneri 2a str. 2457T
uaucagagauaaccacguuc

SEQ ID NO: 1904230 - RNA, 17 nt, Shigella flexneri 2a str. 2457T
uaucagagauucuuuuc

SEQ ID NO: 1904231 - RNA, 21 nt, Shigella flexneri 2a str. 2457T
uaucagagauucuuuuccuuu

SEQ ID NO: 1904232 - RNA, 16 nt, Shigella flexneri 2a str. 2457T
uaucauucgacaacug

SEQ ID NO: 1904233 - RNA, 17 nt, Shigella flexneri 2a str. 2457T
uaucagcaaagcaaauu

SEQ ID NO: 1904234 - RNA, 12 nt, Shigella flexneri 2a str. 2457T
uaucagcaacuc

SEQ ID NO: 1904235 - RNA, 19 nt, Shigella flexneri 2a str. 2457T
uaucagcaacuggcaaaaa

SEQ ID NO: 1904236 - RNA, 18 nt, Shigella flexneri 2a str. 2457T
uaucauuuuacguugcau

SEQ ID NO: 1904237 - RNA, 16 nt, Shigella flexneri 2a str. 2457T
uaucauuuugcugcca

SEQ ID NO: 1904238 - RNA, 20 nt, Shigella flexneri 2a str. 2457T
uauccauuugugacauuaac

SEQ ID NO: 1904239 - RNA, 20 nt, Shigella flexneri 2a str. 2457T
uauccaucaaagguuuuuca

SEQ ID NO: 1904240 - RNA, 19 nt, Shigella flexneri 2a str. 2457T
uauccauauggcugcauuc

SEQ ID NO: 1904241 - RNA, 20 nt, Shigella flexneri 2a str. 2457T
uauccaccgggguaaaucca

SEQ ID NO: 1904242 - RNA, 21 nt, Shigella flexneri 2a str. 2457T
uauccacgauacgcugcacaa

SEQ ID NO: 1904243 - RNA, 21 nt, Shigella flexneri 2a str. 2457T
uauccacgcgauacuuuuuca

SEQ ID NO: 1904244 - RNA, 21 nt, Shigella flexneri 2a str. 2457T
uauccggcacuuacuuuccuu

SEQ ID NO: 1904245 - RNA, 15 nt, Shigella flexneri 2a str. 2457T
uauccggcuaacaaa

SEQ ID NO: 1904246 - RNA, 18 nt, Shigella flexneri 2a str. 2457T
uauaugauaauuauuaua

SEQ ID NO: 1904247 - RNA, 17 nt, Shigella flexneri 2a str. 2457T
uauaugaugaaacugau

SEQ ID NO: 1904248 - RNA, 21 nt, Shigella flexneri 2a str. 2457T
uauauggugagcgauauuuau

SEQ ID NO: 1904249 - RNA, 13 nt, Shigella flexneri 2a str. 2457T
uauauuucaucaa

SEQ ID NO: 1904250 - RNA, 21 nt, Shigella flexneri 2a str. 2457T
uauauuuccagacaucuguua

SEQ ID NO: 1904251 - RNA, 21 nt, Shigella flexneri 2a str. 2457T
uauauuuccccuguugcaaac

SEQ ID NO: 1904252 - RNA, 15 nt, Shigella flexneri 2a str. 2457T
uaucaaacccuucca

SEQ ID NO: 1904253 - RNA, 15 nt, Shigella flexneri 2a str. 2457T
uauauuuuuaaauau

SEQ ID NO: 1904254 - RNA, 13 nt, Shigella flexneri 2a str. 2457T
uauauuuuuaaau

SEQ ID NO: 1904255 - RNA, 16 nt, Shigella flexneri 2a str. 2457T
uaucaaauucauugcg

SEQ ID NO: 1904256 - RNA, 15 nt, Shigella flexneri 2a str. 2457T
uaucaaacugaccuu

SEQ ID NO: 1904257 - RNA, 18 nt, Shigella flexneri 2a str. 2457T
uaucacgaugcuaaaaac

SEQ ID NO: 1904258 - RNA, 21 nt, Shigella flexneri 2a str. 2457T
uaucacucggggcuuuucucu

SEQ ID NO: 1904259 - RNA, 13 nt, Shigella flexneri 2a str. 2457T
uaucacucugccg

SEQ ID NO: 1904260 - RNA, 14 nt, Shigella flexneri 2a str. 2457T
uauauaauuaaaaa

SEQ ID NO: 1904261 - RNA, 15 nt, Shigella flexneri 2a str. 2457T
uauauaauuaaaaau

SEQ ID NO: 1904262 - RNA, 14 nt, Shigella flexneri 2a str. 2457T
uauaucccauuuuu

SEQ ID NO: 1904263 - RNA, 17 nt, Shigella flexneri 2a str. 2457T
uauaucccauuuuugaa

SEQ ID NO: 1904264 - RNA, 16 nt, Shigella flexneri 2a str. 2457T
uauauccgaaaaagga

SEQ ID NO: 1904265 - RNA, 17 nt, Shigella flexneri 2a str. 2457T
uauauccgaaaaaggau

SEQ ID NO: 1904266 - RNA, 22 nt, Shigella flexneri 2a str. 2457T
uauagugauccugcauacugac

SEQ ID NO: 1904267 - RNA, 13 nt, Shigella flexneri 2a str. 2457T
uauagucaauaag

SEQ ID NO: 1904268 - RNA, 21 nt, Shigella flexneri 2a str. 2457T
uauaaucaccaaucacaacua

SEQ ID NO: 1904269 - RNA, 22 nt, Shigella flexneri 2a str. 2457T
uauaaucgcgaauagcuucaaa

SEQ ID NO: 1904270 - RNA, 17 nt, Shigella flexneri 2a str. 2457T
uaugcccagggcaaugu

SEQ ID NO: 1904271 - RNA, 13 nt, Shigella flexneri 2a str. 2457T
uaugcccagggca

SEQ ID NO: 1904272 - RNA, 13 nt, Shigella flexneri 2a str. 2457T
uaugccucuuuca

SEQ ID NO: 1904273 - RNA, 22 nt, Shigella flexneri 2a str. 2457T
uaugccaugcgauggcggcagc

SEQ ID NO: 1904274 - RNA, 14 nt, Shigella flexneri 2a str. 2457T
uaugcccagcgcag

SEQ ID NO: 1904275 - RNA, 13 nt, Shigella flexneri 2a str. 2457T
uaugcauuauaug

SEQ ID NO: 1904276 - RNA, 12 nt, Shigella flexneri 2a str. 2457T
uaugccagcccc

SEQ ID NO: 1904277 - RNA, 15 nt, Shigella flexneri 2a str. 2457T
uaugccagccccagc

SEQ ID NO: 1904278 - RNA, 24 nt, Shigella flexneri 2a str. 2457T
uaugccacgugagcuuuucugcuu

SEQ ID NO: 1904279 - RNA, 14 nt, Shigella flexneri 2a str. 2457T
uaugcgcuggcagu

SEQ ID NO: 1904280 - RNA, 15 nt, Shigella flexneri 2a str. 2457T
uaugcgccuuuacca

SEQ ID NO: 1904281 - RNA, 13 nt, Shigella flexneri 2a str. 2457T
uaugcgccagacu

SEQ ID NO: 1904282 - RNA, 17 nt, Shigella flexneri 2a str. 2457T
uaugcgggcguuuugcu

SEQ ID NO: 1904283 - RNA, 17 nt, Shigella flexneri 2a str. 2457T
uaugcgcgucagagauu

SEQ ID NO: 1904284 - RNA, 22 nt, Shigella flexneri 2a str. 2457T
uaugcugaaugaucggauaucu

SEQ ID NO: 1904285 - RNA, 19 nt, Shigella flexneri 2a str. 2457T
uauggccguuuuccccaac

SEQ ID NO: 1904286 - RNA, 17 nt, Shigella flexneri 2a str. 2457T
uauggcaccuguugcca

SEQ ID NO: 1904287 - RNA, 18 nt, Shigella flexneri 2a str. 2457T
uaugugcuucuaccauga

SEQ ID NO: 1904288 - RNA, 18 nt, Shigella flexneri 2a str. 2457T
uauguggaaacagugauu

SEQ ID NO: 1904289 - RNA, 19 nt, Shigella flexneri 2a str. 2457T
uaugugacuggaaaucaaa

SEQ ID NO: 1904290 - RNA, 16 nt, Shigella flexneri 2a str. 2457T
uaugucguuauauaaa

SEQ ID NO: 1904291 - RNA, 15 nt, Shigella flexneri 2a str. 2457T
uaugugaucuuuauc

SEQ ID NO: 1904292 - RNA, 22 nt, Shigella flexneri 2a str. 2457T
uaugugaucuuuaucacacaga

SEQ ID NO: 1904293 - RNA, 22 nt, Shigella flexneri 2a str. 2457T
uauguucagaaagcgccagcaa

SEQ ID NO: 1904294 - RNA, 22 nt, Shigella flexneri 2a str. 2457T
uauguucaggauauuuauauuu

SEQ ID NO: 1904295 - RNA, 16 nt, Shigella flexneri 2a str. 2457T
uauguuuaucaggcca

SEQ ID NO: 1904296 - RNA, 14 nt, Shigella flexneri 2a str. 2457T
uaugucauuaaccg

SEQ ID NO: 1904297 - RNA, 21 nt, Shigella flexneri 2a str. 2457T
uaugguugccgggcuggagag

SEQ ID NO: 1904298 - RNA, 15 nt, Shigella flexneri 2a str. 2457T
uauggucguuugccu

SEQ ID NO: 1904299 - RNA, 21 nt, Shigella flexneri 2a str. 2457T
uaugggcgaauaaaaagccua

SEQ ID NO: 1904300 - RNA, 17 nt, Shigella flexneri 2a str. 2457T
uaugaagaacaaguuca

SEQ ID NO: 1904301 - RNA, 22 nt, Shigella flexneri 2a str. 2457T
uaugaauagcggaaaucuccag

SEQ ID NO: 1904302 - RNA, 19 nt, Shigella flexneri 2a str. 2457T
uaugaauagcggaaaucuc

SEQ ID NO: 1904303 - RNA, 15 nt, Shigella flexneri 2a str. 2457T
uaugaaugauaaaau

SEQ ID NO: 1904304 - RNA, 19 nt, Shigella flexneri 2a str. 2457T
uaugaaugauaaaauucau

SEQ ID NO: 1904305 - RNA, 17 nt, Shigella flexneri 2a str. 2457T
uaugaaagaaaaucaau

SEQ ID NO: 1904306 - RNA, 22 nt, Shigella flexneri 2a str. 2457T
uaucuuuuucgguauauaacgc

SEQ ID NO: 1904307 - RNA, 11 nt, Shigella flexneri 2a str. 2457T
uaugaaacaac

SEQ ID NO: 1904308 - RNA, 15 nt, Shigella flexneri 2a str. 2457T
uaucuuuauuaucaa

SEQ ID NO: 1904309 - RNA, 17 nt, Shigella flexneri 2a str. 2457T
uaucugcugcuugcggu

SEQ ID NO: 1904310 - RNA, 15 nt, Shigella flexneri 2a str. 2457T
uaucuggcaacuuau

SEQ ID NO: 1904311 - RNA, 15 nt, Shigella flexneri 2a str. 2457T
uaucuggccuacaaa

SEQ ID NO: 1904312 - RNA, 11 nt, Shigella flexneri 2a str. 2457T
uaucuggcaag

SEQ ID NO: 1904313 - RNA, 21 nt, Shigella flexneri 2a str. 2457T
uaugauaggucauaucacaaa

SEQ ID NO: 1904314 - RNA, 17 nt, Shigella flexneri 2a str. 2457T
uaugagucguaaacaac

SEQ ID NO: 1904315 - RNA, 20 nt, Shigella flexneri 2a str. 2457T
uaugagcgauuuuuuauagu

SEQ ID NO: 1904316 - RNA, 12 nt, Shigella flexneri 2a str. 2457T
uaugcagccuuu

SEQ ID NO: 1904317 - RNA, 16 nt, Shigella flexneri 2a str. 2457T
uaugcaagauguuaau

SEQ ID NO: 1904318 - RNA, 14 nt, Shigella flexneri 2a str. 2457T
uaugcacucagucg

SEQ ID NO: 1904319 - RNA, 13 nt, Shigella flexneri 2a str. 2457T
uaugauuuuccug

SEQ ID NO: 1904320 - RNA, 14 nt, Shigella flexneri 2a str. 2457T
uaugaugaaacuga

SEQ ID NO: 1904321 - RNA, 18 nt, Shigella flexneri 2a str. 2457T
uaugaugcgacuugucau

SEQ ID NO: 1904322 - RNA, 14 nt, Shigella flexneri 2a str. 2457T
uaugauuuaaaaaa

SEQ ID NO: 1904323 - RNA, 17 nt, Shigella flexneri 2a str. 2457T
uaugauuaauuacacca

SEQ ID NO: 1904324 - RNA, 16 nt, Shigella flexneri 2a str. 2457T
uacuggugcaaaaccu

SEQ ID NO: 1904325 - RNA, 18 nt, Shigella flexneri 2a str. 2457T
uacuggugcaaaaccugg

SEQ ID NO: 1904326 - RNA, 13 nt, Shigella flexneri 2a str. 2457T
uacugggaagaau

SEQ ID NO: 1904327 - RNA, 21 nt, Shigella flexneri 2a str. 2457T
uacugggaagaauggaaaaaa

SEQ ID NO: 1904328 - RNA, 14 nt, Shigella flexneri 2a str. 2457T
uacugggccgccug

SEQ ID NO: 1904329 - RNA, 16 nt, Shigella flexneri 2a str. 2457T
uacugggcggcaaaau

SEQ ID NO: 1904330 - RNA, 11 nt, Shigella flexneri 2a str. 2457T
uacuggcaaua

SEQ ID NO: 1904331 - RNA, 22 nt, Shigella flexneri 2a str. 2457T
uacuggcaaucgccagcggcag

SEQ ID NO: 1904332 - RNA, 23 nt, Shigella flexneri 2a str. 2457T
uacuggcaccgaagcccaucagu

SEQ ID NO: 1904333 - RNA, 23 nt, Shigella flexneri 2a str. 2457T
uacuguauacgggcuuuuuaauu

SEQ ID NO: 1904334 - RNA, 19 nt, Shigella flexneri 2a str. 2457T
uacuguauacgggcuuuuu

SEQ ID NO: 1904335 - RNA, 15 nt, Shigella flexneri 2a str. 2457T
uacuguacagauccg

SEQ ID NO: 1904336 - RNA, 21 nt, Shigella flexneri 2a str. 2457T
uacuucagacggucagcgaga

SEQ ID NO: 1904337 - RNA, 12 nt, Shigella flexneri 2a str. 2457T
uacuucagcaag

SEQ ID NO: 1904338 - RNA, 15 nt, Shigella flexneri 2a str. 2457T
uacuuugccuuucau

SEQ ID NO: 1904339 - RNA, 18 nt, Shigella flexneri 2a str. 2457T
uacuuucacaaaaauaau

SEQ ID NO: 1904340 - RNA, 16 nt, Shigella flexneri 2a str. 2457T
uacuuuccagccacag

SEQ ID NO: 1904341 - RNA, 17 nt, Shigella flexneri 2a str. 2457T
uacuuuuuucacccaca

SEQ ID NO: 1904342 - RNA, 17 nt, Shigella flexneri 2a str. 2457T
uacuuuucaggauggua

SEQ ID NO: 1904343 - RNA, 16 nt, Shigella flexneri 2a str. 2457T
uacuugcaagaucgcg

SEQ ID NO: 1904344 - RNA, 15 nt, Shigella flexneri 2a str. 2457T
uacuucugaccagga

SEQ ID NO: 1904345 - RNA, 14 nt, Shigella flexneri 2a str. 2457T
uacuuucacaaaaa

SEQ ID NO: 1904346 - RNA, 18 nt, Shigella flexneri 2a str. 2457T
uacugaaggcgcauugcu

SEQ ID NO: 1904347 - RNA, 15 nt, Shigella flexneri 2a str. 2457T
uacugacaauuugcc

SEQ ID NO: 1904348 - RNA, 21 nt, Shigella flexneri 2a str. 2457T
uacugacaauuugcccaugua

SEQ ID NO: 1904349 - RNA, 11 nt, Shigella flexneri 2a str. 2457T
uacugacauca

SEQ ID NO: 1904350 - RNA, 16 nt, Shigella flexneri 2a str. 2457T
uacugacaucaaaccc

SEQ ID NO: 1904351 - RNA, 17 nt, Shigella flexneri 2a str. 2457T
uacugaaucccugcgaa

SEQ ID NO: 1904352 - RNA, 15 nt, Shigella flexneri 2a str. 2457T
uacugacauuaacgu

SEQ ID NO: 1904353 - RNA, 21 nt, Shigella flexneri 2a str. 2457T
uacugaccgucgccuucaacg

SEQ ID NO: 1904354 - RNA, 21 nt, Shigella flexneri 2a str. 2457T
uacugaccccaaaaaguugga

SEQ ID NO: 1904355 - RNA, 16 nt, Shigella flexneri 2a str. 2457T
uacucuuugacaacau

SEQ ID NO: 1904356 - RNA, 19 nt, Shigella flexneri 2a str. 2457T
uacucuuugaacagccaga

SEQ ID NO: 1904357 - RNA, 13 nt, Shigella flexneri 2a str. 2457T
uacugaaaccuga

SEQ ID NO: 1904358 - RNA, 18 nt, Shigella flexneri 2a str. 2457T
uacucuugugccaguuca

SEQ ID NO: 1904359 - RNA, 23 nt, Shigella flexneri 2a str. 2457T
uacucuuaucaaacgacagcgug

SEQ ID NO: 1904360 - RNA, 22 nt, Shigella flexneri 2a str. 2457T
uacugauugacgcguucgcuaa

SEQ ID NO: 1904361 - RNA, 14 nt, Shigella flexneri 2a str. 2457T
uacugaucaucauu

SEQ ID NO: 1904362 - RNA, 18 nt, Shigella flexneri 2a str. 2457T
uacugauaauuuuuucac

SEQ ID NO: 1904363 - RNA, 20 nt, Shigella flexneri 2a str. 2457T
uacugauaauuuuuucacua

SEQ ID NO: 1904364 - RNA, 23 nt, Shigella flexneri 2a str. 2457T
uacugaggccggaugucgcugcu

SEQ ID NO: 1904365 - RNA, 21 nt, Shigella flexneri 2a str. 2457T
uacugacggaucccgccaaca

SEQ ID NO: 1904366 - RNA, 14 nt, Shigella flexneri 2a str. 2457T
uacugacuggcaag

SEQ ID NO: 1904367 - RNA, 20 nt, Shigella flexneri 2a str. 2457T
uacugagaacgcaauggucg

SEQ ID NO: 1904368 - RNA, 21 nt, Shigella flexneri 2a str. 2457T
uacugcucagacggugaccag

SEQ ID NO: 1904369 - RNA, 16 nt, Shigella flexneri 2a str. 2457T
uacucccgcauacauu

SEQ ID NO: 1904370 - RNA, 20 nt, Shigella flexneri 2a str. 2457T
uacuccuuagcaacaggcca

SEQ ID NO: 1904371 - RNA, 16 nt, Shigella flexneri 2a str. 2457T
uacucaccagacaucc

SEQ ID NO: 1904372 - RNA, 12 nt, Shigella flexneri 2a str. 2457T
uacucaacuccc

SEQ ID NO: 1904373 - RNA, 14 nt, Shigella flexneri 2a str. 2457T
uacucaagcagcca

SEQ ID NO: 1904374 - RNA, 14 nt, Shigella flexneri 2a str. 2457T
uacucagcgccugc

SEQ ID NO: 1904375 - RNA, 20 nt, Shigella flexneri 2a str. 2457T
uacucagcaacuuccugcuu

SEQ ID NO: 1904376 - RNA, 14 nt, Shigella flexneri 2a str. 2457T
uaccccugauuuug

SEQ ID NO: 1904377 - RNA, 15 nt, Shigella flexneri 2a str. 2457T
uaccccuucauccac

SEQ ID NO: 1904378 - RNA, 15 nt, Shigella flexneri 2a str. 2457T
uacccaaucccccac

SEQ ID NO: 1904379 - RNA, 13 nt, Shigella flexneri 2a str. 2457T
uacccugacccag

SEQ ID NO: 1904380 - RNA, 14 nt, Shigella flexneri 2a str. 2457T
uaccgauccccgga

SEQ ID NO: 1904381 - RNA, 17 nt, Shigella flexneri 2a str. 2457T
uacccuucgucaaucag

SEQ ID NO: 1904382 - RNA, 17 nt, Shigella flexneri 2a str. 2457T
uacccugugacagacua

SEQ ID NO: 1904383 - RNA, 23 nt, Shigella flexneri 2a str. 2457T
uaccgcaacucauuuacagaaac

SEQ ID NO: 1904384 - RNA, 16 nt, Shigella flexneri 2a str. 2457T
uaccgccagcaggaac

SEQ ID NO: 1904385 - RNA, 14 nt, Shigella flexneri 2a str. 2457T
uaccgccagaccac

SEQ ID NO: 1904386 - RNA, 18 nt, Shigella flexneri 2a str. 2457T
uaccgcagugaaauuucu

SEQ ID NO: 1904387 - RNA, 18 nt, Shigella flexneri 2a str. 2457T
uaccgcccaccaccagcg

SEQ ID NO: 1904388 - RNA, 14 nt, Shigella flexneri 2a str. 2457T
uaccgcgaagaaca

SEQ ID NO: 1904389 - RNA, 13 nt, Shigella flexneri 2a str. 2457T
uaccgcgguugau

SEQ ID NO: 1904390 - RNA, 16 nt, Shigella flexneri 2a str. 2457T
uaccgccuuacgcugc

SEQ ID NO: 1904391 - RNA, 17 nt, Shigella flexneri 2a str. 2457T
uaccgcguaauacauca

SEQ ID NO: 1904392 - RNA, 21 nt, Shigella flexneri 2a str. 2457T
uaccgcugcuggcguugucau

SEQ ID NO: 1904393 - RNA, 17 nt, Shigella flexneri 2a str. 2457T
uaccggugacagcggug

SEQ ID NO: 1904394 - RNA, 16 nt, Shigella flexneri 2a str. 2457T
uaccgggucgcacugg

SEQ ID NO: 1904395 - RNA, 19 nt, Shigella flexneri 2a str. 2457T
uaccggcuggcgcauacca

SEQ ID NO: 1904396 - RNA, 13 nt, Shigella flexneri 2a str. 2457T
uaccgggaugcug

SEQ ID NO: 1904397 - RNA, 11 nt, Shigella flexneri 2a str. 2457T
uacauacugag

SEQ ID NO: 1904398 - RNA, 15 nt, Shigella flexneri 2a str. 2457T
uacauacugagaacc

SEQ ID NO: 1904399 - RNA, 16 nt, Shigella flexneri 2a str. 2457T
uacauacgcaaaaaac

SEQ ID NO: 1904400 - RNA, 18 nt, Shigella flexneri 2a str. 2457T
uacauacgcaaaaaacau

SEQ ID NO: 1904401 - RNA, 19 nt, Shigella flexneri 2a str. 2457T
uacauacgcaaaaaacauu

SEQ ID NO: 1904402 - RNA, 21 nt, Shigella flexneri 2a str. 2457T
uacauagccaucugccugauc

SEQ ID NO: 1904403 - RNA, 20 nt, Shigella flexneri 2a str. 2457T
uaccaccugcucgucauccg

SEQ ID NO: 1904404 - RNA, 20 nt, Shigella flexneri 2a str. 2457T
uacauagcgccucuuuauaa

SEQ ID NO: 1904405 - RNA, 22 nt, Shigella flexneri 2a str. 2457T
uaccacgcacagcccgccgcca

SEQ ID NO: 1904406 - RNA, 15 nt, Shigella flexneri 2a str. 2457T
uaccacgauuuugac

SEQ ID NO: 1904407 - RNA, 17 nt, Shigella flexneri 2a str. 2457T
uaccacgcaaagcacgc

SEQ ID NO: 1904408 - RNA, 16 nt, Shigella flexneri 2a str. 2457T
uaccacgcacagcccg

SEQ ID NO: 1904409 - RNA, 22 nt, Shigella flexneri 2a str. 2457T
uaccaccuuacuuacacaucaa

SEQ ID NO: 1904410 - RNA, 15 nt, Shigella flexneri 2a str. 2457T
uaccacuuccagcag

SEQ ID NO: 1904411 - RNA, 13 nt, Shigella flexneri 2a str. 2457T
uaccacuacauca

SEQ ID NO: 1904412 - RNA, 20 nt, Shigella flexneri 2a str. 2457T
uaccagcaacgcuucaacca

SEQ ID NO: 1904413 - RNA, 16 nt, Shigella flexneri 2a str. 2457T
uaccagcaccugcuug

SEQ ID NO: 1904414 - RNA, 22 nt, Shigella flexneri 2a str. 2457T
uaccagaugcucuuuucugaag

SEQ ID NO: 1904415 - RNA, 19 nt, Shigella flexneri 2a str. 2457T
uaccagauaaucaccugcc

SEQ ID NO: 1904416 - RNA, 22 nt, Shigella flexneri 2a str. 2457T
uaccagccccgaugccaucaug

SEQ ID NO: 1904417 - RNA, 14 nt, Shigella flexneri 2a str. 2457T
uaccagcgccgcca

SEQ ID NO: 1904418 - RNA, 20 nt, Shigella flexneri 2a str. 2457T
uaccagcgacaucaccgccg

SEQ ID NO: 1904419 - RNA, 19 nt, Shigella flexneri 2a str. 2457T
uaccaggcgguaugguaaa

SEQ ID NO: 1904420 - RNA, 23 nt, Shigella flexneri 2a str. 2457T
uacccaaccgauaaccacgcuca

SEQ ID NO: 1904421 - RNA, 13 nt, Shigella flexneri 2a str. 2457T
uacgucaucccaa

SEQ ID NO: 1904422 - RNA, 18 nt, Shigella flexneri 2a str. 2457T
uacgggcggcuuugaaau

SEQ ID NO: 1904423 - RNA, 15 nt, Shigella flexneri 2a str. 2457T
uacguaauuuauaau

SEQ ID NO: 1904424 - RNA, 19 nt, Shigella flexneri 2a str. 2457T
uacguaccacgcacagccc

SEQ ID NO: 1904425 - RNA, 16 nt, Shigella flexneri 2a str. 2457T
uacgggcaaucuccug

SEQ ID NO: 1904426 - RNA, 19 nt, Shigella flexneri 2a str. 2457T
uacgggcaccaguaacgau

SEQ ID NO: 1904427 - RNA, 13 nt, Shigella flexneri 2a str. 2457T
uacggcauucugc

SEQ ID NO: 1904428 - RNA, 15 nt, Shigella flexneri 2a str. 2457T
uacggcacuccucuu

SEQ ID NO: 1904429 - RNA, 19 nt, Shigella flexneri 2a str. 2457T
uacggauauguuuacuucu

SEQ ID NO: 1904430 - RNA, 19 nt, Shigella flexneri 2a str. 2457T
uacggcuccgcaagcgaau

SEQ ID NO: 1904431 - RNA, 14 nt, Shigella flexneri 2a str. 2457T
uacggcuaaaaaaa

SEQ ID NO: 1904432 - RNA, 12 nt, Shigella flexneri 2a str. 2457T
uacggcagugaa

SEQ ID NO: 1904433 - RNA, 15 nt, Shigella flexneri 2a str. 2457T
uacgcgccccuucca

SEQ ID NO: 1904434 - RNA, 15 nt, Shigella flexneri 2a str. 2457T
uacgcauaaaaccag

SEQ ID NO: 1904435 - RNA, 22 nt, Shigella flexneri 2a str. 2457T
uacgcauaaaaccagcaaacag

SEQ ID NO: 1904436 - RNA, 17 nt, Shigella flexneri 2a str. 2457T
uacgauguguggcaucg

SEQ ID NO: 1904437 - RNA, 18 nt, Shigella flexneri 2a str. 2457T
uacgcagauauucguuca

SEQ ID NO: 1904438 - RNA, 19 nt, Shigella flexneri 2a str. 2457T
uacgcucacgcgcugccuc

SEQ ID NO: 1904439 - RNA, 22 nt, Shigella flexneri 2a str. 2457T
uacggaaugauauuggucacca

SEQ ID NO: 1904440 - RNA, 19 nt, Shigella flexneri 2a str. 2457T
uacggacgcggcauuuuua

SEQ ID NO: 1904441 - RNA, 17 nt, Shigella flexneri 2a str. 2457T
uacgcguaaaacagcca

SEQ ID NO: 1904442 - RNA, 22 nt, Shigella flexneri 2a str. 2457T
uacgcguaaaugcguugcuggc

SEQ ID NO: 1904443 - RNA, 18 nt, Shigella flexneri 2a str. 2457T
uacgcguacacuuuccug

SEQ ID NO: 1904444 - RNA, 15 nt, Shigella flexneri 2a str. 2457T
uaccuucauuugcca

SEQ ID NO: 1904445 - RNA, 17 nt, Shigella flexneri 2a str. 2457T
uaccuuccacaauggca

SEQ ID NO: 1904446 - RNA, 22 nt, Shigella flexneri 2a str. 2457T
uaccuucguuauauccaggcag

SEQ ID NO: 1904447 - RNA, 17 nt, Shigella flexneri 2a str. 2457T
uaccuucaacacuggca

SEQ ID NO: 1904448 - RNA, 12 nt, Shigella flexneri 2a str. 2457T
uaccuucuuccc

SEQ ID NO: 1904449 - RNA, 14 nt, Shigella flexneri 2a str. 2457T
uaccuugcugcucc

SEQ ID NO: 1904450 - RNA, 18 nt, Shigella flexneri 2a str. 2457T
uaccgguuucaauccagg

SEQ ID NO: 1904451 - RNA, 17 nt, Shigella flexneri 2a str. 2457T
uaccuaacauuuuacuu

SEQ ID NO: 1904452 - RNA, 16 nt, Shigella flexneri 2a str. 2457T
uaccuaaggaauccag

SEQ ID NO: 1904453 - RNA, 18 nt, Shigella flexneri 2a str. 2457T
uaccuuucgauuucucuu

SEQ ID NO: 1904454 - RNA, 16 nt, Shigella flexneri 2a str. 2457T
uacgauccugguggua

SEQ ID NO: 1904455 - RNA, 22 nt, Shigella flexneri 2a str. 2457T
uacgaucaagauugauccccgc

SEQ ID NO: 1904456 - RNA, 19 nt, Shigella flexneri 2a str. 2457T
uacgagugcgcucuucaac

SEQ ID NO: 1904457 - RNA, 14 nt, Shigella flexneri 2a str. 2457T
uaauuuuuccagca

SEQ ID NO: 1904458 - RNA, 18 nt, Shigella flexneri 2a str. 2457T
uaauuuuucaaacucuuc

SEQ ID NO: 1904459 - RNA, 23 nt, Shigella flexneri 2a str. 2457T
uaauuuuuauauagccagccuca

SEQ ID NO: 1904460 - RNA, 23 nt, Shigella flexneri 2a str. 2457T
uaauuuuuccagcauuucuucca

SEQ ID NO: 1904461 - RNA, 23 nt, Shigella flexneri 2a str. 2457T
uaauuuuuucgccaacuucgauu

SEQ ID NO: 1904462 - RNA, 14 nt, Shigella flexneri 2a str. 2457T
uaauuuuuucuucc

SEQ ID NO: 1904463 - RNA, 15 nt, Shigella flexneri 2a str. 2457T
uaauuuuuugcgcca

SEQ ID NO: 1904464 - RNA, 15 nt, Shigella flexneri 2a str. 2457T
uacaaaaaaugugaa

SEQ ID NO: 1904465 - RNA, 23 nt, Shigella flexneri 2a str. 2457T
uacaaaaccacacuucuucagcc

SEQ ID NO: 1904466 - RNA, 16 nt, Shigella flexneri 2a str. 2457T
uacaaaaucuauugca

SEQ ID NO: 1904467 - RNA, 15 nt, Shigella flexneri 2a str. 2457T
uaauuuccagcagug

SEQ ID NO: 1904468 - RNA, 19 nt, Shigella flexneri 2a str. 2457T
uaauuucauuuugauauuu

SEQ ID NO: 1904469 - RNA, 13 nt, Shigella flexneri 2a str. 2457T
uaauuuccacgcc

SEQ ID NO: 1904470 - RNA, 16 nt, Shigella flexneri 2a str. 2457T
uaauuucaauggggug

SEQ ID NO: 1904471 - RNA, 11 nt, Shigella flexneri 2a str. 2457T
uaauuucacaa

SEQ ID NO: 1904472 - RNA, 20 nt, Shigella flexneri 2a str. 2457T
uaauuucacaccaucaacaa

SEQ ID NO: 1904473 - RNA, 20 nt, Shigella flexneri 2a str. 2457T
uaauuugcggaauuuuuccg

SEQ ID NO: 1904474 - RNA, 18 nt, Shigella flexneri 2a str. 2457T
uaauuucggcagcgcgcu

SEQ ID NO: 1904475 - RNA, 19 nt, Shigella flexneri 2a str. 2457T
uaauuuagugaccaaucau

SEQ ID NO: 1904476 - RNA, 19 nt, Shigella flexneri 2a str. 2457T
uacaguaugagcaaacaau

SEQ ID NO: 1904477 - RNA, 18 nt, Shigella flexneri 2a str. 2457T
uacagucuggcgaacucu

SEQ ID NO: 1904478 - RNA, 20 nt, Shigella flexneri 2a str. 2457T
uacaggauauauuucaucaa

SEQ ID NO: 1904479 - RNA, 15 nt, Shigella flexneri 2a str. 2457T
uacaggaacagccac

SEQ ID NO: 1904480 - RNA, 15 nt, Shigella flexneri 2a str. 2457T
uacagcguuaaaaag

SEQ ID NO: 1904481 - RNA, 22 nt, Shigella flexneri 2a str. 2457T
uacagcuucacgcgccagcuua

SEQ ID NO: 1904482 - RNA, 16 nt, Shigella flexneri 2a str. 2457T
uacagcucucacuuau

SEQ ID NO: 1904483 - RNA, 13 nt, Shigella flexneri 2a str. 2457T
uacagcucgguau

SEQ ID NO: 1904484 - RNA, 22 nt, Shigella flexneri 2a str. 2457T
uacaccuuaaggcuguucccac

SEQ ID NO: 1904485 - RNA, 20 nt, Shigella flexneri 2a str. 2457T
uacagcagccauucauucaa

SEQ ID NO: 1904486 - RNA, 14 nt, Shigella flexneri 2a str. 2457T
uacagcauugucuc

SEQ ID NO: 1904487 - RNA, 14 nt, Shigella flexneri 2a str. 2457T
uacagcauuuccuu

SEQ ID NO: 1904488 - RNA, 18 nt, Shigella flexneri 2a str. 2457T
uacagccaaaucaucagu

SEQ ID NO: 1904489 - RNA, 23 nt, Shigella flexneri 2a str. 2457T
uacagccagccagcaccaggcuu

SEQ ID NO: 1904490 - RNA, 21 nt, Shigella flexneri 2a str. 2457T
uacagcaguacgccgagaaua

SEQ ID NO: 1904491 - RNA, 20 nt, Shigella flexneri 2a str. 2457T
uacaccggcaacguuuucaa

SEQ ID NO: 1904492 - RNA, 14 nt, Shigella flexneri 2a str. 2457T
uacacccagccccg

SEQ ID NO: 1904493 - RNA, 23 nt, Shigella flexneri 2a str. 2457T
uacacccagccccgguuuuucug

SEQ ID NO: 1904494 - RNA, 14 nt, Shigella flexneri 2a str. 2457T
uacaccaaagcggu

SEQ ID NO: 1904495 - RNA, 17 nt, Shigella flexneri 2a str. 2457T
uacaauuuacguuuuaa

SEQ ID NO: 1904496 - RNA, 23 nt, Shigella flexneri 2a str. 2457T
uacaauuuacguuuuaaaccuac

SEQ ID NO: 1904497 - RNA, 22 nt, Shigella flexneri 2a str. 2457T
uacaauguuucugcaauauauu

SEQ ID NO: 1904498 - RNA, 19 nt, Shigella flexneri 2a str. 2457T
uacaagcaacuugcaaucu

SEQ ID NO: 1904499 - RNA, 21 nt, Shigella flexneri 2a str. 2457T
uacaaguccguugaaaaugcu

SEQ ID NO: 1904500 - RNA, 12 nt, Shigella flexneri 2a str. 2457T
uacaacuuucuc

SEQ ID NO: 1904501 - RNA, 15 nt, Shigella flexneri 2a str. 2457T
uacaacuuacgcagu

SEQ ID NO: 1904502 - RNA, 17 nt, Shigella flexneri 2a str. 2457T
uaauccacagcaaugca

SEQ ID NO: 1904503 - RNA, 15 nt, Shigella flexneri 2a str. 2457T
uaaucccuucccgca

SEQ ID NO: 1904504 - RNA, 15 nt, Shigella flexneri 2a str. 2457T
uaaucaucucuccuu

SEQ ID NO: 1904505 - RNA, 15 nt, Shigella flexneri 2a str. 2457T
uaauccguaaagccc

SEQ ID NO: 1904506 - RNA, 15 nt, Shigella flexneri 2a str. 2457T
uaaucgaaaacauca

SEQ ID NO: 1904507 - RNA, 22 nt, Shigella flexneri 2a str. 2457T
uaauccugaguuaagcaaaaaa

SEQ ID NO: 1904508 - RNA, 15 nt, Shigella flexneri 2a str. 2457T
uaaucaccaaucaca

SEQ ID NO: 1904509 - RNA, 12 nt, Shigella flexneri 2a str. 2457T
uaaucaccagcg

SEQ ID NO: 1904510 - RNA, 18 nt, Shigella flexneri 2a str. 2457T
uaaucaucccacaugaau

SEQ ID NO: 1904511 - RNA, 21 nt, Shigella flexneri 2a str. 2457T
uaauauucaacgucacugggu

SEQ ID NO: 1904512 - RNA, 17 nt, Shigella flexneri 2a str. 2457T
uaauaucuuuucuuaac

SEQ ID NO: 1904513 - RNA, 13 nt, Shigella flexneri 2a str. 2457T
uaauauuuaucuu

SEQ ID NO: 1904514 - RNA, 16 nt, Shigella flexneri 2a str. 2457T
uaauauugauauccgc

SEQ ID NO: 1904515 - RNA, 19 nt, Shigella flexneri 2a str. 2457T
uaacgugcagcuuucccuu

SEQ ID NO: 1904516 - RNA, 15 nt, Shigella flexneri 2a str. 2457T
uaacguuauauccca

SEQ ID NO: 1904517 - RNA, 17 nt, Shigella flexneri 2a str. 2457T
uaacguuauaucccauu

SEQ ID NO: 1904518 - RNA, 21 nt, Shigella flexneri 2a str. 2457T
uaacggaggacuuauggcugg

SEQ ID NO: 1904519 - RNA, 14 nt, Shigella flexneri 2a str. 2457T
uaacggaauugcca

SEQ ID NO: 1904520 - RNA, 17 nt, Shigella flexneri 2a str. 2457T
uaacggaauugccaacg

SEQ ID NO: 1904521 - RNA, 18 nt, Shigella flexneri 2a str. 2457T
uaacgcuugcugauaacg

SEQ ID NO: 1904522 - RNA, 13 nt, Shigella flexneri 2a str. 2457T
uaacgcuggggau

SEQ ID NO: 1904523 - RNA, 19 nt, Shigella flexneri 2a str. 2457T
uaauaggcaggcaucauca

SEQ ID NO: 1904524 - RNA, 23 nt, Shigella flexneri 2a str. 2457T
uaauauccaggcccaggaaaacg

SEQ ID NO: 1904525 - RNA, 17 nt, Shigella flexneri 2a str. 2457T
uaauaucuccagcuaua

SEQ ID NO: 1904526 - RNA, 16 nt, Shigella flexneri 2a str. 2457T
uaauaucccuuccucc

SEQ ID NO: 1904527 - RNA, 23 nt, Shigella flexneri 2a str. 2457T
uaauaucccuuccucccuuucac

SEQ ID NO: 1904528 - RNA, 19 nt, Shigella flexneri 2a str. 2457T
uaauauccggugcauucau

SEQ ID NO: 1904529 - RNA, 12 nt, Shigella flexneri 2a str. 2457T
uaauauaacagc

SEQ ID NO: 1904530 - RNA, 19 nt, Shigella flexneri 2a str. 2457T
uaauucaggaaauuaccgc

SEQ ID NO: 1904531 - RNA, 15 nt, Shigella flexneri 2a str. 2457T
uaauucaaaaaccug

SEQ ID NO: 1904532 - RNA, 14 nt, Shigella flexneri 2a str. 2457T
uaauuauccugugg

SEQ ID NO: 1904533 - RNA, 15 nt, Shigella flexneri 2a str. 2457T
uaauuauuauaauaa

SEQ ID NO: 1904534 - RNA, 12 nt, Shigella flexneri 2a str. 2457T
uaauuacugaga

SEQ ID NO: 1904535 - RNA, 24 nt, Shigella flexneri 2a str. 2457T
uaauuaccuuaucaaucucagcaa

SEQ ID NO: 1904536 - RNA, 14 nt, Shigella flexneri 2a str. 2457T
uaauuacacccuua

SEQ ID NO: 1904537 - RNA, 15 nt, Shigella flexneri 2a str. 2457T
uaauuacacccuuaa

SEQ ID NO: 1904538 - RNA, 13 nt, Shigella flexneri 2a str. 2457T
uaauuaaaaauag

SEQ ID NO: 1904539 - RNA, 21 nt, Shigella flexneri 2a str. 2457T
uaauggcuggggaauauuuaa

SEQ ID NO: 1904540 - RNA, 22 nt, Shigella flexneri 2a str. 2457T
uaauggcuggggaauauuuaau

SEQ ID NO: 1904541 - RNA, 18 nt, Shigella flexneri 2a str. 2457T
uaaugauuuaaaaccacu

SEQ ID NO: 1904542 - RNA, 19 nt, Shigella flexneri 2a str. 2457T
uaaugcaggcagcacugcu

SEQ ID NO: 1904543 - RNA, 15 nt, Shigella flexneri 2a str. 2457T
uaaugcaaaaugccg

SEQ ID NO: 1904544 - RNA, 15 nt, Shigella flexneri 2a str. 2457T
uaaugcgcuuccugc

SEQ ID NO: 1904545 - RNA, 14 nt, Shigella flexneri 2a str. 2457T
uaaugcgcuuuuac

SEQ ID NO: 1904546 - RNA, 19 nt, Shigella flexneri 2a str. 2457T
uaaugcgacaacagaaaua

SEQ ID NO: 1904547 - RNA, 22 nt, Shigella flexneri 2a str. 2457T
uaaugccugcacuuugugucag

SEQ ID NO: 1904548 - RNA, 23 nt, Shigella flexneri 2a str. 2457T
uaaugcccaucucuucuucaagc

SEQ ID NO: 1904549 - RNA, 13 nt, Shigella flexneri 2a str. 2457T
uaaugccacauua

SEQ ID NO: 1904550 - RNA, 21 nt, Shigella flexneri 2a str. 2457T
uaaugccagucaguuaagcaa

SEQ ID NO: 1904551 - RNA, 13 nt, Shigella flexneri 2a str. 2457T
uaaugccaguccc

SEQ ID NO: 1904552 - RNA, 22 nt, Shigella flexneri 2a str. 2457T
uaaugccaaucuucacaucauc

SEQ ID NO: 1904553 - RNA, 21 nt, Shigella flexneri 2a str. 2457T
uaaugcccgaugaccuuguca

SEQ ID NO: 1904554 - RNA, 16 nt, Shigella flexneri 2a str. 2457T
uaaugccucuccccag

SEQ ID NO: 1904555 - RNA, 19 nt, Shigella flexneri 2a str. 2457T
uaaugagaauaaucaccuu

SEQ ID NO: 1904556 - RNA, 13 nt, Shigella flexneri 2a str. 2457T
uaaugagcacaga

SEQ ID NO: 1904557 - RNA, 21 nt, Shigella flexneri 2a str. 2457T
uaaugacuuuuggaccacgga

SEQ ID NO: 1904558 - RNA, 14 nt, Shigella flexneri 2a str. 2457T
uaaugagcagaaaa

SEQ ID NO: 1904559 - RNA, 21 nt, Shigella flexneri 2a str. 2457T
uaaugaaucgucggaauggca

SEQ ID NO: 1904560 - RNA, 13 nt, Shigella flexneri 2a str. 2457T
uaaucgaaccaaa

SEQ ID NO: 1904561 - RNA, 13 nt, Shigella flexneri 2a str. 2457T
ggcaucgggcagc

SEQ ID NO: 1904562 - RNA, 15 nt, Shigella flexneri 2a str. 2457T
ggcaucggugcacaa

SEQ ID NO: 1904563 - RNA, 20 nt, Shigella flexneri 2a str. 2457T
ggcaguaugcucagaauaug

SEQ ID NO: 1904564 - RNA, 16 nt, Shigella flexneri 2a str. 2457T
ggcaguacgcggcggu

SEQ ID NO: 1904565 - RNA, 19 nt, Shigella flexneri 2a str. 2457T
ggcauacaacgccaugaag

SEQ ID NO: 1904566 - RNA, 10 nt, Shigella flexneri 2a str. 2457T
ggcaucaaac

SEQ ID NO: 1904567 - RNA, 13 nt, Shigella flexneri 2a str. 2457T
ggcagcgaagggu

SEQ ID NO: 1904568 - RNA, 12 nt, Shigella flexneri 2a str. 2457T
ggcagccuuucu

SEQ ID NO: 1904569 - RNA, 13 nt, Shigella flexneri 2a str. 2457T
ggcagcuccagca

SEQ ID NO: 1904570 - RNA, 17 nt, Shigella flexneri 2a str. 2457T
ggcaggaaaaaagcgcu

SEQ ID NO: 1904571 - RNA, 14 nt, Shigella flexneri 2a str. 2457T
ggcaggaguggcag

SEQ ID NO: 1904572 - RNA, 16 nt, Shigella flexneri 2a str. 2457T
ggcaggccuggguaaa

SEQ ID NO: 1904573 - RNA, 15 nt, Shigella flexneri 2a str. 2457T
ggcaggccuaacaca

SEQ ID NO: 1904574 - RNA, 22 nt, Shigella flexneri 2a str. 2457T
ggcaggaugcccaugccaauua

SEQ ID NO: 1904575 - RNA, 14 nt, Shigella flexneri 2a str. 2457T
ggcaggccaaaaaa

SEQ ID NO: 1904576 - RNA, 20 nt, Shigella flexneri 2a str. 2457T
ggcagcaauugucgcagaag

SEQ ID NO: 1904577 - RNA, 14 nt, Shigella flexneri 2a str. 2457T
ggcagcauguguaa

SEQ ID NO: 1904578 - RNA, 20 nt, Shigella flexneri 2a str. 2457T
ggcagccaccgccagcgggu

SEQ ID NO: 1904579 - RNA, 23 nt, Shigella flexneri 2a str. 2457T
ggcagccagccaugcggcaucuu

SEQ ID NO: 1904580 - RNA, 21 nt, Shigella flexneri 2a str. 2457T
ggcagccaguucgagaaaaau

SEQ ID NO: 1904581 - RNA, 22 nt, Shigella flexneri 2a str. 2457T
ggcagccaguucgagaaaaaua

SEQ ID NO: 1904582 - RNA, 17 nt, Shigella flexneri 2a str. 2457T
ggcacguugcugcggcg

SEQ ID NO: 1904583 - RNA, 22 nt, Shigella flexneri 2a str. 2457T
ggcagacgcucgccauuuuuca

SEQ ID NO: 1904584 - RNA, 16 nt, Shigella flexneri 2a str. 2457T
ggcagcaaucacugcc

SEQ ID NO: 1904585 - RNA, 23 nt, Shigella flexneri 2a str. 2457T
ggcagcaaggcuauucagcaguu

SEQ ID NO: 1904586 - RNA, 15 nt, Shigella flexneri 2a str. 2457T
ggcagaguugccacc

SEQ ID NO: 1904587 - RNA, 21 nt, Shigella flexneri 2a str. 2457T
ggcaccaaucaccgccagcaa

SEQ ID NO: 1904588 - RNA, 22 nt, Shigella flexneri 2a str. 2457T
ggcaccaaucaccgccagcaag

SEQ ID NO: 1904589 - RNA, 20 nt, Shigella flexneri 2a str. 2457T
ggcacauccagauuuuucag

SEQ ID NO: 1904590 - RNA, 21 nt, Shigella flexneri 2a str. 2457T
ggcaccaccuggcuugccggg

SEQ ID NO: 1904591 - RNA, 21 nt, Shigella flexneri 2a str. 2457T
ggcaccagcgcacaguuauaa

SEQ ID NO: 1904592 - RNA, 15 nt, Shigella flexneri 2a str. 2457T
ggcacagcaggccaa

SEQ ID NO: 1904593 - RNA, 16 nt, Shigella flexneri 2a str. 2457T
ggcaaacuacaaaucc

SEQ ID NO: 1904594 - RNA, 18 nt, Shigella flexneri 2a str. 2457T
ggcaaacagcacggucag

SEQ ID NO: 1904595 - RNA, 13 nt, Shigella flexneri 2a str. 2457T
ggcaaacgcccuu

SEQ ID NO: 1904596 - RNA, 13 nt, Shigella flexneri 2a str. 2457T
ggcacgcccgcgc

SEQ ID NO: 1904597 - RNA, 20 nt, Shigella flexneri 2a str. 2457T
ggcaccgccaaagauaaaau

SEQ ID NO: 1904598 - RNA, 19 nt, Shigella flexneri 2a str. 2457T
ggcacgaaagguuccaaua

SEQ ID NO: 1904599 - RNA, 17 nt, Shigella flexneri 2a str. 2457T
ggcccgcgugccggaag

SEQ ID NO: 1904600 - RNA, 15 nt, Shigella flexneri 2a str. 2457T
ggccgaagaggaacu

SEQ ID NO: 1904601 - RNA, 21 nt, Shigella flexneri 2a str. 2457T
ggccgcaaaccagcgcauggc

SEQ ID NO: 1904602 - RNA, 18 nt, Shigella flexneri 2a str. 2457T
ggccgcaaaccagcgcau

SEQ ID NO: 1904603 - RNA, 14 nt, Shigella flexneri 2a str. 2457T
ggccgacagcaggc

SEQ ID NO: 1904604 - RNA, 14 nt, Shigella flexneri 2a str. 2457T
ggcccagccgugaa

SEQ ID NO: 1904605 - RNA, 12 nt, Shigella flexneri 2a str. 2457T
ggcccaucaucu

SEQ ID NO: 1904606 - RNA, 16 nt, Shigella flexneri 2a str. 2457T
ggccaugcggcgagga

SEQ ID NO: 1904607 - RNA, 17 nt, Shigella flexneri 2a str. 2457T
ggccauugaauauuuuu

SEQ ID NO: 1904608 - RNA, 23 nt, Shigella flexneri 2a str. 2457T
ggccauugaauauuuuucgucag

SEQ ID NO: 1904609 - RNA, 15 nt, Shigella flexneri 2a str. 2457T
ggccauuacuacccu

SEQ ID NO: 1904610 - RNA, 14 nt, Shigella flexneri 2a str. 2457T
ggccauuccagcac

SEQ ID NO: 1904611 - RNA, 19 nt, Shigella flexneri 2a str. 2457T
ggccauuccagcacccggc

SEQ ID NO: 1904612 - RNA, 15 nt, Shigella flexneri 2a str. 2457T
ggccaguuucauagu

SEQ ID NO: 1904613 - RNA, 14 nt, Shigella flexneri 2a str. 2457T
ggccaccaggccac

SEQ ID NO: 1904614 - RNA, 12 nt, Shigella flexneri 2a str. 2457T
ggcauuaaacau

SEQ ID NO: 1904615 - RNA, 23 nt, Shigella flexneri 2a str. 2457T
ggcaugucgguuguacaaaaaau

SEQ ID NO: 1904616 - RNA, 15 nt, Shigella flexneri 2a str. 2457T
ggcauguggcggcgc

SEQ ID NO: 1904617 - RNA, 14 nt, Shigella flexneri 2a str. 2457T
ggccacccuguacg

SEQ ID NO: 1904618 - RNA, 19 nt, Shigella flexneri 2a str. 2457T
ggccaccgaagagacauug

SEQ ID NO: 1904619 - RNA, 21 nt, Shigella flexneri 2a str. 2457T
ggccaccgaagcuuucuugca

SEQ ID NO: 1904620 - RNA, 22 nt, Shigella flexneri 2a str. 2457T
ggccaccgaagcuuucuugcag

SEQ ID NO: 1904621 - RNA, 15 nt, Shigella flexneri 2a str. 2457T
ggccagccagcagag

SEQ ID NO: 1904622 - RNA, 14 nt, Shigella flexneri 2a str. 2457T
ggccagcaggucaa

SEQ ID NO: 1904623 - RNA, 13 nt, Shigella flexneri 2a str. 2457T
ggccacggcgacc

SEQ ID NO: 1904624 - RNA, 22 nt, Shigella flexneri 2a str. 2457T
ggauuccugcgcuuccagcucc

SEQ ID NO: 1904625 - RNA, 20 nt, Shigella flexneri 2a str. 2457T
ggauguguuauucagcuggc

SEQ ID NO: 1904626 - RNA, 21 nt, Shigella flexneri 2a str. 2457T
ggauuccagcgccgccagaag

SEQ ID NO: 1904627 - RNA, 19 nt, Shigella flexneri 2a str. 2457T
ggauguguuauucagcugg

SEQ ID NO: 1904628 - RNA, 13 nt, Shigella flexneri 2a str. 2457T
ggaugugaugcau

SEQ ID NO: 1904629 - RNA, 21 nt, Shigella flexneri 2a str. 2457T
ggaugucgcugcuagggcgcg

SEQ ID NO: 1904630 - RNA, 19 nt, Shigella flexneri 2a str. 2457T
ggaucgucaggaucagcca

SEQ ID NO: 1904631 - RNA, 15 nt, Shigella flexneri 2a str. 2457T
ggaugaaaaaauccc

SEQ ID NO: 1904632 - RNA, 16 nt, Shigella flexneri 2a str. 2457T
ggaugccucuccuguu

SEQ ID NO: 1904633 - RNA, 12 nt, Shigella flexneri 2a str. 2457T
ggaugacccagc

SEQ ID NO: 1904634 - RNA, 20 nt, Shigella flexneri 2a str. 2457T
ggaugcgggucaggccagga

SEQ ID NO: 1904635 - RNA, 23 nt, Shigella flexneri 2a str. 2457T
ggaucgcuguccgcuucaccacc

SEQ ID NO: 1904636 - RNA, 13 nt, Shigella flexneri 2a str. 2457T
ggauccccugccc

SEQ ID NO: 1904637 - RNA, 14 nt, Shigella flexneri 2a str. 2457T
ggauccccugcccg

SEQ ID NO: 1904638 - RNA, 20 nt, Shigella flexneri 2a str. 2457T
ggauauccacugucaaaucc

SEQ ID NO: 1904639 - RNA, 16 nt, Shigella flexneri 2a str. 2457T
ggauaccaccagugcc

SEQ ID NO: 1904640 - RNA, 16 nt, Shigella flexneri 2a str. 2457T
ggauaugugaaauuua

SEQ ID NO: 1904641 - RNA, 18 nt, Shigella flexneri 2a str. 2457T
ggauauucaucuccagca

SEQ ID NO: 1904642 - RNA, 20 nt, Shigella flexneri 2a str. 2457T
ggaucagcaaauccaucgcc

SEQ ID NO: 1904643 - RNA, 15 nt, Shigella flexneri 2a str. 2457T
ggaucaguuccagca

SEQ ID NO: 1904644 - RNA, 20 nt, Shigella flexneri 2a str. 2457T
ggauaacuauggucggucag

SEQ ID NO: 1904645 - RNA, 20 nt, Shigella flexneri 2a str. 2457T
ggauaauacacuaacagaac

SEQ ID NO: 1904646 - RNA, 16 nt, Shigella flexneri 2a str. 2457T
ggauaauauuuuugcg

SEQ ID NO: 1904647 - RNA, 20 nt, Shigella flexneri 2a str. 2457T
ggagggauguggcccagccu

SEQ ID NO: 1904648 - RNA, 15 nt, Shigella flexneri 2a str. 2457T
ggaguugaucgccaa

SEQ ID NO: 1904649 - RNA, 21 nt, Shigella flexneri 2a str. 2457T
ggagccaccuuaugagucaga

SEQ ID NO: 1904650 - RNA, 14 nt, Shigella flexneri 2a str. 2457T
ggagcagccagcca

SEQ ID NO: 1904651 - RNA, 12 nt, Shigella flexneri 2a str. 2457T
ggagcagccccu

SEQ ID NO: 1904652 - RNA, 21 nt, Shigella flexneri 2a str. 2457T
ggagcagccccugcgccagcg

SEQ ID NO: 1904653 - RNA, 13 nt, Shigella flexneri 2a str. 2457T
ggagccgaaagau

SEQ ID NO: 1904654 - RNA, 13 nt, Shigella flexneri 2a str. 2457T
ggagcuaauaaug

SEQ ID NO: 1904655 - RNA, 13 nt, Shigella flexneri 2a str. 2457T
ggagagggccggg

SEQ ID NO: 1904656 - RNA, 13 nt, Shigella flexneri 2a str. 2457T
ggagcaacaggga

SEQ ID NO: 1904657 - RNA, 14 nt, Shigella flexneri 2a str. 2457T
ggagcaacugcgcu

SEQ ID NO: 1904658 - RNA, 16 nt, Shigella flexneri 2a str. 2457T
ggagaacggacccgcg

SEQ ID NO: 1904659 - RNA, 22 nt, Shigella flexneri 2a str. 2457T
ggacuccgcaccgccguguucu

SEQ ID NO: 1904660 - RNA, 12 nt, Shigella flexneri 2a str. 2457T
ggagaacgcugc

SEQ ID NO: 1904661 - RNA, 21 nt, Shigella flexneri 2a str. 2457T
ggagacgauucguaaauucgc

SEQ ID NO: 1904662 - RNA, 17 nt, Shigella flexneri 2a str. 2457T
ggacaucccggcagaga

SEQ ID NO: 1904663 - RNA, 19 nt, Shigella flexneri 2a str. 2457T
ggaauuuuacagcccuggc

SEQ ID NO: 1904664 - RNA, 21 nt, Shigella flexneri 2a str. 2457T
ggacacugccggaagagagca

SEQ ID NO: 1904665 - RNA, 15 nt, Shigella flexneri 2a str. 2457T
ggaaugugaugaaaa

SEQ ID NO: 1904666 - RNA, 19 nt, Shigella flexneri 2a str. 2457T
ggaauucucaaacgaaucu

SEQ ID NO: 1904667 - RNA, 18 nt, Shigella flexneri 2a str. 2457T
ggaauuuuacagcccugg

SEQ ID NO: 1904668 - RNA, 20 nt, Shigella flexneri 2a str. 2457T
ggaagggcuuucacugccca

SEQ ID NO: 1904669 - RNA, 22 nt, Shigella flexneri 2a str. 2457T
ggaaggcuagguugaccuggaa

SEQ ID NO: 1904670 - RNA, 20 nt, Shigella flexneri 2a str. 2457T
ggaaggauuacucagcgcug

SEQ ID NO: 1904671 - RNA, 21 nt, Shigella flexneri 2a str. 2457T
ggaaggccagcaggucaaagc

SEQ ID NO: 1904672 - RNA, 16 nt, Shigella flexneri 2a str. 2457T
ggaaggcccuuucccu

SEQ ID NO: 1904673 - RNA, 19 nt, Shigella flexneri 2a str. 2457T
ggaaggguguucauccugg

SEQ ID NO: 1904674 - RNA, 14 nt, Shigella flexneri 2a str. 2457T
ggaaggucauccaa

SEQ ID NO: 1904675 - RNA, 18 nt, Shigella flexneri 2a str. 2457T
ggaacugugcugccgggg

SEQ ID NO: 1904676 - RNA, 15 nt, Shigella flexneri 2a str. 2457T
ggaacuugccgggcg

SEQ ID NO: 1904677 - RNA, 11 nt, Shigella flexneri 2a str. 2457T
ggaagaaaaau

SEQ ID NO: 1904678 - RNA, 13 nt, Shigella flexneri 2a str. 2457T
ggaagaaaaauau

SEQ ID NO: 1904679 - RNA, 14 nt, Shigella flexneri 2a str. 2457T
ggaacgggcaagca

SEQ ID NO: 1904680 - RNA, 21 nt, Shigella flexneri 2a str. 2457T
ggaagagcgacaaucccugca

SEQ ID NO: 1904681 - RNA, 14 nt, Shigella flexneri 2a str. 2457T
ggaagaccugacug

SEQ ID NO: 1904682 - RNA, 13 nt, Shigella flexneri 2a str. 2457T
ggaagagauggug

SEQ ID NO: 1904683 - RNA, 14 nt, Shigella flexneri 2a str. 2457T
ggaagaauggaaaa

SEQ ID NO: 1904684 - RNA, 17 nt, Shigella flexneri 2a str. 2457T
ggaaggaagacgcagca

SEQ ID NO: 1904685 - RNA, 20 nt, Shigella flexneri 2a str. 2457T
ggaaggaagacgcagcaugc

SEQ ID NO: 1904686 - RNA, 19 nt, Shigella flexneri 2a str. 2457T
ggaagccuuccgcaaacag

SEQ ID NO: 1904687 - RNA, 23 nt, Shigella flexneri 2a str. 2457T
ggaagccuuccgcaaacaggcgc

SEQ ID NO: 1904688 - RNA, 15 nt, Shigella flexneri 2a str. 2457T
ggaagccaccacgcc

SEQ ID NO: 1904689 - RNA, 16 nt, Shigella flexneri 2a str. 2457T
ggaacaacguaucuug

SEQ ID NO: 1904690 - RNA, 13 nt, Shigella flexneri 2a str. 2457T
ggaaauugccacu

SEQ ID NO: 1904691 - RNA, 22 nt, Shigella flexneri 2a str. 2457T
ggaaauuaccgcaccaccagca

SEQ ID NO: 1904692 - RNA, 21 nt, Shigella flexneri 2a str. 2457T
ggaaauucagcaguuuuugca

SEQ ID NO: 1904693 - RNA, 16 nt, Shigella flexneri 2a str. 2457T
ggaaauccaggucagc

SEQ ID NO: 1904694 - RNA, 16 nt, Shigella flexneri 2a str. 2457T
ggaaauaacaucccuu

SEQ ID NO: 1904695 - RNA, 22 nt, Shigella flexneri 2a str. 2457T
ggaaauaaucgggaauacagaa

SEQ ID NO: 1904696 - RNA, 19 nt, Shigella flexneri 2a str. 2457T
ggaacccggcuuucugcaa

SEQ ID NO: 1904697 - RNA, 20 nt, Shigella flexneri 2a str. 2457T
ggaaccuccauguccagcuu

SEQ ID NO: 1904698 - RNA, 12 nt, Shigella flexneri 2a str. 2457T
ggaacaccagca

SEQ ID NO: 1904699 - RNA, 20 nt, Shigella flexneri 2a str. 2457T
ggaacacucuuccagucgcc

SEQ ID NO: 1904700 - RNA, 14 nt, Shigella flexneri 2a str. 2457T
ggaacaccucuggc

SEQ ID NO: 1904701 - RNA, 19 nt, Shigella flexneri 2a str. 2457T
ggaacaucccuugugcacu

SEQ ID NO: 1904702 - RNA, 15 nt, Shigella flexneri 2a str. 2457T
ggaacauccuuuccu

SEQ ID NO: 1904703 - RNA, 18 nt, Shigella flexneri 2a str. 2457T
gcuuuuuuaccucuuuuu

SEQ ID NO: 1904704 - RNA, 22 nt, Shigella flexneri 2a str. 2457T
gcuuuuuuagguacaaagccaa

SEQ ID NO: 1904705 - RNA, 13 nt, Shigella flexneri 2a str. 2457T
gcuuuuuuaaccg

SEQ ID NO: 1904706 - RNA, 15 nt, Shigella flexneri 2a str. 2457T
ggaaaaacagaggcc

SEQ ID NO: 1904707 - RNA, 14 nt, Shigella flexneri 2a str. 2457T
ggaaaaacggaggc

SEQ ID NO: 1904708 - RNA, 16 nt, Shigella flexneri 2a str. 2457T
ggaaaaacggaggccc

SEQ ID NO: 1904709 - RNA, 18 nt, Shigella flexneri 2a str. 2457T
gcuuuuuugauuacagcu

SEQ ID NO: 1904710 - RNA, 20 nt, Shigella flexneri 2a str. 2457T
ggaaaaauuuauugaaagca

SEQ ID NO: 1904711 - RNA, 21 nt, Shigella flexneri 2a str. 2457T
ggaaaacagcgcaccagaaac

SEQ ID NO: 1904712 - RNA, 18 nt, Shigella flexneri 2a str. 2457T
ggaaaauaaucaugcagc

SEQ ID NO: 1904713 - RNA, 19 nt, Shigella flexneri 2a str. 2457T
ggaaagaagucucugaaau

SEQ ID NO: 1904714 - RNA, 12 nt, Shigella flexneri 2a str. 2457T
ggaaagagcaac

SEQ ID NO: 1904715 - RNA, 16 nt, Shigella flexneri 2a str. 2457T
ggaaagauaccgccgc

SEQ ID NO: 1904716 - RNA, 16 nt, Shigella flexneri 2a str. 2457T
ggaaagcacaaaauca

SEQ ID NO: 1904717 - RNA, 23 nt, Shigella flexneri 2a str. 2457T
ggaaacugucaauaaacgccugc

SEQ ID NO: 1904718 - RNA, 17 nt, Shigella flexneri 2a str. 2457T
ggaaacucacgccagca

SEQ ID NO: 1904719 - RNA, 18 nt, Shigella flexneri 2a str. 2457T
ggaaagggccgcagugga

SEQ ID NO: 1904720 - RNA, 14 nt, Shigella flexneri 2a str. 2457T
ggaaaccaacucca

SEQ ID NO: 1904721 - RNA, 22 nt, Shigella flexneri 2a str. 2457T
ggaaacagcaccauccgcccac

SEQ ID NO: 1904722 - RNA, 21 nt, Shigella flexneri 2a str. 2457T
ggaaaaucaucaggggcagca

SEQ ID NO: 1904723 - RNA, 17 nt, Shigella flexneri 2a str. 2457T
ggaaacgacuauuaaac

SEQ ID NO: 1904724 - RNA, 19 nt, Shigella flexneri 2a str. 2457T
gcuuugaauaucuccucug

SEQ ID NO: 1904725 - RNA, 23 nt, Shigella flexneri 2a str. 2457T
gcuuugacgaccuucuuccagcu

SEQ ID NO: 1904726 - RNA, 22 nt, Shigella flexneri 2a str. 2457T
gcuuugacgaugcuccacuccu

SEQ ID NO: 1904727 - RNA, 14 nt, Shigella flexneri 2a str. 2457T
gcuuugaauaucuc

SEQ ID NO: 1904728 - RNA, 23 nt, Shigella flexneri 2a str. 2457T
gcuuucuucucagauauaaacgg

SEQ ID NO: 1904729 - RNA, 14 nt, Shigella flexneri 2a str. 2457T
gcuuucucuuccag

SEQ ID NO: 1904730 - RNA, 13 nt, Shigella flexneri 2a str. 2457T
gcuuucugggaug

SEQ ID NO: 1904731 - RNA, 22 nt, Shigella flexneri 2a str. 2457T
gcuuucguuuucuacuuuguaa

SEQ ID NO: 1904732 - RNA, 14 nt, Shigella flexneri 2a str. 2457T
gcuuucucaccaug

SEQ ID NO: 1904733 - RNA, 20 nt, Shigella flexneri 2a str. 2457T
gcuuucucugcaagaacuuu

SEQ ID NO: 1904734 - RNA, 20 nt, Shigella flexneri 2a str. 2457T
gcuuucgccaggucgcugac

SEQ ID NO: 1904735 - RNA, 22 nt, Shigella flexneri 2a str. 2457T
gcuuucgcaauaaucaucucuc

SEQ ID NO: 1904736 - RNA, 21 nt, Shigella flexneri 2a str. 2457T
gcuuucgcaauaaucaucucu

SEQ ID NO: 1904737 - RNA, 16 nt, Shigella flexneri 2a str. 2457T
gcuuucgagcacgacu

SEQ ID NO: 1904738 - RNA, 15 nt, Shigella flexneri 2a str. 2457T
gcuuucgugaagcug

SEQ ID NO: 1904739 - RNA, 18 nt, Shigella flexneri 2a str. 2457T
gcuuucgugaagcuggca

SEQ ID NO: 1904740 - RNA, 21 nt, Shigella flexneri 2a str. 2457T
gcuuucgcuacuucaaacaaa

SEQ ID NO: 1904741 - RNA, 16 nt, Shigella flexneri 2a str. 2457T
gcuuucgcuuucucuu

SEQ ID NO: 1904742 - RNA, 18 nt, Shigella flexneri 2a str. 2457T
gcuuuccagcuucaaauu

SEQ ID NO: 1904743 - RNA, 15 nt, Shigella flexneri 2a str. 2457T
gcuuucauucagaac

SEQ ID NO: 1904744 - RNA, 16 nt, Shigella flexneri 2a str. 2457T
gcuuucauucgguuuu

SEQ ID NO: 1904745 - RNA, 21 nt, Shigella flexneri 2a str. 2457T
gcuuuccggcggucagcgcca

SEQ ID NO: 1904746 - RNA, 14 nt, Shigella flexneri 2a str. 2457T
gcuuuccgcuggcg

SEQ ID NO: 1904747 - RNA, 21 nt, Shigella flexneri 2a str. 2457T
gcuuucaccugcgcgugaccg

SEQ ID NO: 1904748 - RNA, 16 nt, Shigella flexneri 2a str. 2457T
gcuuucacuauuucuu

SEQ ID NO: 1904749 - RNA, 21 nt, Shigella flexneri 2a str. 2457T
gcuuucacucaguguuggaug

SEQ ID NO: 1904750 - RNA, 21 nt, Shigella flexneri 2a str. 2457T
gcuuucacgcucgguccuucg

SEQ ID NO: 1904751 - RNA, 21 nt, Shigella flexneri 2a str. 2457T
gcuuucacucugaaaacgcug

SEQ ID NO: 1904752 - RNA, 20 nt, Shigella flexneri 2a str. 2457T
gcuuucagcacuuaucucuu

SEQ ID NO: 1904753 - RNA, 15 nt, Shigella flexneri 2a str. 2457T
gcuuucagcacgaca

SEQ ID NO: 1904754 - RNA, 23 nt, Shigella flexneri 2a str. 2457T
gcuuuggcugccgccaguuuacu

SEQ ID NO: 1904755 - RNA, 18 nt, Shigella flexneri 2a str. 2457T
gcuuugguggucaccaug

SEQ ID NO: 1904756 - RNA, 18 nt, Shigella flexneri 2a str. 2457T
gcuuuggugccagauuua

SEQ ID NO: 1904757 - RNA, 17 nt, Shigella flexneri 2a str. 2457T
gcuuugcuguuuccagu

SEQ ID NO: 1904758 - RNA, 19 nt, Shigella flexneri 2a str. 2457T
gcuuuggcaaacuacaaau

SEQ ID NO: 1904759 - RNA, 18 nt, Shigella flexneri 2a str. 2457T
gcuuuggcaaacuacaaa

SEQ ID NO: 1904760 - RNA, 17 nt, Shigella flexneri 2a str. 2457T
gcuuugcuaccuuccuc

SEQ ID NO: 1904761 - RNA, 16 nt, Shigella flexneri 2a str. 2457T
gcuuugcugauucucc

SEQ ID NO: 1904762 - RNA, 20 nt, Shigella flexneri 2a str. 2457T
gcuuuuaccgcgucaucggc

SEQ ID NO: 1904763 - RNA, 23 nt, Shigella flexneri 2a str. 2457T
gcuuuuagcgacaaauccuucac

SEQ ID NO: 1904764 - RNA, 14 nt, Shigella flexneri 2a str. 2457T
gcuuuucccuccac

SEQ ID NO: 1904765 - RNA, 20 nt, Shigella flexneri 2a str. 2457T
gcuuuuuaaucucccgccag

SEQ ID NO: 1904766 - RNA, 15 nt, Shigella flexneri 2a str. 2457T
gcuuuuucugcuucu

SEQ ID NO: 1904767 - RNA, 19 nt, Shigella flexneri 2a str. 2457T
gcuuuuuccaggcuggcag

SEQ ID NO: 1904768 - RNA, 23 nt, Shigella flexneri 2a str. 2457T
gcuuuuuaguaucuauucaucaa

SEQ ID NO: 1904769 - RNA, 15 nt, Shigella flexneri 2a str. 2457T
gcuuuauacaaauga

SEQ ID NO: 1904770 - RNA, 20 nt, Shigella flexneri 2a str. 2457T
gcuuuaccuuggugagauug

SEQ ID NO: 1904771 - RNA, 14 nt, Shigella flexneri 2a str. 2457T
gcuuguggaauuaa

SEQ ID NO: 1904772 - RNA, 14 nt, Shigella flexneri 2a str. 2457T
gcuuuaaagcaggc

SEQ ID NO: 1904773 - RNA, 17 nt, Shigella flexneri 2a str. 2457T
gcuuguuucauuacucg

SEQ ID NO: 1904774 - RNA, 14 nt, Shigella flexneri 2a str. 2457T
gcuuuaaaaaagaa

SEQ ID NO: 1904775 - RNA, 22 nt, Shigella flexneri 2a str. 2457T
gcuuguaaaugaacucaacgcc

SEQ ID NO: 1904776 - RNA, 14 nt, Shigella flexneri 2a str. 2457T
gcuugcucaaguug

SEQ ID NO: 1904777 - RNA, 16 nt, Shigella flexneri 2a str. 2457T
gcuugcgucauccagc

SEQ ID NO: 1904778 - RNA, 17 nt, Shigella flexneri 2a str. 2457T
gcuugcgauauucuuca

SEQ ID NO: 1904779 - RNA, 19 nt, Shigella flexneri 2a str. 2457T
gcuugcaggaucagcuccg

SEQ ID NO: 1904780 - RNA, 15 nt, Shigella flexneri 2a str. 2457T
gcuugccagagcagc

SEQ ID NO: 1904781 - RNA, 18 nt, Shigella flexneri 2a str. 2457T
gcuugauccuacacauac

SEQ ID NO: 1904782 - RNA, 22 nt, Shigella flexneri 2a str. 2457T
gcuugaucaauaacgccaugag

SEQ ID NO: 1904783 - RNA, 22 nt, Shigella flexneri 2a str. 2457T
gcuugacgugucuuaucaggcc

SEQ ID NO: 1904784 - RNA, 18 nt, Shigella flexneri 2a str. 2457T
gcuugacgcgucuuauca

SEQ ID NO: 1904785 - RNA, 14 nt, Shigella flexneri 2a str. 2457T
gcuugacgugucuu

SEQ ID NO: 1904786 - RNA, 15 nt, Shigella flexneri 2a str. 2457T
gcuucccaaagaucu

SEQ ID NO: 1904787 - RNA, 21 nt, Shigella flexneri 2a str. 2457T
gcuucccgauaagggagcagg

SEQ ID NO: 1904788 - RNA, 15 nt, Shigella flexneri 2a str. 2457T
gcuuccgccagcggc

SEQ ID NO: 1904789 - RNA, 14 nt, Shigella flexneri 2a str. 2457T
gcuuccuaacauaa

SEQ ID NO: 1904790 - RNA, 15 nt, Shigella flexneri 2a str. 2457T
gcuuccggucugcga

SEQ ID NO: 1904791 - RNA, 18 nt, Shigella flexneri 2a str. 2457T
gcuuccugaguaauaacu

SEQ ID NO: 1904792 - RNA, 12 nt, Shigella flexneri 2a str. 2457T
gcuuccugcagc

SEQ ID NO: 1904793 - RNA, 16 nt, Shigella flexneri 2a str. 2457T
gcuuccuggcgcuggg

SEQ ID NO: 1904794 - RNA, 18 nt, Shigella flexneri 2a str. 2457T
gcuucgagcuggaagcca

SEQ ID NO: 1904795 - RNA, 22 nt, Shigella flexneri 2a str. 2457T
gcuucgcggacaucguccagcu

SEQ ID NO: 1904796 - RNA, 23 nt, Shigella flexneri 2a str. 2457T
gcuucgcggacaucguccagcuu

SEQ ID NO: 1904797 - RNA, 16 nt, Shigella flexneri 2a str. 2457T
gcuucgccugagcggc

SEQ ID NO: 1904798 - RNA, 19 nt, Shigella flexneri 2a str. 2457T
gcuucgcgaaucgccacaa

SEQ ID NO: 1904799 - RNA, 23 nt, Shigella flexneri 2a str. 2457T
gcuucgguuuuguugccgcccgu

SEQ ID NO: 1904800 - RNA, 14 nt, Shigella flexneri 2a str. 2457T
gcuucguagacgcu

SEQ ID NO: 1904801 - RNA, 22 nt, Shigella flexneri 2a str. 2457T
gcuucgguuuucgcgccagcca

SEQ ID NO: 1904802 - RNA, 19 nt, Shigella flexneri 2a str. 2457T
gcuucucccagccgcccug

SEQ ID NO: 1904803 - RNA, 21 nt, Shigella flexneri 2a str. 2457T
gcuucucgugaaacucacgca

SEQ ID NO: 1904804 - RNA, 16 nt, Shigella flexneri 2a str. 2457T
gcuucugcuucagccg

SEQ ID NO: 1904805 - RNA, 14 nt, Shigella flexneri 2a str. 2457T
gcuucugcagcuuu

SEQ ID NO: 1904806 - RNA, 18 nt, Shigella flexneri 2a str. 2457T
gcuucugccuuauccagc

SEQ ID NO: 1904807 - RNA, 17 nt, Shigella flexneri 2a str. 2457T
gcuucguccaguuucac

SEQ ID NO: 1904808 - RNA, 12 nt, Shigella flexneri 2a str. 2457T
gcuucguccaug

SEQ ID NO: 1904809 - RNA, 14 nt, Shigella flexneri 2a str. 2457T
gcuucguccaugcu

SEQ ID NO: 1904810 - RNA, 14 nt, Shigella flexneri 2a str. 2457T
gcuucuaccaugau

SEQ ID NO: 1904811 - RNA, 22 nt, Shigella flexneri 2a str. 2457T
gcuucuuucucaaucugcuugc

SEQ ID NO: 1904812 - RNA, 11 nt, Shigella flexneri 2a str. 2457T
gcuucuuucuc

SEQ ID NO: 1904813 - RNA, 13 nt, Shigella flexneri 2a str. 2457T
gcuugaaaaggua

SEQ ID NO: 1904814 - RNA, 22 nt, Shigella flexneri 2a str. 2457T
gcuucuucugccgcuuccagca

SEQ ID NO: 1904815 - RNA, 12 nt, Shigella flexneri 2a str. 2457T
gcuucuucuuca

SEQ ID NO: 1904816 - RNA, 15 nt, Shigella flexneri 2a str. 2457T
gcuucuguuauucca

SEQ ID NO: 1904817 - RNA, 19 nt, Shigella flexneri 2a str. 2457T
gcuucuguuuuaccugcgc

SEQ ID NO: 1904818 - RNA, 15 nt, Shigella flexneri 2a str. 2457T
gcuucaacacaggcc

SEQ ID NO: 1904819 - RNA, 21 nt, Shigella flexneri 2a str. 2457T
gcuucaaucaauaacagcgca

SEQ ID NO: 1904820 - RNA, 23 nt, Shigella flexneri 2a str. 2457T
gcuucaauacgcucgaacagcug

SEQ ID NO: 1904821 - RNA, 13 nt, Shigella flexneri 2a str. 2457T
gcuucaaucugau

SEQ ID NO: 1904822 - RNA, 14 nt, Shigella flexneri 2a str. 2457T
gcuucaauuuuuuc

SEQ ID NO: 1904823 - RNA, 20 nt, Shigella flexneri 2a str. 2457T
gcuucacucccugccccauc

SEQ ID NO: 1904824 - RNA, 21 nt, Shigella flexneri 2a str. 2457T
gcuucacgcggguugccaccg

SEQ ID NO: 1904825 - RNA, 16 nt, Shigella flexneri 2a str. 2457T
gcuucacgcgccagcu

SEQ ID NO: 1904826 - RNA, 19 nt, Shigella flexneri 2a str. 2457T
gcuucacccuugaugcaga

SEQ ID NO: 1904827 - RNA, 14 nt, Shigella flexneri 2a str. 2457T
gcuucaauuuccug

SEQ ID NO: 1904828 - RNA, 15 nt, Shigella flexneri 2a str. 2457T
gcuucaauuuccuga

SEQ ID NO: 1904829 - RNA, 13 nt, Shigella flexneri 2a str. 2457T
gcuucacaugcca

SEQ ID NO: 1904830 - RNA, 21 nt, Shigella flexneri 2a str. 2457T
gcuucaccaaucagaaaggcg

SEQ ID NO: 1904831 - RNA, 13 nt, Shigella flexneri 2a str. 2457T
gcuucaccagcag

SEQ ID NO: 1904832 - RNA, 14 nt, Shigella flexneri 2a str. 2457T
gcuucaccagcagc

SEQ ID NO: 1904833 - RNA, 12 nt, Shigella flexneri 2a str. 2457T
gcuucagccgga

SEQ ID NO: 1904834 - RNA, 17 nt, Shigella flexneri 2a str. 2457T
gcuucagcguaucccag

SEQ ID NO: 1904835 - RNA, 15 nt, Shigella flexneri 2a str. 2457T
gcuucaucgcccaca

SEQ ID NO: 1904836 - RNA, 11 nt, Shigella flexneri 2a str. 2457T
gcuucaucgcc

SEQ ID NO: 1904837 - RNA, 11 nt, Shigella flexneri 2a str. 2457T
gcuucauugac

SEQ ID NO: 1904838 - RNA, 18 nt, Shigella flexneri 2a str. 2457T
gcuucauugcucucuucu

SEQ ID NO: 1904839 - RNA, 20 nt, Shigella flexneri 2a str. 2457T
gcuucauugcucucuucucc

SEQ ID NO: 1904840 - RNA, 14 nt, Shigella flexneri 2a str. 2457T
gcuucaugcuuaau

SEQ ID NO: 1904841 - RNA, 16 nt, Shigella flexneri 2a str. 2457T
gcuucaugcuuaauca

SEQ ID NO: 1904842 - RNA, 18 nt, Shigella flexneri 2a str. 2457T
gcuucaugcaucgguuuu

SEQ ID NO: 1904843 - RNA, 15 nt, Shigella flexneri 2a str. 2457T
gcuuccaccgccgga

SEQ ID NO: 1904844 - RNA, 15 nt, Shigella flexneri 2a str. 2457T
gcuuaaucgcggcgg

SEQ ID NO: 1904845 - RNA, 18 nt, Shigella flexneri 2a str. 2457T
gcuuaaggcagaaacaaa

SEQ ID NO: 1904846 - RNA, 22 nt, Shigella flexneri 2a str. 2457T
gcuuaauaucccuuccucccuu

SEQ ID NO: 1904847 - RNA, 14 nt, Shigella flexneri 2a str. 2457T
gcuuaaucaccagc

SEQ ID NO: 1904848 - RNA, 13 nt, Shigella flexneri 2a str. 2457T
gcuuacaggcugg

SEQ ID NO: 1904849 - RNA, 16 nt, Shigella flexneri 2a str. 2457T
gcuuacaaaaccugcu

SEQ ID NO: 1904850 - RNA, 20 nt, Shigella flexneri 2a str. 2457T
gcuuacaaaaccugcuuaac

SEQ ID NO: 1904851 - RNA, 16 nt, Shigella flexneri 2a str. 2457T
gcuuaauuacugccuu

SEQ ID NO: 1904852 - RNA, 15 nt, Shigella flexneri 2a str. 2457T
gcuuaccaugccaac

SEQ ID NO: 1904853 - RNA, 16 nt, Shigella flexneri 2a str. 2457T
gcuuacccuaaauccg

SEQ ID NO: 1904854 - RNA, 21 nt, Shigella flexneri 2a str. 2457T
gcuuaccguccucuucccaga

SEQ ID NO: 1904855 - RNA, 22 nt, Shigella flexneri 2a str. 2457T
gcuuaccguccucuucccagac

SEQ ID NO: 1904856 - RNA, 16 nt, Shigella flexneri 2a str. 2457T
gcuuaucgccagcgcc

SEQ ID NO: 1904857 - RNA, 14 nt, Shigella flexneri 2a str. 2457T
gcuuaucuuccugu

SEQ ID NO: 1904858 - RNA, 14 nt, Shigella flexneri 2a str. 2457T
gcuuauucauuacu

SEQ ID NO: 1904859 - RNA, 16 nt, Shigella flexneri 2a str. 2457T
gcuuauuagggaucau

SEQ ID NO: 1904860 - RNA, 23 nt, Shigella flexneri 2a str. 2457T
gcuuauuagggaucaucuuaacu

SEQ ID NO: 1904861 - RNA, 23 nt, Shigella flexneri 2a str. 2457T
gcuuauaauccccggccuuugau

SEQ ID NO: 1904862 - RNA, 17 nt, Shigella flexneri 2a str. 2457T
gcuuacgccugccagcu

SEQ ID NO: 1904863 - RNA, 14 nt, Shigella flexneri 2a str. 2457T
gcuuacucauccac

SEQ ID NO: 1904864 - RNA, 21 nt, Shigella flexneri 2a str. 2457T
gcuuacucaugaugucauaaa

SEQ ID NO: 1904865 - RNA, 22 nt, Shigella flexneri 2a str. 2457T
gcuuacuugcugcucugaaggu

SEQ ID NO: 1904866 - RNA, 14 nt, Shigella flexneri 2a str. 2457T
gcuuagcaucccca

SEQ ID NO: 1904867 - RNA, 18 nt, Shigella flexneri 2a str. 2457T
gcuggcaucuugauacca

SEQ ID NO: 1904868 - RNA, 13 nt, Shigella flexneri 2a str. 2457T
gcuggcagugggc

SEQ ID NO: 1904869 - RNA, 15 nt, Shigella flexneri 2a str. 2457T
gcuggcccaucagaa

SEQ ID NO: 1904870 - RNA, 20 nt, Shigella flexneri 2a str. 2457T
gcuggccccgucagcaaaau

SEQ ID NO: 1904871 - RNA, 17 nt, Shigella flexneri 2a str. 2457T
gcuggcguacccaucaa

SEQ ID NO: 1904872 - RNA, 13 nt, Shigella flexneri 2a str. 2457T
gcuggcgucuggg

SEQ ID NO: 1904873 - RNA, 13 nt, Shigella flexneri 2a str. 2457T
gcuggcggcggcg

SEQ ID NO: 1904874 - RNA, 19 nt, Shigella flexneri 2a str. 2457T
gcuggcggcggcgggcgca

SEQ ID NO: 1904875 - RNA, 22 nt, Shigella flexneri 2a str. 2457T
gcuggcgcguuuaaucacacca

SEQ ID NO: 1904876 - RNA, 22 nt, Shigella flexneri 2a str. 2457T
gcuggcgcauguuggcgcggug

SEQ ID NO: 1904877 - RNA, 22 nt, Shigella flexneri 2a str. 2457T
gcuggcgacgccucuauuaaaa

SEQ ID NO: 1904878 - RNA, 15 nt, Shigella flexneri 2a str. 2457T
gcuggcgauuccacu

SEQ ID NO: 1904879 - RNA, 16 nt, Shigella flexneri 2a str. 2457T
gcuggucagcgccagu

SEQ ID NO: 1904880 - RNA, 20 nt, Shigella flexneri 2a str. 2457T
gcugguaauccgagaaucgu

SEQ ID NO: 1904881 - RNA, 16 nt, Shigella flexneri 2a str. 2457T
gcuggcuggcacgcuc

SEQ ID NO: 1904882 - RNA, 20 nt, Shigella flexneri 2a str. 2457T
gcuggcuuugcccuggcgcg

SEQ ID NO: 1904883 - RNA, 20 nt, Shigella flexneri 2a str. 2457T
gcugggaaaucaccaccagc

SEQ ID NO: 1904884 - RNA, 13 nt, Shigella flexneri 2a str. 2457T
gcugucggcggcg

SEQ ID NO: 1904885 - RNA, 14 nt, Shigella flexneri 2a str. 2457T
gcugugccaggacu

SEQ ID NO: 1904886 - RNA, 19 nt, Shigella flexneri 2a str. 2457T
gcugugaaccgcacagguu

SEQ ID NO: 1904887 - RNA, 18 nt, Shigella flexneri 2a str. 2457T
gcugugccggaaggggcg

SEQ ID NO: 1904888 - RNA, 18 nt, Shigella flexneri 2a str. 2457T
gcugugggguauuuccag

SEQ ID NO: 1904889 - RNA, 20 nt, Shigella flexneri 2a str. 2457T
gcugugccguaaaucccagu

SEQ ID NO: 1904890 - RNA, 12 nt, Shigella flexneri 2a str. 2457T
gcugugcucugg

SEQ ID NO: 1904891 - RNA, 12 nt, Shigella flexneri 2a str. 2457T
gcuguucuuccc

SEQ ID NO: 1904892 - RNA, 20 nt, Shigella flexneri 2a str. 2457T
gcuguucgguuuugcccaca

SEQ ID NO: 1904893 - RNA, 15 nt, Shigella flexneri 2a str. 2457T
gcuguucacugugcu

SEQ ID NO: 1904894 - RNA, 15 nt, Shigella flexneri 2a str. 2457T
gcuguuccaucuuua

SEQ ID NO: 1904895 - RNA, 15 nt, Shigella flexneri 2a str. 2457T
gcuguuuuucguuug

SEQ ID NO: 1904896 - RNA, 19 nt, Shigella flexneri 2a str. 2457T
gcuguuuuccagcaccacu

SEQ ID NO: 1904897 - RNA, 23 nt, Shigella flexneri 2a str. 2457T
gcuguuuuccagcaccacuuccg

SEQ ID NO: 1904898 - RNA, 17 nt, Shigella flexneri 2a str. 2457T
gcuguuuguucaagcgc

SEQ ID NO: 1904899 - RNA, 16 nt, Shigella flexneri 2a str. 2457T
gcuguuuuccagcacc

SEQ ID NO: 1904900 - RNA, 18 nt, Shigella flexneri 2a str. 2457T
gcuguuuucagcaccaga

SEQ ID NO: 1904901 - RNA, 17 nt, Shigella flexneri 2a str. 2457T
gcuguugucugaaugau

SEQ ID NO: 1904902 - RNA, 15 nt, Shigella flexneri 2a str. 2457T
gcuguuggugccaga

SEQ ID NO: 1904903 - RNA, 12 nt, Shigella flexneri 2a str. 2457T
gcuguuuaaccu

SEQ ID NO: 1904904 - RNA, 18 nt, Shigella flexneri 2a str. 2457T
gcuguuucaggaacaccg

SEQ ID NO: 1904905 - RNA, 16 nt, Shigella flexneri 2a str. 2457T
gcugguuaccaccugc

SEQ ID NO: 1904906 - RNA, 12 nt, Shigella flexneri 2a str. 2457T
gcugguggugca

SEQ ID NO: 1904907 - RNA, 23 nt, Shigella flexneri 2a str. 2457T
gcuguaaaaggcgccauuuucau

SEQ ID NO: 1904908 - RNA, 16 nt, Shigella flexneri 2a str. 2457T
gcuguacauauccagu

SEQ ID NO: 1904909 - RNA, 20 nt, Shigella flexneri 2a str. 2457T
gcuguaauuucacaccauca

SEQ ID NO: 1904910 - RNA, 14 nt, Shigella flexneri 2a str. 2457T
gcuguaauuucaca

SEQ ID NO: 1904911 - RNA, 19 nt, Shigella flexneri 2a str. 2457T
gcuguccggcaccaucgga

SEQ ID NO: 1904912 - RNA, 19 nt, Shigella flexneri 2a str. 2457T
gcugucaccagugagugug

SEQ ID NO: 1904913 - RNA, 16 nt, Shigella flexneri 2a str. 2457T
gcuguauguuccccuc

SEQ ID NO: 1904914 - RNA, 20 nt, Shigella flexneri 2a str. 2457T
gcuguauucaagccaugaau

SEQ ID NO: 1904915 - RNA, 20 nt, Shigella flexneri 2a str. 2457T
gcuguaguccuaacagagca

SEQ ID NO: 1904916 - RNA, 17 nt, Shigella flexneri 2a str. 2457T
gcuguaguccuaacaga

SEQ ID NO: 1904917 - RNA, 12 nt, Shigella flexneri 2a str. 2457T
gcugcuaauauu

SEQ ID NO: 1904918 - RNA, 20 nt, Shigella flexneri 2a str. 2457T
gcugcguuugcccuaaagcg

SEQ ID NO: 1904919 - RNA, 23 nt, Shigella flexneri 2a str. 2457T
gcugcugacuuugauccagccau

SEQ ID NO: 1904920 - RNA, 14 nt, Shigella flexneri 2a str. 2457T
gcugcugauccagc

SEQ ID NO: 1904921 - RNA, 16 nt, Shigella flexneri 2a str. 2457T
gcugcuccugcggcug

SEQ ID NO: 1904922 - RNA, 15 nt, Shigella flexneri 2a str. 2457T
gcugcgcgacggcga

SEQ ID NO: 1904923 - RNA, 18 nt, Shigella flexneri 2a str. 2457T
gcugcggcggacaaaguu

SEQ ID NO: 1904924 - RNA, 19 nt, Shigella flexneri 2a str. 2457T
gcugcgggaguugcuccac

SEQ ID NO: 1904925 - RNA, 21 nt, Shigella flexneri 2a str. 2457T
gcuggcaaaaaugauagccag

SEQ ID NO: 1904926 - RNA, 14 nt, Shigella flexneri 2a str. 2457T
gcuggcaagauggc

SEQ ID NO: 1904927 - RNA, 13 nt, Shigella flexneri 2a str. 2457T
gcuggcacuggga

SEQ ID NO: 1904928 - RNA, 16 nt, Shigella flexneri 2a str. 2457T
gcuggcacgcucuuca

SEQ ID NO: 1904929 - RNA, 20 nt, Shigella flexneri 2a str. 2457T
gcuggcagaugcgucuucug

SEQ ID NO: 1904930 - RNA, 12 nt, Shigella flexneri 2a str. 2457T
gcuggcaaugac

SEQ ID NO: 1904931 - RNA, 17 nt, Shigella flexneri 2a str. 2457T
gcuggaugucuggcaga

SEQ ID NO: 1904932 - RNA, 21 nt, Shigella flexneri 2a str. 2457T
gcuggaugucuggcagagccu

SEQ ID NO: 1904933 - RNA, 19 nt, Shigella flexneri 2a str. 2457T
gcuggauuaacgcugggga

SEQ ID NO: 1904934 - RNA, 13 nt, Shigella flexneri 2a str. 2457T
gcuggaugcccaa

SEQ ID NO: 1904935 - RNA, 18 nt, Shigella flexneri 2a str. 2457T
gcuggaugcccaacaggc

SEQ ID NO: 1904936 - RNA, 21 nt, Shigella flexneri 2a str. 2457T
gcuggaguggugaaacaggga

SEQ ID NO: 1904937 - RNA, 13 nt, Shigella flexneri 2a str. 2457T
gcuggagcgggga

SEQ ID NO: 1904938 - RNA, 21 nt, Shigella flexneri 2a str. 2457T
gcuggacguugcguugcagca

SEQ ID NO: 1904939 - RNA, 17 nt, Shigella flexneri 2a str. 2457T
gcugcuuguuccacuuc

SEQ ID NO: 1904940 - RNA, 17 nt, Shigella flexneri 2a str. 2457T
gcugcuucggucagcac

SEQ ID NO: 1904941 - RNA, 18 nt, Shigella flexneri 2a str. 2457T
gcugcuuguuccacuuca

SEQ ID NO: 1904942 - RNA, 22 nt, Shigella flexneri 2a str. 2457T
gcuggaaagcucuucaugcagc

SEQ ID NO: 1904943 - RNA, 13 nt, Shigella flexneri 2a str. 2457T
gcuggaagcuggc

SEQ ID NO: 1904944 - RNA, 15 nt, Shigella flexneri 2a str. 2457T
gcuggaagguggcau

SEQ ID NO: 1904945 - RNA, 23 nt, Shigella flexneri 2a str. 2457T
gcuggaaugcaacugaguucuca

SEQ ID NO: 1904946 - RNA, 17 nt, Shigella flexneri 2a str. 2457T
gcugcugcucaaaggca

SEQ ID NO: 1904947 - RNA, 15 nt, Shigella flexneri 2a str. 2457T
gcugccagaaccgcu

SEQ ID NO: 1904948 - RNA, 23 nt, Shigella flexneri 2a str. 2457T
gcugccacauugcguccaggccc

SEQ ID NO: 1904949 - RNA, 15 nt, Shigella flexneri 2a str. 2457T
gcugccagccaggau

SEQ ID NO: 1904950 - RNA, 14 nt, Shigella flexneri 2a str. 2457T
gcugcagccagggu

SEQ ID NO: 1904951 - RNA, 16 nt, Shigella flexneri 2a str. 2457T
gcugcagccaggguca

SEQ ID NO: 1904952 - RNA, 22 nt, Shigella flexneri 2a str. 2457T
gcugcagcucaucuaaugcagg

SEQ ID NO: 1904953 - RNA, 16 nt, Shigella flexneri 2a str. 2457T
gcugauuucaccaucu

SEQ ID NO: 1904954 - RNA, 21 nt, Shigella flexneri 2a str. 2457T
gcugauuuuucugcucguugc

SEQ ID NO: 1904955 - RNA, 13 nt, Shigella flexneri 2a str. 2457T
gcugauuuuucug

SEQ ID NO: 1904956 - RNA, 23 nt, Shigella flexneri 2a str. 2457T
gcugauuaugucaucaucgccac

SEQ ID NO: 1904957 - RNA, 14 nt, Shigella flexneri 2a str. 2457T
gcugauugcggaga

SEQ ID NO: 1904958 - RNA, 18 nt, Shigella flexneri 2a str. 2457T
gcugauuccauuauucaa

SEQ ID NO: 1904959 - RNA, 13 nt, Shigella flexneri 2a str. 2457T
gcugcaaaaaauu

SEQ ID NO: 1904960 - RNA, 12 nt, Shigella flexneri 2a str. 2457T
gcugcaaagucu

SEQ ID NO: 1904961 - RNA, 17 nt, Shigella flexneri 2a str. 2457T
gcugcaaagucugggcu

SEQ ID NO: 1904962 - RNA, 22 nt, Shigella flexneri 2a str. 2457T
gcugcaagaugaauaauguuua

SEQ ID NO: 1904963 - RNA, 16 nt, Shigella flexneri 2a str. 2457T
gcugcaaaaaauugcg

SEQ ID NO: 1904964 - RNA, 19 nt, Shigella flexneri 2a str. 2457T
gcugcaccucgagaucauc

SEQ ID NO: 1904965 - RNA, 19 nt, Shigella flexneri 2a str. 2457T
gcugcacaauugccagccc

SEQ ID NO: 1904966 - RNA, 23 nt, Shigella flexneri 2a str. 2457T
gcugcaauaaacaagauaacaga

SEQ ID NO: 1904967 - RNA, 20 nt, Shigella flexneri 2a str. 2457T
gcugcacaauugccagcccu

SEQ ID NO: 1904968 - RNA, 20 nt, Shigella flexneri 2a str. 2457T
gcugcacauacugcaucagc

SEQ ID NO: 1904969 - RNA, 14 nt, Shigella flexneri 2a str. 2457T
gcugcccaucaucg

SEQ ID NO: 1904970 - RNA, 20 nt, Shigella flexneri 2a str. 2457T
gcugccgaaccacugaugga

SEQ ID NO: 1904971 - RNA, 15 nt, Shigella flexneri 2a str. 2457T
gcugccgccaguucu

SEQ ID NO: 1904972 - RNA, 20 nt, Shigella flexneri 2a str. 2457T
gcugccgccaguucuuccag

SEQ ID NO: 1904973 - RNA, 20 nt, Shigella flexneri 2a str. 2457T
gcugccucucuucgcugcug

SEQ ID NO: 1904974 - RNA, 20 nt, Shigella flexneri 2a str. 2457T
gcugccuguacggcagugaa

SEQ ID NO: 1904975 - RNA, 23 nt, Shigella flexneri 2a str. 2457T
gcugccuggcccauagacagggu

SEQ ID NO: 1904976 - RNA, 19 nt, Shigella flexneri 2a str. 2457T
gcugccuucggcgucucca

SEQ ID NO: 1904977 - RNA, 14 nt, Shigella flexneri 2a str. 2457T
gcugccguuuucaa

SEQ ID NO: 1904978 - RNA, 14 nt, Shigella flexneri 2a str. 2457T
gcugccuacacaau

SEQ ID NO: 1904979 - RNA, 18 nt, Shigella flexneri 2a str. 2457T
gcugccguuuucaaaggu

SEQ ID NO: 1904980 - RNA, 19 nt, Shigella flexneri 2a str. 2457T
gcugccggaugacagacuc

SEQ ID NO: 1904981 - RNA, 21 nt, Shigella flexneri 2a str. 2457T
gcugccggcacaggcaucacu

SEQ ID NO: 1904982 - RNA, 23 nt, Shigella flexneri 2a str. 2457T
gcugccggggagauauuccccag

SEQ ID NO: 1904983 - RNA, 14 nt, Shigella flexneri 2a str. 2457T
gcgcaucaggcaau

SEQ ID NO: 1904984 - RNA, 19 nt, Shigella flexneri 2a str. 2457T
gcgcaucaggcaaugcuuc

SEQ ID NO: 1904985 - RNA, 15 nt, Shigella flexneri 2a str. 2457T
gcgcaucagcuccgg

SEQ ID NO: 1904986 - RNA, 19 nt, Shigella flexneri 2a str. 2457T
gcgcauccaguuccuucaa

SEQ ID NO: 1904987 - RNA, 19 nt, Shigella flexneri 2a str. 2457T
gcgcaucaugccacccagg

SEQ ID NO: 1904988 - RNA, 17 nt, Shigella flexneri 2a str. 2457T
gcgcaucccauuucucc

SEQ ID NO: 1904989 - RNA, 12 nt, Shigella flexneri 2a str. 2457T
gcgcauauugcc

SEQ ID NO: 1904990 - RNA, 19 nt, Shigella flexneri 2a str. 2457T
gcgcaucaaagccaggcag

SEQ ID NO: 1904991 - RNA, 13 nt, Shigella flexneri 2a str. 2457T
gcgcagucaccag

SEQ ID NO: 1904992 - RNA, 19 nt, Shigella flexneri 2a str. 2457T
gcgcaguucgcacaccgcu

SEQ ID NO: 1904993 - RNA, 17 nt, Shigella flexneri 2a str. 2457T
gcgcaguaaauccgcca

SEQ ID NO: 1904994 - RNA, 14 nt, Shigella flexneri 2a str. 2457T
gcgcaguaccacgg

SEQ ID NO: 1904995 - RNA, 21 nt, Shigella flexneri 2a str. 2457T
gcgcaggguuugcaucgccau

SEQ ID NO: 1904996 - RNA, 20 nt, Shigella flexneri 2a str. 2457T
gcgcaggguuugcaucgcca

SEQ ID NO: 1904997 - RNA, 22 nt, Shigella flexneri 2a str. 2457T
gcgcacuggcggaugugcugga

SEQ ID NO: 1904998 - RNA, 23 nt, Shigella flexneri 2a str. 2457T
gcgcaccggccccugaucggcca

SEQ ID NO: 1904999 - RNA, 17 nt, Shigella flexneri 2a str. 2457T
gcgcacaauggcgguga

SEQ ID NO: 1905000 - RNA, 18 nt, Shigella flexneri 2a str. 2457T
gcgcacacacgcccagcu

SEQ ID NO: 1905001 - RNA, 20 nt, Shigella flexneri 2a str. 2457T
gcgcaaggugugggcaauca

SEQ ID NO: 1905002 - RNA, 17 nt, Shigella flexneri 2a str. 2457T
gcgcaagggccgcagcu

SEQ ID NO: 1905003 - RNA, 19 nt, Shigella flexneri 2a str. 2457T
gcgcacaguaaugcgccag

SEQ ID NO: 1905004 - RNA, 14 nt, Shigella flexneri 2a str. 2457T
gcgaugcuggcaga

SEQ ID NO: 1905005 - RNA, 13 nt, Shigella flexneri 2a str. 2457T
gcgccagccagcc

SEQ ID NO: 1905006 - RNA, 17 nt, Shigella flexneri 2a str. 2457T
gcgccagcugcauuuca

SEQ ID NO: 1905007 - RNA, 17 nt, Shigella flexneri 2a str. 2457T
gcgccacgguguuguug

SEQ ID NO: 1905008 - RNA, 16 nt, Shigella flexneri 2a str. 2457T
gcgccacgcaacagac

SEQ ID NO: 1905009 - RNA, 19 nt, Shigella flexneri 2a str. 2457T
gcgcauuucccagcaagaa

SEQ ID NO: 1905010 - RNA, 19 nt, Shigella flexneri 2a str. 2457T
gcgccaagcagcgcgcaga

SEQ ID NO: 1905011 - RNA, 18 nt, Shigella flexneri 2a str. 2457T
gcgccaaucagcgcagca

SEQ ID NO: 1905012 - RNA, 14 nt, Shigella flexneri 2a str. 2457T
gcgccaaucggcaa

SEQ ID NO: 1905013 - RNA, 15 nt, Shigella flexneri 2a str. 2457T
gcgccacaggucagc

SEQ ID NO: 1905014 - RNA, 24 nt, Shigella flexneri 2a str. 2457T
gcgccacauaagaucaucggccag

SEQ ID NO: 1905015 - RNA, 14 nt, Shigella flexneri 2a str. 2457T
gcgccaauugccag

SEQ ID NO: 1905016 - RNA, 11 nt, Shigella flexneri 2a str. 2457T
gcgccaccagc

SEQ ID NO: 1905017 - RNA, 18 nt, Shigella flexneri 2a str. 2457T
gcgcauucuggagcugga

SEQ ID NO: 1905018 - RNA, 16 nt, Shigella flexneri 2a str. 2457T
gcgcauuucccagcaa

SEQ ID NO: 1905019 - RNA, 17 nt, Shigella flexneri 2a str. 2457T
gcgcauguuggcgcggu

SEQ ID NO: 1905020 - RNA, 21 nt, Shigella flexneri 2a str. 2457T
gcgcauggcguccgucaucga

SEQ ID NO: 1905021 - RNA, 19 nt, Shigella flexneri 2a str. 2457T
gcgcaucggucagacccag

SEQ ID NO: 1905022 - RNA, 17 nt, Shigella flexneri 2a str. 2457T
gcgcaucuuauccggcc

SEQ ID NO: 1905023 - RNA, 18 nt, Shigella flexneri 2a str. 2457T
gcgcaucggucagaccca

SEQ ID NO: 1905024 - RNA, 23 nt, Shigella flexneri 2a str. 2457T
gcgagcuuucgaccagccaggcc

SEQ ID NO: 1905025 - RNA, 13 nt, Shigella flexneri 2a str. 2457T
gcgagcuggcgcu

SEQ ID NO: 1905026 - RNA, 16 nt, Shigella flexneri 2a str. 2457T
gcgauaacgccccaau

SEQ ID NO: 1905027 - RNA, 21 nt, Shigella flexneri 2a str. 2457T
gcgauaaaaauccuguuccau

SEQ ID NO: 1905028 - RNA, 15 nt, Shigella flexneri 2a str. 2457T
gcgaguggucuccug

SEQ ID NO: 1905029 - RNA, 15 nt, Shigella flexneri 2a str. 2457T
gcgagucgagauccc

SEQ ID NO: 1905030 - RNA, 22 nt, Shigella flexneri 2a str. 2457T
gcgauauguuuaucaggccacg

SEQ ID NO: 1905031 - RNA, 17 nt, Shigella flexneri 2a str. 2457T
gcgaugcccccagcagc

SEQ ID NO: 1905032 - RNA, 14 nt, Shigella flexneri 2a str. 2457T
gcgaugccuggcaa

SEQ ID NO: 1905033 - RNA, 15 nt, Shigella flexneri 2a str. 2457T
gcgaucugcgcguca

SEQ ID NO: 1905034 - RNA, 21 nt, Shigella flexneri 2a str. 2457T
gcgacguucguuaacaacaac

SEQ ID NO: 1905035 - RNA, 23 nt, Shigella flexneri 2a str. 2457T
gcgacgcguaugucgaucaccca

SEQ ID NO: 1905036 - RNA, 24 nt, Shigella flexneri 2a str. 2457T
gcgacggaacuucauaugcgccag

SEQ ID NO: 1905037 - RNA, 16 nt, Shigella flexneri 2a str. 2457T
gcgagcgcggcuggcu

SEQ ID NO: 1905038 - RNA, 21 nt, Shigella flexneri 2a str. 2457T
gcgagcgccuuauccugccug

SEQ ID NO: 1905039 - RNA, 21 nt, Shigella flexneri 2a str. 2457T
gcgagcauaggcauuaaacau

SEQ ID NO: 1905040 - RNA, 23 nt, Shigella flexneri 2a str. 2457T
gcgagacggcggaaagggccgca

SEQ ID NO: 1905041 - RNA, 18 nt, Shigella flexneri 2a str. 2457T
gcgaccggaauguuccau

SEQ ID NO: 1905042 - RNA, 13 nt, Shigella flexneri 2a str. 2457T
gcgaccaccagcg

SEQ ID NO: 1905043 - RNA, 13 nt, Shigella flexneri 2a str. 2457T
gcgacauaucauu

SEQ ID NO: 1905044 - RNA, 14 nt, Shigella flexneri 2a str. 2457T
gcgacaggagccgc

SEQ ID NO: 1905045 - RNA, 17 nt, Shigella flexneri 2a str. 2457T
gcgacagggaucucuuc

SEQ ID NO: 1905046 - RNA, 16 nt, Shigella flexneri 2a str. 2457T
gcgacaucuucuccag

SEQ ID NO: 1905047 - RNA, 19 nt, Shigella flexneri 2a str. 2457T
gcgaauguuccaucaccag

SEQ ID NO: 1905048 - RNA, 18 nt, Shigella flexneri 2a str. 2457T
gcgaauccagcaugcuca

SEQ ID NO: 1905049 - RNA, 22 nt, Shigella flexneri 2a str. 2457T
gcgaacaucgagugcggcgagc

SEQ ID NO: 1905050 - RNA, 15 nt, Shigella flexneri 2a str. 2457T
gcgaauccagcaugc

SEQ ID NO: 1905051 - RNA, 15 nt, Shigella flexneri 2a str. 2457T
gcgaauacuccccuu

SEQ ID NO: 1905052 - RNA, 17 nt, Shigella flexneri 2a str. 2457T
gcgaagcuggcggcggc

SEQ ID NO: 1905053 - RNA, 22 nt, Shigella flexneri 2a str. 2457T
gcgaagcgcauaccuucuugua

SEQ ID NO: 1905054 - RNA, 17 nt, Shigella flexneri 2a str. 2457T
gcgaagcccacgccgcc

SEQ ID NO: 1905055 - RNA, 20 nt, Shigella flexneri 2a str. 2457T
gccguuuuuacccagcagca

SEQ ID NO: 1905056 - RNA, 11 nt, Shigella flexneri 2a str. 2457T
gcgaaagaaaa

SEQ ID NO: 1905057 - RNA, 13 nt, Shigella flexneri 2a str. 2457T
gcggauaaagcag

SEQ ID NO: 1905058 - RNA, 19 nt, Shigella flexneri 2a str. 2457T
gcggauaaagcagagcagg

SEQ ID NO: 1905059 - RNA, 14 nt, Shigella flexneri 2a str. 2457T
gcggauauaaaauu

SEQ ID NO: 1905060 - RNA, 14 nt, Shigella flexneri 2a str. 2457T
gcggacugaauacg

SEQ ID NO: 1905061 - RNA, 20 nt, Shigella flexneri 2a str. 2457T
gcggacugaauacgcuggcg

SEQ ID NO: 1905062 - RNA, 18 nt, Shigella flexneri 2a str. 2457T
gcggacugaacgcggccc

SEQ ID NO: 1905063 - RNA, 21 nt, Shigella flexneri 2a str. 2457T
gcggacgcacauagcgugaca

SEQ ID NO: 1905064 - RNA, 16 nt, Shigella flexneri 2a str. 2457T
gcggaccaacaaaaau

SEQ ID NO: 1905065 - RNA, 23 nt, Shigella flexneri 2a str. 2457T
gcggacagccauccgucauccau

SEQ ID NO: 1905066 - RNA, 18 nt, Shigella flexneri 2a str. 2457T
gcggauucgaugcccagc

SEQ ID NO: 1905067 - RNA, 19 nt, Shigella flexneri 2a str. 2457T
gcggauggaguggggcgga

SEQ ID NO: 1905068 - RNA, 21 nt, Shigella flexneri 2a str. 2457T
gcggaugaggcguuaacagcg

SEQ ID NO: 1905069 - RNA, 19 nt, Shigella flexneri 2a str. 2457T
gcggaucaguuccagcagc

SEQ ID NO: 1905070 - RNA, 20 nt, Shigella flexneri 2a str. 2457T
gcggaucucuucguuuucaa

SEQ ID NO: 1905071 - RNA, 15 nt, Shigella flexneri 2a str. 2457T
gcggaugacccagcg

SEQ ID NO: 1905072 - RNA, 13 nt, Shigella flexneri 2a str. 2457T
gcggaugacccag

SEQ ID NO: 1905073 - RNA, 20 nt, Shigella flexneri 2a str. 2457T
gcggcacccauuuauccagc

SEQ ID NO: 1905074 - RNA, 21 nt, Shigella flexneri 2a str. 2457T
gcggcacacagcacggcagca

SEQ ID NO: 1905075 - RNA, 19 nt, Shigella flexneri 2a str. 2457T
gcggcaauucuuucucgcu

SEQ ID NO: 1905076 - RNA, 22 nt, Shigella flexneri 2a str. 2457T
gcggcaauucuuucucgcucag

SEQ ID NO: 1905077 - RNA, 14 nt, Shigella flexneri 2a str. 2457T
gcggcaaucgccag

SEQ ID NO: 1905078 - RNA, 15 nt, Shigella flexneri 2a str. 2457T
gcggcaaucgcugcu

SEQ ID NO: 1905079 - RNA, 23 nt, Shigella flexneri 2a str. 2457T
gcggcaauuagcggccagcgggc

SEQ ID NO: 1905080 - RNA, 18 nt, Shigella flexneri 2a str. 2457T
gcggcaauuagcggcugg

SEQ ID NO: 1905081 - RNA, 21 nt, Shigella flexneri 2a str. 2457T
gcggcaauuagcggcuggcug

SEQ ID NO: 1905082 - RNA, 15 nt, Shigella flexneri 2a str. 2457T
gcggcaagcccagcc

SEQ ID NO: 1905083 - RNA, 21 nt, Shigella flexneri 2a str. 2457T
gcggcaacguauauaacggaa

SEQ ID NO: 1905084 - RNA, 13 nt, Shigella flexneri 2a str. 2457T
gcggcaaauauua

SEQ ID NO: 1905085 - RNA, 18 nt, Shigella flexneri 2a str. 2457T
gcggcaaaaucgccggug

SEQ ID NO: 1905086 - RNA, 13 nt, Shigella flexneri 2a str. 2457T
gcgcuuccagcuc

SEQ ID NO: 1905087 - RNA, 14 nt, Shigella flexneri 2a str. 2457T
gcgcuuccagcucc

SEQ ID NO: 1905088 - RNA, 12 nt, Shigella flexneri 2a str. 2457T
gcgcuuccugca

SEQ ID NO: 1905089 - RNA, 17 nt, Shigella flexneri 2a str. 2457T
gcgcuuccugcagcuuc

SEQ ID NO: 1905090 - RNA, 14 nt, Shigella flexneri 2a str. 2457T
gcgcuuauccggcc

SEQ ID NO: 1905091 - RNA, 14 nt, Shigella flexneri 2a str. 2457T
gcgcuuaucgccag

SEQ ID NO: 1905092 - RNA, 15 nt, Shigella flexneri 2a str. 2457T
gcgcuuaucgccagc

SEQ ID NO: 1905093 - RNA, 21 nt, Shigella flexneri 2a str. 2457T
gcgcuuaaucaauugcaggaa

SEQ ID NO: 1905094 - RNA, 22 nt, Shigella flexneri 2a str. 2457T
gcgcuuaaucaauugcaggaag

SEQ ID NO: 1905095 - RNA, 13 nt, Shigella flexneri 2a str. 2457T
gcgcuggcggcug

SEQ ID NO: 1905096 - RNA, 20 nt, Shigella flexneri 2a str. 2457T
gcgcuuucagcacgacauaa

SEQ ID NO: 1905097 - RNA, 23 nt, Shigella flexneri 2a str. 2457T
gcgcuuuauagggugcaauuuuu

SEQ ID NO: 1905098 - RNA, 13 nt, Shigella flexneri 2a str. 2457T
gcgcuucugccac

SEQ ID NO: 1905099 - RNA, 19 nt, Shigella flexneri 2a str. 2457T
gcggaagacccggcggcgc

SEQ ID NO: 1905100 - RNA, 18 nt, Shigella flexneri 2a str. 2457T
gcggaacaucgccugccg

SEQ ID NO: 1905101 - RNA, 19 nt, Shigella flexneri 2a str. 2457T
gcggaaaucacgcaucacu

SEQ ID NO: 1905102 - RNA, 22 nt, Shigella flexneri 2a str. 2457T
gcgcuuuuggcaggaacugcuc

SEQ ID NO: 1905103 - RNA, 16 nt, Shigella flexneri 2a str. 2457T
gcggaaaucuccagau

SEQ ID NO: 1905104 - RNA, 17 nt, Shigella flexneri 2a str. 2457T
gcgcuuuuuuccugccg

SEQ ID NO: 1905105 - RNA, 20 nt, Shigella flexneri 2a str. 2457T
gcggaaacgacuauuaaaca

SEQ ID NO: 1905106 - RNA, 11 nt, Shigella flexneri 2a str. 2457T
gcgcuggaagg

SEQ ID NO: 1905107 - RNA, 23 nt, Shigella flexneri 2a str. 2457T
gcgcugaguaauccuucccccac

SEQ ID NO: 1905108 - RNA, 22 nt, Shigella flexneri 2a str. 2457T
gcgcugaagaaaauggccagcc

SEQ ID NO: 1905109 - RNA, 23 nt, Shigella flexneri 2a str. 2457T
gcgcugaagaaaauggccagcca

SEQ ID NO: 1905110 - RNA, 18 nt, Shigella flexneri 2a str. 2457T
gcgcuggaugucuggcag

SEQ ID NO: 1905111 - RNA, 20 nt, Shigella flexneri 2a str. 2457T
gcgcucugguagauaagcaa

SEQ ID NO: 1905112 - RNA, 15 nt, Shigella flexneri 2a str. 2457T
gcgcguaaauaccuu

SEQ ID NO: 1905113 - RNA, 16 nt, Shigella flexneri 2a str. 2457T
gcgcgcggcaggaagu

SEQ ID NO: 1905114 - RNA, 18 nt, Shigella flexneri 2a str. 2457T
gcgcgaaaacaacuggca

SEQ ID NO: 1905115 - RNA, 21 nt, Shigella flexneri 2a str. 2457T
gcgcgaucgcuaccuaaggaa

SEQ ID NO: 1905116 - RNA, 15 nt, Shigella flexneri 2a str. 2457T
gcgcgcaggcgcuga

SEQ ID NO: 1905117 - RNA, 15 nt, Shigella flexneri 2a str. 2457T
gcgcgcagugccggu

SEQ ID NO: 1905118 - RNA, 14 nt, Shigella flexneri 2a str. 2457T
gcgcggcccacuuc

SEQ ID NO: 1905119 - RNA, 21 nt, Shigella flexneri 2a str. 2457T
gcgcggucauaaaauccguaa

SEQ ID NO: 1905120 - RNA, 19 nt, Shigella flexneri 2a str. 2457T
gcgcgguaucaccacccag

SEQ ID NO: 1905121 - RNA, 17 nt, Shigella flexneri 2a str. 2457T
gcgcgguagagaaguuu

SEQ ID NO: 1905122 - RNA, 18 nt, Shigella flexneri 2a str. 2457T
gcgcgggucaccgcggug

SEQ ID NO: 1905123 - RNA, 13 nt, Shigella flexneri 2a str. 2457T
gcgcggugcugga

SEQ ID NO: 1905124 - RNA, 16 nt, Shigella flexneri 2a str. 2457T
gcgcggugcuggauga

SEQ ID NO: 1905125 - RNA, 22 nt, Shigella flexneri 2a str. 2457T
gcgccugaccauuaucaaacag

SEQ ID NO: 1905126 - RNA, 18 nt, Shigella flexneri 2a str. 2457T
gcgccggucacaucuucc

SEQ ID NO: 1905127 - RNA, 23 nt, Shigella flexneri 2a str. 2457T
gcgccuucauucaggccaaagcc

SEQ ID NO: 1905128 - RNA, 14 nt, Shigella flexneri 2a str. 2457T
gcgccuucauucag

SEQ ID NO: 1905129 - RNA, 19 nt, Shigella flexneri 2a str. 2457T
gcgccuucauucaggccaa

SEQ ID NO: 1905130 - RNA, 18 nt, Shigella flexneri 2a str. 2457T
gcgccugcggccagcagc

SEQ ID NO: 1905131 - RNA, 17 nt, Shigella flexneri 2a str. 2457T
gcgccgcugagaaaaag

SEQ ID NO: 1905132 - RNA, 17 nt, Shigella flexneri 2a str. 2457T
gcgggcguagugcccgc

SEQ ID NO: 1905133 - RNA, 14 nt, Shigella flexneri 2a str. 2457T
gcggugaccagcag

SEQ ID NO: 1905134 - RNA, 15 nt, Shigella flexneri 2a str. 2457T
gcggugaccagcagc

SEQ ID NO: 1905135 - RNA, 15 nt, Shigella flexneri 2a str. 2457T
gcgguaucaccaccc

SEQ ID NO: 1905136 - RNA, 13 nt, Shigella flexneri 2a str. 2457T
gcgguaucaccac

SEQ ID NO: 1905137 - RNA, 22 nt, Shigella flexneri 2a str. 2457T
gcgggguuuuuuuaugggcacg

SEQ ID NO: 1905138 - RNA, 22 nt, Shigella flexneri 2a str. 2457T
gcggguaucuuuaaucgagaua

SEQ ID NO: 1905139 - RNA, 20 nt, Shigella flexneri 2a str. 2457T
gcgggugacuucccgcacgc

SEQ ID NO: 1905140 - RNA, 15 nt, Shigella flexneri 2a str. 2457T
gcgguaaccuggcag

SEQ ID NO: 1905141 - RNA, 18 nt, Shigella flexneri 2a str. 2457T
gcgguaaaauggucagcc

SEQ ID NO: 1905142 - RNA, 13 nt, Shigella flexneri 2a str. 2457T
gcgguaauggucg

SEQ ID NO: 1905143 - RNA, 21 nt, Shigella flexneri 2a str. 2457T
gcgguacugaccaucagcagc

SEQ ID NO: 1905144 - RNA, 21 nt, Shigella flexneri 2a str. 2457T
gcggcugcugauguucgccag

SEQ ID NO: 1905145 - RNA, 12 nt, Shigella flexneri 2a str. 2457T
gcggcuggcgca

SEQ ID NO: 1905146 - RNA, 15 nt, Shigella flexneri 2a str. 2457T
gcggcuggcugaccu

SEQ ID NO: 1905147 - RNA, 13 nt, Shigella flexneri 2a str. 2457T
gcggcugguuaaa

SEQ ID NO: 1905148 - RNA, 20 nt, Shigella flexneri 2a str. 2457T
gcggcuuguacgccgccgca

SEQ ID NO: 1905149 - RNA, 23 nt, Shigella flexneri 2a str. 2457T
gcggcgugaacgccuaauccagc

SEQ ID NO: 1905150 - RNA, 16 nt, Shigella flexneri 2a str. 2457T
gcggcguugagaaaac

SEQ ID NO: 1905151 - RNA, 15 nt, Shigella flexneri 2a str. 2457T
gcggcuagccaggaa

SEQ ID NO: 1905152 - RNA, 18 nt, Shigella flexneri 2a str. 2457T
gcggcgcaacccccacac

SEQ ID NO: 1905153 - RNA, 16 nt, Shigella flexneri 2a str. 2457T
gcggcgcaagcggcga

SEQ ID NO: 1905154 - RNA, 14 nt, Shigella flexneri 2a str. 2457T
gcggcgauuaagaa

SEQ ID NO: 1905155 - RNA, 23 nt, Shigella flexneri 2a str. 2457T
gcggcguaaacgccuuauccagc

SEQ ID NO: 1905156 - RNA, 15 nt, Shigella flexneri 2a str. 2457T
gcggcggucuucuca

SEQ ID NO: 1905157 - RNA, 19 nt, Shigella flexneri 2a str. 2457T
gcggcggguuaaccagcac

SEQ ID NO: 1905158 - RNA, 15 nt, Shigella flexneri 2a str. 2457T
gcggcggcaaaauca

SEQ ID NO: 1905159 - RNA, 18 nt, Shigella flexneri 2a str. 2457T
gcggcggacgugcaccgu

SEQ ID NO: 1905160 - RNA, 17 nt, Shigella flexneri 2a str. 2457T
gcgucagcuuucagaga

SEQ ID NO: 1905161 - RNA, 16 nt, Shigella flexneri 2a str. 2457T
gcgucagcaccagaga

SEQ ID NO: 1905162 - RNA, 21 nt, Shigella flexneri 2a str. 2457T
gcggugccauuaaaccaacaa

SEQ ID NO: 1905163 - RNA, 17 nt, Shigella flexneri 2a str. 2457T
gcguagcagcguuaaug

SEQ ID NO: 1905164 - RNA, 16 nt, Shigella flexneri 2a str. 2457T
gcguagauucgaaaug

SEQ ID NO: 1905165 - RNA, 20 nt, Shigella flexneri 2a str. 2457T
gcguagcuaccuugcucggc

SEQ ID NO: 1905166 - RNA, 15 nt, Shigella flexneri 2a str. 2457T
gcguagccggugccg

SEQ ID NO: 1905167 - RNA, 14 nt, Shigella flexneri 2a str. 2457T
gcguaugcccagcg

SEQ ID NO: 1905168 - RNA, 13 nt, Shigella flexneri 2a str. 2457T
gcgucgccagcgc

SEQ ID NO: 1905169 - RNA, 15 nt, Shigella flexneri 2a str. 2457T
gcgucgccagcgcgc

SEQ ID NO: 1905170 - RNA, 16 nt, Shigella flexneri 2a str. 2457T
gcgucgauugcucaac

SEQ ID NO: 1905171 - RNA, 21 nt, Shigella flexneri 2a str. 2457T
gcgucgaagaaaacauggcgu

SEQ ID NO: 1905172 - RNA, 21 nt, Shigella flexneri 2a str. 2457T
gcguccgcucggucacugaca

SEQ ID NO: 1905173 - RNA, 23 nt, Shigella flexneri 2a str. 2457T
gcguccccugcaauauuuugaau

SEQ ID NO: 1905174 - RNA, 13 nt, Shigella flexneri 2a str. 2457T
gcgucccaucggc

SEQ ID NO: 1905175 - RNA, 22 nt, Shigella flexneri 2a str. 2457T
gcgucauuuucaucgcuuucuu

SEQ ID NO: 1905176 - RNA, 21 nt, Shigella flexneri 2a str. 2457T
gcguccacagccaacacauuu

SEQ ID NO: 1905177 - RNA, 17 nt, Shigella flexneri 2a str. 2457T
gcgucauugacgcuggc

SEQ ID NO: 1905178 - RNA, 13 nt, Shigella flexneri 2a str. 2457T
gcguuccccagaa

SEQ ID NO: 1905179 - RNA, 19 nt, Shigella flexneri 2a str. 2457T
gcguuccauuggcggcguc

SEQ ID NO: 1905180 - RNA, 19 nt, Shigella flexneri 2a str. 2457T
gcguucagcaguucugcca

SEQ ID NO: 1905181 - RNA, 15 nt, Shigella flexneri 2a str. 2457T
gcguucacgccacau

SEQ ID NO: 1905182 - RNA, 20 nt, Shigella flexneri 2a str. 2457T
gcguugcgccuguucccuuc

SEQ ID NO: 1905183 - RNA, 16 nt, Shigella flexneri 2a str. 2457T
gcguugucgccaucca

SEQ ID NO: 1905184 - RNA, 13 nt, Shigella flexneri 2a str. 2457T
gcguguuccagag

SEQ ID NO: 1905185 - RNA, 15 nt, Shigella flexneri 2a str. 2457T
gcgugucccacuggu

SEQ ID NO: 1905186 - RNA, 16 nt, Shigella flexneri 2a str. 2457T
gcguggcgcagugccu

SEQ ID NO: 1905187 - RNA, 23 nt, Shigella flexneri 2a str. 2457T
gcguggcgauaaucagcgccagc

SEQ ID NO: 1905188 - RNA, 14 nt, Shigella flexneri 2a str. 2457T
gcgugacaccagca

SEQ ID NO: 1905189 - RNA, 20 nt, Shigella flexneri 2a str. 2457T
gcgugacgaaagucugggcc

SEQ ID NO: 1905190 - RNA, 23 nt, Shigella flexneri 2a str. 2457T
gcgucucaucuuuaucggugaga

SEQ ID NO: 1905191 - RNA, 19 nt, Shigella flexneri 2a str. 2457T
gcgucucacuaucgcugag

SEQ ID NO: 1905192 - RNA, 20 nt, Shigella flexneri 2a str. 2457T
gcgucguucgcgccaacagc

SEQ ID NO: 1905193 - RNA, 17 nt, Shigella flexneri 2a str. 2457T
gcgucguucgcgccaac

SEQ ID NO: 1905194 - RNA, 19 nt, Shigella flexneri 2a str. 2457T
gcgugccgugaauauggaa

SEQ ID NO: 1905195 - RNA, 21 nt, Shigella flexneri 2a str. 2457T
gcgugagaucgcgcgggagca

SEQ ID NO: 1905196 - RNA, 13 nt, Shigella flexneri 2a str. 2457T
gcgucgggaucau

SEQ ID NO: 1905197 - RNA, 18 nt, Shigella flexneri 2a str. 2457T
gcgucgcugcucuucagu

SEQ ID NO: 1905198 - RNA, 15 nt, Shigella flexneri 2a str. 2457T
gcucuuccuucagcu

SEQ ID NO: 1905199 - RNA, 14 nt, Shigella flexneri 2a str. 2457T
gcucuucaugcagc

SEQ ID NO: 1905200 - RNA, 21 nt, Shigella flexneri 2a str. 2457T
gcucuucaugcagcaugguca

SEQ ID NO: 1905201 - RNA, 22 nt, Shigella flexneri 2a str. 2457T
gcucuucuucacucucaccacg

SEQ ID NO: 1905202 - RNA, 17 nt, Shigella flexneri 2a str. 2457T
gcucuucuggcaccagu

SEQ ID NO: 1905203 - RNA, 23 nt, Shigella flexneri 2a str. 2457T
gcugaaagaagcggugaaaaaau

SEQ ID NO: 1905204 - RNA, 13 nt, Shigella flexneri 2a str. 2457T
gcugaaaguucau

SEQ ID NO: 1905205 - RNA, 15 nt, Shigella flexneri 2a str. 2457T
gcugaaaguucauga

SEQ ID NO: 1905206 - RNA, 17 nt, Shigella flexneri 2a str. 2457T
gcugaaaguucaugauu

SEQ ID NO: 1905207 - RNA, 23 nt, Shigella flexneri 2a str. 2457T
gcugaaaguuuucuucagugccu

SEQ ID NO: 1905208 - RNA, 20 nt, Shigella flexneri 2a str. 2457T
gcucuuuucuuuaucuauua

SEQ ID NO: 1905209 - RNA, 22 nt, Shigella flexneri 2a str. 2457T
gcucuuuugacgcccccaaacu

SEQ ID NO: 1905210 - RNA, 15 nt, Shigella flexneri 2a str. 2457T
gcucugacuggcgcu

SEQ ID NO: 1905211 - RNA, 20 nt, Shigella flexneri 2a str. 2457T
gcucugcacuaaugcaucug

SEQ ID NO: 1905212 - RNA, 13 nt, Shigella flexneri 2a str. 2457T
gcucugaggcuga

SEQ ID NO: 1905213 - RNA, 21 nt, Shigella flexneri 2a str. 2457T
gcucugauugccuuccaccag

SEQ ID NO: 1905214 - RNA, 22 nt, Shigella flexneri 2a str. 2457T
gcucugcuuucucagcaaauag

SEQ ID NO: 1905215 - RNA, 19 nt, Shigella flexneri 2a str. 2457T
gcucugcugucaccgaagc

SEQ ID NO: 1905216 - RNA, 13 nt, Shigella flexneri 2a str. 2457T
gcucugcgccgcc

SEQ ID NO: 1905217 - RNA, 15 nt, Shigella flexneri 2a str. 2457T
gcucugguucaccau

SEQ ID NO: 1905218 - RNA, 19 nt, Shigella flexneri 2a str. 2457T
gcucugguucaccauucug

SEQ ID NO: 1905219 - RNA, 16 nt, Shigella flexneri 2a str. 2457T
gcucuggcaagcgacu

SEQ ID NO: 1905220 - RNA, 18 nt, Shigella flexneri 2a str. 2457T
gcucuggugcggcaaaaa

SEQ ID NO: 1905221 - RNA, 23 nt, Shigella flexneri 2a str. 2457T
gcucuggcaggcuucaauuuuuu

SEQ ID NO: 1905222 - RNA, 19 nt, Shigella flexneri 2a str. 2457T
gcucuucaauggucagcca

SEQ ID NO: 1905223 - RNA, 20 nt, Shigella flexneri 2a str. 2457T
gcucuucaauggucagccac

SEQ ID NO: 1905224 - RNA, 16 nt, Shigella flexneri 2a str. 2457T
gcucuguucugcgcuu

SEQ ID NO: 1905225 - RNA, 23 nt, Shigella flexneri 2a str. 2457T
gcucguugccugcgaagcucuuu

SEQ ID NO: 1905226 - RNA, 16 nt, Shigella flexneri 2a str. 2457T
gcucgucauccgccag

SEQ ID NO: 1905227 - RNA, 19 nt, Shigella flexneri 2a str. 2457T
gcucgucacaucaccaaca

SEQ ID NO: 1905228 - RNA, 16 nt, Shigella flexneri 2a str. 2457T
gcucucaaauaucugc

SEQ ID NO: 1905229 - RNA, 22 nt, Shigella flexneri 2a str. 2457T
gcucucacuuauuuguuauuac

SEQ ID NO: 1905230 - RNA, 17 nt, Shigella flexneri 2a str. 2457T
gcucucagccagcuggc

SEQ ID NO: 1905231 - RNA, 19 nt, Shigella flexneri 2a str. 2457T
gcucucagccagcuggcag

SEQ ID NO: 1905232 - RNA, 13 nt, Shigella flexneri 2a str. 2457T
gcucucguuuuau

SEQ ID NO: 1905233 - RNA, 20 nt, Shigella flexneri 2a str. 2457T
gcucucgcagcucaucaaca

SEQ ID NO: 1905234 - RNA, 19 nt, Shigella flexneri 2a str. 2457T
gcucuccugaacuuucucc

SEQ ID NO: 1905235 - RNA, 15 nt, Shigella flexneri 2a str. 2457T
gcugaacgcaccuuc

SEQ ID NO: 1905236 - RNA, 18 nt, Shigella flexneri 2a str. 2457T
gcugaagaaaauggccag

SEQ ID NO: 1905237 - RNA, 17 nt, Shigella flexneri 2a str. 2457T
gcugaacgugcucugcg

SEQ ID NO: 1905238 - RNA, 18 nt, Shigella flexneri 2a str. 2457T
gcugaaagggcaaauaau

SEQ ID NO: 1905239 - RNA, 16 nt, Shigella flexneri 2a str. 2457T
gcugaauaucuuucuc

SEQ ID NO: 1905240 - RNA, 15 nt, Shigella flexneri 2a str. 2457T
gcugaaucaacaggc

SEQ ID NO: 1905241 - RNA, 19 nt, Shigella flexneri 2a str. 2457T
gcugaauggcgauuucaca

SEQ ID NO: 1905242 - RNA, 21 nt, Shigella flexneri 2a str. 2457T
gcugaaugaggcuuuaauacc

SEQ ID NO: 1905243 - RNA, 17 nt, Shigella flexneri 2a str. 2457T
gcugacaggcgcugaug

SEQ ID NO: 1905244 - RNA, 19 nt, Shigella flexneri 2a str. 2457T
gcugacagcgcgucuugua

SEQ ID NO: 1905245 - RNA, 18 nt, Shigella flexneri 2a str. 2457T
gcugacaggcgcugauga

SEQ ID NO: 1905246 - RNA, 18 nt, Shigella flexneri 2a str. 2457T
gcugacauaaacaccagc

SEQ ID NO: 1905247 - RNA, 23 nt, Shigella flexneri 2a str. 2457T
gcugacauaaacaccagcaauaa

SEQ ID NO: 1905248 - RNA, 22 nt, Shigella flexneri 2a str. 2457T
gcugaccgccgucgauggcgca

SEQ ID NO: 1905249 - RNA, 16 nt, Shigella flexneri 2a str. 2457T
gcugaccagacuggag

SEQ ID NO: 1905250 - RNA, 22 nt, Shigella flexneri 2a str. 2457T
gcugaccagacuggagcacugc

SEQ ID NO: 1905251 - RNA, 13 nt, Shigella flexneri 2a str. 2457T
gcugauaaacaag

SEQ ID NO: 1905252 - RNA, 15 nt, Shigella flexneri 2a str. 2457T
gcugauaacaauauc

SEQ ID NO: 1905253 - RNA, 21 nt, Shigella flexneri 2a str. 2457T
gcugaguguaacgcuugcuga

SEQ ID NO: 1905254 - RNA, 13 nt, Shigella flexneri 2a str. 2457T
gcugauauuuauc

SEQ ID NO: 1905255 - RNA, 16 nt, Shigella flexneri 2a str. 2457T
gcugaugcagcgauga

SEQ ID NO: 1905256 - RNA, 18 nt, Shigella flexneri 2a str. 2457T
gcugaugccaggcucgga

SEQ ID NO: 1905257 - RNA, 18 nt, Shigella flexneri 2a str. 2457T
gcugaugccgcguuggug

SEQ ID NO: 1905258 - RNA, 22 nt, Shigella flexneri 2a str. 2457T
gcugauuaaaaccgaggggcug

SEQ ID NO: 1905259 - RNA, 21 nt, Shigella flexneri 2a str. 2457T
gcugauguuguuucucuuucu

SEQ ID NO: 1905260 - RNA, 21 nt, Shigella flexneri 2a str. 2457T
gcugagcaaacaguucugcag

SEQ ID NO: 1905261 - RNA, 18 nt, Shigella flexneri 2a str. 2457T
gcugagaaaugccagaau

SEQ ID NO: 1905262 - RNA, 17 nt, Shigella flexneri 2a str. 2457T
gcugacuuugauccagc

SEQ ID NO: 1905263 - RNA, 22 nt, Shigella flexneri 2a str. 2457T
gcugacggugauaaucauccca

SEQ ID NO: 1905264 - RNA, 16 nt, Shigella flexneri 2a str. 2457T
gcugacguagcagcuc

SEQ ID NO: 1905265 - RNA, 20 nt, Shigella flexneri 2a str. 2457T
gcuccaguaccugcaaaccg

SEQ ID NO: 1905266 - RNA, 19 nt, Shigella flexneri 2a str. 2457T
gcucccaggcuccgccaga

SEQ ID NO: 1905267 - RNA, 13 nt, Shigella flexneri 2a str. 2457T
gcuccagaaacca

SEQ ID NO: 1905268 - RNA, 21 nt, Shigella flexneri 2a str. 2457T
gcuccagcgggcgaaucaacu

SEQ ID NO: 1905269 - RNA, 21 nt, Shigella flexneri 2a str. 2457T
gcucaucggcauacagcgaca

SEQ ID NO: 1905270 - RNA, 20 nt, Shigella flexneri 2a str. 2457T
gcucaucuaaugcaggggcg

SEQ ID NO: 1905271 - RNA, 14 nt, Shigella flexneri 2a str. 2457T
gcucauuaaaaaua

SEQ ID NO: 1905272 - RNA, 15 nt, Shigella flexneri 2a str. 2457T
gcucauuaaaaauau

SEQ ID NO: 1905273 - RNA, 15 nt, Shigella flexneri 2a str. 2457T
gcucagcgccacauc

SEQ ID NO: 1905274 - RNA, 21 nt, Shigella flexneri 2a str. 2457T
gcuccuggcgguuaauaauga

SEQ ID NO: 1905275 - RNA, 16 nt, Shigella flexneri 2a str. 2457T
gcucgagagagaaaau

SEQ ID NO: 1905276 - RNA, 12 nt, Shigella flexneri 2a str. 2457T
gcuccccagaau

SEQ ID NO: 1905277 - RNA, 15 nt, Shigella flexneri 2a str. 2457T
gcucccgcagccacu

SEQ ID NO: 1905278 - RNA, 16 nt, Shigella flexneri 2a str. 2457T
gcuccugcauugacuc

SEQ ID NO: 1905279 - RNA, 22 nt, Shigella flexneri 2a str. 2457T
gcucaacaauaaacuggcugug

SEQ ID NO: 1905280 - RNA, 23 nt, Shigella flexneri 2a str. 2457T
gcucaacugccaguucccccugc

SEQ ID NO: 1905281 - RNA, 16 nt, Shigella flexneri 2a str. 2457T
gcucaaaccagcgacg

SEQ ID NO: 1905282 - RNA, 22 nt, Shigella flexneri 2a str. 2457T
gcucaaagacgcgguaaaagcc

SEQ ID NO: 1905283 - RNA, 13 nt, Shigella flexneri 2a str. 2457T
gcucaaagauauu

SEQ ID NO: 1905284 - RNA, 22 nt, Shigella flexneri 2a str. 2457T
gcucaaagccgucgagggccug

SEQ ID NO: 1905285 - RNA, 18 nt, Shigella flexneri 2a str. 2457T
gcucaaauccaucagacc

SEQ ID NO: 1905286 - RNA, 13 nt, Shigella flexneri 2a str. 2457T
gcucaacaauaaa

SEQ ID NO: 1905287 - RNA, 21 nt, Shigella flexneri 2a str. 2457T
gcucacgcgcugccucucuuc

SEQ ID NO: 1905288 - RNA, 15 nt, Shigella flexneri 2a str. 2457T
gcucacgcccaucag

SEQ ID NO: 1905289 - RNA, 13 nt, Shigella flexneri 2a str. 2457T
gcuauuuaacagu

SEQ ID NO: 1905290 - RNA, 16 nt, Shigella flexneri 2a str. 2457T
gcucaaaacaaaaacc

SEQ ID NO: 1905291 - RNA, 12 nt, Shigella flexneri 2a str. 2457T
gcuauuugcgcc

SEQ ID NO: 1905292 - RNA, 16 nt, Shigella flexneri 2a str. 2457T
gcuauuugcccaccug

SEQ ID NO: 1905293 - RNA, 17 nt, Shigella flexneri 2a str. 2457T
gcuaucagcgccaccac

SEQ ID NO: 1905294 - RNA, 19 nt, Shigella flexneri 2a str. 2457T
gcuaucagcgccaccacaa

SEQ ID NO: 1905295 - RNA, 20 nt, Shigella flexneri 2a str. 2457T
gcuaucgcugauauacccuu

SEQ ID NO: 1905296 - RNA, 14 nt, Shigella flexneri 2a str. 2457T
gcuaucuuucaaca

SEQ ID NO: 1905297 - RNA, 21 nt, Shigella flexneri 2a str. 2457T
gcuaucguccacgucaucaaa

SEQ ID NO: 1905298 - RNA, 21 nt, Shigella flexneri 2a str. 2457T
gcuauaccccaccccgaaaug

SEQ ID NO: 1905299 - RNA, 21 nt, Shigella flexneri 2a str. 2457T
gcuauagacaccuugcaacuc

SEQ ID NO: 1905300 - RNA, 21 nt, Shigella flexneri 2a str. 2457T
gcuauaacauuuuucucggca

SEQ ID NO: 1905301 - RNA, 18 nt, Shigella flexneri 2a str. 2457T
gcguuucaaaaacaaaga

SEQ ID NO: 1905302 - RNA, 20 nt, Shigella flexneri 2a str. 2457T
gcuacuuuuuucacccacac

SEQ ID NO: 1905303 - RNA, 18 nt, Shigella flexneri 2a str. 2457T
gcuagcggcuuuuuacgc

SEQ ID NO: 1905304 - RNA, 15 nt, Shigella flexneri 2a str. 2457T
gcccagcgcaucagg

SEQ ID NO: 1905305 - RNA, 17 nt, Shigella flexneri 2a str. 2457T
gcccagcgcaucaggca

SEQ ID NO: 1905306 - RNA, 12 nt, Shigella flexneri 2a str. 2457T
gcccagccagcc

SEQ ID NO: 1905307 - RNA, 19 nt, Shigella flexneri 2a str. 2457T
gcccagcgcaucaggcaau

SEQ ID NO: 1905308 - RNA, 22 nt, Shigella flexneri 2a str. 2457T
gcccagaccugcguucagcagu

SEQ ID NO: 1905309 - RNA, 16 nt, Shigella flexneri 2a str. 2457T
gcccagaggaugcacu

SEQ ID NO: 1905310 - RNA, 23 nt, Shigella flexneri 2a str. 2457T
gcccacgcgcauucccagcgcgu

SEQ ID NO: 1905311 - RNA, 18 nt, Shigella flexneri 2a str. 2457T
gcccacgccgcccagaga

SEQ ID NO: 1905312 - RNA, 20 nt, Shigella flexneri 2a str. 2457T
gccauuuccccaaucuucuc

SEQ ID NO: 1905313 - RNA, 12 nt, Shigella flexneri 2a str. 2457T
gccauuugccag

SEQ ID NO: 1905314 - RNA, 14 nt, Shigella flexneri 2a str. 2457T
gccauuugauucac

SEQ ID NO: 1905315 - RNA, 16 nt, Shigella flexneri 2a str. 2457T
gccauuugggcggcuu

SEQ ID NO: 1905316 - RNA, 18 nt, Shigella flexneri 2a str. 2457T
gccauuuugcacauucca

SEQ ID NO: 1905317 - RNA, 15 nt, Shigella flexneri 2a str. 2457T
gcccaaaaggcagcg

SEQ ID NO: 1905318 - RNA, 16 nt, Shigella flexneri 2a str. 2457T
gccauuuugcgcggca

SEQ ID NO: 1905319 - RNA, 13 nt, Shigella flexneri 2a str. 2457T
gcccaaacuaaua

SEQ ID NO: 1905320 - RNA, 22 nt, Shigella flexneri 2a str. 2457T
gcccaacgcauaaucuguuuca

SEQ ID NO: 1905321 - RNA, 18 nt, Shigella flexneri 2a str. 2457T
gcccaacaguagacaauu

SEQ ID NO: 1905322 - RNA, 21 nt, Shigella flexneri 2a str. 2457T
gcccaccaccagcgaaaucac

SEQ ID NO: 1905323 - RNA, 16 nt, Shigella flexneri 2a str. 2457T
gccaucaauaaccagc

SEQ ID NO: 1905324 - RNA, 21 nt, Shigella flexneri 2a str. 2457T
gccaucaauugcucacucccg

SEQ ID NO: 1905325 - RNA, 18 nt, Shigella flexneri 2a str. 2457T
gccaucaaugccgcaacu

SEQ ID NO: 1905326 - RNA, 16 nt, Shigella flexneri 2a str. 2457T
gccaucaaucccaucu

SEQ ID NO: 1905327 - RNA, 17 nt, Shigella flexneri 2a str. 2457T
gccaucaaugccgcaac

SEQ ID NO: 1905328 - RNA, 18 nt, Shigella flexneri 2a str. 2457T
gccaucaaauagccccug

SEQ ID NO: 1905329 - RNA, 14 nt, Shigella flexneri 2a str. 2457T
gccaucaaauagcc

SEQ ID NO: 1905330 - RNA, 14 nt, Shigella flexneri 2a str. 2457T
gccaucaacacuuu

SEQ ID NO: 1905331 - RNA, 15 nt, Shigella flexneri 2a str. 2457T
gccauauuucuccau

SEQ ID NO: 1905332 - RNA, 19 nt, Shigella flexneri 2a str. 2457T
gccagucacaucagcgauc

SEQ ID NO: 1905333 - RNA, 13 nt, Shigella flexneri 2a str. 2457T
gccaguccagguu

SEQ ID NO: 1905334 - RNA, 13 nt, Shigella flexneri 2a str. 2457T
gccagucaguuaa

SEQ ID NO: 1905335 - RNA, 16 nt, Shigella flexneri 2a str. 2457T
gccagguuaaccagca

SEQ ID NO: 1905336 - RNA, 18 nt, Shigella flexneri 2a str. 2457T
gccagguuuaccagcagc

SEQ ID NO: 1905337 - RNA, 20 nt, Shigella flexneri 2a str. 2457T
gccagguuuucuuucaccuc

SEQ ID NO: 1905338 - RNA, 15 nt, Shigella flexneri 2a str. 2457T
gccaucgccagcagc

SEQ ID NO: 1905339 - RNA, 15 nt, Shigella flexneri 2a str. 2457T
gccauccgucaucca

SEQ ID NO: 1905340 - RNA, 19 nt, Shigella flexneri 2a str. 2457T
gccauccgucauccauacc

SEQ ID NO: 1905341 - RNA, 15 nt, Shigella flexneri 2a str. 2457T
gccaucagugccagu

SEQ ID NO: 1905342 - RNA, 22 nt, Shigella flexneri 2a str. 2457T
gccaucugaauaaacggcucau

SEQ ID NO: 1905343 - RNA, 15 nt, Shigella flexneri 2a str. 2457T
gccaucuucuugcag

SEQ ID NO: 1905344 - RNA, 20 nt, Shigella flexneri 2a str. 2457T
gccaugcuucaauuuccuga

SEQ ID NO: 1905345 - RNA, 18 nt, Shigella flexneri 2a str. 2457T
gccaugcuugaagggcug

SEQ ID NO: 1905346 - RNA, 22 nt, Shigella flexneri 2a str. 2457T
gccauggcuucucgccagccuc

SEQ ID NO: 1905347 - RNA, 16 nt, Shigella flexneri 2a str. 2457T
gccauucacucuuuaa

SEQ ID NO: 1905348 - RNA, 22 nt, Shigella flexneri 2a str. 2457T
gccauuccuggggucaucagca

SEQ ID NO: 1905349 - RNA, 19 nt, Shigella flexneri 2a str. 2457T
gccauugcccgaugcgcaa

SEQ ID NO: 1905350 - RNA, 17 nt, Shigella flexneri 2a str. 2457T
gccauugaccagcugcc

SEQ ID NO: 1905351 - RNA, 13 nt, Shigella flexneri 2a str. 2457T
gccauuaaacaac

SEQ ID NO: 1905352 - RNA, 22 nt, Shigella flexneri 2a str. 2457T
gccaugguuugggcguuacagc

SEQ ID NO: 1905353 - RNA, 15 nt, Shigella flexneri 2a str. 2457T
gccagcgucugagca

SEQ ID NO: 1905354 - RNA, 10 nt, Shigella flexneri 2a str. 2457T
gccagcggcg

SEQ ID NO: 1905355 - RNA, 17 nt, Shigella flexneri 2a str. 2457T
gccagcucuuuaaacac

SEQ ID NO: 1905356 - RNA, 13 nt, Shigella flexneri 2a str. 2457T
gccagcgaagaag

SEQ ID NO: 1905357 - RNA, 23 nt, Shigella flexneri 2a str. 2457T
gccaggcaacgaaaggugaagug

SEQ ID NO: 1905358 - RNA, 21 nt, Shigella flexneri 2a str. 2457T
gccaggagacgcgcaaaucag

SEQ ID NO: 1905359 - RNA, 13 nt, Shigella flexneri 2a str. 2457T
gccagcuggcaga

SEQ ID NO: 1905360 - RNA, 15 nt, Shigella flexneri 2a str. 2457T
gccagcugcugugga

SEQ ID NO: 1905361 - RNA, 23 nt, Shigella flexneri 2a str. 2457T
gccaggcgcgaauggaaagcccg

SEQ ID NO: 1905362 - RNA, 16 nt, Shigella flexneri 2a str. 2457T
gccaggcgcgaaugga

SEQ ID NO: 1905363 - RNA, 19 nt, Shigella flexneri 2a str. 2457T
gccaggcagagcucaacca

SEQ ID NO: 1905364 - RNA, 19 nt, Shigella flexneri 2a str. 2457T
gccagggcuuacaaaaccu

SEQ ID NO: 1905365 - RNA, 13 nt, Shigella flexneri 2a str. 2457T
gccaggguggcuc

SEQ ID NO: 1905366 - RNA, 14 nt, Shigella flexneri 2a str. 2457T
gccaggugcagccc

SEQ ID NO: 1905367 - RNA, 15 nt, Shigella flexneri 2a str. 2457T
gccagcauacagcuu

SEQ ID NO: 1905368 - RNA, 14 nt, Shigella flexneri 2a str. 2457T
gccagcaugacuac

SEQ ID NO: 1905369 - RNA, 23 nt, Shigella flexneri 2a str. 2457T
gccagcagcgaaucagcccagcc

SEQ ID NO: 1905370 - RNA, 17 nt, Shigella flexneri 2a str. 2457T
gccagccgaacagcgcc

SEQ ID NO: 1905371 - RNA, 16 nt, Shigella flexneri 2a str. 2457T
gccagccauucaaucu

SEQ ID NO: 1905372 - RNA, 12 nt, Shigella flexneri 2a str. 2457T
gccagccagcca

SEQ ID NO: 1905373 - RNA, 16 nt, Shigella flexneri 2a str. 2457T
gccagccagcaccagg

SEQ ID NO: 1905374 - RNA, 21 nt, Shigella flexneri 2a str. 2457T
gccagccaagcaugucauaca

SEQ ID NO: 1905375 - RNA, 16 nt, Shigella flexneri 2a str. 2457T
gccagccacaccacuu

SEQ ID NO: 1905376 - RNA, 22 nt, Shigella flexneri 2a str. 2457T
gccagcauuggcguuugaccaa

SEQ ID NO: 1905377 - RNA, 21 nt, Shigella flexneri 2a str. 2457T
gccagcauucccgccagcggc

SEQ ID NO: 1905378 - RNA, 12 nt, Shigella flexneri 2a str. 2457T
gccagacgcuga

SEQ ID NO: 1905379 - RNA, 15 nt, Shigella flexneri 2a str. 2457T
gccagagaagcgacu

SEQ ID NO: 1905380 - RNA, 14 nt, Shigella flexneri 2a str. 2457T
gccagcaacacaua

SEQ ID NO: 1905381 - RNA, 12 nt, Shigella flexneri 2a str. 2457T
gccagagagcga

SEQ ID NO: 1905382 - RNA, 18 nt, Shigella flexneri 2a str. 2457T
gccagagcaucaguuaac

SEQ ID NO: 1905383 - RNA, 16 nt, Shigella flexneri 2a str. 2457T
gccagagcccaucaca

SEQ ID NO: 1905384 - RNA, 22 nt, Shigella flexneri 2a str. 2457T
gccagcaacugacugacuucaa

SEQ ID NO: 1905385 - RNA, 19 nt, Shigella flexneri 2a str. 2457T
gccagcaagagcaaauaaa

SEQ ID NO: 1905386 - RNA, 21 nt, Shigella flexneri 2a str. 2457T
gccagcacagaucgcacuuaa

SEQ ID NO: 1905387 - RNA, 11 nt, Shigella flexneri 2a str. 2457T
gccacuggccc

SEQ ID NO: 1905388 - RNA, 17 nt, Shigella flexneri 2a str. 2457T
gccaccggcacauccag

SEQ ID NO: 1905389 - RNA, 13 nt, Shigella flexneri 2a str. 2457T
gccacugcgccau

SEQ ID NO: 1905390 - RNA, 18 nt, Shigella flexneri 2a str. 2457T
gccaccggcaaucugcug

SEQ ID NO: 1905391 - RNA, 13 nt, Shigella flexneri 2a str. 2457T
gccagaaagaacc

SEQ ID NO: 1905392 - RNA, 21 nt, Shigella flexneri 2a str. 2457T
gccagaaaaccuggcgcagug

SEQ ID NO: 1905393 - RNA, 20 nt, Shigella flexneri 2a str. 2457T
gccagaaaaccuggcgcagu

SEQ ID NO: 1905394 - RNA, 23 nt, Shigella flexneri 2a str. 2457T
gccacuucuuccagcggcaggcc

SEQ ID NO: 1905395 - RNA, 14 nt, Shigella flexneri 2a str. 2457T
gccacuuucggcag

SEQ ID NO: 1905396 - RNA, 19 nt, Shigella flexneri 2a str. 2457T
gccacuuugcaguuccugc

SEQ ID NO: 1905397 - RNA, 21 nt, Shigella flexneri 2a str. 2457T
gccacuuuucggcaaccgcau

SEQ ID NO: 1905398 - RNA, 18 nt, Shigella flexneri 2a str. 2457T
gccacuucuuccagcggc

SEQ ID NO: 1905399 - RNA, 15 nt, Shigella flexneri 2a str. 2457T
gccacuucuuccagc

SEQ ID NO: 1905400 - RNA, 20 nt, Shigella flexneri 2a str. 2457T
gccacuucuuccagcggcag

SEQ ID NO: 1905401 - RNA, 18 nt, Shigella flexneri 2a str. 2457T
gccacuuucacgccgcca

SEQ ID NO: 1905402 - RNA, 12 nt, Shigella flexneri 2a str. 2457T
gccaauugcugu

SEQ ID NO: 1905403 - RNA, 11 nt, Shigella flexneri 2a str. 2457T
gccaauuccca

SEQ ID NO: 1905404 - RNA, 20 nt, Shigella flexneri 2a str. 2457T
gccaaucuucacaucaucau

SEQ ID NO: 1905405 - RNA, 19 nt, Shigella flexneri 2a str. 2457T
gccaaucuucacaucauca

SEQ ID NO: 1905406 - RNA, 14 nt, Shigella flexneri 2a str. 2457T
gccacaagggcaua

SEQ ID NO: 1905407 - RNA, 22 nt, Shigella flexneri 2a str. 2457T
gccacaagaguaaaaaacguag

SEQ ID NO: 1905408 - RNA, 14 nt, Shigella flexneri 2a str. 2457T
gccacaacuucaac

SEQ ID NO: 1905409 - RNA, 19 nt, Shigella flexneri 2a str. 2457T
gccaauaucaaucuucucu

SEQ ID NO: 1905410 - RNA, 17 nt, Shigella flexneri 2a str. 2457T
gccaaucacucaccugc

SEQ ID NO: 1905411 - RNA, 19 nt, Shigella flexneri 2a str. 2457T
gccaaucagcgcagcaccc

SEQ ID NO: 1905412 - RNA, 20 nt, Shigella flexneri 2a str. 2457T
gccaaucccggaagccacca

SEQ ID NO: 1905413 - RNA, 12 nt, Shigella flexneri 2a str. 2457T
gccaaucggcaa

SEQ ID NO: 1905414 - RNA, 16 nt, Shigella flexneri 2a str. 2457T
gccaauaaaugccacc

SEQ ID NO: 1905415 - RNA, 17 nt, Shigella flexneri 2a str. 2457T
gccaauaaaugccacca

SEQ ID NO: 1905416 - RNA, 14 nt, Shigella flexneri 2a str. 2457T
gccaccaccagcgu

SEQ ID NO: 1905417 - RNA, 14 nt, Shigella flexneri 2a str. 2457T
gccaccaccagcac

SEQ ID NO: 1905418 - RNA, 23 nt, Shigella flexneri 2a str. 2457T
gccaccauuuuacguccgcgcac

SEQ ID NO: 1905419 - RNA, 23 nt, Shigella flexneri 2a str. 2457T
gccaccgcgcguuugaucgacag

SEQ ID NO: 1905420 - RNA, 19 nt, Shigella flexneri 2a str. 2457T
gccacagccgagcgccacc

SEQ ID NO: 1905421 - RNA, 20 nt, Shigella flexneri 2a str. 2457T
gccacagccgagcgccacca

SEQ ID NO: 1905422 - RNA, 14 nt, Shigella flexneri 2a str. 2457T
gccacagccgagcg

SEQ ID NO: 1905423 - RNA, 16 nt, Shigella flexneri 2a str. 2457T
gccacagcgccagaca

SEQ ID NO: 1905424 - RNA, 18 nt, Shigella flexneri 2a str. 2457T
gccacauugcguccaggc

SEQ ID NO: 1905425 - RNA, 21 nt, Shigella flexneri 2a str. 2457T
gccacagcaauuuugcccagc

SEQ ID NO: 1905426 - RNA, 13 nt, Shigella flexneri 2a str. 2457T
gccacagccagcc

SEQ ID NO: 1905427 - RNA, 21 nt, Shigella flexneri 2a str. 2457T
gccacaccgaggcauucagcc

SEQ ID NO: 1905428 - RNA, 19 nt, Shigella flexneri 2a str. 2457T
gcauuugagcaggaugccu

SEQ ID NO: 1905429 - RNA, 14 nt, Shigella flexneri 2a str. 2457T
gcauuuuacauccu

SEQ ID NO: 1905430 - RNA, 16 nt, Shigella flexneri 2a str. 2457T
gcauuuguaggcagga

SEQ ID NO: 1905431 - RNA, 17 nt, Shigella flexneri 2a str. 2457T
gcauuucgccaaaccaa

SEQ ID NO: 1905432 - RNA, 17 nt, Shigella flexneri 2a str. 2457T
gcauuuccgcugauuca

SEQ ID NO: 1905433 - RNA, 18 nt, Shigella flexneri 2a str. 2457T
gcauuuccgcugauucaa

SEQ ID NO: 1905434 - RNA, 19 nt, Shigella flexneri 2a str. 2457T
gcauuuccgccaaucaaga

SEQ ID NO: 1905435 - RNA, 19 nt, Shigella flexneri 2a str. 2457T
gcauuuuuucacauguuca

SEQ ID NO: 1905436 - RNA, 11 nt, Shigella flexneri 2a str. 2457T
gcauuuugcag

SEQ ID NO: 1905437 - RNA, 16 nt, Shigella flexneri 2a str. 2457T
gcauuuugcaguaaca

SEQ ID NO: 1905438 - RNA, 19 nt, Shigella flexneri 2a str. 2457T
gcauuuugcggaucugcuc

SEQ ID NO: 1905439 - RNA, 22 nt, Shigella flexneri 2a str. 2457T
gccaaacuggaacugaaaggcg

SEQ ID NO: 1905440 - RNA, 20 nt, Shigella flexneri 2a str. 2457T
gccaaagcaccacuccucaa

SEQ ID NO: 1905441 - RNA, 19 nt, Shigella flexneri 2a str. 2457T
gccaaagcaccacuccuca

SEQ ID NO: 1905442 - RNA, 18 nt, Shigella flexneri 2a str. 2457T
gccaaagcggcaguuaaa

SEQ ID NO: 1905443 - RNA, 17 nt, Shigella flexneri 2a str. 2457T
gccaaagggcuggcaau

SEQ ID NO: 1905444 - RNA, 19 nt, Shigella flexneri 2a str. 2457T
gccaaaguuaucgagcugc

SEQ ID NO: 1905445 - RNA, 14 nt, Shigella flexneri 2a str. 2457T
gccaaauaaaaucc

SEQ ID NO: 1905446 - RNA, 12 nt, Shigella flexneri 2a str. 2457T
gccaaaaucucu

SEQ ID NO: 1905447 - RNA, 12 nt, Shigella flexneri 2a str. 2457T
gccaaaccacgg

SEQ ID NO: 1905448 - RNA, 21 nt, Shigella flexneri 2a str. 2457T
gccaaacccaccagcugauga

SEQ ID NO: 1905449 - RNA, 16 nt, Shigella flexneri 2a str. 2457T
gccaaaauaacuuaau

SEQ ID NO: 1905450 - RNA, 20 nt, Shigella flexneri 2a str. 2457T
gccaaaauaacuuaauguca

SEQ ID NO: 1905451 - RNA, 14 nt, Shigella flexneri 2a str. 2457T
gccaacguuucugg

SEQ ID NO: 1905452 - RNA, 14 nt, Shigella flexneri 2a str. 2457T
gccaacgcccagcg

SEQ ID NO: 1905453 - RNA, 15 nt, Shigella flexneri 2a str. 2457T
gccaacgauaauuca

SEQ ID NO: 1905454 - RNA, 13 nt, Shigella flexneri 2a str. 2457T
gccaagaaacacc

SEQ ID NO: 1905455 - RNA, 15 nt, Shigella flexneri 2a str. 2457T
gccaagaaacaccag

SEQ ID NO: 1905456 - RNA, 16 nt, Shigella flexneri 2a str. 2457T
gccaagauagaaccac

SEQ ID NO: 1905457 - RNA, 20 nt, Shigella flexneri 2a str. 2457T
gccaagcgccgccucagcca

SEQ ID NO: 1905458 - RNA, 21 nt, Shigella flexneri 2a str. 2457T
gccaaccccaauguagccgca

SEQ ID NO: 1905459 - RNA, 16 nt, Shigella flexneri 2a str. 2457T
gccaaccugcugguca

SEQ ID NO: 1905460 - RNA, 21 nt, Shigella flexneri 2a str. 2457T
gccaaccuugcggaagcguca

SEQ ID NO: 1905461 - RNA, 13 nt, Shigella flexneri 2a str. 2457T
gccaaccgcggca

SEQ ID NO: 1905462 - RNA, 20 nt, Shigella flexneri 2a str. 2457T
gccaaccgucagauccgcca

SEQ ID NO: 1905463 - RNA, 17 nt, Shigella flexneri 2a str. 2457T
gccaaauccuuccagcu

SEQ ID NO: 1905464 - RNA, 15 nt, Shigella flexneri 2a str. 2457T
gccaaauccagcgca

SEQ ID NO: 1905465 - RNA, 21 nt, Shigella flexneri 2a str. 2457T
gccaaaucauccagaccgcuc

SEQ ID NO: 1905466 - RNA, 21 nt, Shigella flexneri 2a str. 2457T
gccaaaucauccagacugcuc

SEQ ID NO: 1905467 - RNA, 14 nt, Shigella flexneri 2a str. 2457T
gccaacaaaaucuu

SEQ ID NO: 1905468 - RNA, 19 nt, Shigella flexneri 2a str. 2457T
gccaaauuuggugcucagu

SEQ ID NO: 1905469 - RNA, 19 nt, Shigella flexneri 2a str. 2457T
gcauugcucacuuccuuuu

SEQ ID NO: 1905470 - RNA, 17 nt, Shigella flexneri 2a str. 2457T
gcauugcucccugcggc

SEQ ID NO: 1905471 - RNA, 14 nt, Shigella flexneri 2a str. 2457T
gcauugauaauguu

SEQ ID NO: 1905472 - RNA, 21 nt, Shigella flexneri 2a str. 2457T
gcauugcauuucgcuaccacc

SEQ ID NO: 1905473 - RNA, 16 nt, Shigella flexneri 2a str. 2457T
gcauuucccagcaaga

SEQ ID NO: 1905474 - RNA, 17 nt, Shigella flexneri 2a str. 2457T
gcauuuaagaaaaaaga

SEQ ID NO: 1905475 - RNA, 17 nt, Shigella flexneri 2a str. 2457T
gcauuuaagcauuagca

SEQ ID NO: 1905476 - RNA, 14 nt, Shigella flexneri 2a str. 2457T
gcauugguugcugg

SEQ ID NO: 1905477 - RNA, 18 nt, Shigella flexneri 2a str. 2457T
gcauugguugcuggaaag

SEQ ID NO: 1905478 - RNA, 18 nt, Shigella flexneri 2a str. 2457T
gcauuguguugccgggcg

SEQ ID NO: 1905479 - RNA, 23 nt, Shigella flexneri 2a str. 2457T
gcauucgucguauagaucacuuu

SEQ ID NO: 1905480 - RNA, 12 nt, Shigella flexneri 2a str. 2457T
gcauucucauca

SEQ ID NO: 1905481 - RNA, 16 nt, Shigella flexneri 2a str. 2457T
gcauucggugcucaau

SEQ ID NO: 1905482 - RNA, 24 nt, Shigella flexneri 2a str. 2457T
gcauucgaguaacguucugucucc

SEQ ID NO: 1905483 - RNA, 16 nt, Shigella flexneri 2a str. 2457T
gcauucuuuuucauua

SEQ ID NO: 1905484 - RNA, 19 nt, Shigella flexneri 2a str. 2457T
gcauugaacucuucuuccg

SEQ ID NO: 1905485 - RNA, 13 nt, Shigella flexneri 2a str. 2457T
gcauucuggagcu

SEQ ID NO: 1905486 - RNA, 19 nt, Shigella flexneri 2a str. 2457T
gcauugacgccaaaauaac

SEQ ID NO: 1905487 - RNA, 13 nt, Shigella flexneri 2a str. 2457T
gcauugacaagcu

SEQ ID NO: 1905488 - RNA, 20 nt, Shigella flexneri 2a str. 2457T
gcauucagugcaaaugccag

SEQ ID NO: 1905489 - RNA, 16 nt, Shigella flexneri 2a str. 2457T
gcauucagaguaucca

SEQ ID NO: 1905490 - RNA, 19 nt, Shigella flexneri 2a str. 2457T
gcauucagcagcagcaaga

SEQ ID NO: 1905491 - RNA, 23 nt, Shigella flexneri 2a str. 2457T
gcauuaugagauugagcgauuua

SEQ ID NO: 1905492 - RNA, 16 nt, Shigella flexneri 2a str. 2457T
gcauggcaccugcgga

SEQ ID NO: 1905493 - RNA, 16 nt, Shigella flexneri 2a str. 2457T
gcauggcaauaaccgc

SEQ ID NO: 1905494 - RNA, 17 nt, Shigella flexneri 2a str. 2457T
gcauggcaauaaccgcu

SEQ ID NO: 1905495 - RNA, 13 nt, Shigella flexneri 2a str. 2457T
gcauggcgcuggc

SEQ ID NO: 1905496 - RNA, 11 nt, Shigella flexneri 2a str. 2457T
gcaugcucagu

SEQ ID NO: 1905497 - RNA, 17 nt, Shigella flexneri 2a str. 2457T
gcauggcuggaaugcaa

SEQ ID NO: 1905498 - RNA, 14 nt, Shigella flexneri 2a str. 2457T
gcauggggagaccc

SEQ ID NO: 1905499 - RNA, 23 nt, Shigella flexneri 2a str. 2457T
gcauggggucagggcuucaaagu

SEQ ID NO: 1905500 - RNA, 14 nt, Shigella flexneri 2a str. 2457T
gcaugguacccaau

SEQ ID NO: 1905501 - RNA, 17 nt, Shigella flexneri 2a str. 2457T
gcauuacgcaauuguuc

SEQ ID NO: 1905502 - RNA, 19 nt, Shigella flexneri 2a str. 2457T
gcauuagcacaaacccagg

SEQ ID NO: 1905503 - RNA, 13 nt, Shigella flexneri 2a str. 2457T
gcauuacugcuau

SEQ ID NO: 1905504 - RNA, 22 nt, Shigella flexneri 2a str. 2457T
gcauuacuuucggugacuucaa

SEQ ID NO: 1905505 - RNA, 18 nt, Shigella flexneri 2a str. 2457T
gcauuaaggcaagaaaau

SEQ ID NO: 1905506 - RNA, 14 nt, Shigella flexneri 2a str. 2457T
gcauguagaugccg

SEQ ID NO: 1905507 - RNA, 18 nt, Shigella flexneri 2a str. 2457T
gcaugguuaacuccuucu

SEQ ID NO: 1905508 - RNA, 21 nt, Shigella flexneri 2a str. 2457T
gcaucuugauaccaaaauggc

SEQ ID NO: 1905509 - RNA, 21 nt, Shigella flexneri 2a str. 2457T
gcaucuuccguggaacaaaau

SEQ ID NO: 1905510 - RNA, 16 nt, Shigella flexneri 2a str. 2457T
gcaucuucuucauucc

SEQ ID NO: 1905511 - RNA, 17 nt, Shigella flexneri 2a str. 2457T
gcaucuuauccagcaac

SEQ ID NO: 1905512 - RNA, 21 nt, Shigella flexneri 2a str. 2457T
gcaucuguuucgaucagcaau

SEQ ID NO: 1905513 - RNA, 16 nt, Shigella flexneri 2a str. 2457T
gcaugcaucccgccgu

SEQ ID NO: 1905514 - RNA, 17 nt, Shigella flexneri 2a str. 2457T
gcaugccgguagaagcc

SEQ ID NO: 1905515 - RNA, 20 nt, Shigella flexneri 2a str. 2457T
gcaucugagcaugaugccug

SEQ ID NO: 1905516 - RNA, 15 nt, Shigella flexneri 2a str. 2457T
gcaucugaccagaug

SEQ ID NO: 1905517 - RNA, 17 nt, Shigella flexneri 2a str. 2457T
gcaucugauaagcccag

SEQ ID NO: 1905518 - RNA, 18 nt, Shigella flexneri 2a str. 2457T
gcaucucgcgcucuucuu

SEQ ID NO: 1905519 - RNA, 15 nt, Shigella flexneri 2a str. 2457T
gcaucuccuguuuca

SEQ ID NO: 1905520 - RNA, 20 nt, Shigella flexneri 2a str. 2457T
gcaucugguaagugccacac

SEQ ID NO: 1905521 - RNA, 15 nt, Shigella flexneri 2a str. 2457T
gcaucgugaauuuua

SEQ ID NO: 1905522 - RNA, 20 nt, Shigella flexneri 2a str. 2457T
gcaucgccgggcuaaccgcu

SEQ ID NO: 1905523 - RNA, 22 nt, Shigella flexneri 2a str. 2457T
gcaucgcccaggcgaccaggcc

SEQ ID NO: 1905524 - RNA, 22 nt, Shigella flexneri 2a str. 2457T
gcaucgcaaaccagacgcgcgu

SEQ ID NO: 1905525 - RNA, 12 nt, Shigella flexneri 2a str. 2457T
gcaucgcaucaa

SEQ ID NO: 1905526 - RNA, 19 nt, Shigella flexneri 2a str. 2457T
gcaucgccaguuuugccag

SEQ ID NO: 1905527 - RNA, 18 nt, Shigella flexneri 2a str. 2457T
gcaucgccaguuuugcca

SEQ ID NO: 1905528 - RNA, 21 nt, Shigella flexneri 2a str. 2457T
gcaucgcgauuaugccgccga

SEQ ID NO: 1905529 - RNA, 18 nt, Shigella flexneri 2a str. 2457T
gcaucgcgaccaaucaca

SEQ ID NO: 1905530 - RNA, 21 nt, Shigella flexneri 2a str. 2457T
gcaucggucgaugaaagcgcc

SEQ ID NO: 1905531 - RNA, 13 nt, Shigella flexneri 2a str. 2457T
gcaucggcaucaa

SEQ ID NO: 1905532 - RNA, 22 nt, Shigella flexneri 2a str. 2457T
gcaucggcaaucacaucaccau

SEQ ID NO: 1905533 - RNA, 17 nt, Shigella flexneri 2a str. 2457T
gccgucaucacaccgcg

SEQ ID NO: 1905534 - RNA, 20 nt, Shigella flexneri 2a str. 2457T
gccgucagccacuucuucca

SEQ ID NO: 1905535 - RNA, 16 nt, Shigella flexneri 2a str. 2457T
gccgguggugaccugu

SEQ ID NO: 1905536 - RNA, 17 nt, Shigella flexneri 2a str. 2457T
gccgguuugcgccgugc

SEQ ID NO: 1905537 - RNA, 17 nt, Shigella flexneri 2a str. 2457T
gccgguuuugcaggaaa

SEQ ID NO: 1905538 - RNA, 14 nt, Shigella flexneri 2a str. 2457T
gccgguuuaucucc

SEQ ID NO: 1905539 - RNA, 22 nt, Shigella flexneri 2a str. 2457T
gccgguuuaucuccgcuggagc

SEQ ID NO: 1905540 - RNA, 19 nt, Shigella flexneri 2a str. 2457T
gccgugcugugugccgcga

SEQ ID NO: 1905541 - RNA, 12 nt, Shigella flexneri 2a str. 2457T
gccgugcgaaua

SEQ ID NO: 1905542 - RNA, 15 nt, Shigella flexneri 2a str. 2457T
gccgugacugggugc

SEQ ID NO: 1905543 - RNA, 20 nt, Shigella flexneri 2a str. 2457T
gccguuaccuucggccccau

SEQ ID NO: 1905544 - RNA, 22 nt, Shigella flexneri 2a str. 2457T
gccguuaccguaccaaccgcaa

SEQ ID NO: 1905545 - RNA, 18 nt, Shigella flexneri 2a str. 2457T
gccgucgccacaaccagc

SEQ ID NO: 1905546 - RNA, 15 nt, Shigella flexneri 2a str. 2457T
gccgucgaugcccca

SEQ ID NO: 1905547 - RNA, 17 nt, Shigella flexneri 2a str. 2457T
gccgucgaugccccagu

SEQ ID NO: 1905548 - RNA, 18 nt, Shigella flexneri 2a str. 2457T
gccgucgaugccccagua

SEQ ID NO: 1905549 - RNA, 19 nt, Shigella flexneri 2a str. 2457T
gccguccugcguuucuucu

SEQ ID NO: 1905550 - RNA, 20 nt, Shigella flexneri 2a str. 2457T
gccgucgaggaacaucugag

SEQ ID NO: 1905551 - RNA, 21 nt, Shigella flexneri 2a str. 2457T
gccgggaagcucucuuccagu

SEQ ID NO: 1905552 - RNA, 22 nt, Shigella flexneri 2a str. 2457T
gccggccagcgccaccaccagc

SEQ ID NO: 1905553 - RNA, 13 nt, Shigella flexneri 2a str. 2457T
gccgggcuggaga

SEQ ID NO: 1905554 - RNA, 13 nt, Shigella flexneri 2a str. 2457T
gccgguauccagc

SEQ ID NO: 1905555 - RNA, 16 nt, Shigella flexneri 2a str. 2457T
gccggugaccaucagc

SEQ ID NO: 1905556 - RNA, 19 nt, Shigella flexneri 2a str. 2457T
gccggugaccaucagcaug

SEQ ID NO: 1905557 - RNA, 18 nt, Shigella flexneri 2a str. 2457T
gccgcgucuuauccggcc

SEQ ID NO: 1905558 - RNA, 15 nt, Shigella flexneri 2a str. 2457T
gccgcgcuuucuucu

SEQ ID NO: 1905559 - RNA, 23 nt, Shigella flexneri 2a str. 2457T
gccggaugcggcguaaaugccuu

SEQ ID NO: 1905560 - RNA, 18 nt, Shigella flexneri 2a str. 2457T
gccggaugcgaugcugac

SEQ ID NO: 1905561 - RNA, 18 nt, Shigella flexneri 2a str. 2457T
gccggaugaucauccggc

SEQ ID NO: 1905562 - RNA, 15 nt, Shigella flexneri 2a str. 2457T
gccggaugcaucaca

SEQ ID NO: 1905563 - RNA, 16 nt, Shigella flexneri 2a str. 2457T
gccggaugucgcugcu

SEQ ID NO: 1905564 - RNA, 19 nt, Shigella flexneri 2a str. 2457T
gccggauguguugcauccg

SEQ ID NO: 1905565 - RNA, 21 nt, Shigella flexneri 2a str. 2457T
gccggauguguugcauccggc

SEQ ID NO: 1905566 - RNA, 15 nt, Shigella flexneri 2a str. 2457T
gccggaauuauccgg

SEQ ID NO: 1905567 - RNA, 12 nt, Shigella flexneri 2a str. 2457T
gccggaauaauc

SEQ ID NO: 1905568 - RNA, 17 nt, Shigella flexneri 2a str. 2457T
gccggacguguuuucac

SEQ ID NO: 1905569 - RNA, 13 nt, Shigella flexneri 2a str. 2457T
gccggacgucagg

SEQ ID NO: 1905570 - RNA, 14 nt, Shigella flexneri 2a str. 2457T
gccggaauggugcu

SEQ ID NO: 1905571 - RNA, 16 nt, Shigella flexneri 2a str. 2457T
gccggaauuuuccuuc

SEQ ID NO: 1905572 - RNA, 18 nt, Shigella flexneri 2a str. 2457T
gccggaauuucuuucagc

SEQ ID NO: 1905573 - RNA, 14 nt, Shigella flexneri 2a str. 2457T
gccggaauuuuccu

SEQ ID NO: 1905574 - RNA, 20 nt, Shigella flexneri 2a str. 2457T
gccgcuucgcccaaauccuu

SEQ ID NO: 1905575 - RNA, 17 nt, Shigella flexneri 2a str. 2457T
gccgcuuccagcagacc

SEQ ID NO: 1905576 - RNA, 15 nt, Shigella flexneri 2a str. 2457T
gccgcuuccagcauu

SEQ ID NO: 1905577 - RNA, 13 nt, Shigella flexneri 2a str. 2457T
gccggaaccugau

SEQ ID NO: 1905578 - RNA, 20 nt, Shigella flexneri 2a str. 2457T
gccgcuguguguaggccagc

SEQ ID NO: 1905579 - RNA, 19 nt, Shigella flexneri 2a str. 2457T
gccgccgcaaacaucggcu

SEQ ID NO: 1905580 - RNA, 22 nt, Shigella flexneri 2a str. 2457T
gccgccgagcaaaccacaggcc

SEQ ID NO: 1905581 - RNA, 20 nt, Shigella flexneri 2a str. 2457T
gccgcacaccugcauucgag

SEQ ID NO: 1905582 - RNA, 16 nt, Shigella flexneri 2a str. 2457T
gccgcgcggguggugc

SEQ ID NO: 1905583 - RNA, 15 nt, Shigella flexneri 2a str. 2457T
gccgacggauugucg

SEQ ID NO: 1905584 - RNA, 15 nt, Shigella flexneri 2a str. 2457T
gccgagcgcguuaaa

SEQ ID NO: 1905585 - RNA, 11 nt, Shigella flexneri 2a str. 2457T
gccgagcgcca

SEQ ID NO: 1905586 - RNA, 22 nt, Shigella flexneri 2a str. 2457T
gccgagaagauuuuuugccagc

SEQ ID NO: 1905587 - RNA, 15 nt, Shigella flexneri 2a str. 2457T
gccgaggcacagcag

SEQ ID NO: 1905588 - RNA, 16 nt, Shigella flexneri 2a str. 2457T
gccgaggcgcuggcag

SEQ ID NO: 1905589 - RNA, 13 nt, Shigella flexneri 2a str. 2457T
gccgauaauacuc

SEQ ID NO: 1905590 - RNA, 17 nt, Shigella flexneri 2a str. 2457T
gccgcaacuaccagcag

SEQ ID NO: 1905591 - RNA, 18 nt, Shigella flexneri 2a str. 2457T
gccgcaacuaccagcagu

SEQ ID NO: 1905592 - RNA, 19 nt, Shigella flexneri 2a str. 2457T
gccgcaacuuuagccgguu

SEQ ID NO: 1905593 - RNA, 17 nt, Shigella flexneri 2a str. 2457T
gccgauguugcaugauu

SEQ ID NO: 1905594 - RNA, 21 nt, Shigella flexneri 2a str. 2457T
gccgaacagcgccagacaaac

SEQ ID NO: 1905595 - RNA, 17 nt, Shigella flexneri 2a str. 2457T
gcccuuugcuggcauga

SEQ ID NO: 1905596 - RNA, 22 nt, Shigella flexneri 2a str. 2457T
gcccuuuuucacgcuaaaagcg

SEQ ID NO: 1905597 - RNA, 22 nt, Shigella flexneri 2a str. 2457T
gcccuuuguaggccagauaaga

SEQ ID NO: 1905598 - RNA, 14 nt, Shigella flexneri 2a str. 2457T
gcccuuuucaccau

SEQ ID NO: 1905599 - RNA, 23 nt, Shigella flexneri 2a str. 2457T
gcccuuuuuucguaaguaagcaa

SEQ ID NO: 1905600 - RNA, 22 nt, Shigella flexneri 2a str. 2457T
gcccuguuugguugccagccac

SEQ ID NO: 1905601 - RNA, 16 nt, Shigella flexneri 2a str. 2457T
gccgacaaaugcaguu

SEQ ID NO: 1905602 - RNA, 15 nt, Shigella flexneri 2a str. 2457T
gccgaagcagcuacu

SEQ ID NO: 1905603 - RNA, 21 nt, Shigella flexneri 2a str. 2457T
gccgaccgcaaggaagccuga

SEQ ID NO: 1905604 - RNA, 13 nt, Shigella flexneri 2a str. 2457T
gccgaccagaccg

SEQ ID NO: 1905605 - RNA, 17 nt, Shigella flexneri 2a str. 2457T
gcccugucgaggccaau

SEQ ID NO: 1905606 - RNA, 19 nt, Shigella flexneri 2a str. 2457T
gcccuggauuucaauaacu

SEQ ID NO: 1905607 - RNA, 15 nt, Shigella flexneri 2a str. 2457T
gcccuggaugcaguc

SEQ ID NO: 1905608 - RNA, 17 nt, Shigella flexneri 2a str. 2457T
gcccugcaaugucauca

SEQ ID NO: 1905609 - RNA, 16 nt, Shigella flexneri 2a str. 2457T
gcccugauggcgcgcc

SEQ ID NO: 1905610 - RNA, 12 nt, Shigella flexneri 2a str. 2457T
gcccucgacggc

SEQ ID NO: 1905611 - RNA, 21 nt, Shigella flexneri 2a str. 2457T
gcccucaaacaacacagcgau

SEQ ID NO: 1905612 - RNA, 16 nt, Shigella flexneri 2a str. 2457T
gcccuauugauugucu

SEQ ID NO: 1905613 - RNA, 15 nt, Shigella flexneri 2a str. 2457T
gcccucagcccacau

SEQ ID NO: 1905614 - RNA, 20 nt, Shigella flexneri 2a str. 2457T
gcccuaggcauagaaaaaga

SEQ ID NO: 1905615 - RNA, 18 nt, Shigella flexneri 2a str. 2457T
gcccuaggcauagaaaaa

SEQ ID NO: 1905616 - RNA, 15 nt, Shigella flexneri 2a str. 2457T
gcccuaggcauagaa

SEQ ID NO: 1905617 - RNA, 19 nt, Shigella flexneri 2a str. 2457T
gcccggcaugacgccgggc

SEQ ID NO: 1905618 - RNA, 18 nt, Shigella flexneri 2a str. 2457T
gcccggucgggugcucau

SEQ ID NO: 1905619 - RNA, 15 nt, Shigella flexneri 2a str. 2457T
gcccgguauccauca

SEQ ID NO: 1905620 - RNA, 20 nt, Shigella flexneri 2a str. 2457T
gcccguaaaaaauggcuggc

SEQ ID NO: 1905621 - RNA, 14 nt, Shigella flexneri 2a str. 2457T
gcccgguugcaguu

SEQ ID NO: 1905622 - RNA, 22 nt, Shigella flexneri 2a str. 2457T
gccccugagcguuacccgcagc

SEQ ID NO: 1905623 - RNA, 17 nt, Shigella flexneri 2a str. 2457T
gccccguugccacccau

SEQ ID NO: 1905624 - RNA, 15 nt, Shigella flexneri 2a str. 2457T
gccccgguuucucuu

SEQ ID NO: 1905625 - RNA, 15 nt, Shigella flexneri 2a str. 2457T
gcccggcaacaacag

SEQ ID NO: 1905626 - RNA, 14 nt, Shigella flexneri 2a str. 2457T
gcccgcccccgggc

SEQ ID NO: 1905627 - RNA, 17 nt, Shigella flexneri 2a str. 2457T
gcccgcccccgggccuc

SEQ ID NO: 1905628 - RNA, 13 nt, Shigella flexneri 2a str. 2457T
gcccgauucacau

SEQ ID NO: 1905629 - RNA, 18 nt, Shigella flexneri 2a str. 2457T
gcccgauggugaugccau

SEQ ID NO: 1905630 - RNA, 21 nt, Shigella flexneri 2a str. 2457T
gcccgaugaccuugucaugca

SEQ ID NO: 1905631 - RNA, 17 nt, Shigella flexneri 2a str. 2457T
gcccgauggcaucacca

SEQ ID NO: 1905632 - RNA, 19 nt, Shigella flexneri 2a str. 2457T
gcccgcacaaagcacgcug

SEQ ID NO: 1905633 - RNA, 18 nt, Shigella flexneri 2a str. 2457T
gcacucgcccugaccugc

SEQ ID NO: 1905634 - RNA, 16 nt, Shigella flexneri 2a str. 2457T
gcacuccugccaccac

SEQ ID NO: 1905635 - RNA, 23 nt, Shigella flexneri 2a str. 2457T
gcacucuccuccguuaaccugga

SEQ ID NO: 1905636 - RNA, 18 nt, Shigella flexneri 2a str. 2457T
gcacugaaagccgcaggc

SEQ ID NO: 1905637 - RNA, 23 nt, Shigella flexneri 2a str. 2457T
gcacugauuuuuuccaacaggcg

SEQ ID NO: 1905638 - RNA, 12 nt, Shigella flexneri 2a str. 2457T
gcacugauucau

SEQ ID NO: 1905639 - RNA, 19 nt, Shigella flexneri 2a str. 2457T
gcacugcuuaaauuucuua

SEQ ID NO: 1905640 - RNA, 16 nt, Shigella flexneri 2a str. 2457T
gcacugcgcccgccag

SEQ ID NO: 1905641 - RNA, 22 nt, Shigella flexneri 2a str. 2457T
gcacugcgcccgccagcaucgg

SEQ ID NO: 1905642 - RNA, 16 nt, Shigella flexneri 2a str. 2457T
gcacguucaucccacu

SEQ ID NO: 1905643 - RNA, 16 nt, Shigella flexneri 2a str. 2457T
gcacguuuagcuuugg

SEQ ID NO: 1905644 - RNA, 19 nt, Shigella flexneri 2a str. 2457T
gcacguuagaaacaaaaaa

SEQ ID NO: 1905645 - RNA, 21 nt, Shigella flexneri 2a str. 2457T
gcacguuagaaacaaaaaaac

SEQ ID NO: 1905646 - RNA, 16 nt, Shigella flexneri 2a str. 2457T
gcacuaugugccagcu

SEQ ID NO: 1905647 - RNA, 23 nt, Shigella flexneri 2a str. 2457T
gcacuaugugccagcuucccgcu

SEQ ID NO: 1905648 - RNA, 17 nt, Shigella flexneri 2a str. 2457T
gcacuauacaaccagau

SEQ ID NO: 1905649 - RNA, 18 nt, Shigella flexneri 2a str. 2457T
gcacgcucuguucugcgc

SEQ ID NO: 1905650 - RNA, 16 nt, Shigella flexneri 2a str. 2457T
gcacgcuggagaacaa

SEQ ID NO: 1905651 - RNA, 22 nt, Shigella flexneri 2a str. 2457T
gcacggaaagcagcauacccac

SEQ ID NO: 1905652 - RNA, 19 nt, Shigella flexneri 2a str. 2457T
gcacgucaccgcagcaucg

SEQ ID NO: 1905653 - RNA, 18 nt, Shigella flexneri 2a str. 2457T
gcacgguuuuuccagcuc

SEQ ID NO: 1905654 - RNA, 22 nt, Shigella flexneri 2a str. 2457T
gcacguaccaugcgcaucaucg

SEQ ID NO: 1905655 - RNA, 18 nt, Shigella flexneri 2a str. 2457T
gcaccagggaaauaaucg

SEQ ID NO: 1905656 - RNA, 21 nt, Shigella flexneri 2a str. 2457T
gcacccuauuuuuacccaggc

SEQ ID NO: 1905657 - RNA, 23 nt, Shigella flexneri 2a str. 2457T
gcacccuauuuuuacccaggccu

SEQ ID NO: 1905658 - RNA, 22 nt, Shigella flexneri 2a str. 2457T
gcaccagaaaguuuuucaacac

SEQ ID NO: 1905659 - RNA, 16 nt, Shigella flexneri 2a str. 2457T
gcaccagcggaaugca

SEQ ID NO: 1905660 - RNA, 22 nt, Shigella flexneri 2a str. 2457T
gcaccaggcaguuuauccagcc

SEQ ID NO: 1905661 - RNA, 13 nt, Shigella flexneri 2a str. 2457T
gcaccgcagagau

SEQ ID NO: 1905662 - RNA, 15 nt, Shigella flexneri 2a str. 2457T
gcaccguaaacggcu

SEQ ID NO: 1905663 - RNA, 17 nt, Shigella flexneri 2a str. 2457T
gcaccgggcuuccggca

SEQ ID NO: 1905664 - RNA, 16 nt, Shigella flexneri 2a str. 2457T
gcaccgugacaguaau

SEQ ID NO: 1905665 - RNA, 24 nt, Shigella flexneri 2a str. 2457T
gcaccugaguaauuaauacgccag

SEQ ID NO: 1905666 - RNA, 14 nt, Shigella flexneri 2a str. 2457T
gcaccuguaccagc

SEQ ID NO: 1905667 - RNA, 17 nt, Shigella flexneri 2a str. 2457T
gcaccuguaccagcccg

SEQ ID NO: 1905668 - RNA, 16 nt, Shigella flexneri 2a str. 2457T
gcaccuuuaccacucc

SEQ ID NO: 1905669 - RNA, 17 nt, Shigella flexneri 2a str. 2457T
gcaccuuaccucaggca

SEQ ID NO: 1905670 - RNA, 16 nt, Shigella flexneri 2a str. 2457T
gcacgccgacaaagau

SEQ ID NO: 1905671 - RNA, 21 nt, Shigella flexneri 2a str. 2457T
gcacgacuuucucuucaucua

SEQ ID NO: 1905672 - RNA, 11 nt, Shigella flexneri 2a str. 2457T
gcaaugaaauu

SEQ ID NO: 1905673 - RNA, 14 nt, Shigella flexneri 2a str. 2457T
gcaaucugcuggca

SEQ ID NO: 1905674 - RNA, 21 nt, Shigella flexneri 2a str. 2457T
gcaaucuuuagcauaaaaacu

SEQ ID NO: 1905675 - RNA, 14 nt, Shigella flexneri 2a str. 2457T
gcaaugcuuccugc

SEQ ID NO: 1905676 - RNA, 20 nt, Shigella flexneri 2a str. 2457T
gcaauggccguuccggcaac

SEQ ID NO: 1905677 - RNA, 23 nt, Shigella flexneri 2a str. 2457T
gcaaucaaauaccaccagcgaaa

SEQ ID NO: 1905678 - RNA, 20 nt, Shigella flexneri 2a str. 2457T
gcaauauucauuaaaacuga

SEQ ID NO: 1905679 - RNA, 18 nt, Shigella flexneri 2a str. 2457T
gcaauauucuuuugcagc

SEQ ID NO: 1905680 - RNA, 19 nt, Shigella flexneri 2a str. 2457T
gcaauauuguagcaacucc

SEQ ID NO: 1905681 - RNA, 14 nt, Shigella flexneri 2a str. 2457T
gcaaucaccgccag

SEQ ID NO: 1905682 - RNA, 22 nt, Shigella flexneri 2a str. 2457T
gcaauagcggacacuaccauuu

SEQ ID NO: 1905683 - RNA, 13 nt, Shigella flexneri 2a str. 2457T
gcaauauauugaa

SEQ ID NO: 1905684 - RNA, 19 nt, Shigella flexneri 2a str. 2457T
gcaauauauugaauuugca

SEQ ID NO: 1905685 - RNA, 20 nt, Shigella flexneri 2a str. 2457T
gcaauauauugaauuugcau

SEQ ID NO: 1905686 - RNA, 22 nt, Shigella flexneri 2a str. 2457T
gcaauagcuucuuccacauugu

SEQ ID NO: 1905687 - RNA, 19 nt, Shigella flexneri 2a str. 2457T
gcaauagacaguucuuccu

SEQ ID NO: 1905688 - RNA, 20 nt, Shigella flexneri 2a str. 2457T
gcaauagauugaauuagcaa

SEQ ID NO: 1905689 - RNA, 18 nt, Shigella flexneri 2a str. 2457T
gcaagucggcaucgccac

SEQ ID NO: 1905690 - RNA, 15 nt, Shigella flexneri 2a str. 2457T
gcaaguaauaauauc

SEQ ID NO: 1905691 - RNA, 22 nt, Shigella flexneri 2a str. 2457T
gcaagugcggcgcaccagcagg

SEQ ID NO: 1905692 - RNA, 12 nt, Shigella flexneri 2a str. 2457T
gcaagcggcggc

SEQ ID NO: 1905693 - RNA, 15 nt, Shigella flexneri 2a str. 2457T
gcaagcggcgacuga

SEQ ID NO: 1905694 - RNA, 23 nt, Shigella flexneri 2a str. 2457T
gcaaggugaaagcaauuaacagu

SEQ ID NO: 1905695 - RNA, 24 nt, Shigella flexneri 2a str. 2457T
gcaagguggucagacggaacaucu

SEQ ID NO: 1905696 - RNA, 15 nt, Shigella flexneri 2a str. 2457T
gcaagccacaauaaa

SEQ ID NO: 1905697 - RNA, 12 nt, Shigella flexneri 2a str. 2457T
gcaagcccagcc

SEQ ID NO: 1905698 - RNA, 20 nt, Shigella flexneri 2a str. 2457T
gcaagccgcuaacagcagca

SEQ ID NO: 1905699 - RNA, 23 nt, Shigella flexneri 2a str. 2457T
gcaacuucucuuucggcagugcc

SEQ ID NO: 1905700 - RNA, 13 nt, Shigella flexneri 2a str. 2457T
gcaagaaauaccg

SEQ ID NO: 1905701 - RNA, 22 nt, Shigella flexneri 2a str. 2457T
gcaagaaauaccgaagaguaac

SEQ ID NO: 1905702 - RNA, 11 nt, Shigella flexneri 2a str. 2457T
gcaagcaaaug

SEQ ID NO: 1905703 - RNA, 15 nt, Shigella flexneri 2a str. 2457T
gcaagaugaauaaug

SEQ ID NO: 1905704 - RNA, 15 nt, Shigella flexneri 2a str. 2457T
gcaaauuuauuaucu

SEQ ID NO: 1905705 - RNA, 12 nt, Shigella flexneri 2a str. 2457T
gcaacuucucuu

SEQ ID NO: 1905706 - RNA, 22 nt, Shigella flexneri 2a str. 2457T
gcaacuuaaucaucaaugccag

SEQ ID NO: 1905707 - RNA, 20 nt, Shigella flexneri 2a str. 2457T
gcaaauucggcggcgugccu

SEQ ID NO: 1905708 - RNA, 20 nt, Shigella flexneri 2a str. 2457T
gcaaauucuugugcgggggc

SEQ ID NO: 1905709 - RNA, 13 nt, Shigella flexneri 2a str. 2457T
gcaccaacaaaua

SEQ ID NO: 1905710 - RNA, 14 nt, Shigella flexneri 2a str. 2457T
gcaccaccagcagc

SEQ ID NO: 1905711 - RNA, 22 nt, Shigella flexneri 2a str. 2457T
gcacaucaauuugcccaccggu

SEQ ID NO: 1905712 - RNA, 14 nt, Shigella flexneri 2a str. 2457T
gcacauuucaauca

SEQ ID NO: 1905713 - RNA, 22 nt, Shigella flexneri 2a str. 2457T
gcaccaccuggcuugccgggcc

SEQ ID NO: 1905714 - RNA, 19 nt, Shigella flexneri 2a str. 2457T
gcaccaccagcagcugcuc

SEQ ID NO: 1905715 - RNA, 23 nt, Shigella flexneri 2a str. 2457T
gcacaccaggcucuuuaaacagu

SEQ ID NO: 1905716 - RNA, 17 nt, Shigella flexneri 2a str. 2457T
gcacaccaaccgcuucc

SEQ ID NO: 1905717 - RNA, 18 nt, Shigella flexneri 2a str. 2457T
gcacacagggcgcuagcc

SEQ ID NO: 1905718 - RNA, 19 nt, Shigella flexneri 2a str. 2457T
gcacacuuagccuguguca

SEQ ID NO: 1905719 - RNA, 16 nt, Shigella flexneri 2a str. 2457T
gcacacguaggccaac

SEQ ID NO: 1905720 - RNA, 14 nt, Shigella flexneri 2a str. 2457T
gcacagaucgcacu

SEQ ID NO: 1905721 - RNA, 16 nt, Shigella flexneri 2a str. 2457T
gcacauacugcaucag

SEQ ID NO: 1905722 - RNA, 17 nt, Shigella flexneri 2a str. 2457T
gcacauaagucagcccg

SEQ ID NO: 1905723 - RNA, 19 nt, Shigella flexneri 2a str. 2457T
gcaauuucacguucaccca

SEQ ID NO: 1905724 - RNA, 18 nt, Shigella flexneri 2a str. 2457T
gcaauuuuuccugguucu

SEQ ID NO: 1905725 - RNA, 14 nt, Shigella flexneri 2a str. 2457T
gcacaaaaccugcc

SEQ ID NO: 1905726 - RNA, 14 nt, Shigella flexneri 2a str. 2457T
gcacaaaacagguc

SEQ ID NO: 1905727 - RNA, 16 nt, Shigella flexneri 2a str. 2457T
gcacaacucggcggcu

SEQ ID NO: 1905728 - RNA, 16 nt, Shigella flexneri 2a str. 2457T
gcacaagcuaccagcc

SEQ ID NO: 1905729 - RNA, 16 nt, Shigella flexneri 2a str. 2457T
gcacacacugcuuaac

SEQ ID NO: 1905730 - RNA, 14 nt, Shigella flexneri 2a str. 2457T
gcacaaucacguca

SEQ ID NO: 1905731 - RNA, 16 nt, Shigella flexneri 2a str. 2457T
gcacaauauuuuuauc

SEQ ID NO: 1905732 - RNA, 18 nt, Shigella flexneri 2a str. 2457T
gcacaauacauagaaacu

SEQ ID NO: 1905733 - RNA, 17 nt, Shigella flexneri 2a str. 2457T
gcaauggcuggccccgu

SEQ ID NO: 1905734 - RNA, 17 nt, Shigella flexneri 2a str. 2457T
gcaauggcuucauccac

SEQ ID NO: 1905735 - RNA, 17 nt, Shigella flexneri 2a str. 2457T
gcaauguguggaugccu

SEQ ID NO: 1905736 - RNA, 16 nt, Shigella flexneri 2a str. 2457T
gcaauuagcggcuggc

SEQ ID NO: 1905737 - RNA, 16 nt, Shigella flexneri 2a str. 2457T
gcaauuacaugcuggu

SEQ ID NO: 1905738 - RNA, 22 nt, Shigella flexneri 2a str. 2457T
gcaauuacccaguagacagcaa

SEQ ID NO: 1905739 - RNA, 17 nt, Shigella flexneri 2a str. 2457T
gcaauuccagcgccagu

SEQ ID NO: 1905740 - RNA, 16 nt, Shigella flexneri 2a str. 2457T
gcaauuccagcgccag

SEQ ID NO: 1905741 - RNA, 23 nt, Shigella flexneri 2a str. 2457T
gcaucauuuaaaaagaaaaaacu

SEQ ID NO: 1905742 - RNA, 16 nt, Shigella flexneri 2a str. 2457T
gcauccauaucgccau

SEQ ID NO: 1905743 - RNA, 16 nt, Shigella flexneri 2a str. 2457T
gcauccccgcccuucc

SEQ ID NO: 1905744 - RNA, 15 nt, Shigella flexneri 2a str. 2457T
gcaucccagaaaaaa

SEQ ID NO: 1905745 - RNA, 15 nt, Shigella flexneri 2a str. 2457T
gcaucccaacucauu

SEQ ID NO: 1905746 - RNA, 16 nt, Shigella flexneri 2a str. 2457T
gcaucccggcagcccc

SEQ ID NO: 1905747 - RNA, 22 nt, Shigella flexneri 2a str. 2457T
gcaucccgguaucaaagcgcca

SEQ ID NO: 1905748 - RNA, 17 nt, Shigella flexneri 2a str. 2457T
gcauccgacauuugcac

SEQ ID NO: 1905749 - RNA, 19 nt, Shigella flexneri 2a str. 2457T
gcauccgaagaaccacaga

SEQ ID NO: 1905750 - RNA, 16 nt, Shigella flexneri 2a str. 2457T
gcauccgacacuggca

SEQ ID NO: 1905751 - RNA, 18 nt, Shigella flexneri 2a str. 2457T
gcaucgacaguuucaccu

SEQ ID NO: 1905752 - RNA, 13 nt, Shigella flexneri 2a str. 2457T
gcaucgaccagga

SEQ ID NO: 1905753 - RNA, 19 nt, Shigella flexneri 2a str. 2457T
gcaucgauaucaaccaguu

SEQ ID NO: 1905754 - RNA, 24 nt, Shigella flexneri 2a str. 2457T
gcaucgacggcggagucauucucc

SEQ ID NO: 1905755 - RNA, 18 nt, Shigella flexneri 2a str. 2457T
gcauccugaucguccugc

SEQ ID NO: 1905756 - RNA, 21 nt, Shigella flexneri 2a str. 2457T
gcauccuggcuguuacucaac

SEQ ID NO: 1905757 - RNA, 20 nt, Shigella flexneri 2a str. 2457T
gcauccuggggguucaucac

SEQ ID NO: 1905758 - RNA, 14 nt, Shigella flexneri 2a str. 2457T
gcauccuugcuaac

SEQ ID NO: 1905759 - RNA, 21 nt, Shigella flexneri 2a str. 2457T
gcauccggucagacaacuucc

SEQ ID NO: 1905760 - RNA, 21 nt, Shigella flexneri 2a str. 2457T
gcauccggcaauucucucuga

SEQ ID NO: 1905761 - RNA, 14 nt, Shigella flexneri 2a str. 2457T
gcauccggcacucu

SEQ ID NO: 1905762 - RNA, 21 nt, Shigella flexneri 2a str. 2457T
gcauccggcaauugugauggu

SEQ ID NO: 1905763 - RNA, 17 nt, Shigella flexneri 2a str. 2457T
gcauccggcaauaagca

SEQ ID NO: 1905764 - RNA, 19 nt, Shigella flexneri 2a str. 2457T
gcauccggcaaucggugca

SEQ ID NO: 1905765 - RNA, 14 nt, Shigella flexneri 2a str. 2457T
gcauccggcaucaa

SEQ ID NO: 1905766 - RNA, 19 nt, Shigella flexneri 2a str. 2457T
gcauccggcaucaacaaag

SEQ ID NO: 1905767 - RNA, 21 nt, Shigella flexneri 2a str. 2457T
gcauccggcauuugagcagga

SEQ ID NO: 1905768 - RNA, 19 nt, Shigella flexneri 2a str. 2457T
gcauccgggauggucagcg

SEQ ID NO: 1905769 - RNA, 17 nt, Shigella flexneri 2a str. 2457T
gcaucacgaauccgcac

SEQ ID NO: 1905770 - RNA, 17 nt, Shigella flexneri 2a str. 2457T
gcaucacgacagcacca

SEQ ID NO: 1905771 - RNA, 14 nt, Shigella flexneri 2a str. 2457T
gcaucacuccacac

SEQ ID NO: 1905772 - RNA, 15 nt, Shigella flexneri 2a str. 2457T
gcaucacuuccagua

SEQ ID NO: 1905773 - RNA, 23 nt, Shigella flexneri 2a str. 2457T
gcaucagacaaaugucacugcuu

SEQ ID NO: 1905774 - RNA, 15 nt, Shigella flexneri 2a str. 2457T
gcaucagaucggcag

SEQ ID NO: 1905775 - RNA, 19 nt, Shigella flexneri 2a str. 2457T
gcaucagcccaaagcagag

SEQ ID NO: 1905776 - RNA, 17 nt, Shigella flexneri 2a str. 2457T
gcaucaggccaaacaga

SEQ ID NO: 1905777 - RNA, 16 nt, Shigella flexneri 2a str. 2457T
gcaucagggcgcuggc

SEQ ID NO: 1905778 - RNA, 18 nt, Shigella flexneri 2a str. 2457T
gcaucaguaugaaugaca

SEQ ID NO: 1905779 - RNA, 14 nt, Shigella flexneri 2a str. 2457T
gcaucaugccaccc

SEQ ID NO: 1905780 - RNA, 21 nt, Shigella flexneri 2a str. 2457T
gcaucaugucgcccacgccag

SEQ ID NO: 1905781 - RNA, 18 nt, Shigella flexneri 2a str. 2457T
gcauaugcgggcguuuug

SEQ ID NO: 1905782 - RNA, 12 nt, Shigella flexneri 2a str. 2457T
gcauaucuucaa

SEQ ID NO: 1905783 - RNA, 22 nt, Shigella flexneri 2a str. 2457T
gcaucacauccggcaauauuca

SEQ ID NO: 1905784 - RNA, 13 nt, Shigella flexneri 2a str. 2457T
gcaucaauaauca

SEQ ID NO: 1905785 - RNA, 21 nt, Shigella flexneri 2a str. 2457T
gcaucaagaaugcucgcuggc

SEQ ID NO: 1905786 - RNA, 18 nt, Shigella flexneri 2a str. 2457T
gcaggucgucuuuuacag

SEQ ID NO: 1905787 - RNA, 14 nt, Shigella flexneri 2a str. 2457T
gcagggccaccagc

SEQ ID NO: 1905788 - RNA, 18 nt, Shigella flexneri 2a str. 2457T
gcaggcuuuagcuaauca

SEQ ID NO: 1905789 - RNA, 15 nt, Shigella flexneri 2a str. 2457T
gcaggcuauuucugg

SEQ ID NO: 1905790 - RNA, 20 nt, Shigella flexneri 2a str. 2457T
gcaguagcgucgccagcagu

SEQ ID NO: 1905791 - RNA, 16 nt, Shigella flexneri 2a str. 2457T
gcaguaucagagauaa

SEQ ID NO: 1905792 - RNA, 12 nt, Shigella flexneri 2a str. 2457T
gcaguaaaccac

SEQ ID NO: 1905793 - RNA, 13 nt, Shigella flexneri 2a str. 2457T
gcaguaaaccgcu

SEQ ID NO: 1905794 - RNA, 20 nt, Shigella flexneri 2a str. 2457T
gcaguaaaccacccaccagc

SEQ ID NO: 1905795 - RNA, 16 nt, Shigella flexneri 2a str. 2457T
gcaguaaaccacccac

SEQ ID NO: 1905796 - RNA, 23 nt, Shigella flexneri 2a str. 2457T
gcagugcacgaaccagagacaga

SEQ ID NO: 1905797 - RNA, 14 nt, Shigella flexneri 2a str. 2457T
gcagucaggcgcgc

SEQ ID NO: 1905798 - RNA, 17 nt, Shigella flexneri 2a str. 2457T
gcagucacaccagcgau

SEQ ID NO: 1905799 - RNA, 19 nt, Shigella flexneri 2a str. 2457T
gcagucaccugcccuccgg

SEQ ID NO: 1905800 - RNA, 16 nt, Shigella flexneri 2a str. 2457T
gcauacggugaaaguc

SEQ ID NO: 1905801 - RNA, 16 nt, Shigella flexneri 2a str. 2457T
gcauacguuucaccag

SEQ ID NO: 1905802 - RNA, 16 nt, Shigella flexneri 2a str. 2457T
gcauacucuccuccag

SEQ ID NO: 1905803 - RNA, 14 nt, Shigella flexneri 2a str. 2457T
gcauagaaaaagaa

SEQ ID NO: 1905804 - RNA, 14 nt, Shigella flexneri 2a str. 2457T
gcauacuuucauca

SEQ ID NO: 1905805 - RNA, 17 nt, Shigella flexneri 2a str. 2457T
gcauacggguaaaggcg

SEQ ID NO: 1905806 - RNA, 15 nt, Shigella flexneri 2a str. 2457T
gcauaaucggcuggg

SEQ ID NO: 1905807 - RNA, 14 nt, Shigella flexneri 2a str. 2457T
gcauauaaugcaac

SEQ ID NO: 1905808 - RNA, 19 nt, Shigella flexneri 2a str. 2457T
gcauauagccaaagcacca

SEQ ID NO: 1905809 - RNA, 18 nt, Shigella flexneri 2a str. 2457T
gcauauaccucagcagac

SEQ ID NO: 1905810 - RNA, 15 nt, Shigella flexneri 2a str. 2457T
gcauauaccacaccc

SEQ ID NO: 1905811 - RNA, 17 nt, Shigella flexneri 2a str. 2457T
gcauaucgacgaaccau

SEQ ID NO: 1905812 - RNA, 13 nt, Shigella flexneri 2a str. 2457T
gcauauccaggcu

SEQ ID NO: 1905813 - RNA, 16 nt, Shigella flexneri 2a str. 2457T
gcauaucagcaacucu

SEQ ID NO: 1905814 - RNA, 18 nt, Shigella flexneri 2a str. 2457T
gcauaauccacuuucuua

SEQ ID NO: 1905815 - RNA, 22 nt, Shigella flexneri 2a str. 2457T
gcauaaucaccaucagcagcaa

SEQ ID NO: 1905816 - RNA, 21 nt, Shigella flexneri 2a str. 2457T
gcauaaucauuacaaccgcug

SEQ ID NO: 1905817 - RNA, 12 nt, Shigella flexneri 2a str. 2457T
gcauaaaaauau

SEQ ID NO: 1905818 - RNA, 16 nt, Shigella flexneri 2a str. 2457T
gcauaaacaaagcgca

SEQ ID NO: 1905819 - RNA, 15 nt, Shigella flexneri 2a str. 2457T
gcaguggauaauaca

SEQ ID NO: 1905820 - RNA, 22 nt, Shigella flexneri 2a str. 2457T
gcaguggcaaacugaguggagu

SEQ ID NO: 1905821 - RNA, 14 nt, Shigella flexneri 2a str. 2457T
gcaguggcaaccag

SEQ ID NO: 1905822 - RNA, 16 nt, Shigella flexneri 2a str. 2457T
gcagugcuuucauuuc

SEQ ID NO: 1905823 - RNA, 15 nt, Shigella flexneri 2a str. 2457T
gcaguuucugauacu

SEQ ID NO: 1905824 - RNA, 21 nt, Shigella flexneri 2a str. 2457T
gcaguuucugauacugcuccg

SEQ ID NO: 1905825 - RNA, 17 nt, Shigella flexneri 2a str. 2457T
gcaguuucaccagcagu

SEQ ID NO: 1905826 - RNA, 18 nt, Shigella flexneri 2a str. 2457T
gcaguuucauccuucauu

SEQ ID NO: 1905827 - RNA, 14 nt, Shigella flexneri 2a str. 2457T
gcaggaaaaaagcg

SEQ ID NO: 1905828 - RNA, 19 nt, Shigella flexneri 2a str. 2457T
gcaggcaucggugaugcuc

SEQ ID NO: 1905829 - RNA, 16 nt, Shigella flexneri 2a str. 2457T
gcaggcaucaucagau

SEQ ID NO: 1905830 - RNA, 16 nt, Shigella flexneri 2a str. 2457T
gcaggcaucaaugaaa

SEQ ID NO: 1905831 - RNA, 17 nt, Shigella flexneri 2a str. 2457T
gcaggccuggguaaaaa

SEQ ID NO: 1905832 - RNA, 20 nt, Shigella flexneri 2a str. 2457T
gcaggccugauaagcgcagc

SEQ ID NO: 1905833 - RNA, 19 nt, Shigella flexneri 2a str. 2457T
gcaggcguaacacucgugc

SEQ ID NO: 1905834 - RNA, 18 nt, Shigella flexneri 2a str. 2457T
gcaggcuaguaaaaagca

SEQ ID NO: 1905835 - RNA, 18 nt, Shigella flexneri 2a str. 2457T
gcaggcguuaaaacaggu

SEQ ID NO: 1905836 - RNA, 20 nt, Shigella flexneri 2a str. 2457T
gcaggcgauccuguucaaac

SEQ ID NO: 1905837 - RNA, 18 nt, Shigella flexneri 2a str. 2457T
gcaggcgauuuacuggca

SEQ ID NO: 1905838 - RNA, 20 nt, Shigella flexneri 2a str. 2457T
gcagcggucggcuucccugc

SEQ ID NO: 1905839 - RNA, 13 nt, Shigella flexneri 2a str. 2457T
gcagcgucuucug

SEQ ID NO: 1905840 - RNA, 18 nt, Shigella flexneri 2a str. 2457T
gcagcgugauccaccccu

SEQ ID NO: 1905841 - RNA, 18 nt, Shigella flexneri 2a str. 2457T
gcagcugcgcuucaauac

SEQ ID NO: 1905842 - RNA, 12 nt, Shigella flexneri 2a str. 2457T
gcagcugcgcau

SEQ ID NO: 1905843 - RNA, 12 nt, Shigella flexneri 2a str. 2457T
gcagcugagaaa

SEQ ID NO: 1905844 - RNA, 22 nt, Shigella flexneri 2a str. 2457T
gcagcgccuuuuguuuguucuu

SEQ ID NO: 1905845 - RNA, 17 nt, Shigella flexneri 2a str. 2457T
gcacuggcggcagcagg

SEQ ID NO: 1905846 - RNA, 15 nt, Shigella flexneri 2a str. 2457T
gcacuguuucgccag

SEQ ID NO: 1905847 - RNA, 18 nt, Shigella flexneri 2a str. 2457T
gcagcaaauagccgagcg

SEQ ID NO: 1905848 - RNA, 19 nt, Shigella flexneri 2a str. 2457T
gcagcaaauagccgagcgc

SEQ ID NO: 1905849 - RNA, 22 nt, Shigella flexneri 2a str. 2457T
gcagauuagccgguaaaucacc

SEQ ID NO: 1905850 - RNA, 19 nt, Shigella flexneri 2a str. 2457T
gcacuucacccaucgccag

SEQ ID NO: 1905851 - RNA, 13 nt, Shigella flexneri 2a str. 2457T
gcagauuugccag

SEQ ID NO: 1905852 - RNA, 12 nt, Shigella flexneri 2a str. 2457T
gcacuucaacuu

SEQ ID NO: 1905853 - RNA, 14 nt, Shigella flexneri 2a str. 2457T
gcagcagagaaaau

SEQ ID NO: 1905854 - RNA, 20 nt, Shigella flexneri 2a str. 2457T
gcagcacccugaguuuucag

SEQ ID NO: 1905855 - RNA, 14 nt, Shigella flexneri 2a str. 2457T
gcagcaccgauccu

SEQ ID NO: 1905856 - RNA, 16 nt, Shigella flexneri 2a str. 2457T
gcagcaucaugccgcu

SEQ ID NO: 1905857 - RNA, 16 nt, Shigella flexneri 2a str. 2457T
gcagcaucgccaggau

SEQ ID NO: 1905858 - RNA, 17 nt, Shigella flexneri 2a str. 2457T
gcagcaucgcucaccca

SEQ ID NO: 1905859 - RNA, 22 nt, Shigella flexneri 2a str. 2457T
gcagcgcaauuaacgccccaag

SEQ ID NO: 1905860 - RNA, 13 nt, Shigella flexneri 2a str. 2457T
gcagcauggucag

SEQ ID NO: 1905861 - RNA, 11 nt, Shigella flexneri 2a str. 2457T
gcagcaugcac

SEQ ID NO: 1905862 - RNA, 13 nt, Shigella flexneri 2a str. 2457T
gcagcaugcaccc

SEQ ID NO: 1905863 - RNA, 18 nt, Shigella flexneri 2a str. 2457T
gcagcaugcaucccgccg

SEQ ID NO: 1905864 - RNA, 22 nt, Shigella flexneri 2a str. 2457T
gcagcaugcacccucaauaacu

SEQ ID NO: 1905865 - RNA, 22 nt, Shigella flexneri 2a str. 2457T
gcagccaccacuugcagcucau

SEQ ID NO: 1905866 - RNA, 20 nt, Shigella flexneri 2a str. 2457T
gcagccacacguuaaugcaa

SEQ ID NO: 1905867 - RNA, 21 nt, Shigella flexneri 2a str. 2457T
gcagcauuucaaaacggucac

SEQ ID NO: 1905868 - RNA, 18 nt, Shigella flexneri 2a str. 2457T
gcagcauguguaaccgcu

SEQ ID NO: 1905869 - RNA, 14 nt, Shigella flexneri 2a str. 2457T
gcagcauggucagg

SEQ ID NO: 1905870 - RNA, 21 nt, Shigella flexneri 2a str. 2457T
gcagcauucgccgcauugucu

SEQ ID NO: 1905871 - RNA, 10 nt, Shigella flexneri 2a str. 2457T
gcaaagcgac

SEQ ID NO: 1905872 - RNA, 15 nt, Shigella flexneri 2a str. 2457T
gcaaagcgccagggc

SEQ ID NO: 1905873 - RNA, 15 nt, Shigella flexneri 2a str. 2457T
gcaaagcaaauuuug

SEQ ID NO: 1905874 - RNA, 19 nt, Shigella flexneri 2a str. 2457T
gcaaagcugucaccaauca

SEQ ID NO: 1905875 - RNA, 22 nt, Shigella flexneri 2a str. 2457T
gcaaaguggcgcagagccugaa

SEQ ID NO: 1905876 - RNA, 16 nt, Shigella flexneri 2a str. 2457T
gcaaagugaauacaga

SEQ ID NO: 1905877 - RNA, 19 nt, Shigella flexneri 2a str. 2457T
gcaaagugaauacagaaca

SEQ ID NO: 1905878 - RNA, 21 nt, Shigella flexneri 2a str. 2457T
gcaaagugaauacagaacagu

SEQ ID NO: 1905879 - RNA, 13 nt, Shigella flexneri 2a str. 2457T
gcaaagugccccc

SEQ ID NO: 1905880 - RNA, 15 nt, Shigella flexneri 2a str. 2457T
gcaaagugcccccaa

SEQ ID NO: 1905881 - RNA, 15 nt, Shigella flexneri 2a str. 2457T
gcaaauaacguaaaa

SEQ ID NO: 1905882 - RNA, 17 nt, Shigella flexneri 2a str. 2457T
gcaaaguuugugaucuu

SEQ ID NO: 1905883 - RNA, 19 nt, Shigella flexneri 2a str. 2457T
gcaaaguaauaaugaucag

SEQ ID NO: 1905884 - RNA, 19 nt, Shigella flexneri 2a str. 2457T
gcaaauucaauaaauugca

SEQ ID NO: 1905885 - RNA, 16 nt, Shigella flexneri 2a str. 2457T
gcaaauucauuaccaa

SEQ ID NO: 1905886 - RNA, 15 nt, Shigella flexneri 2a str. 2457T
gcaaaugcagcauug

SEQ ID NO: 1905887 - RNA, 12 nt, Shigella flexneri 2a str. 2457T
gcaaaucgcggc

SEQ ID NO: 1905888 - RNA, 18 nt, Shigella flexneri 2a str. 2457T
gcaaaucgcugaauaucu

SEQ ID NO: 1905889 - RNA, 23 nt, Shigella flexneri 2a str. 2457T
gcaaaucguauccggcauuauca

SEQ ID NO: 1905890 - RNA, 19 nt, Shigella flexneri 2a str. 2457T
gcaaaucgaucucaaugag

SEQ ID NO: 1905891 - RNA, 20 nt, Shigella flexneri 2a str. 2457T
gcaaaucgaucucaaugagc

SEQ ID NO: 1905892 - RNA, 12 nt, Shigella flexneri 2a str. 2457T
gcaaauauuaau

SEQ ID NO: 1905893 - RNA, 14 nt, Shigella flexneri 2a str. 2457T
gcaaauauuaauaa

SEQ ID NO: 1905894 - RNA, 22 nt, Shigella flexneri 2a str. 2457T
gcaaauaccggacacacuucau

SEQ ID NO: 1905895 - RNA, 17 nt, Shigella flexneri 2a str. 2457T
gcaaauacccaaaaaau

SEQ ID NO: 1905896 - RNA, 17 nt, Shigella flexneri 2a str. 2457T
gcaaauccacguuccag

SEQ ID NO: 1905897 - RNA, 21 nt, Shigella flexneri 2a str. 2457T
gcaaauccacguuccagaucu

SEQ ID NO: 1905898 - RNA, 15 nt, Shigella flexneri 2a str. 2457T
gcaaaucccaucggu

SEQ ID NO: 1905899 - RNA, 16 nt, Shigella flexneri 2a str. 2457T
gcaaauccaucgccug

SEQ ID NO: 1905900 - RNA, 14 nt, Shigella flexneri 2a str. 2457T
gcaaacgaaagcag

SEQ ID NO: 1905901 - RNA, 16 nt, Shigella flexneri 2a str. 2457T
gcaaacguaaaacugc

SEQ ID NO: 1905902 - RNA, 23 nt, Shigella flexneri 2a str. 2457T
gcaaacgguuguagcucggcgca

SEQ ID NO: 1905903 - RNA, 15 nt, Shigella flexneri 2a str. 2457T
gcaaacugaguggag

SEQ ID NO: 1905904 - RNA, 23 nt, Shigella flexneri 2a str. 2457T
gcaaacugcugauguuguuucuc

SEQ ID NO: 1905905 - RNA, 21 nt, Shigella flexneri 2a str. 2457T
gcaaacucaucgccgccaaac

SEQ ID NO: 1905906 - RNA, 21 nt, Shigella flexneri 2a str. 2457T
gcaaacuucuucaguuuuucc

SEQ ID NO: 1905907 - RNA, 15 nt, Shigella flexneri 2a str. 2457T
gcaaagagagaagcc

SEQ ID NO: 1905908 - RNA, 14 nt, Shigella flexneri 2a str. 2457T
gcaaagagagaagc

SEQ ID NO: 1905909 - RNA, 17 nt, Shigella flexneri 2a str. 2457T
gcaaacaggugcuccag

SEQ ID NO: 1905910 - RNA, 18 nt, Shigella flexneri 2a str. 2457T
gcaaacaguucugcagcg

SEQ ID NO: 1905911 - RNA, 13 nt, Shigella flexneri 2a str. 2457T
gcaaacaguuucu

SEQ ID NO: 1905912 - RNA, 23 nt, Shigella flexneri 2a str. 2457T
gcaaaccaugacgcacuuucgcu

SEQ ID NO: 1905913 - RNA, 19 nt, Shigella flexneri 2a str. 2457T
gcaaacaggaacaccagca

SEQ ID NO: 1905914 - RNA, 19 nt, Shigella flexneri 2a str. 2457T
gcaaaauaaccggcaagca

SEQ ID NO: 1905915 - RNA, 22 nt, Shigella flexneri 2a str. 2457T
gcaaaauagguaucguaauuuu

SEQ ID NO: 1905916 - RNA, 11 nt, Shigella flexneri 2a str. 2457T
gcaaaauaggu

SEQ ID NO: 1905917 - RNA, 15 nt, Shigella flexneri 2a str. 2457T
gcaaaauacaugacc

SEQ ID NO: 1905918 - RNA, 22 nt, Shigella flexneri 2a str. 2457T
gcaaaaugcaucggcauaauca

SEQ ID NO: 1905919 - RNA, 18 nt, Shigella flexneri 2a str. 2457T
gcaaaaucguaagcagga

SEQ ID NO: 1905920 - RNA, 13 nt, Shigella flexneri 2a str. 2457T
gcaaaaucaccau

SEQ ID NO: 1905921 - RNA, 15 nt, Shigella flexneri 2a str. 2457T
gcaaaaucaccauca

SEQ ID NO: 1905922 - RNA, 22 nt, Shigella flexneri 2a str. 2457T
gcaaaaaaucgccgagcugaac

SEQ ID NO: 1905923 - RNA, 21 nt, Shigella flexneri 2a str. 2457T
gcaaaaaauugcgucaguauu

SEQ ID NO: 1905924 - RNA, 14 nt, Shigella flexneri 2a str. 2457T
gauuuuucugcucg

SEQ ID NO: 1905925 - RNA, 22 nt, Shigella flexneri 2a str. 2457T
gcaaaaacccuucuuccauacc

SEQ ID NO: 1905926 - RNA, 13 nt, Shigella flexneri 2a str. 2457T
gcaaaaauaagcg

SEQ ID NO: 1905927 - RNA, 24 nt, Shigella flexneri 2a str. 2457T
gauuuuucgugagagugaagccug

SEQ ID NO: 1905928 - RNA, 15 nt, Shigella flexneri 2a str. 2457T
gauuuuguaaaagaa

SEQ ID NO: 1905929 - RNA, 14 nt, Shigella flexneri 2a str. 2457T
gauuucuuuauccg

SEQ ID NO: 1905930 - RNA, 19 nt, Shigella flexneri 2a str. 2457T
gauuucauaacugauggca

SEQ ID NO: 1905931 - RNA, 17 nt, Shigella flexneri 2a str. 2457T
gauuucagcaccgcgcu

SEQ ID NO: 1905932 - RNA, 19 nt, Shigella flexneri 2a str. 2457T
gauuucaacgauaaguggg

SEQ ID NO: 1905933 - RNA, 21 nt, Shigella flexneri 2a str. 2457T
gauuucaccaauuccgcagcg

SEQ ID NO: 1905934 - RNA, 17 nt, Shigella flexneri 2a str. 2457T
gauuugcggaaguaguu

SEQ ID NO: 1905935 - RNA, 22 nt, Shigella flexneri 2a str. 2457T
gauuuaaccaacaauaaaauug

SEQ ID NO: 1905936 - RNA, 13 nt, Shigella flexneri 2a str. 2457T
gauuguuaaucac

SEQ ID NO: 1905937 - RNA, 19 nt, Shigella flexneri 2a str. 2457T
gauuguugauuaacaggcu

SEQ ID NO: 1905938 - RNA, 18 nt, Shigella flexneri 2a str. 2457T
gauugccgugaaccugcg

SEQ ID NO: 1905939 - RNA, 17 nt, Shigella flexneri 2a str. 2457T
gauugcgaugguguucc

SEQ ID NO: 1905940 - RNA, 23 nt, Shigella flexneri 2a str. 2457T
gauucuguguaaaugccuuucuc

SEQ ID NO: 1905941 - RNA, 13 nt, Shigella flexneri 2a str. 2457T
gauugaagaaauc

SEQ ID NO: 1905942 - RNA, 22 nt, Shigella flexneri 2a str. 2457T
gauuauuggacgguaaaaagaa

SEQ ID NO: 1905943 - RNA, 23 nt, Shigella flexneri 2a str. 2457T
gauuauuggacgguaaaaagaaa

SEQ ID NO: 1905944 - RNA, 23 nt, Shigella flexneri 2a str. 2457T
gauuauuucgcugcggauuguca

SEQ ID NO: 1905945 - RNA, 15 nt, Shigella flexneri 2a str. 2457T
gauucugauccugca

SEQ ID NO: 1905946 - RNA, 14 nt, Shigella flexneri 2a str. 2457T
gauuacgucuuuac

SEQ ID NO: 1905947 - RNA, 18 nt, Shigella flexneri 2a str. 2457T
gauuacgcgcucaccgcu

SEQ ID NO: 1905948 - RNA, 17 nt, Shigella flexneri 2a str. 2457T
gauuaagugaaccuuaa

SEQ ID NO: 1905949 - RNA, 12 nt, Shigella flexneri 2a str. 2457T
gauuaucuucac

SEQ ID NO: 1905950 - RNA, 16 nt, Shigella flexneri 2a str. 2457T
gauuaucuucgcacuu

SEQ ID NO: 1905951 - RNA, 22 nt, Shigella flexneri 2a str. 2457T
gauuauggaucaguguacuuau

SEQ ID NO: 1905952 - RNA, 16 nt, Shigella flexneri 2a str. 2457T
gauuaugcccgcagcg

SEQ ID NO: 1905953 - RNA, 14 nt, Shigella flexneri 2a str. 2457T
gauuaugaucgcca

SEQ ID NO: 1905954 - RNA, 15 nt, Shigella flexneri 2a str. 2457T
gauuaugaucgccac

SEQ ID NO: 1905955 - RNA, 14 nt, Shigella flexneri 2a str. 2457T
gauuacuuccuuca

SEQ ID NO: 1905956 - RNA, 15 nt, Shigella flexneri 2a str. 2457T
gauuacuguacagau

SEQ ID NO: 1905957 - RNA, 15 nt, Shigella flexneri 2a str. 2457T
gauuauccaugccac

SEQ ID NO: 1905958 - RNA, 18 nt, Shigella flexneri 2a str. 2457T
gauuaacgcgccggaaau

SEQ ID NO: 1905959 - RNA, 23 nt, Shigella flexneri 2a str. 2457T
gauuaacugggcgucaaagugaa

SEQ ID NO: 1905960 - RNA, 15 nt, Shigella flexneri 2a str. 2457T
gauuaaagaaaauaa

SEQ ID NO: 1905961 - RNA, 13 nt, Shigella flexneri 2a str. 2457T
gaugucagcacuu

SEQ ID NO: 1905962 - RNA, 14 nt, Shigella flexneri 2a str. 2457T
gauguuugagcuaa

SEQ ID NO: 1905963 - RNA, 22 nt, Shigella flexneri 2a str. 2457T
gauggugcaaauugcaccaucc

SEQ ID NO: 1905964 - RNA, 16 nt, Shigella flexneri 2a str. 2457T
gaugguuuugcuuuau

SEQ ID NO: 1905965 - RNA, 22 nt, Shigella flexneri 2a str. 2457T
gaugguuuuuggguucagcauu

SEQ ID NO: 1905966 - RNA, 17 nt, Shigella flexneri 2a str. 2457T
gauguaauuaagcgcaa

SEQ ID NO: 1905967 - RNA, 15 nt, Shigella flexneri 2a str. 2457T
gauguaauucagcca

SEQ ID NO: 1905968 - RNA, 23 nt, Shigella flexneri 2a str. 2457T
gauguaaucaacuccgccagcaa

SEQ ID NO: 1905969 - RNA, 23 nt, Shigella flexneri 2a str. 2457T
gaugggcguuuucuaccagguuu

SEQ ID NO: 1905970 - RNA, 15 nt, Shigella flexneri 2a str. 2457T
gaugguauucaucgc

SEQ ID NO: 1905971 - RNA, 23 nt, Shigella flexneri 2a str. 2457T
gauggucacggacaggugaugca

SEQ ID NO: 1905972 - RNA, 16 nt, Shigella flexneri 2a str. 2457T
gauggcgauaaucuuu

SEQ ID NO: 1905973 - RNA, 16 nt, Shigella flexneri 2a str. 2457T
gauggcagucuggaca

SEQ ID NO: 1905974 - RNA, 19 nt, Shigella flexneri 2a str. 2457T
gauggcagaguugccaccc

SEQ ID NO: 1905975 - RNA, 22 nt, Shigella flexneri 2a str. 2457T
gauggaacaaaauuuucagcgu

SEQ ID NO: 1905976 - RNA, 15 nt, Shigella flexneri 2a str. 2457T
gauggaaugagcauc

SEQ ID NO: 1905977 - RNA, 16 nt, Shigella flexneri 2a str. 2457T
gauggcaauuuucacu

SEQ ID NO: 1905978 - RNA, 19 nt, Shigella flexneri 2a str. 2457T
gauggcaauauguggcuug

SEQ ID NO: 1905979 - RNA, 17 nt, Shigella flexneri 2a str. 2457T
gauggcaagcggugcga

SEQ ID NO: 1905980 - RNA, 11 nt, Shigella flexneri 2a str. 2457T
gaugcuugaug

SEQ ID NO: 1905981 - RNA, 20 nt, Shigella flexneri 2a str. 2457T
gaugcguaccucacguucca

SEQ ID NO: 1905982 - RNA, 14 nt, Shigella flexneri 2a str. 2457T
gaugcuaaaaacau

SEQ ID NO: 1905983 - RNA, 15 nt, Shigella flexneri 2a str. 2457T
gaugccgccagaaau

SEQ ID NO: 1905984 - RNA, 13 nt, Shigella flexneri 2a str. 2457T
gaugccgccagac

SEQ ID NO: 1905985 - RNA, 18 nt, Shigella flexneri 2a str. 2457T
gaugccgcccucgcccgc

SEQ ID NO: 1905986 - RNA, 19 nt, Shigella flexneri 2a str. 2457T
gaugccgccguagaaaaug

SEQ ID NO: 1905987 - RNA, 23 nt, Shigella flexneri 2a str. 2457T
gaugccuugugggccugaaagcu

SEQ ID NO: 1905988 - RNA, 18 nt, Shigella flexneri 2a str. 2457T
gaugcgggucaggccagg

SEQ ID NO: 1905989 - RNA, 17 nt, Shigella flexneri 2a str. 2457T
gaugcgguaaccuggca

SEQ ID NO: 1905990 - RNA, 13 nt, Shigella flexneri 2a str. 2457T
gaugcgccagcau

SEQ ID NO: 1905991 - RNA, 23 nt, Shigella flexneri 2a str. 2457T
gaugcaucggccucaacgucaaa

SEQ ID NO: 1905992 - RNA, 16 nt, Shigella flexneri 2a str. 2457T
gaugcaugauccggca

SEQ ID NO: 1905993 - RNA, 23 nt, Shigella flexneri 2a str. 2457T
gaugaucaacagcaucaucgcaa

SEQ ID NO: 1905994 - RNA, 12 nt, Shigella flexneri 2a str. 2457T
gaugagcaucgu

SEQ ID NO: 1905995 - RNA, 23 nt, Shigella flexneri 2a str. 2457T
gaugagcaaauccgcacucaucu

SEQ ID NO: 1905996 - RNA, 20 nt, Shigella flexneri 2a str. 2457T
gaugaucauccggcuuuuuu

SEQ ID NO: 1905997 - RNA, 12 nt, Shigella flexneri 2a str. 2457T
gaugacagacuc

SEQ ID NO: 1905998 - RNA, 16 nt, Shigella flexneri 2a str. 2457T
gaugacagacuccgcu

SEQ ID NO: 1905999 - RNA, 14 nt, Shigella flexneri 2a str. 2457T
gaugacugaacagg

SEQ ID NO: 1906000 - RNA, 15 nt, Shigella flexneri 2a str. 2457T
gaugacaucgcagca

SEQ ID NO: 1906001 - RNA, 14 nt, Shigella flexneri 2a str. 2457T
gaucgugcucgaca

SEQ ID NO: 1906002 - RNA, 20 nt, Shigella flexneri 2a str. 2457T
gaucguggugaaggcacugg

SEQ ID NO: 1906003 - RNA, 14 nt, Shigella flexneri 2a str. 2457T
gaugaaucaccaca

SEQ ID NO: 1906004 - RNA, 16 nt, Shigella flexneri 2a str. 2457T
gauccgggcauauuuc

SEQ ID NO: 1906005 - RNA, 18 nt, Shigella flexneri 2a str. 2457T
gauccgggcauauuuccg

SEQ ID NO: 1906006 - RNA, 17 nt, Shigella flexneri 2a str. 2457T
gauccuacacauacuua

SEQ ID NO: 1906007 - RNA, 17 nt, Shigella flexneri 2a str. 2457T
gaucgacagcgggugca

SEQ ID NO: 1906008 - RNA, 16 nt, Shigella flexneri 2a str. 2457T
gauccuuuuucccaaa

SEQ ID NO: 1906009 - RNA, 21 nt, Shigella flexneri 2a str. 2457T
gauccugauacagaccgcgca

SEQ ID NO: 1906010 - RNA, 22 nt, Shigella flexneri 2a str. 2457T
gauccuggcgaaaacgcccggc

SEQ ID NO: 1906011 - RNA, 15 nt, Shigella flexneri 2a str. 2457T
gauccuucuguucuu

SEQ ID NO: 1906012 - RNA, 20 nt, Shigella flexneri 2a str. 2457T
gauccacaacgugggccugg

SEQ ID NO: 1906013 - RNA, 17 nt, Shigella flexneri 2a str. 2457T
gaucccuucgccgccgc

SEQ ID NO: 1906014 - RNA, 15 nt, Shigella flexneri 2a str. 2457T
gaucggcaggcaggu

SEQ ID NO: 1906015 - RNA, 21 nt, Shigella flexneri 2a str. 2457T
gaucggacuucaugcgcagca

SEQ ID NO: 1906016 - RNA, 20 nt, Shigella flexneri 2a str. 2457T
gaucgcuuucgcuuucucuu

SEQ ID NO: 1906017 - RNA, 17 nt, Shigella flexneri 2a str. 2457T
gaucgcugcccugcugg

SEQ ID NO: 1906018 - RNA, 23 nt, Shigella flexneri 2a str. 2457T
gaucgcuuucgcuacuucaaaca

SEQ ID NO: 1906019 - RNA, 19 nt, Shigella flexneri 2a str. 2457T
gaucgcucaucugcugcgu

SEQ ID NO: 1906020 - RNA, 13 nt, Shigella flexneri 2a str. 2457T
gaucgcguaauaa

SEQ ID NO: 1906021 - RNA, 15 nt, Shigella flexneri 2a str. 2457T
gaucgaucauauuuc

SEQ ID NO: 1906022 - RNA, 14 nt, Shigella flexneri 2a str. 2457T
gaucgccaaagaaa

SEQ ID NO: 1906023 - RNA, 16 nt, Shigella flexneri 2a str. 2457T
gaucgcauggcggauc

SEQ ID NO: 1906024 - RNA, 13 nt, Shigella flexneri 2a str. 2457T
gaucgccacugcu

SEQ ID NO: 1906025 - RNA, 13 nt, Shigella flexneri 2a str. 2457T
gaucgccagguua

SEQ ID NO: 1906026 - RNA, 14 nt, Shigella flexneri 2a str. 2457T
gaucgcgccgccgc

SEQ ID NO: 1906027 - RNA, 20 nt, Shigella flexneri 2a str. 2457T
gaucgccccggaagcaucaa

SEQ ID NO: 1906028 - RNA, 20 nt, Shigella flexneri 2a str. 2457T
gaucgccgaagugaagagug

SEQ ID NO: 1906029 - RNA, 19 nt, Shigella flexneri 2a str. 2457T
gaucgccgcacuuucuccu

SEQ ID NO: 1906030 - RNA, 21 nt, Shigella flexneri 2a str. 2457T
gauauugccgcgauagcaagc

SEQ ID NO: 1906031 - RNA, 21 nt, Shigella flexneri 2a str. 2457T
gauauugauucaucucuucuu

SEQ ID NO: 1906032 - RNA, 20 nt, Shigella flexneri 2a str. 2457T
gauauugauucaucucuucu

SEQ ID NO: 1906033 - RNA, 23 nt, Shigella flexneri 2a str. 2457T
gauauguucaggauauuuauauu

SEQ ID NO: 1906034 - RNA, 14 nt, Shigella flexneri 2a str. 2457T
gauaugcagcagcc

SEQ ID NO: 1906035 - RNA, 19 nt, Shigella flexneri 2a str. 2457T
gauauggucaaugauuucu

SEQ ID NO: 1906036 - RNA, 16 nt, Shigella flexneri 2a str. 2457T
gauaucucaccagauu

SEQ ID NO: 1906037 - RNA, 23 nt, Shigella flexneri 2a str. 2457T
gauaucuucccgccguugccgca

SEQ ID NO: 1906038 - RNA, 23 nt, Shigella flexneri 2a str. 2457T
gauaucccgccagcaccagcaac

SEQ ID NO: 1906039 - RNA, 19 nt, Shigella flexneri 2a str. 2457T
gauauccacugucaaaucc

SEQ ID NO: 1906040 - RNA, 13 nt, Shigella flexneri 2a str. 2457T
gauauccagcgcc

SEQ ID NO: 1906041 - RNA, 19 nt, Shigella flexneri 2a str. 2457T
gauauccacccgcagccau

SEQ ID NO: 1906042 - RNA, 20 nt, Shigella flexneri 2a str. 2457T
gauagcaagcgcugagacgc

SEQ ID NO: 1906043 - RNA, 15 nt, Shigella flexneri 2a str. 2457T
gaucagcggugguga

SEQ ID NO: 1906044 - RNA, 13 nt, Shigella flexneri 2a str. 2457T
gaucagcgguggu

SEQ ID NO: 1906045 - RNA, 18 nt, Shigella flexneri 2a str. 2457T
gaucagcgguuuugccag

SEQ ID NO: 1906046 - RNA, 16 nt, Shigella flexneri 2a str. 2457T
gaucauucaccagccc

SEQ ID NO: 1906047 - RNA, 16 nt, Shigella flexneri 2a str. 2457T
gaucagcggacgcugc

SEQ ID NO: 1906048 - RNA, 19 nt, Shigella flexneri 2a str. 2457T
gaucagcauccauaucgcc

SEQ ID NO: 1906049 - RNA, 20 nt, Shigella flexneri 2a str. 2457T
gaucagcauccauaucgcca

SEQ ID NO: 1906050 - RNA, 13 nt, Shigella flexneri 2a str. 2457T
gaucagcauuucg

SEQ ID NO: 1906051 - RNA, 19 nt, Shigella flexneri 2a str. 2457T
gaucaagcacaugcugaca

SEQ ID NO: 1906052 - RNA, 17 nt, Shigella flexneri 2a str. 2457T
gaucaagccccagcagg

SEQ ID NO: 1906053 - RNA, 14 nt, Shigella flexneri 2a str. 2457T
gaucaacgcuggca

SEQ ID NO: 1906054 - RNA, 21 nt, Shigella flexneri 2a str. 2457T
gaucaaccaccgucgucccuu

SEQ ID NO: 1906055 - RNA, 16 nt, Shigella flexneri 2a str. 2457T
gauauuuauuuccuuc

SEQ ID NO: 1906056 - RNA, 15 nt, Shigella flexneri 2a str. 2457T
gaucaacagcaucau

SEQ ID NO: 1906057 - RNA, 14 nt, Shigella flexneri 2a str. 2457T
gaucaacacaucca

SEQ ID NO: 1906058 - RNA, 14 nt, Shigella flexneri 2a str. 2457T
gaucaaauuauuac

SEQ ID NO: 1906059 - RNA, 21 nt, Shigella flexneri 2a str. 2457T
gauaauauugaugcacaccau

SEQ ID NO: 1906060 - RNA, 21 nt, Shigella flexneri 2a str. 2457T
gauaacguugaugcaggcagu

SEQ ID NO: 1906061 - RNA, 22 nt, Shigella flexneri 2a str. 2457T
gauaauacacuaacagaacaau

SEQ ID NO: 1906062 - RNA, 17 nt, Shigella flexneri 2a str. 2457T
gauaaccuuccagcuuc

SEQ ID NO: 1906063 - RNA, 21 nt, Shigella flexneri 2a str. 2457T
gauaaccuucuucauuaugaa

SEQ ID NO: 1906064 - RNA, 23 nt, Shigella flexneri 2a str. 2457T
gauaacguguuccaguugcauac

SEQ ID NO: 1906065 - RNA, 16 nt, Shigella flexneri 2a str. 2457T
gauaauuuuuucuucc

SEQ ID NO: 1906066 - RNA, 17 nt, Shigella flexneri 2a str. 2457T
gauaauuuuuucuucca

SEQ ID NO: 1906067 - RNA, 15 nt, Shigella flexneri 2a str. 2457T
gauaauuauuauaau

SEQ ID NO: 1906068 - RNA, 17 nt, Shigella flexneri 2a str. 2457T
gauaauuaaucuuucua

SEQ ID NO: 1906069 - RNA, 20 nt, Shigella flexneri 2a str. 2457T
gauaauuagugcugcuggaa

SEQ ID NO: 1906070 - RNA, 18 nt, Shigella flexneri 2a str. 2457T
gauaauccaucacuucau

SEQ ID NO: 1906071 - RNA, 11 nt, Shigella flexneri 2a str. 2457T
gauaaucucaa

SEQ ID NO: 1906072 - RNA, 22 nt, Shigella flexneri 2a str. 2457T
gauaaugccguuuggcaaauac

SEQ ID NO: 1906073 - RNA, 14 nt, Shigella flexneri 2a str. 2457T
gauaaugcccagca

SEQ ID NO: 1906074 - RNA, 13 nt, Shigella flexneri 2a str. 2457T
gauaauggcuguu

SEQ ID NO: 1906075 - RNA, 16 nt, Shigella flexneri 2a str. 2457T
gauaccaccagugcca

SEQ ID NO: 1906076 - RNA, 17 nt, Shigella flexneri 2a str. 2457T
gauaccagauuaauuau

SEQ ID NO: 1906077 - RNA, 16 nt, Shigella flexneri 2a str. 2457T
gauaccgaacauacca

SEQ ID NO: 1906078 - RNA, 20 nt, Shigella flexneri 2a str. 2457T
gauacgauuugucagcagcu

SEQ ID NO: 1906079 - RNA, 13 nt, Shigella flexneri 2a str. 2457T
gauacccaucauc

SEQ ID NO: 1906080 - RNA, 19 nt, Shigella flexneri 2a str. 2457T
gauaccaucgcuucaugcc

SEQ ID NO: 1906081 - RNA, 15 nt, Shigella flexneri 2a str. 2457T
gauacaguuuuugcg

SEQ ID NO: 1906082 - RNA, 19 nt, Shigella flexneri 2a str. 2457T
gauacagccaaaucaucag

SEQ ID NO: 1906083 - RNA, 22 nt, Shigella flexneri 2a str. 2457T
gauacaacucgcuuaagccauc

SEQ ID NO: 1906084 - RNA, 23 nt, Shigella flexneri 2a str. 2457T
gauacaacugccgcgccugaauc

SEQ ID NO: 1906085 - RNA, 20 nt, Shigella flexneri 2a str. 2457T
gauacacaccgagcguggcg

SEQ ID NO: 1906086 - RNA, 15 nt, Shigella flexneri 2a str. 2457T
gauacagccaaauca

SEQ ID NO: 1906087 - RNA, 16 nt, Shigella flexneri 2a str. 2457T
gauagagcaaccaccu

SEQ ID NO: 1906088 - RNA, 17 nt, Shigella flexneri 2a str. 2457T
gauacgcuugccggaca

SEQ ID NO: 1906089 - RNA, 20 nt, Shigella flexneri 2a str. 2457T
gauacggaauaucgcuggcc

SEQ ID NO: 1906090 - RNA, 13 nt, Shigella flexneri 2a str. 2457T
gauacucugccau

SEQ ID NO: 1906091 - RNA, 21 nt, Shigella flexneri 2a str. 2457T
gauacugaugaacgcgcaggu

SEQ ID NO: 1906092 - RNA, 21 nt, Shigella flexneri 2a str. 2457T
gauacugcccaccgacgcagu

SEQ ID NO: 1906093 - RNA, 13 nt, Shigella flexneri 2a str. 2457T
gauaaagcugggu

SEQ ID NO: 1906094 - RNA, 16 nt, Shigella flexneri 2a str. 2457T
gauaaaggucaucaca

SEQ ID NO: 1906095 - RNA, 12 nt, Shigella flexneri 2a str. 2457T
gauaaaggucga

SEQ ID NO: 1906096 - RNA, 13 nt, Shigella flexneri 2a str. 2457T
gauaaaauacuua

SEQ ID NO: 1906097 - RNA, 21 nt, Shigella flexneri 2a str. 2457T
gauaaaaauaccgagcagcca

SEQ ID NO: 1906098 - RNA, 12 nt, Shigella flexneri 2a str. 2457T
gauaaaaaugaa

SEQ ID NO: 1906099 - RNA, 14 nt, Shigella flexneri 2a str. 2457T
gauaaaacuucccg

SEQ ID NO: 1906100 - RNA, 16 nt, Shigella flexneri 2a str. 2457T
gauaaaagccaucccu

SEQ ID NO: 1906101 - RNA, 16 nt, Shigella flexneri 2a str. 2457T
gauaaaacuucccgug

SEQ ID NO: 1906102 - RNA, 21 nt, Shigella flexneri 2a str. 2457T
gauaaaaccuuccucaccguu

SEQ ID NO: 1906103 - RNA, 14 nt, Shigella flexneri 2a str. 2457T
gauaaaacgacacc

SEQ ID NO: 1906104 - RNA, 12 nt, Shigella flexneri 2a str. 2457T
gauaaaaaaccc

SEQ ID NO: 1906105 - RNA, 19 nt, Shigella flexneri 2a str. 2457T
gaguucccggcagggaagc

SEQ ID NO: 1906106 - RNA, 23 nt, Shigella flexneri 2a str. 2457T
gaguuccaacgcagcacguaauu

SEQ ID NO: 1906107 - RNA, 16 nt, Shigella flexneri 2a str. 2457T
gaguucaggcgcugca

SEQ ID NO: 1906108 - RNA, 18 nt, Shigella flexneri 2a str. 2457T
gaguucaauuggccugau

SEQ ID NO: 1906109 - RNA, 17 nt, Shigella flexneri 2a str. 2457T
gaguucaccguaugacc

SEQ ID NO: 1906110 - RNA, 16 nt, Shigella flexneri 2a str. 2457T
gaauuugcuccagaaa

SEQ ID NO: 1906111 - RNA, 15 nt, Shigella flexneri 2a str. 2457T
gaauuugaugagaac

SEQ ID NO: 1906112 - RNA, 14 nt, Shigella flexneri 2a str. 2457T
gaauuugaggaagc

SEQ ID NO: 1906113 - RNA, 17 nt, Shigella flexneri 2a str. 2457T
gaauuucaucaccagcu

SEQ ID NO: 1906114 - RNA, 19 nt, Shigella flexneri 2a str. 2457T
gagucaauuucugcaaaau

SEQ ID NO: 1906115 - RNA, 14 nt, Shigella flexneri 2a str. 2457T
gagucacaaacauc

SEQ ID NO: 1906116 - RNA, 19 nt, Shigella flexneri 2a str. 2457T
gagucacaaacaucaugcc

SEQ ID NO: 1906117 - RNA, 16 nt, Shigella flexneri 2a str. 2457T
gaguauuuccagcuca

SEQ ID NO: 1906118 - RNA, 17 nt, Shigella flexneri 2a str. 2457T
gagugccgaagaacaua

SEQ ID NO: 1906119 - RNA, 23 nt, Shigella flexneri 2a str. 2457T
gagucugaccgucgaugaaagcg

SEQ ID NO: 1906120 - RNA, 19 nt, Shigella flexneri 2a str. 2457T
gagugccgaagaacauaaa

SEQ ID NO: 1906121 - RNA, 19 nt, Shigella flexneri 2a str. 2457T
gagucauucuccagaucuu

SEQ ID NO: 1906122 - RNA, 22 nt, Shigella flexneri 2a str. 2457T
gagucauucuccagaucuuccg

SEQ ID NO: 1906123 - RNA, 19 nt, Shigella flexneri 2a str. 2457T
gagucgggaccagcauucc

SEQ ID NO: 1906124 - RNA, 19 nt, Shigella flexneri 2a str. 2457T
gagucggggccagcauucc

SEQ ID NO: 1906125 - RNA, 22 nt, Shigella flexneri 2a str. 2457T
gagucgucgauaucgaugacgc

SEQ ID NO: 1906126 - RNA, 19 nt, Shigella flexneri 2a str. 2457T
cuuuuaccugcuuaaucau

SEQ ID NO: 1906127 - RNA, 16 nt, Shigella flexneri 2a str. 2457T
cuuuuagcaucuuauc

SEQ ID NO: 1906128 - RNA, 13 nt, Shigella flexneri 2a str. 2457T
cuuuuacaucauu

SEQ ID NO: 1906129 - RNA, 20 nt, Shigella flexneri 2a str. 2457T
cuuuuacaugcgcgacaaaa

SEQ ID NO: 1906130 - RNA, 21 nt, Shigella flexneri 2a str. 2457T
cuuuuacaugcgcgacaaaaa

SEQ ID NO: 1906131 - RNA, 23 nt, Shigella flexneri 2a str. 2457T
cuuuuaccagcgccugcgcggca

SEQ ID NO: 1906132 - RNA, 17 nt, Shigella flexneri 2a str. 2457T
cuuuuacagcgccagaa

SEQ ID NO: 1906133 - RNA, 22 nt, Shigella flexneri 2a str. 2457T
cuuuucaguuggcugacaaagu

SEQ ID NO: 1906134 - RNA, 17 nt, Shigella flexneri 2a str. 2457T
cuuuucaucgcaucgau

SEQ ID NO: 1906135 - RNA, 18 nt, Shigella flexneri 2a str. 2457T
cuuuuccucucaugagca

SEQ ID NO: 1906136 - RNA, 18 nt, Shigella flexneri 2a str. 2457T
cuuuuccauaucaagcau

SEQ ID NO: 1906137 - RNA, 15 nt, Shigella flexneri 2a str. 2457T
cuuuuaaauggaauc

SEQ ID NO: 1906138 - RNA, 22 nt, Shigella flexneri 2a str. 2457T
cuuuuaauaauucaaaaaccug

SEQ ID NO: 1906139 - RNA, 16 nt, Shigella flexneri 2a str. 2457T
cuuuuaaugcuuuaaa

SEQ ID NO: 1906140 - RNA, 17 nt, Shigella flexneri 2a str. 2457T
cuuuguuagcgaauaaa

SEQ ID NO: 1906141 - RNA, 22 nt, Shigella flexneri 2a str. 2457T
cuuugucgauaauauugagcac

SEQ ID NO: 1906142 - RNA, 21 nt, Shigella flexneri 2a str. 2457T
cuuugucauuaaagccgccaa

SEQ ID NO: 1906143 - RNA, 21 nt, Shigella flexneri 2a str. 2457T
cuuuguuacccccauccacgc

SEQ ID NO: 1906144 - RNA, 18 nt, Shigella flexneri 2a str. 2457T
cuuuguuaaacagugccc

SEQ ID NO: 1906145 - RNA, 11 nt, Shigella flexneri 2a str. 2457T
cuuucuucugg

SEQ ID NO: 1906146 - RNA, 16 nt, Shigella flexneri 2a str. 2457T
cuuucuuucuggaaau

SEQ ID NO: 1906147 - RNA, 17 nt, Shigella flexneri 2a str. 2457T
cuuugaaaauaacaucg

SEQ ID NO: 1906148 - RNA, 16 nt, Shigella flexneri 2a str. 2457T
cuuuguauuuauuuuc

SEQ ID NO: 1906149 - RNA, 23 nt, Shigella flexneri 2a str. 2457T
cuuugucaaaaaucuaaccuacu

SEQ ID NO: 1906150 - RNA, 19 nt, Shigella flexneri 2a str. 2457T
cuuuugcaguuaaaauagg

SEQ ID NO: 1906151 - RNA, 19 nt, Shigella flexneri 2a str. 2457T
cuuuugaacuuuaagcuga

SEQ ID NO: 1906152 - RNA, 14 nt, Shigella flexneri 2a str. 2457T
cuuuuggcaggaac

SEQ ID NO: 1906153 - RNA, 20 nt, Shigella flexneri 2a str. 2457T
cuuuucgcccuggacaacau

SEQ ID NO: 1906154 - RNA, 23 nt, Shigella flexneri 2a str. 2457T
cuuuucgccaccggcaaucugcu

SEQ ID NO: 1906155 - RNA, 16 nt, Shigella flexneri 2a str. 2457T
cuuuucugaaguacac

SEQ ID NO: 1906156 - RNA, 21 nt, Shigella flexneri 2a str. 2457T
cuuuuuaguaucuauucauca

SEQ ID NO: 1906157 - RNA, 19 nt, Shigella flexneri 2a str. 2457T
cuuuuucaauuccauuucc

SEQ ID NO: 1906158 - RNA, 21 nt, Shigella flexneri 2a str. 2457T
cuuuuucaauuccauuucccu

SEQ ID NO: 1906159 - RNA, 22 nt, Shigella flexneri 2a str. 2457T
cuuuuuaaacgaauaguuucag

SEQ ID NO: 1906160 - RNA, 17 nt, Shigella flexneri 2a str. 2457T
cuuuuuacccaugguca

SEQ ID NO: 1906161 - RNA, 17 nt, Shigella flexneri 2a str. 2457T
cuuuuuaccuucauuug

SEQ ID NO: 1906162 - RNA, 20 nt, Shigella flexneri 2a str. 2457T
cuuuuuacccauggucaucu

SEQ ID NO: 1906163 - RNA, 17 nt, Shigella flexneri 2a str. 2457T
cuuuuugcauuuccgcu

SEQ ID NO: 1906164 - RNA, 20 nt, Shigella flexneri 2a str. 2457T
cuuuuugaacggguugcggu

SEQ ID NO: 1906165 - RNA, 21 nt, Shigella flexneri 2a str. 2457T
cuuuuucaugcuauuccuuga

SEQ ID NO: 1906166 - RNA, 20 nt, Shigella flexneri 2a str. 2457T
cuuuuuccaguccacguuca

SEQ ID NO: 1906167 - RNA, 19 nt, Shigella flexneri 2a str. 2457T
gaaaagcgagaguuacagc

SEQ ID NO: 1906168 - RNA, 16 nt, Shigella flexneri 2a str. 2457T
gaaaagcuucuuccuc

SEQ ID NO: 1906169 - RNA, 17 nt, Shigella flexneri 2a str. 2457T
gaaaagauccguaaugc

SEQ ID NO: 1906170 - RNA, 22 nt, Shigella flexneri 2a str. 2457T
gaaaacuuccggcagaaauaaa

SEQ ID NO: 1906171 - RNA, 11 nt, Shigella flexneri 2a str. 2457T
gaaaacgcugu

SEQ ID NO: 1906172 - RNA, 21 nt, Shigella flexneri 2a str. 2457T
gaaaacguuucaaacaggcug

SEQ ID NO: 1906173 - RNA, 20 nt, Shigella flexneri 2a str. 2457T
gaaaauagacguucuucuuc

SEQ ID NO: 1906174 - RNA, 23 nt, Shigella flexneri 2a str. 2457T
gaaaauaaccauauaugauaauu

SEQ ID NO: 1906175 - RNA, 17 nt, Shigella flexneri 2a str. 2457T
gaaaauaaaauguacau

SEQ ID NO: 1906176 - RNA, 17 nt, Shigella flexneri 2a str. 2457T
gaaaauaaaucaaaguc

SEQ ID NO: 1906177 - RNA, 19 nt, Shigella flexneri 2a str. 2457T
gaaaauacagcaauggaaa

SEQ ID NO: 1906178 - RNA, 18 nt, Shigella flexneri 2a str. 2457T
gaaaauaauccgcuguaa

SEQ ID NO: 1906179 - RNA, 13 nt, Shigella flexneri 2a str. 2457T
gaaaaggcggcgc

SEQ ID NO: 1906180 - RNA, 16 nt, Shigella flexneri 2a str. 2457T
gaaaauaaaaaacauu

SEQ ID NO: 1906181 - RNA, 21 nt, Shigella flexneri 2a str. 2457T
gaaaaucucaauguauucccg

SEQ ID NO: 1906182 - RNA, 23 nt, Shigella flexneri 2a str. 2457T
gaaaaugcccauggcaagaauaa

SEQ ID NO: 1906183 - RNA, 14 nt, Shigella flexneri 2a str. 2457T
gaaaaucuucucuc

SEQ ID NO: 1906184 - RNA, 17 nt, Shigella flexneri 2a str. 2457T
gaaaaucucauaucccc

SEQ ID NO: 1906185 - RNA, 22 nt, Shigella flexneri 2a str. 2457T
gaaaaugggcaucaguaugaau

SEQ ID NO: 1906186 - RNA, 22 nt, Shigella flexneri 2a str. 2457T
gaaaauuaacgggcaggucacu

SEQ ID NO: 1906187 - RNA, 19 nt, Shigella flexneri 2a str. 2457T
gaaaauuauuuuaaauuuc

SEQ ID NO: 1906188 - RNA, 12 nt, Shigella flexneri 2a str. 2457T
gaaacaccagaa

SEQ ID NO: 1906189 - RNA, 20 nt, Shigella flexneri 2a str. 2457T
gaaacaacguggaacaaaua

SEQ ID NO: 1906190 - RNA, 23 nt, Shigella flexneri 2a str. 2457T
gaaacaaaucacuauuaaagaaa

SEQ ID NO: 1906191 - RNA, 14 nt, Shigella flexneri 2a str. 2457T
gaaacaaacgcaaa

SEQ ID NO: 1906192 - RNA, 17 nt, Shigella flexneri 2a str. 2457T
gaaaaaucaaaaaacug

SEQ ID NO: 1906193 - RNA, 22 nt, Shigella flexneri 2a str. 2457T
gaaaaaucaauauuuucaaucu

SEQ ID NO: 1906194 - RNA, 19 nt, Shigella flexneri 2a str. 2457T
gaaaaaucacauaaauucu

SEQ ID NO: 1906195 - RNA, 19 nt, Shigella flexneri 2a str. 2457T
gaaaaaguucgacuuaaau

SEQ ID NO: 1906196 - RNA, 21 nt, Shigella flexneri 2a str. 2457T
gaaaaaguucgacuuaaaucu

SEQ ID NO: 1906197 - RNA, 23 nt, Shigella flexneri 2a str. 2457T
gaaaaauaaaagcgugaaacaaa

SEQ ID NO: 1906198 - RNA, 23 nt, Shigella flexneri 2a str. 2457T
gaaaaaugaauaccaagucucaa

SEQ ID NO: 1906199 - RNA, 18 nt, Shigella flexneri 2a str. 2457T
gaaaaacgggucgccaga

SEQ ID NO: 1906200 - RNA, 15 nt, Shigella flexneri 2a str. 2457T
gaaaaacuuaauccu

SEQ ID NO: 1906201 - RNA, 17 nt, Shigella flexneri 2a str. 2457T
gaaaaacucuccucguu

SEQ ID NO: 1906202 - RNA, 22 nt, Shigella flexneri 2a str. 2457T
gaaaaccggacugaaaguacuu

SEQ ID NO: 1906203 - RNA, 13 nt, Shigella flexneri 2a str. 2457T
gaaaacgcuggca

SEQ ID NO: 1906204 - RNA, 23 nt, Shigella flexneri 2a str. 2457T
gaaaacgccggagugaaaauucu

SEQ ID NO: 1906205 - RNA, 17 nt, Shigella flexneri 2a str. 2457T
gaaaaauuuauugaaag

SEQ ID NO: 1906206 - RNA, 12 nt, Shigella flexneri 2a str. 2457T
gaaaacagcgca

SEQ ID NO: 1906207 - RNA, 13 nt, Shigella flexneri 2a str. 2457T
gaaaaaaccagaa

SEQ ID NO: 1906208 - RNA, 18 nt, Shigella flexneri 2a str. 2457T
gaaaaaagcgcucccgca

SEQ ID NO: 1906209 - RNA, 12 nt, Shigella flexneri 2a str. 2457T
gaaaaacacaaa

SEQ ID NO: 1906210 - RNA, 20 nt, Shigella flexneri 2a str. 2457T
gaaaaaaugaccggccagca

SEQ ID NO: 1906211 - RNA, 18 nt, Shigella flexneri 2a str. 2457T
gaaaaaccaaucucccag

SEQ ID NO: 1906212 - RNA, 16 nt, Shigella flexneri 2a str. 2457T
gaaaaaccagacagca

SEQ ID NO: 1906213 - RNA, 21 nt, Shigella flexneri 2a str. 2457T
gaaaaaaaauuacaaaaagug

SEQ ID NO: 1906214 - RNA, 18 nt, Shigella flexneri 2a str. 2457T
gaaaaaaaucaugcaaua

SEQ ID NO: 1906215 - RNA, 14 nt, Shigella flexneri 2a str. 2457T
cuuuuuuauggaau

SEQ ID NO: 1906216 - RNA, 20 nt, Shigella flexneri 2a str. 2457T
cuuuuuuccagcacacccau

SEQ ID NO: 1906217 - RNA, 20 nt, Shigella flexneri 2a str. 2457T
cuuuuuuagguacaaagcca

SEQ ID NO: 1906218 - RNA, 13 nt, Shigella flexneri 2a str. 2457T
cuuuuuuccgcuu

SEQ ID NO: 1906219 - RNA, 15 nt, Shigella flexneri 2a str. 2457T
cuuuuuucgcugucg

SEQ ID NO: 1906220 - RNA, 18 nt, Shigella flexneri 2a str. 2457T
cuuuuuugguaaugacuc

SEQ ID NO: 1906221 - RNA, 20 nt, Shigella flexneri 2a str. 2457T
cuuuuuugagcagcauuacc

SEQ ID NO: 1906222 - RNA, 15 nt, Shigella flexneri 2a str. 2457T
cuuuuugguucaucg

SEQ ID NO: 1906223 - RNA, 12 nt, Shigella flexneri 2a str. 2457T
cuuuuugcucuc

SEQ ID NO: 1906224 - RNA, 12 nt, Shigella flexneri 2a str. 2457T
cuuuuuuaaaca

SEQ ID NO: 1906225 - RNA, 17 nt, Shigella flexneri 2a str. 2457T
cuuuuuuaagauccagu

SEQ ID NO: 1906226 - RNA, 16 nt, Shigella flexneri 2a str. 2457T
cuuuuuuacaucauca

SEQ ID NO: 1906227 - RNA, 13 nt, Shigella flexneri 2a str. 2457T
gaaacccaacgca

SEQ ID NO: 1906228 - RNA, 21 nt, Shigella flexneri 2a str. 2457T
gaaaccaaacuuaugcagcug

SEQ ID NO: 1906229 - RNA, 14 nt, Shigella flexneri 2a str. 2457T
gaaaccuccgcauu

SEQ ID NO: 1906230 - RNA, 14 nt, Shigella flexneri 2a str. 2457T
gaaaccuggauauu

SEQ ID NO: 1906231 - RNA, 22 nt, Shigella flexneri 2a str. 2457T
gaaacgccaccauuuuacgucc

SEQ ID NO: 1906232 - RNA, 14 nt, Shigella flexneri 2a str. 2457T
gaaacgauacccac

SEQ ID NO: 1906233 - RNA, 16 nt, Shigella flexneri 2a str. 2457T
gaaacgauuaauuaca

SEQ ID NO: 1906234 - RNA, 19 nt, Shigella flexneri 2a str. 2457T
gaaacgcgaucgccaaaua

SEQ ID NO: 1906235 - RNA, 23 nt, Shigella flexneri 2a str. 2457T
gaaaccgggcaauuuaaacccua

SEQ ID NO: 1906236 - RNA, 20 nt, Shigella flexneri 2a str. 2457T
gaaaccgucuucccgcagcc

SEQ ID NO: 1906237 - RNA, 13 nt, Shigella flexneri 2a str. 2457T
gaaaccgaaguug

SEQ ID NO: 1906238 - RNA, 14 nt, Shigella flexneri 2a str. 2457T
gaaaccgaaguugu

SEQ ID NO: 1906239 - RNA, 23 nt, Shigella flexneri 2a str. 2457T
gaaaccgacuuacuuauuucugu

SEQ ID NO: 1906240 - RNA, 18 nt, Shigella flexneri 2a str. 2457T
gaaacuucacaucaccau

SEQ ID NO: 1906241 - RNA, 24 nt, Shigella flexneri 2a str. 2457T
gaaagaaaaucaauccaguguaaa

SEQ ID NO: 1906242 - RNA, 22 nt, Shigella flexneri 2a str. 2457T
gaaagacgguuaaugcguuuug

SEQ ID NO: 1906243 - RNA, 18 nt, Shigella flexneri 2a str. 2457T
gaaagagcaacccacugg

SEQ ID NO: 1906244 - RNA, 15 nt, Shigella flexneri 2a str. 2457T
gaaacgucaaauaau

SEQ ID NO: 1906245 - RNA, 18 nt, Shigella flexneri 2a str. 2457T
gaaacgcucauaaauugc

SEQ ID NO: 1906246 - RNA, 21 nt, Shigella flexneri 2a str. 2457T
gaaacgcucauaaauugcagc

SEQ ID NO: 1906247 - RNA, 22 nt, Shigella flexneri 2a str. 2457T
gaaacgguaauuauugaugaag

SEQ ID NO: 1906248 - RNA, 21 nt, Shigella flexneri 2a str. 2457T
gaaacuaucaggcaaaaaaau

SEQ ID NO: 1906249 - RNA, 18 nt, Shigella flexneri 2a str. 2457T
gaaacucgcguaaaucca

SEQ ID NO: 1906250 - RNA, 14 nt, Shigella flexneri 2a str. 2457T
gaaacugauaauuu

SEQ ID NO: 1906251 - RNA, 18 nt, Shigella flexneri 2a str. 2457T
gaaacucgcugccagcac

SEQ ID NO: 1906252 - RNA, 17 nt, Shigella flexneri 2a str. 2457T
gaaagcaccugcgcagg

SEQ ID NO: 1906253 - RNA, 20 nt, Shigella flexneri 2a str. 2457T
gaaagcaauuaacagugaca

SEQ ID NO: 1906254 - RNA, 17 nt, Shigella flexneri 2a str. 2457T
gaaagcagggcggcagg

SEQ ID NO: 1906255 - RNA, 19 nt, Shigella flexneri 2a str. 2457T
gaaagcauaguuuuuacaa

SEQ ID NO: 1906256 - RNA, 21 nt, Shigella flexneri 2a str. 2457T
gaaagauggcgcgcagaaaga

SEQ ID NO: 1906257 - RNA, 17 nt, Shigella flexneri 2a str. 2457T
gaaagcgccucaagcuc

SEQ ID NO: 1906258 - RNA, 14 nt, Shigella flexneri 2a str. 2457T
gaaagcgccagcaa

SEQ ID NO: 1906259 - RNA, 19 nt, Shigella flexneri 2a str. 2457T
gaaagcgccagcaagagca

SEQ ID NO: 1906260 - RNA, 15 nt, Shigella flexneri 2a str. 2457T
gaaagcggcguuuug

SEQ ID NO: 1906261 - RNA, 19 nt, Shigella flexneri 2a str. 2457T
gaaagcgucagcuuucaga

SEQ ID NO: 1906262 - RNA, 23 nt, Shigella flexneri 2a str. 2457T
gaaagcguuuaugcgcauugcca

SEQ ID NO: 1906263 - RNA, 14 nt, Shigella flexneri 2a str. 2457T
gaaagccgacugca

SEQ ID NO: 1906264 - RNA, 20 nt, Shigella flexneri 2a str. 2457T
gaaagccccaccagcaaaua

SEQ ID NO: 1906265 - RNA, 12 nt, Shigella flexneri 2a str. 2457T
gaaaggcgcggu

SEQ ID NO: 1906266 - RNA, 15 nt, Shigella flexneri 2a str. 2457T
gaaagggcaaauaau

SEQ ID NO: 1906267 - RNA, 23 nt, Shigella flexneri 2a str. 2457T
gaaagcggaucaguuccagcagc

SEQ ID NO: 1906268 - RNA, 22 nt, Shigella flexneri 2a str. 2457T
gaaagcugcugaccaccagcac

SEQ ID NO: 1906269 - RNA, 16 nt, Shigella flexneri 2a str. 2457T
gaaagcuucaggcacc

SEQ ID NO: 1906270 - RNA, 19 nt, Shigella flexneri 2a str. 2457T
gaaaguaaaaaagaaggaa

SEQ ID NO: 1906271 - RNA, 13 nt, Shigella flexneri 2a str. 2457T
gaaaguaaauuua

SEQ ID NO: 1906272 - RNA, 20 nt, Shigella flexneri 2a str. 2457T
gaaaguaaucuauauuucug

SEQ ID NO: 1906273 - RNA, 15 nt, Shigella flexneri 2a str. 2457T
gaaaguauuugacug

SEQ ID NO: 1906274 - RNA, 20 nt, Shigella flexneri 2a str. 2457T
gaaaguauuugacuguucua

SEQ ID NO: 1906275 - RNA, 15 nt, Shigella flexneri 2a str. 2457T
gaaagucauggcaaa

SEQ ID NO: 1906276 - RNA, 21 nt, Shigella flexneri 2a str. 2457T
gaaauauggcgcugcggcgga

SEQ ID NO: 1906277 - RNA, 20 nt, Shigella flexneri 2a str. 2457T
gaaauaucggcgucguugua

SEQ ID NO: 1906278 - RNA, 22 nt, Shigella flexneri 2a str. 2457T
gaaauauccagcggaucaagaa

SEQ ID NO: 1906279 - RNA, 23 nt, Shigella flexneri 2a str. 2457T
gaaauaguugcauuccaguccac

SEQ ID NO: 1906280 - RNA, 14 nt, Shigella flexneri 2a str. 2457T
gaaauauauucccc

SEQ ID NO: 1906281 - RNA, 18 nt, Shigella flexneri 2a str. 2457T
gaaauagagaaaguaaac

SEQ ID NO: 1906282 - RNA, 15 nt, Shigella flexneri 2a str. 2457T
gaaagugaguuuugc

SEQ ID NO: 1906283 - RNA, 18 nt, Shigella flexneri 2a str. 2457T
gaaagugacagcccggca

SEQ ID NO: 1906284 - RNA, 22 nt, Shigella flexneri 2a str. 2457T
gaaagugccggauguuugcauc

SEQ ID NO: 1906285 - RNA, 20 nt, Shigella flexneri 2a str. 2457T
gaaaguguaaagcaggugcc

SEQ ID NO: 1906286 - RNA, 15 nt, Shigella flexneri 2a str. 2457T
gaaaguuguuuuuug

SEQ ID NO: 1906287 - RNA, 20 nt, Shigella flexneri 2a str. 2457T
gaaauaaaaaaaguauuuuu

SEQ ID NO: 1906288 - RNA, 20 nt, Shigella flexneri 2a str. 2457T
gaacagcgccagacaaacca

SEQ ID NO: 1906289 - RNA, 13 nt, Shigella flexneri 2a str. 2457T
gaacaggcgcagg

SEQ ID NO: 1906290 - RNA, 15 nt, Shigella flexneri 2a str. 2457T
gaacaguaaagcgca

SEQ ID NO: 1906291 - RNA, 14 nt, Shigella flexneri 2a str. 2457T
gaacaguucaacgc

SEQ ID NO: 1906292 - RNA, 22 nt, Shigella flexneri 2a str. 2457T
gaacaguucagcagcacuacac

SEQ ID NO: 1906293 - RNA, 14 nt, Shigella flexneri 2a str. 2457T
gaacagugccaugc

SEQ ID NO: 1906294 - RNA, 20 nt, Shigella flexneri 2a str. 2457T
gaacaucccgguaauaaugc

SEQ ID NO: 1906295 - RNA, 15 nt, Shigella flexneri 2a str. 2457T
gaacaucacugcaaa

SEQ ID NO: 1906296 - RNA, 12 nt, Shigella flexneri 2a str. 2457T
gaacaucgccau

SEQ ID NO: 1906297 - RNA, 14 nt, Shigella flexneri 2a str. 2457T
gaacaucgcaggga

SEQ ID NO: 1906298 - RNA, 23 nt, Shigella flexneri 2a str. 2457T
gaacaucugaguugccaucauca

SEQ ID NO: 1906299 - RNA, 15 nt, Shigella flexneri 2a str. 2457T
gaacauuuaccgcaa

SEQ ID NO: 1906300 - RNA, 17 nt, Shigella flexneri 2a str. 2457T
gaacaaucacccccacc

SEQ ID NO: 1906301 - RNA, 24 nt, Shigella flexneri 2a str. 2457T
gaacaagguggugaggccagagca

SEQ ID NO: 1906302 - RNA, 14 nt, Shigella flexneri 2a str. 2457T
gaacaccaccugcc

SEQ ID NO: 1906303 - RNA, 15 nt, Shigella flexneri 2a str. 2457T
gaacagcaguuguuu

SEQ ID NO: 1906304 - RNA, 16 nt, Shigella flexneri 2a str. 2457T
gaacagcgccagacaa

SEQ ID NO: 1906305 - RNA, 23 nt, Shigella flexneri 2a str. 2457T
gaacacgguaguuaaacuuucau

SEQ ID NO: 1906306 - RNA, 15 nt, Shigella flexneri 2a str. 2457T
gaacacgguaaugac

SEQ ID NO: 1906307 - RNA, 22 nt, Shigella flexneri 2a str. 2457T
gaacacgacauacaccgcagcc

SEQ ID NO: 1906308 - RNA, 20 nt, Shigella flexneri 2a str. 2457T
gaacacgcucccagcagaga

SEQ ID NO: 1906309 - RNA, 13 nt, Shigella flexneri 2a str. 2457T
gaacagaccagca

SEQ ID NO: 1906310 - RNA, 16 nt, Shigella flexneri 2a str. 2457T
gaaauuucuuccucgu

SEQ ID NO: 1906311 - RNA, 20 nt, Shigella flexneri 2a str. 2457T
gaaauugcgaauuccuucac

SEQ ID NO: 1906312 - RNA, 21 nt, Shigella flexneri 2a str. 2457T
gaaauuguaaacgaguuaagc

SEQ ID NO: 1906313 - RNA, 14 nt, Shigella flexneri 2a str. 2457T
gaacaaaaucuuaa

SEQ ID NO: 1906314 - RNA, 15 nt, Shigella flexneri 2a str. 2457T
gaacaaacugccgcg

SEQ ID NO: 1906315 - RNA, 16 nt, Shigella flexneri 2a str. 2457T
gaacaaauaaauagau

SEQ ID NO: 1906316 - RNA, 12 nt, Shigella flexneri 2a str. 2457T
gaacaaccagaa

SEQ ID NO: 1906317 - RNA, 21 nt, Shigella flexneri 2a str. 2457T
gaaauucagcaguuuuugcaa

SEQ ID NO: 1906318 - RNA, 13 nt, Shigella flexneri 2a str. 2457T
gaaauuaccgcaa

SEQ ID NO: 1906319 - RNA, 19 nt, Shigella flexneri 2a str. 2457T
gaaauuaacgucaccaucc

SEQ ID NO: 1906320 - RNA, 21 nt, Shigella flexneri 2a str. 2457T
gaaaugagauauuucagagcu

SEQ ID NO: 1906321 - RNA, 17 nt, Shigella flexneri 2a str. 2457T
gaaaugaaaaaauagaa

SEQ ID NO: 1906322 - RNA, 14 nt, Shigella flexneri 2a str. 2457T
gaaaugaaaaaaua

SEQ ID NO: 1906323 - RNA, 21 nt, Shigella flexneri 2a str. 2457T
gaaauggcccaaaaggcagcg

SEQ ID NO: 1906324 - RNA, 21 nt, Shigella flexneri 2a str. 2457T
gaaauggugugcaugguguuc

SEQ ID NO: 1906325 - RNA, 19 nt, Shigella flexneri 2a str. 2457T
gaaauggcccaaaaggcag

SEQ ID NO: 1906326 - RNA, 19 nt, Shigella flexneri 2a str. 2457T
gaaaucagcuuuggugaaa

SEQ ID NO: 1906327 - RNA, 20 nt, Shigella flexneri 2a str. 2457T
gaaaucagcagcuuugcccg

SEQ ID NO: 1906328 - RNA, 16 nt, Shigella flexneri 2a str. 2457T
gaaaucaccaccagca

SEQ ID NO: 1906329 - RNA, 21 nt, Shigella flexneri 2a str. 2457T
gaaaucaccaccagcaccgcg

SEQ ID NO: 1906330 - RNA, 12 nt, Shigella flexneri 2a str. 2457T
gaaaucaccacc

SEQ ID NO: 1906331 - RNA, 17 nt, Shigella flexneri 2a str. 2457T
gaaaucguaaaaacgga

SEQ ID NO: 1906332 - RNA, 14 nt, Shigella flexneri 2a str. 2457T
gaaaucuccagaua

SEQ ID NO: 1906333 - RNA, 21 nt, Shigella flexneri 2a str. 2457T
gaaaucuacgguggaacauuu

SEQ ID NO: 1906334 - RNA, 21 nt, Shigella flexneri 2a str. 2457T
gaaaucguuugcauccagcuc

SEQ ID NO: 1906335 - RNA, 14 nt, Shigella flexneri 2a str. 2457T
gaaauccugccgca

SEQ ID NO: 1906336 - RNA, 14 nt, Shigella flexneri 2a str. 2457T
gaaaucgaucauca

SEQ ID NO: 1906337 - RNA, 19 nt, Shigella flexneri 2a str. 2457T
gaacuuuuugauagccacu

SEQ ID NO: 1906338 - RNA, 14 nt, Shigella flexneri 2a str. 2457T
gaagaaaaauauaa

SEQ ID NO: 1906339 - RNA, 18 nt, Shigella flexneri 2a str. 2457T
gaagaaaaauauaaaccg

SEQ ID NO: 1906340 - RNA, 23 nt, Shigella flexneri 2a str. 2457T
gaacuugacgaucugcuacaggc

SEQ ID NO: 1906341 - RNA, 21 nt, Shigella flexneri 2a str. 2457T
gaacuugacgaucugcuacag

SEQ ID NO: 1906342 - RNA, 18 nt, Shigella flexneri 2a str. 2457T
gaagaacugcuggaagcu

SEQ ID NO: 1906343 - RNA, 13 nt, Shigella flexneri 2a str. 2457T
gaagaagaaguuu

SEQ ID NO: 1906344 - RNA, 20 nt, Shigella flexneri 2a str. 2457T
gaagaaaucccccagcauca

SEQ ID NO: 1906345 - RNA, 12 nt, Shigella flexneri 2a str. 2457T
gaagaaaucagu

SEQ ID NO: 1906346 - RNA, 12 nt, Shigella flexneri 2a str. 2457T
gaagaaagcaau

SEQ ID NO: 1906347 - RNA, 13 nt, Shigella flexneri 2a str. 2457T
gaagaaguaaaac

SEQ ID NO: 1906348 - RNA, 18 nt, Shigella flexneri 2a str. 2457T
gaagaaguaagcugagug

SEQ ID NO: 1906349 - RNA, 14 nt, Shigella flexneri 2a str. 2457T
gaagacacauugcg

SEQ ID NO: 1906350 - RNA, 22 nt, Shigella flexneri 2a str. 2457T
gaagacaaccaaaaucaggccg

SEQ ID NO: 1906351 - RNA, 14 nt, Shigella flexneri 2a str. 2457T
gaagaauggaaaaa

SEQ ID NO: 1906352 - RNA, 15 nt, Shigella flexneri 2a str. 2457T
gaagaauggaaaaaa

SEQ ID NO: 1906353 - RNA, 13 nt, Shigella flexneri 2a str. 2457T
gaagacaaccaaa

SEQ ID NO: 1906354 - RNA, 23 nt, Shigella flexneri 2a str. 2457T
gaagaucagaaauuuccugagca

SEQ ID NO: 1906355 - RNA, 14 nt, Shigella flexneri 2a str. 2457T
gaagaugaaaaacg

SEQ ID NO: 1906356 - RNA, 14 nt, Shigella flexneri 2a str. 2457T
gaagagcacacauu

SEQ ID NO: 1906357 - RNA, 13 nt, Shigella flexneri 2a str. 2457T
gaagaggaacaaa

SEQ ID NO: 1906358 - RNA, 17 nt, Shigella flexneri 2a str. 2457T
gaagaguaaaaaaaccg

SEQ ID NO: 1906359 - RNA, 14 nt, Shigella flexneri 2a str. 2457T
gaagaguaaaaaaa

SEQ ID NO: 1906360 - RNA, 14 nt, Shigella flexneri 2a str. 2457T
gaagauuuugcugu

SEQ ID NO: 1906361 - RNA, 16 nt, Shigella flexneri 2a str. 2457T
gaagcaaaauaaccgg

SEQ ID NO: 1906362 - RNA, 16 nt, Shigella flexneri 2a str. 2457T
gaagcagcuugcuguu

SEQ ID NO: 1906363 - RNA, 20 nt, Shigella flexneri 2a str. 2457T
gaagcaguuucaccagcagu

SEQ ID NO: 1906364 - RNA, 21 nt, Shigella flexneri 2a str. 2457T
gaagcacacgacauccgugca

SEQ ID NO: 1906365 - RNA, 19 nt, Shigella flexneri 2a str. 2457T
gaagcauugcgccugcagg

SEQ ID NO: 1906366 - RNA, 18 nt, Shigella flexneri 2a str. 2457T
gaagccaccgcgccacga

SEQ ID NO: 1906367 - RNA, 13 nt, Shigella flexneri 2a str. 2457T
gaagccauccagc

SEQ ID NO: 1906368 - RNA, 17 nt, Shigella flexneri 2a str. 2457T
gaagccagucacaucag

SEQ ID NO: 1906369 - RNA, 22 nt, Shigella flexneri 2a str. 2457T
gaagcccaguaccgccagugca

SEQ ID NO: 1906370 - RNA, 16 nt, Shigella flexneri 2a str. 2457T
gaagcccucaaacaac

SEQ ID NO: 1906371 - RNA, 13 nt, Shigella flexneri 2a str. 2457T
gaagccgccagac

SEQ ID NO: 1906372 - RNA, 14 nt, Shigella flexneri 2a str. 2457T
gaagccgccagacc

SEQ ID NO: 1906373 - RNA, 20 nt, Shigella flexneri 2a str. 2457T
gaagcgcaacgcaucaggca

SEQ ID NO: 1906374 - RNA, 13 nt, Shigella flexneri 2a str. 2457T
gaagcggaaauca

SEQ ID NO: 1906375 - RNA, 17 nt, Shigella flexneri 2a str. 2457T
gaagcggcacugcucuu

SEQ ID NO: 1906376 - RNA, 14 nt, Shigella flexneri 2a str. 2457T
gaagcgcauggcgu

SEQ ID NO: 1906377 - RNA, 15 nt, Shigella flexneri 2a str. 2457T
gaaggaauuuuacag

SEQ ID NO: 1906378 - RNA, 22 nt, Shigella flexneri 2a str. 2457T
gaaggacucgaggagcuggagg

SEQ ID NO: 1906379 - RNA, 23 nt, Shigella flexneri 2a str. 2457T
gaaggacucgaggagcuggagga

SEQ ID NO: 1906380 - RNA, 20 nt, Shigella flexneri 2a str. 2457T
gaagcuuucuugcagcucuu

SEQ ID NO: 1906381 - RNA, 14 nt, Shigella flexneri 2a str. 2457T
gaaggaaaauacag

SEQ ID NO: 1906382 - RNA, 19 nt, Shigella flexneri 2a str. 2457T
gaaggaagacgcagcaugc

SEQ ID NO: 1906383 - RNA, 14 nt, Shigella flexneri 2a str. 2457T
gaaggaugagaagc

SEQ ID NO: 1906384 - RNA, 18 nt, Shigella flexneri 2a str. 2457T
gaagcuggauuaacgcug

SEQ ID NO: 1906385 - RNA, 16 nt, Shigella flexneri 2a str. 2457T
gaagcugcaaguauuc

SEQ ID NO: 1906386 - RNA, 22 nt, Shigella flexneri 2a str. 2457T
gaagcuggauuaacgcugggga

SEQ ID NO: 1906387 - RNA, 18 nt, Shigella flexneri 2a str. 2457T
gaagcuggucagcaucgu

SEQ ID NO: 1906388 - RNA, 17 nt, Shigella flexneri 2a str. 2457T
gaagcguaaaucccagc

SEQ ID NO: 1906389 - RNA, 18 nt, Shigella flexneri 2a str. 2457T
gaacucacagggcugcug

SEQ ID NO: 1906390 - RNA, 20 nt, Shigella flexneri 2a str. 2457T
gaacucaggcugccagauca

SEQ ID NO: 1906391 - RNA, 22 nt, Shigella flexneri 2a str. 2457T
gaacucaggcugccagaucauc

SEQ ID NO: 1906392 - RNA, 15 nt, Shigella flexneri 2a str. 2457T
gaacuccugaaagcg

SEQ ID NO: 1906393 - RNA, 14 nt, Shigella flexneri 2a str. 2457T
gaacucgagaacac

SEQ ID NO: 1906394 - RNA, 17 nt, Shigella flexneri 2a str. 2457T
gaacucgagaacacggu

SEQ ID NO: 1906395 - RNA, 15 nt, Shigella flexneri 2a str. 2457T
gaacucgaggauaaa

SEQ ID NO: 1906396 - RNA, 20 nt, Shigella flexneri 2a str. 2457T
gaacucgaggauaaauuuuc

SEQ ID NO: 1906397 - RNA, 18 nt, Shigella flexneri 2a str. 2457T
gaacugaacaaaaaagag

SEQ ID NO: 1906398 - RNA, 13 nt, Shigella flexneri 2a str. 2457T
gaacugaaaggcg

SEQ ID NO: 1906399 - RNA, 13 nt, Shigella flexneri 2a str. 2457T
gaacugaagcuga

SEQ ID NO: 1906400 - RNA, 17 nt, Shigella flexneri 2a str. 2457T
gaacugacugaaugcca

SEQ ID NO: 1906401 - RNA, 21 nt, Shigella flexneri 2a str. 2457T
gaacugauaacgcauuucaug

SEQ ID NO: 1906402 - RNA, 19 nt, Shigella flexneri 2a str. 2457T
gaacugacuuccacuuccu

SEQ ID NO: 1906403 - RNA, 15 nt, Shigella flexneri 2a str. 2457T
gaacuguagacaaaa

SEQ ID NO: 1906404 - RNA, 23 nt, Shigella flexneri 2a str. 2457T
gaacuguuaucgcagggagccac

SEQ ID NO: 1906405 - RNA, 12 nt, Shigella flexneri 2a str. 2457T
gaacuggucugc

SEQ ID NO: 1906406 - RNA, 16 nt, Shigella flexneri 2a str. 2457T
gaacuucgcagccgug

SEQ ID NO: 1906407 - RNA, 12 nt, Shigella flexneri 2a str. 2457T
gaacuucgccac

SEQ ID NO: 1906408 - RNA, 22 nt, Shigella flexneri 2a str. 2457T
gaacuucgccauuuucugccgc

SEQ ID NO: 1906409 - RNA, 16 nt, Shigella flexneri 2a str. 2457T
gaacuggcguguuuca

SEQ ID NO: 1906410 - RNA, 19 nt, Shigella flexneri 2a str. 2457T
gaacuggcguguuucauua

SEQ ID NO: 1906411 - RNA, 15 nt, Shigella flexneri 2a str. 2457T
gaacuggcugccagc

SEQ ID NO: 1906412 - RNA, 14 nt, Shigella flexneri 2a str. 2457T
gaacuggcaggaaa

SEQ ID NO: 1906413 - RNA, 15 nt, Shigella flexneri 2a str. 2457T
gaacuggcuuucaca

SEQ ID NO: 1906414 - RNA, 15 nt, Shigella flexneri 2a str. 2457T
gaacugggcgcggcc

SEQ ID NO: 1906415 - RNA, 14 nt, Shigella flexneri 2a str. 2457T
gaacugcaacucac

SEQ ID NO: 1906416 - RNA, 17 nt, Shigella flexneri 2a str. 2457T
gaacugcaacucaccuu

SEQ ID NO: 1906417 - RNA, 19 nt, Shigella flexneri 2a str. 2457T
gaacugcgguaauccgggu

SEQ ID NO: 1906418 - RNA, 16 nt, Shigella flexneri 2a str. 2457T
gaacgcguucacugcc

SEQ ID NO: 1906419 - RNA, 17 nt, Shigella flexneri 2a str. 2457T
gaacgcguucacugccg

SEQ ID NO: 1906420 - RNA, 15 nt, Shigella flexneri 2a str. 2457T
gaacgcggcccaggc

SEQ ID NO: 1906421 - RNA, 19 nt, Shigella flexneri 2a str. 2457T
gaacggauagagcgcggcg

SEQ ID NO: 1906422 - RNA, 21 nt, Shigella flexneri 2a str. 2457T
gaacggauagagcgcggcgca

SEQ ID NO: 1906423 - RNA, 19 nt, Shigella flexneri 2a str. 2457T
gaacgcuuuugcaucggca

SEQ ID NO: 1906424 - RNA, 15 nt, Shigella flexneri 2a str. 2457T
gaacggcggcggcgc

SEQ ID NO: 1906425 - RNA, 20 nt, Shigella flexneri 2a str. 2457T
gaacggauaucgagaaucac

SEQ ID NO: 1906426 - RNA, 20 nt, Shigella flexneri 2a str. 2457T
gaacgguaacaggaagcagc

SEQ ID NO: 1906427 - RNA, 23 nt, Shigella flexneri 2a str. 2457T
gaacggugaaaacccuauuuuug

SEQ ID NO: 1906428 - RNA, 16 nt, Shigella flexneri 2a str. 2457T
gaacgggugauuaaag

SEQ ID NO: 1906429 - RNA, 18 nt, Shigella flexneri 2a str. 2457T
gaacgggagaaacccggc

SEQ ID NO: 1906430 - RNA, 19 nt, Shigella flexneri 2a str. 2457T
gaacuauauucucaaaaua

SEQ ID NO: 1906431 - RNA, 14 nt, Shigella flexneri 2a str. 2457T
gaacucaaaccauu

SEQ ID NO: 1906432 - RNA, 18 nt, Shigella flexneri 2a str. 2457T
gaacuauuggucuggaac

SEQ ID NO: 1906433 - RNA, 14 nt, Shigella flexneri 2a str. 2457T
gaacucacagggcu

SEQ ID NO: 1906434 - RNA, 19 nt, Shigella flexneri 2a str. 2457T
gaacuaccgugcuguacag

SEQ ID NO: 1906435 - RNA, 13 nt, Shigella flexneri 2a str. 2457T
gaacgugcauauu

SEQ ID NO: 1906436 - RNA, 17 nt, Shigella flexneri 2a str. 2457T
gaacgugcaaaaucaaa

SEQ ID NO: 1906437 - RNA, 18 nt, Shigella flexneri 2a str. 2457T
gaacguugccugauuuua

SEQ ID NO: 1906438 - RNA, 17 nt, Shigella flexneri 2a str. 2457T
gaacgugcucugcgccg

SEQ ID NO: 1906439 - RNA, 17 nt, Shigella flexneri 2a str. 2457T
gaaccugugacagcagc

SEQ ID NO: 1906440 - RNA, 19 nt, Shigella flexneri 2a str. 2457T
gaaccugugacagcagcgg

SEQ ID NO: 1906441 - RNA, 20 nt, Shigella flexneri 2a str. 2457T
gaacgacgugguaaaagccg

SEQ ID NO: 1906442 - RNA, 16 nt, Shigella flexneri 2a str. 2457T
gaacgagaaaaugacg

SEQ ID NO: 1906443 - RNA, 20 nt, Shigella flexneri 2a str. 2457T
gaacgagaaaaugacgauga

SEQ ID NO: 1906444 - RNA, 15 nt, Shigella flexneri 2a str. 2457T
gaaccguaaaagccu

SEQ ID NO: 1906445 - RNA, 17 nt, Shigella flexneri 2a str. 2457T
gaaccucgcggcugccc

SEQ ID NO: 1906446 - RNA, 23 nt, Shigella flexneri 2a str. 2457T
gaaccucacagaggucuuuucuc

SEQ ID NO: 1906447 - RNA, 18 nt, Shigella flexneri 2a str. 2457T
gaaccugaacgccggguu

SEQ ID NO: 1906448 - RNA, 13 nt, Shigella flexneri 2a str. 2457T
gaacgccaguuca

SEQ ID NO: 1906449 - RNA, 14 nt, Shigella flexneri 2a str. 2457T
gaacgcccacggcg

SEQ ID NO: 1906450 - RNA, 16 nt, Shigella flexneri 2a str. 2457T
gaacgccuucgccauc

SEQ ID NO: 1906451 - RNA, 14 nt, Shigella flexneri 2a str. 2457T
gaacgccugugucc

SEQ ID NO: 1906452 - RNA, 17 nt, Shigella flexneri 2a str. 2457T
gaacgccaaauucuuua

SEQ ID NO: 1906453 - RNA, 19 nt, Shigella flexneri 2a str. 2457T
gaacgcaaucaaauaccac

SEQ ID NO: 1906454 - RNA, 20 nt, Shigella flexneri 2a str. 2457T
gaacgcaccgaccaucggca

SEQ ID NO: 1906455 - RNA, 20 nt, Shigella flexneri 2a str. 2457T
gaacgcacuauacaaccaga

SEQ ID NO: 1906456 - RNA, 19 nt, Shigella flexneri 2a str. 2457T
gaaccagggaaaaaagccc

SEQ ID NO: 1906457 - RNA, 18 nt, Shigella flexneri 2a str. 2457T
gaaccagugcuccaccuu

SEQ ID NO: 1906458 - RNA, 16 nt, Shigella flexneri 2a str. 2457T
gaaccagugaauacug

SEQ ID NO: 1906459 - RNA, 17 nt, Shigella flexneri 2a str. 2457T
gaaccagagaaucugcg

SEQ ID NO: 1906460 - RNA, 21 nt, Shigella flexneri 2a str. 2457T
gaaccacggaauaaccagcga

SEQ ID NO: 1906461 - RNA, 13 nt, Shigella flexneri 2a str. 2457T
gaaccacagcgcc

SEQ ID NO: 1906462 - RNA, 17 nt, Shigella flexneri 2a str. 2457T
gaaccacaaugaagaaa

SEQ ID NO: 1906463 - RNA, 21 nt, Shigella flexneri 2a str. 2457T
gaaccaccgaugcacagcacg

SEQ ID NO: 1906464 - RNA, 13 nt, Shigella flexneri 2a str. 2457T
gaaccaucaccuc

SEQ ID NO: 1906465 - RNA, 11 nt, Shigella flexneri 2a str. 2457T
gaaccaucggc

SEQ ID NO: 1906466 - RNA, 13 nt, Shigella flexneri 2a str. 2457T
gaaccaugcaauu

SEQ ID NO: 1906467 - RNA, 23 nt, Shigella flexneri 2a str. 2457T
gaaccaugcaauuaccgccacca

SEQ ID NO: 1906468 - RNA, 19 nt, Shigella flexneri 2a str. 2457T
gaaccauuucgauagacuc

SEQ ID NO: 1906469 - RNA, 21 nt, Shigella flexneri 2a str. 2457T
gaaccauuauccgucagccac

SEQ ID NO: 1906470 - RNA, 15 nt, Shigella flexneri 2a str. 2457T
gaaccggaccagcaa

SEQ ID NO: 1906471 - RNA, 21 nt, Shigella flexneri 2a str. 2457T
gaaccgauaguauggagcagg

SEQ ID NO: 1906472 - RNA, 14 nt, Shigella flexneri 2a str. 2457T
gaauuaaugccucu

SEQ ID NO: 1906473 - RNA, 18 nt, Shigella flexneri 2a str. 2457T
gaauuccgacagagaaag

SEQ ID NO: 1906474 - RNA, 13 nt, Shigella flexneri 2a str. 2457T
gaauucagaaaaa

SEQ ID NO: 1906475 - RNA, 17 nt, Shigella flexneri 2a str. 2457T
gaauucaaauccuucag

SEQ ID NO: 1906476 - RNA, 19 nt, Shigella flexneri 2a str. 2457T
gaauuguuuuauaaagaac

SEQ ID NO: 1906477 - RNA, 21 nt, Shigella flexneri 2a str. 2457T
gaauuguuuggacgaauuagc

SEQ ID NO: 1906478 - RNA, 15 nt, Shigella flexneri 2a str. 2457T
gaauugcgagccugu

SEQ ID NO: 1906479 - RNA, 15 nt, Shigella flexneri 2a str. 2457T
gaauucgacuuucuc

SEQ ID NO: 1906480 - RNA, 17 nt, Shigella flexneri 2a str. 2457T
gaauucgacuuucucug

SEQ ID NO: 1906481 - RNA, 17 nt, Shigella flexneri 2a str. 2457T
gaauucuaucaugcaaa

SEQ ID NO: 1906482 - RNA, 19 nt, Shigella flexneri 2a str. 2457T
gaaugcucgcuggcaggcc

SEQ ID NO: 1906483 - RNA, 14 nt, Shigella flexneri 2a str. 2457T
gaaugcggcaggca

SEQ ID NO: 1906484 - RNA, 21 nt, Shigella flexneri 2a str. 2457T
gaauggacaccagcucaguga

SEQ ID NO: 1906485 - RNA, 15 nt, Shigella flexneri 2a str. 2457T
gaauggaaacagcac

SEQ ID NO: 1906486 - RNA, 23 nt, Shigella flexneri 2a str. 2457T
gaauggcaucagaaggagcuaau

SEQ ID NO: 1906487 - RNA, 20 nt, Shigella flexneri 2a str. 2457T
gaauggcaucuacgcucucu

SEQ ID NO: 1906488 - RNA, 20 nt, Shigella flexneri 2a str. 2457T
gaauggcaucugauaagccc

SEQ ID NO: 1906489 - RNA, 16 nt, Shigella flexneri 2a str. 2457T
gaaugccaauuucccg

SEQ ID NO: 1906490 - RNA, 18 nt, Shigella flexneri 2a str. 2457T
gaaugccacgcaaacuuc

SEQ ID NO: 1906491 - RNA, 14 nt, Shigella flexneri 2a str. 2457T
gaaugcaggcgcgc

SEQ ID NO: 1906492 - RNA, 21 nt, Shigella flexneri 2a str. 2457T
gaaugccgcagcacccugagu

SEQ ID NO: 1906493 - RNA, 17 nt, Shigella flexneri 2a str. 2457T
gaaugccggguaauuuc

SEQ ID NO: 1906494 - RNA, 12 nt, Shigella flexneri 2a str. 2457T
gaauuaaaauau

SEQ ID NO: 1906495 - RNA, 21 nt, Shigella flexneri 2a str. 2457T
gaauguggcaaugagugguga

SEQ ID NO: 1906496 - RNA, 11 nt, Shigella flexneri 2a str. 2457T
gaauguuccau

SEQ ID NO: 1906497 - RNA, 13 nt, Shigella flexneri 2a str. 2457T
gaaugugacccgg

SEQ ID NO: 1906498 - RNA, 14 nt, Shigella flexneri 2a str. 2457T
gaauggugaccugc

SEQ ID NO: 1906499 - RNA, 16 nt, Shigella flexneri 2a str. 2457T
gaaugucgauaaaguu

SEQ ID NO: 1906500 - RNA, 15 nt, Shigella flexneri 2a str. 2457T
gaaugucguuuccau

SEQ ID NO: 1906501 - RNA, 22 nt, Shigella flexneri 2a str. 2457T
gaauggucaaugguggcaaucu

SEQ ID NO: 1906502 - RNA, 22 nt, Shigella flexneri 2a str. 2457T
gaaugguauaacgcaagugauc

SEQ ID NO: 1906503 - RNA, 18 nt, Shigella flexneri 2a str. 2457T
gaauggguucgauuucau

SEQ ID NO: 1906504 - RNA, 18 nt, Shigella flexneri 2a str. 2457T
gaaugaggaucagccgcu

SEQ ID NO: 1906505 - RNA, 18 nt, Shigella flexneri 2a str. 2457T
gaaugacgacuaaaucug

SEQ ID NO: 1906506 - RNA, 16 nt, Shigella flexneri 2a str. 2457T
gaaugacgacguacca

SEQ ID NO: 1906507 - RNA, 22 nt, Shigella flexneri 2a str. 2457T
gaaugaucagcgguuuugccag

SEQ ID NO: 1906508 - RNA, 16 nt, Shigella flexneri 2a str. 2457T
gaaugacauaaugcaa

SEQ ID NO: 1906509 - RNA, 15 nt, Shigella flexneri 2a str. 2457T
gaaucugcguaaaua

SEQ ID NO: 1906510 - RNA, 21 nt, Shigella flexneri 2a str. 2457T
gaaucucugcgcuauccagcg

SEQ ID NO: 1906511 - RNA, 13 nt, Shigella flexneri 2a str. 2457T
gaaucugcaauca

SEQ ID NO: 1906512 - RNA, 15 nt, Shigella flexneri 2a str. 2457T
gaaucugaaggaugu

SEQ ID NO: 1906513 - RNA, 13 nt, Shigella flexneri 2a str. 2457T
gaaucucuucuuc

SEQ ID NO: 1906514 - RNA, 21 nt, Shigella flexneri 2a str. 2457T
gaaucgguccaccacguacca

SEQ ID NO: 1906515 - RNA, 15 nt, Shigella flexneri 2a str. 2457T
gaaucgcuucauuua

SEQ ID NO: 1906516 - RNA, 13 nt, Shigella flexneri 2a str. 2457T
gaaucggcggcgg

SEQ ID NO: 1906517 - RNA, 17 nt, Shigella flexneri 2a str. 2457T
gaaucagauucaaauua

SEQ ID NO: 1906518 - RNA, 16 nt, Shigella flexneri 2a str. 2457T
gaaucaccgccacgcc

SEQ ID NO: 1906519 - RNA, 21 nt, Shigella flexneri 2a str. 2457T
gaaucacuccauccccagcuc

SEQ ID NO: 1906520 - RNA, 22 nt, Shigella flexneri 2a str. 2457T
gaaucaccgccacgcccuccug

SEQ ID NO: 1906521 - RNA, 16 nt, Shigella flexneri 2a str. 2457T
gaaucauaacugccgu

SEQ ID NO: 1906522 - RNA, 18 nt, Shigella flexneri 2a str. 2457T
gaaucaugccgaucgucu

SEQ ID NO: 1906523 - RNA, 21 nt, Shigella flexneri 2a str. 2457T
gaaucaugguuuauuucccag

SEQ ID NO: 1906524 - RNA, 22 nt, Shigella flexneri 2a str. 2457T
gaaucaguuguucagaaugccc

SEQ ID NO: 1906525 - RNA, 19 nt, Shigella flexneri 2a str. 2457T
gaaucauaaauacaaggcc

SEQ ID NO: 1906526 - RNA, 23 nt, Shigella flexneri 2a str. 2457T
gaaucaggcaggucuuucaccug

SEQ ID NO: 1906527 - RNA, 14 nt, Shigella flexneri 2a str. 2457T
gaaucagcccagcc

SEQ ID NO: 1906528 - RNA, 15 nt, Shigella flexneri 2a str. 2457T
gaaucccgcugcaau

SEQ ID NO: 1906529 - RNA, 17 nt, Shigella flexneri 2a str. 2457T
gaauccgcaccaacucc

SEQ ID NO: 1906530 - RNA, 18 nt, Shigella flexneri 2a str. 2457T
gaauccgcaccaacucca

SEQ ID NO: 1906531 - RNA, 15 nt, Shigella flexneri 2a str. 2457T
gaauccuucccccac

SEQ ID NO: 1906532 - RNA, 16 nt, Shigella flexneri 2a str. 2457T
gaaucgccacaacuuc

SEQ ID NO: 1906533 - RNA, 15 nt, Shigella flexneri 2a str. 2457T
gaaguuccagggcag

SEQ ID NO: 1906534 - RNA, 16 nt, Shigella flexneri 2a str. 2457T
gaaguugcucaagcug

SEQ ID NO: 1906535 - RNA, 16 nt, Shigella flexneri 2a str. 2457T
gaaguuguagcuggcu

SEQ ID NO: 1906536 - RNA, 18 nt, Shigella flexneri 2a str. 2457T
gaaguuguccaugugcug

SEQ ID NO: 1906537 - RNA, 19 nt, Shigella flexneri 2a str. 2457T
gaaguuuugucgcugauuu

SEQ ID NO: 1906538 - RNA, 16 nt, Shigella flexneri 2a str. 2457T
gaaguuuaauucuuug

SEQ ID NO: 1906539 - RNA, 12 nt, Shigella flexneri 2a str. 2457T
gaauaaaacaga

SEQ ID NO: 1906540 - RNA, 20 nt, Shigella flexneri 2a str. 2457T
gaauaaaacagaaaccgagg

SEQ ID NO: 1906541 - RNA, 12 nt, Shigella flexneri 2a str. 2457T
gaauaaaagcca

SEQ ID NO: 1906542 - RNA, 22 nt, Shigella flexneri 2a str. 2457T
gaaguccacgcgguagcgggca

SEQ ID NO: 1906543 - RNA, 23 nt, Shigella flexneri 2a str. 2457T
gaaguccacgcgguagcgggcag

SEQ ID NO: 1906544 - RNA, 21 nt, Shigella flexneri 2a str. 2457T
gaagucgcagaccaaacucuu

SEQ ID NO: 1906545 - RNA, 15 nt, Shigella flexneri 2a str. 2457T
gaaguggcguucagc

SEQ ID NO: 1906546 - RNA, 23 nt, Shigella flexneri 2a str. 2457T
gaagugauccgccgcgcgguggg

SEQ ID NO: 1906547 - RNA, 20 nt, Shigella flexneri 2a str. 2457T
gaagugauccgccgcgcggu

SEQ ID NO: 1906548 - RNA, 17 nt, Shigella flexneri 2a str. 2457T
gaaguaccaauggcaau

SEQ ID NO: 1906549 - RNA, 14 nt, Shigella flexneri 2a str. 2457T
gaaguaguugcugu

SEQ ID NO: 1906550 - RNA, 18 nt, Shigella flexneri 2a str. 2457T
gaaguauuggugaguccu

SEQ ID NO: 1906551 - RNA, 17 nt, Shigella flexneri 2a str. 2457T
gaaguauuggugagucc

SEQ ID NO: 1906552 - RNA, 14 nt, Shigella flexneri 2a str. 2457T
gaaggucagguuug

SEQ ID NO: 1906553 - RNA, 21 nt, Shigella flexneri 2a str. 2457T
gaagguaaggauaaaaaaggg

SEQ ID NO: 1906554 - RNA, 21 nt, Shigella flexneri 2a str. 2457T
gaagguuucugcauuauccag

SEQ ID NO: 1906555 - RNA, 20 nt, Shigella flexneri 2a str. 2457T
gaaggugccucccguuuugc

SEQ ID NO: 1906556 - RNA, 21 nt, Shigella flexneri 2a str. 2457T
gaaggcgauguucuggucacu

SEQ ID NO: 1906557 - RNA, 11 nt, Shigella flexneri 2a str. 2457T
gaaggcggcga

SEQ ID NO: 1906558 - RNA, 16 nt, Shigella flexneri 2a str. 2457T
gaaggcuuauaaggaa

SEQ ID NO: 1906559 - RNA, 18 nt, Shigella flexneri 2a str. 2457T
gaaggcuucguaaguggc

SEQ ID NO: 1906560 - RNA, 20 nt, Shigella flexneri 2a str. 2457T
gaagggauugugcaggcgcu

SEQ ID NO: 1906561 - RNA, 23 nt, Shigella flexneri 2a str. 2457T
gaagggcuggcuguucugccucu

SEQ ID NO: 1906562 - RNA, 22 nt, Shigella flexneri 2a str. 2457T
gaagggcuggccaauuggcugg

SEQ ID NO: 1906563 - RNA, 17 nt, Shigella flexneri 2a str. 2457T
gaaggggccgaaaaaug

SEQ ID NO: 1906564 - RNA, 21 nt, Shigella flexneri 2a str. 2457T
gaauaagacuggcaaaugaca

SEQ ID NO: 1906565 - RNA, 15 nt, Shigella flexneri 2a str. 2457T
gaauaauccgcccgg

SEQ ID NO: 1906566 - RNA, 13 nt, Shigella flexneri 2a str. 2457T
gaauaaccgguuc

SEQ ID NO: 1906567 - RNA, 13 nt, Shigella flexneri 2a str. 2457T
gaauaccuucuuc

SEQ ID NO: 1906568 - RNA, 17 nt, Shigella flexneri 2a str. 2457T
gaauaccuugcugcucc

SEQ ID NO: 1906569 - RNA, 20 nt, Shigella flexneri 2a str. 2457T
gaauaccccauggagaaaau

SEQ ID NO: 1906570 - RNA, 13 nt, Shigella flexneri 2a str. 2457T
gaauaccgacauc

SEQ ID NO: 1906571 - RNA, 12 nt, Shigella flexneri 2a str. 2457T
gaauacagaaca

SEQ ID NO: 1906572 - RNA, 22 nt, Shigella flexneri 2a str. 2457T
gaauaccaacgaggagacugca

SEQ ID NO: 1906573 - RNA, 21 nt, Shigella flexneri 2a str. 2457T
gaauaucaagaucaucaaacu

SEQ ID NO: 1906574 - RNA, 17 nt, Shigella flexneri 2a str. 2457T
gaauauauaauuaaaaa

SEQ ID NO: 1906575 - RNA, 19 nt, Shigella flexneri 2a str. 2457T
gaauauauaauuaaaaaua

SEQ ID NO: 1906576 - RNA, 20 nt, Shigella flexneri 2a str. 2457T
gaauauauaauuaaaaauag

SEQ ID NO: 1906577 - RNA, 20 nt, Shigella flexneri 2a str. 2457T
gaauauauccgaaaaaggau

SEQ ID NO: 1906578 - RNA, 20 nt, Shigella flexneri 2a str. 2457T
gaauaucgcuggccuccagu

SEQ ID NO: 1906579 - RNA, 20 nt, Shigella flexneri 2a str. 2457T
gaauaucguucaagagacug

SEQ ID NO: 1906580 - RNA, 21 nt, Shigella flexneri 2a str. 2457T
gaauaucuucaaccgucacca

SEQ ID NO: 1906581 - RNA, 23 nt, Shigella flexneri 2a str. 2457T
gaauaugagucguaaacaacugg

SEQ ID NO: 1906582 - RNA, 23 nt, Shigella flexneri 2a str. 2457T
gaauaugaacaugaaaaaacugg

SEQ ID NO: 1906583 - RNA, 20 nt, Shigella flexneri 2a str. 2457T
gaauaugguuagagaacaac

SEQ ID NO: 1906584 - RNA, 17 nt, Shigella flexneri 2a str. 2457T
gaauauggcggcggcuu

SEQ ID NO: 1906585 - RNA, 19 nt, Shigella flexneri 2a str. 2457T
gaauauucugaagcaaacu

SEQ ID NO: 1906586 - RNA, 17 nt, Shigella flexneri 2a str. 2457T
gaauauuucuauauccu

SEQ ID NO: 1906587 - RNA, 14 nt, Shigella flexneri 2a str. 2457T
gaauauaagucagg

SEQ ID NO: 1906588 - RNA, 22 nt, Shigella flexneri 2a str. 2457T
gaauaguuuccgcuucugcuuu

SEQ ID NO: 1906589 - RNA, 14 nt, Shigella flexneri 2a str. 2457T
gaauaguuucagcc

SEQ ID NO: 1906590 - RNA, 15 nt, Shigella flexneri 2a str. 2457T
gaauaguuucagccu

SEQ ID NO: 1906591 - RNA, 19 nt, Shigella flexneri 2a str. 2457T
gaauaguuuccgcuucugc

SEQ ID NO: 1906592 - RNA, 22 nt, Shigella flexneri 2a str. 2457T
cuuaaacaguacgagagaagag

SEQ ID NO: 1906593 - RNA, 17 nt, Shigella flexneri 2a str. 2457T
cuuaaaaucccgccagc

SEQ ID NO: 1906594 - RNA, 14 nt, Shigella flexneri 2a str. 2457T
cuguuuuuuauacu

SEQ ID NO: 1906595 - RNA, 18 nt, Shigella flexneri 2a str. 2457T
cuguuucaggaacaccgc

SEQ ID NO: 1906596 - RNA, 23 nt, Shigella flexneri 2a str. 2457T
cuguuuagccgcuucugcagcuu

SEQ ID NO: 1906597 - RNA, 20 nt, Shigella flexneri 2a str. 2457T
cuguuuagcgacucgauggc

SEQ ID NO: 1906598 - RNA, 19 nt, Shigella flexneri 2a str. 2457T
cuguuuaucuucccagcgc

SEQ ID NO: 1906599 - RNA, 20 nt, Shigella flexneri 2a str. 2457T
cuguuucgccaguuuuuucg

SEQ ID NO: 1906600 - RNA, 18 nt, Shigella flexneri 2a str. 2457T
cuguuucgcuucuucagc

SEQ ID NO: 1906601 - RNA, 19 nt, Shigella flexneri 2a str. 2457T
cuguuuuccagcaccacuu

SEQ ID NO: 1906602 - RNA, 15 nt, Shigella flexneri 2a str. 2457T
cuguucugccucuga

SEQ ID NO: 1906603 - RNA, 18 nt, Shigella flexneri 2a str. 2457T
cuguucugccucugaaac

SEQ ID NO: 1906604 - RNA, 21 nt, Shigella flexneri 2a str. 2457T
cuguugacguccagcccuucu

SEQ ID NO: 1906605 - RNA, 23 nt, Shigella flexneri 2a str. 2457T
cuguugaagccgccgguagucac

SEQ ID NO: 1906606 - RNA, 15 nt, Shigella flexneri 2a str. 2457T
cuguugaaauuauug

SEQ ID NO: 1906607 - RNA, 16 nt, Shigella flexneri 2a str. 2457T
cugucuguuauuuauu

SEQ ID NO: 1906608 - RNA, 22 nt, Shigella flexneri 2a str. 2457T
cugucugcuucugccugggccu

SEQ ID NO: 1906609 - RNA, 21 nt, Shigella flexneri 2a str. 2457T
cugucucauuguguacauccu

SEQ ID NO: 1906610 - RNA, 16 nt, Shigella flexneri 2a str. 2457T
cugucucucagcacac

SEQ ID NO: 1906611 - RNA, 15 nt, Shigella flexneri 2a str. 2457T
cugucugauaaaaaa

SEQ ID NO: 1906612 - RNA, 22 nt, Shigella flexneri 2a str. 2457T
cuguuggaaucacucaucaugc

SEQ ID NO: 1906613 - RNA, 20 nt, Shigella flexneri 2a str. 2457T
cuguugcccaugcuucugca

SEQ ID NO: 1906614 - RNA, 19 nt, Shigella flexneri 2a str. 2457T
cuguuggugccagauagcc

SEQ ID NO: 1906615 - RNA, 18 nt, Shigella flexneri 2a str. 2457T
cuguugguaacuuacuga

SEQ ID NO: 1906616 - RNA, 16 nt, Shigella flexneri 2a str. 2457T
cuguuuagccgcuucu

SEQ ID NO: 1906617 - RNA, 19 nt, Shigella flexneri 2a str. 2457T
cuguugucuuuccagacuc

SEQ ID NO: 1906618 - RNA, 19 nt, Shigella flexneri 2a str. 2457T
cuguugugccagaccaaac

SEQ ID NO: 1906619 - RNA, 16 nt, Shigella flexneri 2a str. 2457T
cuguuguucaacacuc

SEQ ID NO: 1906620 - RNA, 14 nt, Shigella flexneri 2a str. 2457T
cuuacacacccggc

SEQ ID NO: 1906621 - RNA, 18 nt, Shigella flexneri 2a str. 2457T
cuuacggauaauuauuua

SEQ ID NO: 1906622 - RNA, 19 nt, Shigella flexneri 2a str. 2457T
cuuacggcacuccucuuca

SEQ ID NO: 1906623 - RNA, 16 nt, Shigella flexneri 2a str. 2457T
cuuacggcuuuuaauc

SEQ ID NO: 1906624 - RNA, 17 nt, Shigella flexneri 2a str. 2457T
cuuacguaauuuauaau

SEQ ID NO: 1906625 - RNA, 17 nt, Shigella flexneri 2a str. 2457T
cuuaccuuuacguccac

SEQ ID NO: 1906626 - RNA, 15 nt, Shigella flexneri 2a str. 2457T
cuuacgcaacugcca

SEQ ID NO: 1906627 - RNA, 23 nt, Shigella flexneri 2a str. 2457T
cuuaaauaagguuaauuaccuua

SEQ ID NO: 1906628 - RNA, 17 nt, Shigella flexneri 2a str. 2457T
cuuaaagucuuuguauu

SEQ ID NO: 1906629 - RNA, 21 nt, Shigella flexneri 2a str. 2457T
cuuaaaggggugaaaaaaacu

SEQ ID NO: 1906630 - RNA, 20 nt, Shigella flexneri 2a str. 2457T
cuuaaagucuuuguauuuau

SEQ ID NO: 1906631 - RNA, 23 nt, Shigella flexneri 2a str. 2457T
cuuaaucaucgcguacucaccgc

SEQ ID NO: 1906632 - RNA, 16 nt, Shigella flexneri 2a str. 2457T
cuuaaucaucaaugcc

SEQ ID NO: 1906633 - RNA, 18 nt, Shigella flexneri 2a str. 2457T
cuuaaucaucaaugccag

SEQ ID NO: 1906634 - RNA, 22 nt, Shigella flexneri 2a str. 2457T
cuuaaucaucaaugccagcaua

SEQ ID NO: 1906635 - RNA, 18 nt, Shigella flexneri 2a str. 2457T
cuuaaucaauugcaggaa

SEQ ID NO: 1906636 - RNA, 17 nt, Shigella flexneri 2a str. 2457T
cuuaauauuaacuuaau

SEQ ID NO: 1906637 - RNA, 14 nt, Shigella flexneri 2a str. 2457T
cuuaaucaacucac

SEQ ID NO: 1906638 - RNA, 13 nt, Shigella flexneri 2a str. 2457T
cuuauccagcaga

SEQ ID NO: 1906639 - RNA, 12 nt, Shigella flexneri 2a str. 2457T
cuuaucaggccu

SEQ ID NO: 1906640 - RNA, 21 nt, Shigella flexneri 2a str. 2457T
cuuaucaggccuacaacuccg

SEQ ID NO: 1906641 - RNA, 20 nt, Shigella flexneri 2a str. 2457T
cuuaucaggccuaccaauaa

SEQ ID NO: 1906642 - RNA, 17 nt, Shigella flexneri 2a str. 2457T
cuuaucgcccugcucca

SEQ ID NO: 1906643 - RNA, 13 nt, Shigella flexneri 2a str. 2457T
cuuaucgaagagg

SEQ ID NO: 1906644 - RNA, 22 nt, Shigella flexneri 2a str. 2457T
cuuauccgacauuucugcugcc

SEQ ID NO: 1906645 - RNA, 22 nt, Shigella flexneri 2a str. 2457T
cuuauccggccuccauaagagu

SEQ ID NO: 1906646 - RNA, 15 nt, Shigella flexneri 2a str. 2457T
cuuauauugagccaa

SEQ ID NO: 1906647 - RNA, 14 nt, Shigella flexneri 2a str. 2457T
cuuauagacuaaau

SEQ ID NO: 1906648 - RNA, 13 nt, Shigella flexneri 2a str. 2457T
cuuauagaaagca

SEQ ID NO: 1906649 - RNA, 17 nt, Shigella flexneri 2a str. 2457T
cuuauaauccccggccu

SEQ ID NO: 1906650 - RNA, 15 nt, Shigella flexneri 2a str. 2457T
cuuacugauaguguu

SEQ ID NO: 1906651 - RNA, 16 nt, Shigella flexneri 2a str. 2457T
cuuacugauaguguuu

SEQ ID NO: 1906652 - RNA, 16 nt, Shigella flexneri 2a str. 2457T
cuuacucaugauguca

SEQ ID NO: 1906653 - RNA, 22 nt, Shigella flexneri 2a str. 2457T
cuuacucauuaaugcacuucca

SEQ ID NO: 1906654 - RNA, 14 nt, Shigella flexneri 2a str. 2457T
cuucacaucaccau

SEQ ID NO: 1906655 - RNA, 19 nt, Shigella flexneri 2a str. 2457T
cuucacacacuuuuauuaa

SEQ ID NO: 1906656 - RNA, 21 nt, Shigella flexneri 2a str. 2457T
cuucacacugaugacaggcua

SEQ ID NO: 1906657 - RNA, 12 nt, Shigella flexneri 2a str. 2457T
cuucaccagcag

SEQ ID NO: 1906658 - RNA, 18 nt, Shigella flexneri 2a str. 2457T
cuucaauuuccugacguc

SEQ ID NO: 1906659 - RNA, 22 nt, Shigella flexneri 2a str. 2457T
cuucaauuuuuucuggcgaacc

SEQ ID NO: 1906660 - RNA, 19 nt, Shigella flexneri 2a str. 2457T
cuuauuaugaaugauaaaa

SEQ ID NO: 1906661 - RNA, 16 nt, Shigella flexneri 2a str. 2457T
cuuauuaacuucccac

SEQ ID NO: 1906662 - RNA, 12 nt, Shigella flexneri 2a str. 2457T
cuuauuaaaauu

SEQ ID NO: 1906663 - RNA, 14 nt, Shigella flexneri 2a str. 2457T
cuuaucguuauaua

SEQ ID NO: 1906664 - RNA, 23 nt, Shigella flexneri 2a str. 2457T
cuuaucgugccuacacauuaucu

SEQ ID NO: 1906665 - RNA, 11 nt, Shigella flexneri 2a str. 2457T
cuuaucuggcc

SEQ ID NO: 1906666 - RNA, 23 nt, Shigella flexneri 2a str. 2457T
cuucacguuuuucgaaaaucuca

SEQ ID NO: 1906667 - RNA, 20 nt, Shigella flexneri 2a str. 2457T
cuucacgcuuugcaggcugg

SEQ ID NO: 1906668 - RNA, 21 nt, Shigella flexneri 2a str. 2457T
cuucacggcugcuaauauuuu

SEQ ID NO: 1906669 - RNA, 23 nt, Shigella flexneri 2a str. 2457T
cuucacggcugcuaauauuuucg

SEQ ID NO: 1906670 - RNA, 19 nt, Shigella flexneri 2a str. 2457T
cuucacgcuaauaccggau

SEQ ID NO: 1906671 - RNA, 20 nt, Shigella flexneri 2a str. 2457T
cuucacgcuaauaccggaug

SEQ ID NO: 1906672 - RNA, 22 nt, Shigella flexneri 2a str. 2457T
cuucaccagcagcgucaacacu

SEQ ID NO: 1906673 - RNA, 14 nt, Shigella flexneri 2a str. 2457T
cuucaccagccugc

SEQ ID NO: 1906674 - RNA, 22 nt, Shigella flexneri 2a str. 2457T
cuucagccgcaaaccuggcaac

SEQ ID NO: 1906675 - RNA, 23 nt, Shigella flexneri 2a str. 2457T
cuucagccaucaaagauuguugg

SEQ ID NO: 1906676 - RNA, 14 nt, Shigella flexneri 2a str. 2457T
cuucagcaguucag

SEQ ID NO: 1906677 - RNA, 14 nt, Shigella flexneri 2a str. 2457T
cuucagcaagcgau

SEQ ID NO: 1906678 - RNA, 20 nt, Shigella flexneri 2a str. 2457T
cuucaguuuuucccgcuucg

SEQ ID NO: 1906679 - RNA, 16 nt, Shigella flexneri 2a str. 2457T
cuucauagugcgcggu

SEQ ID NO: 1906680 - RNA, 14 nt, Shigella flexneri 2a str. 2457T
cuucauacuaccug

SEQ ID NO: 1906681 - RNA, 14 nt, Shigella flexneri 2a str. 2457T
cuucaucauccucu

SEQ ID NO: 1906682 - RNA, 19 nt, Shigella flexneri 2a str. 2457T
cuucaucaucgcagauuuc

SEQ ID NO: 1906683 - RNA, 14 nt, Shigella flexneri 2a str. 2457T
cuucauccagcagu

SEQ ID NO: 1906684 - RNA, 23 nt, Shigella flexneri 2a str. 2457T
cuucaucccuuucgcuucaagua

SEQ ID NO: 1906685 - RNA, 21 nt, Shigella flexneri 2a str. 2457T
cuucauccuucacacugccuc

SEQ ID NO: 1906686 - RNA, 19 nt, Shigella flexneri 2a str. 2457T
cuucaugcagcauggucag

SEQ ID NO: 1906687 - RNA, 17 nt, Shigella flexneri 2a str. 2457T
cuucauggggaugcuga

SEQ ID NO: 1906688 - RNA, 22 nt, Shigella flexneri 2a str. 2457T
cuucauggggaugcugaaaaga

SEQ ID NO: 1906689 - RNA, 20 nt, Shigella flexneri 2a str. 2457T
cuucaggugcccaacauacu

SEQ ID NO: 1906690 - RNA, 14 nt, Shigella flexneri 2a str. 2457T
cuucaguugccugg

SEQ ID NO: 1906691 - RNA, 23 nt, Shigella flexneri 2a str. 2457T
cuucaggaucaaccgcuacauac

SEQ ID NO: 1906692 - RNA, 22 nt, Shigella flexneri 2a str. 2457T
cuucaggacccuuaaaggguca

SEQ ID NO: 1906693 - RNA, 14 nt, Shigella flexneri 2a str. 2457T
cuucaggcccugcu

SEQ ID NO: 1906694 - RNA, 23 nt, Shigella flexneri 2a str. 2457T
cuucgccauugaaaccgcugccu

SEQ ID NO: 1906695 - RNA, 12 nt, Shigella flexneri 2a str. 2457T
cuucgccugccu

SEQ ID NO: 1906696 - RNA, 18 nt, Shigella flexneri 2a str. 2457T
cuucgccugccugcagcu

SEQ ID NO: 1906697 - RNA, 13 nt, Shigella flexneri 2a str. 2457T
cuucgccgccgcu

SEQ ID NO: 1906698 - RNA, 16 nt, Shigella flexneri 2a str. 2457T
cuucgcggaauuucag

SEQ ID NO: 1906699 - RNA, 20 nt, Shigella flexneri 2a str. 2457T
cuuccgggauuucccggcac

SEQ ID NO: 1906700 - RNA, 19 nt, Shigella flexneri 2a str. 2457T
cuuccggacguucagccau

SEQ ID NO: 1906701 - RNA, 17 nt, Shigella flexneri 2a str. 2457T
cuuccgcugacagcgcg

SEQ ID NO: 1906702 - RNA, 23 nt, Shigella flexneri 2a str. 2457T
cuuccucguuucgcccugccuuu

SEQ ID NO: 1906703 - RNA, 12 nt, Shigella flexneri 2a str. 2457T
cuuccucgccag

SEQ ID NO: 1906704 - RNA, 15 nt, Shigella flexneri 2a str. 2457T
cuucgauccagugau

SEQ ID NO: 1906705 - RNA, 16 nt, Shigella flexneri 2a str. 2457T
cuucgaucuugccgcu

SEQ ID NO: 1906706 - RNA, 12 nt, Shigella flexneri 2a str. 2457T
cuuccugcagcu

SEQ ID NO: 1906707 - RNA, 15 nt, Shigella flexneri 2a str. 2457T
cuuccugccagaucc

SEQ ID NO: 1906708 - RNA, 21 nt, Shigella flexneri 2a str. 2457T
cuuccugcaacgagugcaucu

SEQ ID NO: 1906709 - RNA, 23 nt, Shigella flexneri 2a str. 2457T
cuuccugcaacgagugcaucugg

SEQ ID NO: 1906710 - RNA, 15 nt, Shigella flexneri 2a str. 2457T
cuucccacgucagac

SEQ ID NO: 1906711 - RNA, 20 nt, Shigella flexneri 2a str. 2457T
cuucccaauugcacauauuu

SEQ ID NO: 1906712 - RNA, 19 nt, Shigella flexneri 2a str. 2457T
cuucccagguuucaaugcc

SEQ ID NO: 1906713 - RNA, 22 nt, Shigella flexneri 2a str. 2457T
cuuccauugccgcuuuccaggc

SEQ ID NO: 1906714 - RNA, 19 nt, Shigella flexneri 2a str. 2457T
cuuccaucgcaucuucgcc

SEQ ID NO: 1906715 - RNA, 17 nt, Shigella flexneri 2a str. 2457T
cuuccgcaauacagcca

SEQ ID NO: 1906716 - RNA, 18 nt, Shigella flexneri 2a str. 2457T
cuuccgcaauacagccag

SEQ ID NO: 1906717 - RNA, 22 nt, Shigella flexneri 2a str. 2457T
cuuccgcaauacagccagccag

SEQ ID NO: 1906718 - RNA, 20 nt, Shigella flexneri 2a str. 2457T
cuuccgcuaguguacccuuc

SEQ ID NO: 1906719 - RNA, 14 nt, Shigella flexneri 2a str. 2457T
cuuccgccagcggc

SEQ ID NO: 1906720 - RNA, 20 nt, Shigella flexneri 2a str. 2457T
cuuccaguacgcgcaacccc

SEQ ID NO: 1906721 - RNA, 18 nt, Shigella flexneri 2a str. 2457T
cuuccagucgccugcuuu

SEQ ID NO: 1906722 - RNA, 12 nt, Shigella flexneri 2a str. 2457T
cuuccagugccu

SEQ ID NO: 1906723 - RNA, 14 nt, Shigella flexneri 2a str. 2457T
cuuccauacagcuc

SEQ ID NO: 1906724 - RNA, 19 nt, Shigella flexneri 2a str. 2457T
cuuccaguuugcucaaauc

SEQ ID NO: 1906725 - RNA, 13 nt, Shigella flexneri 2a str. 2457T
cuuccaucacaaa

SEQ ID NO: 1906726 - RNA, 16 nt, Shigella flexneri 2a str. 2457T
cuucauuugccagcuu

SEQ ID NO: 1906727 - RNA, 17 nt, Shigella flexneri 2a str. 2457T
cuucauuugccagcuuc

SEQ ID NO: 1906728 - RNA, 13 nt, Shigella flexneri 2a str. 2457T
cuucauugcucuc

SEQ ID NO: 1906729 - RNA, 15 nt, Shigella flexneri 2a str. 2457T
cuucauugcucucuu

SEQ ID NO: 1906730 - RNA, 12 nt, Shigella flexneri 2a str. 2457T
cuucauugcucu

SEQ ID NO: 1906731 - RNA, 13 nt, Shigella flexneri 2a str. 2457T
cuucauuauccuu

SEQ ID NO: 1906732 - RNA, 19 nt, Shigella flexneri 2a str. 2457T
cuucauucagacaggcgaa

SEQ ID NO: 1906733 - RNA, 21 nt, Shigella flexneri 2a str. 2457T
cuuucauaugauaggcuucca

SEQ ID NO: 1906734 - RNA, 14 nt, Shigella flexneri 2a str. 2457T
cuuucaucaaaaaa

SEQ ID NO: 1906735 - RNA, 13 nt, Shigella flexneri 2a str. 2457T
cuuuccaggcauc

SEQ ID NO: 1906736 - RNA, 14 nt, Shigella flexneri 2a str. 2457T
cuuuccaggcauca

SEQ ID NO: 1906737 - RNA, 19 nt, Shigella flexneri 2a str. 2457T
cuuuccaugccaucugcca

SEQ ID NO: 1906738 - RNA, 16 nt, Shigella flexneri 2a str. 2457T
cuuuccggcagaagca

SEQ ID NO: 1906739 - RNA, 21 nt, Shigella flexneri 2a str. 2457T
cuuuccggcagaagcaaucau

SEQ ID NO: 1906740 - RNA, 18 nt, Shigella flexneri 2a str. 2457T
cuuuccuggucggcaaac

SEQ ID NO: 1906741 - RNA, 13 nt, Shigella flexneri 2a str. 2457T
cuuuccugcugcg

SEQ ID NO: 1906742 - RNA, 14 nt, Shigella flexneri 2a str. 2457T
cuuucccuggcgcu

SEQ ID NO: 1906743 - RNA, 22 nt, Shigella flexneri 2a str. 2457T
cuuucccuucacucugcugcca

SEQ ID NO: 1906744 - RNA, 13 nt, Shigella flexneri 2a str. 2457T
cuuucccuucucg

SEQ ID NO: 1906745 - RNA, 20 nt, Shigella flexneri 2a str. 2457T
cuuucccgcgcccgugcauc

SEQ ID NO: 1906746 - RNA, 20 nt, Shigella flexneri 2a str. 2457T
cuuucgcuaaggucaccagu

SEQ ID NO: 1906747 - RNA, 18 nt, Shigella flexneri 2a str. 2457T
cuuucgcccagcguugca

SEQ ID NO: 1906748 - RNA, 23 nt, Shigella flexneri 2a str. 2457T
cuuucgacagcgauuccaguucg

SEQ ID NO: 1906749 - RNA, 17 nt, Shigella flexneri 2a str. 2457T
cuuucgaucagugaagg

SEQ ID NO: 1906750 - RNA, 21 nt, Shigella flexneri 2a str. 2457T
cuuucgaaaucauucgcaguu

SEQ ID NO: 1906751 - RNA, 15 nt, Shigella flexneri 2a str. 2457T
cuuucgcuucaacca

SEQ ID NO: 1906752 - RNA, 16 nt, Shigella flexneri 2a str. 2457T
cuuucgcuuucucuuc

SEQ ID NO: 1906753 - RNA, 23 nt, Shigella flexneri 2a str. 2457T
cuuucucaauuaacgguaauaau

SEQ ID NO: 1906754 - RNA, 20 nt, Shigella flexneri 2a str. 2457T
cuuucuaugguuuugaagaa

SEQ ID NO: 1906755 - RNA, 16 nt, Shigella flexneri 2a str. 2457T
cuuucucuucaucuau

SEQ ID NO: 1906756 - RNA, 14 nt, Shigella flexneri 2a str. 2457T
cuuucucuucaucu

SEQ ID NO: 1906757 - RNA, 21 nt, Shigella flexneri 2a str. 2457T
cuuucugaacugaacaaaaaa

SEQ ID NO: 1906758 - RNA, 14 nt, Shigella flexneri 2a str. 2457T
cuuucugaaggauu

SEQ ID NO: 1906759 - RNA, 17 nt, Shigella flexneri 2a str. 2457T
cuuucucauuuuuuaaa

SEQ ID NO: 1906760 - RNA, 19 nt, Shigella flexneri 2a str. 2457T
cuuucucccgaaaaaccug

SEQ ID NO: 1906761 - RNA, 14 nt, Shigella flexneri 2a str. 2457T
cuuuaccucgaaaa

SEQ ID NO: 1906762 - RNA, 20 nt, Shigella flexneri 2a str. 2457T
cuuuacgaucaucacguugg

SEQ ID NO: 1906763 - RNA, 20 nt, Shigella flexneri 2a str. 2457T
cuuuauagugugcaaucacu

SEQ ID NO: 1906764 - RNA, 15 nt, Shigella flexneri 2a str. 2457T
cuuuaucaccaauga

SEQ ID NO: 1906765 - RNA, 16 nt, Shigella flexneri 2a str. 2457T
cuuuaauaugccacgc

SEQ ID NO: 1906766 - RNA, 23 nt, Shigella flexneri 2a str. 2457T
cuuuaccgcaucuuaacgccugg

SEQ ID NO: 1906767 - RNA, 14 nt, Shigella flexneri 2a str. 2457T
cuuuacccagcgga

SEQ ID NO: 1906768 - RNA, 17 nt, Shigella flexneri 2a str. 2457T
cuuuacccagcggaugu

SEQ ID NO: 1906769 - RNA, 20 nt, Shigella flexneri 2a str. 2457T
cuuuaccaccgucaaaaaaa

SEQ ID NO: 1906770 - RNA, 21 nt, Shigella flexneri 2a str. 2457T
cuuuaaugccacauuagauaa

SEQ ID NO: 1906771 - RNA, 15 nt, Shigella flexneri 2a str. 2457T
cuuuaaugacacgaa

SEQ ID NO: 1906772 - RNA, 21 nt, Shigella flexneri 2a str. 2457T
cuuucacaaagacgccaucaa

SEQ ID NO: 1906773 - RNA, 17 nt, Shigella flexneri 2a str. 2457T
cuuuauuauuuucaaua

SEQ ID NO: 1906774 - RNA, 20 nt, Shigella flexneri 2a str. 2457T
cuuuauucaccaguaaggca

SEQ ID NO: 1906775 - RNA, 22 nt, Shigella flexneri 2a str. 2457T
cuuuauuaucaacaugauggcu

SEQ ID NO: 1906776 - RNA, 14 nt, Shigella flexneri 2a str. 2457T
cuuucaccucuuca

SEQ ID NO: 1906777 - RNA, 20 nt, Shigella flexneri 2a str. 2457T
cuuucacccggcgcuaauuc

SEQ ID NO: 1906778 - RNA, 16 nt, Shigella flexneri 2a str. 2457T
cuuucaccgccugauc

SEQ ID NO: 1906779 - RNA, 23 nt, Shigella flexneri 2a str. 2457T
cuuucaccaucgcgaucaucagu

SEQ ID NO: 1906780 - RNA, 22 nt, Shigella flexneri 2a str. 2457T
cuuucaguggcuuaucuuccug

SEQ ID NO: 1906781 - RNA, 18 nt, Shigella flexneri 2a str. 2457T
cuuucacucaguguugga

SEQ ID NO: 1906782 - RNA, 22 nt, Shigella flexneri 2a str. 2457T
cuuucacgcgcugaccuucuuc

SEQ ID NO: 1906783 - RNA, 16 nt, Shigella flexneri 2a str. 2457T
cuuucaccucuucauu

SEQ ID NO: 1906784 - RNA, 16 nt, Shigella flexneri 2a str. 2457T
cuuguacggcuccgcc

SEQ ID NO: 1906785 - RNA, 18 nt, Shigella flexneri 2a str. 2457T
cuuguacucuacaaccag

SEQ ID NO: 1906786 - RNA, 19 nt, Shigella flexneri 2a str. 2457T
cuuguacggcuccgcccca

SEQ ID NO: 1906787 - RNA, 22 nt, Shigella flexneri 2a str. 2457T
cuugucaugcagcuccaccgau

SEQ ID NO: 1906788 - RNA, 15 nt, Shigella flexneri 2a str. 2457T
cuugugcucaauuga

SEQ ID NO: 1906789 - RNA, 17 nt, Shigella flexneri 2a str. 2457T
cuugugccaguucaggu

SEQ ID NO: 1906790 - RNA, 16 nt, Shigella flexneri 2a str. 2457T
cuugugcaaaaagucc

SEQ ID NO: 1906791 - RNA, 18 nt, Shigella flexneri 2a str. 2457T
cuuguuaccugaugcagc

SEQ ID NO: 1906792 - RNA, 22 nt, Shigella flexneri 2a str. 2457T
cuuguucacgccaucaucggca

SEQ ID NO: 1906793 - RNA, 15 nt, Shigella flexneri 2a str. 2457T
cuuguggugaaacua

SEQ ID NO: 1906794 - RNA, 14 nt, Shigella flexneri 2a str. 2457T
cuuguuuaaggaaa

SEQ ID NO: 1906795 - RNA, 17 nt, Shigella flexneri 2a str. 2457T
cuuuaaaaaaagcauuu

SEQ ID NO: 1906796 - RNA, 13 nt, Shigella flexneri 2a str. 2457T
cuuuaaaggccag

SEQ ID NO: 1906797 - RNA, 22 nt, Shigella flexneri 2a str. 2457T
cuuuaaacgauuccacuuuuuc

SEQ ID NO: 1906798 - RNA, 21 nt, Shigella flexneri 2a str. 2457T
cuuuaaacacgcgaccaaagg

SEQ ID NO: 1906799 - RNA, 11 nt, Shigella flexneri 2a str. 2457T
cuuuaaacaga

SEQ ID NO: 1906800 - RNA, 14 nt, Shigella flexneri 2a str. 2457T
cuuuaaaaaagaau

SEQ ID NO: 1906801 - RNA, 14 nt, Shigella flexneri 2a str. 2457T
cuuuaaaaaguaaa

SEQ ID NO: 1906802 - RNA, 22 nt, Shigella flexneri 2a str. 2457T
cuuuaaccuuugcgguuaaaaa

SEQ ID NO: 1906803 - RNA, 15 nt, Shigella flexneri 2a str. 2457T
cuuuaauaccugccu

SEQ ID NO: 1906804 - RNA, 20 nt, Shigella flexneri 2a str. 2457T
cuugcgucauccagcacuug

SEQ ID NO: 1906805 - RNA, 19 nt, Shigella flexneri 2a str. 2457T
cuugcguacaccaacauca

SEQ ID NO: 1906806 - RNA, 16 nt, Shigella flexneri 2a str. 2457T
cuugcgucgccaguuu

SEQ ID NO: 1906807 - RNA, 22 nt, Shigella flexneri 2a str. 2457T
cuugcucgcgcaccuacagcca

SEQ ID NO: 1906808 - RNA, 19 nt, Shigella flexneri 2a str. 2457T
cuugcuccacaagcuccgg

SEQ ID NO: 1906809 - RNA, 20 nt, Shigella flexneri 2a str. 2457T
cuugcuccacguucagagag

SEQ ID NO: 1906810 - RNA, 14 nt, Shigella flexneri 2a str. 2457T
cuugcucaaugagu

SEQ ID NO: 1906811 - RNA, 13 nt, Shigella flexneri 2a str. 2457T
cuugcuuugcaac

SEQ ID NO: 1906812 - RNA, 20 nt, Shigella flexneri 2a str. 2457T
cuugcuuuccagcuucaaau

SEQ ID NO: 1906813 - RNA, 18 nt, Shigella flexneri 2a str. 2457T
cuugcugauacuccucau

SEQ ID NO: 1906814 - RNA, 20 nt, Shigella flexneri 2a str. 2457T
cuugcugauacuccucauug

SEQ ID NO: 1906815 - RNA, 15 nt, Shigella flexneri 2a str. 2457T
cuugcagcgucuuau

SEQ ID NO: 1906816 - RNA, 18 nt, Shigella flexneri 2a str. 2457T
cuugcagucggcuuucuc

SEQ ID NO: 1906817 - RNA, 22 nt, Shigella flexneri 2a str. 2457T
cuugccggacaugcugccucca

SEQ ID NO: 1906818 - RNA, 12 nt, Shigella flexneri 2a str. 2457T
cuucuuuauuga

SEQ ID NO: 1906819 - RNA, 12 nt, Shigella flexneri 2a str. 2457T
cuugaaaccaga

SEQ ID NO: 1906820 - RNA, 15 nt, Shigella flexneri 2a str. 2457T
cuugaugugcuucau

SEQ ID NO: 1906821 - RNA, 16 nt, Shigella flexneri 2a str. 2457T
cuugauguuccucgcu

SEQ ID NO: 1906822 - RNA, 20 nt, Shigella flexneri 2a str. 2457T
cuugcaccggcgacauccca

SEQ ID NO: 1906823 - RNA, 12 nt, Shigella flexneri 2a str. 2457T
cuugauacugaa

SEQ ID NO: 1906824 - RNA, 18 nt, Shigella flexneri 2a str. 2457T
cuugauagaacaaaagac

SEQ ID NO: 1906825 - RNA, 18 nt, Shigella flexneri 2a str. 2457T
cuugauauaaaucccagg

SEQ ID NO: 1906826 - RNA, 22 nt, Shigella flexneri 2a str. 2457T
cuugauaaagaucgaucauuuu

SEQ ID NO: 1906827 - RNA, 19 nt, Shigella flexneri 2a str. 2457T
cuugauaacgagcaauaga

SEQ ID NO: 1906828 - RNA, 23 nt, Shigella flexneri 2a str. 2457T
cuugaguuuuucaucccucucau

SEQ ID NO: 1906829 - RNA, 16 nt, Shigella flexneri 2a str. 2457T
cuucucugaaaauuaa

SEQ ID NO: 1906830 - RNA, 20 nt, Shigella flexneri 2a str. 2457T
cuucucgugaaacucacgca

SEQ ID NO: 1906831 - RNA, 22 nt, Shigella flexneri 2a str. 2457T
cuucucgauaaaaccuuccuca

SEQ ID NO: 1906832 - RNA, 14 nt, Shigella flexneri 2a str. 2457T
cuucucgauaaacc

SEQ ID NO: 1906833 - RNA, 23 nt, Shigella flexneri 2a str. 2457T
cuucucgauaaaccauccugcuc

SEQ ID NO: 1906834 - RNA, 21 nt, Shigella flexneri 2a str. 2457T
cuucucgccagccucccagcc

SEQ ID NO: 1906835 - RNA, 22 nt, Shigella flexneri 2a str. 2457T
cuucucgcucgagagagaaaau

SEQ ID NO: 1906836 - RNA, 20 nt, Shigella flexneri 2a str. 2457T
cuucgcguaacugaagcauu

SEQ ID NO: 1906837 - RNA, 22 nt, Shigella flexneri 2a str. 2457T
cuucgcggacaucguccagcuu

SEQ ID NO: 1906838 - RNA, 16 nt, Shigella flexneri 2a str. 2457T
cuucugccagcugcug

SEQ ID NO: 1906839 - RNA, 20 nt, Shigella flexneri 2a str. 2457T
cuucugcuuucauucgguuu

SEQ ID NO: 1906840 - RNA, 22 nt, Shigella flexneri 2a str. 2457T
cuucugcuuuggcugccgccag

SEQ ID NO: 1906841 - RNA, 15 nt, Shigella flexneri 2a str. 2457T
cuucucuucuuccgc

SEQ ID NO: 1906842 - RNA, 17 nt, Shigella flexneri 2a str. 2457T
cuucugaucuacagccu

SEQ ID NO: 1906843 - RNA, 19 nt, Shigella flexneri 2a str. 2457T
cuucugcaacgucuccggu

SEQ ID NO: 1906844 - RNA, 18 nt, Shigella flexneri 2a str. 2457T
cuucuugcagcuuaauca

SEQ ID NO: 1906845 - RNA, 21 nt, Shigella flexneri 2a str. 2457T
cuucuucugucgggcaucacu

SEQ ID NO: 1906846 - RNA, 20 nt, Shigella flexneri 2a str. 2457T
cuucuuccauaccgaccaug

SEQ ID NO: 1906847 - RNA, 17 nt, Shigella flexneri 2a str. 2457T
cuucuucauucauccgc

SEQ ID NO: 1906848 - RNA, 19 nt, Shigella flexneri 2a str. 2457T
cuucuucgucgucuucguc

SEQ ID NO: 1906849 - RNA, 16 nt, Shigella flexneri 2a str. 2457T
cuucuucuggcugcca

SEQ ID NO: 1906850 - RNA, 23 nt, Shigella flexneri 2a str. 2457T
cuucuuaaugcccaucucuucuu

SEQ ID NO: 1906851 - RNA, 15 nt, Shigella flexneri 2a str. 2457T
cuucuucaguuuuuc

SEQ ID NO: 1906852 - RNA, 19 nt, Shigella flexneri 2a str. 2457T
cuucuggugauaggcguug

SEQ ID NO: 1906853 - RNA, 22 nt, Shigella flexneri 2a str. 2457T
cuucuggcgacccguuuuucuu

SEQ ID NO: 1906854 - RNA, 18 nt, Shigella flexneri 2a str. 2457T
cuucugguuucaguaauc

SEQ ID NO: 1906855 - RNA, 15 nt, Shigella flexneri 2a str. 2457T
cuucuguaacuggaa

SEQ ID NO: 1906856 - RNA, 21 nt, Shigella flexneri 2a str. 2457T
cuucugguugcgaaaaaauca

SEQ ID NO: 1906857 - RNA, 17 nt, Shigella flexneri 2a str. 2457T
cuucugguuauauuucc

SEQ ID NO: 1906858 - RNA, 19 nt, Shigella flexneri 2a str. 2457T
cuucugguuauauuucccc

SEQ ID NO: 1906859 - RNA, 20 nt, Shigella flexneri 2a str. 2457T
cuucugucgggcaucacuau

SEQ ID NO: 1906860 - RNA, 19 nt, Shigella flexneri 2a str. 2457T
cuggcgauauugccgcgau

SEQ ID NO: 1906861 - RNA, 15 nt, Shigella flexneri 2a str. 2457T
cuggcgcgacgcagg

SEQ ID NO: 1906862 - RNA, 13 nt, Shigella flexneri 2a str. 2457T
cuggcgaugcccc

SEQ ID NO: 1906863 - RNA, 14 nt, Shigella flexneri 2a str. 2457T
cuggccgugcagac

SEQ ID NO: 1906864 - RNA, 17 nt, Shigella flexneri 2a str. 2457T
cuggcggaugugcugga

SEQ ID NO: 1906865 - RNA, 18 nt, Shigella flexneri 2a str. 2457T
cuggcggcaaucgccaga

SEQ ID NO: 1906866 - RNA, 13 nt, Shigella flexneri 2a str. 2457T
cuggcggcagcag

SEQ ID NO: 1906867 - RNA, 17 nt, Shigella flexneri 2a str. 2457T
cuggcggcaaugaaagc

SEQ ID NO: 1906868 - RNA, 18 nt, Shigella flexneri 2a str. 2457T
cuggcggagcucccaggc

SEQ ID NO: 1906869 - RNA, 22 nt, Shigella flexneri 2a str. 2457T
cuggcgcuggaugucuggcaga

SEQ ID NO: 1906870 - RNA, 18 nt, Shigella flexneri 2a str. 2457T
cuggcgcguuuaaucaca

SEQ ID NO: 1906871 - RNA, 15 nt, Shigella flexneri 2a str. 2457T
cuggcgcuaucaaua

SEQ ID NO: 1906872 - RNA, 18 nt, Shigella flexneri 2a str. 2457T
cuggcgcguuaucgacaa

SEQ ID NO: 1906873 - RNA, 16 nt, Shigella flexneri 2a str. 2457T
cuggcauaaacaaagc

SEQ ID NO: 1906874 - RNA, 19 nt, Shigella flexneri 2a str. 2457T
cuggcaguggaauauaauu

SEQ ID NO: 1906875 - RNA, 23 nt, Shigella flexneri 2a str. 2457T
cuggcaugccgguagaagccagu

SEQ ID NO: 1906876 - RNA, 16 nt, Shigella flexneri 2a str. 2457T
cuggcaugcuguccag

SEQ ID NO: 1906877 - RNA, 17 nt, Shigella flexneri 2a str. 2457T
cuggccaaugccucuac

SEQ ID NO: 1906878 - RNA, 16 nt, Shigella flexneri 2a str. 2457T
cuggccauuucugcca

SEQ ID NO: 1906879 - RNA, 18 nt, Shigella flexneri 2a str. 2457T
cuggccauuucugccagu

SEQ ID NO: 1906880 - RNA, 23 nt, Shigella flexneri 2a str. 2457T
cuggaguuaaauuaauaaucaca

SEQ ID NO: 1906881 - RNA, 19 nt, Shigella flexneri 2a str. 2457T
cuggaguuauagcuggauu

SEQ ID NO: 1906882 - RNA, 12 nt, Shigella flexneri 2a str. 2457T
cuggauaaaauu

SEQ ID NO: 1906883 - RNA, 18 nt, Shigella flexneri 2a str. 2457T
cuggauaaucacaauggu

SEQ ID NO: 1906884 - RNA, 22 nt, Shigella flexneri 2a str. 2457T
cuggauaaggcguuuacgccgc

SEQ ID NO: 1906885 - RNA, 22 nt, Shigella flexneri 2a str. 2457T
cuggauaaggcguucacgccgc

SEQ ID NO: 1906886 - RNA, 21 nt, Shigella flexneri 2a str. 2457T
cuggauaaucacaauggucaa

SEQ ID NO: 1906887 - RNA, 17 nt, Shigella flexneri 2a str. 2457T
cuggcaccgcagaucag

SEQ ID NO: 1906888 - RNA, 16 nt, Shigella flexneri 2a str. 2457T
cuggcaaucaguggcu

SEQ ID NO: 1906889 - RNA, 12 nt, Shigella flexneri 2a str. 2457T
cuggcaaugacc

SEQ ID NO: 1906890 - RNA, 14 nt, Shigella flexneri 2a str. 2457T
cuggaagauucccc

SEQ ID NO: 1906891 - RNA, 23 nt, Shigella flexneri 2a str. 2457T
cuggaagaguuuguugagauggu

SEQ ID NO: 1906892 - RNA, 21 nt, Shigella flexneri 2a str. 2457T
cuggaaggacucgaggagcug

SEQ ID NO: 1906893 - RNA, 13 nt, Shigella flexneri 2a str. 2457T
cuggaacaaacug

SEQ ID NO: 1906894 - RNA, 18 nt, Shigella flexneri 2a str. 2457T
cuggaacaaacugccgcg

SEQ ID NO: 1906895 - RNA, 15 nt, Shigella flexneri 2a str. 2457T
cuggaaaucaauggu

SEQ ID NO: 1906896 - RNA, 16 nt, Shigella flexneri 2a str. 2457T
cuggaaaucaaugguc

SEQ ID NO: 1906897 - RNA, 14 nt, Shigella flexneri 2a str. 2457T
cuggaaaucaaaaa

SEQ ID NO: 1906898 - RNA, 16 nt, Shigella flexneri 2a str. 2457T
cuggaccauauuagcc

SEQ ID NO: 1906899 - RNA, 18 nt, Shigella flexneri 2a str. 2457T
cuggacaacuucugaugu

SEQ ID NO: 1906900 - RNA, 15 nt, Shigella flexneri 2a str. 2457T
cuggacaacuucuga

SEQ ID NO: 1906901 - RNA, 22 nt, Shigella flexneri 2a str. 2457T
cuggacaacauuccugcugacg

SEQ ID NO: 1906902 - RNA, 22 nt, Shigella flexneri 2a str. 2457T
cuggacgguggagcaacaggga

SEQ ID NO: 1906903 - RNA, 20 nt, Shigella flexneri 2a str. 2457T
cuggacucccagaacaaccc

SEQ ID NO: 1906904 - RNA, 15 nt, Shigella flexneri 2a str. 2457T
cuggagcagcaaaga

SEQ ID NO: 1906905 - RNA, 18 nt, Shigella flexneri 2a str. 2457T
cuggagcacugcgcccgc

SEQ ID NO: 1906906 - RNA, 15 nt, Shigella flexneri 2a str. 2457T
cuggagcaggaacuu

SEQ ID NO: 1906907 - RNA, 19 nt, Shigella flexneri 2a str. 2457T
cuggagccgcaucaccgca

SEQ ID NO: 1906908 - RNA, 21 nt, Shigella flexneri 2a str. 2457T
cugcuugaacgcaccgccacc

SEQ ID NO: 1906909 - RNA, 15 nt, Shigella flexneri 2a str. 2457T
cugcucaucagcggu

SEQ ID NO: 1906910 - RNA, 12 nt, Shigella flexneri 2a str. 2457T
cugcucaauguc

SEQ ID NO: 1906911 - RNA, 15 nt, Shigella flexneri 2a str. 2457T
cugcucaaugucugu

SEQ ID NO: 1906912 - RNA, 12 nt, Shigella flexneri 2a str. 2457T
cugcucagcucc

SEQ ID NO: 1906913 - RNA, 14 nt, Shigella flexneri 2a str. 2457T
cugcucagcuccuc

SEQ ID NO: 1906914 - RNA, 16 nt, Shigella flexneri 2a str. 2457T
cugcucagcuccucuu

SEQ ID NO: 1906915 - RNA, 21 nt, Shigella flexneri 2a str. 2457T
cugcucaguugcaucgucugu

SEQ ID NO: 1906916 - RNA, 17 nt, Shigella flexneri 2a str. 2457T
cugcucaaagccgucga

SEQ ID NO: 1906917 - RNA, 12 nt, Shigella flexneri 2a str. 2457T
cugcucaaugga

SEQ ID NO: 1906918 - RNA, 21 nt, Shigella flexneri 2a str. 2457T
cugcuacggcaauucccagaa

SEQ ID NO: 1906919 - RNA, 17 nt, Shigella flexneri 2a str. 2457T
cugcuuuccgcuggcgu

SEQ ID NO: 1906920 - RNA, 13 nt, Shigella flexneri 2a str. 2457T
cuggaaagagaaa

SEQ ID NO: 1906921 - RNA, 14 nt, Shigella flexneri 2a str. 2457T
cuggaaaaagugcc

SEQ ID NO: 1906922 - RNA, 18 nt, Shigella flexneri 2a str. 2457T
cugcuuguuccacuucau

SEQ ID NO: 1906923 - RNA, 16 nt, Shigella flexneri 2a str. 2457T
cugcuuguuccacuuc

SEQ ID NO: 1906924 - RNA, 17 nt, Shigella flexneri 2a str. 2457T
cugcuuguuccacuuca

SEQ ID NO: 1906925 - RNA, 15 nt, Shigella flexneri 2a str. 2457T
cugcuuuacgccagg

SEQ ID NO: 1906926 - RNA, 21 nt, Shigella flexneri 2a str. 2457T
cugcuuuaucagaucacgcau

SEQ ID NO: 1906927 - RNA, 16 nt, Shigella flexneri 2a str. 2457T
cugcuuuaucagauca

SEQ ID NO: 1906928 - RNA, 16 nt, Shigella flexneri 2a str. 2457T
cugcuugccagauacg

SEQ ID NO: 1906929 - RNA, 14 nt, Shigella flexneri 2a str. 2457T
cugucgcagccagc

SEQ ID NO: 1906930 - RNA, 18 nt, Shigella flexneri 2a str. 2457T
cugucgcagcgugcucuc

SEQ ID NO: 1906931 - RNA, 15 nt, Shigella flexneri 2a str. 2457T
cugucgcaaauccgc

SEQ ID NO: 1906932 - RNA, 14 nt, Shigella flexneri 2a str. 2457T
cugucgcaaauccg

SEQ ID NO: 1906933 - RNA, 15 nt, Shigella flexneri 2a str. 2457T
cugucgcgcagcacu

SEQ ID NO: 1906934 - RNA, 20 nt, Shigella flexneri 2a str. 2457T
cugucggcaaaucaauagug

SEQ ID NO: 1906935 - RNA, 17 nt, Shigella flexneri 2a str. 2457T
cugucggguaagcgcca

SEQ ID NO: 1906936 - RNA, 22 nt, Shigella flexneri 2a str. 2457T
cugucggcacugaccaccacca

SEQ ID NO: 1906937 - RNA, 20 nt, Shigella flexneri 2a str. 2457T
cugucggguaagcgccacaa

SEQ ID NO: 1906938 - RNA, 13 nt, Shigella flexneri 2a str. 2457T
cugucaccaauca

SEQ ID NO: 1906939 - RNA, 17 nt, Shigella flexneri 2a str. 2457T
cugucacaccuuauuua

SEQ ID NO: 1906940 - RNA, 13 nt, Shigella flexneri 2a str. 2457T
cugucaauaaacg

SEQ ID NO: 1906941 - RNA, 14 nt, Shigella flexneri 2a str. 2457T
cuguauuacagagg

SEQ ID NO: 1906942 - RNA, 21 nt, Shigella flexneri 2a str. 2457T
cuguauuagcaucgcgauggc

SEQ ID NO: 1906943 - RNA, 16 nt, Shigella flexneri 2a str. 2457T
cuguauucuucagcga

SEQ ID NO: 1906944 - RNA, 13 nt, Shigella flexneri 2a str. 2457T
cugucauaacaca

SEQ ID NO: 1906945 - RNA, 17 nt, Shigella flexneri 2a str. 2457T
cuguaaaaggcgccauu

SEQ ID NO: 1906946 - RNA, 20 nt, Shigella flexneri 2a str. 2457T
cugguuuucagcgaaacagc

SEQ ID NO: 1906947 - RNA, 21 nt, Shigella flexneri 2a str. 2457T
cuguaacaaggugaaucaagc

SEQ ID NO: 1906948 - RNA, 20 nt, Shigella flexneri 2a str. 2457T
cuguaaauucucaauaucau

SEQ ID NO: 1906949 - RNA, 19 nt, Shigella flexneri 2a str. 2457T
cuguaaauugaugugaaaa

SEQ ID NO: 1906950 - RNA, 19 nt, Shigella flexneri 2a str. 2457T
cuguaaaugcugcuccagc

SEQ ID NO: 1906951 - RNA, 18 nt, Shigella flexneri 2a str. 2457T
cuguaaaucgccaugguc

SEQ ID NO: 1906952 - RNA, 21 nt, Shigella flexneri 2a str. 2457T
cuguaaaacgcgcccucagcc

SEQ ID NO: 1906953 - RNA, 23 nt, Shigella flexneri 2a str. 2457T
cuguaauugagaaccacaaugaa

SEQ ID NO: 1906954 - RNA, 21 nt, Shigella flexneri 2a str. 2457T
cuguaccuucacgcgcuccag

SEQ ID NO: 1906955 - RNA, 14 nt, Shigella flexneri 2a str. 2457T
cuguacggcaguga

SEQ ID NO: 1906956 - RNA, 21 nt, Shigella flexneri 2a str. 2457T
cuguaccagcggcuuccagca

SEQ ID NO: 1906957 - RNA, 16 nt, Shigella flexneri 2a str. 2457T
cuguaccagcccgccu

SEQ ID NO: 1906958 - RNA, 14 nt, Shigella flexneri 2a str. 2457T
cuguaccagcccgc

SEQ ID NO: 1906959 - RNA, 17 nt, Shigella flexneri 2a str. 2457T
cuguacaggcuccugua

SEQ ID NO: 1906960 - RNA, 17 nt, Shigella flexneri 2a str. 2457T
cuggggaaaaugggcau

SEQ ID NO: 1906961 - RNA, 16 nt, Shigella flexneri 2a str. 2457T
cuggggauagaaacag

SEQ ID NO: 1906962 - RNA, 13 nt, Shigella flexneri 2a str. 2457T
cuggggccgucau

SEQ ID NO: 1906963 - RNA, 18 nt, Shigella flexneri 2a str. 2457T
cugguaacuggugccagg

SEQ ID NO: 1906964 - RNA, 14 nt, Shigella flexneri 2a str. 2457T
cugguaaucaccac

SEQ ID NO: 1906965 - RNA, 15 nt, Shigella flexneri 2a str. 2457T
cugguaccagcaccg

SEQ ID NO: 1906966 - RNA, 21 nt, Shigella flexneri 2a str. 2457T
cugguacgauucgcccgcagc

SEQ ID NO: 1906967 - RNA, 14 nt, Shigella flexneri 2a str. 2457T
cugggccugcauau

SEQ ID NO: 1906968 - RNA, 16 nt, Shigella flexneri 2a str. 2457T
cugggcgcaccugccc

SEQ ID NO: 1906969 - RNA, 18 nt, Shigella flexneri 2a str. 2457T
cugggcgauuuucuacuu

SEQ ID NO: 1906970 - RNA, 15 nt, Shigella flexneri 2a str. 2457T
cugggcgaaacagag

SEQ ID NO: 1906971 - RNA, 16 nt, Shigella flexneri 2a str. 2457T
cugggcgauuuccuuc

SEQ ID NO: 1906972 - RNA, 23 nt, Shigella flexneri 2a str. 2457T
cugggcgauuuccuucagcagca

SEQ ID NO: 1906973 - RNA, 16 nt, Shigella flexneri 2a str. 2457T
cuggcguacagagggc

SEQ ID NO: 1906974 - RNA, 17 nt, Shigella flexneri 2a str. 2457T
cuggcguacagagggca

SEQ ID NO: 1906975 - RNA, 19 nt, Shigella flexneri 2a str. 2457T
cuggcgggaauaaaagcca

SEQ ID NO: 1906976 - RNA, 12 nt, Shigella flexneri 2a str. 2457T
cuggcggcggcg

SEQ ID NO: 1906977 - RNA, 17 nt, Shigella flexneri 2a str. 2457T
cuggcgucaaagcugcu

SEQ ID NO: 1906978 - RNA, 14 nt, Shigella flexneri 2a str. 2457T
cuggcguccggaaa

SEQ ID NO: 1906979 - RNA, 21 nt, Shigella flexneri 2a str. 2457T
cuggcgucacgccgaccagac

SEQ ID NO: 1906980 - RNA, 23 nt, Shigella flexneri 2a str. 2457T
cuggcgucacgccgaccagaccg

SEQ ID NO: 1906981 - RNA, 16 nt, Shigella flexneri 2a str. 2457T
cuggcguacccaucaa

SEQ ID NO: 1906982 - RNA, 19 nt, Shigella flexneri 2a str. 2457T
cuggcguacagagggcagg

SEQ ID NO: 1906983 - RNA, 23 nt, Shigella flexneri 2a str. 2457T
cuggcguaccaaucagacucaua

SEQ ID NO: 1906984 - RNA, 14 nt, Shigella flexneri 2a str. 2457T
cuggcguacccauc

SEQ ID NO: 1906985 - RNA, 19 nt, Shigella flexneri 2a str. 2457T
cuggugacuuuugcccggc

SEQ ID NO: 1906986 - RNA, 12 nt, Shigella flexneri 2a str. 2457T
cuggugaccugg

SEQ ID NO: 1906987 - RNA, 20 nt, Shigella flexneri 2a str. 2457T
cuggugauacaacgaccggc

SEQ ID NO: 1906988 - RNA, 22 nt, Shigella flexneri 2a str. 2457T
cuggugcaauuucagcguccug

SEQ ID NO: 1906989 - RNA, 21 nt, Shigella flexneri 2a str. 2457T
cuggugauugcaccgacuggc

SEQ ID NO: 1906990 - RNA, 18 nt, Shigella flexneri 2a str. 2457T
cuggugccaagcuccagc

SEQ ID NO: 1906991 - RNA, 16 nt, Shigella flexneri 2a str. 2457T
cugguccuucaucuuc

SEQ ID NO: 1906992 - RNA, 18 nt, Shigella flexneri 2a str. 2457T
cugguccuucaucuucaa

SEQ ID NO: 1906993 - RNA, 21 nt, Shigella flexneri 2a str. 2457T
cuggucggcaaacugcugaug

SEQ ID NO: 1906994 - RNA, 16 nt, Shigella flexneri 2a str. 2457T
cuggucacucucgacc

SEQ ID NO: 1906995 - RNA, 20 nt, Shigella flexneri 2a str. 2457T
cuggucaguuucagccagga

SEQ ID NO: 1906996 - RNA, 18 nt, Shigella flexneri 2a str. 2457T
cugguacucaaccgccac

SEQ ID NO: 1906997 - RNA, 14 nt, Shigella flexneri 2a str. 2457T
cugguagauaagca

SEQ ID NO: 1906998 - RNA, 12 nt, Shigella flexneri 2a str. 2457T
cugguagcaucu

SEQ ID NO: 1906999 - RNA, 19 nt, Shigella flexneri 2a str. 2457T
cugguagcgggugaagaga

SEQ ID NO: 1907000 - RNA, 13 nt, Shigella flexneri 2a str. 2457T
cugcguaauguuu

SEQ ID NO: 1907001 - RNA, 21 nt, Shigella flexneri 2a str. 2457T
cugcguaauguuuagagacgc

SEQ ID NO: 1907002 - RNA, 20 nt, Shigella flexneri 2a str. 2457T
cugcgguuucaacgacccag

SEQ ID NO: 1907003 - RNA, 15 nt, Shigella flexneri 2a str. 2457T
cugcguuccggcaug

SEQ ID NO: 1907004 - RNA, 19 nt, Shigella flexneri 2a str. 2457T
cugcguuccggcaugauuc

SEQ ID NO: 1907005 - RNA, 20 nt, Shigella flexneri 2a str. 2457T
cugcguggucauuaugaccg

SEQ ID NO: 1907006 - RNA, 17 nt, Shigella flexneri 2a str. 2457T
cugcguggcgcgcguca

SEQ ID NO: 1907007 - RNA, 15 nt, Shigella flexneri 2a str. 2457T
cugcguggaauuugu

SEQ ID NO: 1907008 - RNA, 16 nt, Shigella flexneri 2a str. 2457T
cugcguggaauuuguc

SEQ ID NO: 1907009 - RNA, 15 nt, Shigella flexneri 2a str. 2457T
cugcuaauauuuucg

SEQ ID NO: 1907010 - RNA, 12 nt, Shigella flexneri 2a str. 2457T
cugcuaauuuau

SEQ ID NO: 1907011 - RNA, 14 nt, Shigella flexneri 2a str. 2457T
cugcguucagcagu

SEQ ID NO: 1907012 - RNA, 13 nt, Shigella flexneri 2a str. 2457T
cugcguucugucg

SEQ ID NO: 1907013 - RNA, 22 nt, Shigella flexneri 2a str. 2457T
cugcguuagaaaacgccugcuc

SEQ ID NO: 1907014 - RNA, 15 nt, Shigella flexneri 2a str. 2457T
cugcguuucuggcuu

SEQ ID NO: 1907015 - RNA, 16 nt, Shigella flexneri 2a str. 2457T
cugcggguuagucugc

SEQ ID NO: 1907016 - RNA, 17 nt, Shigella flexneri 2a str. 2457T
cugcgggaguugcucca

SEQ ID NO: 1907017 - RNA, 12 nt, Shigella flexneri 2a str. 2457T
cugcgggcgcaa

SEQ ID NO: 1907018 - RNA, 19 nt, Shigella flexneri 2a str. 2457T
cugcgggcgcaagggcugg

SEQ ID NO: 1907019 - RNA, 14 nt, Shigella flexneri 2a str. 2457T
cugcgguaauccgg

SEQ ID NO: 1907020 - RNA, 21 nt, Shigella flexneri 2a str. 2457T
cugcggguuagucugcauuuu

SEQ ID NO: 1907021 - RNA, 18 nt, Shigella flexneri 2a str. 2457T
cugcggaaucaccggcaa

SEQ ID NO: 1907022 - RNA, 21 nt, Shigella flexneri 2a str. 2457T
cugcggaauugccgguacagc

SEQ ID NO: 1907023 - RNA, 13 nt, Shigella flexneri 2a str. 2457T
cugcgggagcgcu

SEQ ID NO: 1907024 - RNA, 16 nt, Shigella flexneri 2a str. 2457T
cugcggacgcaccgcg

SEQ ID NO: 1907025 - RNA, 15 nt, Shigella flexneri 2a str. 2457T
cugcgcauaacugcc

SEQ ID NO: 1907026 - RNA, 19 nt, Shigella flexneri 2a str. 2457T
cugcgcaucaugccaccca

SEQ ID NO: 1907027 - RNA, 21 nt, Shigella flexneri 2a str. 2457T
cugcgcaucaugccacccagg

SEQ ID NO: 1907028 - RNA, 14 nt, Shigella flexneri 2a str. 2457T
cugcgcaucuuccc

SEQ ID NO: 1907029 - RNA, 20 nt, Shigella flexneri 2a str. 2457T
cugcgcauuucccagcaaga

SEQ ID NO: 1907030 - RNA, 14 nt, Shigella flexneri 2a str. 2457T
cugcgcccgcagcg

SEQ ID NO: 1907031 - RNA, 16 nt, Shigella flexneri 2a str. 2457T
cugccugcagcugcuc

SEQ ID NO: 1907032 - RNA, 18 nt, Shigella flexneri 2a str. 2457T
cugccucucuucgcugcu

SEQ ID NO: 1907033 - RNA, 21 nt, Shigella flexneri 2a str. 2457T
cugccucgggauccaugcacg

SEQ ID NO: 1907034 - RNA, 19 nt, Shigella flexneri 2a str. 2457T
cugccuguacggcagugaa

SEQ ID NO: 1907035 - RNA, 17 nt, Shigella flexneri 2a str. 2457T
cugcgcagauuagccgg

SEQ ID NO: 1907036 - RNA, 12 nt, Shigella flexneri 2a str. 2457T
cugccugcuggg

SEQ ID NO: 1907037 - RNA, 19 nt, Shigella flexneri 2a str. 2457T
cugccugcggaaugagcga

SEQ ID NO: 1907038 - RNA, 16 nt, Shigella flexneri 2a str. 2457T
cugcgcgacucccuga

SEQ ID NO: 1907039 - RNA, 22 nt, Shigella flexneri 2a str. 2457T
cugcgccuuuuuucgccgcagc

SEQ ID NO: 1907040 - RNA, 21 nt, Shigella flexneri 2a str. 2457T
cugcgcgaccucuucugccug

SEQ ID NO: 1907041 - RNA, 17 nt, Shigella flexneri 2a str. 2457T
cugcgccgagcaauaaa

SEQ ID NO: 1907042 - RNA, 19 nt, Shigella flexneri 2a str. 2457T
cugcgcgcuucgcccuucg

SEQ ID NO: 1907043 - RNA, 21 nt, Shigella flexneri 2a str. 2457T
cugcgcgucuuaucaggccug

SEQ ID NO: 1907044 - RNA, 22 nt, Shigella flexneri 2a str. 2457T
cugcgcgucuuaucaggccugu

SEQ ID NO: 1907045 - RNA, 19 nt, Shigella flexneri 2a str. 2457T
cugcgcgugaagcacguaa

SEQ ID NO: 1907046 - RNA, 13 nt, Shigella flexneri 2a str. 2457T
cugccccaguucc

SEQ ID NO: 1907047 - RNA, 21 nt, Shigella flexneri 2a str. 2457T
cugccauccguaauuuuuacu

SEQ ID NO: 1907048 - RNA, 23 nt, Shigella flexneri 2a str. 2457T
cugccagaggagccaucaccauc

SEQ ID NO: 1907049 - RNA, 15 nt, Shigella flexneri 2a str. 2457T
cugccagcucucaga

SEQ ID NO: 1907050 - RNA, 23 nt, Shigella flexneri 2a str. 2457T
cugccaggucgugccagaaaguc

SEQ ID NO: 1907051 - RNA, 23 nt, Shigella flexneri 2a str. 2457T
cugccauaaacgguuucagcagc

SEQ ID NO: 1907052 - RNA, 15 nt, Shigella flexneri 2a str. 2457T
cugccagugcugcuu

SEQ ID NO: 1907053 - RNA, 18 nt, Shigella flexneri 2a str. 2457T
cugccagucaaucaucca

SEQ ID NO: 1907054 - RNA, 20 nt, Shigella flexneri 2a str. 2457T
cugcauaaacgccgucauca

SEQ ID NO: 1907055 - RNA, 21 nt, Shigella flexneri 2a str. 2457T
cugcauaaacgccgucaucac

SEQ ID NO: 1907056 - RNA, 14 nt, Shigella flexneri 2a str. 2457T
cugccagaaggauu

SEQ ID NO: 1907057 - RNA, 15 nt, Shigella flexneri 2a str. 2457T
cugccacuacccgca

SEQ ID NO: 1907058 - RNA, 19 nt, Shigella flexneri 2a str. 2457T
cugccagaaaucggccuuc

SEQ ID NO: 1907059 - RNA, 15 nt, Shigella flexneri 2a str. 2457T
cugccagaaccgcuu

SEQ ID NO: 1907060 - RNA, 15 nt, Shigella flexneri 2a str. 2457T
cugccguacaggcag

SEQ ID NO: 1907061 - RNA, 18 nt, Shigella flexneri 2a str. 2457T
cugccguugcuugaugca

SEQ ID NO: 1907062 - RNA, 14 nt, Shigella flexneri 2a str. 2457T
cugccuccaugaaa

SEQ ID NO: 1907063 - RNA, 17 nt, Shigella flexneri 2a str. 2457T
cugccguacaggcagcu

SEQ ID NO: 1907064 - RNA, 21 nt, Shigella flexneri 2a str. 2457T
cugccguacaggcagcuuaga

SEQ ID NO: 1907065 - RNA, 14 nt, Shigella flexneri 2a str. 2457T
cugccguuaacccg

SEQ ID NO: 1907066 - RNA, 15 nt, Shigella flexneri 2a str. 2457T
cugccggaacgugca

SEQ ID NO: 1907067 - RNA, 20 nt, Shigella flexneri 2a str. 2457T
cugccggaggaguaucugcu

SEQ ID NO: 1907068 - RNA, 16 nt, Shigella flexneri 2a str. 2457T
cugccgcugcgcguga

SEQ ID NO: 1907069 - RNA, 22 nt, Shigella flexneri 2a str. 2457T
cugccggaucagcgucgccugg

SEQ ID NO: 1907070 - RNA, 22 nt, Shigella flexneri 2a str. 2457T
cugccggaugacagacuccgcu

SEQ ID NO: 1907071 - RNA, 21 nt, Shigella flexneri 2a str. 2457T
cugccggcacaggcaucacuu

SEQ ID NO: 1907072 - RNA, 15 nt, Shigella flexneri 2a str. 2457T
cugccgaccaucugu

SEQ ID NO: 1907073 - RNA, 15 nt, Shigella flexneri 2a str. 2457T
cugccgauggcacaa

SEQ ID NO: 1907074 - RNA, 18 nt, Shigella flexneri 2a str. 2457T
cugccgagcgugcgggca

SEQ ID NO: 1907075 - RNA, 22 nt, Shigella flexneri 2a str. 2457T
cugaugugauccaucaggucau

SEQ ID NO: 1907076 - RNA, 14 nt, Shigella flexneri 2a str. 2457T
cugaucuuucuuca

SEQ ID NO: 1907077 - RNA, 14 nt, Shigella flexneri 2a str. 2457T
cugauuacccuucg

SEQ ID NO: 1907078 - RNA, 15 nt, Shigella flexneri 2a str. 2457T
cugauguucgccaga

SEQ ID NO: 1907079 - RNA, 16 nt, Shigella flexneri 2a str. 2457T
cugauugcggagaagg

SEQ ID NO: 1907080 - RNA, 17 nt, Shigella flexneri 2a str. 2457T
cugauuaccgugaauca

SEQ ID NO: 1907081 - RNA, 20 nt, Shigella flexneri 2a str. 2457T
cugauuaccuuccugccaga

SEQ ID NO: 1907082 - RNA, 14 nt, Shigella flexneri 2a str. 2457T
cugcaaauauuaau

SEQ ID NO: 1907083 - RNA, 14 nt, Shigella flexneri 2a str. 2457T
cugcaaaucaccac

SEQ ID NO: 1907084 - RNA, 14 nt, Shigella flexneri 2a str. 2457T
cugcaacuucucuu

SEQ ID NO: 1907085 - RNA, 18 nt, Shigella flexneri 2a str. 2457T
cugcaaggugaaagcaau

SEQ ID NO: 1907086 - RNA, 14 nt, Shigella flexneri 2a str. 2457T
cugcaaggcucuau

SEQ ID NO: 1907087 - RNA, 21 nt, Shigella flexneri 2a str. 2457T
cugcaaagcauuuuuucacau

SEQ ID NO: 1907088 - RNA, 11 nt, Shigella flexneri 2a str. 2457T
cugcaaaccau

SEQ ID NO: 1907089 - RNA, 19 nt, Shigella flexneri 2a str. 2457T
cugauuuauagauuuacua

SEQ ID NO: 1907090 - RNA, 15 nt, Shigella flexneri 2a str. 2457T
cugauuuauagauuu

SEQ ID NO: 1907091 - RNA, 22 nt, Shigella flexneri 2a str. 2457T
cugauuuaaccaacaauaaaau

SEQ ID NO: 1907092 - RNA, 12 nt, Shigella flexneri 2a str. 2457T
cugcaaugacca

SEQ ID NO: 1907093 - RNA, 20 nt, Shigella flexneri 2a str. 2457T
cugcaauaaaauaucuucca

SEQ ID NO: 1907094 - RNA, 21 nt, Shigella flexneri 2a str. 2457T
cugcacuuaacaggaucuggu

SEQ ID NO: 1907095 - RNA, 24 nt, Shigella flexneri 2a str. 2457T
cugcacggcuucccacgucagacc

SEQ ID NO: 1907096 - RNA, 20 nt, Shigella flexneri 2a str. 2457T
cugcacggucacaucgcuga

SEQ ID NO: 1907097 - RNA, 19 nt, Shigella flexneri 2a str. 2457T
cugcacggugugcggcagg

SEQ ID NO: 1907098 - RNA, 14 nt, Shigella flexneri 2a str. 2457T
cugcagggcuuuca

SEQ ID NO: 1907099 - RNA, 18 nt, Shigella flexneri 2a str. 2457T
cugcagauuaugccugau

SEQ ID NO: 1907100 - RNA, 18 nt, Shigella flexneri 2a str. 2457T
cugcagugaaauuaaacu

SEQ ID NO: 1907101 - RNA, 15 nt, Shigella flexneri 2a str. 2457T
cugcagguauugcuu

SEQ ID NO: 1907102 - RNA, 18 nt, Shigella flexneri 2a str. 2457T
cugaguuuaacggacacu

SEQ ID NO: 1907103 - RNA, 23 nt, Shigella flexneri 2a str. 2457T
cugaguugcagcaacucuuuuuc

SEQ ID NO: 1907104 - RNA, 17 nt, Shigella flexneri 2a str. 2457T
cugaguugccaucauca

SEQ ID NO: 1907105 - RNA, 19 nt, Shigella flexneri 2a str. 2457T
cugaguugccaucaucacc

SEQ ID NO: 1907106 - RNA, 21 nt, Shigella flexneri 2a str. 2457T
cugauaaaaaccauucaggcu

SEQ ID NO: 1907107 - RNA, 23 nt, Shigella flexneri 2a str. 2457T
cugauaaaaaacccgcuuuuuga

SEQ ID NO: 1907108 - RNA, 17 nt, Shigella flexneri 2a str. 2457T
cugaguuuuuuaaguga

SEQ ID NO: 1907109 - RNA, 12 nt, Shigella flexneri 2a str. 2457T
cugauaaaaaac

SEQ ID NO: 1907110 - RNA, 14 nt, Shigella flexneri 2a str. 2457T
cugaguuaagcaaa

SEQ ID NO: 1907111 - RNA, 19 nt, Shigella flexneri 2a str. 2457T
cugagugggcgucagcagu

SEQ ID NO: 1907112 - RNA, 23 nt, Shigella flexneri 2a str. 2457T
cugagugauacguaaaccacuga

SEQ ID NO: 1907113 - RNA, 21 nt, Shigella flexneri 2a str. 2457T
cugaguaauuaauacgccaga

SEQ ID NO: 1907114 - RNA, 14 nt, Shigella flexneri 2a str. 2457T
cugagucagaaacu

SEQ ID NO: 1907115 - RNA, 15 nt, Shigella flexneri 2a str. 2457T
cugaguaauaacuuc

SEQ ID NO: 1907116 - RNA, 13 nt, Shigella flexneri 2a str. 2457T
cugaggcugucau

SEQ ID NO: 1907117 - RNA, 22 nt, Shigella flexneri 2a str. 2457T
cugagcuucuucaaaaaaguca

SEQ ID NO: 1907118 - RNA, 18 nt, Shigella flexneri 2a str. 2457T
cugagcuggcagaccugc

SEQ ID NO: 1907119 - RNA, 18 nt, Shigella flexneri 2a str. 2457T
cugagcuccugcauugac

SEQ ID NO: 1907120 - RNA, 22 nt, Shigella flexneri 2a str. 2457T
cucuaucuguuugccagucugg

SEQ ID NO: 1907121 - RNA, 17 nt, Shigella flexneri 2a str. 2457T
cucuauucuuaaaauag

SEQ ID NO: 1907122 - RNA, 15 nt, Shigella flexneri 2a str. 2457T
cugauaguuaaaauu

SEQ ID NO: 1907123 - RNA, 16 nt, Shigella flexneri 2a str. 2457T
cugauaucucaccaga

SEQ ID NO: 1907124 - RNA, 17 nt, Shigella flexneri 2a str. 2457T
cugauaucucaccagau

SEQ ID NO: 1907125 - RNA, 17 nt, Shigella flexneri 2a str. 2457T
cugaucgccauauuucu

SEQ ID NO: 1907126 - RNA, 12 nt, Shigella flexneri 2a str. 2457T
cugauccugcac

SEQ ID NO: 1907127 - RNA, 13 nt, Shigella flexneri 2a str. 2457T
cugauccgcuucg

SEQ ID NO: 1907128 - RNA, 17 nt, Shigella flexneri 2a str. 2457T
cugauccccgcaagucc

SEQ ID NO: 1907129 - RNA, 15 nt, Shigella flexneri 2a str. 2457T
cugauccagcucuuc

SEQ ID NO: 1907130 - RNA, 19 nt, Shigella flexneri 2a str. 2457T
cugauccagcucuucuuca

SEQ ID NO: 1907131 - RNA, 17 nt, Shigella flexneri 2a str. 2457T
cugauaacgugcagcuu

SEQ ID NO: 1907132 - RNA, 20 nt, Shigella flexneri 2a str. 2457T
cugauaagacgcgccagcgu

SEQ ID NO: 1907133 - RNA, 18 nt, Shigella flexneri 2a str. 2457T
cugauaagacgcgccagc

SEQ ID NO: 1907134 - RNA, 14 nt, Shigella flexneri 2a str. 2457T
cugauaaacaagcg

SEQ ID NO: 1907135 - RNA, 15 nt, Shigella flexneri 2a str. 2457T
cugauaaccuuccag

SEQ ID NO: 1907136 - RNA, 18 nt, Shigella flexneri 2a str. 2457T
cugauacagccaaaucau

SEQ ID NO: 1907137 - RNA, 22 nt, Shigella flexneri 2a str. 2457T
cugauaauaaauaacagugccg

SEQ ID NO: 1907138 - RNA, 20 nt, Shigella flexneri 2a str. 2457T
cugauaaucggggauaagaa

SEQ ID NO: 1907139 - RNA, 21 nt, Shigella flexneri 2a str. 2457T
cugauagcguagcgccucagg

SEQ ID NO: 1907140 - RNA, 14 nt, Shigella flexneri 2a str. 2457T
cugauacugcuccg

SEQ ID NO: 1907141 - RNA, 22 nt, Shigella flexneri 2a str. 2457T
cuaggacgcacaucgcugugcu

SEQ ID NO: 1907142 - RNA, 19 nt, Shigella flexneri 2a str. 2457T
cuaggaagccuuccgcaaa

SEQ ID NO: 1907143 - RNA, 20 nt, Shigella flexneri 2a str. 2457T
cuauaaccggcuguuuauua

SEQ ID NO: 1907144 - RNA, 14 nt, Shigella flexneri 2a str. 2457T
cuauaacaaaacug

SEQ ID NO: 1907145 - RNA, 19 nt, Shigella flexneri 2a str. 2457T
cuauaccagauaaacaucg

SEQ ID NO: 1907146 - RNA, 14 nt, Shigella flexneri 2a str. 2457T
cuauaccccacccc

SEQ ID NO: 1907147 - RNA, 15 nt, Shigella flexneri 2a str. 2457T
cuauaaugagauauu

SEQ ID NO: 1907148 - RNA, 21 nt, Shigella flexneri 2a str. 2457T
cuauaaguguaaaauucuaca

SEQ ID NO: 1907149 - RNA, 14 nt, Shigella flexneri 2a str. 2457T
cuaucuguuugcca

SEQ ID NO: 1907150 - RNA, 15 nt, Shigella flexneri 2a str. 2457T
cuaucuguuugccag

SEQ ID NO: 1907151 - RNA, 18 nt, Shigella flexneri 2a str. 2457T
cuaucuucgauaaacuca

SEQ ID NO: 1907152 - RNA, 11 nt, Shigella flexneri 2a str. 2457T
cuaugagcaga

SEQ ID NO: 1907153 - RNA, 18 nt, Shigella flexneri 2a str. 2457T
cuaugaacacgaucucac

SEQ ID NO: 1907154 - RNA, 11 nt, Shigella flexneri 2a str. 2457T
cuauggggaaa

SEQ ID NO: 1907155 - RNA, 18 nt, Shigella flexneri 2a str. 2457T
cuauggaacgcucaagcc

SEQ ID NO: 1907156 - RNA, 17 nt, Shigella flexneri 2a str. 2457T
cuaugagaaaauuucau

SEQ ID NO: 1907157 - RNA, 20 nt, Shigella flexneri 2a str. 2457T
cuaucgaacaugcgggucuu

SEQ ID NO: 1907158 - RNA, 18 nt, Shigella flexneri 2a str. 2457T
cuauaucgcucuugcucu

SEQ ID NO: 1907159 - RNA, 20 nt, Shigella flexneri 2a str. 2457T
cuauccugguuauuucacuu

SEQ ID NO: 1907160 - RNA, 17 nt, Shigella flexneri 2a str. 2457T
cuagccucccugccucc

SEQ ID NO: 1907161 - RNA, 16 nt, Shigella flexneri 2a str. 2457T
cuagccucccugccuc

SEQ ID NO: 1907162 - RNA, 20 nt, Shigella flexneri 2a str. 2457T
cuacguuucuggugugcagc

SEQ ID NO: 1907163 - RNA, 15 nt, Shigella flexneri 2a str. 2457T
cuacggucacgccac

SEQ ID NO: 1907164 - RNA, 16 nt, Shigella flexneri 2a str. 2457T
cuacgugcgcuaugug

SEQ ID NO: 1907165 - RNA, 19 nt, Shigella flexneri 2a str. 2457T
cuacgugcgcuauguguua

SEQ ID NO: 1907166 - RNA, 20 nt, Shigella flexneri 2a str. 2457T
cuacuauggaacgcucaagc

SEQ ID NO: 1907167 - RNA, 17 nt, Shigella flexneri 2a str. 2457T
cuaccgcgaugacccaa

SEQ ID NO: 1907168 - RNA, 16 nt, Shigella flexneri 2a str. 2457T
cuaccgcgcaggguaa

SEQ ID NO: 1907169 - RNA, 16 nt, Shigella flexneri 2a str. 2457T
cuaccguguucagcgu

SEQ ID NO: 1907170 - RNA, 20 nt, Shigella flexneri 2a str. 2457T
cuaccgugcuguacagcagu

SEQ ID NO: 1907171 - RNA, 19 nt, Shigella flexneri 2a str. 2457T
cuacgcagggauauuucac

SEQ ID NO: 1907172 - RNA, 21 nt, Shigella flexneri 2a str. 2457T
cuacgcucucuucaaacgcuu

SEQ ID NO: 1907173 - RNA, 19 nt, Shigella flexneri 2a str. 2457T
cuacgcuuaucaggccuac

SEQ ID NO: 1907174 - RNA, 15 nt, Shigella flexneri 2a str. 2457T
cuacgucucaauuca

SEQ ID NO: 1907175 - RNA, 19 nt, Shigella flexneri 2a str. 2457T
cuacgucucaauucaucuu

SEQ ID NO: 1907176 - RNA, 13 nt, Shigella flexneri 2a str. 2457T
cucaguacaggcc

SEQ ID NO: 1907177 - RNA, 19 nt, Shigella flexneri 2a str. 2457T
cucaguaaaguuaccuucg

SEQ ID NO: 1907178 - RNA, 9 nt, Shigella flexneri 2a str. 2457T
cucaucaau

SEQ ID NO: 1907179 - RNA, 23 nt, Shigella flexneri 2a str. 2457T
cucaucaauaccugguccuucau

SEQ ID NO: 1907180 - RNA, 15 nt, Shigella flexneri 2a str. 2457T
cucaucaacguuuuu

SEQ ID NO: 1907181 - RNA, 21 nt, Shigella flexneri 2a str. 2457T
cucaucaccacagacaaacag

SEQ ID NO: 1907182 - RNA, 12 nt, Shigella flexneri 2a str. 2457T
cucaucaccauu

SEQ ID NO: 1907183 - RNA, 15 nt, Shigella flexneri 2a str. 2457T
cucaucagcccggca

SEQ ID NO: 1907184 - RNA, 21 nt, Shigella flexneri 2a str. 2457T
cucaucguugcgaucgaccug

SEQ ID NO: 1907185 - RNA, 14 nt, Shigella flexneri 2a str. 2457T
cucaucggcauaca

SEQ ID NO: 1907186 - RNA, 20 nt, Shigella flexneri 2a str. 2457T
cucauguagccgcuuuuucu

SEQ ID NO: 1907187 - RNA, 21 nt, Shigella flexneri 2a str. 2457T
cucauguagccgcuuuuucug

SEQ ID NO: 1907188 - RNA, 20 nt, Shigella flexneri 2a str. 2457T
cucaugggaccgcuaccacg

SEQ ID NO: 1907189 - RNA, 15 nt, Shigella flexneri 2a str. 2457T
cucaucuuccaccac

SEQ ID NO: 1907190 - RNA, 16 nt, Shigella flexneri 2a str. 2457T
cucaccggauaauucc

SEQ ID NO: 1907191 - RNA, 20 nt, Shigella flexneri 2a str. 2457T
cucaccgguaaagucagcgu

SEQ ID NO: 1907192 - RNA, 19 nt, Shigella flexneri 2a str. 2457T
cucaccuauguggaaacag

SEQ ID NO: 1907193 - RNA, 15 nt, Shigella flexneri 2a str. 2457T
cucaccuuccacgcg

SEQ ID NO: 1907194 - RNA, 13 nt, Shigella flexneri 2a str. 2457T
cucacuuccuuuu

SEQ ID NO: 1907195 - RNA, 18 nt, Shigella flexneri 2a str. 2457T
cucacuguucacuuuugc

SEQ ID NO: 1907196 - RNA, 16 nt, Shigella flexneri 2a str. 2457T
cucagaagacgcucca

SEQ ID NO: 1907197 - RNA, 14 nt, Shigella flexneri 2a str. 2457T
cucacuuuucaccg

SEQ ID NO: 1907198 - RNA, 15 nt, Shigella flexneri 2a str. 2457T
cucacuuucuggcag

SEQ ID NO: 1907199 - RNA, 21 nt, Shigella flexneri 2a str. 2457T
cucagcaaauagauaaaauau

SEQ ID NO: 1907200 - RNA, 13 nt, Shigella flexneri 2a str. 2457T
cucagccagcugg

SEQ ID NO: 1907201 - RNA, 15 nt, Shigella flexneri 2a str. 2457T
cucagccagcuggca

SEQ ID NO: 1907202 - RNA, 19 nt, Shigella flexneri 2a str. 2457T
cucagccaaauccagcgca

SEQ ID NO: 1907203 - RNA, 16 nt, Shigella flexneri 2a str. 2457T
cucagcacaccauaaa

SEQ ID NO: 1907204 - RNA, 17 nt, Shigella flexneri 2a str. 2457T
cucagcaagugaauaaa

SEQ ID NO: 1907205 - RNA, 21 nt, Shigella flexneri 2a str. 2457T
cucagccgcacaccugcauuc

SEQ ID NO: 1907206 - RNA, 21 nt, Shigella flexneri 2a str. 2457T
cucaccagauuauaagccagu

SEQ ID NO: 1907207 - RNA, 17 nt, Shigella flexneri 2a str. 2457T
cucaccagccgcgacau

SEQ ID NO: 1907208 - RNA, 20 nt, Shigella flexneri 2a str. 2457T
cucaccacgcuccaucaugu

SEQ ID NO: 1907209 - RNA, 13 nt, Shigella flexneri 2a str. 2457T
cucaccgccgccu

SEQ ID NO: 1907210 - RNA, 15 nt, Shigella flexneri 2a str. 2457T
cucaauggauuuacc

SEQ ID NO: 1907211 - RNA, 14 nt, Shigella flexneri 2a str. 2457T
cucaaugccugaug

SEQ ID NO: 1907212 - RNA, 21 nt, Shigella flexneri 2a str. 2457T
cucaaugagcaccuuuuuucu

SEQ ID NO: 1907213 - RNA, 14 nt, Shigella flexneri 2a str. 2457T
cucaaugucuguca

SEQ ID NO: 1907214 - RNA, 18 nt, Shigella flexneri 2a str. 2457T
cucaaugguguuuuccac

SEQ ID NO: 1907215 - RNA, 19 nt, Shigella flexneri 2a str. 2457T
cucaaugucugucauauua

SEQ ID NO: 1907216 - RNA, 11 nt, Shigella flexneri 2a str. 2457T
cucaauuacca

SEQ ID NO: 1907217 - RNA, 20 nt, Shigella flexneri 2a str. 2457T
cucaaugguguuuuccaccg

SEQ ID NO: 1907218 - RNA, 17 nt, Shigella flexneri 2a str. 2457T
cucaaucucuuuuucca

SEQ ID NO: 1907219 - RNA, 13 nt, Shigella flexneri 2a str. 2457T
cucaaucuucacg

SEQ ID NO: 1907220 - RNA, 22 nt, Shigella flexneri 2a str. 2457T
cucaaucucuuuuuccaccgca

SEQ ID NO: 1907221 - RNA, 22 nt, Shigella flexneri 2a str. 2457T
cucaaucgagauacgacugaua

SEQ ID NO: 1907222 - RNA, 20 nt, Shigella flexneri 2a str. 2457T
cucaaucugauagugaucca

SEQ ID NO: 1907223 - RNA, 19 nt, Shigella flexneri 2a str. 2457T
cucaaucccuuucucuuca

SEQ ID NO: 1907224 - RNA, 22 nt, Shigella flexneri 2a str. 2457T
cucaauccgggcgauccggcaa

SEQ ID NO: 1907225 - RNA, 19 nt, Shigella flexneri 2a str. 2457T
cucaacccuuuuuuaaaca

SEQ ID NO: 1907226 - RNA, 13 nt, Shigella flexneri 2a str. 2457T
cucaaccgcuucu

SEQ ID NO: 1907227 - RNA, 18 nt, Shigella flexneri 2a str. 2457T
cucaaccgcuucuuucuc

SEQ ID NO: 1907228 - RNA, 17 nt, Shigella flexneri 2a str. 2457T
cucaaccgcuucuuucu

SEQ ID NO: 1907229 - RNA, 14 nt, Shigella flexneri 2a str. 2457T
cucaaccuucagga

SEQ ID NO: 1907230 - RNA, 14 nt, Shigella flexneri 2a str. 2457T
cuauuugcgccugg

SEQ ID NO: 1907231 - RNA, 22 nt, Shigella flexneri 2a str. 2457T
cuauuuccccggaaccugaacu

SEQ ID NO: 1907232 - RNA, 19 nt, Shigella flexneri 2a str. 2457T
cuauuuccaccucccccuu

SEQ ID NO: 1907233 - RNA, 17 nt, Shigella flexneri 2a str. 2457T
cuauuucaauaugauaa

SEQ ID NO: 1907234 - RNA, 19 nt, Shigella flexneri 2a str. 2457T
cucaaaccauuucugcgag

SEQ ID NO: 1907235 - RNA, 22 nt, Shigella flexneri 2a str. 2457T
cucaaagucgagaugaaacucg

SEQ ID NO: 1907236 - RNA, 23 nt, Shigella flexneri 2a str. 2457T
cucaaagccgucgagggccugaa

SEQ ID NO: 1907237 - RNA, 18 nt, Shigella flexneri 2a str. 2457T
cucaaacuucgucacagc

SEQ ID NO: 1907238 - RNA, 20 nt, Shigella flexneri 2a str. 2457T
cuauuuuuggaggugaaggu

SEQ ID NO: 1907239 - RNA, 15 nt, Shigella flexneri 2a str. 2457T
cuauuuuagaaaaac

SEQ ID NO: 1907240 - RNA, 15 nt, Shigella flexneri 2a str. 2457T
cucgcgcucuucuuc

SEQ ID NO: 1907241 - RNA, 18 nt, Shigella flexneri 2a str. 2457T
cucgcgcuugcggaagca

SEQ ID NO: 1907242 - RNA, 17 nt, Shigella flexneri 2a str. 2457T
cucgcccagaucaccaa

SEQ ID NO: 1907243 - RNA, 19 nt, Shigella flexneri 2a str. 2457T
cucgccggaugaaaaguca

SEQ ID NO: 1907244 - RNA, 15 nt, Shigella flexneri 2a str. 2457T
cucgcggacugccug

SEQ ID NO: 1907245 - RNA, 17 nt, Shigella flexneri 2a str. 2457T
cucgcggacugccuggc

SEQ ID NO: 1907246 - RNA, 11 nt, Shigella flexneri 2a str. 2457T
cucgcggcgga

SEQ ID NO: 1907247 - RNA, 16 nt, Shigella flexneri 2a str. 2457T
cucgcucgagagagaa

SEQ ID NO: 1907248 - RNA, 13 nt, Shigella flexneri 2a str. 2457T
cucgauaaaaccu

SEQ ID NO: 1907249 - RNA, 17 nt, Shigella flexneri 2a str. 2457T
cucgauaaaaccuuccu

SEQ ID NO: 1907250 - RNA, 18 nt, Shigella flexneri 2a str. 2457T
cucgaguccuuccagguc

SEQ ID NO: 1907251 - RNA, 21 nt, Shigella flexneri 2a str. 2457T
cucgauguuguacaugcugcu

SEQ ID NO: 1907252 - RNA, 14 nt, Shigella flexneri 2a str. 2457T
cucgccaacaagcc

SEQ ID NO: 1907253 - RNA, 18 nt, Shigella flexneri 2a str. 2457T
cucgccacgucacucuuu

SEQ ID NO: 1907254 - RNA, 15 nt, Shigella flexneri 2a str. 2457T
cucgacuggagccgc

SEQ ID NO: 1907255 - RNA, 23 nt, Shigella flexneri 2a str. 2457T
cucgacuguggcgcgaccaaugu

SEQ ID NO: 1907256 - RNA, 23 nt, Shigella flexneri 2a str. 2457T
cucgacuuuagucgcuugcagga

SEQ ID NO: 1907257 - RNA, 17 nt, Shigella flexneri 2a str. 2457T
cucgagagagaaaauaa

SEQ ID NO: 1907258 - RNA, 20 nt, Shigella flexneri 2a str. 2457T
cuccugccaauacaaaauuu

SEQ ID NO: 1907259 - RNA, 15 nt, Shigella flexneri 2a str. 2457T
cucgacaccaaacag

SEQ ID NO: 1907260 - RNA, 17 nt, Shigella flexneri 2a str. 2457T
cucgacaccaaacagac

SEQ ID NO: 1907261 - RNA, 13 nt, Shigella flexneri 2a str. 2457T
cucuaaaaucauc

SEQ ID NO: 1907262 - RNA, 14 nt, Shigella flexneri 2a str. 2457T
cucguuuauuaugc

SEQ ID NO: 1907263 - RNA, 14 nt, Shigella flexneri 2a str. 2457T
cucgugccaccagu

SEQ ID NO: 1907264 - RNA, 21 nt, Shigella flexneri 2a str. 2457T
cucuacaauauccucaagcgu

SEQ ID NO: 1907265 - RNA, 14 nt, Shigella flexneri 2a str. 2457T
cucuacaggaaugg

SEQ ID NO: 1907266 - RNA, 17 nt, Shigella flexneri 2a str. 2457T
cucgugauaguccagcc

SEQ ID NO: 1907267 - RNA, 17 nt, Shigella flexneri 2a str. 2457T
cucguaaugcuccggcu

SEQ ID NO: 1907268 - RNA, 22 nt, Shigella flexneri 2a str. 2457T
cucgguuuugcgguauuuguau

SEQ ID NO: 1907269 - RNA, 17 nt, Shigella flexneri 2a str. 2457T
cucgcuguggcagcguu

SEQ ID NO: 1907270 - RNA, 17 nt, Shigella flexneri 2a str. 2457T
cucgcuggcgcucaagu

SEQ ID NO: 1907271 - RNA, 13 nt, Shigella flexneri 2a str. 2457T
cucggcaaauuca

SEQ ID NO: 1907272 - RNA, 21 nt, Shigella flexneri 2a str. 2457T
cucgggaaggcccuuccccuu

SEQ ID NO: 1907273 - RNA, 14 nt, Shigella flexneri 2a str. 2457T
cucggcuauuuccg

SEQ ID NO: 1907274 - RNA, 21 nt, Shigella flexneri 2a str. 2457T
cucggcgcuaaucaugucugg

SEQ ID NO: 1907275 - RNA, 22 nt, Shigella flexneri 2a str. 2457T
cucccgcauacauugcguaacc

SEQ ID NO: 1907276 - RNA, 16 nt, Shigella flexneri 2a str. 2457T
cucccgcagccacucc

SEQ ID NO: 1907277 - RNA, 18 nt, Shigella flexneri 2a str. 2457T
cuccccagaauccaggaa

SEQ ID NO: 1907278 - RNA, 12 nt, Shigella flexneri 2a str. 2457T
cucccccagcau

SEQ ID NO: 1907279 - RNA, 16 nt, Shigella flexneri 2a str. 2457T
cucccuguaucccagu

SEQ ID NO: 1907280 - RNA, 12 nt, Shigella flexneri 2a str. 2457T
cucccuucgcug

SEQ ID NO: 1907281 - RNA, 19 nt, Shigella flexneri 2a str. 2457T
cuccauugcccgcccgaca

SEQ ID NO: 1907282 - RNA, 22 nt, Shigella flexneri 2a str. 2457T
cucccaguugugggugcccaca

SEQ ID NO: 1907283 - RNA, 22 nt, Shigella flexneri 2a str. 2457T
cuccccaaaauccccuggccug

SEQ ID NO: 1907284 - RNA, 15 nt, Shigella flexneri 2a str. 2457T
cucccagccucccau

SEQ ID NO: 1907285 - RNA, 19 nt, Shigella flexneri 2a str. 2457T
cucccacggaauagaaccu

SEQ ID NO: 1907286 - RNA, 20 nt, Shigella flexneri 2a str. 2457T
cuccgccggaaucaacggca

SEQ ID NO: 1907287 - RNA, 15 nt, Shigella flexneri 2a str. 2457T
cuccggcagcugcuc

SEQ ID NO: 1907288 - RNA, 13 nt, Shigella flexneri 2a str. 2457T
cuccggccagagc

SEQ ID NO: 1907289 - RNA, 16 nt, Shigella flexneri 2a str. 2457T
cuccgggcgcaccagu

SEQ ID NO: 1907290 - RNA, 21 nt, Shigella flexneri 2a str. 2457T
cuccgggaaaacgcuggcagc

SEQ ID NO: 1907291 - RNA, 22 nt, Shigella flexneri 2a str. 2457T
cuccgggaaaacgcuggcagca

SEQ ID NO: 1907292 - RNA, 14 nt, Shigella flexneri 2a str. 2457T
cuccggcugggcgu

SEQ ID NO: 1907293 - RNA, 23 nt, Shigella flexneri 2a str. 2457T
cuccggccuuuuuuaucucuuac

SEQ ID NO: 1907294 - RNA, 17 nt, Shigella flexneri 2a str. 2457T
cuccggccugcacugca

SEQ ID NO: 1907295 - RNA, 24 nt, Shigella flexneri 2a str. 2457T
cuccggcgcguugaugccgugcag

SEQ ID NO: 1907296 - RNA, 24 nt, Shigella flexneri 2a str. 2457T
cuccugagaauuccgacagagaaa

SEQ ID NO: 1907297 - RNA, 22 nt, Shigella flexneri 2a str. 2457T
cuccugacgaucauauuguucc

SEQ ID NO: 1907298 - RNA, 17 nt, Shigella flexneri 2a str. 2457T
cuccucgaguccuucca

SEQ ID NO: 1907299 - RNA, 18 nt, Shigella flexneri 2a str. 2457T
cuccucgaguccuuccag

SEQ ID NO: 1907300 - RNA, 20 nt, Shigella flexneri 2a str. 2457T
cuccucgaguccuuccaggu

SEQ ID NO: 1907301 - RNA, 20 nt, Shigella flexneri 2a str. 2457T
cuccuauuguugauaaggaa

SEQ ID NO: 1907302 - RNA, 12 nt, Shigella flexneri 2a str. 2457T
cuccagcaaugu

SEQ ID NO: 1907303 - RNA, 23 nt, Shigella flexneri 2a str. 2457T
cuccagauuaccagcgacaucac

SEQ ID NO: 1907304 - RNA, 14 nt, Shigella flexneri 2a str. 2457T
cuccagcagugccg

SEQ ID NO: 1907305 - RNA, 13 nt, Shigella flexneri 2a str. 2457T
cuccagcagacca

SEQ ID NO: 1907306 - RNA, 14 nt, Shigella flexneri 2a str. 2457T
cuccagcagaccag

SEQ ID NO: 1907307 - RNA, 19 nt, Shigella flexneri 2a str. 2457T
cuccacgauguucugagcg

SEQ ID NO: 1907308 - RNA, 16 nt, Shigella flexneri 2a str. 2457T
cuccacgauguucuga

SEQ ID NO: 1907309 - RNA, 20 nt, Shigella flexneri 2a str. 2457T
cuccacgcugcaucgccaau

SEQ ID NO: 1907310 - RNA, 12 nt, Shigella flexneri 2a str. 2457T
cuccacgcugca

SEQ ID NO: 1907311 - RNA, 17 nt, Shigella flexneri 2a str. 2457T
cuccacuucaccgcgaa

SEQ ID NO: 1907312 - RNA, 11 nt, Shigella flexneri 2a str. 2457T
cuccacuuccu

SEQ ID NO: 1907313 - RNA, 22 nt, Shigella flexneri 2a str. 2457T
cuccacuuuuacaugcgcgaca

SEQ ID NO: 1907314 - RNA, 13 nt, Shigella flexneri 2a str. 2457T
cuccacuuccugc

SEQ ID NO: 1907315 - RNA, 14 nt, Shigella flexneri 2a str. 2457T
cuccacuuccugcc

SEQ ID NO: 1907316 - RNA, 14 nt, Shigella flexneri 2a str. 2457T
cucauuugcagaaa

SEQ ID NO: 1907317 - RNA, 20 nt, Shigella flexneri 2a str. 2457T
cuccaccucauuaagaugca

SEQ ID NO: 1907318 - RNA, 17 nt, Shigella flexneri 2a str. 2457T
cuccaggagcguauuca

SEQ ID NO: 1907319 - RNA, 18 nt, Shigella flexneri 2a str. 2457T
cuccaggagcguauucag

SEQ ID NO: 1907320 - RNA, 22 nt, Shigella flexneri 2a str. 2457T
cuccaggagcguauucagcaau

SEQ ID NO: 1907321 - RNA, 23 nt, Shigella flexneri 2a str. 2457T
cuccaggaguuccgggucaucca

SEQ ID NO: 1907322 - RNA, 23 nt, Shigella flexneri 2a str. 2457T
cuccaggcguuuugcagauucag

SEQ ID NO: 1907323 - RNA, 20 nt, Shigella flexneri 2a str. 2457T
cuccagcgccgccagaauca

SEQ ID NO: 1907324 - RNA, 13 nt, Shigella flexneri 2a str. 2457T
cuccagcgccgcc

SEQ ID NO: 1907325 - RNA, 23 nt, Shigella flexneri 2a str. 2457T
cuccagcgggcgaaucaacucca

SEQ ID NO: 1907326 - RNA, 22 nt, Shigella flexneri 2a str. 2457T
cuccagcgcgucugcgcccagc

SEQ ID NO: 1907327 - RNA, 19 nt, Shigella flexneri 2a str. 2457T
cuccagcgggcgaaucaac

SEQ ID NO: 1907328 - RNA, 11 nt, Shigella flexneri 2a str. 2457T
cuccagcgcca

SEQ ID NO: 1907329 - RNA, 15 nt, Shigella flexneri 2a str. 2457T
cuccagugcauccag

SEQ ID NO: 1907330 - RNA, 22 nt, Shigella flexneri 2a str. 2457T
cuccagguccuccuguaccuuc

SEQ ID NO: 1907331 - RNA, 13 nt, Shigella flexneri 2a str. 2457T
cuccagguccucc

SEQ ID NO: 1907332 - RNA, 18 nt, Shigella flexneri 2a str. 2457T
cuccauccagcaacaaca

SEQ ID NO: 1907333 - RNA, 22 nt, Shigella flexneri 2a str. 2457T
cuccaugagaagcugaaaucau

SEQ ID NO: 1907334 - RNA, 18 nt, Shigella flexneri 2a str. 2457T
cuccaucucgccauccuu

SEQ ID NO: 1907335 - RNA, 20 nt, Shigella flexneri 2a str. 2457T
cguggcccuaggcauagaaa

SEQ ID NO: 1907336 - RNA, 23 nt, Shigella flexneri 2a str. 2457T
cguggccaugagccaguucuucu

SEQ ID NO: 1907337 - RNA, 17 nt, Shigella flexneri 2a str. 2457T
cguggcgcagccgucau

SEQ ID NO: 1907338 - RNA, 22 nt, Shigella flexneri 2a str. 2457T
cguggcggaaaucuuucauuuc

SEQ ID NO: 1907339 - RNA, 16 nt, Shigella flexneri 2a str. 2457T
cguggggucucugcaa

SEQ ID NO: 1907340 - RNA, 19 nt, Shigella flexneri 2a str. 2457T
cgugggauugccgcuucau

SEQ ID NO: 1907341 - RNA, 14 nt, Shigella flexneri 2a str. 2457T
cgugggcaggaaaa

SEQ ID NO: 1907342 - RNA, 17 nt, Shigella flexneri 2a str. 2457T
cgugggcaucgcgacag

SEQ ID NO: 1907343 - RNA, 14 nt, Shigella flexneri 2a str. 2457T
cguggucauggcau

SEQ ID NO: 1907344 - RNA, 19 nt, Shigella flexneri 2a str. 2457T
cguggaauuuguccaccaa

SEQ ID NO: 1907345 - RNA, 15 nt, Shigella flexneri 2a str. 2457T
cgugcuguacagcag

SEQ ID NO: 1907346 - RNA, 18 nt, Shigella flexneri 2a str. 2457T
cguggauuuaaugccaau

SEQ ID NO: 1907347 - RNA, 17 nt, Shigella flexneri 2a str. 2457T
cguggagcaacugcgcu

SEQ ID NO: 1907348 - RNA, 20 nt, Shigella flexneri 2a str. 2457T
cguggacggucaacugaugg

SEQ ID NO: 1907349 - RNA, 20 nt, Shigella flexneri 2a str. 2457T
cguggaucaagccccagcag

SEQ ID NO: 1907350 - RNA, 13 nt, Shigella flexneri 2a str. 2457T
cguggaugggacu

SEQ ID NO: 1907351 - RNA, 18 nt, Shigella flexneri 2a str. 2457T
cguggaugcgauguuccc

SEQ ID NO: 1907352 - RNA, 14 nt, Shigella flexneri 2a str. 2457T
cgugcgcuuuuuag

SEQ ID NO: 1907353 - RNA, 22 nt, Shigella flexneri 2a str. 2457T
cgugcgaggugauguuccgcuu

SEQ ID NO: 1907354 - RNA, 16 nt, Shigella flexneri 2a str. 2457T
cgugcgggcacaggcg

SEQ ID NO: 1907355 - RNA, 14 nt, Shigella flexneri 2a str. 2457T
cgugcggcugugcg

SEQ ID NO: 1907356 - RNA, 16 nt, Shigella flexneri 2a str. 2457T
cgugcucgaacauccc

SEQ ID NO: 1907357 - RNA, 18 nt, Shigella flexneri 2a str. 2457T
cgugcgguuucagcucac

SEQ ID NO: 1907358 - RNA, 13 nt, Shigella flexneri 2a str. 2457T
cgugcguuuuuug

SEQ ID NO: 1907359 - RNA, 15 nt, Shigella flexneri 2a str. 2457T
cgugguuuaugcaau

SEQ ID NO: 1907360 - RNA, 21 nt, Shigella flexneri 2a str. 2457T
cgugguuuucgccggaaccug

SEQ ID NO: 1907361 - RNA, 18 nt, Shigella flexneri 2a str. 2457T
cgugucuuaucaggccua

SEQ ID NO: 1907362 - RNA, 15 nt, Shigella flexneri 2a str. 2457T
cgugucuuuuacuga

SEQ ID NO: 1907363 - RNA, 20 nt, Shigella flexneri 2a str. 2457T
cguguggcgaugggacgcgc

SEQ ID NO: 1907364 - RNA, 15 nt, Shigella flexneri 2a str. 2457T
cguuaaccacuucag

SEQ ID NO: 1907365 - RNA, 18 nt, Shigella flexneri 2a str. 2457T
cguuaagcuggaaaucaa

SEQ ID NO: 1907366 - RNA, 12 nt, Shigella flexneri 2a str. 2457T
cguuaaauaacu

SEQ ID NO: 1907367 - RNA, 17 nt, Shigella flexneri 2a str. 2457T
cguuaaauccagauccu

SEQ ID NO: 1907368 - RNA, 22 nt, Shigella flexneri 2a str. 2457T
cguguuuaugaaaguuuaacua

SEQ ID NO: 1907369 - RNA, 21 nt, Shigella flexneri 2a str. 2457T
cguguugucagcucauccagc

SEQ ID NO: 1907370 - RNA, 16 nt, Shigella flexneri 2a str. 2457T
cguguucucaucgcca

SEQ ID NO: 1907371 - RNA, 15 nt, Shigella flexneri 2a str. 2457T
cguguuaauuaccua

SEQ ID NO: 1907372 - RNA, 22 nt, Shigella flexneri 2a str. 2457T
cguuccccuguugugccagacc

SEQ ID NO: 1907373 - RNA, 15 nt, Shigella flexneri 2a str. 2457T
cguuccauggcagga

SEQ ID NO: 1907374 - RNA, 21 nt, Shigella flexneri 2a str. 2457T
cguuccccgaagacgugcgcc

SEQ ID NO: 1907375 - RNA, 15 nt, Shigella flexneri 2a str. 2457T
cguucgcccauucca

SEQ ID NO: 1907376 - RNA, 20 nt, Shigella flexneri 2a str. 2457T
cguuccacggggacuccaca

SEQ ID NO: 1907377 - RNA, 14 nt, Shigella flexneri 2a str. 2457T
cguuccagcaacuc

SEQ ID NO: 1907378 - RNA, 13 nt, Shigella flexneri 2a str. 2457T
cguucacugccac

SEQ ID NO: 1907379 - RNA, 20 nt, Shigella flexneri 2a str. 2457T
cguucaccccuuucucgccc

SEQ ID NO: 1907380 - RNA, 20 nt, Shigella flexneri 2a str. 2457T
cguuagugucuuaucuggca

SEQ ID NO: 1907381 - RNA, 20 nt, Shigella flexneri 2a str. 2457T
cguucaagugcguucacccc

SEQ ID NO: 1907382 - RNA, 18 nt, Shigella flexneri 2a str. 2457T
cguuagccagcgcaccag

SEQ ID NO: 1907383 - RNA, 20 nt, Shigella flexneri 2a str. 2457T
cguuagccagcgcaccagcg

SEQ ID NO: 1907384 - RNA, 18 nt, Shigella flexneri 2a str. 2457T
cguuacgccccaacacaa

SEQ ID NO: 1907385 - RNA, 16 nt, Shigella flexneri 2a str. 2457T
cguuacucuccggacu

SEQ ID NO: 1907386 - RNA, 16 nt, Shigella flexneri 2a str. 2457T
cguuacugucgcgcag

SEQ ID NO: 1907387 - RNA, 12 nt, Shigella flexneri 2a str. 2457T
cguuacguacuu

SEQ ID NO: 1907388 - RNA, 19 nt, Shigella flexneri 2a str. 2457T
cguuacguaccacgcacag

SEQ ID NO: 1907389 - RNA, 17 nt, Shigella flexneri 2a str. 2457T
cguuacguacuuccuua

SEQ ID NO: 1907390 - RNA, 17 nt, Shigella flexneri 2a str. 2457T
cguuacguucuccugaa

SEQ ID NO: 1907391 - RNA, 13 nt, Shigella flexneri 2a str. 2457T
cguuacgcagcau

SEQ ID NO: 1907392 - RNA, 16 nt, Shigella flexneri 2a str. 2457T
cguuacgccccaacac

SEQ ID NO: 1907393 - RNA, 19 nt, Shigella flexneri 2a str. 2457T
cguugggugcuugaggcug

SEQ ID NO: 1907394 - RNA, 14 nt, Shigella flexneri 2a str. 2457T
cguuucauucaggc

SEQ ID NO: 1907395 - RNA, 11 nt, Shigella flexneri 2a str. 2457T
cguuucccugu

SEQ ID NO: 1907396 - RNA, 17 nt, Shigella flexneri 2a str. 2457T
cguuuccauucgcugcu

SEQ ID NO: 1907397 - RNA, 19 nt, Shigella flexneri 2a str. 2457T
cguuuccagcaccaguuca

SEQ ID NO: 1907398 - RNA, 14 nt, Shigella flexneri 2a str. 2457T
cguucggcgagcag

SEQ ID NO: 1907399 - RNA, 18 nt, Shigella flexneri 2a str. 2457T
cguucuggguggugauuu

SEQ ID NO: 1907400 - RNA, 15 nt, Shigella flexneri 2a str. 2457T
cguugaaaaaucaaa

SEQ ID NO: 1907401 - RNA, 21 nt, Shigella flexneri 2a str. 2457T
cguugcuuuuugcgcauccag

SEQ ID NO: 1907402 - RNA, 22 nt, Shigella flexneri 2a str. 2457T
cguugcuugaugcacugggaga

SEQ ID NO: 1907403 - RNA, 19 nt, Shigella flexneri 2a str. 2457T
cguuuuacgcgucacgccu

SEQ ID NO: 1907404 - RNA, 15 nt, Shigella flexneri 2a str. 2457T
cguuuuaguaacaac

SEQ ID NO: 1907405 - RNA, 15 nt, Shigella flexneri 2a str. 2457T
cguuuuuuguacucu

SEQ ID NO: 1907406 - RNA, 13 nt, Shigella flexneri 2a str. 2457T
cguuuuuuuucug

SEQ ID NO: 1907407 - RNA, 19 nt, Shigella flexneri 2a str. 2457T
cguuuguaacccaccaugc

SEQ ID NO: 1907408 - RNA, 20 nt, Shigella flexneri 2a str. 2457T
cguuucgaauuacacagcca

SEQ ID NO: 1907409 - RNA, 23 nt, Shigella flexneri 2a str. 2457T
cuaaaccagguauccaguuucug

SEQ ID NO: 1907410 - RNA, 16 nt, Shigella flexneri 2a str. 2457T
cuaaaagcacgccaga

SEQ ID NO: 1907411 - RNA, 12 nt, Shigella flexneri 2a str. 2457T
cuaaaaaauccc

SEQ ID NO: 1907412 - RNA, 13 nt, Shigella flexneri 2a str. 2457T
cuaaaaaaugacg

SEQ ID NO: 1907413 - RNA, 19 nt, Shigella flexneri 2a str. 2457T
cuaacacaugcaagucgaa

SEQ ID NO: 1907414 - RNA, 12 nt, Shigella flexneri 2a str. 2457T
cuaacagcagca

SEQ ID NO: 1907415 - RNA, 14 nt, Shigella flexneri 2a str. 2457T
cuaacagaucaucc

SEQ ID NO: 1907416 - RNA, 12 nt, Shigella flexneri 2a str. 2457T
cuaacaucaucc

SEQ ID NO: 1907417 - RNA, 17 nt, Shigella flexneri 2a str. 2457T
cuaaauguucaauaagc

SEQ ID NO: 1907418 - RNA, 15 nt, Shigella flexneri 2a str. 2457T
cuaaaugcugcagcc

SEQ ID NO: 1907419 - RNA, 22 nt, Shigella flexneri 2a str. 2457T
cuaaaucuggugcuuuuucaac

SEQ ID NO: 1907420 - RNA, 17 nt, Shigella flexneri 2a str. 2457T
cuaaaucuuccgccggg

SEQ ID NO: 1907421 - RNA, 15 nt, Shigella flexneri 2a str. 2457T
cuaaagcaacuccau

SEQ ID NO: 1907422 - RNA, 15 nt, Shigella flexneri 2a str. 2457T
cuaagccauuuaacu

SEQ ID NO: 1907423 - RNA, 20 nt, Shigella flexneri 2a str. 2457T
cuaagccauuuaacucaccg

SEQ ID NO: 1907424 - RNA, 19 nt, Shigella flexneri 2a str. 2457T
cuaagcgccaccgucagug

SEQ ID NO: 1907425 - RNA, 19 nt, Shigella flexneri 2a str. 2457T
cuaagaagccuuuaucugg

SEQ ID NO: 1907426 - RNA, 15 nt, Shigella flexneri 2a str. 2457T
cuaagaagucauugg

SEQ ID NO: 1907427 - RNA, 16 nt, Shigella flexneri 2a str. 2457T
cuaacgcgucuuaucu

SEQ ID NO: 1907428 - RNA, 20 nt, Shigella flexneri 2a str. 2457T
cuaacgcgucuuaucuggcc

SEQ ID NO: 1907429 - RNA, 18 nt, Shigella flexneri 2a str. 2457T
cuaacgcgucuuaucugg

SEQ ID NO: 1907430 - RNA, 17 nt, Shigella flexneri 2a str. 2457T
cuaacgaugccagcacc

SEQ ID NO: 1907431 - RNA, 14 nt, Shigella flexneri 2a str. 2457T
cuaacggaauugcc

SEQ ID NO: 1907432 - RNA, 19 nt, Shigella flexneri 2a str. 2457T
cuaacggugcacgcuuuau

SEQ ID NO: 1907433 - RNA, 15 nt, Shigella flexneri 2a str. 2457T
cuaaccgaauucaaa

SEQ ID NO: 1907434 - RNA, 15 nt, Shigella flexneri 2a str. 2457T
cuaacccucucccca

SEQ ID NO: 1907435 - RNA, 19 nt, Shigella flexneri 2a str. 2457T
cuaacccucuccccaaggg

SEQ ID NO: 1907436 - RNA, 15 nt, Shigella flexneri 2a str. 2457T
cuaaccgcuuuucca

SEQ ID NO: 1907437 - RNA, 17 nt, Shigella flexneri 2a str. 2457T
cuaaccgcuuuuccagc

SEQ ID NO: 1907438 - RNA, 18 nt, Shigella flexneri 2a str. 2457T
cuaaccgcuuuuccagca

SEQ ID NO: 1907439 - RNA, 15 nt, Shigella flexneri 2a str. 2457T
cgucugauguaauca

SEQ ID NO: 1907440 - RNA, 23 nt, Shigella flexneri 2a str. 2457T
cgucugguaucgcgccagccagu

SEQ ID NO: 1907441 - RNA, 18 nt, Shigella flexneri 2a str. 2457T
cgucuucugguugcgaaa

SEQ ID NO: 1907442 - RNA, 16 nt, Shigella flexneri 2a str. 2457T
cgucuucugcagucac

SEQ ID NO: 1907443 - RNA, 17 nt, Shigella flexneri 2a str. 2457T
cgucuuccgugccugac

SEQ ID NO: 1907444 - RNA, 12 nt, Shigella flexneri 2a str. 2457T
cgucuuaucugg

SEQ ID NO: 1907445 - RNA, 14 nt, Shigella flexneri 2a str. 2457T
cgugaaacucagcc

SEQ ID NO: 1907446 - RNA, 14 nt, Shigella flexneri 2a str. 2457T
cgucuuuuacagcg

SEQ ID NO: 1907447 - RNA, 19 nt, Shigella flexneri 2a str. 2457T
cgucuuugcguuccaucag

SEQ ID NO: 1907448 - RNA, 23 nt, Shigella flexneri 2a str. 2457T
cgucgguucagggcaucaucauu

SEQ ID NO: 1907449 - RNA, 19 nt, Shigella flexneri 2a str. 2457T
cgucgggaucaucgcccag

SEQ ID NO: 1907450 - RNA, 13 nt, Shigella flexneri 2a str. 2457T
cgucgggaagacc

SEQ ID NO: 1907451 - RNA, 19 nt, Shigella flexneri 2a str. 2457T
cgucguggcaaaaugcauc

SEQ ID NO: 1907452 - RNA, 17 nt, Shigella flexneri 2a str. 2457T
cgucuacaggcgcgacc

SEQ ID NO: 1907453 - RNA, 23 nt, Shigella flexneri 2a str. 2457T
cgucucagcgccgcuuuccaggc

SEQ ID NO: 1907454 - RNA, 12 nt, Shigella flexneri 2a str. 2457T
cgucuccaucaa

SEQ ID NO: 1907455 - RNA, 20 nt, Shigella flexneri 2a str. 2457T
cgucucccgaugccagcaca

SEQ ID NO: 1907456 - RNA, 15 nt, Shigella flexneri 2a str. 2457T
cgucuccaucaauac

SEQ ID NO: 1907457 - RNA, 16 nt, Shigella flexneri 2a str. 2457T
cgucuccugccgagcg

SEQ ID NO: 1907458 - RNA, 19 nt, Shigella flexneri 2a str. 2457T
cgugauucacguucgugaa

SEQ ID NO: 1907459 - RNA, 20 nt, Shigella flexneri 2a str. 2457T
cgugaucgaacaucugcgug

SEQ ID NO: 1907460 - RNA, 23 nt, Shigella flexneri 2a str. 2457T
cgugaucgucuucaaccgcagug

SEQ ID NO: 1907461 - RNA, 14 nt, Shigella flexneri 2a str. 2457T
cgugagguaacaau

SEQ ID NO: 1907462 - RNA, 21 nt, Shigella flexneri 2a str. 2457T
cgugagcguauuggugaauug

SEQ ID NO: 1907463 - RNA, 20 nt, Shigella flexneri 2a str. 2457T
cgugagggaaacaacaccgu

SEQ ID NO: 1907464 - RNA, 19 nt, Shigella flexneri 2a str. 2457T
cgugagcguauuggugaau

SEQ ID NO: 1907465 - RNA, 21 nt, Shigella flexneri 2a str. 2457T
cgugaaugccguaggcccagc

SEQ ID NO: 1907466 - RNA, 20 nt, Shigella flexneri 2a str. 2457T
cgugaaugccuuauccggca

SEQ ID NO: 1907467 - RNA, 20 nt, Shigella flexneri 2a str. 2457T
cgugaauuuuaggaugcugc

SEQ ID NO: 1907468 - RNA, 18 nt, Shigella flexneri 2a str. 2457T
cgugaagcuggcagaagu

SEQ ID NO: 1907469 - RNA, 17 nt, Shigella flexneri 2a str. 2457T
cgugaauauggaacgga

SEQ ID NO: 1907470 - RNA, 21 nt, Shigella flexneri 2a str. 2457T
cgugaacugggccugcauauc

SEQ ID NO: 1907471 - RNA, 22 nt, Shigella flexneri 2a str. 2457T
cgugaacuucgccauuuucugc

SEQ ID NO: 1907472 - RNA, 16 nt, Shigella flexneri 2a str. 2457T
cgugaacgugcaaaau

SEQ ID NO: 1907473 - RNA, 19 nt, Shigella flexneri 2a str. 2457T
cgugaccugugccagccau

SEQ ID NO: 1907474 - RNA, 22 nt, Shigella flexneri 2a str. 2457T
cgugaccgaaauggagccgaaa

SEQ ID NO: 1907475 - RNA, 16 nt, Shigella flexneri 2a str. 2457T
cgugagaacaccaccu

SEQ ID NO: 1907476 - RNA, 23 nt, Shigella flexneri 2a str. 2457T
cgugacgucucaaucaccaccag

SEQ ID NO: 1907477 - RNA, 17 nt, Shigella flexneri 2a str. 2457T
cgugcaaaaucaaacag

SEQ ID NO: 1907478 - RNA, 21 nt, Shigella flexneri 2a str. 2457T
cgugcaaauauacauaaaguc

SEQ ID NO: 1907479 - RNA, 16 nt, Shigella flexneri 2a str. 2457T
cgugcaaauucaauau

SEQ ID NO: 1907480 - RNA, 20 nt, Shigella flexneri 2a str. 2457T
cgugcauagcagcacaccac

SEQ ID NO: 1907481 - RNA, 12 nt, Shigella flexneri 2a str. 2457T
cgugccagaacu

SEQ ID NO: 1907482 - RNA, 13 nt, Shigella flexneri 2a str. 2457T
cgugccagauguu

SEQ ID NO: 1907483 - RNA, 13 nt, Shigella flexneri 2a str. 2457T
cgugccagagcau

SEQ ID NO: 1907484 - RNA, 16 nt, Shigella flexneri 2a str. 2457T
cgugcauuucucacuu

SEQ ID NO: 1907485 - RNA, 16 nt, Shigella flexneri 2a str. 2457T
cgugccaccagugcag

SEQ ID NO: 1907486 - RNA, 23 nt, Shigella flexneri 2a str. 2457T
cgugccaggguggcucaaucgcc

SEQ ID NO: 1907487 - RNA, 15 nt, Shigella flexneri 2a str. 2457T
cgugccauuaauguc

SEQ ID NO: 1907488 - RNA, 18 nt, Shigella flexneri 2a str. 2457T
cgucgccaguaccagcag

SEQ ID NO: 1907489 - RNA, 14 nt, Shigella flexneri 2a str. 2457T
cgucgcccgcgcga

SEQ ID NO: 1907490 - RNA, 16 nt, Shigella flexneri 2a str. 2457T
cgucgcccgcgcgagc

SEQ ID NO: 1907491 - RNA, 19 nt, Shigella flexneri 2a str. 2457T
cgucgauaucgaugacgcg

SEQ ID NO: 1907492 - RNA, 17 nt, Shigella flexneri 2a str. 2457T
cgucgcgcacgcccauc

SEQ ID NO: 1907493 - RNA, 16 nt, Shigella flexneri 2a str. 2457T
cgucgcgcccuccugc

SEQ ID NO: 1907494 - RNA, 12 nt, Shigella flexneri 2a str. 2457T
cgucgcuuuaua

SEQ ID NO: 1907495 - RNA, 21 nt, Shigella flexneri 2a str. 2457T
cgucgcuuaauugaccugccg

SEQ ID NO: 1907496 - RNA, 23 nt, Shigella flexneri 2a str. 2457T
cguccucacuguuuucuaacuca

SEQ ID NO: 1907497 - RNA, 20 nt, Shigella flexneri 2a str. 2457T
cguccuggcaacggacgacc

SEQ ID NO: 1907498 - RNA, 15 nt, Shigella flexneri 2a str. 2457T
cguccggcugccagc

SEQ ID NO: 1907499 - RNA, 20 nt, Shigella flexneri 2a str. 2457T
cguccgcucggucacugaca

SEQ ID NO: 1907500 - RNA, 19 nt, Shigella flexneri 2a str. 2457T
cguccgauuaaaaacccug

SEQ ID NO: 1907501 - RNA, 13 nt, Shigella flexneri 2a str. 2457T
cguccgcacgcug

SEQ ID NO: 1907502 - RNA, 21 nt, Shigella flexneri 2a str. 2457T
cgucccggugaagcgcccugc

SEQ ID NO: 1907503 - RNA, 18 nt, Shigella flexneri 2a str. 2457T
cgucccagucgucauccc

SEQ ID NO: 1907504 - RNA, 20 nt, Shigella flexneri 2a str. 2457T
cgucccaucggcaaucauuc

SEQ ID NO: 1907505 - RNA, 15 nt, Shigella flexneri 2a str. 2457T
cgucccaggcaaauc

SEQ ID NO: 1907506 - RNA, 22 nt, Shigella flexneri 2a str. 2457T
cguccaguuugccuucacaggc

SEQ ID NO: 1907507 - RNA, 20 nt, Shigella flexneri 2a str. 2457T
cguccaggcccaggcauccc

SEQ ID NO: 1907508 - RNA, 14 nt, Shigella flexneri 2a str. 2457T
cguccagcagcaau

SEQ ID NO: 1907509 - RNA, 16 nt, Shigella flexneri 2a str. 2457T
cguacuugccaauacg

SEQ ID NO: 1907510 - RNA, 12 nt, Shigella flexneri 2a str. 2457T
cguacuuccuua

SEQ ID NO: 1907511 - RNA, 21 nt, Shigella flexneri 2a str. 2457T
cguacucugccacuacccgca

SEQ ID NO: 1907512 - RNA, 12 nt, Shigella flexneri 2a str. 2457T
cguccagaugcg

SEQ ID NO: 1907513 - RNA, 20 nt, Shigella flexneri 2a str. 2457T
cgcggcgaaggugccugccc

SEQ ID NO: 1907514 - RNA, 15 nt, Shigella flexneri 2a str. 2457T
cgcggcgacuuccag

SEQ ID NO: 1907515 - RNA, 19 nt, Shigella flexneri 2a str. 2457T
cgcggccuuuaccuucgcc

SEQ ID NO: 1907516 - RNA, 16 nt, Shigella flexneri 2a str. 2457T
cgcggcccaccuggcu

SEQ ID NO: 1907517 - RNA, 13 nt, Shigella flexneri 2a str. 2457T
cgcggcaggcauc

SEQ ID NO: 1907518 - RNA, 22 nt, Shigella flexneri 2a str. 2457T
cgcggcacacagcacggcagca

SEQ ID NO: 1907519 - RNA, 22 nt, Shigella flexneri 2a str. 2457T
cgcggcaauuagcggccagcgg

SEQ ID NO: 1907520 - RNA, 13 nt, Shigella flexneri 2a str. 2457T
cgcggauccccug

SEQ ID NO: 1907521 - RNA, 15 nt, Shigella flexneri 2a str. 2457T
cgcgcuuaucgccag

SEQ ID NO: 1907522 - RNA, 16 nt, Shigella flexneri 2a str. 2457T
cgcgcuuaucgccagc

SEQ ID NO: 1907523 - RNA, 17 nt, Shigella flexneri 2a str. 2457T
cgcgcuucacaugccac

SEQ ID NO: 1907524 - RNA, 15 nt, Shigella flexneri 2a str. 2457T
cgcggaccaacaaaa

SEQ ID NO: 1907525 - RNA, 19 nt, Shigella flexneri 2a str. 2457T
cgcggaagacccggcggcg

SEQ ID NO: 1907526 - RNA, 22 nt, Shigella flexneri 2a str. 2457T
cgcgcuucgguguuaaaacgca

SEQ ID NO: 1907527 - RNA, 14 nt, Shigella flexneri 2a str. 2457T
cgcgcuauuuuccu

SEQ ID NO: 1907528 - RNA, 15 nt, Shigella flexneri 2a str. 2457T
cgcgcuacggccgcc

SEQ ID NO: 1907529 - RNA, 15 nt, Shigella flexneri 2a str. 2457T
cgcgcucaucagcgg

SEQ ID NO: 1907530 - RNA, 16 nt, Shigella flexneri 2a str. 2457T
cgcgcucuuuaaaggc

SEQ ID NO: 1907531 - RNA, 22 nt, Shigella flexneri 2a str. 2457T
cgcgcugccagaaccgcuucuu

SEQ ID NO: 1907532 - RNA, 18 nt, Shigella flexneri 2a str. 2457T
cgcgcggcgaaccagccg

SEQ ID NO: 1907533 - RNA, 16 nt, Shigella flexneri 2a str. 2457T
cgcgcgguaucaccac

SEQ ID NO: 1907534 - RNA, 18 nt, Shigella flexneri 2a str. 2457T
cgcgcgguaucaccaccc

SEQ ID NO: 1907535 - RNA, 13 nt, Shigella flexneri 2a str. 2457T
cgcgcgucacgau

SEQ ID NO: 1907536 - RNA, 20 nt, Shigella flexneri 2a str. 2457T
cgcgcgaauauggcggcggc

SEQ ID NO: 1907537 - RNA, 15 nt, Shigella flexneri 2a str. 2457T
cgcgccucaggcacu

SEQ ID NO: 1907538 - RNA, 15 nt, Shigella flexneri 2a str. 2457T
cgccagaugcggcgu

SEQ ID NO: 1907539 - RNA, 21 nt, Shigella flexneri 2a str. 2457T
cgcucccuggcccaucgccag

SEQ ID NO: 1907540 - RNA, 13 nt, Shigella flexneri 2a str. 2457T
cgcucccugccag

SEQ ID NO: 1907541 - RNA, 12 nt, Shigella flexneri 2a str. 2457T
cgcuccauucca

SEQ ID NO: 1907542 - RNA, 17 nt, Shigella flexneri 2a str. 2457T
cgcucaucugcugcguu

SEQ ID NO: 1907543 - RNA, 14 nt, Shigella flexneri 2a str. 2457T
cgcucaucugcugc

SEQ ID NO: 1907544 - RNA, 13 nt, Shigella flexneri 2a str. 2457T
cgcuccgucagca

SEQ ID NO: 1907545 - RNA, 14 nt, Shigella flexneri 2a str. 2457T
cgcuccgucagcac

SEQ ID NO: 1907546 - RNA, 17 nt, Shigella flexneri 2a str. 2457T
cgcuccgcaccugagua

SEQ ID NO: 1907547 - RNA, 17 nt, Shigella flexneri 2a str. 2457T
cgcucgaagcgggcgcg

SEQ ID NO: 1907548 - RNA, 19 nt, Shigella flexneri 2a str. 2457T
cgcucgagagagaaaauaa

SEQ ID NO: 1907549 - RNA, 22 nt, Shigella flexneri 2a str. 2457T
cgcucuuguucuuccggcacac

SEQ ID NO: 1907550 - RNA, 17 nt, Shigella flexneri 2a str. 2457T
cgcucuugcucucauua

SEQ ID NO: 1907551 - RNA, 19 nt, Shigella flexneri 2a str. 2457T
cgcucggcgcaaucgccag

SEQ ID NO: 1907552 - RNA, 15 nt, Shigella flexneri 2a str. 2457T
cgcucuuuaaaggcc

SEQ ID NO: 1907553 - RNA, 21 nt, Shigella flexneri 2a str. 2457T
cgcucggcaacaccucagcca

SEQ ID NO: 1907554 - RNA, 13 nt, Shigella flexneri 2a str. 2457T
cgcucgcgccgca

SEQ ID NO: 1907555 - RNA, 16 nt, Shigella flexneri 2a str. 2457T
cgcugauuugcuucaa

SEQ ID NO: 1907556 - RNA, 20 nt, Shigella flexneri 2a str. 2457T
cgcugaugucagcacuucca

SEQ ID NO: 1907557 - RNA, 15 nt, Shigella flexneri 2a str. 2457T
cgcugauuaccuucc

SEQ ID NO: 1907558 - RNA, 12 nt, Shigella flexneri 2a str. 2457T
cgcugauucaag

SEQ ID NO: 1907559 - RNA, 19 nt, Shigella flexneri 2a str. 2457T
cgcugauugggaaaucaga

SEQ ID NO: 1907560 - RNA, 13 nt, Shigella flexneri 2a str. 2457T
cgcugagacgcgc

SEQ ID NO: 1907561 - RNA, 14 nt, Shigella flexneri 2a str. 2457T
cgcugagagaagca

SEQ ID NO: 1907562 - RNA, 14 nt, Shigella flexneri 2a str. 2457T
cgcugcaucgccaa

SEQ ID NO: 1907563 - RNA, 19 nt, Shigella flexneri 2a str. 2457T
cgcugcauggcaacuuuaa

SEQ ID NO: 1907564 - RNA, 14 nt, Shigella flexneri 2a str. 2457T
cgcugcacuuucuc

SEQ ID NO: 1907565 - RNA, 22 nt, Shigella flexneri 2a str. 2457T
cgcugcacuuucucgacaucca

SEQ ID NO: 1907566 - RNA, 21 nt, Shigella flexneri 2a str. 2457T
cgcugcacaauugccagcccu

SEQ ID NO: 1907567 - RNA, 12 nt, Shigella flexneri 2a str. 2457T
cgcuaauaauaa

SEQ ID NO: 1907568 - RNA, 16 nt, Shigella flexneri 2a str. 2457T
cgcuaaucgcaccgac

SEQ ID NO: 1907569 - RNA, 17 nt, Shigella flexneri 2a str. 2457T
cgcguuuaaucacacca

SEQ ID NO: 1907570 - RNA, 19 nt, Shigella flexneri 2a str. 2457T
cgcuaauuuauucggucag

SEQ ID NO: 1907571 - RNA, 14 nt, Shigella flexneri 2a str. 2457T
cgcuaccaccaaac

SEQ ID NO: 1907572 - RNA, 21 nt, Shigella flexneri 2a str. 2457T
cgcuagccaacuuaccgccgg

SEQ ID NO: 1907573 - RNA, 17 nt, Shigella flexneri 2a str. 2457T
cgcguuacccauucaag

SEQ ID NO: 1907574 - RNA, 22 nt, Shigella flexneri 2a str. 2457T
cgcguuaucagcaacuggcaaa

SEQ ID NO: 1907575 - RNA, 15 nt, Shigella flexneri 2a str. 2457T
cgcguuauccgcuuu

SEQ ID NO: 1907576 - RNA, 15 nt, Shigella flexneri 2a str. 2457T
cgcucaccggaugcg

SEQ ID NO: 1907577 - RNA, 13 nt, Shigella flexneri 2a str. 2457T
cgcucauaaccaa

SEQ ID NO: 1907578 - RNA, 15 nt, Shigella flexneri 2a str. 2457T
cgcucagucggcgcu

SEQ ID NO: 1907579 - RNA, 22 nt, Shigella flexneri 2a str. 2457T
cgcucagucggcgcuuuugcau

SEQ ID NO: 1907580 - RNA, 21 nt, Shigella flexneri 2a str. 2457T
cgcuauaucgcugauaucaaa

SEQ ID NO: 1907581 - RNA, 22 nt, Shigella flexneri 2a str. 2457T
cgcuauagacaccuugcaacuc

SEQ ID NO: 1907582 - RNA, 13 nt, Shigella flexneri 2a str. 2457T
cgcuauccagcgc

SEQ ID NO: 1907583 - RNA, 14 nt, Shigella flexneri 2a str. 2457T
cgcuaucagcgcca

SEQ ID NO: 1907584 - RNA, 17 nt, Shigella flexneri 2a str. 2457T
cgcguaaugcuucuacc

SEQ ID NO: 1907585 - RNA, 15 nt, Shigella flexneri 2a str. 2457T
cgcguaauggcagca

SEQ ID NO: 1907586 - RNA, 14 nt, Shigella flexneri 2a str. 2457T
cgcguaccgcagca

SEQ ID NO: 1907587 - RNA, 13 nt, Shigella flexneri 2a str. 2457T
cgcguaccgccga

SEQ ID NO: 1907588 - RNA, 16 nt, Shigella flexneri 2a str. 2457T
cgcguaauggcagcau

SEQ ID NO: 1907589 - RNA, 19 nt, Shigella flexneri 2a str. 2457T
cgcguaauggcagcauuca

SEQ ID NO: 1907590 - RNA, 17 nt, Shigella flexneri 2a str. 2457T
cgcguagagaauccagu

SEQ ID NO: 1907591 - RNA, 11 nt, Shigella flexneri 2a str. 2457T
cgcguggaaca

SEQ ID NO: 1907592 - RNA, 22 nt, Shigella flexneri 2a str. 2457T
cggccaguuucggacgcggcac

SEQ ID NO: 1907593 - RNA, 22 nt, Shigella flexneri 2a str. 2457T
cggccagcgggcgucaaaauca

SEQ ID NO: 1907594 - RNA, 14 nt, Shigella flexneri 2a str. 2457T
cggccacagccagc

SEQ ID NO: 1907595 - RNA, 19 nt, Shigella flexneri 2a str. 2457T
cggccacagccagccaacg

SEQ ID NO: 1907596 - RNA, 15 nt, Shigella flexneri 2a str. 2457T
cggcauuuugcugau

SEQ ID NO: 1907597 - RNA, 18 nt, Shigella flexneri 2a str. 2457T
cggcauuuugcugaugca

SEQ ID NO: 1907598 - RNA, 13 nt, Shigella flexneri 2a str. 2457T
cggcauuuugugc

SEQ ID NO: 1907599 - RNA, 14 nt, Shigella flexneri 2a str. 2457T
cggcagcuccagca

SEQ ID NO: 1907600 - RNA, 12 nt, Shigella flexneri 2a str. 2457T
cggcagcgucgg

SEQ ID NO: 1907601 - RNA, 14 nt, Shigella flexneri 2a str. 2457T
cggcauggaucgcc

SEQ ID NO: 1907602 - RNA, 16 nt, Shigella flexneri 2a str. 2457T
cggcaugacgccgggc

SEQ ID NO: 1907603 - RNA, 21 nt, Shigella flexneri 2a str. 2457T
cggcaugaacaaagcgcaccu

SEQ ID NO: 1907604 - RNA, 21 nt, Shigella flexneri 2a str. 2457T
cggcaugaaaacccuucaaau

SEQ ID NO: 1907605 - RNA, 18 nt, Shigella flexneri 2a str. 2457T
cggcaucuuguucauagu

SEQ ID NO: 1907606 - RNA, 24 nt, Shigella flexneri 2a str. 2457T
cggcauuacugguuugcagauaac

SEQ ID NO: 1907607 - RNA, 22 nt, Shigella flexneri 2a str. 2457T
cggauauccacccgcagccauc

SEQ ID NO: 1907608 - RNA, 13 nt, Shigella flexneri 2a str. 2457T
cggauaucaccac

SEQ ID NO: 1907609 - RNA, 16 nt, Shigella flexneri 2a str. 2457T
cggauaucgagaauca

SEQ ID NO: 1907610 - RNA, 16 nt, Shigella flexneri 2a str. 2457T
cggaucagcgucgccu

SEQ ID NO: 1907611 - RNA, 14 nt, Shigella flexneri 2a str. 2457T
cggauagagcgcgg

SEQ ID NO: 1907612 - RNA, 22 nt, Shigella flexneri 2a str. 2457T
cggauagcguguuuuauaccuc

SEQ ID NO: 1907613 - RNA, 16 nt, Shigella flexneri 2a str. 2457T
cggaucaagaaaguuc

SEQ ID NO: 1907614 - RNA, 14 nt, Shigella flexneri 2a str. 2457T
cggaucauuaguca

SEQ ID NO: 1907615 - RNA, 19 nt, Shigella flexneri 2a str. 2457T
cggaucgaacuccgccccg

SEQ ID NO: 1907616 - RNA, 23 nt, Shigella flexneri 2a str. 2457T
cggcaaucggugcaaaugccaga

SEQ ID NO: 1907617 - RNA, 14 nt, Shigella flexneri 2a str. 2457T
cggcaaugcgcccc

SEQ ID NO: 1907618 - RNA, 12 nt, Shigella flexneri 2a str. 2457T
cggcaaucgcca

SEQ ID NO: 1907619 - RNA, 17 nt, Shigella flexneri 2a str. 2457T
cggcaaucacaucacca

SEQ ID NO: 1907620 - RNA, 14 nt, Shigella flexneri 2a str. 2457T
cggcaaucacgccc

SEQ ID NO: 1907621 - RNA, 21 nt, Shigella flexneri 2a str. 2457T
cggcaauacuuugcagaucgc

SEQ ID NO: 1907622 - RNA, 22 nt, Shigella flexneri 2a str. 2457T
cggcaauauagauaucaugcuc

SEQ ID NO: 1907623 - RNA, 22 nt, Shigella flexneri 2a str. 2457T
cggcaaggguugagauuuauuu

SEQ ID NO: 1907624 - RNA, 17 nt, Shigella flexneri 2a str. 2457T
cggcaagaucaccguuu

SEQ ID NO: 1907625 - RNA, 16 nt, Shigella flexneri 2a str. 2457T
cggcaagaucagcauc

SEQ ID NO: 1907626 - RNA, 19 nt, Shigella flexneri 2a str. 2457T
cggcacgcguugcgcauga

SEQ ID NO: 1907627 - RNA, 18 nt, Shigella flexneri 2a str. 2457T
cggcacggaaagcagcau

SEQ ID NO: 1907628 - RNA, 23 nt, Shigella flexneri 2a str. 2457T
cggcacguucgaugcggcucagc

SEQ ID NO: 1907629 - RNA, 16 nt, Shigella flexneri 2a str. 2457T
cggcacagaaacgcca

SEQ ID NO: 1907630 - RNA, 22 nt, Shigella flexneri 2a str. 2457T
cggcacacagcacggcagcaac

SEQ ID NO: 1907631 - RNA, 16 nt, Shigella flexneri 2a str. 2457T
cggcaauuagcggcug

SEQ ID NO: 1907632 - RNA, 18 nt, Shigella flexneri 2a str. 2457T
cggcaauuagcggcuggc

SEQ ID NO: 1907633 - RNA, 19 nt, Shigella flexneri 2a str. 2457T
cggcaauucucugcuccug

SEQ ID NO: 1907634 - RNA, 21 nt, Shigella flexneri 2a str. 2457T
cggcaauucucugcuccugau

SEQ ID NO: 1907635 - RNA, 16 nt, Shigella flexneri 2a str. 2457T
cggcagcaggaucucc

SEQ ID NO: 1907636 - RNA, 19 nt, Shigella flexneri 2a str. 2457T
cggcagcaggugcgccagc

SEQ ID NO: 1907637 - RNA, 11 nt, Shigella flexneri 2a str. 2457T
cgcuucugcca

SEQ ID NO: 1907638 - RNA, 11 nt, Shigella flexneri 2a str. 2457T
cgcuucugcuu

SEQ ID NO: 1907639 - RNA, 12 nt, Shigella flexneri 2a str. 2457T
cgcuucuucagc

SEQ ID NO: 1907640 - RNA, 19 nt, Shigella flexneri 2a str. 2457T
cgcuucugguuauauuucc

SEQ ID NO: 1907641 - RNA, 16 nt, Shigella flexneri 2a str. 2457T
cgcuucggcgccuuuu

SEQ ID NO: 1907642 - RNA, 21 nt, Shigella flexneri 2a str. 2457T
cgcuucgguuuucgcgccagc

SEQ ID NO: 1907643 - RNA, 23 nt, Shigella flexneri 2a str. 2457T
cgcuugcugauaacgugcagcuu

SEQ ID NO: 1907644 - RNA, 23 nt, Shigella flexneri 2a str. 2457T
cgcuuccauugagaaagcccugg

SEQ ID NO: 1907645 - RNA, 18 nt, Shigella flexneri 2a str. 2457T
cgcuucaugcuuaaucau

SEQ ID NO: 1907646 - RNA, 16 nt, Shigella flexneri 2a str. 2457T
cgcuucgcccgccagc

SEQ ID NO: 1907647 - RNA, 16 nt, Shigella flexneri 2a str. 2457T
cgcuucgcccaaaucc

SEQ ID NO: 1907648 - RNA, 14 nt, Shigella flexneri 2a str. 2457T
cgcuucaaccaccu

SEQ ID NO: 1907649 - RNA, 15 nt, Shigella flexneri 2a str. 2457T
cgcuuugcaggcugg

SEQ ID NO: 1907650 - RNA, 23 nt, Shigella flexneri 2a str. 2457T
cgcuuucugagcggccuuuuccu

SEQ ID NO: 1907651 - RNA, 15 nt, Shigella flexneri 2a str. 2457T
cggaacaucugcccc

SEQ ID NO: 1907652 - RNA, 14 nt, Shigella flexneri 2a str. 2457T
cggaaccagccagg

SEQ ID NO: 1907653 - RNA, 15 nt, Shigella flexneri 2a str. 2457T
cggaaauugccacug

SEQ ID NO: 1907654 - RNA, 15 nt, Shigella flexneri 2a str. 2457T
cggaacaacggcaaa

SEQ ID NO: 1907655 - RNA, 19 nt, Shigella flexneri 2a str. 2457T
cggaacacucuuccagucg

SEQ ID NO: 1907656 - RNA, 14 nt, Shigella flexneri 2a str. 2457T
cggaacccagcgcg

SEQ ID NO: 1907657 - RNA, 21 nt, Shigella flexneri 2a str. 2457T
cggaacccagcgcgauacgca

SEQ ID NO: 1907658 - RNA, 15 nt, Shigella flexneri 2a str. 2457T
cggaauaaucagaug

SEQ ID NO: 1907659 - RNA, 16 nt, Shigella flexneri 2a str. 2457T
cggaaucaccggcaaa

SEQ ID NO: 1907660 - RNA, 15 nt, Shigella flexneri 2a str. 2457T
cggaauaucagaggc

SEQ ID NO: 1907661 - RNA, 12 nt, Shigella flexneri 2a str. 2457T
cggaagcuccac

SEQ ID NO: 1907662 - RNA, 15 nt, Shigella flexneri 2a str. 2457T
cggaagcgucaaggu

SEQ ID NO: 1907663 - RNA, 19 nt, Shigella flexneri 2a str. 2457T
cggaagcgagguauuuucu

SEQ ID NO: 1907664 - RNA, 22 nt, Shigella flexneri 2a str. 2457T
cggaagcaaaauaaccggcaag

SEQ ID NO: 1907665 - RNA, 17 nt, Shigella flexneri 2a str. 2457T
cggaagcccgcugcuau

SEQ ID NO: 1907666 - RNA, 13 nt, Shigella flexneri 2a str. 2457T
cggaagccaccac

SEQ ID NO: 1907667 - RNA, 12 nt, Shigella flexneri 2a str. 2457T
cggaagccacca

SEQ ID NO: 1907668 - RNA, 15 nt, Shigella flexneri 2a str. 2457T
cggagugaaaauucu

SEQ ID NO: 1907669 - RNA, 19 nt, Shigella flexneri 2a str. 2457T
cggagggguuuuugccagc

SEQ ID NO: 1907670 - RNA, 22 nt, Shigella flexneri 2a str. 2457T
cggaggggcggcucuccugcca

SEQ ID NO: 1907671 - RNA, 19 nt, Shigella flexneri 2a str. 2457T
cggagggauguggcccagc

SEQ ID NO: 1907672 - RNA, 15 nt, Shigella flexneri 2a str. 2457T
cggagguuuuuuccu

SEQ ID NO: 1907673 - RNA, 14 nt, Shigella flexneri 2a str. 2457T
cggaggcccgcccc

SEQ ID NO: 1907674 - RNA, 17 nt, Shigella flexneri 2a str. 2457T
cggagaguaaacgguga

SEQ ID NO: 1907675 - RNA, 22 nt, Shigella flexneri 2a str. 2457T
cggagagaaaaaccuccggcgu

SEQ ID NO: 1907676 - RNA, 15 nt, Shigella flexneri 2a str. 2457T
cggacuuuuuauuua

SEQ ID NO: 1907677 - RNA, 14 nt, Shigella flexneri 2a str. 2457T
cggagaacaggaau

SEQ ID NO: 1907678 - RNA, 18 nt, Shigella flexneri 2a str. 2457T
cggacguaaugauguaaa

SEQ ID NO: 1907679 - RNA, 20 nt, Shigella flexneri 2a str. 2457T
cggaaugauauuggucacca

SEQ ID NO: 1907680 - RNA, 15 nt, Shigella flexneri 2a str. 2457T
cggaauggcaucuuc

SEQ ID NO: 1907681 - RNA, 19 nt, Shigella flexneri 2a str. 2457T
cggacaaacggcuggaaca

SEQ ID NO: 1907682 - RNA, 17 nt, Shigella flexneri 2a str. 2457T
cggacaauaauaucuuu

SEQ ID NO: 1907683 - RNA, 11 nt, Shigella flexneri 2a str. 2457T
cggaauuucaa

SEQ ID NO: 1907684 - RNA, 20 nt, Shigella flexneri 2a str. 2457T
cggacaaaguuccugccgau

SEQ ID NO: 1907685 - RNA, 14 nt, Shigella flexneri 2a str. 2457T
cggaauuuuccuuc

SEQ ID NO: 1907686 - RNA, 18 nt, Shigella flexneri 2a str. 2457T
cggacaauaauaucuuuu

SEQ ID NO: 1907687 - RNA, 15 nt, Shigella flexneri 2a str. 2457T
cggacagaucugccu

SEQ ID NO: 1907688 - RNA, 17 nt, Shigella flexneri 2a str. 2457T
cggacaugacucuacgc

SEQ ID NO: 1907689 - RNA, 23 nt, Shigella flexneri 2a str. 2457T
cggacagucacguagcggcggca

SEQ ID NO: 1907690 - RNA, 14 nt, Shigella flexneri 2a str. 2457T
cggacccacacccc

SEQ ID NO: 1907691 - RNA, 15 nt, Shigella flexneri 2a str. 2457T
cggaccgucaucuuc

SEQ ID NO: 1907692 - RNA, 16 nt, Shigella flexneri 2a str. 2457T
cguacccagcagcgcc

SEQ ID NO: 1907693 - RNA, 18 nt, Shigella flexneri 2a str. 2457T
cguaccaugcgcaucauc

SEQ ID NO: 1907694 - RNA, 16 nt, Shigella flexneri 2a str. 2457T
cguacccgccugauag

SEQ ID NO: 1907695 - RNA, 23 nt, Shigella flexneri 2a str. 2457T
cguaccaaucagacucauauaaa

SEQ ID NO: 1907696 - RNA, 20 nt, Shigella flexneri 2a str. 2457T
cguacauugccgacauggca

SEQ ID NO: 1907697 - RNA, 17 nt, Shigella flexneri 2a str. 2457T
cguaccucacguuccag

SEQ ID NO: 1907698 - RNA, 22 nt, Shigella flexneri 2a str. 2457T
cguaccggcaacgacugcgagc

SEQ ID NO: 1907699 - RNA, 18 nt, Shigella flexneri 2a str. 2457T
cguacgcuuuugaggauu

SEQ ID NO: 1907700 - RNA, 21 nt, Shigella flexneri 2a str. 2457T
cguacgggucgggcuguguuu

SEQ ID NO: 1907701 - RNA, 18 nt, Shigella flexneri 2a str. 2457T
cguaaugauguaaaaaua

SEQ ID NO: 1907702 - RNA, 19 nt, Shigella flexneri 2a str. 2457T
cguaaugauguaaaaauac

SEQ ID NO: 1907703 - RNA, 20 nt, Shigella flexneri 2a str. 2457T
cguaaugauguaaaaauacu

SEQ ID NO: 1907704 - RNA, 23 nt, Shigella flexneri 2a str. 2457T
cguaaugaauguuuuccugcuuc

SEQ ID NO: 1907705 - RNA, 16 nt, Shigella flexneri 2a str. 2457T
cguaauccguaaagcc

SEQ ID NO: 1907706 - RNA, 13 nt, Shigella flexneri 2a str. 2457T
cguaauauccagg

SEQ ID NO: 1907707 - RNA, 15 nt, Shigella flexneri 2a str. 2457T
cguaauauccaggcc

SEQ ID NO: 1907708 - RNA, 22 nt, Shigella flexneri 2a str. 2457T
cguaaucaacauauuccccugg

SEQ ID NO: 1907709 - RNA, 19 nt, Shigella flexneri 2a str. 2457T
cguacaaaauuagaaaggg

SEQ ID NO: 1907710 - RNA, 14 nt, Shigella flexneri 2a str. 2457T
cguaauuugccguu

SEQ ID NO: 1907711 - RNA, 16 nt, Shigella flexneri 2a str. 2457T
cguaauuggccugaca

SEQ ID NO: 1907712 - RNA, 12 nt, Shigella flexneri 2a str. 2457T
cguacaccaaca

SEQ ID NO: 1907713 - RNA, 16 nt, Shigella flexneri 2a str. 2457T
cguacaaccaaaucug

SEQ ID NO: 1907714 - RNA, 16 nt, Shigella flexneri 2a str. 2457T
cguaaaagccuggacc

SEQ ID NO: 1907715 - RNA, 20 nt, Shigella flexneri 2a str. 2457T
cguaaagucgaugcgcuggc

SEQ ID NO: 1907716 - RNA, 15 nt, Shigella flexneri 2a str. 2457T
cguaaaucuuuacca

SEQ ID NO: 1907717 - RNA, 11 nt, Shigella flexneri 2a str. 2457T
cguaaaugccu

SEQ ID NO: 1907718 - RNA, 22 nt, Shigella flexneri 2a str. 2457T
cguaagcgcauccggcaccagc

SEQ ID NO: 1907719 - RNA, 17 nt, Shigella flexneri 2a str. 2457T
cguaaaaacccgcuucg

SEQ ID NO: 1907720 - RNA, 23 nt, Shigella flexneri 2a str. 2457T
cgguuuuuaaggguauuuuucua

SEQ ID NO: 1907721 - RNA, 15 nt, Shigella flexneri 2a str. 2457T
cgguugccagcgcca

SEQ ID NO: 1907722 - RNA, 14 nt, Shigella flexneri 2a str. 2457T
cgguucccucgccc

SEQ ID NO: 1907723 - RNA, 16 nt, Shigella flexneri 2a str. 2457T
cgguucgccugcacca

SEQ ID NO: 1907724 - RNA, 18 nt, Shigella flexneri 2a str. 2457T
cgguucguugauaauaaa

SEQ ID NO: 1907725 - RNA, 14 nt, Shigella flexneri 2a str. 2457T
cgguugacugcuga

SEQ ID NO: 1907726 - RNA, 15 nt, Shigella flexneri 2a str. 2457T
cgguugacugcugag

SEQ ID NO: 1907727 - RNA, 13 nt, Shigella flexneri 2a str. 2457T
cggugcuggucug

SEQ ID NO: 1907728 - RNA, 21 nt, Shigella flexneri 2a str. 2457T
cggugcuggucuguuccccuc

SEQ ID NO: 1907729 - RNA, 17 nt, Shigella flexneri 2a str. 2457T
cgguggccgucgagcag

SEQ ID NO: 1907730 - RNA, 15 nt, Shigella flexneri 2a str. 2457T
cggugcguugucauc

SEQ ID NO: 1907731 - RNA, 17 nt, Shigella flexneri 2a str. 2457T
cggugcgguaagcugcg

SEQ ID NO: 1907732 - RNA, 15 nt, Shigella flexneri 2a str. 2457T
cggugguguuaucac

SEQ ID NO: 1907733 - RNA, 18 nt, Shigella flexneri 2a str. 2457T
cgguguucaagccaaaac

SEQ ID NO: 1907734 - RNA, 19 nt, Shigella flexneri 2a str. 2457T
cgguguucaagccaaaacg

SEQ ID NO: 1907735 - RNA, 13 nt, Shigella flexneri 2a str. 2457T
cgguguggcaugg

SEQ ID NO: 1907736 - RNA, 17 nt, Shigella flexneri 2a str. 2457T
cgguucagcgucggcgu

SEQ ID NO: 1907737 - RNA, 20 nt, Shigella flexneri 2a str. 2457T
cggugauauacgucacuuca

SEQ ID NO: 1907738 - RNA, 21 nt, Shigella flexneri 2a str. 2457T
cggugauauacgucacuucau

SEQ ID NO: 1907739 - RNA, 18 nt, Shigella flexneri 2a str. 2457T
cggugauaaucaucccac

SEQ ID NO: 1907740 - RNA, 16 nt, Shigella flexneri 2a str. 2457T
cggucagcagcaccac

SEQ ID NO: 1907741 - RNA, 22 nt, Shigella flexneri 2a str. 2457T
cggucagaaaauuauuuuaaau

SEQ ID NO: 1907742 - RNA, 12 nt, Shigella flexneri 2a str. 2457T
cggucagccauu

SEQ ID NO: 1907743 - RNA, 22 nt, Shigella flexneri 2a str. 2457T
cggugaaaguaacugacaguag

SEQ ID NO: 1907744 - RNA, 13 nt, Shigella flexneri 2a str. 2457T
cggggaucacucc

SEQ ID NO: 1907745 - RNA, 17 nt, Shigella flexneri 2a str. 2457T
cggggaucacuggcaga

SEQ ID NO: 1907746 - RNA, 14 nt, Shigella flexneri 2a str. 2457T
cggggacaggcggg

SEQ ID NO: 1907747 - RNA, 17 nt, Shigella flexneri 2a str. 2457T
cggggcuauaccagaua

SEQ ID NO: 1907748 - RNA, 14 nt, Shigella flexneri 2a str. 2457T
cgggcaugauagcc

SEQ ID NO: 1907749 - RNA, 21 nt, Shigella flexneri 2a str. 2457T
cgggcaugucgguuguacaaa

SEQ ID NO: 1907750 - RNA, 21 nt, Shigella flexneri 2a str. 2457T
cggguaacuaauaauugcccc

SEQ ID NO: 1907751 - RNA, 15 nt, Shigella flexneri 2a str. 2457T
cgggucaggccagga

SEQ ID NO: 1907752 - RNA, 20 nt, Shigella flexneri 2a str. 2457T
cgggucaguauuccaaucgg

SEQ ID NO: 1907753 - RNA, 13 nt, Shigella flexneri 2a str. 2457T
cgggggaagcuga

SEQ ID NO: 1907754 - RNA, 21 nt, Shigella flexneri 2a str. 2457T
cggggcuguuuuccagcacca

SEQ ID NO: 1907755 - RNA, 19 nt, Shigella flexneri 2a str. 2457T
cgggugcgacaggagccgc

SEQ ID NO: 1907756 - RNA, 20 nt, Shigella flexneri 2a str. 2457T
cgguaccuuugaacugcuga

SEQ ID NO: 1907757 - RNA, 19 nt, Shigella flexneri 2a str. 2457T
cgguaauuauugaugaagu

SEQ ID NO: 1907758 - RNA, 20 nt, Shigella flexneri 2a str. 2457T
cgguacugaccaucagcagc

SEQ ID NO: 1907759 - RNA, 12 nt, Shigella flexneri 2a str. 2457T
cgguacuucacc

SEQ ID NO: 1907760 - RNA, 20 nt, Shigella flexneri 2a str. 2457T
cgguagccccgcgaacgggg

SEQ ID NO: 1907761 - RNA, 14 nt, Shigella flexneri 2a str. 2457T
cgguagccauuccc

SEQ ID NO: 1907762 - RNA, 23 nt, Shigella flexneri 2a str. 2457T
cgguagauuauuucgcugcggau

SEQ ID NO: 1907763 - RNA, 15 nt, Shigella flexneri 2a str. 2457T
cgguagcagcuuuca

SEQ ID NO: 1907764 - RNA, 20 nt, Shigella flexneri 2a str. 2457T
cgguagcagcuuucagcagc

SEQ ID NO: 1907765 - RNA, 17 nt, Shigella flexneri 2a str. 2457T
cgguaguggcaaccagc

SEQ ID NO: 1907766 - RNA, 17 nt, Shigella flexneri 2a str. 2457T
cgguaucaccacccagc

SEQ ID NO: 1907767 - RNA, 14 nt, Shigella flexneri 2a str. 2457T
cgguauuggugaaa

SEQ ID NO: 1907768 - RNA, 18 nt, Shigella flexneri 2a str. 2457T
cgguauuaaucugccagc

SEQ ID NO: 1907769 - RNA, 16 nt, Shigella flexneri 2a str. 2457T
cgguaugacccagcgc

SEQ ID NO: 1907770 - RNA, 14 nt, Shigella flexneri 2a str. 2457T
cgguaaauugcccc

SEQ ID NO: 1907771 - RNA, 13 nt, Shigella flexneri 2a str. 2457T
cgguaacccuuca

SEQ ID NO: 1907772 - RNA, 22 nt, Shigella flexneri 2a str. 2457T
cgguaaagccgugcugcugcca

SEQ ID NO: 1907773 - RNA, 22 nt, Shigella flexneri 2a str. 2457T
cgguaaagaagagcggcaaacg

SEQ ID NO: 1907774 - RNA, 18 nt, Shigella flexneri 2a str. 2457T
cgguaaaagcccauuauu

SEQ ID NO: 1907775 - RNA, 13 nt, Shigella flexneri 2a str. 2457T
cgguaaaaucauc

SEQ ID NO: 1907776 - RNA, 18 nt, Shigella flexneri 2a str. 2457T
cgguaaaaccuuugcgaa

SEQ ID NO: 1907777 - RNA, 20 nt, Shigella flexneri 2a str. 2457T
cgguaaaaucauccugcugc

SEQ ID NO: 1907778 - RNA, 20 nt, Shigella flexneri 2a str. 2457T
cgguaacguugcucaagggu

SEQ ID NO: 1907779 - RNA, 15 nt, Shigella flexneri 2a str. 2457T
cgguaagcugaugac

SEQ ID NO: 1907780 - RNA, 23 nt, Shigella flexneri 2a str. 2457T
cgguaagaguaaagcccgccauc

SEQ ID NO: 1907781 - RNA, 15 nt, Shigella flexneri 2a str. 2457T
cgguaacuuaucugu

SEQ ID NO: 1907782 - RNA, 21 nt, Shigella flexneri 2a str. 2457T
cgguaaguucacgcagguuag

SEQ ID NO: 1907783 - RNA, 22 nt, Shigella flexneri 2a str. 2457T
cgguaauaaaugccggaagcug

SEQ ID NO: 1907784 - RNA, 15 nt, Shigella flexneri 2a str. 2457T
cgguaaugacuccaa

SEQ ID NO: 1907785 - RNA, 18 nt, Shigella flexneri 2a str. 2457T
cggguuuacuuccccggc

SEQ ID NO: 1907786 - RNA, 13 nt, Shigella flexneri 2a str. 2457T
cggguuuccugga

SEQ ID NO: 1907787 - RNA, 15 nt, Shigella flexneri 2a str. 2457T
cggguuuucaacggc

SEQ ID NO: 1907788 - RNA, 14 nt, Shigella flexneri 2a str. 2457T
cggguuuucaauga

SEQ ID NO: 1907789 - RNA, 20 nt, Shigella flexneri 2a str. 2457T
cggguugcgguuucaacugc

SEQ ID NO: 1907790 - RNA, 20 nt, Shigella flexneri 2a str. 2457T
cggguuagguggcaccugac

SEQ ID NO: 1907791 - RNA, 19 nt, Shigella flexneri 2a str. 2457T
cggguggugacuggcaaca

SEQ ID NO: 1907792 - RNA, 18 nt, Shigella flexneri 2a str. 2457T
cgggcaaagcgacgcgca

SEQ ID NO: 1907793 - RNA, 13 nt, Shigella flexneri 2a str. 2457T
cgggcaacugcug

SEQ ID NO: 1907794 - RNA, 14 nt, Shigella flexneri 2a str. 2457T
cgggcaaucggcug

SEQ ID NO: 1907795 - RNA, 13 nt, Shigella flexneri 2a str. 2457T
cgggcaacuucaa

SEQ ID NO: 1907796 - RNA, 15 nt, Shigella flexneri 2a str. 2457T
cgggaugccuucagu

SEQ ID NO: 1907797 - RNA, 22 nt, Shigella flexneri 2a str. 2457T
cgggaucugauucugauccugc

SEQ ID NO: 1907798 - RNA, 11 nt, Shigella flexneri 2a str. 2457T
cgggauaaacg

SEQ ID NO: 1907799 - RNA, 18 nt, Shigella flexneri 2a str. 2457T
cgggaucaccagaccaau

SEQ ID NO: 1907800 - RNA, 18 nt, Shigella flexneri 2a str. 2457T
cgggagagauaagauaaa

SEQ ID NO: 1907801 - RNA, 20 nt, Shigella flexneri 2a str. 2457T
cgggaacuggcaacaauggc

SEQ ID NO: 1907802 - RNA, 15 nt, Shigella flexneri 2a str. 2457T
cgggaagauccaggu

SEQ ID NO: 1907803 - RNA, 16 nt, Shigella flexneri 2a str. 2457T
cgggacagcauggggc

SEQ ID NO: 1907804 - RNA, 22 nt, Shigella flexneri 2a str. 2457T
cggcuugcgcgcaaucagcacc

SEQ ID NO: 1907805 - RNA, 18 nt, Shigella flexneri 2a str. 2457T
cggcuuguacgccgccgc

SEQ ID NO: 1907806 - RNA, 15 nt, Shigella flexneri 2a str. 2457T
cggcguccuggaacu

SEQ ID NO: 1907807 - RNA, 21 nt, Shigella flexneri 2a str. 2457T
cggcguaucguaaaacgcgga

SEQ ID NO: 1907808 - RNA, 16 nt, Shigella flexneri 2a str. 2457T
cggcggugaccagcag

SEQ ID NO: 1907809 - RNA, 23 nt, Shigella flexneri 2a str. 2457T
cggcggugaccagcagcauuuca

SEQ ID NO: 1907810 - RNA, 21 nt, Shigella flexneri 2a str. 2457T
cggcggugagaagaccgccgc

SEQ ID NO: 1907811 - RNA, 16 nt, Shigella flexneri 2a str. 2457T
cggcgguaaaaucauc

SEQ ID NO: 1907812 - RNA, 18 nt, Shigella flexneri 2a str. 2457T
cggcggguuaaccagcac

SEQ ID NO: 1907813 - RNA, 13 nt, Shigella flexneri 2a str. 2457T
cggcggcaaauau

SEQ ID NO: 1907814 - RNA, 14 nt, Shigella flexneri 2a str. 2457T
cggcuccagcaaug

SEQ ID NO: 1907815 - RNA, 22 nt, Shigella flexneri 2a str. 2457T
cggcuccagcaaugucauaaac

SEQ ID NO: 1907816 - RNA, 14 nt, Shigella flexneri 2a str. 2457T
cggcguuuucaggu

SEQ ID NO: 1907817 - RNA, 18 nt, Shigella flexneri 2a str. 2457T
cggcucccgcagccacuc

SEQ ID NO: 1907818 - RNA, 19 nt, Shigella flexneri 2a str. 2457T
cggcucgccuuucggcugc

SEQ ID NO: 1907819 - RNA, 18 nt, Shigella flexneri 2a str. 2457T
cggcuccgccccaaugcg

SEQ ID NO: 1907820 - RNA, 20 nt, Shigella flexneri 2a str. 2457T
cggcucgccuuucggcugca

SEQ ID NO: 1907821 - RNA, 17 nt, Shigella flexneri 2a str. 2457T
cggcucggcuccgggcg

SEQ ID NO: 1907822 - RNA, 23 nt, Shigella flexneri 2a str. 2457T
cggcugauaacaauaucaaaugc

SEQ ID NO: 1907823 - RNA, 14 nt, Shigella flexneri 2a str. 2457T
cggcgaaaacgcca

SEQ ID NO: 1907824 - RNA, 13 nt, Shigella flexneri 2a str. 2457T
cggccuuuuccuu

SEQ ID NO: 1907825 - RNA, 18 nt, Shigella flexneri 2a str. 2457T
cggcgaagauacccgcga

SEQ ID NO: 1907826 - RNA, 13 nt, Shigella flexneri 2a str. 2457T
cggcgacccgcga

SEQ ID NO: 1907827 - RNA, 17 nt, Shigella flexneri 2a str. 2457T
cggcgagcaacgcagcg

SEQ ID NO: 1907828 - RNA, 20 nt, Shigella flexneri 2a str. 2457T
cggcgagauaaugcgauaac

SEQ ID NO: 1907829 - RNA, 22 nt, Shigella flexneri 2a str. 2457T
cggcgaccguucgccaggucag

SEQ ID NO: 1907830 - RNA, 14 nt, Shigella flexneri 2a str. 2457T
cggcgauuuacagc

SEQ ID NO: 1907831 - RNA, 18 nt, Shigella flexneri 2a str. 2457T
cggcgaucuuuuaauaau

SEQ ID NO: 1907832 - RNA, 11 nt, Shigella flexneri 2a str. 2457T
cggcgcgcgcu

SEQ ID NO: 1907833 - RNA, 22 nt, Shigella flexneri 2a str. 2457T
cccugcuguuuuuucaggcccu

SEQ ID NO: 1907834 - RNA, 21 nt, Shigella flexneri 2a str. 2457T
cccugcucuuucagcaccgcg

SEQ ID NO: 1907835 - RNA, 20 nt, Shigella flexneri 2a str. 2457T
cccugcuaugcaagauguua

SEQ ID NO: 1907836 - RNA, 17 nt, Shigella flexneri 2a str. 2457T
cccugcgguuucaacga

SEQ ID NO: 1907837 - RNA, 17 nt, Shigella flexneri 2a str. 2457T
cccuggccugaccgaug

SEQ ID NO: 1907838 - RNA, 15 nt, Shigella flexneri 2a str. 2457T
cccuggaugcaguca

SEQ ID NO: 1907839 - RNA, 15 nt, Shigella flexneri 2a str. 2457T
cccugcuuugcaagc

SEQ ID NO: 1907840 - RNA, 18 nt, Shigella flexneri 2a str. 2457T
cccugcccguugccagga

SEQ ID NO: 1907841 - RNA, 14 nt, Shigella flexneri 2a str. 2457T
cccugccgcggucu

SEQ ID NO: 1907842 - RNA, 23 nt, Shigella flexneri 2a str. 2457T
cccugccaggucaucauugcagu

SEQ ID NO: 1907843 - RNA, 23 nt, Shigella flexneri 2a str. 2457T
cccugcauauaaucgauccccaa

SEQ ID NO: 1907844 - RNA, 18 nt, Shigella flexneri 2a str. 2457T
cccugcagucaccugccc

SEQ ID NO: 1907845 - RNA, 18 nt, Shigella flexneri 2a str. 2457T
cccugcgcuggugaaaac

SEQ ID NO: 1907846 - RNA, 19 nt, Shigella flexneri 2a str. 2457T
cccugcgcuaaacaggauc

SEQ ID NO: 1907847 - RNA, 15 nt, Shigella flexneri 2a str. 2457T
cccugcgccagcggc

SEQ ID NO: 1907848 - RNA, 14 nt, Shigella flexneri 2a str. 2457T
cccucuucagccgc

SEQ ID NO: 1907849 - RNA, 13 nt, Shigella flexneri 2a str. 2457T
ccccuuccugcug

SEQ ID NO: 1907850 - RNA, 18 nt, Shigella flexneri 2a str. 2457T
cccugcaauuauuaaccu

SEQ ID NO: 1907851 - RNA, 21 nt, Shigella flexneri 2a str. 2457T
cccugcacuuaacaggaucug

SEQ ID NO: 1907852 - RNA, 19 nt, Shigella flexneri 2a str. 2457T
cccugcacuuaacaggauc

SEQ ID NO: 1907853 - RNA, 15 nt, Shigella flexneri 2a str. 2457T
cccugauaaccgcau

SEQ ID NO: 1907854 - RNA, 16 nt, Shigella flexneri 2a str. 2457T
cccugaucggccauga

SEQ ID NO: 1907855 - RNA, 22 nt, Shigella flexneri 2a str. 2457T
cccugaauaacaccagccagaa

SEQ ID NO: 1907856 - RNA, 10 nt, Shigella flexneri 2a str. 2457T
cccugaguga

SEQ ID NO: 1907857 - RNA, 16 nt, Shigella flexneri 2a str. 2457T
cccugagcaucaauac

SEQ ID NO: 1907858 - RNA, 17 nt, Shigella flexneri 2a str. 2457T
cccugagacaguuauua

SEQ ID NO: 1907859 - RNA, 14 nt, Shigella flexneri 2a str. 2457T
cccuucucaauccc

SEQ ID NO: 1907860 - RNA, 13 nt, Shigella flexneri 2a str. 2457T
cccuugcaggcga

SEQ ID NO: 1907861 - RNA, 23 nt, Shigella flexneri 2a str. 2457T
cccuugaugcagauucggguuca

SEQ ID NO: 1907862 - RNA, 22 nt, Shigella flexneri 2a str. 2457T
cccuugauguggcggauggcga

SEQ ID NO: 1907863 - RNA, 19 nt, Shigella flexneri 2a str. 2457T
ccgaacagcgccagacaaa

SEQ ID NO: 1907864 - RNA, 18 nt, Shigella flexneri 2a str. 2457T
ccgaaaaaccgggugcag

SEQ ID NO: 1907865 - RNA, 21 nt, Shigella flexneri 2a str. 2457T
ccgaagcccaucaguacacca

SEQ ID NO: 1907866 - RNA, 22 nt, Shigella flexneri 2a str. 2457T
ccgaagcccaucaguacaccac

SEQ ID NO: 1907867 - RNA, 17 nt, Shigella flexneri 2a str. 2457T
ccgaaggugcacuagac

SEQ ID NO: 1907868 - RNA, 15 nt, Shigella flexneri 2a str. 2457T
ccgaauccaguaagc

SEQ ID NO: 1907869 - RNA, 18 nt, Shigella flexneri 2a str. 2457T
ccgaaguuguagcuggcu

SEQ ID NO: 1907870 - RNA, 15 nt, Shigella flexneri 2a str. 2457T
ccgaagaaguaagcu

SEQ ID NO: 1907871 - RNA, 22 nt, Shigella flexneri 2a str. 2457T
ccgaacagcgccagacaaacca

SEQ ID NO: 1907872 - RNA, 23 nt, Shigella flexneri 2a str. 2457T
ccgaacagcgccagacaaaccac

SEQ ID NO: 1907873 - RNA, 19 nt, Shigella flexneri 2a str. 2457T
ccgaaccagugcuccaccu

SEQ ID NO: 1907874 - RNA, 20 nt, Shigella flexneri 2a str. 2457T
cccuucaucacgcagcguca

SEQ ID NO: 1907875 - RNA, 20 nt, Shigella flexneri 2a str. 2457T
cccuuccagauucaguuuca

SEQ ID NO: 1907876 - RNA, 18 nt, Shigella flexneri 2a str. 2457T
cccuuccccguucugcca

SEQ ID NO: 1907877 - RNA, 14 nt, Shigella flexneri 2a str. 2457T
cccuucgccgccgc

SEQ ID NO: 1907878 - RNA, 16 nt, Shigella flexneri 2a str. 2457T
cccuuauugcuaauga

SEQ ID NO: 1907879 - RNA, 15 nt, Shigella flexneri 2a str. 2457T
cccuuacccuuacuc

SEQ ID NO: 1907880 - RNA, 22 nt, Shigella flexneri 2a str. 2457T
cccuuacgcguucauacuuuuc

SEQ ID NO: 1907881 - RNA, 22 nt, Shigella flexneri 2a str. 2457T
cccuguuugguugccagccaca

SEQ ID NO: 1907882 - RNA, 22 nt, Shigella flexneri 2a str. 2457T
cccuguuuuauuucccgcccgc

SEQ ID NO: 1907883 - RNA, 23 nt, Shigella flexneri 2a str. 2457T
cccuguuugguugccagccacac

SEQ ID NO: 1907884 - RNA, 18 nt, Shigella flexneri 2a str. 2457T
cccugugcgcccuguucu

SEQ ID NO: 1907885 - RNA, 15 nt, Shigella flexneri 2a str. 2457T
cccugugcgccaccg

SEQ ID NO: 1907886 - RNA, 15 nt, Shigella flexneri 2a str. 2457T
cccuguaauugccug

SEQ ID NO: 1907887 - RNA, 14 nt, Shigella flexneri 2a str. 2457T
cccugggcaccgac

SEQ ID NO: 1907888 - RNA, 15 nt, Shigella flexneri 2a str. 2457T
cccugggcuucaucc

SEQ ID NO: 1907889 - RNA, 23 nt, Shigella flexneri 2a str. 2457T
cccuggggagugaccuuaccacc

SEQ ID NO: 1907890 - RNA, 17 nt, Shigella flexneri 2a str. 2457T
cccuggucaguuucagc

SEQ ID NO: 1907891 - RNA, 22 nt, Shigella flexneri 2a str. 2457T
cccugguggcauugguugcugg

SEQ ID NO: 1907892 - RNA, 17 nt, Shigella flexneri 2a str. 2457T
ccgaugaguuaagaaga

SEQ ID NO: 1907893 - RNA, 22 nt, Shigella flexneri 2a str. 2457T
ccgaugaucaacagcaucaucg

SEQ ID NO: 1907894 - RNA, 13 nt, Shigella flexneri 2a str. 2457T
ccgaugaacuggc

SEQ ID NO: 1907895 - RNA, 14 nt, Shigella flexneri 2a str. 2457T
ccgaugauucccag

SEQ ID NO: 1907896 - RNA, 19 nt, Shigella flexneri 2a str. 2457T
ccgauucccgggcacacuu

SEQ ID NO: 1907897 - RNA, 17 nt, Shigella flexneri 2a str. 2457T
ccgauuacucagcaacu

SEQ ID NO: 1907898 - RNA, 14 nt, Shigella flexneri 2a str. 2457T
ccgcaacaaugccg

SEQ ID NO: 1907899 - RNA, 20 nt, Shigella flexneri 2a str. 2457T
ccgcaacagugaaauacagu

SEQ ID NO: 1907900 - RNA, 23 nt, Shigella flexneri 2a str. 2457T
ccgcaaccggccguaagaaaguc

SEQ ID NO: 1907901 - RNA, 15 nt, Shigella flexneri 2a str. 2457T
ccgcaacagcaauac

SEQ ID NO: 1907902 - RNA, 18 nt, Shigella flexneri 2a str. 2457T
ccgauuuuguaaaagaag

SEQ ID NO: 1907903 - RNA, 20 nt, Shigella flexneri 2a str. 2457T
ccgcaaaaggcgaaacgccu

SEQ ID NO: 1907904 - RNA, 11 nt, Shigella flexneri 2a str. 2457T
ccgcaaagccc

SEQ ID NO: 1907905 - RNA, 18 nt, Shigella flexneri 2a str. 2457T
ccgauuuugccuucauac

SEQ ID NO: 1907906 - RNA, 17 nt, Shigella flexneri 2a str. 2457T
ccgcacucuacuucuuc

SEQ ID NO: 1907907 - RNA, 22 nt, Shigella flexneri 2a str. 2457T
ccgcacucguaucaccccgccc

SEQ ID NO: 1907908 - RNA, 21 nt, Shigella flexneri 2a str. 2457T
ccgcaccccugauaaccgcau

SEQ ID NO: 1907909 - RNA, 13 nt, Shigella flexneri 2a str. 2457T
ccgcaccaggcag

SEQ ID NO: 1907910 - RNA, 14 nt, Shigella flexneri 2a str. 2457T
ccgcaccaccagca

SEQ ID NO: 1907911 - RNA, 19 nt, Shigella flexneri 2a str. 2457T
ccgcagucauggcucuucc

SEQ ID NO: 1907912 - RNA, 18 nt, Shigella flexneri 2a str. 2457T
ccgcaggcgcaauggcgc

SEQ ID NO: 1907913 - RNA, 14 nt, Shigella flexneri 2a str. 2457T
ccgcagccaucaac

SEQ ID NO: 1907914 - RNA, 14 nt, Shigella flexneri 2a str. 2457T
ccgcagccaucagc

SEQ ID NO: 1907915 - RNA, 21 nt, Shigella flexneri 2a str. 2457T
ccgcagccaucacugacugcg

SEQ ID NO: 1907916 - RNA, 13 nt, Shigella flexneri 2a str. 2457T
ccgcagccccaga

SEQ ID NO: 1907917 - RNA, 18 nt, Shigella flexneri 2a str. 2457T
ccgacgauaccgccgcac

SEQ ID NO: 1907918 - RNA, 13 nt, Shigella flexneri 2a str. 2457T
ccgacgugcagca

SEQ ID NO: 1907919 - RNA, 14 nt, Shigella flexneri 2a str. 2457T
ccgagaagcagcaa

SEQ ID NO: 1907920 - RNA, 23 nt, Shigella flexneri 2a str. 2457T
ccgacuuuaucgcgcaaaaaauc

SEQ ID NO: 1907921 - RNA, 19 nt, Shigella flexneri 2a str. 2457T
ccgacucacuugcagucgg

SEQ ID NO: 1907922 - RNA, 23 nt, Shigella flexneri 2a str. 2457T
ccgagauaaugguuuccagcauc

SEQ ID NO: 1907923 - RNA, 15 nt, Shigella flexneri 2a str. 2457T
ccgagcaccacguug

SEQ ID NO: 1907924 - RNA, 14 nt, Shigella flexneri 2a str. 2457T
ccgaucaucaucca

SEQ ID NO: 1907925 - RNA, 18 nt, Shigella flexneri 2a str. 2457T
ccgaucaucaaaaaacac

SEQ ID NO: 1907926 - RNA, 17 nt, Shigella flexneri 2a str. 2457T
ccgauaaccgcaaaacc

SEQ ID NO: 1907927 - RNA, 13 nt, Shigella flexneri 2a str. 2457T
ccgaucaaacgcc

SEQ ID NO: 1907928 - RNA, 13 nt, Shigella flexneri 2a str. 2457T
ccgaguggcauuu

SEQ ID NO: 1907929 - RNA, 23 nt, Shigella flexneri 2a str. 2457T
ccgaguggcauuucgccaaacca

SEQ ID NO: 1907930 - RNA, 15 nt, Shigella flexneri 2a str. 2457T
ccgagcgccaccauc

SEQ ID NO: 1907931 - RNA, 20 nt, Shigella flexneri 2a str. 2457T
ccgaggcgcuggcagaaggc

SEQ ID NO: 1907932 - RNA, 23 nt, Shigella flexneri 2a str. 2457T
ccgagcuuaugcaauagcgccug

SEQ ID NO: 1907933 - RNA, 23 nt, Shigella flexneri 2a str. 2457T
ccgaggggcugacgcaacugguc

SEQ ID NO: 1907934 - RNA, 23 nt, Shigella flexneri 2a str. 2457T
ccggacacugcuuacaggcuggu

SEQ ID NO: 1907935 - RNA, 22 nt, Shigella flexneri 2a str. 2457T
ccggacacugcuuacaggcugg

SEQ ID NO: 1907936 - RNA, 22 nt, Shigella flexneri 2a str. 2457T
ccggauaaggcauuuacgccgc

SEQ ID NO: 1907937 - RNA, 14 nt, Shigella flexneri 2a str. 2457T
ccggauaaacaaug

SEQ ID NO: 1907938 - RNA, 15 nt, Shigella flexneri 2a str. 2457T
ccggauaaacaaugu

SEQ ID NO: 1907939 - RNA, 15 nt, Shigella flexneri 2a str. 2457T
ccggagaagcguagg

SEQ ID NO: 1907940 - RNA, 23 nt, Shigella flexneri 2a str. 2457T
ccggaacaggcagggccaccagc

SEQ ID NO: 1907941 - RNA, 21 nt, Shigella flexneri 2a str. 2457T
ccggaaccggauuuucaccau

SEQ ID NO: 1907942 - RNA, 14 nt, Shigella flexneri 2a str. 2457T
ccggaacccaccgc

SEQ ID NO: 1907943 - RNA, 19 nt, Shigella flexneri 2a str. 2457T
ccggaacuugccgggcgca

SEQ ID NO: 1907944 - RNA, 20 nt, Shigella flexneri 2a str. 2457T
ccggaacuugccgggcgcag

SEQ ID NO: 1907945 - RNA, 15 nt, Shigella flexneri 2a str. 2457T
ccggaauagcuuuac

SEQ ID NO: 1907946 - RNA, 18 nt, Shigella flexneri 2a str. 2457T
ccgcuuuccaggcugugu

SEQ ID NO: 1907947 - RNA, 14 nt, Shigella flexneri 2a str. 2457T
ccgcuuuuccagca

SEQ ID NO: 1907948 - RNA, 14 nt, Shigella flexneri 2a str. 2457T
ccgcuuuggcgucu

SEQ ID NO: 1907949 - RNA, 22 nt, Shigella flexneri 2a str. 2457T
ccggaaaagguguucacgccgc

SEQ ID NO: 1907950 - RNA, 14 nt, Shigella flexneri 2a str. 2457T
ccgcuuuugcgcgu

SEQ ID NO: 1907951 - RNA, 12 nt, Shigella flexneri 2a str. 2457T
ccgcuuuuucaa

SEQ ID NO: 1907952 - RNA, 19 nt, Shigella flexneri 2a str. 2457T
ccggcaauaaaacagggcg

SEQ ID NO: 1907953 - RNA, 23 nt, Shigella flexneri 2a str. 2457T
ccggcaauaaaacagggcggaac

SEQ ID NO: 1907954 - RNA, 16 nt, Shigella flexneri 2a str. 2457T
ccggcaauaaaacagg

SEQ ID NO: 1907955 - RNA, 19 nt, Shigella flexneri 2a str. 2457T
ccggcaaucggugcaaaug

SEQ ID NO: 1907956 - RNA, 23 nt, Shigella flexneri 2a str. 2457T
ccggcaaucggugcaaaugccag

SEQ ID NO: 1907957 - RNA, 16 nt, Shigella flexneri 2a str. 2457T
ccggcaccugucagac

SEQ ID NO: 1907958 - RNA, 11 nt, Shigella flexneri 2a str. 2457T
ccggcaccuuu

SEQ ID NO: 1907959 - RNA, 22 nt, Shigella flexneri 2a str. 2457T
ccggauaaggcguucgcgccgc

SEQ ID NO: 1907960 - RNA, 22 nt, Shigella flexneri 2a str. 2457T
ccggauaaggcguuuacgccgc

SEQ ID NO: 1907961 - RNA, 18 nt, Shigella flexneri 2a str. 2457T
ccggcaacgacugcgagc

SEQ ID NO: 1907962 - RNA, 18 nt, Shigella flexneri 2a str. 2457T
ccggcaacgucaguccca

SEQ ID NO: 1907963 - RNA, 13 nt, Shigella flexneri 2a str. 2457T
ccggcaagauucc

SEQ ID NO: 1907964 - RNA, 22 nt, Shigella flexneri 2a str. 2457T
ccggcagagaaaaugccgcaca

SEQ ID NO: 1907965 - RNA, 18 nt, Shigella flexneri 2a str. 2457T
ccggcagaagcaaucauc

SEQ ID NO: 1907966 - RNA, 15 nt, Shigella flexneri 2a str. 2457T
ccggcagcaugugua

SEQ ID NO: 1907967 - RNA, 19 nt, Shigella flexneri 2a str. 2457T
ccggcauucagugcaaaug

SEQ ID NO: 1907968 - RNA, 19 nt, Shigella flexneri 2a str. 2457T
ccggcauuaucacaucagc

SEQ ID NO: 1907969 - RNA, 23 nt, Shigella flexneri 2a str. 2457T
ccgcuaucguccacgucaucaaa

SEQ ID NO: 1907970 - RNA, 20 nt, Shigella flexneri 2a str. 2457T
ccgcuaacugguggcaggaa

SEQ ID NO: 1907971 - RNA, 15 nt, Shigella flexneri 2a str. 2457T
ccgcuaacagcagca

SEQ ID NO: 1907972 - RNA, 14 nt, Shigella flexneri 2a str. 2457T
ccgcguugcagcau

SEQ ID NO: 1907973 - RNA, 21 nt, Shigella flexneri 2a str. 2457T
ccgcuggagcggggaacaccu

SEQ ID NO: 1907974 - RNA, 22 nt, Shigella flexneri 2a str. 2457T
ccgcuggcccaucagaauaucg

SEQ ID NO: 1907975 - RNA, 16 nt, Shigella flexneri 2a str. 2457T
ccgcuucauugaccuu

SEQ ID NO: 1907976 - RNA, 14 nt, Shigella flexneri 2a str. 2457T
ccgcuucacucccu

SEQ ID NO: 1907977 - RNA, 19 nt, Shigella flexneri 2a str. 2457T
ccgcuucaaucuucgauuu

SEQ ID NO: 1907978 - RNA, 14 nt, Shigella flexneri 2a str. 2457T
ccgcuucaccaauc

SEQ ID NO: 1907979 - RNA, 22 nt, Shigella flexneri 2a str. 2457T
ccgcuucaacgaccgcuuuugu

SEQ ID NO: 1907980 - RNA, 13 nt, Shigella flexneri 2a str. 2457T
ccgcuuccagcau

SEQ ID NO: 1907981 - RNA, 14 nt, Shigella flexneri 2a str. 2457T
ccgcuuccagcucc

SEQ ID NO: 1907982 - RNA, 10 nt, Shigella flexneri 2a str. 2457T
ccgcuucccu

SEQ ID NO: 1907983 - RNA, 23 nt, Shigella flexneri 2a str. 2457T
ccgcuauuauaucgcucucuuua

SEQ ID NO: 1907984 - RNA, 11 nt, Shigella flexneri 2a str. 2457T
ccgcucaaaca

SEQ ID NO: 1907985 - RNA, 20 nt, Shigella flexneri 2a str. 2457T
ccgcucacgaugccgccgag

SEQ ID NO: 1907986 - RNA, 15 nt, Shigella flexneri 2a str. 2457T
ccgcucuuccaggca

SEQ ID NO: 1907987 - RNA, 20 nt, Shigella flexneri 2a str. 2457T
ccgccguccggcgcugaucu

SEQ ID NO: 1907988 - RNA, 19 nt, Shigella flexneri 2a str. 2457T
ccgccucacuauccgcccc

SEQ ID NO: 1907989 - RNA, 15 nt, Shigella flexneri 2a str. 2457T
ccgccucagccagaa

SEQ ID NO: 1907990 - RNA, 19 nt, Shigella flexneri 2a str. 2457T
ccgccguuagcuucagccg

SEQ ID NO: 1907991 - RNA, 14 nt, Shigella flexneri 2a str. 2457T
ccgccguugcucuu

SEQ ID NO: 1907992 - RNA, 15 nt, Shigella flexneri 2a str. 2457T
ccgccucccuucgcu

SEQ ID NO: 1907993 - RNA, 17 nt, Shigella flexneri 2a str. 2457T
ccgccugagccagugcc

SEQ ID NO: 1907994 - RNA, 19 nt, Shigella flexneri 2a str. 2457T
ccgcgacugggaggacagc

SEQ ID NO: 1907995 - RNA, 19 nt, Shigella flexneri 2a str. 2457T
ccgcgacgacgacaggcaa

SEQ ID NO: 1907996 - RNA, 20 nt, Shigella flexneri 2a str. 2457T
ccgcgacgacgacaggcaag

SEQ ID NO: 1907997 - RNA, 21 nt, Shigella flexneri 2a str. 2457T
ccgcgcaaucgcccagcgcgu

SEQ ID NO: 1907998 - RNA, 16 nt, Shigella flexneri 2a str. 2457T
ccgcgcaauggcuggc

SEQ ID NO: 1907999 - RNA, 21 nt, Shigella flexneri 2a str. 2457T
ccgccugaugggcgaagagaa

SEQ ID NO: 1908000 - RNA, 12 nt, Shigella flexneri 2a str. 2457T
ccgccuugcugu

SEQ ID NO: 1908001 - RNA, 16 nt, Shigella flexneri 2a str. 2457T
ccgccuugauauaaau

SEQ ID NO: 1908002 - RNA, 16 nt, Shigella flexneri 2a str. 2457T
ccgcgccgcugagaaa

SEQ ID NO: 1908003 - RNA, 11 nt, Shigella flexneri 2a str. 2457T
ccgccccugca

SEQ ID NO: 1908004 - RNA, 21 nt, Shigella flexneri 2a str. 2457T
ccgcaguuucugauacugcuc

SEQ ID NO: 1908005 - RNA, 16 nt, Shigella flexneri 2a str. 2457T
ccgccaucucuuccag

SEQ ID NO: 1908006 - RNA, 13 nt, Shigella flexneri 2a str. 2457T
ccgccaucuucuu

SEQ ID NO: 1908007 - RNA, 18 nt, Shigella flexneri 2a str. 2457T
ccgccaucucuuccagcg

SEQ ID NO: 1908008 - RNA, 18 nt, Shigella flexneri 2a str. 2457T
ccgccauuaaacgcagua

SEQ ID NO: 1908009 - RNA, 13 nt, Shigella flexneri 2a str. 2457T
ccgcccccgggcc

SEQ ID NO: 1908010 - RNA, 18 nt, Shigella flexneri 2a str. 2457T
ccgcccccgggccucccc

SEQ ID NO: 1908011 - RNA, 19 nt, Shigella flexneri 2a str. 2457T
ccgcccccgggccuccccu

SEQ ID NO: 1908012 - RNA, 21 nt, Shigella flexneri 2a str. 2457T
ccgccgcuauuauaucgcucu

SEQ ID NO: 1908013 - RNA, 20 nt, Shigella flexneri 2a str. 2457T
ccgccgccauuugggcggcu

SEQ ID NO: 1908014 - RNA, 14 nt, Shigella flexneri 2a str. 2457T
ccgccgcuccucau

SEQ ID NO: 1908015 - RNA, 23 nt, Shigella flexneri 2a str. 2457T
ccugcucaaacuucgucacagcg

SEQ ID NO: 1908016 - RNA, 18 nt, Shigella flexneri 2a str. 2457T
ccugcguuuguccgccgg

SEQ ID NO: 1908017 - RNA, 14 nt, Shigella flexneri 2a str. 2457T
ccugcgugacuaaa

SEQ ID NO: 1908018 - RNA, 16 nt, Shigella flexneri 2a str. 2457T
ccugcucuuucagcac

SEQ ID NO: 1908019 - RNA, 17 nt, Shigella flexneri 2a str. 2457T
ccugcucugccagacgg

SEQ ID NO: 1908020 - RNA, 12 nt, Shigella flexneri 2a str. 2457T
ccugcucugcca

SEQ ID NO: 1908021 - RNA, 16 nt, Shigella flexneri 2a str. 2457T
ccugcucgucauccgc

SEQ ID NO: 1908022 - RNA, 22 nt, Shigella flexneri 2a str. 2457T
ccugcugauggcgggaugugua

SEQ ID NO: 1908023 - RNA, 20 nt, Shigella flexneri 2a str. 2457T
ccugcugcacgcccugauaa

SEQ ID NO: 1908024 - RNA, 16 nt, Shigella flexneri 2a str. 2457T
ccuggaugacccggaa

SEQ ID NO: 1908025 - RNA, 16 nt, Shigella flexneri 2a str. 2457T
ccuggcuaccauccgc

SEQ ID NO: 1908026 - RNA, 18 nt, Shigella flexneri 2a str. 2457T
ccugggcgaugcuggcag

SEQ ID NO: 1908027 - RNA, 15 nt, Shigella flexneri 2a str. 2457T
ccuggcgucuggccc

SEQ ID NO: 1908028 - RNA, 15 nt, Shigella flexneri 2a str. 2457T
ccuggcggggauuau

SEQ ID NO: 1908029 - RNA, 20 nt, Shigella flexneri 2a str. 2457T
ccuggcgggaauaaaagcca

SEQ ID NO: 1908030 - RNA, 13 nt, Shigella flexneri 2a str. 2457T
ccuggcacagcag

SEQ ID NO: 1908031 - RNA, 16 nt, Shigella flexneri 2a str. 2457T
ccuggcauguggcggc

SEQ ID NO: 1908032 - RNA, 20 nt, Shigella flexneri 2a str. 2457T
ccuggcggaagagcacacau

SEQ ID NO: 1908033 - RNA, 13 nt, Shigella flexneri 2a str. 2457T
ccuguacggcagu

SEQ ID NO: 1908034 - RNA, 15 nt, Shigella flexneri 2a str. 2457T
ccuguacuguuucac

SEQ ID NO: 1908035 - RNA, 20 nt, Shigella flexneri 2a str. 2457T
ccuguacgucgagaauaucg

SEQ ID NO: 1908036 - RNA, 18 nt, Shigella flexneri 2a str. 2457T
ccugggcuucauccagca

SEQ ID NO: 1908037 - RNA, 14 nt, Shigella flexneri 2a str. 2457T
ccugucgaggccaa

SEQ ID NO: 1908038 - RNA, 20 nt, Shigella flexneri 2a str. 2457T
ccugucgcuuugacugcuuu

SEQ ID NO: 1908039 - RNA, 23 nt, Shigella flexneri 2a str. 2457T
ccugucgggugcuuuuuucaauu

SEQ ID NO: 1908040 - RNA, 18 nt, Shigella flexneri 2a str. 2457T
ccugugccugagccggag

SEQ ID NO: 1908041 - RNA, 13 nt, Shigella flexneri 2a str. 2457T
ccuguaucccagu

SEQ ID NO: 1908042 - RNA, 21 nt, Shigella flexneri 2a str. 2457T
ccugucauacgcguaaaacag

SEQ ID NO: 1908043 - RNA, 21 nt, Shigella flexneri 2a str. 2457T
ccuguaucaggcuguguuuaa

SEQ ID NO: 1908044 - RNA, 22 nt, Shigella flexneri 2a str. 2457T
ccuguaguguguugcaauacac

SEQ ID NO: 1908045 - RNA, 23 nt, Shigella flexneri 2a str. 2457T
ccugcacggagauauccagcgcc

SEQ ID NO: 1908046 - RNA, 22 nt, Shigella flexneri 2a str. 2457T
ccugcacggagauauccagcgc

SEQ ID NO: 1908047 - RNA, 16 nt, Shigella flexneri 2a str. 2457T
ccugcacgaccggguu

SEQ ID NO: 1908048 - RNA, 19 nt, Shigella flexneri 2a str. 2457T
ccugaauggugaccugcag

SEQ ID NO: 1908049 - RNA, 18 nt, Shigella flexneri 2a str. 2457T
ccugaaucaccugauuga

SEQ ID NO: 1908050 - RNA, 12 nt, Shigella flexneri 2a str. 2457T
ccugaauaaacg

SEQ ID NO: 1908051 - RNA, 13 nt, Shigella flexneri 2a str. 2457T
ccugaauaaacgc

SEQ ID NO: 1908052 - RNA, 16 nt, Shigella flexneri 2a str. 2457T
ccugaauaaacgccau

SEQ ID NO: 1908053 - RNA, 15 nt, Shigella flexneri 2a str. 2457T
ccugaauaacaccag

SEQ ID NO: 1908054 - RNA, 23 nt, Shigella flexneri 2a str. 2457T
ccugcaauuuauugauuuugcaa

SEQ ID NO: 1908055 - RNA, 17 nt, Shigella flexneri 2a str. 2457T
ccugcaagguggucaga

SEQ ID NO: 1908056 - RNA, 18 nt, Shigella flexneri 2a str. 2457T
ccugaaugucuccauacu

SEQ ID NO: 1908057 - RNA, 22 nt, Shigella flexneri 2a str. 2457T
ccugccgcaggacgggcaauuc

SEQ ID NO: 1908058 - RNA, 18 nt, Shigella flexneri 2a str. 2457T
ccugcccgcgauccagcg

SEQ ID NO: 1908059 - RNA, 14 nt, Shigella flexneri 2a str. 2457T
ccugcagucaccug

SEQ ID NO: 1908060 - RNA, 21 nt, Shigella flexneri 2a str. 2457T
ccugcauacgacgugccgcag

SEQ ID NO: 1908061 - RNA, 23 nt, Shigella flexneri 2a str. 2457T
ccugcauaucgguaaaugcuuua

SEQ ID NO: 1908062 - RNA, 17 nt, Shigella flexneri 2a str. 2457T
ccugcauugacucgccu

SEQ ID NO: 1908063 - RNA, 17 nt, Shigella flexneri 2a str. 2457T
ccugcggcggcaucgcc

SEQ ID NO: 1908064 - RNA, 18 nt, Shigella flexneri 2a str. 2457T
ccugcgggagcgcuuuuu

SEQ ID NO: 1908065 - RNA, 23 nt, Shigella flexneri 2a str. 2457T
ccugcgggagcgcuuuuuuccug

SEQ ID NO: 1908066 - RNA, 21 nt, Shigella flexneri 2a str. 2457T
ccugcgggaugguuggucugg

SEQ ID NO: 1908067 - RNA, 16 nt, Shigella flexneri 2a str. 2457T
ccugcgcgcccgccgc

SEQ ID NO: 1908068 - RNA, 18 nt, Shigella flexneri 2a str. 2457T
ccugcgcgcccgccgccu

SEQ ID NO: 1908069 - RNA, 18 nt, Shigella flexneri 2a str. 2457T
ccugcgcggcaaugcgcc

SEQ ID NO: 1908070 - RNA, 17 nt, Shigella flexneri 2a str. 2457T
ccugcgcuuccugcaac

SEQ ID NO: 1908071 - RNA, 13 nt, Shigella flexneri 2a str. 2457T
ccugcggaaccgg

SEQ ID NO: 1908072 - RNA, 14 nt, Shigella flexneri 2a str. 2457T
ccugcggaaccggu

SEQ ID NO: 1908073 - RNA, 15 nt, Shigella flexneri 2a str. 2457T
ccugcggccagcagc

SEQ ID NO: 1908074 - RNA, 19 nt, Shigella flexneri 2a str. 2457T
ccugcggcaccuaauaacu

SEQ ID NO: 1908075 - RNA, 15 nt, Shigella flexneri 2a str. 2457T
ccugcggcaacgcuc

SEQ ID NO: 1908076 - RNA, 15 nt, Shigella flexneri 2a str. 2457T
ccugcgccagcgcgc

SEQ ID NO: 1908077 - RNA, 14 nt, Shigella flexneri 2a str. 2457T
ccugcgccagcggc

SEQ ID NO: 1908078 - RNA, 15 nt, Shigella flexneri 2a str. 2457T
ccugcgccagccagc

SEQ ID NO: 1908079 - RNA, 13 nt, Shigella flexneri 2a str. 2457T
ccugccugacgga

SEQ ID NO: 1908080 - RNA, 17 nt, Shigella flexneri 2a str. 2457T
ccugccugcagcugcuc

SEQ ID NO: 1908081 - RNA, 13 nt, Shigella flexneri 2a str. 2457T
ccugcgacaggga

SEQ ID NO: 1908082 - RNA, 16 nt, Shigella flexneri 2a str. 2457T
ccugaagcguccgcuu

SEQ ID NO: 1908083 - RNA, 13 nt, Shigella flexneri 2a str. 2457T
ccugaagaucaac

SEQ ID NO: 1908084 - RNA, 15 nt, Shigella flexneri 2a str. 2457T
ccugaagaugcugca

SEQ ID NO: 1908085 - RNA, 18 nt, Shigella flexneri 2a str. 2457T
ccugaaccgaacuuuuug

SEQ ID NO: 1908086 - RNA, 13 nt, Shigella flexneri 2a str. 2457T
ccugaacaagcaa

SEQ ID NO: 1908087 - RNA, 18 nt, Shigella flexneri 2a str. 2457T
ccugaaagcgugucaugu

SEQ ID NO: 1908088 - RNA, 12 nt, Shigella flexneri 2a str. 2457T
ccugaaaguauu

SEQ ID NO: 1908089 - RNA, 23 nt, Shigella flexneri 2a str. 2457T
ccugaaaguauuugacuguucua

SEQ ID NO: 1908090 - RNA, 21 nt, Shigella flexneri 2a str. 2457T
ccucuuuuuauuuacucuccu

SEQ ID NO: 1908091 - RNA, 13 nt, Shigella flexneri 2a str. 2457T
ccugaaaacgaaa

SEQ ID NO: 1908092 - RNA, 21 nt, Shigella flexneri 2a str. 2457T
ccugaaacgcggcguaaccgc

SEQ ID NO: 1908093 - RNA, 23 nt, Shigella flexneri 2a str. 2457T
ccugaaacgcggcguaaccgccc

SEQ ID NO: 1908094 - RNA, 14 nt, Shigella flexneri 2a str. 2457T
ccucuucugccugc

SEQ ID NO: 1908095 - RNA, 16 nt, Shigella flexneri 2a str. 2457T
ccucuucggcagucac

SEQ ID NO: 1908096 - RNA, 15 nt, Shigella flexneri 2a str. 2457T
ccucucaugagcaga

SEQ ID NO: 1908097 - RNA, 18 nt, Shigella flexneri 2a str. 2457T
ccucguuucgcccugccu

SEQ ID NO: 1908098 - RNA, 22 nt, Shigella flexneri 2a str. 2457T
ccucucccgaaugaccgccccu

SEQ ID NO: 1908099 - RNA, 21 nt, Shigella flexneri 2a str. 2457T
ccucuccccgaaggggcgagg

SEQ ID NO: 1908100 - RNA, 15 nt, Shigella flexneri 2a str. 2457T
ccucguuuugccgcc

SEQ ID NO: 1908101 - RNA, 18 nt, Shigella flexneri 2a str. 2457T
ccucgggauccaugcacg

SEQ ID NO: 1908102 - RNA, 17 nt, Shigella flexneri 2a str. 2457T
ccuccuuuuaucaucac

SEQ ID NO: 1908103 - RNA, 22 nt, Shigella flexneri 2a str. 2457T
ccucgcgcguccacggugcgac

SEQ ID NO: 1908104 - RNA, 17 nt, Shigella flexneri 2a str. 2457T
ccuacgugcgcaauaac

SEQ ID NO: 1908105 - RNA, 14 nt, Shigella flexneri 2a str. 2457T
ccucaucaccacag

SEQ ID NO: 1908106 - RNA, 14 nt, Shigella flexneri 2a str. 2457T
ccuccagcuccucg

SEQ ID NO: 1908107 - RNA, 19 nt, Shigella flexneri 2a str. 2457T
ccuccacgauauccagcgu

SEQ ID NO: 1908108 - RNA, 18 nt, Shigella flexneri 2a str. 2457T
ccuccacauucagucccg

SEQ ID NO: 1908109 - RNA, 15 nt, Shigella flexneri 2a str. 2457T
ccuccaaaaaacaaa

SEQ ID NO: 1908110 - RNA, 23 nt, Shigella flexneri 2a str. 2457T
ccuccgggaccuuucugaugcau

SEQ ID NO: 1908111 - RNA, 15 nt, Shigella flexneri 2a str. 2457T
ccuccggcguuucag

SEQ ID NO: 1908112 - RNA, 14 nt, Shigella flexneri 2a str. 2457T
ccuccggcguacag

SEQ ID NO: 1908113 - RNA, 16 nt, Shigella flexneri 2a str. 2457T
ccuccguuucacuucu

SEQ ID NO: 1908114 - RNA, 21 nt, Shigella flexneri 2a str. 2457T
ccuccugucuucccugcugaa

SEQ ID NO: 1908115 - RNA, 11 nt, Shigella flexneri 2a str. 2457T
ccuccugcagc

SEQ ID NO: 1908116 - RNA, 12 nt, Shigella flexneri 2a str. 2457T
ccuccgcaauau

SEQ ID NO: 1908117 - RNA, 18 nt, Shigella flexneri 2a str. 2457T
ccucccguuucccugucu

SEQ ID NO: 1908118 - RNA, 15 nt, Shigella flexneri 2a str. 2457T
ccuccaugaaaauag

SEQ ID NO: 1908119 - RNA, 13 nt, Shigella flexneri 2a str. 2457T
ccucccccugagc

SEQ ID NO: 1908120 - RNA, 23 nt, Shigella flexneri 2a str. 2457T
ccucccgcuguuuguucaagcgc

SEQ ID NO: 1908121 - RNA, 17 nt, Shigella flexneri 2a str. 2457T
ccucccgguaggugagg

SEQ ID NO: 1908122 - RNA, 18 nt, Shigella flexneri 2a str. 2457T
ccguuauuacgcccgcca

SEQ ID NO: 1908123 - RNA, 18 nt, Shigella flexneri 2a str. 2457T
ccgugcugacucagcggc

SEQ ID NO: 1908124 - RNA, 13 nt, Shigella flexneri 2a str. 2457T
ccgugcgcuuuuu

SEQ ID NO: 1908125 - RNA, 14 nt, Shigella flexneri 2a str. 2457T
ccguggauuuaaug

SEQ ID NO: 1908126 - RNA, 14 nt, Shigella flexneri 2a str. 2457T
ccgucuuuuuucac

SEQ ID NO: 1908127 - RNA, 20 nt, Shigella flexneri 2a str. 2457T
ccgugaaaacagcaaccucc

SEQ ID NO: 1908128 - RNA, 18 nt, Shigella flexneri 2a str. 2457T
ccgugaacguggccauga

SEQ ID NO: 1908129 - RNA, 24 nt, Shigella flexneri 2a str. 2457T
ccgugagcggaacggcaggaauac

SEQ ID NO: 1908130 - RNA, 13 nt, Shigella flexneri 2a str. 2457T
ccgugccagagca

SEQ ID NO: 1908131 - RNA, 18 nt, Shigella flexneri 2a str. 2457T
ccgugccgcuaauggugc

SEQ ID NO: 1908132 - RNA, 18 nt, Shigella flexneri 2a str. 2457T
ccguugauuuuauuggca

SEQ ID NO: 1908133 - RNA, 16 nt, Shigella flexneri 2a str. 2457T
ccguugcgcgucaacu

SEQ ID NO: 1908134 - RNA, 17 nt, Shigella flexneri 2a str. 2457T
ccguuuccucaagcgga

SEQ ID NO: 1908135 - RNA, 16 nt, Shigella flexneri 2a str. 2457T
ccguuucgcagguucc

SEQ ID NO: 1908136 - RNA, 23 nt, Shigella flexneri 2a str. 2457T
ccguuuggugguuuggcggcggc

SEQ ID NO: 1908137 - RNA, 15 nt, Shigella flexneri 2a str. 2457T
ccguuuacggcuaaa

SEQ ID NO: 1908138 - RNA, 20 nt, Shigella flexneri 2a str. 2457T
ccguuucuacaagcagagag

SEQ ID NO: 1908139 - RNA, 12 nt, Shigella flexneri 2a str. 2457T
ccguuuucucca

SEQ ID NO: 1908140 - RNA, 17 nt, Shigella flexneri 2a str. 2457T
ccuaacaaccaucccca

SEQ ID NO: 1908141 - RNA, 17 nt, Shigella flexneri 2a str. 2457T
ccguuuuacugggaaga

SEQ ID NO: 1908142 - RNA, 15 nt, Shigella flexneri 2a str. 2457T
ccuaacacaugcaag

SEQ ID NO: 1908143 - RNA, 15 nt, Shigella flexneri 2a str. 2457T
ccuaacaaggcuucg

SEQ ID NO: 1908144 - RNA, 16 nt, Shigella flexneri 2a str. 2457T
ccuaacaucauccccg

SEQ ID NO: 1908145 - RNA, 23 nt, Shigella flexneri 2a str. 2457T
ccuaacccucuccccaagggggc

SEQ ID NO: 1908146 - RNA, 15 nt, Shigella flexneri 2a str. 2457T
ccuaacauuuuacuu

SEQ ID NO: 1908147 - RNA, 23 nt, Shigella flexneri 2a str. 2457T
ccuacauagucccugcaauagau

SEQ ID NO: 1908148 - RNA, 20 nt, Shigella flexneri 2a str. 2457T
ccuacaugauuucugcaaua

SEQ ID NO: 1908149 - RNA, 12 nt, Shigella flexneri 2a str. 2457T
ccguagugaaaa

SEQ ID NO: 1908150 - RNA, 19 nt, Shigella flexneri 2a str. 2457T
ccguaguccauacccagca

SEQ ID NO: 1908151 - RNA, 14 nt, Shigella flexneri 2a str. 2457T
ccgucacuucuucg

SEQ ID NO: 1908152 - RNA, 14 nt, Shigella flexneri 2a str. 2457T
ccgucagcaaaaua

SEQ ID NO: 1908153 - RNA, 21 nt, Shigella flexneri 2a str. 2457T
ccgucagcaaaauacugaaca

SEQ ID NO: 1908154 - RNA, 18 nt, Shigella flexneri 2a str. 2457T
ccguauaauaucuuuucu

SEQ ID NO: 1908155 - RNA, 15 nt, Shigella flexneri 2a str. 2457T
ccguagcguucuuug

SEQ ID NO: 1908156 - RNA, 18 nt, Shigella flexneri 2a str. 2457T
ccguacgcaucaccagac

SEQ ID NO: 1908157 - RNA, 20 nt, Shigella flexneri 2a str. 2457T
ccguaaagcccauaccacag

SEQ ID NO: 1908158 - RNA, 21 nt, Shigella flexneri 2a str. 2457T
ccguaaccaccagcacugauu

SEQ ID NO: 1908159 - RNA, 12 nt, Shigella flexneri 2a str. 2457T
ccguaaaaaaug

SEQ ID NO: 1908160 - RNA, 13 nt, Shigella flexneri 2a str. 2457T
ccgguuuuaaagc

SEQ ID NO: 1908161 - RNA, 16 nt, Shigella flexneri 2a str. 2457T
ccgguuuugcaggaaa

SEQ ID NO: 1908162 - RNA, 14 nt, Shigella flexneri 2a str. 2457T
ccggugagcugcau

SEQ ID NO: 1908163 - RNA, 21 nt, Shigella flexneri 2a str. 2457T
ccgucguugagcaucugcaaa

SEQ ID NO: 1908164 - RNA, 17 nt, Shigella flexneri 2a str. 2457T
ccgucgaugccccagua

SEQ ID NO: 1908165 - RNA, 14 nt, Shigella flexneri 2a str. 2457T
ccgucgaggaacau

SEQ ID NO: 1908166 - RNA, 19 nt, Shigella flexneri 2a str. 2457T
ccgucgaggaacaucugag

SEQ ID NO: 1908167 - RNA, 18 nt, Shigella flexneri 2a str. 2457T
ccgucgcgcccuccugca

SEQ ID NO: 1908168 - RNA, 12 nt, Shigella flexneri 2a str. 2457T
ccgucagcgagu

SEQ ID NO: 1908169 - RNA, 17 nt, Shigella flexneri 2a str. 2457T
ccggucgcuucuagugc

SEQ ID NO: 1908170 - RNA, 20 nt, Shigella flexneri 2a str. 2457T
ccgguaucaaacccuuccau

SEQ ID NO: 1908171 - RNA, 15 nt, Shigella flexneri 2a str. 2457T
ccgguagucaccgcc

SEQ ID NO: 1908172 - RNA, 20 nt, Shigella flexneri 2a str. 2457T
ccgggguucgaauccccgcc

SEQ ID NO: 1908173 - RNA, 18 nt, Shigella flexneri 2a str. 2457T
ccggggcgcgugcuccag

SEQ ID NO: 1908174 - RNA, 19 nt, Shigella flexneri 2a str. 2457T
ccggguuuucaaugauaaa

SEQ ID NO: 1908175 - RNA, 16 nt, Shigella flexneri 2a str. 2457T
ccggguuuuuuauuaa

SEQ ID NO: 1908176 - RNA, 21 nt, Shigella flexneri 2a str. 2457T
ccgggagggaaccuguucaac

SEQ ID NO: 1908177 - RNA, 17 nt, Shigella flexneri 2a str. 2457T
ccgggcucccggcggua

SEQ ID NO: 1908178 - RNA, 18 nt, Shigella flexneri 2a str. 2457T
ccgggcuuggcaccauua

SEQ ID NO: 1908179 - RNA, 15 nt, Shigella flexneri 2a str. 2457T
ccggcguccaccugc

SEQ ID NO: 1908180 - RNA, 23 nt, Shigella flexneri 2a str. 2457T
ccggcguaccuuugccuuccagc

SEQ ID NO: 1908181 - RNA, 18 nt, Shigella flexneri 2a str. 2457T
ccggcgguaaaucgccgc

SEQ ID NO: 1908182 - RNA, 21 nt, Shigella flexneri 2a str. 2457T
ccggccaguaagcaguccagc

SEQ ID NO: 1908183 - RNA, 23 nt, Shigella flexneri 2a str. 2457T
ccggcugccggaugacagacucc

SEQ ID NO: 1908184 - RNA, 21 nt, Shigella flexneri 2a str. 2457T
ccggcuuauaauccccggccu

SEQ ID NO: 1908185 - RNA, 13 nt, Shigella flexneri 2a str. 2457T
ccggcuguuuauu

SEQ ID NO: 1908186 - RNA, 13 nt, Shigella flexneri 2a str. 2457T
ccggcuugaacca

SEQ ID NO: 1908187 - RNA, 18 nt, Shigella flexneri 2a str. 2457T
ccggcgucgcauccggca

SEQ ID NO: 1908188 - RNA, 22 nt, Shigella flexneri 2a str. 2457T
ccggcuccgguuaacgccgcgc

SEQ ID NO: 1908189 - RNA, 13 nt, Shigella flexneri 2a str. 2457T
ccggcucccgcag

SEQ ID NO: 1908190 - RNA, 18 nt, Shigella flexneri 2a str. 2457T
cgaggccauauuucacau

SEQ ID NO: 1908191 - RNA, 16 nt, Shigella flexneri 2a str. 2457T
cgaggcuuauccggca

SEQ ID NO: 1908192 - RNA, 21 nt, Shigella flexneri 2a str. 2457T
cgaggcucugauugccuucca

SEQ ID NO: 1908193 - RNA, 19 nt, Shigella flexneri 2a str. 2457T
cgagggagaaaacccggcc

SEQ ID NO: 1908194 - RNA, 18 nt, Shigella flexneri 2a str. 2457T
cgaggcucugauugccuu

SEQ ID NO: 1908195 - RNA, 15 nt, Shigella flexneri 2a str. 2457T
cgaggcgaacaugcg

SEQ ID NO: 1908196 - RNA, 16 nt, Shigella flexneri 2a str. 2457T
cgaggcgcuggcagaa

SEQ ID NO: 1908197 - RNA, 14 nt, Shigella flexneri 2a str. 2457T
cgaggagcuggagg

SEQ ID NO: 1908198 - RNA, 12 nt, Shigella flexneri 2a str. 2457T
cgaggacagcau

SEQ ID NO: 1908199 - RNA, 17 nt, Shigella flexneri 2a str. 2457T
cgagcuuucgaccagcc

SEQ ID NO: 1908200 - RNA, 15 nt, Shigella flexneri 2a str. 2457T
cgaggaacaucugag

SEQ ID NO: 1908201 - RNA, 21 nt, Shigella flexneri 2a str. 2457T
cgagcgucauauagccgccuu

SEQ ID NO: 1908202 - RNA, 13 nt, Shigella flexneri 2a str. 2457T
cgagcuggaagcc

SEQ ID NO: 1908203 - RNA, 22 nt, Shigella flexneri 2a str. 2457T
cgagccguuccuaacaugccac

SEQ ID NO: 1908204 - RNA, 16 nt, Shigella flexneri 2a str. 2457T
cgagccgguugccuga

SEQ ID NO: 1908205 - RNA, 19 nt, Shigella flexneri 2a str. 2457T
cgagcgacagauucaggcg

SEQ ID NO: 1908206 - RNA, 17 nt, Shigella flexneri 2a str. 2457T
cgagcgacucgaaggcc

SEQ ID NO: 1908207 - RNA, 22 nt, Shigella flexneri 2a str. 2457T
cgauaagguaucgcgaaaaaaa

SEQ ID NO: 1908208 - RNA, 17 nt, Shigella flexneri 2a str. 2457T
cgauaagcaacgcggcg

SEQ ID NO: 1908209 - RNA, 21 nt, Shigella flexneri 2a str. 2457T
cgauaacucgcuuugcccaga

SEQ ID NO: 1908210 - RNA, 15 nt, Shigella flexneri 2a str. 2457T
cgauaacucgcuuug

SEQ ID NO: 1908211 - RNA, 14 nt, Shigella flexneri 2a str. 2457T
cgauaacggucgua

SEQ ID NO: 1908212 - RNA, 15 nt, Shigella flexneri 2a str. 2457T
cgaguuuuucagucc

SEQ ID NO: 1908213 - RNA, 15 nt, Shigella flexneri 2a str. 2457T
cgauaaucagcgcca

SEQ ID NO: 1908214 - RNA, 23 nt, Shigella flexneri 2a str. 2457T
cgauaagguaucgcgaaaaaaag

SEQ ID NO: 1908215 - RNA, 19 nt, Shigella flexneri 2a str. 2457T
cgauaauauugaugcacac

SEQ ID NO: 1908216 - RNA, 13 nt, Shigella flexneri 2a str. 2457T
cgauaaugcccag

SEQ ID NO: 1908217 - RNA, 23 nt, Shigella flexneri 2a str. 2457T
cgauagcgcacgcgcuucacaug

SEQ ID NO: 1908218 - RNA, 17 nt, Shigella flexneri 2a str. 2457T
cgauaugaccauuggua

SEQ ID NO: 1908219 - RNA, 18 nt, Shigella flexneri 2a str. 2457T
cgauacccccaguaaaug

SEQ ID NO: 1908220 - RNA, 18 nt, Shigella flexneri 2a str. 2457T
cgauaccgcuguccacgc

SEQ ID NO: 1908221 - RNA, 12 nt, Shigella flexneri 2a str. 2457T
cgauaccacccg

SEQ ID NO: 1908222 - RNA, 16 nt, Shigella flexneri 2a str. 2457T
cgauacagaagcaccg

SEQ ID NO: 1908223 - RNA, 22 nt, Shigella flexneri 2a str. 2457T
cgauaccaauaucaacguaaug

SEQ ID NO: 1908224 - RNA, 22 nt, Shigella flexneri 2a str. 2457T
cgauaccaauguagccgcggau

SEQ ID NO: 1908225 - RNA, 16 nt, Shigella flexneri 2a str. 2457T
cgagguuggcucauca

SEQ ID NO: 1908226 - RNA, 13 nt, Shigella flexneri 2a str. 2457T
cgagguuuuccuu

SEQ ID NO: 1908227 - RNA, 17 nt, Shigella flexneri 2a str. 2457T
cgaggggaccgccccug

SEQ ID NO: 1908228 - RNA, 15 nt, Shigella flexneri 2a str. 2457T
cgagguccagcuccg

SEQ ID NO: 1908229 - RNA, 19 nt, Shigella flexneri 2a str. 2457T
cgagguacgcuccagcagg

SEQ ID NO: 1908230 - RNA, 19 nt, Shigella flexneri 2a str. 2457T
cgaggggacuguccgggca

SEQ ID NO: 1908231 - RNA, 14 nt, Shigella flexneri 2a str. 2457T
cgaguagaucaaca

SEQ ID NO: 1908232 - RNA, 15 nt, Shigella flexneri 2a str. 2457T
cgaguaaaaaaacau

SEQ ID NO: 1908233 - RNA, 22 nt, Shigella flexneri 2a str. 2457T
cgaguauugucuccgcugagac

SEQ ID NO: 1908234 - RNA, 11 nt, Shigella flexneri 2a str. 2457T
cgaguccuguu

SEQ ID NO: 1908235 - RNA, 16 nt, Shigella flexneri 2a str. 2457T
cgaguccuuccagguc

SEQ ID NO: 1908236 - RNA, 19 nt, Shigella flexneri 2a str. 2457T
cgaguggcgauugccgcac

SEQ ID NO: 1908237 - RNA, 18 nt, Shigella flexneri 2a str. 2457T
cgacguucugccaaacgc

SEQ ID NO: 1908238 - RNA, 16 nt, Shigella flexneri 2a str. 2457T
cgacguuuuacagcaa

SEQ ID NO: 1908239 - RNA, 13 nt, Shigella flexneri 2a str. 2457T
cgacuaaccugag

SEQ ID NO: 1908240 - RNA, 19 nt, Shigella flexneri 2a str. 2457T
cgacuacgggcaccaguaa

SEQ ID NO: 1908241 - RNA, 19 nt, Shigella flexneri 2a str. 2457T
cgacucgcaauuauaauac

SEQ ID NO: 1908242 - RNA, 15 nt, Shigella flexneri 2a str. 2457T
cgacucucugagcca

SEQ ID NO: 1908243 - RNA, 15 nt, Shigella flexneri 2a str. 2457T
cgacucaaaucacgc

SEQ ID NO: 1908244 - RNA, 16 nt, Shigella flexneri 2a str. 2457T
cgacucaaaucacgca

SEQ ID NO: 1908245 - RNA, 18 nt, Shigella flexneri 2a str. 2457T
cgacucaaaucacgcagu

SEQ ID NO: 1908246 - RNA, 17 nt, Shigella flexneri 2a str. 2457T
cgacucaaccccagcca

SEQ ID NO: 1908247 - RNA, 13 nt, Shigella flexneri 2a str. 2457T
cgacuuuuuccug

SEQ ID NO: 1908248 - RNA, 14 nt, Shigella flexneri 2a str. 2457T
cgacuuugccuggc

SEQ ID NO: 1908249 - RNA, 22 nt, Shigella flexneri 2a str. 2457T
cgacuuuguuuuuaguuaaauc

SEQ ID NO: 1908250 - RNA, 20 nt, Shigella flexneri 2a str. 2457T
cgacuugggcgauuuuugca

SEQ ID NO: 1908251 - RNA, 18 nt, Shigella flexneri 2a str. 2457T
cgacuucgauguccgcuc

SEQ ID NO: 1908252 - RNA, 23 nt, Shigella flexneri 2a str. 2457T
cgacugcaaaccaugacgcacuu

SEQ ID NO: 1908253 - RNA, 15 nt, Shigella flexneri 2a str. 2457T
cgacugcccgcgagc

SEQ ID NO: 1908254 - RNA, 14 nt, Shigella flexneri 2a str. 2457T
cgacugccgcucac

SEQ ID NO: 1908255 - RNA, 16 nt, Shigella flexneri 2a str. 2457T
cgacugcgccaauacc

SEQ ID NO: 1908256 - RNA, 21 nt, Shigella flexneri 2a str. 2457T
cgacugcgggcgcaagggcug

SEQ ID NO: 1908257 - RNA, 15 nt, Shigella flexneri 2a str. 2457T
cgacggcaucgccau

SEQ ID NO: 1908258 - RNA, 17 nt, Shigella flexneri 2a str. 2457T
cgacgcugaugucagca

SEQ ID NO: 1908259 - RNA, 19 nt, Shigella flexneri 2a str. 2457T
cgacgcguccaggcucgcc

SEQ ID NO: 1908260 - RNA, 23 nt, Shigella flexneri 2a str. 2457T
cgacgcgcuuuuacugcauucac

SEQ ID NO: 1908261 - RNA, 15 nt, Shigella flexneri 2a str. 2457T
cgacgcgccagcacc

SEQ ID NO: 1908262 - RNA, 19 nt, Shigella flexneri 2a str. 2457T
cgacgucgauuucugggug

SEQ ID NO: 1908263 - RNA, 14 nt, Shigella flexneri 2a str. 2457T
cgacguagcccggu

SEQ ID NO: 1908264 - RNA, 13 nt, Shigella flexneri 2a str. 2457T
cgacguaaaaaac

SEQ ID NO: 1908265 - RNA, 14 nt, Shigella flexneri 2a str. 2457T
cgacggcuggcaaa

SEQ ID NO: 1908266 - RNA, 11 nt, Shigella flexneri 2a str. 2457T
cgacgggcgac

SEQ ID NO: 1908267 - RNA, 22 nt, Shigella flexneri 2a str. 2457T
cgacggcgggugacuucccgca

SEQ ID NO: 1908268 - RNA, 22 nt, Shigella flexneri 2a str. 2457T
cgagaacacgguaaugacucca

SEQ ID NO: 1908269 - RNA, 21 nt, Shigella flexneri 2a str. 2457T
cgagaagcagcaacacaauca

SEQ ID NO: 1908270 - RNA, 19 nt, Shigella flexneri 2a str. 2457T
cgagaacucggaagcagcg

SEQ ID NO: 1908271 - RNA, 13 nt, Shigella flexneri 2a str. 2457T
cgagaagcaacug

SEQ ID NO: 1908272 - RNA, 18 nt, Shigella flexneri 2a str. 2457T
cgagaauacugaagucga

SEQ ID NO: 1908273 - RNA, 21 nt, Shigella flexneri 2a str. 2457T
cgagaauggacaccagcucag

SEQ ID NO: 1908274 - RNA, 16 nt, Shigella flexneri 2a str. 2457T
cgagauucuuaaaguc

SEQ ID NO: 1908275 - RNA, 15 nt, Shigella flexneri 2a str. 2457T
cgagagaagagacag

SEQ ID NO: 1908276 - RNA, 21 nt, Shigella flexneri 2a str. 2457T
cgagagaauggggucagcagg

SEQ ID NO: 1908277 - RNA, 23 nt, Shigella flexneri 2a str. 2457T
cgagagaauggggucagcaggug

SEQ ID NO: 1908278 - RNA, 21 nt, Shigella flexneri 2a str. 2457T
cgagagcaaugcgcaucaaag

SEQ ID NO: 1908279 - RNA, 19 nt, Shigella flexneri 2a str. 2457T
cgagauaaccccgcuugcu

SEQ ID NO: 1908280 - RNA, 23 nt, Shigella flexneri 2a str. 2457T
cgagcaauagacaguucuuccug

SEQ ID NO: 1908281 - RNA, 14 nt, Shigella flexneri 2a str. 2457T
cgagcaacgcagcg

SEQ ID NO: 1908282 - RNA, 20 nt, Shigella flexneri 2a str. 2457T
cgagcacgccgccagugccg

SEQ ID NO: 1908283 - RNA, 12 nt, Shigella flexneri 2a str. 2457T
cgagcagccacu

SEQ ID NO: 1908284 - RNA, 19 nt, Shigella flexneri 2a str. 2457T
cgagcauccgauccuggac

SEQ ID NO: 1908285 - RNA, 18 nt, Shigella flexneri 2a str. 2457T
cgagccauaaacugagcc

SEQ ID NO: 1908286 - RNA, 15 nt, Shigella flexneri 2a str. 2457T
cgagccauaaacuga

SEQ ID NO: 1908287 - RNA, 15 nt, Shigella flexneri 2a str. 2457T
cgcaucagcuccggu

SEQ ID NO: 1908288 - RNA, 22 nt, Shigella flexneri 2a str. 2457T
cgcaucaggcauugugcacgau

SEQ ID NO: 1908289 - RNA, 13 nt, Shigella flexneri 2a str. 2457T
cgcauccaccaga

SEQ ID NO: 1908290 - RNA, 21 nt, Shigella flexneri 2a str. 2457T
cgcauccgacaaauguguuca

SEQ ID NO: 1908291 - RNA, 15 nt, Shigella flexneri 2a str. 2457T
cgcauccgcuugcgu

SEQ ID NO: 1908292 - RNA, 13 nt, Shigella flexneri 2a str. 2457T
cgcauccggcaag

SEQ ID NO: 1908293 - RNA, 23 nt, Shigella flexneri 2a str. 2457T
cgcauccggcaauucucucugau

SEQ ID NO: 1908294 - RNA, 15 nt, Shigella flexneri 2a str. 2457T
cgcauccgacacugg

SEQ ID NO: 1908295 - RNA, 12 nt, Shigella flexneri 2a str. 2457T
cgcaucuucucc

SEQ ID NO: 1908296 - RNA, 21 nt, Shigella flexneri 2a str. 2457T
cgcaugcauuuucaauaacug

SEQ ID NO: 1908297 - RNA, 17 nt, Shigella flexneri 2a str. 2457T
cgcaucugaccagaugc

SEQ ID NO: 1908298 - RNA, 21 nt, Shigella flexneri 2a str. 2457T
cgcaucugccggaaccagcca

SEQ ID NO: 1908299 - RNA, 18 nt, Shigella flexneri 2a str. 2457T
cgcaucuacgcgggucag

SEQ ID NO: 1908300 - RNA, 12 nt, Shigella flexneri 2a str. 2457T
cgcaucggucag

SEQ ID NO: 1908301 - RNA, 17 nt, Shigella flexneri 2a str. 2457T
cgcaucggcgucgugga

SEQ ID NO: 1908302 - RNA, 16 nt, Shigella flexneri 2a str. 2457T
cgcaucgggcaauggc

SEQ ID NO: 1908303 - RNA, 19 nt, Shigella flexneri 2a str. 2457T
cgcagugagaagccaccgc

SEQ ID NO: 1908304 - RNA, 20 nt, Shigella flexneri 2a str. 2457T
cgcaguguaguucuggccuu

SEQ ID NO: 1908305 - RNA, 14 nt, Shigella flexneri 2a str. 2457T
cgcagucuucccag

SEQ ID NO: 1908306 - RNA, 14 nt, Shigella flexneri 2a str. 2457T
cgcaggccaacagu

SEQ ID NO: 1908307 - RNA, 14 nt, Shigella flexneri 2a str. 2457T
cgcaggccaauagc

SEQ ID NO: 1908308 - RNA, 20 nt, Shigella flexneri 2a str. 2457T
cgcagcacccugaguuuuca

SEQ ID NO: 1908309 - RNA, 12 nt, Shigella flexneri 2a str. 2457T
cgcagcacggcg

SEQ ID NO: 1908310 - RNA, 12 nt, Shigella flexneri 2a str. 2457T
cgcagcuccagc

SEQ ID NO: 1908311 - RNA, 13 nt, Shigella flexneri 2a str. 2457T
cgcagcuccagcc

SEQ ID NO: 1908312 - RNA, 17 nt, Shigella flexneri 2a str. 2457T
cgcagcuccagcccgcg

SEQ ID NO: 1908313 - RNA, 18 nt, Shigella flexneri 2a str. 2457T
cgcagcgguuucacagga

SEQ ID NO: 1908314 - RNA, 19 nt, Shigella flexneri 2a str. 2457T
cgcagcugcgcguuaucua

SEQ ID NO: 1908315 - RNA, 22 nt, Shigella flexneri 2a str. 2457T
cgcagcuccgggcucaugcugu

SEQ ID NO: 1908316 - RNA, 16 nt, Shigella flexneri 2a str. 2457T
cgcauuuucuucauuc

SEQ ID NO: 1908317 - RNA, 19 nt, Shigella flexneri 2a str. 2457T
cgcauuuuuucuucaguuc

SEQ ID NO: 1908318 - RNA, 15 nt, Shigella flexneri 2a str. 2457T
cgcauuuacucucau

SEQ ID NO: 1908319 - RNA, 16 nt, Shigella flexneri 2a str. 2457T
cgcauugcucacuucc

SEQ ID NO: 1908320 - RNA, 13 nt, Shigella flexneri 2a str. 2457T
cgcauugcuggcu

SEQ ID NO: 1908321 - RNA, 12 nt, Shigella flexneri 2a str. 2457T
cgcauucuggag

SEQ ID NO: 1908322 - RNA, 17 nt, Shigella flexneri 2a str. 2457T
cgcauucccagcgcguu

SEQ ID NO: 1908323 - RNA, 19 nt, Shigella flexneri 2a str. 2457T
cgcauuaagccaugaauga

SEQ ID NO: 1908324 - RNA, 22 nt, Shigella flexneri 2a str. 2457T
cgcauuaagccaugaaugaugu

SEQ ID NO: 1908325 - RNA, 21 nt, Shigella flexneri 2a str. 2457T
cgccaacggugaaaaaccaau

SEQ ID NO: 1908326 - RNA, 23 nt, Shigella flexneri 2a str. 2457T
cgccaaccguggcguaaaucauc

SEQ ID NO: 1908327 - RNA, 22 nt, Shigella flexneri 2a str. 2457T
cgccaaccgauaucuuuccggc

SEQ ID NO: 1908328 - RNA, 16 nt, Shigella flexneri 2a str. 2457T
cgccaacgcccagcgc

SEQ ID NO: 1908329 - RNA, 15 nt, Shigella flexneri 2a str. 2457T
cgccaacaaaagcaa

SEQ ID NO: 1908330 - RNA, 23 nt, Shigella flexneri 2a str. 2457T
cgccaaaucgauaaaacuucccg

SEQ ID NO: 1908331 - RNA, 18 nt, Shigella flexneri 2a str. 2457T
cgccaaaucgcugcugcu

SEQ ID NO: 1908332 - RNA, 15 nt, Shigella flexneri 2a str. 2457T
cgccaaagcggcagu

SEQ ID NO: 1908333 - RNA, 18 nt, Shigella flexneri 2a str. 2457T
cgccaaaaggcaauucaa

SEQ ID NO: 1908334 - RNA, 22 nt, Shigella flexneri 2a str. 2457T
cgccaaguuuuuucuucccaag

SEQ ID NO: 1908335 - RNA, 17 nt, Shigella flexneri 2a str. 2457T
cgccaagcagcgcgcag

SEQ ID NO: 1908336 - RNA, 23 nt, Shigella flexneri 2a str. 2457T
cgccaagcagcgcgcagaacaua

SEQ ID NO: 1908337 - RNA, 16 nt, Shigella flexneri 2a str. 2457T
cgccaccgaccaggca

SEQ ID NO: 1908338 - RNA, 21 nt, Shigella flexneri 2a str. 2457T
cgccaccgaccaggcaaacca

SEQ ID NO: 1908339 - RNA, 22 nt, Shigella flexneri 2a str. 2457T
cgccacuuagcgcuuggucgaa

SEQ ID NO: 1908340 - RNA, 19 nt, Shigella flexneri 2a str. 2457T
cgccagacaauugccgcca

SEQ ID NO: 1908341 - RNA, 18 nt, Shigella flexneri 2a str. 2457T
cgccagacaauugccgcc

SEQ ID NO: 1908342 - RNA, 23 nt, Shigella flexneri 2a str. 2457T
cgccagaacacgcucccagcaga

SEQ ID NO: 1908343 - RNA, 16 nt, Shigella flexneri 2a str. 2457T
cgccagaacagcuaca

SEQ ID NO: 1908344 - RNA, 21 nt, Shigella flexneri 2a str. 2457T
cgccagacugaucaucgccca

SEQ ID NO: 1908345 - RNA, 20 nt, Shigella flexneri 2a str. 2457T
cgccagaccuaccaucuccu

SEQ ID NO: 1908346 - RNA, 17 nt, Shigella flexneri 2a str. 2457T
cgccagaccaauagaaa

SEQ ID NO: 1908347 - RNA, 21 nt, Shigella flexneri 2a str. 2457T
cgccagaccagcuaccacgcc

SEQ ID NO: 1908348 - RNA, 20 nt, Shigella flexneri 2a str. 2457T
cgcaagcgaaugaggcagca

SEQ ID NO: 1908349 - RNA, 14 nt, Shigella flexneri 2a str. 2457T
cgcaacuuccccuc

SEQ ID NO: 1908350 - RNA, 20 nt, Shigella flexneri 2a str. 2457T
cgcaacgacaccguuaaaua

SEQ ID NO: 1908351 - RNA, 18 nt, Shigella flexneri 2a str. 2457T
cgcaaaaucucacacuca

SEQ ID NO: 1908352 - RNA, 13 nt, Shigella flexneri 2a str. 2457T
cgcaacaucgcaa

SEQ ID NO: 1908353 - RNA, 18 nt, Shigella flexneri 2a str. 2457T
cgcaaaaccucuuccagc

SEQ ID NO: 1908354 - RNA, 20 nt, Shigella flexneri 2a str. 2457T
cgcaaaaccucuuccagcag

SEQ ID NO: 1908355 - RNA, 21 nt, Shigella flexneri 2a str. 2457T
cgcaaaaccucuuccagcaga

SEQ ID NO: 1908356 - RNA, 16 nt, Shigella flexneri 2a str. 2457T
cgcaaaacugccugau

SEQ ID NO: 1908357 - RNA, 16 nt, Shigella flexneri 2a str. 2457T
cgcaaaaucagcaauu

SEQ ID NO: 1908358 - RNA, 20 nt, Shigella flexneri 2a str. 2457T
cgcaaaaucagcaauuuuuc

SEQ ID NO: 1908359 - RNA, 17 nt, Shigella flexneri 2a str. 2457T
cgcaacauugcgccuca

SEQ ID NO: 1908360 - RNA, 17 nt, Shigella flexneri 2a str. 2457T
cgcaauuaacgccccaa

SEQ ID NO: 1908361 - RNA, 14 nt, Shigella flexneri 2a str. 2457T
cgcaauuuccauug

SEQ ID NO: 1908362 - RNA, 19 nt, Shigella flexneri 2a str. 2457T
cgcaauuuccauugcucug

SEQ ID NO: 1908363 - RNA, 18 nt, Shigella flexneri 2a str. 2457T
cgcaauuuugacaauaau

SEQ ID NO: 1908364 - RNA, 12 nt, Shigella flexneri 2a str. 2457T
cgcaauguugcg

SEQ ID NO: 1908365 - RNA, 18 nt, Shigella flexneri 2a str. 2457T
cgcaauggccguuccggc

SEQ ID NO: 1908366 - RNA, 14 nt, Shigella flexneri 2a str. 2457T
cgcaaucagcaccg

SEQ ID NO: 1908367 - RNA, 13 nt, Shigella flexneri 2a str. 2457T
cgcagacaccaga

SEQ ID NO: 1908368 - RNA, 18 nt, Shigella flexneri 2a str. 2457T
cgcacguugucagcaacu

SEQ ID NO: 1908369 - RNA, 19 nt, Shigella flexneri 2a str. 2457T
cgcacguugucagcaacug

SEQ ID NO: 1908370 - RNA, 21 nt, Shigella flexneri 2a str. 2457T
cgcacguucugucgcucugcu

SEQ ID NO: 1908371 - RNA, 16 nt, Shigella flexneri 2a str. 2457T
cgcagaucagaccaau

SEQ ID NO: 1908372 - RNA, 20 nt, Shigella flexneri 2a str. 2457T
cgcacgaggaagauuacgcu

SEQ ID NO: 1908373 - RNA, 19 nt, Shigella flexneri 2a str. 2457T
cgcacgaggaacagcgcgc

SEQ ID NO: 1908374 - RNA, 16 nt, Shigella flexneri 2a str. 2457T
cgcaccaccagcagcu

SEQ ID NO: 1908375 - RNA, 14 nt, Shigella flexneri 2a str. 2457T
cgcaccaccagcag

SEQ ID NO: 1908376 - RNA, 19 nt, Shigella flexneri 2a str. 2457T
cgauuucuacacccagccc

SEQ ID NO: 1908377 - RNA, 21 nt, Shigella flexneri 2a str. 2457T
cgauuugccgucucuuucaug

SEQ ID NO: 1908378 - RNA, 21 nt, Shigella flexneri 2a str. 2457T
cgauuugcggucguaugcugg

SEQ ID NO: 1908379 - RNA, 11 nt, Shigella flexneri 2a str. 2457T
cgauuucacaa

SEQ ID NO: 1908380 - RNA, 15 nt, Shigella flexneri 2a str. 2457T
cgauuuggccgaaga

SEQ ID NO: 1908381 - RNA, 19 nt, Shigella flexneri 2a str. 2457T
cgauuugucgccugcauca

SEQ ID NO: 1908382 - RNA, 14 nt, Shigella flexneri 2a str. 2457T
cgauuuuccuccau

SEQ ID NO: 1908383 - RNA, 13 nt, Shigella flexneri 2a str. 2457T
cgauuuugaaguc

SEQ ID NO: 1908384 - RNA, 22 nt, Shigella flexneri 2a str. 2457T
cgauuuuggguuccacuucugc

SEQ ID NO: 1908385 - RNA, 17 nt, Shigella flexneri 2a str. 2457T
cgauuuuuuuaauaaua

SEQ ID NO: 1908386 - RNA, 13 nt, Shigella flexneri 2a str. 2457T
cgcaaaaccucuu

SEQ ID NO: 1908387 - RNA, 22 nt, Shigella flexneri 2a str. 2457T
cgcaaaaaaucgccgagcugaa

SEQ ID NO: 1908388 - RNA, 23 nt, Shigella flexneri 2a str. 2457T
cgauugugauucgauucacauuu

SEQ ID NO: 1908389 - RNA, 15 nt, Shigella flexneri 2a str. 2457T
cgauugugcugguga

SEQ ID NO: 1908390 - RNA, 14 nt, Shigella flexneri 2a str. 2457T
cgauuuaucgauuu

SEQ ID NO: 1908391 - RNA, 19 nt, Shigella flexneri 2a str. 2457T
cgauugucguguuaagccg

SEQ ID NO: 1908392 - RNA, 23 nt, Shigella flexneri 2a str. 2457T
cgauugauuuaucagguauugau

SEQ ID NO: 1908393 - RNA, 18 nt, Shigella flexneri 2a str. 2457T
cgauguuguacaugcugc

SEQ ID NO: 1908394 - RNA, 19 nt, Shigella flexneri 2a str. 2457T
cgaucacccaagcuucggg

SEQ ID NO: 1908395 - RNA, 20 nt, Shigella flexneri 2a str. 2457T
cgaucaagauugauccccgc

SEQ ID NO: 1908396 - RNA, 15 nt, Shigella flexneri 2a str. 2457T
cgaugcugacgcauc

SEQ ID NO: 1908397 - RNA, 21 nt, Shigella flexneri 2a str. 2457T
cgaugcuuuccaacuguacca

SEQ ID NO: 1908398 - RNA, 18 nt, Shigella flexneri 2a str. 2457T
cgauggaaccguacagca

SEQ ID NO: 1908399 - RNA, 19 nt, Shigella flexneri 2a str. 2457T
cgauggaaccguacagcau

SEQ ID NO: 1908400 - RNA, 19 nt, Shigella flexneri 2a str. 2457T
cgauggcaaacaaacugcg

SEQ ID NO: 1908401 - RNA, 18 nt, Shigella flexneri 2a str. 2457T
cgaugucgcccacuuuca

SEQ ID NO: 1908402 - RNA, 20 nt, Shigella flexneri 2a str. 2457T
cgaugguagcagcgaagaga

SEQ ID NO: 1908403 - RNA, 18 nt, Shigella flexneri 2a str. 2457T
cgauggucuggcgacggc

SEQ ID NO: 1908404 - RNA, 12 nt, Shigella flexneri 2a str. 2457T
cgauggucuguu

SEQ ID NO: 1908405 - RNA, 20 nt, Shigella flexneri 2a str. 2457T
cgaaaucaccgccaccagcg

SEQ ID NO: 1908406 - RNA, 17 nt, Shigella flexneri 2a str. 2457T
cgaaaugagauauuuca

SEQ ID NO: 1908407 - RNA, 12 nt, Shigella flexneri 2a str. 2457T
cgaaaucgccau

SEQ ID NO: 1908408 - RNA, 15 nt, Shigella flexneri 2a str. 2457T
cgaaaucgccuuugg

SEQ ID NO: 1908409 - RNA, 15 nt, Shigella flexneri 2a str. 2457T
cgaacaaaaaaagcg

SEQ ID NO: 1908410 - RNA, 14 nt, Shigella flexneri 2a str. 2457T
cgaacaacagauca

SEQ ID NO: 1908411 - RNA, 14 nt, Shigella flexneri 2a str. 2457T
cgaacaccagcagu

SEQ ID NO: 1908412 - RNA, 21 nt, Shigella flexneri 2a str. 2457T
cgaacaccagcaguaaaccac

SEQ ID NO: 1908413 - RNA, 19 nt, Shigella flexneri 2a str. 2457T
cgaaagcuggcacugggau

SEQ ID NO: 1908414 - RNA, 17 nt, Shigella flexneri 2a str. 2457T
cgaaacccgcugccauc

SEQ ID NO: 1908415 - RNA, 14 nt, Shigella flexneri 2a str. 2457T
cgaaacgauuaauu

SEQ ID NO: 1908416 - RNA, 20 nt, Shigella flexneri 2a str. 2457T
cgaaacgcaccucagcaagu

SEQ ID NO: 1908417 - RNA, 16 nt, Shigella flexneri 2a str. 2457T
cgaaacgccugcaauu

SEQ ID NO: 1908418 - RNA, 18 nt, Shigella flexneri 2a str. 2457T
cgaacgcguucacugccg

SEQ ID NO: 1908419 - RNA, 15 nt, Shigella flexneri 2a str. 2457T
cgaacgccucugcaa

SEQ ID NO: 1908420 - RNA, 21 nt, Shigella flexneri 2a str. 2457T
cgaacgcagugauaacucaaa

SEQ ID NO: 1908421 - RNA, 14 nt, Shigella flexneri 2a str. 2457T
cgaacccagcaggu

SEQ ID NO: 1908422 - RNA, 15 nt, Shigella flexneri 2a str. 2457T
cgaaccauaaaauca

SEQ ID NO: 1908423 - RNA, 22 nt, Shigella flexneri 2a str. 2457T
cgaaccggaccagcaacaaaua

SEQ ID NO: 1908424 - RNA, 24 nt, Shigella flexneri 2a str. 2457T
cgaaccagccguugucagucauca

SEQ ID NO: 1908425 - RNA, 12 nt, Shigella flexneri 2a str. 2457T
cgaaccagcgga

SEQ ID NO: 1908426 - RNA, 13 nt, Shigella flexneri 2a str. 2457T
cgaaccaggaaga

SEQ ID NO: 1908427 - RNA, 18 nt, Shigella flexneri 2a str. 2457T
cgaacagacaaaaagaau

SEQ ID NO: 1908428 - RNA, 15 nt, Shigella flexneri 2a str. 2457T
cgaacaggccgacug

SEQ ID NO: 1908429 - RNA, 14 nt, Shigella flexneri 2a str. 2457T
cgaacaggauugcc

SEQ ID NO: 1908430 - RNA, 15 nt, Shigella flexneri 2a str. 2457T
cgaacagcugguuga

SEQ ID NO: 1908431 - RNA, 15 nt, Shigella flexneri 2a str. 2457T
ccuuuugcccggcaa

SEQ ID NO: 1908432 - RNA, 21 nt, Shigella flexneri 2a str. 2457T
ccuuuuguuuguucuucucga

SEQ ID NO: 1908433 - RNA, 22 nt, Shigella flexneri 2a str. 2457T
ccuuuucgccaccggcaaucug

SEQ ID NO: 1908434 - RNA, 16 nt, Shigella flexneri 2a str. 2457T
ccuuuucaccaugggc

SEQ ID NO: 1908435 - RNA, 18 nt, Shigella flexneri 2a str. 2457T
ccuuuuccauugccgcag

SEQ ID NO: 1908436 - RNA, 13 nt, Shigella flexneri 2a str. 2457T
ccuuuuucccaaa

SEQ ID NO: 1908437 - RNA, 21 nt, Shigella flexneri 2a str. 2457T
ccuuuuuuugucuguuugcuc

SEQ ID NO: 1908438 - RNA, 15 nt, Shigella flexneri 2a str. 2457T
ccuuuuuuauuuuuu

SEQ ID NO: 1908439 - RNA, 17 nt, Shigella flexneri 2a str. 2457T
cgaaacagggcuggaag

SEQ ID NO: 1908440 - RNA, 16 nt, Shigella flexneri 2a str. 2457T
cgaaacaucaaaaagc

SEQ ID NO: 1908441 - RNA, 20 nt, Shigella flexneri 2a str. 2457T
cgaaaaaagucauuaccagc

SEQ ID NO: 1908442 - RNA, 15 nt, Shigella flexneri 2a str. 2457T
cgaaaaacucuccuc

SEQ ID NO: 1908443 - RNA, 16 nt, Shigella flexneri 2a str. 2457T
cgaaaacaacuggcaa

SEQ ID NO: 1908444 - RNA, 18 nt, Shigella flexneri 2a str. 2457T
cgaaaaccacuccugacg

SEQ ID NO: 1908445 - RNA, 16 nt, Shigella flexneri 2a str. 2457T
cgaaaagcuucuuccu

SEQ ID NO: 1908446 - RNA, 17 nt, Shigella flexneri 2a str. 2457T
ccuuugccuuccagcga

SEQ ID NO: 1908447 - RNA, 15 nt, Shigella flexneri 2a str. 2457T
ccuuugccuuccagc

SEQ ID NO: 1908448 - RNA, 15 nt, Shigella flexneri 2a str. 2457T
ccuuuuauuuaaccg

SEQ ID NO: 1908449 - RNA, 21 nt, Shigella flexneri 2a str. 2457T
ccuuugaccagccagucagua

SEQ ID NO: 1908450 - RNA, 18 nt, Shigella flexneri 2a str. 2457T
ccuuugaaaauaacaucg

SEQ ID NO: 1908451 - RNA, 21 nt, Shigella flexneri 2a str. 2457T
ccuuugaaaauaacaucgcca

SEQ ID NO: 1908452 - RNA, 14 nt, Shigella flexneri 2a str. 2457T
ccuuugccaaaaug

SEQ ID NO: 1908453 - RNA, 13 nt, Shigella flexneri 2a str. 2457T
ccuuugccaaaau

SEQ ID NO: 1908454 - RNA, 13 nt, Shigella flexneri 2a str. 2457T
ccuuucugcaucc

SEQ ID NO: 1908455 - RNA, 23 nt, Shigella flexneri 2a str. 2457T
ccuuucguugcgcaacacagauu

SEQ ID NO: 1908456 - RNA, 22 nt, Shigella flexneri 2a str. 2457T
ccuuucaugguugucaccgcca

SEQ ID NO: 1908457 - RNA, 21 nt, Shigella flexneri 2a str. 2457T
ccuuucagauguuccgccauu

SEQ ID NO: 1908458 - RNA, 21 nt, Shigella flexneri 2a str. 2457T
ccuuucaauaccgccugcaaa

SEQ ID NO: 1908459 - RNA, 16 nt, Shigella flexneri 2a str. 2457T
ccuuucccuauuuuuu

SEQ ID NO: 1908460 - RNA, 22 nt, Shigella flexneri 2a str. 2457T
ccuuuccuuaagccagcgcccg

SEQ ID NO: 1908461 - RNA, 23 nt, Shigella flexneri 2a str. 2457T
ccuugccggaugcggcguaaaug

SEQ ID NO: 1908462 - RNA, 21 nt, Shigella flexneri 2a str. 2457T
ccuugcggaaauuccagcggc

SEQ ID NO: 1908463 - RNA, 15 nt, Shigella flexneri 2a str. 2457T
ccuugcucaaugagu

SEQ ID NO: 1908464 - RNA, 16 nt, Shigella flexneri 2a str. 2457T
ccuugauauaaauccc

SEQ ID NO: 1908465 - RNA, 19 nt, Shigella flexneri 2a str. 2457T
ccuugaguaccauuugcau

SEQ ID NO: 1908466 - RNA, 14 nt, Shigella flexneri 2a str. 2457T
ccuugaugaaaaaa

SEQ ID NO: 1908467 - RNA, 16 nt, Shigella flexneri 2a str. 2457T
ccuugccagauguugu

SEQ ID NO: 1908468 - RNA, 16 nt, Shigella flexneri 2a str. 2457T
ccuugcaguugaucua

SEQ ID NO: 1908469 - RNA, 13 nt, Shigella flexneri 2a str. 2457T
ccuugcaacuccg

SEQ ID NO: 1908470 - RNA, 20 nt, Shigella flexneri 2a str. 2457T
ccuuuaccgccacagcagcc

SEQ ID NO: 1908471 - RNA, 15 nt, Shigella flexneri 2a str. 2457T
ccuuuaccuucgccg

SEQ ID NO: 1908472 - RNA, 18 nt, Shigella flexneri 2a str. 2457T
ccuuuacgaagaaagcaa

SEQ ID NO: 1908473 - RNA, 19 nt, Shigella flexneri 2a str. 2457T
ccuugugggccugaaagcu

SEQ ID NO: 1908474 - RNA, 19 nt, Shigella flexneri 2a str. 2457T
ccuuguuucuucaacgaag

SEQ ID NO: 1908475 - RNA, 15 nt, Shigella flexneri 2a str. 2457T
ccuuguuuaaggaaa

SEQ ID NO: 1908476 - RNA, 16 nt, Shigella flexneri 2a str. 2457T
ccuuccuuauuucuug

SEQ ID NO: 1908477 - RNA, 13 nt, Shigella flexneri 2a str. 2457T
ccuucgccaccgu

SEQ ID NO: 1908478 - RNA, 14 nt, Shigella flexneri 2a str. 2457T
ccuucggauuuccg

SEQ ID NO: 1908479 - RNA, 14 nt, Shigella flexneri 2a str. 2457T
ccuucggccccauc

SEQ ID NO: 1908480 - RNA, 17 nt, Shigella flexneri 2a str. 2457T
ccuucggcgucuccacc

SEQ ID NO: 1908481 - RNA, 20 nt, Shigella flexneri 2a str. 2457T
ccuucgggcuggcauuuuuu

SEQ ID NO: 1908482 - RNA, 20 nt, Shigella flexneri 2a str. 2457T
ccuucggggcuaaugccagu

SEQ ID NO: 1908483 - RNA, 16 nt, Shigella flexneri 2a str. 2457T
ccugugucacuuugac

SEQ ID NO: 1908484 - RNA, 15 nt, Shigella flexneri 2a str. 2457T
ccuguguccuguuga

SEQ ID NO: 1908485 - RNA, 22 nt, Shigella flexneri 2a str. 2457T
ccuguuaagaagggcuggccaa

SEQ ID NO: 1908486 - RNA, 13 nt, Shigella flexneri 2a str. 2457T
ccuguuaugccuc

SEQ ID NO: 1908487 - RNA, 14 nt, Shigella flexneri 2a str. 2457T
ccuuccacaccacu

SEQ ID NO: 1908488 - RNA, 19 nt, Shigella flexneri 2a str. 2457T
ccuuccugaacggucgagg

SEQ ID NO: 1908489 - RNA, 15 nt, Shigella flexneri 2a str. 2457T
ccuucccccaccacc

SEQ ID NO: 1908490 - RNA, 20 nt, Shigella flexneri 2a str. 2457T
ccuuccgcaauacagccagc

SEQ ID NO: 1908491 - RNA, 12 nt, Shigella flexneri 2a str. 2457T
ccuucccuuuca

SEQ ID NO: 1908492 - RNA, 13 nt, Shigella flexneri 2a str. 2457T
ccuucuucugccg

SEQ ID NO: 1908493 - RNA, 16 nt, Shigella flexneri 2a str. 2457T
ccuucuugaacccuuu

SEQ ID NO: 1908494 - RNA, 18 nt, Shigella flexneri 2a str. 2457T
ccuucuuugaacugaaua

SEQ ID NO: 1908495 - RNA, 17 nt, Shigella flexneri 2a str. 2457T
ccuucuuuuauuucuga

SEQ ID NO: 1908496 - RNA, 18 nt, Shigella flexneri 2a str. 2457T
ccuucugcgcccgcccgc

SEQ ID NO: 1908497 - RNA, 19 nt, Shigella flexneri 2a str. 2457T
ccuucugagaucaaugcgc

SEQ ID NO: 1908498 - RNA, 20 nt, Shigella flexneri 2a str. 2457T
ccuucgguagcagcuuucag

SEQ ID NO: 1908499 - RNA, 14 nt, Shigella flexneri 2a str. 2457T
ccuucggucagagu

SEQ ID NO: 1908500 - RNA, 14 nt, Shigella flexneri 2a str. 2457T
ccuucgugcggcug

SEQ ID NO: 1908501 - RNA, 17 nt, Shigella flexneri 2a str. 2457T
ccuucguucacagaggg

SEQ ID NO: 1908502 - RNA, 12 nt, Shigella flexneri 2a str. 2457T
ccuucuccacac

SEQ ID NO: 1908503 - RNA, 15 nt, Shigella flexneri 2a str. 2457T
ccuucuccacaccgu

SEQ ID NO: 1908504 - RNA, 13 nt, Shigella flexneri 2a str. 2457T
cgaaggugcauug

SEQ ID NO: 1908505 - RNA, 12 nt, Shigella flexneri 2a str. 2457T
cgaaguuuuccu

SEQ ID NO: 1908506 - RNA, 20 nt, Shigella flexneri 2a str. 2457T
cgaaguuguagcuggcuucg

SEQ ID NO: 1908507 - RNA, 21 nt, Shigella flexneri 2a str. 2457T
cgaaguggacgaacaguucaa

SEQ ID NO: 1908508 - RNA, 23 nt, Shigella flexneri 2a str. 2457T
cgaagcccucaaacaacacagcg

SEQ ID NO: 1908509 - RNA, 17 nt, Shigella flexneri 2a str. 2457T
cgaagccguauucugac

SEQ ID NO: 1908510 - RNA, 15 nt, Shigella flexneri 2a str. 2457T
cgaagcgcaguuuaa

SEQ ID NO: 1908511 - RNA, 22 nt, Shigella flexneri 2a str. 2457T
cgaagcuuucuugcagcucuug

SEQ ID NO: 1908512 - RNA, 19 nt, Shigella flexneri 2a str. 2457T
cgaaggaauuuuacagccc

SEQ ID NO: 1908513 - RNA, 13 nt, Shigella flexneri 2a str. 2457T
cgaaggacggccg

SEQ ID NO: 1908514 - RNA, 16 nt, Shigella flexneri 2a str. 2457T
cgaacugguaaggaac

SEQ ID NO: 1908515 - RNA, 19 nt, Shigella flexneri 2a str. 2457T
cgaacuccgccccggcaau

SEQ ID NO: 1908516 - RNA, 10 nt, Shigella flexneri 2a str. 2457T
cgaacgcugc

SEQ ID NO: 1908517 - RNA, 22 nt, Shigella flexneri 2a str. 2457T
cgaacgggauaaacgaaaugcg

SEQ ID NO: 1908518 - RNA, 16 nt, Shigella flexneri 2a str. 2457T
cgaacguccagccagg

SEQ ID NO: 1908519 - RNA, 17 nt, Shigella flexneri 2a str. 2457T
cgaacguuuaauaaaac

SEQ ID NO: 1908520 - RNA, 13 nt, Shigella flexneri 2a str. 2457T
cgaagaaagcaau

SEQ ID NO: 1908521 - RNA, 16 nt, Shigella flexneri 2a str. 2457T
cgaagaaaacauggcg

SEQ ID NO: 1908522 - RNA, 22 nt, Shigella flexneri 2a str. 2457T
cgaagaagugguucauguugcg

SEQ ID NO: 1908523 - RNA, 13 nt, Shigella flexneri 2a str. 2457T
cgaagaacugcug

SEQ ID NO: 1908524 - RNA, 19 nt, Shigella flexneri 2a str. 2457T
cgaagaacugcuggaagcu

SEQ ID NO: 1908525 - RNA, 20 nt, Shigella flexneri 2a str. 2457T
cgaagauaguuggcagcgcg

SEQ ID NO: 1908526 - RNA, 18 nt, Shigella flexneri 2a str. 2457T
cgaagauauucaucagcg

SEQ ID NO: 1908527 - RNA, 22 nt, Shigella flexneri 2a str. 2457T
cgaagauggcauacaacgccau

SEQ ID NO: 1908528 - RNA, 15 nt, Shigella flexneri 2a str. 2457T
cgaagccaauuugcg

SEQ ID NO: 1908529 - RNA, 14 nt, Shigella flexneri 2a str. 2457T
cgaagcauugcgcc

SEQ ID NO: 1908530 - RNA, 18 nt, Shigella flexneri 2a str. 2457T
cgaagauuucguuuucua

SEQ ID NO: 1908531 - RNA, 19 nt, Shigella flexneri 2a str. 2457T
cgacaaccugaccuuuuuu

SEQ ID NO: 1908532 - RNA, 14 nt, Shigella flexneri 2a str. 2457T
cgacaaauguugca

SEQ ID NO: 1908533 - RNA, 17 nt, Shigella flexneri 2a str. 2457T
cgacaauaugcucucca

SEQ ID NO: 1908534 - RNA, 18 nt, Shigella flexneri 2a str. 2457T
cgacaacugacgaaucaa

SEQ ID NO: 1908535 - RNA, 21 nt, Shigella flexneri 2a str. 2457T
cgacaaaaucggaaacaaaua

SEQ ID NO: 1908536 - RNA, 22 nt, Shigella flexneri 2a str. 2457T
cgaauuuuccaugaccugccag

SEQ ID NO: 1908537 - RNA, 15 nt, Shigella flexneri 2a str. 2457T
cgacacaauccaugc

SEQ ID NO: 1908538 - RNA, 16 nt, Shigella flexneri 2a str. 2457T
cgacaaugccacaaac

SEQ ID NO: 1908539 - RNA, 14 nt, Shigella flexneri 2a str. 2457T
cgacagcagccccg

SEQ ID NO: 1908540 - RNA, 16 nt, Shigella flexneri 2a str. 2457T
cgacagagaaagcaaa

SEQ ID NO: 1908541 - RNA, 17 nt, Shigella flexneri 2a str. 2457T
cgacacgccuccuggcu

SEQ ID NO: 1908542 - RNA, 16 nt, Shigella flexneri 2a str. 2457T
cgaauccagcaugcuc

SEQ ID NO: 1908543 - RNA, 11 nt, Shigella flexneri 2a str. 2457T
cgaauauaaau

SEQ ID NO: 1908544 - RNA, 20 nt, Shigella flexneri 2a str. 2457T
cgaauauaaauauuuucuga

SEQ ID NO: 1908545 - RNA, 23 nt, Shigella flexneri 2a str. 2457T
cgaaucaugguuuauuucccaga

SEQ ID NO: 1908546 - RNA, 16 nt, Shigella flexneri 2a str. 2457T
cgaauauguuuuugca

SEQ ID NO: 1908547 - RNA, 22 nt, Shigella flexneri 2a str. 2457T
cgaauacuccccuuucuuauuu

SEQ ID NO: 1908548 - RNA, 16 nt, Shigella flexneri 2a str. 2457T
cgaauaccuucuuccu

SEQ ID NO: 1908549 - RNA, 13 nt, Shigella flexneri 2a str. 2457T
cgaauaccuucuu

SEQ ID NO: 1908550 - RNA, 15 nt, Shigella flexneri 2a str. 2457T
cgaaucugcaaucaa

SEQ ID NO: 1908551 - RNA, 13 nt, Shigella flexneri 2a str. 2457T
cgaaucuguuuuu

SEQ ID NO: 1908552 - RNA, 13 nt, Shigella flexneri 2a str. 2457T
cgaaugacaugcc

SEQ ID NO: 1908553 - RNA, 21 nt, Shigella flexneri 2a str. 2457T
cgaauggaaagcccgccccgc

SEQ ID NO: 1908554 - RNA, 16 nt, Shigella flexneri 2a str. 2457T
cgaauucuaucaugca

SEQ ID NO: 1908555 - RNA, 10 nt, Shigella flexneri 2a str. 2457T
cgaauuccaa

SEQ ID NO: 1908556 - RNA, 17 nt, Shigella flexneri 2a str. 2457T
cgaauggguucgauuuc

SEQ ID NO: 1908557 - RNA, 22 nt, Shigella flexneri 2a str. 2457T
cgaauuaugauagucuguuaac

SEQ ID NO: 1908558 - RNA, 15 nt, Shigella flexneri 2a str. 2457T
cgaauuagcauggcu

SEQ ID NO: 1908559 - RNA, 13 nt, Shigella flexneri 2a str. 2457T
cgacauaaaauaa

SEQ ID NO: 1908560 - RNA, 20 nt, Shigella flexneri 2a str. 2457T
cgacaguuucaccugcugau

SEQ ID NO: 1908561 - RNA, 16 nt, Shigella flexneri 2a str. 2457T
cgacaguuucaccugc

SEQ ID NO: 1908562 - RNA, 17 nt, Shigella flexneri 2a str. 2457T
cgacaguuucaccugcu

SEQ ID NO: 1908563 - RNA, 23 nt, Shigella flexneri 2a str. 2457T
cgacagccauaaagaaaucaccu

SEQ ID NO: 1908564 - RNA, 17 nt, Shigella flexneri 2a str. 2457T
cgacagcgccuuuucuu

SEQ ID NO: 1908565 - RNA, 15 nt, Shigella flexneri 2a str. 2457T
cgacauauucaccau

SEQ ID NO: 1908566 - RNA, 23 nt, Shigella flexneri 2a str. 2457T
cgacauacucagcgccugcugca

SEQ ID NO: 1908567 - RNA, 14 nt, Shigella flexneri 2a str. 2457T
cgacauagccaucc

SEQ ID NO: 1908568 - RNA, 16 nt, Shigella flexneri 2a str. 2457T
cgacaucaucagcggu

SEQ ID NO: 1908569 - RNA, 12 nt, Shigella flexneri 2a str. 2457T
cgacaucgccac

SEQ ID NO: 1908570 - RNA, 20 nt, Shigella flexneri 2a str. 2457T
cgacaucgacguagugaaau

SEQ ID NO: 1908571 - RNA, 19 nt, Shigella flexneri 2a str. 2457T
cgacauccaugcacugcaa

SEQ ID NO: 1908572 - RNA, 22 nt, Shigella flexneri 2a str. 2457T
cgacauccgugcagaacuaaaa

SEQ ID NO: 1908573 - RNA, 15 nt, Shigella flexneri 2a str. 2457T
cgacccgcgacuggu

SEQ ID NO: 1908574 - RNA, 17 nt, Shigella flexneri 2a str. 2457T
cgaccaggcaaaccagu

SEQ ID NO: 1908575 - RNA, 18 nt, Shigella flexneri 2a str. 2457T
cgaccauacagcagcaac

SEQ ID NO: 1908576 - RNA, 19 nt, Shigella flexneri 2a str. 2457T
cgaccaucggaucggccau

SEQ ID NO: 1908577 - RNA, 19 nt, Shigella flexneri 2a str. 2457T
cgaccaucggcaccaccaa

SEQ ID NO: 1908578 - RNA, 14 nt, Shigella flexneri 2a str. 2457T
cgaccaucagcugc

SEQ ID NO: 1908579 - RNA, 18 nt, Shigella flexneri 2a str. 2457T
cgaccaucagcugccagg

SEQ ID NO: 1908580 - RNA, 18 nt, Shigella flexneri 2a str. 2457T
cgaccaugacacuucagc

SEQ ID NO: 1908581 - RNA, 21 nt, Shigella flexneri 2a str. 2457T
cgaccaucuccuuacugcccc

SEQ ID NO: 1908582 - RNA, 12 nt, Shigella flexneri 2a str. 2457T
cgaccaccagcg

SEQ ID NO: 1908583 - RNA, 21 nt, Shigella flexneri 2a str. 2457T
cgaccagauaagaacugacuu

SEQ ID NO: 1908584 - RNA, 12 nt, Shigella flexneri 2a str. 2457T
cgaccacuucau

SEQ ID NO: 1908585 - RNA, 22 nt, Shigella flexneri 2a str. 2457T
cgaccagcggaauucccgcuuc

SEQ ID NO: 1908586 - RNA, 20 nt, Shigella flexneri 2a str. 2457T
cgaccuucgcggucagcgcc

SEQ ID NO: 1908587 - RNA, 22 nt, Shigella flexneri 2a str. 2457T
cgaccuucgcggucagcgccuc

SEQ ID NO: 1908588 - RNA, 15 nt, Shigella flexneri 2a str. 2457T
cgacgaacaccaacc

SEQ ID NO: 1908589 - RNA, 15 nt, Shigella flexneri 2a str. 2457T
cgacgaacagcucag

SEQ ID NO: 1908590 - RNA, 12 nt, Shigella flexneri 2a str. 2457T
cgacgacuggcc

SEQ ID NO: 1908591 - RNA, 20 nt, Shigella flexneri 2a str. 2457T
cgacgacugccgcucaccug

SEQ ID NO: 1908592 - RNA, 20 nt, Shigella flexneri 2a str. 2457T
cgacgcaaacgacgagcgcu

SEQ ID NO: 1908593 - RNA, 12 nt, Shigella flexneri 2a str. 2457T
cgacgauugcuu

SEQ ID NO: 1908594 - RNA, 18 nt, Shigella flexneri 2a str. 2457T
cgaccugcgccugcacca

SEQ ID NO: 1908595 - RNA, 19 nt, Shigella flexneri 2a str. 2457T
cgaccuaaacguuuaaaaa

SEQ ID NO: 1908596 - RNA, 19 nt, Shigella flexneri 2a str. 2457T
cgaccggcguaacggccac

SEQ ID NO: 1908597 - RNA, 17 nt, Shigella flexneri 2a str. 2457T
cgaccggguuagucugg

SEQ ID NO: 1908598 - RNA, 21 nt, Shigella flexneri 2a str. 2457T
cgaccggccauuccagcaccc

SEQ ID NO: 1908599 - RNA, 12 nt, Shigella flexneri 2a str. 2457T
cgaccgcagcau

SEQ ID NO: 1908600 - RNA, 16 nt, Shigella flexneri 2a str. 2457T
cccagauagcaacagc

SEQ ID NO: 1908601 - RNA, 15 nt, Shigella flexneri 2a str. 2457T
cccagauagcaacag

SEQ ID NO: 1908602 - RNA, 15 nt, Shigella flexneri 2a str. 2457T
cccagcaucacgccc

SEQ ID NO: 1908603 - RNA, 21 nt, Shigella flexneri 2a str. 2457T
cccagaagcuuuccaucggag

SEQ ID NO: 1908604 - RNA, 18 nt, Shigella flexneri 2a str. 2457T
cccagaccugcguucagc

SEQ ID NO: 1908605 - RNA, 19 nt, Shigella flexneri 2a str. 2457T
cccacuuuuauuucacccc

SEQ ID NO: 1908606 - RNA, 16 nt, Shigella flexneri 2a str. 2457T
cccacuuucugcgcaa

SEQ ID NO: 1908607 - RNA, 17 nt, Shigella flexneri 2a str. 2457T
cccacuuucugcgcaau

SEQ ID NO: 1908608 - RNA, 19 nt, Shigella flexneri 2a str. 2457T
cccacugcucaaucaucac

SEQ ID NO: 1908609 - RNA, 13 nt, Shigella flexneri 2a str. 2457T
cccaccgcagccc

SEQ ID NO: 1908610 - RNA, 13 nt, Shigella flexneri 2a str. 2457T
cccaccgcaauaa

SEQ ID NO: 1908611 - RNA, 16 nt, Shigella flexneri 2a str. 2457T
cccacgaccgcagcau

SEQ ID NO: 1908612 - RNA, 13 nt, Shigella flexneri 2a str. 2457T
cccacucgccccg

SEQ ID NO: 1908613 - RNA, 17 nt, Shigella flexneri 2a str. 2457T
cccacucgccccgagaa

SEQ ID NO: 1908614 - RNA, 15 nt, Shigella flexneri 2a str. 2457T
cccacgccagccugc

SEQ ID NO: 1908615 - RNA, 23 nt, Shigella flexneri 2a str. 2457T
cccacgauugaucucguugauca

SEQ ID NO: 1908616 - RNA, 23 nt, Shigella flexneri 2a str. 2457T
cccaacgcaaagagagaagccag

SEQ ID NO: 1908617 - RNA, 17 nt, Shigella flexneri 2a str. 2457T
cccaacgcgccaccgac

SEQ ID NO: 1908618 - RNA, 15 nt, Shigella flexneri 2a str. 2457T
cccaacguaacaaaa

SEQ ID NO: 1908619 - RNA, 18 nt, Shigella flexneri 2a str. 2457T
cccaacgugaccaguacc

SEQ ID NO: 1908620 - RNA, 15 nt, Shigella flexneri 2a str. 2457T
cccaaucccccacuu

SEQ ID NO: 1908621 - RNA, 20 nt, Shigella flexneri 2a str. 2457T
cccaauccaguacaugaagc

SEQ ID NO: 1908622 - RNA, 22 nt, Shigella flexneri 2a str. 2457T
cccaauacgauuaacgccagac

SEQ ID NO: 1908623 - RNA, 19 nt, Shigella flexneri 2a str. 2457T
cccaccccagcagcagccg

SEQ ID NO: 1908624 - RNA, 15 nt, Shigella flexneri 2a str. 2457T
cccaccccggcccuc

SEQ ID NO: 1908625 - RNA, 12 nt, Shigella flexneri 2a str. 2457T
cccacauccaug

SEQ ID NO: 1908626 - RNA, 15 nt, Shigella flexneri 2a str. 2457T
cccacauccaugugg

SEQ ID NO: 1908627 - RNA, 11 nt, Shigella flexneri 2a str. 2457T
cccacaaccgg

SEQ ID NO: 1908628 - RNA, 15 nt, Shigella flexneri 2a str. 2457T
cccacaaccggcggg

SEQ ID NO: 1908629 - RNA, 20 nt, Shigella flexneri 2a str. 2457T
cccacaguuucagccccauc

SEQ ID NO: 1908630 - RNA, 19 nt, Shigella flexneri 2a str. 2457T
cccacaguuucauaucugc

SEQ ID NO: 1908631 - RNA, 18 nt, Shigella flexneri 2a str. 2457T
cccacaaacccgccagac

SEQ ID NO: 1908632 - RNA, 19 nt, Shigella flexneri 2a str. 2457T
ccauucccccuuugaccag

SEQ ID NO: 1908633 - RNA, 22 nt, Shigella flexneri 2a str. 2457T
ccauuccaguaauugacgcauc

SEQ ID NO: 1908634 - RNA, 11 nt, Shigella flexneri 2a str. 2457T
ccauucaggcu

SEQ ID NO: 1908635 - RNA, 22 nt, Shigella flexneri 2a str. 2457T
ccauucuggauaaucaaugaca

SEQ ID NO: 1908636 - RNA, 12 nt, Shigella flexneri 2a str. 2457T
ccauugcucugg

SEQ ID NO: 1908637 - RNA, 20 nt, Shigella flexneri 2a str. 2457T
ccauugggccacucaacauc

SEQ ID NO: 1908638 - RNA, 15 nt, Shigella flexneri 2a str. 2457T
ccauugggccacuca

SEQ ID NO: 1908639 - RNA, 19 nt, Shigella flexneri 2a str. 2457T
ccauuggcggcguccugga

SEQ ID NO: 1908640 - RNA, 13 nt, Shigella flexneri 2a str. 2457T
ccauuggcaggcu

SEQ ID NO: 1908641 - RNA, 16 nt, Shigella flexneri 2a str. 2457T
ccauucaccauuuuuu

SEQ ID NO: 1908642 - RNA, 17 nt, Shigella flexneri 2a str. 2457T
ccauucaccauuuuuua

SEQ ID NO: 1908643 - RNA, 19 nt, Shigella flexneri 2a str. 2457T
ccauuauccgucagccacu

SEQ ID NO: 1908644 - RNA, 23 nt, Shigella flexneri 2a str. 2457T
ccauguuuaauucacgcaggcga

SEQ ID NO: 1908645 - RNA, 13 nt, Shigella flexneri 2a str. 2457T
ccauuaaaagaau

SEQ ID NO: 1908646 - RNA, 12 nt, Shigella flexneri 2a str. 2457T
ccauuaaacacc

SEQ ID NO: 1908647 - RNA, 21 nt, Shigella flexneri 2a str. 2457T
ccauuaaggcugaugaagcaa

SEQ ID NO: 1908648 - RNA, 13 nt, Shigella flexneri 2a str. 2457T
ccaugugcuggac

SEQ ID NO: 1908649 - RNA, 15 nt, Shigella flexneri 2a str. 2457T
ccauguugacuucaa

SEQ ID NO: 1908650 - RNA, 20 nt, Shigella flexneri 2a str. 2457T
ccauguuauuaguguguaua

SEQ ID NO: 1908651 - RNA, 18 nt, Shigella flexneri 2a str. 2457T
ccauggcucaccagcagc

SEQ ID NO: 1908652 - RNA, 20 nt, Shigella flexneri 2a str. 2457T
ccauggcucaccagcagcgg

SEQ ID NO: 1908653 - RNA, 14 nt, Shigella flexneri 2a str. 2457T
ccauggacgcguca

SEQ ID NO: 1908654 - RNA, 19 nt, Shigella flexneri 2a str. 2457T
ccaugcugucggcugccag

SEQ ID NO: 1908655 - RNA, 15 nt, Shigella flexneri 2a str. 2457T
ccaugcugugcgcca

SEQ ID NO: 1908656 - RNA, 23 nt, Shigella flexneri 2a str. 2457T
ccaugcugugcgccacagacaua

SEQ ID NO: 1908657 - RNA, 16 nt, Shigella flexneri 2a str. 2457T
ccaugcuucaauuucc

SEQ ID NO: 1908658 - RNA, 18 nt, Shigella flexneri 2a str. 2457T
ccaugcuucaauuuccug

SEQ ID NO: 1908659 - RNA, 23 nt, Shigella flexneri 2a str. 2457T
ccaugcgaagaccgcaucacgac

SEQ ID NO: 1908660 - RNA, 21 nt, Shigella flexneri 2a str. 2457T
ccaugcguugucgccauccag

SEQ ID NO: 1908661 - RNA, 16 nt, Shigella flexneri 2a str. 2457T
ccaugcugagcuucuu

SEQ ID NO: 1908662 - RNA, 15 nt, Shigella flexneri 2a str. 2457T
ccaugcgcaucaucg

SEQ ID NO: 1908663 - RNA, 19 nt, Shigella flexneri 2a str. 2457T
ccaugcgaagaagggacua

SEQ ID NO: 1908664 - RNA, 20 nt, Shigella flexneri 2a str. 2457T
cccagguuucaaugccgccg

SEQ ID NO: 1908665 - RNA, 16 nt, Shigella flexneri 2a str. 2457T
cccaguagacgagccg

SEQ ID NO: 1908666 - RNA, 15 nt, Shigella flexneri 2a str. 2457T
cccaguagacagcaa

SEQ ID NO: 1908667 - RNA, 13 nt, Shigella flexneri 2a str. 2457T
cccaguaauucag

SEQ ID NO: 1908668 - RNA, 16 nt, Shigella flexneri 2a str. 2457T
cccagugaguuggggc

SEQ ID NO: 1908669 - RNA, 16 nt, Shigella flexneri 2a str. 2457T
cccagccagacgccag

SEQ ID NO: 1908670 - RNA, 22 nt, Shigella flexneri 2a str. 2457T
cccagccagacgccagccacag

SEQ ID NO: 1908671 - RNA, 23 nt, Shigella flexneri 2a str. 2457T
cccauaacggggcuaccggauuu

SEQ ID NO: 1908672 - RNA, 20 nt, Shigella flexneri 2a str. 2457T
cccauauguucccgcgccuc

SEQ ID NO: 1908673 - RNA, 19 nt, Shigella flexneri 2a str. 2457T
cccauacuugcaagaucgc

SEQ ID NO: 1908674 - RNA, 22 nt, Shigella flexneri 2a str. 2457T
cccauagauaccuucuugacau

SEQ ID NO: 1908675 - RNA, 20 nt, Shigella flexneri 2a str. 2457T
cccaguuacugccaucuucc

SEQ ID NO: 1908676 - RNA, 14 nt, Shigella flexneri 2a str. 2457T
cccaguucagcggc

SEQ ID NO: 1908677 - RNA, 15 nt, Shigella flexneri 2a str. 2457T
cccaguggcagcaau

SEQ ID NO: 1908678 - RNA, 20 nt, Shigella flexneri 2a str. 2457T
cccagugguuucgccagcac

SEQ ID NO: 1908679 - RNA, 14 nt, Shigella flexneri 2a str. 2457T
cccaucucuucuuc

SEQ ID NO: 1908680 - RNA, 14 nt, Shigella flexneri 2a str. 2457T
cccaugacuuugau

SEQ ID NO: 1908681 - RNA, 19 nt, Shigella flexneri 2a str. 2457T
cccaucuuuuuaaguuuau

SEQ ID NO: 1908682 - RNA, 14 nt, Shigella flexneri 2a str. 2457T
cccaucaacgccau

SEQ ID NO: 1908683 - RNA, 23 nt, Shigella flexneri 2a str. 2457T
cccaucacaauggcacaaauggc

SEQ ID NO: 1908684 - RNA, 11 nt, Shigella flexneri 2a str. 2457T
cccauccacgc

SEQ ID NO: 1908685 - RNA, 20 nt, Shigella flexneri 2a str. 2457T
cccccguuuuguugucaggu

SEQ ID NO: 1908686 - RNA, 17 nt, Shigella flexneri 2a str. 2457T
cccccugaagcaguuuc

SEQ ID NO: 1908687 - RNA, 23 nt, Shigella flexneri 2a str. 2457T
cccccgucaccggcacaaagcug

SEQ ID NO: 1908688 - RNA, 17 nt, Shigella flexneri 2a str. 2457T
cccccaaauaaccccuc

SEQ ID NO: 1908689 - RNA, 16 nt, Shigella flexneri 2a str. 2457T
cccccgggccuccccu

SEQ ID NO: 1908690 - RNA, 12 nt, Shigella flexneri 2a str. 2457T
ccccagcuuuug

SEQ ID NO: 1908691 - RNA, 15 nt, Shigella flexneri 2a str. 2457T
ccccaggccagcagc

SEQ ID NO: 1908692 - RNA, 17 nt, Shigella flexneri 2a str. 2457T
ccccagucuuccugcgg

SEQ ID NO: 1908693 - RNA, 15 nt, Shigella flexneri 2a str. 2457T
cccauuucuccagca

SEQ ID NO: 1908694 - RNA, 12 nt, Shigella flexneri 2a str. 2457T
cccauuugccac

SEQ ID NO: 1908695 - RNA, 13 nt, Shigella flexneri 2a str. 2457T
cccauuugccacu

SEQ ID NO: 1908696 - RNA, 12 nt, Shigella flexneri 2a str. 2457T
cccauuucucca

SEQ ID NO: 1908697 - RNA, 19 nt, Shigella flexneri 2a str. 2457T
ccccgugaugaacugcggu

SEQ ID NO: 1908698 - RNA, 17 nt, Shigella flexneri 2a str. 2457T
ccccgucagcaaaauac

SEQ ID NO: 1908699 - RNA, 12 nt, Shigella flexneri 2a str. 2457T
ccccuccagcga

SEQ ID NO: 1908700 - RNA, 17 nt, Shigella flexneri 2a str. 2457T
ccccggcccucucccua

SEQ ID NO: 1908701 - RNA, 22 nt, Shigella flexneri 2a str. 2457T
ccccggcugccggaugacagac

SEQ ID NO: 1908702 - RNA, 21 nt, Shigella flexneri 2a str. 2457T
ccccggcgaucccagagcggg

SEQ ID NO: 1908703 - RNA, 18 nt, Shigella flexneri 2a str. 2457T
ccccggcagugcuuucau

SEQ ID NO: 1908704 - RNA, 21 nt, Shigella flexneri 2a str. 2457T
cccccuuugaccagccaguca

SEQ ID NO: 1908705 - RNA, 13 nt, Shigella flexneri 2a str. 2457T
cccccuuccugcu

SEQ ID NO: 1908706 - RNA, 18 nt, Shigella flexneri 2a str. 2457T
ccaugaccgcuccgccau

SEQ ID NO: 1908707 - RNA, 12 nt, Shigella flexneri 2a str. 2457T
ccaugaccgccg

SEQ ID NO: 1908708 - RNA, 20 nt, Shigella flexneri 2a str. 2457T
ccaugaccgccgcagcaacc

SEQ ID NO: 1908709 - RNA, 17 nt, Shigella flexneri 2a str. 2457T
ccaugagaagcugaaau

SEQ ID NO: 1908710 - RNA, 18 nt, Shigella flexneri 2a str. 2457T
ccaugagaagcugaaauc

SEQ ID NO: 1908711 - RNA, 12 nt, Shigella flexneri 2a str. 2457T
ccaugagacaaa

SEQ ID NO: 1908712 - RNA, 16 nt, Shigella flexneri 2a str. 2457T
ccaugauaguguccau

SEQ ID NO: 1908713 - RNA, 14 nt, Shigella flexneri 2a str. 2457T
ccaugauauuggca

SEQ ID NO: 1908714 - RNA, 14 nt, Shigella flexneri 2a str. 2457T
ccaucuucaccgcc

SEQ ID NO: 1908715 - RNA, 13 nt, Shigella flexneri 2a str. 2457T
ccaugccaucugc

SEQ ID NO: 1908716 - RNA, 23 nt, Shigella flexneri 2a str. 2457T
ccaugccggaugcgccagcaucc

SEQ ID NO: 1908717 - RNA, 20 nt, Shigella flexneri 2a str. 2457T
ccaugccggaugcgccagca

SEQ ID NO: 1908718 - RNA, 21 nt, Shigella flexneri 2a str. 2457T
ccaugccggaugcgccagcau

SEQ ID NO: 1908719 - RNA, 19 nt, Shigella flexneri 2a str. 2457T
ccaugccggaugcgccagc

SEQ ID NO: 1908720 - RNA, 15 nt, Shigella flexneri 2a str. 2457T
ccaugccguucuggg

SEQ ID NO: 1908721 - RNA, 22 nt, Shigella flexneri 2a str. 2457T
ccaugccggugaugccgccaga

SEQ ID NO: 1908722 - RNA, 17 nt, Shigella flexneri 2a str. 2457T
ccaugcaccaacccuaa

SEQ ID NO: 1908723 - RNA, 15 nt, Shigella flexneri 2a str. 2457T
ccaugcacugcaacg

SEQ ID NO: 1908724 - RNA, 19 nt, Shigella flexneri 2a str. 2457T
ccaugcaggaucgcuccau

SEQ ID NO: 1908725 - RNA, 11 nt, Shigella flexneri 2a str. 2457T
ccaugcauauc

SEQ ID NO: 1908726 - RNA, 18 nt, Shigella flexneri 2a str. 2457T
ccaucgcuacauaacgca

SEQ ID NO: 1908727 - RNA, 15 nt, Shigella flexneri 2a str. 2457T
ccaucuccuuacugc

SEQ ID NO: 1908728 - RNA, 21 nt, Shigella flexneri 2a str. 2457T
ccaucucugcaacgucuuccc

SEQ ID NO: 1908729 - RNA, 15 nt, Shigella flexneri 2a str. 2457T
ccauccgucauccau

SEQ ID NO: 1908730 - RNA, 21 nt, Shigella flexneri 2a str. 2457T
ccauccccaaaaaaucaacga

SEQ ID NO: 1908731 - RNA, 18 nt, Shigella flexneri 2a str. 2457T
ccauccauuuuucacgca

SEQ ID NO: 1908732 - RNA, 13 nt, Shigella flexneri 2a str. 2457T
ccauccagcaaca

SEQ ID NO: 1908733 - RNA, 23 nt, Shigella flexneri 2a str. 2457T
ccauccagcuuuuagaucacuca

SEQ ID NO: 1908734 - RNA, 16 nt, Shigella flexneri 2a str. 2457T
ccauccaucaacgcca

SEQ ID NO: 1908735 - RNA, 18 nt, Shigella flexneri 2a str. 2457T
ccauccaucaacgccagc

SEQ ID NO: 1908736 - RNA, 13 nt, Shigella flexneri 2a str. 2457T
ccaucaccgcgag

SEQ ID NO: 1908737 - RNA, 13 nt, Shigella flexneri 2a str. 2457T
ccaucaccucuuc

SEQ ID NO: 1908738 - RNA, 13 nt, Shigella flexneri 2a str. 2457T
ccauacugacgga

SEQ ID NO: 1908739 - RNA, 17 nt, Shigella flexneri 2a str. 2457T
ccauagcaucccaauac

SEQ ID NO: 1908740 - RNA, 16 nt, Shigella flexneri 2a str. 2457T
ccauagcgaaguugau

SEQ ID NO: 1908741 - RNA, 17 nt, Shigella flexneri 2a str. 2457T
ccauaccggcugcaaac

SEQ ID NO: 1908742 - RNA, 22 nt, Shigella flexneri 2a str. 2457T
ccauaguguguuccucugcucc

SEQ ID NO: 1908743 - RNA, 19 nt, Shigella flexneri 2a str. 2457T
ccauauucugaucgugcuc

SEQ ID NO: 1908744 - RNA, 19 nt, Shigella flexneri 2a str. 2457T
ccauauuucuccauuagca

SEQ ID NO: 1908745 - RNA, 15 nt, Shigella flexneri 2a str. 2457T
ccaucaaaucacuaa

SEQ ID NO: 1908746 - RNA, 15 nt, Shigella flexneri 2a str. 2457T
ccaucaacaagcgaa

SEQ ID NO: 1908747 - RNA, 22 nt, Shigella flexneri 2a str. 2457T
ccaucaccaacgauuuuuuccg

SEQ ID NO: 1908748 - RNA, 12 nt, Shigella flexneri 2a str. 2457T
ccaucaaccacu

SEQ ID NO: 1908749 - RNA, 12 nt, Shigella flexneri 2a str. 2457T
ccaucacaccuc

SEQ ID NO: 1908750 - RNA, 13 nt, Shigella flexneri 2a str. 2457T
ccaucaacgccag

SEQ ID NO: 1908751 - RNA, 14 nt, Shigella flexneri 2a str. 2457T
ccaguaaugcgccc

SEQ ID NO: 1908752 - RNA, 13 nt, Shigella flexneri 2a str. 2457T
ccaguaauucagc

SEQ ID NO: 1908753 - RNA, 16 nt, Shigella flexneri 2a str. 2457T
ccaguacaugaagcac

SEQ ID NO: 1908754 - RNA, 14 nt, Shigella flexneri 2a str. 2457T
ccaguaccagcagc

SEQ ID NO: 1908755 - RNA, 11 nt, Shigella flexneri 2a str. 2457T
ccaguaccgau

SEQ ID NO: 1908756 - RNA, 17 nt, Shigella flexneri 2a str. 2457T
ccaguaccgccaccacc

SEQ ID NO: 1908757 - RNA, 24 nt, Shigella flexneri 2a str. 2457T
ccaguaccgccaccaccagacgca

SEQ ID NO: 1908758 - RNA, 16 nt, Shigella flexneri 2a str. 2457T
ccaguacgccuucacg

SEQ ID NO: 1908759 - RNA, 19 nt, Shigella flexneri 2a str. 2457T
ccaguacgcgcaaccccgc

SEQ ID NO: 1908760 - RNA, 15 nt, Shigella flexneri 2a str. 2457T
ccaguacgccaaucu

SEQ ID NO: 1908761 - RNA, 15 nt, Shigella flexneri 2a str. 2457T
ccaguacgccuucac

SEQ ID NO: 1908762 - RNA, 24 nt, Shigella flexneri 2a str. 2457T
ccaguaccuguauaaacuauccug

SEQ ID NO: 1908763 - RNA, 15 nt, Shigella flexneri 2a str. 2457T
ccaguaccgccgcca

SEQ ID NO: 1908764 - RNA, 19 nt, Shigella flexneri 2a str. 2457T
ccaguaccgccagugcagc

SEQ ID NO: 1908765 - RNA, 14 nt, Shigella flexneri 2a str. 2457T
ccaguuacugccac

SEQ ID NO: 1908766 - RNA, 18 nt, Shigella flexneri 2a str. 2457T
ccaguuaaccugcuccuc

SEQ ID NO: 1908767 - RNA, 13 nt, Shigella flexneri 2a str. 2457T
ccaguagacagca

SEQ ID NO: 1908768 - RNA, 15 nt, Shigella flexneri 2a str. 2457T
ccaguggcagcaauu

SEQ ID NO: 1908769 - RNA, 17 nt, Shigella flexneri 2a str. 2457T
ccaguguaaaacagcac

SEQ ID NO: 1908770 - RNA, 14 nt, Shigella flexneri 2a str. 2457T
ccaguucauuugaa

SEQ ID NO: 1908771 - RNA, 21 nt, Shigella flexneri 2a str. 2457T
ccaguucauguucgacaugcu

SEQ ID NO: 1908772 - RNA, 22 nt, Shigella flexneri 2a str. 2457T
ccaguucacgcgauuucucauc

SEQ ID NO: 1908773 - RNA, 15 nt, Shigella flexneri 2a str. 2457T
ccaguucagcggcug

SEQ ID NO: 1908774 - RNA, 17 nt, Shigella flexneri 2a str. 2457T
ccaguucacaccagcca

SEQ ID NO: 1908775 - RNA, 15 nt, Shigella flexneri 2a str. 2457T
ccaguuaucaagcca

SEQ ID NO: 1908776 - RNA, 21 nt, Shigella flexneri 2a str. 2457T
ccaguucaagugcuacccacu

SEQ ID NO: 1908777 - RNA, 12 nt, Shigella flexneri 2a str. 2457T
ccaguucacacc

SEQ ID NO: 1908778 - RNA, 12 nt, Shigella flexneri 2a str. 2457T
ccaguucccccu

SEQ ID NO: 1908779 - RNA, 20 nt, Shigella flexneri 2a str. 2457T
ccaguuucggcaucagcaga

SEQ ID NO: 1908780 - RNA, 23 nt, Shigella flexneri 2a str. 2457T
ccauaagcccagaacaaauaaau

SEQ ID NO: 1908781 - RNA, 15 nt, Shigella flexneri 2a str. 2457T
ccauaagcccagaac

SEQ ID NO: 1908782 - RNA, 22 nt, Shigella flexneri 2a str. 2457T
ccaguuuguucagcugcgugcc

SEQ ID NO: 1908783 - RNA, 21 nt, Shigella flexneri 2a str. 2457T
ccaguuuugccagucagcucc

SEQ ID NO: 1908784 - RNA, 21 nt, Shigella flexneri 2a str. 2457T
ccauaaaaggcaccuggaaau

SEQ ID NO: 1908785 - RNA, 15 nt, Shigella flexneri 2a str. 2457T
ccaguuuucggauuu

SEQ ID NO: 1908786 - RNA, 16 nt, Shigella flexneri 2a str. 2457T
ccaguuuucaaauauc

SEQ ID NO: 1908787 - RNA, 22 nt, Shigella flexneri 2a str. 2457T
ccaggaaccugugacagcagcg

SEQ ID NO: 1908788 - RNA, 21 nt, Shigella flexneri 2a str. 2457T
ccaggaacgcgccaagauaga

SEQ ID NO: 1908789 - RNA, 21 nt, Shigella flexneri 2a str. 2457T
ccaggaaccugugacagcagc

SEQ ID NO: 1908790 - RNA, 16 nt, Shigella flexneri 2a str. 2457T
ccaggaaccugugaca

SEQ ID NO: 1908791 - RNA, 13 nt, Shigella flexneri 2a str. 2457T
ccaggaacagaag

SEQ ID NO: 1908792 - RNA, 23 nt, Shigella flexneri 2a str. 2457T
ccagcuuucgcuuaacgcccaug

SEQ ID NO: 1908793 - RNA, 14 nt, Shigella flexneri 2a str. 2457T
ccaggagauuaacg

SEQ ID NO: 1908794 - RNA, 20 nt, Shigella flexneri 2a str. 2457T
ccaggaucagacacaauaau

SEQ ID NO: 1908795 - RNA, 22 nt, Shigella flexneri 2a str. 2457T
ccagcugacguagcaguucacc

SEQ ID NO: 1908796 - RNA, 15 nt, Shigella flexneri 2a str. 2457T
ccagcucuucuucac

SEQ ID NO: 1908797 - RNA, 23 nt, Shigella flexneri 2a str. 2457T
ccagcucuucuucacucucacca

SEQ ID NO: 1908798 - RNA, 14 nt, Shigella flexneri 2a str. 2457T
ccagcucuucuuca

SEQ ID NO: 1908799 - RNA, 22 nt, Shigella flexneri 2a str. 2457T
ccagcuguggucuuuaaugaca

SEQ ID NO: 1908800 - RNA, 11 nt, Shigella flexneri 2a str. 2457T
ccagcuugaag

SEQ ID NO: 1908801 - RNA, 15 nt, Shigella flexneri 2a str. 2457T
ccagcuucagauuca

SEQ ID NO: 1908802 - RNA, 18 nt, Shigella flexneri 2a str. 2457T
ccagcuucaacgauucaa

SEQ ID NO: 1908803 - RNA, 15 nt, Shigella flexneri 2a str. 2457T
ccagcuuagcauccc

SEQ ID NO: 1908804 - RNA, 21 nt, Shigella flexneri 2a str. 2457T
ccagcuucccaaagaucuccu

SEQ ID NO: 1908805 - RNA, 12 nt, Shigella flexneri 2a str. 2457T
ccagcguaaauc

SEQ ID NO: 1908806 - RNA, 23 nt, Shigella flexneri 2a str. 2457T
ccagcguaaauccugacgcuggg

SEQ ID NO: 1908807 - RNA, 18 nt, Shigella flexneri 2a str. 2457T
ccagcguagugaaggcaa

SEQ ID NO: 1908808 - RNA, 13 nt, Shigella flexneri 2a str. 2457T
ccagcguggagag

SEQ ID NO: 1908809 - RNA, 21 nt, Shigella flexneri 2a str. 2457T
ccagcguggcgaacggauagc

SEQ ID NO: 1908810 - RNA, 17 nt, Shigella flexneri 2a str. 2457T
ccagcguggucauggca

SEQ ID NO: 1908811 - RNA, 19 nt, Shigella flexneri 2a str. 2457T
ccagcguguugaggaagcg

SEQ ID NO: 1908812 - RNA, 15 nt, Shigella flexneri 2a str. 2457T
ccagcuccggcaccu

SEQ ID NO: 1908813 - RNA, 19 nt, Shigella flexneri 2a str. 2457T
ccagcuccccacgauugau

SEQ ID NO: 1908814 - RNA, 12 nt, Shigella flexneri 2a str. 2457T
ccagcuccagcc

SEQ ID NO: 1908815 - RNA, 15 nt, Shigella flexneri 2a str. 2457T
ccagggauaaagccc

SEQ ID NO: 1908816 - RNA, 20 nt, Shigella flexneri 2a str. 2457T
ccagggcagcaguucaugca

SEQ ID NO: 1908817 - RNA, 22 nt, Shigella flexneri 2a str. 2457T
ccagggaucgggucaccgccga

SEQ ID NO: 1908818 - RNA, 19 nt, Shigella flexneri 2a str. 2457T
ccagggccuccugcagcgu

SEQ ID NO: 1908819 - RNA, 16 nt, Shigella flexneri 2a str. 2457T
ccagggccaacuggca

SEQ ID NO: 1908820 - RNA, 16 nt, Shigella flexneri 2a str. 2457T
ccaggcgagaucggca

SEQ ID NO: 1908821 - RNA, 20 nt, Shigella flexneri 2a str. 2457T
ccaggcacuuucaguuugac

SEQ ID NO: 1908822 - RNA, 18 nt, Shigella flexneri 2a str. 2457T
ccagguacgcaggcggcu

SEQ ID NO: 1908823 - RNA, 16 nt, Shigella flexneri 2a str. 2457T
ccagggcuuacaaaac

SEQ ID NO: 1908824 - RNA, 20 nt, Shigella flexneri 2a str. 2457T
ccagggcuuuuuuauuucau

SEQ ID NO: 1908825 - RNA, 17 nt, Shigella flexneri 2a str. 2457T
ccaggguuuuauuauuc

SEQ ID NO: 1908826 - RNA, 23 nt, Shigella flexneri 2a str. 2457T
ccagguaaacaccuucauccagc

SEQ ID NO: 1908827 - RNA, 15 nt, Shigella flexneri 2a str. 2457T
ccagguaacgaagau

SEQ ID NO: 1908828 - RNA, 16 nt, Shigella flexneri 2a str. 2457T
ccagguggugcaggcu

SEQ ID NO: 1908829 - RNA, 14 nt, Shigella flexneri 2a str. 2457T
ccagguggugcagg

SEQ ID NO: 1908830 - RNA, 17 nt, Shigella flexneri 2a str. 2457T
ccagguuaacgcaggcg

SEQ ID NO: 1908831 - RNA, 16 nt, Shigella flexneri 2a str. 2457T
ccagguuaaacaguuu

SEQ ID NO: 1908832 - RNA, 21 nt, Shigella flexneri 2a str. 2457T
ccagguuguacuuuccagcca

SEQ ID NO: 1908833 - RNA, 17 nt, Shigella flexneri 2a str. 2457T
ccagguuguucacggca

SEQ ID NO: 1908834 - RNA, 22 nt, Shigella flexneri 2a str. 2457T
ccaguaacgucccccagauccc

SEQ ID NO: 1908835 - RNA, 19 nt, Shigella flexneri 2a str. 2457T
ccaguaagcaguccagcgc

SEQ ID NO: 1908836 - RNA, 21 nt, Shigella flexneri 2a str. 2457T
ccaguaagcaguccagcgccu

SEQ ID NO: 1908837 - RNA, 23 nt, Shigella flexneri 2a str. 2457T
ccaguaagacaccccacagcucu

SEQ ID NO: 1908838 - RNA, 17 nt, Shigella flexneri 2a str. 2457T
ccaguaaccuuucagau

SEQ ID NO: 1908839 - RNA, 19 nt, Shigella flexneri 2a str. 2457T
ccaguaaccuuucagaugu

SEQ ID NO: 1908840 - RNA, 23 nt, Shigella flexneri 2a str. 2457T
ccaguaacucauugccaguccua

SEQ ID NO: 1908841 - RNA, 14 nt, Shigella flexneri 2a str. 2457T
ccaguaaucuggcc

SEQ ID NO: 1908842 - RNA, 19 nt, Shigella flexneri 2a str. 2457T
ccaguaaggcaucuucuuc

SEQ ID NO: 1908843 - RNA, 18 nt, Shigella flexneri 2a str. 2457T
ccaguaaagcagcgaagc

SEQ ID NO: 1908844 - RNA, 14 nt, Shigella flexneri 2a str. 2457T
ccagguuucuucca

SEQ ID NO: 1908845 - RNA, 22 nt, Shigella flexneri 2a str. 2457T
ccagguuuucuuucaccucuuc

SEQ ID NO: 1908846 - RNA, 20 nt, Shigella flexneri 2a str. 2457T
ccagguuuucuuucaccucu

SEQ ID NO: 1908847 - RNA, 13 nt, Shigella flexneri 2a str. 2457T
ccagacaaaccac

SEQ ID NO: 1908848 - RNA, 15 nt, Shigella flexneri 2a str. 2457T
ccagacaccgcugcu

SEQ ID NO: 1908849 - RNA, 19 nt, Shigella flexneri 2a str. 2457T
ccagacaauggcccgccgc

SEQ ID NO: 1908850 - RNA, 22 nt, Shigella flexneri 2a str. 2457T
ccagacacaguucuucaaaaau

SEQ ID NO: 1908851 - RNA, 17 nt, Shigella flexneri 2a str. 2457T
ccagaaacgccaccauu

SEQ ID NO: 1908852 - RNA, 12 nt, Shigella flexneri 2a str. 2457T
ccagaaacaaua

SEQ ID NO: 1908853 - RNA, 20 nt, Shigella flexneri 2a str. 2457T
ccagaaagcguauccaucac

SEQ ID NO: 1908854 - RNA, 23 nt, Shigella flexneri 2a str. 2457T
ccagaaagcguauccaucacuaa

SEQ ID NO: 1908855 - RNA, 23 nt, Shigella flexneri 2a str. 2457T
ccagaacugauaacgcauuucau

SEQ ID NO: 1908856 - RNA, 14 nt, Shigella flexneri 2a str. 2457T
ccagaagaauauca

SEQ ID NO: 1908857 - RNA, 13 nt, Shigella flexneri 2a str. 2457T
ccacuuugcgcuc

SEQ ID NO: 1908858 - RNA, 16 nt, Shigella flexneri 2a str. 2457T
ccacuuugcgcuccug

SEQ ID NO: 1908859 - RNA, 18 nt, Shigella flexneri 2a str. 2457T
ccagaaaaccuggcgcag

SEQ ID NO: 1908860 - RNA, 22 nt, Shigella flexneri 2a str. 2457T
ccacuuuuuucaccgagucguc

SEQ ID NO: 1908861 - RNA, 23 nt, Shigella flexneri 2a str. 2457T
ccagaaaaaacguugucgccgcu

SEQ ID NO: 1908862 - RNA, 12 nt, Shigella flexneri 2a str. 2457T
ccacuuugcgcu

SEQ ID NO: 1908863 - RNA, 16 nt, Shigella flexneri 2a str. 2457T
ccacuuucacgccgcc

SEQ ID NO: 1908864 - RNA, 14 nt, Shigella flexneri 2a str. 2457T
ccacguucugaucu

SEQ ID NO: 1908865 - RNA, 18 nt, Shigella flexneri 2a str. 2457T
ccacguucugaucuuucu

SEQ ID NO: 1908866 - RNA, 13 nt, Shigella flexneri 2a str. 2457T
ccacguucauuuc

SEQ ID NO: 1908867 - RNA, 13 nt, Shigella flexneri 2a str. 2457T
ccacgucugaagu

SEQ ID NO: 1908868 - RNA, 20 nt, Shigella flexneri 2a str. 2457T
ccagacuggagcacugcgcc

SEQ ID NO: 1908869 - RNA, 17 nt, Shigella flexneri 2a str. 2457T
ccagacuggagcacugc

SEQ ID NO: 1908870 - RNA, 15 nt, Shigella flexneri 2a str. 2457T
ccagagaauauuaac

SEQ ID NO: 1908871 - RNA, 19 nt, Shigella flexneri 2a str. 2457T
ccagacguccggcgcugca

SEQ ID NO: 1908872 - RNA, 23 nt, Shigella flexneri 2a str. 2457T
ccagacugaugugauccaucagg

SEQ ID NO: 1908873 - RNA, 14 nt, Shigella flexneri 2a str. 2457T
ccagacugcucagc

SEQ ID NO: 1908874 - RNA, 16 nt, Shigella flexneri 2a str. 2457T
ccagaggagccaucac

SEQ ID NO: 1908875 - RNA, 13 nt, Shigella flexneri 2a str. 2457T
ccagagccugaag

SEQ ID NO: 1908876 - RNA, 17 nt, Shigella flexneri 2a str. 2457T
ccagacgcgcagcuuca

SEQ ID NO: 1908877 - RNA, 18 nt, Shigella flexneri 2a str. 2457T
ccagacgcgcagcuucac

SEQ ID NO: 1908878 - RNA, 19 nt, Shigella flexneri 2a str. 2457T
ccagacgcgcguccccugc

SEQ ID NO: 1908879 - RNA, 13 nt, Shigella flexneri 2a str. 2457T
ccagacgccagcc

SEQ ID NO: 1908880 - RNA, 19 nt, Shigella flexneri 2a str. 2457T
ccagacgcgcagcuucacu

SEQ ID NO: 1908881 - RNA, 23 nt, Shigella flexneri 2a str. 2457T
ccagacgcucuucaauggucagc

SEQ ID NO: 1908882 - RNA, 17 nt, Shigella flexneri 2a str. 2457T
ccagacgguaaccccuc

SEQ ID NO: 1908883 - RNA, 17 nt, Shigella flexneri 2a str. 2457T
ccagacgaauaaaacag

SEQ ID NO: 1908884 - RNA, 12 nt, Shigella flexneri 2a str. 2457T
ccagaccugaau

SEQ ID NO: 1908885 - RNA, 19 nt, Shigella flexneri 2a str. 2457T
ccagaccguggucagaaaa

SEQ ID NO: 1908886 - RNA, 20 nt, Shigella flexneri 2a str. 2457T
ccagaccguggucagaaaag

SEQ ID NO: 1908887 - RNA, 22 nt, Shigella flexneri 2a str. 2457T
ccagacauuauaaauucuggcc

SEQ ID NO: 1908888 - RNA, 21 nt, Shigella flexneri 2a str. 2457T
ccagacaauugccgccagcuc

SEQ ID NO: 1908889 - RNA, 19 nt, Shigella flexneri 2a str. 2457T
ccagacauguggauuaaau

SEQ ID NO: 1908890 - RNA, 15 nt, Shigella flexneri 2a str. 2457T
ccagaccaaacagca

SEQ ID NO: 1908891 - RNA, 15 nt, Shigella flexneri 2a str. 2457T
ccagaugacggcugc

SEQ ID NO: 1908892 - RNA, 23 nt, Shigella flexneri 2a str. 2457T
ccagcaaccaacgccagcagcag

SEQ ID NO: 1908893 - RNA, 21 nt, Shigella flexneri 2a str. 2457T
ccagcaaccaaugccaccagg

SEQ ID NO: 1908894 - RNA, 23 nt, Shigella flexneri 2a str. 2457T
ccagaucugaaucauucagguaa

SEQ ID NO: 1908895 - RNA, 14 nt, Shigella flexneri 2a str. 2457T
ccagaucuucauca

SEQ ID NO: 1908896 - RNA, 20 nt, Shigella flexneri 2a str. 2457T
ccagaucgcucaucugcugc

SEQ ID NO: 1908897 - RNA, 17 nt, Shigella flexneri 2a str. 2457T
ccagaucggacuucaug

SEQ ID NO: 1908898 - RNA, 23 nt, Shigella flexneri 2a str. 2457T
ccagcaaggcgcuaaaagcauag

SEQ ID NO: 1908899 - RNA, 20 nt, Shigella flexneri 2a str. 2457T
ccagcaauccccagacaaaa

SEQ ID NO: 1908900 - RNA, 15 nt, Shigella flexneri 2a str. 2457T
ccagcaauccccaga

SEQ ID NO: 1908901 - RNA, 17 nt, Shigella flexneri 2a str. 2457T
ccagcaauccccagaca

SEQ ID NO: 1908902 - RNA, 23 nt, Shigella flexneri 2a str. 2457T
ccagcaccggacuauccgccgcu

SEQ ID NO: 1908903 - RNA, 15 nt, Shigella flexneri 2a str. 2457T
ccagcacuucgcugg

SEQ ID NO: 1908904 - RNA, 15 nt, Shigella flexneri 2a str. 2457T
ccagccagacgccag

SEQ ID NO: 1908905 - RNA, 16 nt, Shigella flexneri 2a str. 2457T
ccagccagaaucauug

SEQ ID NO: 1908906 - RNA, 12 nt, Shigella flexneri 2a str. 2457T
ccagccagagcc

SEQ ID NO: 1908907 - RNA, 23 nt, Shigella flexneri 2a str. 2457T
ccagcaugugguuaccaucaacc

SEQ ID NO: 1908908 - RNA, 22 nt, Shigella flexneri 2a str. 2457T
ccagccaacuugcccaggugug

SEQ ID NO: 1908909 - RNA, 23 nt, Shigella flexneri 2a str. 2457T
ccagccaguauugccaugcacgc

SEQ ID NO: 1908910 - RNA, 22 nt, Shigella flexneri 2a str. 2457T
ccagccagguguugauccacgg

SEQ ID NO: 1908911 - RNA, 13 nt, Shigella flexneri 2a str. 2457T
ccagcaucgacca

SEQ ID NO: 1908912 - RNA, 17 nt, Shigella flexneri 2a str. 2457T
ccagcaucggcagcgcc

SEQ ID NO: 1908913 - RNA, 17 nt, Shigella flexneri 2a str. 2457T
ccagcaugguaccgugu

SEQ ID NO: 1908914 - RNA, 20 nt, Shigella flexneri 2a str. 2457T
ccagcauggcaauaaccgcu

SEQ ID NO: 1908915 - RNA, 13 nt, Shigella flexneri 2a str. 2457T
ccagcaucaacaa

SEQ ID NO: 1908916 - RNA, 18 nt, Shigella flexneri 2a str. 2457T
ccagcaucacgcccgcuu

SEQ ID NO: 1908917 - RNA, 17 nt, Shigella flexneri 2a str. 2457T
ccagcaucccggcagcc

SEQ ID NO: 1908918 - RNA, 22 nt, Shigella flexneri 2a str. 2457T
ccagcagcgaaucagcccagcc

SEQ ID NO: 1908919 - RNA, 17 nt, Shigella flexneri 2a str. 2457T
ccacggcgcagcuucac

SEQ ID NO: 1908920 - RNA, 14 nt, Shigella flexneri 2a str. 2457T
ccacggcuccagca

SEQ ID NO: 1908921 - RNA, 15 nt, Shigella flexneri 2a str. 2457T
ccacgccacgcugcc

SEQ ID NO: 1908922 - RNA, 16 nt, Shigella flexneri 2a str. 2457T
ccacgcuuaacaaccc

SEQ ID NO: 1908923 - RNA, 18 nt, Shigella flexneri 2a str. 2457T
ccacgcuugcuaacgccc

SEQ ID NO: 1908924 - RNA, 15 nt, Shigella flexneri 2a str. 2457T
ccacgcuuuuuugcu

SEQ ID NO: 1908925 - RNA, 14 nt, Shigella flexneri 2a str. 2457T
ccaccguuucuuuu

SEQ ID NO: 1908926 - RNA, 14 nt, Shigella flexneri 2a str. 2457T
ccaccguuauccug

SEQ ID NO: 1908927 - RNA, 21 nt, Shigella flexneri 2a str. 2457T
ccaccuugcggaaacugucaa

SEQ ID NO: 1908928 - RNA, 14 nt, Shigella flexneri 2a str. 2457T
ccaccuucaacguu

SEQ ID NO: 1908929 - RNA, 18 nt, Shigella flexneri 2a str. 2457T
ccaccucauuaagaugca

SEQ ID NO: 1908930 - RNA, 22 nt, Shigella flexneri 2a str. 2457T
ccaccucccgucgcccacacca

SEQ ID NO: 1908931 - RNA, 14 nt, Shigella flexneri 2a str. 2457T
ccaccuccacgccc

SEQ ID NO: 1908932 - RNA, 20 nt, Shigella flexneri 2a str. 2457T
ccacgaaaccgacugccaug

SEQ ID NO: 1908933 - RNA, 15 nt, Shigella flexneri 2a str. 2457T
ccacgauacgcugca

SEQ ID NO: 1908934 - RNA, 14 nt, Shigella flexneri 2a str. 2457T
ccaccaccaccugc

SEQ ID NO: 1908935 - RNA, 15 nt, Shigella flexneri 2a str. 2457T
ccacauugcaucuga

SEQ ID NO: 1908936 - RNA, 16 nt, Shigella flexneri 2a str. 2457T
ccaccaaacugcgccc

SEQ ID NO: 1908937 - RNA, 14 nt, Shigella flexneri 2a str. 2457T
ccaccaaagauguc

SEQ ID NO: 1908938 - RNA, 21 nt, Shigella flexneri 2a str. 2457T
ccaccaaugacguuaauaaaa

SEQ ID NO: 1908939 - RNA, 18 nt, Shigella flexneri 2a str. 2457T
ccaccaauggcuggccug

SEQ ID NO: 1908940 - RNA, 12 nt, Shigella flexneri 2a str. 2457T
ccaccacaaaag

SEQ ID NO: 1908941 - RNA, 17 nt, Shigella flexneri 2a str. 2457T
ccacaguuucagcccca

SEQ ID NO: 1908942 - RNA, 21 nt, Shigella flexneri 2a str. 2457T
ccacaguuucauaucugccag

SEQ ID NO: 1908943 - RNA, 23 nt, Shigella flexneri 2a str. 2457T
ccacaugcuggucacugacacca

SEQ ID NO: 1908944 - RNA, 17 nt, Shigella flexneri 2a str. 2457T
ccacauuagauaaaaau

SEQ ID NO: 1908945 - RNA, 21 nt, Shigella flexneri 2a str. 2457T
ccacauuagauaaaaaugaag

SEQ ID NO: 1908946 - RNA, 23 nt, Shigella flexneri 2a str. 2457T
ccacauucagccguaacucaucc

SEQ ID NO: 1908947 - RNA, 23 nt, Shigella flexneri 2a str. 2457T
ccaccagacaaccgcucaacaaa

SEQ ID NO: 1908948 - RNA, 17 nt, Shigella flexneri 2a str. 2457T
ccaccacguccagagug

SEQ ID NO: 1908949 - RNA, 22 nt, Shigella flexneri 2a str. 2457T
ccaccacgcggggguaaaaccc

SEQ ID NO: 1908950 - RNA, 12 nt, Shigella flexneri 2a str. 2457T
ccaccagcagcu

SEQ ID NO: 1908951 - RNA, 13 nt, Shigella flexneri 2a str. 2457T
ccaccaguccuuc

SEQ ID NO: 1908952 - RNA, 9 nt, Shigella flexneri 2a str. 2457T
ccaccaguc

SEQ ID NO: 1908953 - RNA, 17 nt, Shigella flexneri 2a str. 2457T
ccaccaguccuucuacc

SEQ ID NO: 1908954 - RNA, 14 nt, Shigella flexneri 2a str. 2457T
ccacccauuuuaau

SEQ ID NO: 1908955 - RNA, 15 nt, Shigella flexneri 2a str. 2457T
ccacccaccgcagcc

SEQ ID NO: 1908956 - RNA, 18 nt, Shigella flexneri 2a str. 2457T
ccacccaccgcagcccag

SEQ ID NO: 1908957 - RNA, 22 nt, Shigella flexneri 2a str. 2457T
ccacccagucccguacccagca

SEQ ID NO: 1908958 - RNA, 22 nt, Shigella flexneri 2a str. 2457T
ccaccaugcuaauagcugcgcc

SEQ ID NO: 1908959 - RNA, 16 nt, Shigella flexneri 2a str. 2457T
ccacccaccagcgccg

SEQ ID NO: 1908960 - RNA, 16 nt, Shigella flexneri 2a str. 2457T
ccacaaacucuuuucc

SEQ ID NO: 1908961 - RNA, 22 nt, Shigella flexneri 2a str. 2457T
ccacaaaagcggugauaaaccc

SEQ ID NO: 1908962 - RNA, 10 nt, Shigella flexneri 2a str. 2457T
ccaauugccu

SEQ ID NO: 1908963 - RNA, 23 nt, Shigella flexneri 2a str. 2457T
ccaauuucugugcagccaaaaau

SEQ ID NO: 1908964 - RNA, 15 nt, Shigella flexneri 2a str. 2457T
ccacaauugaccagu

SEQ ID NO: 1908965 - RNA, 23 nt, Shigella flexneri 2a str. 2457T
ccacaauugaccaguaauauccc

SEQ ID NO: 1908966 - RNA, 16 nt, Shigella flexneri 2a str. 2457T
ccacaaugucacaaau

SEQ ID NO: 1908967 - RNA, 21 nt, Shigella flexneri 2a str. 2457T
ccacaacuggcuugguaacau

SEQ ID NO: 1908968 - RNA, 13 nt, Shigella flexneri 2a str. 2457T
ccacaacuucaac

SEQ ID NO: 1908969 - RNA, 20 nt, Shigella flexneri 2a str. 2457T
ccacaaccgccguugccuuu

SEQ ID NO: 1908970 - RNA, 20 nt, Shigella flexneri 2a str. 2457T
ccacaaccggcgggaaaaau

SEQ ID NO: 1908971 - RNA, 13 nt, Shigella flexneri 2a str. 2457T
ccaauugaacucu

SEQ ID NO: 1908972 - RNA, 22 nt, Shigella flexneri 2a str. 2457T
ccaaugccaccagggauaaagc

SEQ ID NO: 1908973 - RNA, 22 nt, Shigella flexneri 2a str. 2457T
ccaaugucgaaagccccagccc

SEQ ID NO: 1908974 - RNA, 18 nt, Shigella flexneri 2a str. 2457T
ccaauggcuuuugccgcc

SEQ ID NO: 1908975 - RNA, 16 nt, Shigella flexneri 2a str. 2457T
ccacagggugaucacc

SEQ ID NO: 1908976 - RNA, 13 nt, Shigella flexneri 2a str. 2457T
ccacagcucugcu

SEQ ID NO: 1908977 - RNA, 17 nt, Shigella flexneri 2a str. 2457T
ccacagcucacggcccu

SEQ ID NO: 1908978 - RNA, 15 nt, Shigella flexneri 2a str. 2457T
ccacagcaaugcauu

SEQ ID NO: 1908979 - RNA, 18 nt, Shigella flexneri 2a str. 2457T
ccacagcagccuucgcca

SEQ ID NO: 1908980 - RNA, 14 nt, Shigella flexneri 2a str. 2457T
ccacagcaaaacac

SEQ ID NO: 1908981 - RNA, 15 nt, Shigella flexneri 2a str. 2457T
ccacaccagcuuucg

SEQ ID NO: 1908982 - RNA, 23 nt, Shigella flexneri 2a str. 2457T
ccacaccaaucaacaauugcggg

SEQ ID NO: 1908983 - RNA, 16 nt, Shigella flexneri 2a str. 2457T
ccacaccggaccagac

SEQ ID NO: 1908984 - RNA, 15 nt, Shigella flexneri 2a str. 2457T
ccacaccacugcgca

SEQ ID NO: 1908985 - RNA, 14 nt, Shigella flexneri 2a str. 2457T
ccacacccgcaaga

SEQ ID NO: 1908986 - RNA, 16 nt, Shigella flexneri 2a str. 2457T
ccacaccuggugcagc

SEQ ID NO: 1908987 - RNA, 15 nt, Shigella flexneri 2a str. 2457T
ccacacgaauuccaa

SEQ ID NO: 1908988 - RNA, 16 nt, Shigella flexneri 2a str. 2457T
ccacacgcccaacuaa

SEQ ID NO: 1908989 - RNA, 18 nt, Shigella flexneri 2a str. 2457T
ccacacucucgcgcagcg

SEQ ID NO: 1908990 - RNA, 20 nt, Shigella flexneri 2a str. 2457T
ccacacggucuaucaucagc

SEQ ID NO: 1908991 - RNA, 17 nt, Shigella flexneri 2a str. 2457T
ccacagacaaucgccag

SEQ ID NO: 1908992 - RNA, 22 nt, Shigella flexneri 2a str. 2457T
ccacagacauaaagccugcuuc

SEQ ID NO: 1908993 - RNA, 17 nt, Shigella flexneri 2a str. 2457T
ccacagaccggacugac

SEQ ID NO: 1908994 - RNA, 16 nt, Shigella flexneri 2a str. 2457T
ccaauaccgcccacca

SEQ ID NO: 1908995 - RNA, 18 nt, Shigella flexneri 2a str. 2457T
ccaauagaaagugacagc

SEQ ID NO: 1908996 - RNA, 23 nt, Shigella flexneri 2a str. 2457T
ccaauagaaagugacagcccggc

SEQ ID NO: 1908997 - RNA, 14 nt, Shigella flexneri 2a str. 2457T
ccaauauucagaaa

SEQ ID NO: 1908998 - RNA, 22 nt, Shigella flexneri 2a str. 2457T
ccaauaguuccacuauuucaau

SEQ ID NO: 1908999 - RNA, 14 nt, Shigella flexneri 2a str. 2457T
ccaauaccaaaauc

SEQ ID NO: 1909000 - RNA, 16 nt, Shigella flexneri 2a str. 2457T
ccaaucagguaagcaa

SEQ ID NO: 1909001 - RNA, 23 nt, Shigella flexneri 2a str. 2457T
ccaaucagacucauauaaaaacc

SEQ ID NO: 1909002 - RNA, 20 nt, Shigella flexneri 2a str. 2457T
ccaaucccccacuuuuaaau

SEQ ID NO: 1909003 - RNA, 13 nt, Shigella flexneri 2a str. 2457T
ccaaucugcaaaa

SEQ ID NO: 1909004 - RNA, 18 nt, Shigella flexneri 2a str. 2457T
ccaaucuucacaucauca

SEQ ID NO: 1909005 - RNA, 22 nt, Shigella flexneri 2a str. 2457T
ccaaugauugggucauuuccca

SEQ ID NO: 1909006 - RNA, 14 nt, Shigella flexneri 2a str. 2457T
ccaagauagaacca

SEQ ID NO: 1909007 - RNA, 15 nt, Shigella flexneri 2a str. 2457T
ccaagcggcucaugc

SEQ ID NO: 1909008 - RNA, 18 nt, Shigella flexneri 2a str. 2457T
ccaaggucuccgcccagc

SEQ ID NO: 1909009 - RNA, 15 nt, Shigella flexneri 2a str. 2457T
ccaagggcggcgaga

SEQ ID NO: 1909010 - RNA, 13 nt, Shigella flexneri 2a str. 2457T
ccaauaaaaauac

SEQ ID NO: 1909011 - RNA, 16 nt, Shigella flexneri 2a str. 2457T
ccaacagcagccacac

SEQ ID NO: 1909012 - RNA, 12 nt, Shigella flexneri 2a str. 2457T
ccaacaggcgag

SEQ ID NO: 1909013 - RNA, 15 nt, Shigella flexneri 2a str. 2457T
ccaacagcgacauca

SEQ ID NO: 1909014 - RNA, 17 nt, Shigella flexneri 2a str. 2457T
ccaacaucgaaaacgcc

SEQ ID NO: 1909015 - RNA, 20 nt, Shigella flexneri 2a str. 2457T
ccaacaucgaaaacgccacc

SEQ ID NO: 1909016 - RNA, 22 nt, Shigella flexneri 2a str. 2457T
ccaacaucgaaaacgccaccgc

SEQ ID NO: 1909017 - RNA, 20 nt, Shigella flexneri 2a str. 2457T
ccaaccacaugaucauucac

SEQ ID NO: 1909018 - RNA, 13 nt, Shigella flexneri 2a str. 2457T
ccaaccaaggaag

SEQ ID NO: 1909019 - RNA, 21 nt, Shigella flexneri 2a str. 2457T
ccaaccaugccgcccagaagc

SEQ ID NO: 1909020 - RNA, 19 nt, Shigella flexneri 2a str. 2457T
ccaacacuuccccggacgc

SEQ ID NO: 1909021 - RNA, 15 nt, Shigella flexneri 2a str. 2457T
ccaacagcagccaca

SEQ ID NO: 1909022 - RNA, 14 nt, Shigella flexneri 2a str. 2457T
ccaacaauaaaauu

SEQ ID NO: 1909023 - RNA, 17 nt, Shigella flexneri 2a str. 2457T
ccaacaaaagcaacaaa

SEQ ID NO: 1909024 - RNA, 16 nt, Shigella flexneri 2a str. 2457T
ccaaaugucaccagcc

SEQ ID NO: 1909025 - RNA, 20 nt, Shigella flexneri 2a str. 2457T
ccaacaaacaguacacagac

SEQ ID NO: 1909026 - RNA, 22 nt, Shigella flexneri 2a str. 2457T
ccaacaaauggaaggucacgcc

SEQ ID NO: 1909027 - RNA, 15 nt, Shigella flexneri 2a str. 2457T
ccaaauuuaaacgac

SEQ ID NO: 1909028 - RNA, 20 nt, Shigella flexneri 2a str. 2457T
ccaaauuuaaacgacaauac

SEQ ID NO: 1909029 - RNA, 20 nt, Shigella flexneri 2a str. 2457T
ccaaauuuggugcucaguuu

SEQ ID NO: 1909030 - RNA, 14 nt, Shigella flexneri 2a str. 2457T
ccaacuccagcggc

SEQ ID NO: 1909031 - RNA, 15 nt, Shigella flexneri 2a str. 2457T
ccaacugauccugac

SEQ ID NO: 1909032 - RNA, 15 nt, Shigella flexneri 2a str. 2457T
ccaagaaacaccaga

SEQ ID NO: 1909033 - RNA, 23 nt, Shigella flexneri 2a str. 2457T
ccaacuguagugaucaaacacaa

SEQ ID NO: 1909034 - RNA, 21 nt, Shigella flexneri 2a str. 2457T
ccaacuguugauccaggagcu

SEQ ID NO: 1909035 - RNA, 18 nt, Shigella flexneri 2a str. 2457T
ccaacuguugauccagga

SEQ ID NO: 1909036 - RNA, 19 nt, Shigella flexneri 2a str. 2457T
ccaacuguugauccaggag

SEQ ID NO: 1909037 - RNA, 22 nt, Shigella flexneri 2a str. 2457T
ccaacuggcaaaagauaaagcc

SEQ ID NO: 1909038 - RNA, 20 nt, Shigella flexneri 2a str. 2457T
ccaacguuucgcugugauua

SEQ ID NO: 1909039 - RNA, 21 nt, Shigella flexneri 2a str. 2457T
ccaacguuucuggaaguaauc

SEQ ID NO: 1909040 - RNA, 15 nt, Shigella flexneri 2a str. 2457T
ccaacguaacaaaac

SEQ ID NO: 1909041 - RNA, 18 nt, Shigella flexneri 2a str. 2457T
ccaacggugaaaaaccaa

SEQ ID NO: 1909042 - RNA, 17 nt, Shigella flexneri 2a str. 2457T
ccaacggugaaaaacca

SEQ ID NO: 1909043 - RNA, 20 nt, Shigella flexneri 2a str. 2457T
ccaacggcgaaagcuggcac

SEQ ID NO: 1909044 - RNA, 20 nt, Shigella flexneri 2a str. 2457T
ccaacggcacgauaaauggc

SEQ ID NO: 1909045 - RNA, 14 nt, Shigella flexneri 2a str. 2457T
ccaacgcgccaccg

SEQ ID NO: 1909046 - RNA, 13 nt, Shigella flexneri 2a str. 2457T
ccaacgauaauuc

SEQ ID NO: 1909047 - RNA, 15 nt, Shigella flexneri 2a str. 2457T
ccaacgauaauucag

SEQ ID NO: 1909048 - RNA, 14 nt, Shigella flexneri 2a str. 2457T
ccaaccuugcgccu

SEQ ID NO: 1909049 - RNA, 15 nt, Shigella flexneri 2a str. 2457T
ccaacgcagcaacau

SEQ ID NO: 1909050 - RNA, 20 nt, Shigella flexneri 2a str. 2457T
ccaaaucauccagacugcuc

SEQ ID NO: 1909051 - RNA, 21 nt, Shigella flexneri 2a str. 2457T
ccaaaucauccagacugcuca

SEQ ID NO: 1909052 - RNA, 20 nt, Shigella flexneri 2a str. 2457T
ccaaauaucuuauagacuaa

SEQ ID NO: 1909053 - RNA, 18 nt, Shigella flexneri 2a str. 2457T
ccaaaucgcugcugcuca

SEQ ID NO: 1909054 - RNA, 21 nt, Shigella flexneri 2a str. 2457T
ccaaaucgauaaaacuucccg

SEQ ID NO: 1909055 - RNA, 17 nt, Shigella flexneri 2a str. 2457T
ccaaaucgcccagcaaa

SEQ ID NO: 1909056 - RNA, 18 nt, Shigella flexneri 2a str. 2457T
ccaaaucgcccagcaaau

SEQ ID NO: 1909057 - RNA, 21 nt, Shigella flexneri 2a str. 2457T
ccaaagugacacaaucaaauc

SEQ ID NO: 1909058 - RNA, 16 nt, Shigella flexneri 2a str. 2457T
ccaaagucaucaaucg

SEQ ID NO: 1909059 - RNA, 17 nt, Shigella flexneri 2a str. 2457T
ccaaagaaaucaguaaa

SEQ ID NO: 1909060 - RNA, 22 nt, Shigella flexneri 2a str. 2457T
ccaaacuuaugcagcugcucga

SEQ ID NO: 1909061 - RNA, 19 nt, Shigella flexneri 2a str. 2457T
ccaaacuggaacugaaagg

SEQ ID NO: 1909062 - RNA, 15 nt, Shigella flexneri 2a str. 2457T
ccaaagcaccacucc

SEQ ID NO: 1909063 - RNA, 18 nt, Shigella flexneri 2a str. 2457T
ccaaagcaccacuccuca

SEQ ID NO: 1909064 - RNA, 16 nt, Shigella flexneri 2a str. 2457T
ccaaagcagaguugcu

SEQ ID NO: 1909065 - RNA, 19 nt, Shigella flexneri 2a str. 2457T
cauuucugcugccuacaca

SEQ ID NO: 1909066 - RNA, 19 nt, Shigella flexneri 2a str. 2457T
cauuucucgguauuacaau

SEQ ID NO: 1909067 - RNA, 14 nt, Shigella flexneri 2a str. 2457T
cauuucgucuucau

SEQ ID NO: 1909068 - RNA, 11 nt, Shigella flexneri 2a str. 2457T
ccaaaaacauu

SEQ ID NO: 1909069 - RNA, 16 nt, Shigella flexneri 2a str. 2457T
ccaaaacagcgacacc

SEQ ID NO: 1909070 - RNA, 13 nt, Shigella flexneri 2a str. 2457T
ccaaaagguccuu

SEQ ID NO: 1909071 - RNA, 11 nt, Shigella flexneri 2a str. 2457T
ccaaaacugga

SEQ ID NO: 1909072 - RNA, 11 nt, Shigella flexneri 2a str. 2457T
ccaaacagcag

SEQ ID NO: 1909073 - RNA, 14 nt, Shigella flexneri 2a str. 2457T
ccaaacagaccaau

SEQ ID NO: 1909074 - RNA, 15 nt, Shigella flexneri 2a str. 2457T
ccaaaccucagaguu

SEQ ID NO: 1909075 - RNA, 16 nt, Shigella flexneri 2a str. 2457T
ccaaaaugccugaugc

SEQ ID NO: 1909076 - RNA, 20 nt, Shigella flexneri 2a str. 2457T
ccaaaauaacuuaaugucau

SEQ ID NO: 1909077 - RNA, 21 nt, Shigella flexneri 2a str. 2457T
ccaaaauaauaaauuaacugc

SEQ ID NO: 1909078 - RNA, 21 nt, Shigella flexneri 2a str. 2457T
cagggaucucuuccagugccu

SEQ ID NO: 1909079 - RNA, 18 nt, Shigella flexneri 2a str. 2457T
cagggaucauccacccgc

SEQ ID NO: 1909080 - RNA, 18 nt, Shigella flexneri 2a str. 2457T
cagggauauuucaccgcc

SEQ ID NO: 1909081 - RNA, 17 nt, Shigella flexneri 2a str. 2457T
cagggaucauccacccg

SEQ ID NO: 1909082 - RNA, 22 nt, Shigella flexneri 2a str. 2457T
cagguaagagugaauucacaau

SEQ ID NO: 1909083 - RNA, 21 nt, Shigella flexneri 2a str. 2457T
cagguaagaguuucaacauca

SEQ ID NO: 1909084 - RNA, 21 nt, Shigella flexneri 2a str. 2457T
cagggcaaacucugagagauc

SEQ ID NO: 1909085 - RNA, 17 nt, Shigella flexneri 2a str. 2457T
cagggcaaaauuucccc

SEQ ID NO: 1909086 - RNA, 15 nt, Shigella flexneri 2a str. 2457T
cagguacgggaaacc

SEQ ID NO: 1909087 - RNA, 16 nt, Shigella flexneri 2a str. 2457T
caggucagcgccuggc

SEQ ID NO: 1909088 - RNA, 19 nt, Shigella flexneri 2a str. 2457T
caggucaaaaaaugaaacu

SEQ ID NO: 1909089 - RNA, 23 nt, Shigella flexneri 2a str. 2457T
caggucaaaaaaugaaacuggaa

SEQ ID NO: 1909090 - RNA, 22 nt, Shigella flexneri 2a str. 2457T
caggucagauuucaaucuggcc

SEQ ID NO: 1909091 - RNA, 17 nt, Shigella flexneri 2a str. 2457T
caggucagcaggagcag

SEQ ID NO: 1909092 - RNA, 21 nt, Shigella flexneri 2a str. 2457T
caggugaugcauagcaaccgc

SEQ ID NO: 1909093 - RNA, 14 nt, Shigella flexneri 2a str. 2457T
caggugcaaaaaaa

SEQ ID NO: 1909094 - RNA, 17 nt, Shigella flexneri 2a str. 2457T
caggugaaaaauaaaag

SEQ ID NO: 1909095 - RNA, 16 nt, Shigella flexneri 2a str. 2457T
caggugaaaaauaaaa

SEQ ID NO: 1909096 - RNA, 15 nt, Shigella flexneri 2a str. 2457T
caggucggcucagcc

SEQ ID NO: 1909097 - RNA, 16 nt, Shigella flexneri 2a str. 2457T
cagguuguugccuuca

SEQ ID NO: 1909098 - RNA, 16 nt, Shigella flexneri 2a str. 2457T
cagguuuaccagcagc

SEQ ID NO: 1909099 - RNA, 14 nt, Shigella flexneri 2a str. 2457T
cagguuuaccagca

SEQ ID NO: 1909100 - RNA, 21 nt, Shigella flexneri 2a str. 2457T
cagguuugacauaaauuccgc

SEQ ID NO: 1909101 - RNA, 14 nt, Shigella flexneri 2a str. 2457T
caguaaauccauaa

SEQ ID NO: 1909102 - RNA, 13 nt, Shigella flexneri 2a str. 2457T
caguaaccgcuuu

SEQ ID NO: 1909103 - RNA, 17 nt, Shigella flexneri 2a str. 2457T
caguaaccacgcagcgu

SEQ ID NO: 1909104 - RNA, 21 nt, Shigella flexneri 2a str. 2457T
cagguuauugacguuccccug

SEQ ID NO: 1909105 - RNA, 12 nt, Shigella flexneri 2a str. 2457T
cagguucaacag

SEQ ID NO: 1909106 - RNA, 18 nt, Shigella flexneri 2a str. 2457T
cagguuacgcaccagaua

SEQ ID NO: 1909107 - RNA, 13 nt, Shigella flexneri 2a str. 2457T
cagguuaacgcag

SEQ ID NO: 1909108 - RNA, 19 nt, Shigella flexneri 2a str. 2457T
cagguuaaugacccacccc

SEQ ID NO: 1909109 - RNA, 11 nt, Shigella flexneri 2a str. 2457T
caggugcagcc

SEQ ID NO: 1909110 - RNA, 21 nt, Shigella flexneri 2a str. 2457T
cagguuccgcauaccccuuca

SEQ ID NO: 1909111 - RNA, 19 nt, Shigella flexneri 2a str. 2457T
cagguuccgcauaccccuu

SEQ ID NO: 1909112 - RNA, 19 nt, Shigella flexneri 2a str. 2457T
caguacgcgcccgccgcug

SEQ ID NO: 1909113 - RNA, 19 nt, Shigella flexneri 2a str. 2457T
caguacgccaaucugcaaa

SEQ ID NO: 1909114 - RNA, 16 nt, Shigella flexneri 2a str. 2457T
caguaccuccuucaca

SEQ ID NO: 1909115 - RNA, 20 nt, Shigella flexneri 2a str. 2457T
caguacgaaauaacugaaua

SEQ ID NO: 1909116 - RNA, 22 nt, Shigella flexneri 2a str. 2457T
caguagcgucgccagcaguuuc

SEQ ID NO: 1909117 - RNA, 20 nt, Shigella flexneri 2a str. 2457T
caguagcuauaaaccugcug

SEQ ID NO: 1909118 - RNA, 17 nt, Shigella flexneri 2a str. 2457T
caguagcgccucuucca

SEQ ID NO: 1909119 - RNA, 16 nt, Shigella flexneri 2a str. 2457T
caguagccaugcauaa

SEQ ID NO: 1909120 - RNA, 17 nt, Shigella flexneri 2a str. 2457T
caguccccucgccccuc

SEQ ID NO: 1909121 - RNA, 18 nt, Shigella flexneri 2a str. 2457T
caguccccucgccccucc

SEQ ID NO: 1909122 - RNA, 16 nt, Shigella flexneri 2a str. 2457T
caguccccacaucacu

SEQ ID NO: 1909123 - RNA, 23 nt, Shigella flexneri 2a str. 2457T
caguccccacaucacuccaucca

SEQ ID NO: 1909124 - RNA, 19 nt, Shigella flexneri 2a str. 2457T
caguccaccugaccugcga

SEQ ID NO: 1909125 - RNA, 18 nt, Shigella flexneri 2a str. 2457T
caguccagacuccgagaa

SEQ ID NO: 1909126 - RNA, 19 nt, Shigella flexneri 2a str. 2457T
caguauucaggucagcggc

SEQ ID NO: 1909127 - RNA, 15 nt, Shigella flexneri 2a str. 2457T
caguaugaaugacag

SEQ ID NO: 1909128 - RNA, 14 nt, Shigella flexneri 2a str. 2457T
caguaugcucagaa

SEQ ID NO: 1909129 - RNA, 18 nt, Shigella flexneri 2a str. 2457T
caguauugggaugccgaa

SEQ ID NO: 1909130 - RNA, 18 nt, Shigella flexneri 2a str. 2457T
cagucaugcgagaagcaa

SEQ ID NO: 1909131 - RNA, 14 nt, Shigella flexneri 2a str. 2457T
caguuuauuuucug

SEQ ID NO: 1909132 - RNA, 14 nt, Shigella flexneri 2a str. 2457T
caguuucaccagca

SEQ ID NO: 1909133 - RNA, 22 nt, Shigella flexneri 2a str. 2457T
caguuucaugauauguuuuaaa

SEQ ID NO: 1909134 - RNA, 22 nt, Shigella flexneri 2a str. 2457T
caguucguuuuacgcacuucuu

SEQ ID NO: 1909135 - RNA, 17 nt, Shigella flexneri 2a str. 2457T
caguuugcucaaaucca

SEQ ID NO: 1909136 - RNA, 11 nt, Shigella flexneri 2a str. 2457T
caguuucugau

SEQ ID NO: 1909137 - RNA, 17 nt, Shigella flexneri 2a str. 2457T
caguuugagauugaaaa

SEQ ID NO: 1909138 - RNA, 17 nt, Shigella flexneri 2a str. 2457T
caguuugaugccugcau

SEQ ID NO: 1909139 - RNA, 15 nt, Shigella flexneri 2a str. 2457T
caguuucugcagcuc

SEQ ID NO: 1909140 - RNA, 15 nt, Shigella flexneri 2a str. 2457T
cauaaagccugcuuc

SEQ ID NO: 1909141 - RNA, 17 nt, Shigella flexneri 2a str. 2457T
cauaaagcgguuuucaa

SEQ ID NO: 1909142 - RNA, 22 nt, Shigella flexneri 2a str. 2457T
cauaaaauaaccaaauaaaaua

SEQ ID NO: 1909143 - RNA, 16 nt, Shigella flexneri 2a str. 2457T
caguuuuucuuuuuca

SEQ ID NO: 1909144 - RNA, 21 nt, Shigella flexneri 2a str. 2457T
caguuuuugcaaucagauaaa

SEQ ID NO: 1909145 - RNA, 13 nt, Shigella flexneri 2a str. 2457T
cauaaugcugaca

SEQ ID NO: 1909146 - RNA, 14 nt, Shigella flexneri 2a str. 2457T
cauaaugcaaaaug

SEQ ID NO: 1909147 - RNA, 17 nt, Shigella flexneri 2a str. 2457T
cauaauccccagaacca

SEQ ID NO: 1909148 - RNA, 20 nt, Shigella flexneri 2a str. 2457T
cauaaucaccaucagcagca

SEQ ID NO: 1909149 - RNA, 14 nt, Shigella flexneri 2a str. 2457T
cauaaucaauaaaa

SEQ ID NO: 1909150 - RNA, 17 nt, Shigella flexneri 2a str. 2457T
cauaaucaauaaaaaua

SEQ ID NO: 1909151 - RNA, 12 nt, Shigella flexneri 2a str. 2457T
cauaaucaauac

SEQ ID NO: 1909152 - RNA, 19 nt, Shigella flexneri 2a str. 2457T
cauaauaagcuuuuucugc

SEQ ID NO: 1909153 - RNA, 22 nt, Shigella flexneri 2a str. 2457T
cauaauaagcgccauaucggca

SEQ ID NO: 1909154 - RNA, 21 nt, Shigella flexneri 2a str. 2457T
cauaagagauggaaugagcau

SEQ ID NO: 1909155 - RNA, 20 nt, Shigella flexneri 2a str. 2457T
cauaagagauggaaugagca

SEQ ID NO: 1909156 - RNA, 13 nt, Shigella flexneri 2a str. 2457T
cauaagagaugga

SEQ ID NO: 1909157 - RNA, 16 nt, Shigella flexneri 2a str. 2457T
cauaaagucuuucuua

SEQ ID NO: 1909158 - RNA, 18 nt, Shigella flexneri 2a str. 2457T
cauaaggaaacuccagcc

SEQ ID NO: 1909159 - RNA, 15 nt, Shigella flexneri 2a str. 2457T
caguccgccuucaac

SEQ ID NO: 1909160 - RNA, 21 nt, Shigella flexneri 2a str. 2457T
caguccgcucgccgcagagau

SEQ ID NO: 1909161 - RNA, 19 nt, Shigella flexneri 2a str. 2457T
cagugauuucuucauuaaa

SEQ ID NO: 1909162 - RNA, 14 nt, Shigella flexneri 2a str. 2457T
cagugccaguucuu

SEQ ID NO: 1909163 - RNA, 20 nt, Shigella flexneri 2a str. 2457T
cagugccauuaacaggccaa

SEQ ID NO: 1909164 - RNA, 14 nt, Shigella flexneri 2a str. 2457T
cagugauucauagu

SEQ ID NO: 1909165 - RNA, 20 nt, Shigella flexneri 2a str. 2457T
caguggcuuaucuuccuguu

SEQ ID NO: 1909166 - RNA, 18 nt, Shigella flexneri 2a str. 2457T
caguggugcggcugaugg

SEQ ID NO: 1909167 - RNA, 23 nt, Shigella flexneri 2a str. 2457T
caguggguuaugaaacuccaccg

SEQ ID NO: 1909168 - RNA, 23 nt, Shigella flexneri 2a str. 2457T
caguggguaaugcugugaagaug

SEQ ID NO: 1909169 - RNA, 20 nt, Shigella flexneri 2a str. 2457T
cagugggcgcugcuguacuu

SEQ ID NO: 1909170 - RNA, 17 nt, Shigella flexneri 2a str. 2457T
cagugggcguuggucag

SEQ ID NO: 1909171 - RNA, 16 nt, Shigella flexneri 2a str. 2457T
cagugggccagaaaaa

SEQ ID NO: 1909172 - RNA, 20 nt, Shigella flexneri 2a str. 2457T
cagugcgucgcugcucuuca

SEQ ID NO: 1909173 - RNA, 20 nt, Shigella flexneri 2a str. 2457T
cagugcuccaccuugcggaa

SEQ ID NO: 1909174 - RNA, 14 nt, Shigella flexneri 2a str. 2457T
cagugcguaagcgc

SEQ ID NO: 1909175 - RNA, 22 nt, Shigella flexneri 2a str. 2457T
cagugccgcacauagcaccacc

SEQ ID NO: 1909176 - RNA, 17 nt, Shigella flexneri 2a str. 2457T
cagugccgguggaaggg

SEQ ID NO: 1909177 - RNA, 18 nt, Shigella flexneri 2a str. 2457T
cagugcccgaccacuuca

SEQ ID NO: 1909178 - RNA, 17 nt, Shigella flexneri 2a str. 2457T
cagugccgcauccugca

SEQ ID NO: 1909179 - RNA, 20 nt, Shigella flexneri 2a str. 2457T
cagugccgcauccugcacca

SEQ ID NO: 1909180 - RNA, 21 nt, Shigella flexneri 2a str. 2457T
cagugccgcauccugcaccac

SEQ ID NO: 1909181 - RNA, 15 nt, Shigella flexneri 2a str. 2457T
cagugccgcauugac

SEQ ID NO: 1909182 - RNA, 19 nt, Shigella flexneri 2a str. 2457T
cagugccgaaaugucuucc

SEQ ID NO: 1909183 - RNA, 21 nt, Shigella flexneri 2a str. 2457T
cagugccugcauaaacgccgu

SEQ ID NO: 1909184 - RNA, 21 nt, Shigella flexneri 2a str. 2457T
caguucagcagcacuacaccc

SEQ ID NO: 1909185 - RNA, 18 nt, Shigella flexneri 2a str. 2457T
caguucagaagcugaagc

SEQ ID NO: 1909186 - RNA, 21 nt, Shigella flexneri 2a str. 2457T
caguucaaagcguggugauac

SEQ ID NO: 1909187 - RNA, 17 nt, Shigella flexneri 2a str. 2457T
caguucaaaguugcauu

SEQ ID NO: 1909188 - RNA, 19 nt, Shigella flexneri 2a str. 2457T
caguucacgaauauuuccc

SEQ ID NO: 1909189 - RNA, 14 nt, Shigella flexneri 2a str. 2457T
caguuacgcagacg

SEQ ID NO: 1909190 - RNA, 13 nt, Shigella flexneri 2a str. 2457T
caguuaagcaacu

SEQ ID NO: 1909191 - RNA, 23 nt, Shigella flexneri 2a str. 2457T
caguucgaucucuucgccugccu

SEQ ID NO: 1909192 - RNA, 14 nt, Shigella flexneri 2a str. 2457T
caguucgauuuccc

SEQ ID NO: 1909193 - RNA, 17 nt, Shigella flexneri 2a str. 2457T
caguuccugcaacuucu

SEQ ID NO: 1909194 - RNA, 18 nt, Shigella flexneri 2a str. 2457T
caguuccugccagauuug

SEQ ID NO: 1909195 - RNA, 18 nt, Shigella flexneri 2a str. 2457T
caguucgaaauccagacg

SEQ ID NO: 1909196 - RNA, 17 nt, Shigella flexneri 2a str. 2457T
caguucggaaacagugc

SEQ ID NO: 1909197 - RNA, 15 nt, Shigella flexneri 2a str. 2457T
caguucggaaacagu

SEQ ID NO: 1909198 - RNA, 19 nt, Shigella flexneri 2a str. 2457T
caguuccgcaaagcccauc

SEQ ID NO: 1909199 - RNA, 21 nt, Shigella flexneri 2a str. 2457T
caguuccuuaacuucaucagc

SEQ ID NO: 1909200 - RNA, 12 nt, Shigella flexneri 2a str. 2457T
caguuccgggau

SEQ ID NO: 1909201 - RNA, 22 nt, Shigella flexneri 2a str. 2457T
caguuccggcaucgacaguuuc

SEQ ID NO: 1909202 - RNA, 23 nt, Shigella flexneri 2a str. 2457T
caguuccggcaucgacaguuuca

SEQ ID NO: 1909203 - RNA, 14 nt, Shigella flexneri 2a str. 2457T
caguucccccugcc

SEQ ID NO: 1909204 - RNA, 19 nt, Shigella flexneri 2a str. 2457T
caguuccacuucugcacgg

SEQ ID NO: 1909205 - RNA, 13 nt, Shigella flexneri 2a str. 2457T
caggcccugcugu

SEQ ID NO: 1909206 - RNA, 16 nt, Shigella flexneri 2a str. 2457T
caggccuggguaaaaa

SEQ ID NO: 1909207 - RNA, 19 nt, Shigella flexneri 2a str. 2457T
caggccugauaagcgcagc

SEQ ID NO: 1909208 - RNA, 20 nt, Shigella flexneri 2a str. 2457T
caggcgaccguuuucaccag

SEQ ID NO: 1909209 - RNA, 18 nt, Shigella flexneri 2a str. 2457T
caggcgagaucggcaggc

SEQ ID NO: 1909210 - RNA, 17 nt, Shigella flexneri 2a str. 2457T
caggcgauuuacuggca

SEQ ID NO: 1909211 - RNA, 17 nt, Shigella flexneri 2a str. 2457T
caggcggcccagugagu

SEQ ID NO: 1909212 - RNA, 20 nt, Shigella flexneri 2a str. 2457T
caggcggauugcuucugcuu

SEQ ID NO: 1909213 - RNA, 13 nt, Shigella flexneri 2a str. 2457T
caggcgcugaaag

SEQ ID NO: 1909214 - RNA, 15 nt, Shigella flexneri 2a str. 2457T
caggcgcugaaagaa

SEQ ID NO: 1909215 - RNA, 19 nt, Shigella flexneri 2a str. 2457T
caggcgcugauagguuuca

SEQ ID NO: 1909216 - RNA, 23 nt, Shigella flexneri 2a str. 2457T
caggcgcugcauaucucccagua

SEQ ID NO: 1909217 - RNA, 21 nt, Shigella flexneri 2a str. 2457T
caggcgcuugucgucccaggc

SEQ ID NO: 1909218 - RNA, 22 nt, Shigella flexneri 2a str. 2457T
caggcgcuugucgucccaggca

SEQ ID NO: 1909219 - RNA, 16 nt, Shigella flexneri 2a str. 2457T
caggcucgccgccgcu

SEQ ID NO: 1909220 - RNA, 17 nt, Shigella flexneri 2a str. 2457T
caggcgucgggaagacc

SEQ ID NO: 1909221 - RNA, 21 nt, Shigella flexneri 2a str. 2457T
caggcucgccgccgcuggcgu

SEQ ID NO: 1909222 - RNA, 18 nt, Shigella flexneri 2a str. 2457T
caggcucucauuuuucag

SEQ ID NO: 1909223 - RNA, 13 nt, Shigella flexneri 2a str. 2457T
caggcucuuuaaa

SEQ ID NO: 1909224 - RNA, 15 nt, Shigella flexneri 2a str. 2457T
caggcucuuuaaaca

SEQ ID NO: 1909225 - RNA, 18 nt, Shigella flexneri 2a str. 2457T
caggcucugacuggcgcu

SEQ ID NO: 1909226 - RNA, 13 nt, Shigella flexneri 2a str. 2457T
caggcuucaacac

SEQ ID NO: 1909227 - RNA, 14 nt, Shigella flexneri 2a str. 2457T
caggcuucaacaca

SEQ ID NO: 1909228 - RNA, 17 nt, Shigella flexneri 2a str. 2457T
caggcuuacgcagaaga

SEQ ID NO: 1909229 - RNA, 22 nt, Shigella flexneri 2a str. 2457T
caggcuguuaaggaaauccugc

SEQ ID NO: 1909230 - RNA, 20 nt, Shigella flexneri 2a str. 2457T
caggcuguuaccccugcggc

SEQ ID NO: 1909231 - RNA, 13 nt, Shigella flexneri 2a str. 2457T
cagggaaaaauug

SEQ ID NO: 1909232 - RNA, 20 nt, Shigella flexneri 2a str. 2457T
cagggagucuugcuggaugc

SEQ ID NO: 1909233 - RNA, 16 nt, Shigella flexneri 2a str. 2457T
cagggauaaagccccc

SEQ ID NO: 1909234 - RNA, 16 nt, Shigella flexneri 2a str. 2457T
cagggagucuugcugg

SEQ ID NO: 1909235 - RNA, 15 nt, Shigella flexneri 2a str. 2457T
caggcuuuauucuga

SEQ ID NO: 1909236 - RNA, 22 nt, Shigella flexneri 2a str. 2457T
caggcuugcugaugcacgcaga

SEQ ID NO: 1909237 - RNA, 18 nt, Shigella flexneri 2a str. 2457T
caggaugauuccggcaaa

SEQ ID NO: 1909238 - RNA, 17 nt, Shigella flexneri 2a str. 2457T
caggaucagacacaaua

SEQ ID NO: 1909239 - RNA, 16 nt, Shigella flexneri 2a str. 2457T
caggauauuuauauuu

SEQ ID NO: 1909240 - RNA, 22 nt, Shigella flexneri 2a str. 2457T
caggaaccccauaagccugaua

SEQ ID NO: 1909241 - RNA, 13 nt, Shigella flexneri 2a str. 2457T
caggaacaccagc

SEQ ID NO: 1909242 - RNA, 16 nt, Shigella flexneri 2a str. 2457T
caggauaagcgccgcu

SEQ ID NO: 1909243 - RNA, 23 nt, Shigella flexneri 2a str. 2457T
caggaaauuaccgcaaagcccac

SEQ ID NO: 1909244 - RNA, 15 nt, Shigella flexneri 2a str. 2457T
caggaaauaaauaau

SEQ ID NO: 1909245 - RNA, 12 nt, Shigella flexneri 2a str. 2457T
caggaaauaaau

SEQ ID NO: 1909246 - RNA, 14 nt, Shigella flexneri 2a str. 2457T
caggcaccuucggg

SEQ ID NO: 1909247 - RNA, 21 nt, Shigella flexneri 2a str. 2457T
caggcaaucgagcccagaugc

SEQ ID NO: 1909248 - RNA, 15 nt, Shigella flexneri 2a str. 2457T
caggcacaccgccgc

SEQ ID NO: 1909249 - RNA, 21 nt, Shigella flexneri 2a str. 2457T
caggauggcguucgcaacacc

SEQ ID NO: 1909250 - RNA, 23 nt, Shigella flexneri 2a str. 2457T
caggauggcguucgcaacaccgu

SEQ ID NO: 1909251 - RNA, 12 nt, Shigella flexneri 2a str. 2457T
caggaugggcaa

SEQ ID NO: 1909252 - RNA, 14 nt, Shigella flexneri 2a str. 2457T
caggcaaccgcuga

SEQ ID NO: 1909253 - RNA, 18 nt, Shigella flexneri 2a str. 2457T
caggcaacuucaagguca

SEQ ID NO: 1909254 - RNA, 22 nt, Shigella flexneri 2a str. 2457T
caggcaagccgcuaacagcagc

SEQ ID NO: 1909255 - RNA, 16 nt, Shigella flexneri 2a str. 2457T
caggcaagcauaugac

SEQ ID NO: 1909256 - RNA, 14 nt, Shigella flexneri 2a str. 2457T
caggcaaaaaaaug

SEQ ID NO: 1909257 - RNA, 21 nt, Shigella flexneri 2a str. 2457T
caggcaaaaaaaugcacauau

SEQ ID NO: 1909258 - RNA, 14 nt, Shigella flexneri 2a str. 2457T
caggcccgcauaga

SEQ ID NO: 1909259 - RNA, 15 nt, Shigella flexneri 2a str. 2457T
caggcccgcauuaaa

SEQ ID NO: 1909260 - RNA, 17 nt, Shigella flexneri 2a str. 2457T
caggcccaacuguugau

SEQ ID NO: 1909261 - RNA, 16 nt, Shigella flexneri 2a str. 2457T
caggcauuuuuaucac

SEQ ID NO: 1909262 - RNA, 15 nt, Shigella flexneri 2a str. 2457T
caggccaaaaaacag

SEQ ID NO: 1909263 - RNA, 18 nt, Shigella flexneri 2a str. 2457T
caggcaucgugcaccaau

SEQ ID NO: 1909264 - RNA, 21 nt, Shigella flexneri 2a str. 2457T
caggcaucguguugaugcucc

SEQ ID NO: 1909265 - RNA, 16 nt, Shigella flexneri 2a str. 2457T
caggcaucggugcugg

SEQ ID NO: 1909266 - RNA, 20 nt, Shigella flexneri 2a str. 2457T
caggccacgaaucagcaccg

SEQ ID NO: 1909267 - RNA, 13 nt, Shigella flexneri 2a str. 2457T
caggccagcagca

SEQ ID NO: 1909268 - RNA, 14 nt, Shigella flexneri 2a str. 2457T
caggccaccaggcc

SEQ ID NO: 1909269 - RNA, 19 nt, Shigella flexneri 2a str. 2457T
caggcauuugcuccagacg

SEQ ID NO: 1909270 - RNA, 14 nt, Shigella flexneri 2a str. 2457T
caggccaacagucu

SEQ ID NO: 1909271 - RNA, 21 nt, Shigella flexneri 2a str. 2457T
caggaaacccaacgcaaagag

SEQ ID NO: 1909272 - RNA, 15 nt, Shigella flexneri 2a str. 2457T
caggaaacccaacgc

SEQ ID NO: 1909273 - RNA, 10 nt, Shigella flexneri 2a str. 2457T
caggaaaauc

SEQ ID NO: 1909274 - RNA, 22 nt, Shigella flexneri 2a str. 2457T
cagcuuuuuagcgaucucgguc

SEQ ID NO: 1909275 - RNA, 21 nt, Shigella flexneri 2a str. 2457T
cagcuuugcccgaucaucaaa

SEQ ID NO: 1909276 - RNA, 14 nt, Shigella flexneri 2a str. 2457T
cagcuuuggugaaa

SEQ ID NO: 1909277 - RNA, 13 nt, Shigella flexneri 2a str. 2457T
cagcuuuggugaa

SEQ ID NO: 1909278 - RNA, 13 nt, Shigella flexneri 2a str. 2457T
cagcuuucagaga

SEQ ID NO: 1909279 - RNA, 18 nt, Shigella flexneri 2a str. 2457T
cagcuuucagcagcggcu

SEQ ID NO: 1909280 - RNA, 14 nt, Shigella flexneri 2a str. 2457T
cagcuuucccuuca

SEQ ID NO: 1909281 - RNA, 16 nt, Shigella flexneri 2a str. 2457T
cagcugguuauuuucu

SEQ ID NO: 1909282 - RNA, 23 nt, Shigella flexneri 2a str. 2457T
cagcugguguaacugcgccagac

SEQ ID NO: 1909283 - RNA, 20 nt, Shigella flexneri 2a str. 2457T
cagcugcgugccuaauuccg

SEQ ID NO: 1909284 - RNA, 13 nt, Shigella flexneri 2a str. 2457T
cagcugcucccag

SEQ ID NO: 1909285 - RNA, 23 nt, Shigella flexneri 2a str. 2457T
cagcuucgcuaccugagucauca

SEQ ID NO: 1909286 - RNA, 20 nt, Shigella flexneri 2a str. 2457T
cagcuucgccaguuuuucaa

SEQ ID NO: 1909287 - RNA, 19 nt, Shigella flexneri 2a str. 2457T
cagcuucucgugaaacuca

SEQ ID NO: 1909288 - RNA, 17 nt, Shigella flexneri 2a str. 2457T
cagcuugcgauccugca

SEQ ID NO: 1909289 - RNA, 16 nt, Shigella flexneri 2a str. 2457T
cagcuugcgauccugc

SEQ ID NO: 1909290 - RNA, 18 nt, Shigella flexneri 2a str. 2457T
cagcucauauuccugcau

SEQ ID NO: 1909291 - RNA, 13 nt, Shigella flexneri 2a str. 2457T
cagcucagugacc

SEQ ID NO: 1909292 - RNA, 17 nt, Shigella flexneri 2a str. 2457T
cagcucacaaauacgcu

SEQ ID NO: 1909293 - RNA, 22 nt, Shigella flexneri 2a str. 2457T
cagcucucagacgauuacucgc

SEQ ID NO: 1909294 - RNA, 18 nt, Shigella flexneri 2a str. 2457T
cagcucgaugauguguuc

SEQ ID NO: 1909295 - RNA, 21 nt, Shigella flexneri 2a str. 2457T
cagcuccucuuucaucucccg

SEQ ID NO: 1909296 - RNA, 23 nt, Shigella flexneri 2a str. 2457T
cagcucauauuccugcauugcuu

SEQ ID NO: 1909297 - RNA, 18 nt, Shigella flexneri 2a str. 2457T
cagcugccgccaggcuuc

SEQ ID NO: 1909298 - RNA, 19 nt, Shigella flexneri 2a str. 2457T
cagcugcgcaucaugccac

SEQ ID NO: 1909299 - RNA, 15 nt, Shigella flexneri 2a str. 2457T
cagcugccgccaggc

SEQ ID NO: 1909300 - RNA, 16 nt, Shigella flexneri 2a str. 2457T
cagcugccgacgccag

SEQ ID NO: 1909301 - RNA, 17 nt, Shigella flexneri 2a str. 2457T
cagcugccgacgccagu

SEQ ID NO: 1909302 - RNA, 20 nt, Shigella flexneri 2a str. 2457T
cagcucuuuuccagccauca

SEQ ID NO: 1909303 - RNA, 20 nt, Shigella flexneri 2a str. 2457T
cagcucuuccuucagcuccc

SEQ ID NO: 1909304 - RNA, 12 nt, Shigella flexneri 2a str. 2457T
cagcucuuccuu

SEQ ID NO: 1909305 - RNA, 14 nt, Shigella flexneri 2a str. 2457T
cagcugaccgccgu

SEQ ID NO: 1909306 - RNA, 18 nt, Shigella flexneri 2a str. 2457T
cagcugaccgguugcugg

SEQ ID NO: 1909307 - RNA, 20 nt, Shigella flexneri 2a str. 2457T
cagcugacaaucgcugcggc

SEQ ID NO: 1909308 - RNA, 22 nt, Shigella flexneri 2a str. 2457T
cacugauaagcugagcacaaaa

SEQ ID NO: 1909309 - RNA, 16 nt, Shigella flexneri 2a str. 2457T
cacugaugacaggcua

SEQ ID NO: 1909310 - RNA, 21 nt, Shigella flexneri 2a str. 2457T
cacugauauggugguaacuac

SEQ ID NO: 1909311 - RNA, 22 nt, Shigella flexneri 2a str. 2457T
cagcgggugcauuuucacuuca

SEQ ID NO: 1909312 - RNA, 21 nt, Shigella flexneri 2a str. 2457T
cagcgggguucuccugagaau

SEQ ID NO: 1909313 - RNA, 13 nt, Shigella flexneri 2a str. 2457T
cagcgucaucaac

SEQ ID NO: 1909314 - RNA, 14 nt, Shigella flexneri 2a str. 2457T
cagcgucagaaaca

SEQ ID NO: 1909315 - RNA, 21 nt, Shigella flexneri 2a str. 2457T
cagcgucacaucaggccaucc

SEQ ID NO: 1909316 - RNA, 14 nt, Shigella flexneri 2a str. 2457T
cagcgucacaucag

SEQ ID NO: 1909317 - RNA, 16 nt, Shigella flexneri 2a str. 2457T
cagcgucagccagaaa

SEQ ID NO: 1909318 - RNA, 12 nt, Shigella flexneri 2a str. 2457T
cagcgucaucaa

SEQ ID NO: 1909319 - RNA, 19 nt, Shigella flexneri 2a str. 2457T
cagcgguugggcaucggca

SEQ ID NO: 1909320 - RNA, 23 nt, Shigella flexneri 2a str. 2457T
cagcguaaaggcggcagaacaga

SEQ ID NO: 1909321 - RNA, 16 nt, Shigella flexneri 2a str. 2457T
cagcgguuuacccugc

SEQ ID NO: 1909322 - RNA, 18 nt, Shigella flexneri 2a str. 2457T
cagcgguuucacaggaaa

SEQ ID NO: 1909323 - RNA, 15 nt, Shigella flexneri 2a str. 2457T
cagcgguuuugccag

SEQ ID NO: 1909324 - RNA, 17 nt, Shigella flexneri 2a str. 2457T
cagcguacaauagccac

SEQ ID NO: 1909325 - RNA, 17 nt, Shigella flexneri 2a str. 2457T
cagcguaucccagugcg

SEQ ID NO: 1909326 - RNA, 19 nt, Shigella flexneri 2a str. 2457T
cagcguaccaugauccugc

SEQ ID NO: 1909327 - RNA, 22 nt, Shigella flexneri 2a str. 2457T
cagcguugcccccugaagcagu

SEQ ID NO: 1909328 - RNA, 15 nt, Shigella flexneri 2a str. 2457T
cagcguuccccagaa

SEQ ID NO: 1909329 - RNA, 16 nt, Shigella flexneri 2a str. 2457T
cagcguguugaggaag

SEQ ID NO: 1909330 - RNA, 19 nt, Shigella flexneri 2a str. 2457T
cagcguuaucccaucccac

SEQ ID NO: 1909331 - RNA, 14 nt, Shigella flexneri 2a str. 2457T
cagcguuccccaga

SEQ ID NO: 1909332 - RNA, 16 nt, Shigella flexneri 2a str. 2457T
cagcguuuccagcacc

SEQ ID NO: 1909333 - RNA, 21 nt, Shigella flexneri 2a str. 2457T
cagcguuuccagcaccaguuc

SEQ ID NO: 1909334 - RNA, 17 nt, Shigella flexneri 2a str. 2457T
cagcgucggacuaaaua

SEQ ID NO: 1909335 - RNA, 22 nt, Shigella flexneri 2a str. 2457T
cagcgucgugaaacgcgucuga

SEQ ID NO: 1909336 - RNA, 17 nt, Shigella flexneri 2a str. 2457T
cagcgucgcacccggca

SEQ ID NO: 1909337 - RNA, 18 nt, Shigella flexneri 2a str. 2457T
cagcgugcucucaaauau

SEQ ID NO: 1909338 - RNA, 15 nt, Shigella flexneri 2a str. 2457T
cagcgugaacugggc

SEQ ID NO: 1909339 - RNA, 19 nt, Shigella flexneri 2a str. 2457T
cauguaacgaugcaugaca

SEQ ID NO: 1909340 - RNA, 21 nt, Shigella flexneri 2a str. 2457T
caugguuggccaucguaugau

SEQ ID NO: 1909341 - RNA, 22 nt, Shigella flexneri 2a str. 2457T
cauguaaaaggcgcuaaaaaua

SEQ ID NO: 1909342 - RNA, 21 nt, Shigella flexneri 2a str. 2457T
caugguuuggaucuguugcug

SEQ ID NO: 1909343 - RNA, 16 nt, Shigella flexneri 2a str. 2457T
cauggcucaccagcag

SEQ ID NO: 1909344 - RNA, 17 nt, Shigella flexneri 2a str. 2457T
cauguagccgcuuuuuc

SEQ ID NO: 1909345 - RNA, 12 nt, Shigella flexneri 2a str. 2457T
cauguccagcuu

SEQ ID NO: 1909346 - RNA, 19 nt, Shigella flexneri 2a str. 2457T
caugugggcugccccagcc

SEQ ID NO: 1909347 - RNA, 20 nt, Shigella flexneri 2a str. 2457T
caugucgguuguacaaaaaa

SEQ ID NO: 1909348 - RNA, 14 nt, Shigella flexneri 2a str. 2457T
cauggccuguguua

SEQ ID NO: 1909349 - RNA, 16 nt, Shigella flexneri 2a str. 2457T
cauggcgcagcgauuc

SEQ ID NO: 1909350 - RNA, 17 nt, Shigella flexneri 2a str. 2457T
cauggcgcgacauggcg

SEQ ID NO: 1909351 - RNA, 20 nt, Shigella flexneri 2a str. 2457T
caugcuuaccaaaaugcugc

SEQ ID NO: 1909352 - RNA, 16 nt, Shigella flexneri 2a str. 2457T
caugcuggaaccacag

SEQ ID NO: 1909353 - RNA, 19 nt, Shigella flexneri 2a str. 2457T
caugcuggaaccacagcgc

SEQ ID NO: 1909354 - RNA, 22 nt, Shigella flexneri 2a str. 2457T
caugcugucggcugccagccau

SEQ ID NO: 1909355 - RNA, 23 nt, Shigella flexneri 2a str. 2457T
caugccgggcaaaagucaccagu

SEQ ID NO: 1909356 - RNA, 13 nt, Shigella flexneri 2a str. 2457T
caugcuauuccuu

SEQ ID NO: 1909357 - RNA, 18 nt, Shigella flexneri 2a str. 2457T
caugccagugaugggcag

SEQ ID NO: 1909358 - RNA, 15 nt, Shigella flexneri 2a str. 2457T
caugccaaaucaaug

SEQ ID NO: 1909359 - RNA, 17 nt, Shigella flexneri 2a str. 2457T
caugccaaucagcagaa

SEQ ID NO: 1909360 - RNA, 17 nt, Shigella flexneri 2a str. 2457T
caugccgaucgucuggg

SEQ ID NO: 1909361 - RNA, 16 nt, Shigella flexneri 2a str. 2457T
caugccaucugccagc

SEQ ID NO: 1909362 - RNA, 22 nt, Shigella flexneri 2a str. 2457T
caugauaccgauuacucagcaa

SEQ ID NO: 1909363 - RNA, 19 nt, Shigella flexneri 2a str. 2457T
caugauaagacgcgccagc

SEQ ID NO: 1909364 - RNA, 14 nt, Shigella flexneri 2a str. 2457T
caugauccuggauu

SEQ ID NO: 1909365 - RNA, 22 nt, Shigella flexneri 2a str. 2457T
caugagagaaaaucacacuacc

SEQ ID NO: 1909366 - RNA, 16 nt, Shigella flexneri 2a str. 2457T
caugaguaaaauaaca

SEQ ID NO: 1909367 - RNA, 14 nt, Shigella flexneri 2a str. 2457T
caugaguugcugga

SEQ ID NO: 1909368 - RNA, 16 nt, Shigella flexneri 2a str. 2457T
caugcauuuaagaaaa

SEQ ID NO: 1909369 - RNA, 16 nt, Shigella flexneri 2a str. 2457T
caugccaaaagggagc

SEQ ID NO: 1909370 - RNA, 16 nt, Shigella flexneri 2a str. 2457T
caugcaucgguuuugc

SEQ ID NO: 1909371 - RNA, 22 nt, Shigella flexneri 2a str. 2457T
caugcagaucguuuuccugcau

SEQ ID NO: 1909372 - RNA, 13 nt, Shigella flexneri 2a str. 2457T
caugcagcauggu

SEQ ID NO: 1909373 - RNA, 17 nt, Shigella flexneri 2a str. 2457T
caugcagcauggucagg

SEQ ID NO: 1909374 - RNA, 15 nt, Shigella flexneri 2a str. 2457T
caugcagcuccaccg

SEQ ID NO: 1909375 - RNA, 13 nt, Shigella flexneri 2a str. 2457T
caugcagcuccac

SEQ ID NO: 1909376 - RNA, 23 nt, Shigella flexneri 2a str. 2457T
caugcagggcaaacucugagaga

SEQ ID NO: 1909377 - RNA, 14 nt, Shigella flexneri 2a str. 2457T
caugaugacaacau

SEQ ID NO: 1909378 - RNA, 23 nt, Shigella flexneri 2a str. 2457T
caugaugcgcggcuccagaauau

SEQ ID NO: 1909379 - RNA, 20 nt, Shigella flexneri 2a str. 2457T
caugaugccggguuuacuuc

SEQ ID NO: 1909380 - RNA, 22 nt, Shigella flexneri 2a str. 2457T
caugacagcgcccgacaagauc

SEQ ID NO: 1909381 - RNA, 23 nt, Shigella flexneri 2a str. 2457T
caugaccacucauuacggucaaa

SEQ ID NO: 1909382 - RNA, 15 nt, Shigella flexneri 2a str. 2457T
caugaauucgacuuu

SEQ ID NO: 1909383 - RNA, 16 nt, Shigella flexneri 2a str. 2457T
caugacaaaaaagcca

SEQ ID NO: 1909384 - RNA, 23 nt, Shigella flexneri 2a str. 2457T
caugaccgugaucguggccauga

SEQ ID NO: 1909385 - RNA, 15 nt, Shigella flexneri 2a str. 2457T
caugaccgugaucgu

SEQ ID NO: 1909386 - RNA, 18 nt, Shigella flexneri 2a str. 2457T
caugaccgcuccgccauc

SEQ ID NO: 1909387 - RNA, 16 nt, Shigella flexneri 2a str. 2457T
caugacguccuguacu

SEQ ID NO: 1909388 - RNA, 17 nt, Shigella flexneri 2a str. 2457T
caugacugcggcguggg

SEQ ID NO: 1909389 - RNA, 13 nt, Shigella flexneri 2a str. 2457T
caugaauaucaag

SEQ ID NO: 1909390 - RNA, 17 nt, Shigella flexneri 2a str. 2457T
caugaaucagcaaggaa

SEQ ID NO: 1909391 - RNA, 24 nt, Shigella flexneri 2a str. 2457T
caugaagauggucuguaccaccag

SEQ ID NO: 1909392 - RNA, 12 nt, Shigella flexneri 2a str. 2457T
caucucuuccca

SEQ ID NO: 1909393 - RNA, 16 nt, Shigella flexneri 2a str. 2457T
caugaaaugaaaauca

SEQ ID NO: 1909394 - RNA, 22 nt, Shigella flexneri 2a str. 2457T
caucucuucuucaagccaggcu

SEQ ID NO: 1909395 - RNA, 13 nt, Shigella flexneri 2a str. 2457T
caucucuucccau

SEQ ID NO: 1909396 - RNA, 20 nt, Shigella flexneri 2a str. 2457T
caucucugcaacgucuuccc

SEQ ID NO: 1909397 - RNA, 16 nt, Shigella flexneri 2a str. 2457T
caucucuacagcgccc

SEQ ID NO: 1909398 - RNA, 12 nt, Shigella flexneri 2a str. 2457T
cauuuccauaaa

SEQ ID NO: 1909399 - RNA, 18 nt, Shigella flexneri 2a str. 2457T
cauuuccccaaucuucuc

SEQ ID NO: 1909400 - RNA, 17 nt, Shigella flexneri 2a str. 2457T
cauuucccccuuccugc

SEQ ID NO: 1909401 - RNA, 17 nt, Shigella flexneri 2a str. 2457T
cauuuccgcugauucaa

SEQ ID NO: 1909402 - RNA, 15 nt, Shigella flexneri 2a str. 2457T
cauuuccaagauuaa

SEQ ID NO: 1909403 - RNA, 15 nt, Shigella flexneri 2a str. 2457T
cauuucagggaugaa

SEQ ID NO: 1909404 - RNA, 22 nt, Shigella flexneri 2a str. 2457T
cauuucagaaaguauauaaaaa

SEQ ID NO: 1909405 - RNA, 16 nt, Shigella flexneri 2a str. 2457T
cauuucacguucacgu

SEQ ID NO: 1909406 - RNA, 16 nt, Shigella flexneri 2a str. 2457T
cauuucacucacgccg

SEQ ID NO: 1909407 - RNA, 20 nt, Shigella flexneri 2a str. 2457T
cauuuauuuuuccuccauug

SEQ ID NO: 1909408 - RNA, 21 nt, Shigella flexneri 2a str. 2457T
cauuuauggugcuaguuaucu

SEQ ID NO: 1909409 - RNA, 23 nt, Shigella flexneri 2a str. 2457T
cauuuaccgcaacucauuuacag

SEQ ID NO: 1909410 - RNA, 20 nt, Shigella flexneri 2a str. 2457T
cauuuaccgcaacucauuua

SEQ ID NO: 1909411 - RNA, 20 nt, Shigella flexneri 2a str. 2457T
cauugcugccgccaguucuu

SEQ ID NO: 1909412 - RNA, 15 nt, Shigella flexneri 2a str. 2457T
cauugcugccgccag

SEQ ID NO: 1909413 - RNA, 21 nt, Shigella flexneri 2a str. 2457T
cauugcugaugcaccuucaac

SEQ ID NO: 1909414 - RNA, 16 nt, Shigella flexneri 2a str. 2457T
cauugcucacuuccuu

SEQ ID NO: 1909415 - RNA, 16 nt, Shigella flexneri 2a str. 2457T
cauugcuauuuccacc

SEQ ID NO: 1909416 - RNA, 13 nt, Shigella flexneri 2a str. 2457T
cauugcuauuucc

SEQ ID NO: 1909417 - RNA, 13 nt, Shigella flexneri 2a str. 2457T
cauugcguaacca

SEQ ID NO: 1909418 - RNA, 21 nt, Shigella flexneri 2a str. 2457T
cauugcgguucguugauaaua

SEQ ID NO: 1909419 - RNA, 17 nt, Shigella flexneri 2a str. 2457T
cauugcguugauaugca

SEQ ID NO: 1909420 - RNA, 21 nt, Shigella flexneri 2a str. 2457T
cauugcguuuaguuacaccac

SEQ ID NO: 1909421 - RNA, 19 nt, Shigella flexneri 2a str. 2457T
cauugggccacucaacauc

SEQ ID NO: 1909422 - RNA, 16 nt, Shigella flexneri 2a str. 2457T
cauuggccguugccau

SEQ ID NO: 1909423 - RNA, 14 nt, Shigella flexneri 2a str. 2457T
cauugccauguuga

SEQ ID NO: 1909424 - RNA, 23 nt, Shigella flexneri 2a str. 2457T
cauugcagucauaaccaguccau

SEQ ID NO: 1909425 - RNA, 15 nt, Shigella flexneri 2a str. 2457T
cauugcaguuaucug

SEQ ID NO: 1909426 - RNA, 16 nt, Shigella flexneri 2a str. 2457T
cauucgcgguuuuaca

SEQ ID NO: 1909427 - RNA, 20 nt, Shigella flexneri 2a str. 2457T
cauucggauugcuauuuaac

SEQ ID NO: 1909428 - RNA, 13 nt, Shigella flexneri 2a str. 2457T
cauucggugcuca

SEQ ID NO: 1909429 - RNA, 24 nt, Shigella flexneri 2a str. 2457T
cauuacuacgguaauacaaccugc

SEQ ID NO: 1909430 - RNA, 13 nt, Shigella flexneri 2a str. 2457T
cauuagucacaaa

SEQ ID NO: 1909431 - RNA, 15 nt, Shigella flexneri 2a str. 2457T
cauuacgccaguaaa

SEQ ID NO: 1909432 - RNA, 17 nt, Shigella flexneri 2a str. 2457T
cauuacgccagucacgg

SEQ ID NO: 1909433 - RNA, 23 nt, Shigella flexneri 2a str. 2457T
cauuacgcucacugcaaaacagg

SEQ ID NO: 1909434 - RNA, 19 nt, Shigella flexneri 2a str. 2457T
cauguucauuuauuaccuu

SEQ ID NO: 1909435 - RNA, 16 nt, Shigella flexneri 2a str. 2457T
cauguuaaauuccggc

SEQ ID NO: 1909436 - RNA, 18 nt, Shigella flexneri 2a str. 2457T
cauguuaaauuccggcuc

SEQ ID NO: 1909437 - RNA, 20 nt, Shigella flexneri 2a str. 2457T
cauuauuaaacagacaguaa

SEQ ID NO: 1909438 - RNA, 16 nt, Shigella flexneri 2a str. 2457T
cauuauuaaauuuaau

SEQ ID NO: 1909439 - RNA, 21 nt, Shigella flexneri 2a str. 2457T
cauuauuaaauuuaauaauaa

SEQ ID NO: 1909440 - RNA, 14 nt, Shigella flexneri 2a str. 2457T
cauuagugauuaac

SEQ ID NO: 1909441 - RNA, 23 nt, Shigella flexneri 2a str. 2457T
cauuaugcuggaaucaauaauua

SEQ ID NO: 1909442 - RNA, 14 nt, Shigella flexneri 2a str. 2457T
cauuaucaaagaug

SEQ ID NO: 1909443 - RNA, 14 nt, Shigella flexneri 2a str. 2457T
cauuaucaaacgug

SEQ ID NO: 1909444 - RNA, 18 nt, Shigella flexneri 2a str. 2457T
cauuauucauuguucucc

SEQ ID NO: 1909445 - RNA, 14 nt, Shigella flexneri 2a str. 2457T
cauuauugcgcaca

SEQ ID NO: 1909446 - RNA, 19 nt, Shigella flexneri 2a str. 2457T
cauuauugcgcacaucaau

SEQ ID NO: 1909447 - RNA, 22 nt, Shigella flexneri 2a str. 2457T
cauuauugucgguggcgggcaa

SEQ ID NO: 1909448 - RNA, 19 nt, Shigella flexneri 2a str. 2457T
cauucaacgucuugcugau

SEQ ID NO: 1909449 - RNA, 17 nt, Shigella flexneri 2a str. 2457T
cauucaaacgauuuuuu

SEQ ID NO: 1909450 - RNA, 13 nt, Shigella flexneri 2a str. 2457T
cauucgagccaag

SEQ ID NO: 1909451 - RNA, 16 nt, Shigella flexneri 2a str. 2457T
cauuccugcugacggc

SEQ ID NO: 1909452 - RNA, 21 nt, Shigella flexneri 2a str. 2457T
cauucgcaguugcaguaccag

SEQ ID NO: 1909453 - RNA, 15 nt, Shigella flexneri 2a str. 2457T
cauucgccaguccuu

SEQ ID NO: 1909454 - RNA, 19 nt, Shigella flexneri 2a str. 2457T
cauucgccgguuccagcuu

SEQ ID NO: 1909455 - RNA, 20 nt, Shigella flexneri 2a str. 2457T
cauucgccgcuuaccauaac

SEQ ID NO: 1909456 - RNA, 18 nt, Shigella flexneri 2a str. 2457T
cauucccuacgcgauaaa

SEQ ID NO: 1909457 - RNA, 21 nt, Shigella flexneri 2a str. 2457T
cauucccagcgcguucuggua

SEQ ID NO: 1909458 - RNA, 17 nt, Shigella flexneri 2a str. 2457T
cauuccggccaucgccu

SEQ ID NO: 1909459 - RNA, 19 nt, Shigella flexneri 2a str. 2457T
cauuccgcaugauucugag

SEQ ID NO: 1909460 - RNA, 19 nt, Shigella flexneri 2a str. 2457T
cauuccggaguuuaugagg

SEQ ID NO: 1909461 - RNA, 23 nt, Shigella flexneri 2a str. 2457T
cauuccgggaaacgaaccauaaa

SEQ ID NO: 1909462 - RNA, 21 nt, Shigella flexneri 2a str. 2457T
cauucauuuuuuguggcuucu

SEQ ID NO: 1909463 - RNA, 22 nt, Shigella flexneri 2a str. 2457T
cauuccagaugugccaguugca

SEQ ID NO: 1909464 - RNA, 13 nt, Shigella flexneri 2a str. 2457T
cauuccaguaauu

SEQ ID NO: 1909465 - RNA, 20 nt, Shigella flexneri 2a str. 2457T
cauucacgcugucggcacug

SEQ ID NO: 1909466 - RNA, 15 nt, Shigella flexneri 2a str. 2457T
cauucaccauuuuuu

SEQ ID NO: 1909467 - RNA, 14 nt, Shigella flexneri 2a str. 2457T
cauucagacaggcg

SEQ ID NO: 1909468 - RNA, 18 nt, Shigella flexneri 2a str. 2457T
cauucagcagcagcaaga

SEQ ID NO: 1909469 - RNA, 21 nt, Shigella flexneri 2a str. 2457T
cauucaggccgccgucaucac

SEQ ID NO: 1909470 - RNA, 18 nt, Shigella flexneri 2a str. 2457T
cauucagugcaaaugcca

SEQ ID NO: 1909471 - RNA, 16 nt, Shigella flexneri 2a str. 2457T
cauucaguuaccugaa

SEQ ID NO: 1909472 - RNA, 21 nt, Shigella flexneri 2a str. 2457T
cauucaguuaccugaaugcuc

SEQ ID NO: 1909473 - RNA, 23 nt, Shigella flexneri 2a str. 2457T
cauagauuaauuucccaccacua

SEQ ID NO: 1909474 - RNA, 19 nt, Shigella flexneri 2a str. 2457T
cauagcagcacaccacauc

SEQ ID NO: 1909475 - RNA, 12 nt, Shigella flexneri 2a str. 2457T
cauagcauccca

SEQ ID NO: 1909476 - RNA, 21 nt, Shigella flexneri 2a str. 2457T
cauagcaucccaauacccgca

SEQ ID NO: 1909477 - RNA, 22 nt, Shigella flexneri 2a str. 2457T
cauagcgccucuuuauaaauau

SEQ ID NO: 1909478 - RNA, 14 nt, Shigella flexneri 2a str. 2457T
cauagcgauaagaa

SEQ ID NO: 1909479 - RNA, 16 nt, Shigella flexneri 2a str. 2457T
cauagcgauaagaacu

SEQ ID NO: 1909480 - RNA, 22 nt, Shigella flexneri 2a str. 2457T
cauaaugguggaguggcccagg

SEQ ID NO: 1909481 - RNA, 13 nt, Shigella flexneri 2a str. 2457T
cauaauguccugc

SEQ ID NO: 1909482 - RNA, 17 nt, Shigella flexneri 2a str. 2457T
cauaauuuccagcagug

SEQ ID NO: 1909483 - RNA, 15 nt, Shigella flexneri 2a str. 2457T
cauagaccauugcau

SEQ ID NO: 1909484 - RNA, 14 nt, Shigella flexneri 2a str. 2457T
cauagaccauugca

SEQ ID NO: 1909485 - RNA, 12 nt, Shigella flexneri 2a str. 2457T
cauagacuuccc

SEQ ID NO: 1909486 - RNA, 17 nt, Shigella flexneri 2a str. 2457T
cauagacuggaaacuca

SEQ ID NO: 1909487 - RNA, 14 nt, Shigella flexneri 2a str. 2457T
cauagguucuuuua

SEQ ID NO: 1909488 - RNA, 14 nt, Shigella flexneri 2a str. 2457T
cauaguagccagcc

SEQ ID NO: 1909489 - RNA, 14 nt, Shigella flexneri 2a str. 2457T
cauaguauuuaucc

SEQ ID NO: 1909490 - RNA, 15 nt, Shigella flexneri 2a str. 2457T
cauaggcggcaaaca

SEQ ID NO: 1909491 - RNA, 16 nt, Shigella flexneri 2a str. 2457T
cauagcgugacaccag

SEQ ID NO: 1909492 - RNA, 15 nt, Shigella flexneri 2a str. 2457T
cauaggcauuaaaca

SEQ ID NO: 1909493 - RNA, 19 nt, Shigella flexneri 2a str. 2457T
cauauagccgcgcaguuuc

SEQ ID NO: 1909494 - RNA, 22 nt, Shigella flexneri 2a str. 2457T
cauauacgccaucgccagcagc

SEQ ID NO: 1909495 - RNA, 23 nt, Shigella flexneri 2a str. 2457T
cauauacgccaucgccagcagcc

SEQ ID NO: 1909496 - RNA, 20 nt, Shigella flexneri 2a str. 2457T
cauauaccgcaucagcaucg

SEQ ID NO: 1909497 - RNA, 18 nt, Shigella flexneri 2a str. 2457T
cauauaccgucagcgucu

SEQ ID NO: 1909498 - RNA, 17 nt, Shigella flexneri 2a str. 2457T
cauauaccucagcagac

SEQ ID NO: 1909499 - RNA, 20 nt, Shigella flexneri 2a str. 2457T
cauagucuuugcgaggcgcg

SEQ ID NO: 1909500 - RNA, 18 nt, Shigella flexneri 2a str. 2457T
cauagugcaaauccacuc

SEQ ID NO: 1909501 - RNA, 17 nt, Shigella flexneri 2a str. 2457T
cauauucgccaccgcgc

SEQ ID NO: 1909502 - RNA, 19 nt, Shigella flexneri 2a str. 2457T
cauauuccgcaccugccag

SEQ ID NO: 1909503 - RNA, 16 nt, Shigella flexneri 2a str. 2457T
cauauugccgugcccc

SEQ ID NO: 1909504 - RNA, 18 nt, Shigella flexneri 2a str. 2457T
cauauuuaaucaguucua

SEQ ID NO: 1909505 - RNA, 12 nt, Shigella flexneri 2a str. 2457T
cauauuguuuca

SEQ ID NO: 1909506 - RNA, 20 nt, Shigella flexneri 2a str. 2457T
caucaaauggcauccuugcu

SEQ ID NO: 1909507 - RNA, 23 nt, Shigella flexneri 2a str. 2457T
caucaaauguugcguucaucagu

SEQ ID NO: 1909508 - RNA, 14 nt, Shigella flexneri 2a str. 2457T
caucaaaucacuaa

SEQ ID NO: 1909509 - RNA, 15 nt, Shigella flexneri 2a str. 2457T
caucaaaguuuuuau

SEQ ID NO: 1909510 - RNA, 19 nt, Shigella flexneri 2a str. 2457T
caucaaaggcuucaacgac

SEQ ID NO: 1909511 - RNA, 13 nt, Shigella flexneri 2a str. 2457T
caucaaugccagc

SEQ ID NO: 1909512 - RNA, 16 nt, Shigella flexneri 2a str. 2457T
caucaaugccagcaua

SEQ ID NO: 1909513 - RNA, 15 nt, Shigella flexneri 2a str. 2457T
caucaauccaaacau

SEQ ID NO: 1909514 - RNA, 13 nt, Shigella flexneri 2a str. 2457T
caucaaucacuuu

SEQ ID NO: 1909515 - RNA, 14 nt, Shigella flexneri 2a str. 2457T
caucaacacuuugg

SEQ ID NO: 1909516 - RNA, 13 nt, Shigella flexneri 2a str. 2457T
caucaccacgcug

SEQ ID NO: 1909517 - RNA, 17 nt, Shigella flexneri 2a str. 2457T
caucaccaguaccgcca

SEQ ID NO: 1909518 - RNA, 19 nt, Shigella flexneri 2a str. 2457T
caucacgguugagggcaaa

SEQ ID NO: 1909519 - RNA, 14 nt, Shigella flexneri 2a str. 2457T
caucacuccacacc

SEQ ID NO: 1909520 - RNA, 17 nt, Shigella flexneri 2a str. 2457T
caucacucccuuucugc

SEQ ID NO: 1909521 - RNA, 19 nt, Shigella flexneri 2a str. 2457T
caucacuccauccagcaac

SEQ ID NO: 1909522 - RNA, 23 nt, Shigella flexneri 2a str. 2457T
caucacaauuccggugcgccaga

SEQ ID NO: 1909523 - RNA, 14 nt, Shigella flexneri 2a str. 2457T
caucacaucccagc

SEQ ID NO: 1909524 - RNA, 13 nt, Shigella flexneri 2a str. 2457T
caucaccaacacc

SEQ ID NO: 1909525 - RNA, 19 nt, Shigella flexneri 2a str. 2457T
caucaccaaugaaagcccc

SEQ ID NO: 1909526 - RNA, 22 nt, Shigella flexneri 2a str. 2457T
caucaccaauacgcauaugcau

SEQ ID NO: 1909527 - RNA, 22 nt, Shigella flexneri 2a str. 2457T
caucacauauucgccgcccugc

SEQ ID NO: 1909528 - RNA, 16 nt, Shigella flexneri 2a str. 2457T
caucagcaucccaccu

SEQ ID NO: 1909529 - RNA, 20 nt, Shigella flexneri 2a str. 2457T
caucagcgccugauggacau

SEQ ID NO: 1909530 - RNA, 23 nt, Shigella flexneri 2a str. 2457T
caucagcaucggugaggaucacc

SEQ ID NO: 1909531 - RNA, 19 nt, Shigella flexneri 2a str. 2457T
caucagcauaaucaccagu

SEQ ID NO: 1909532 - RNA, 14 nt, Shigella flexneri 2a str. 2457T
caucagaggaauga

SEQ ID NO: 1909533 - RNA, 22 nt, Shigella flexneri 2a str. 2457T
caucagaucguugaacccggca

SEQ ID NO: 1909534 - RNA, 21 nt, Shigella flexneri 2a str. 2457T
caucagacaaaugucacugcu

SEQ ID NO: 1909535 - RNA, 21 nt, Shigella flexneri 2a str. 2457T
caucagaaacacacuuuccag

SEQ ID NO: 1909536 - RNA, 18 nt, Shigella flexneri 2a str. 2457T
caucacuuuugaaaucaa

SEQ ID NO: 1909537 - RNA, 23 nt, Shigella flexneri 2a str. 2457T
caucacugcaaauacccaaaaaa

SEQ ID NO: 1909538 - RNA, 14 nt, Shigella flexneri 2a str. 2457T
caucuccagcugcu

SEQ ID NO: 1909539 - RNA, 22 nt, Shigella flexneri 2a str. 2457T
caucuaaccauuauuaaauuua

SEQ ID NO: 1909540 - RNA, 19 nt, Shigella flexneri 2a str. 2457T
caucuacccgaugcaaaaa

SEQ ID NO: 1909541 - RNA, 23 nt, Shigella flexneri 2a str. 2457T
caucgucggccuuaaugcccacg

SEQ ID NO: 1909542 - RNA, 13 nt, Shigella flexneri 2a str. 2457T
caucgucggccuu

SEQ ID NO: 1909543 - RNA, 20 nt, Shigella flexneri 2a str. 2457T
caucgucggccuuaaugccc

SEQ ID NO: 1909544 - RNA, 13 nt, Shigella flexneri 2a str. 2457T
caucgugcaccaa

SEQ ID NO: 1909545 - RNA, 18 nt, Shigella flexneri 2a str. 2457T
caucguuugcugccuuca

SEQ ID NO: 1909546 - RNA, 21 nt, Shigella flexneri 2a str. 2457T
caucguguugaugcuccuggc

SEQ ID NO: 1909547 - RNA, 15 nt, Shigella flexneri 2a str. 2457T
caucggcagcgccag

SEQ ID NO: 1909548 - RNA, 16 nt, Shigella flexneri 2a str. 2457T
caucggcagcgccaau

SEQ ID NO: 1909549 - RNA, 13 nt, Shigella flexneri 2a str. 2457T
caucggcaucaaa

SEQ ID NO: 1909550 - RNA, 15 nt, Shigella flexneri 2a str. 2457T
caucggcauuaaucu

SEQ ID NO: 1909551 - RNA, 21 nt, Shigella flexneri 2a str. 2457T
caucguaguuuuugcccauca

SEQ ID NO: 1909552 - RNA, 21 nt, Shigella flexneri 2a str. 2457T
caucguacuguguuguacagu

SEQ ID NO: 1909553 - RNA, 13 nt, Shigella flexneri 2a str. 2457T
caucguccagcuu

SEQ ID NO: 1909554 - RNA, 16 nt, Shigella flexneri 2a str. 2457T
caucguauuucagacc

SEQ ID NO: 1909555 - RNA, 14 nt, Shigella flexneri 2a str. 2457T
caucgccaaacagg

SEQ ID NO: 1909556 - RNA, 19 nt, Shigella flexneri 2a str. 2457T
caucgcauaaaccacagac

SEQ ID NO: 1909557 - RNA, 19 nt, Shigella flexneri 2a str. 2457T
caucgcaaaccagacgcgc

SEQ ID NO: 1909558 - RNA, 21 nt, Shigella flexneri 2a str. 2457T
caucgcacgagaaaaaaugac

SEQ ID NO: 1909559 - RNA, 21 nt, Shigella flexneri 2a str. 2457T
caucgcaaaccagacgcgcgu

SEQ ID NO: 1909560 - RNA, 21 nt, Shigella flexneri 2a str. 2457T
cauccuggggguucaucacca

SEQ ID NO: 1909561 - RNA, 12 nt, Shigella flexneri 2a str. 2457T
cauccugcugca

SEQ ID NO: 1909562 - RNA, 14 nt, Shigella flexneri 2a str. 2457T
cauccugcucaagu

SEQ ID NO: 1909563 - RNA, 18 nt, Shigella flexneri 2a str. 2457T
cauccugcggcagcucca

SEQ ID NO: 1909564 - RNA, 19 nt, Shigella flexneri 2a str. 2457T
cauccugcggcagcuccag

SEQ ID NO: 1909565 - RNA, 22 nt, Shigella flexneri 2a str. 2457T
cauccuggggguucaucaccac

SEQ ID NO: 1909566 - RNA, 17 nt, Shigella flexneri 2a str. 2457T
caucgaugagaugacgc

SEQ ID NO: 1909567 - RNA, 23 nt, Shigella flexneri 2a str. 2457T
caucgcugauuucaccaucuuca

SEQ ID NO: 1909568 - RNA, 22 nt, Shigella flexneri 2a str. 2457T
caucgcugggauuacaacacgc

SEQ ID NO: 1909569 - RNA, 19 nt, Shigella flexneri 2a str. 2457T
caucgcuucaugcccgcca

SEQ ID NO: 1909570 - RNA, 19 nt, Shigella flexneri 2a str. 2457T
caucggauugcuccugcuc

SEQ ID NO: 1909571 - RNA, 20 nt, Shigella flexneri 2a str. 2457T
caucggcaaucacaucacca

SEQ ID NO: 1909572 - RNA, 23 nt, Shigella flexneri 2a str. 2457T
caucccgguaucaaagcgccaga

SEQ ID NO: 1909573 - RNA, 15 nt, Shigella flexneri 2a str. 2457T
caucccgguuauuaa

SEQ ID NO: 1909574 - RNA, 20 nt, Shigella flexneri 2a str. 2457T
cauccccggcaaccacaccc

SEQ ID NO: 1909575 - RNA, 18 nt, Shigella flexneri 2a str. 2457T
caucccgagucgcugagc

SEQ ID NO: 1909576 - RNA, 17 nt, Shigella flexneri 2a str. 2457T
caucccgaccaaugcau

SEQ ID NO: 1909577 - RNA, 23 nt, Shigella flexneri 2a str. 2457T
caucccagugcaauaccauggcu

SEQ ID NO: 1909578 - RNA, 20 nt, Shigella flexneri 2a str. 2457T
cauccccaaaaaaucaacga

SEQ ID NO: 1909579 - RNA, 16 nt, Shigella flexneri 2a str. 2457T
cauccauuacaucacg

SEQ ID NO: 1909580 - RNA, 17 nt, Shigella flexneri 2a str. 2457T
cauccauugcauaaaca

SEQ ID NO: 1909581 - RNA, 20 nt, Shigella flexneri 2a str. 2457T
caucccaacuguagugauca

SEQ ID NO: 1909582 - RNA, 22 nt, Shigella flexneri 2a str. 2457T
cauccauucggcgauuaacaag

SEQ ID NO: 1909583 - RNA, 22 nt, Shigella flexneri 2a str. 2457T
caucccugaaauguuugcaaua

SEQ ID NO: 1909584 - RNA, 21 nt, Shigella flexneri 2a str. 2457T
caucccguuaugguuauccac

SEQ ID NO: 1909585 - RNA, 15 nt, Shigella flexneri 2a str. 2457T
cauccgcacaauccc

SEQ ID NO: 1909586 - RNA, 13 nt, Shigella flexneri 2a str. 2457T
cauccgacacugg

SEQ ID NO: 1909587 - RNA, 21 nt, Shigella flexneri 2a str. 2457T
cauccgacaaggcaucagauc

SEQ ID NO: 1909588 - RNA, 17 nt, Shigella flexneri 2a str. 2457T
cauccgacauuugcaca

SEQ ID NO: 1909589 - RNA, 19 nt, Shigella flexneri 2a str. 2457T
cauccggcaugaacaaagc

SEQ ID NO: 1909590 - RNA, 22 nt, Shigella flexneri 2a str. 2457T
cauccggcaugaacaaagcgca

SEQ ID NO: 1909591 - RNA, 21 nt, Shigella flexneri 2a str. 2457T
cauccggcauucagugcaaau

SEQ ID NO: 1909592 - RNA, 22 nt, Shigella flexneri 2a str. 2457T
cauccggcauucagugcaaaug

SEQ ID NO: 1909593 - RNA, 17 nt, Shigella flexneri 2a str. 2457T
cauccggcagccgugcc

SEQ ID NO: 1909594 - RNA, 22 nt, Shigella flexneri 2a str. 2457T
cauccggcagccgugcccaacu

SEQ ID NO: 1909595 - RNA, 13 nt, Shigella flexneri 2a str. 2457T
cauccggcaccuu

SEQ ID NO: 1909596 - RNA, 19 nt, Shigella flexneri 2a str. 2457T
cauccggcaauucucucug

SEQ ID NO: 1909597 - RNA, 15 nt, Shigella flexneri 2a str. 2457T
cauccggcaauaagc

SEQ ID NO: 1909598 - RNA, 17 nt, Shigella flexneri 2a str. 2457T
cauccggcaaaaaagcc

SEQ ID NO: 1909599 - RNA, 22 nt, Shigella flexneri 2a str. 2457T
cauccggcaaaaaagcccgcac

SEQ ID NO: 1909600 - RNA, 21 nt, Shigella flexneri 2a str. 2457T
cauccggcaacaucaaauuac

SEQ ID NO: 1909601 - RNA, 19 nt, Shigella flexneri 2a str. 2457T
cauccggcaaguuguauug

SEQ ID NO: 1909602 - RNA, 14 nt, Shigella flexneri 2a str. 2457T
cauccggcaauauu

SEQ ID NO: 1909603 - RNA, 21 nt, Shigella flexneri 2a str. 2457T
cauccggcaaucggugcaaau

SEQ ID NO: 1909604 - RNA, 22 nt, Shigella flexneri 2a str. 2457T
cauccggcaaucggugcaaaug

SEQ ID NO: 1909605 - RNA, 21 nt, Shigella flexneri 2a str. 2457T
caucaggcaacccagaagaaa

SEQ ID NO: 1909606 - RNA, 14 nt, Shigella flexneri 2a str. 2457T
caucauggcauuuc

SEQ ID NO: 1909607 - RNA, 20 nt, Shigella flexneri 2a str. 2457T
caucaugcucagaugccuga

SEQ ID NO: 1909608 - RNA, 20 nt, Shigella flexneri 2a str. 2457T
caucaugguuugcauccaca

SEQ ID NO: 1909609 - RNA, 20 nt, Shigella flexneri 2a str. 2457T
caucagcgguaaaacgccca

SEQ ID NO: 1909610 - RNA, 18 nt, Shigella flexneri 2a str. 2457T
caucagcgguacucgcgc

SEQ ID NO: 1909611 - RNA, 21 nt, Shigella flexneri 2a str. 2457T
caucaggacgaauacaagaga

SEQ ID NO: 1909612 - RNA, 14 nt, Shigella flexneri 2a str. 2457T
caucaggaaacccg

SEQ ID NO: 1909613 - RNA, 14 nt, Shigella flexneri 2a str. 2457T
cauccaacaauagu

SEQ ID NO: 1909614 - RNA, 22 nt, Shigella flexneri 2a str. 2457T
cauccaacaauagugccgcacu

SEQ ID NO: 1909615 - RNA, 15 nt, Shigella flexneri 2a str. 2457T
cauccagcacuugca

SEQ ID NO: 1909616 - RNA, 20 nt, Shigella flexneri 2a str. 2457T
cauccagcagacgcuccauu

SEQ ID NO: 1909617 - RNA, 20 nt, Shigella flexneri 2a str. 2457T
cauccagcaacaacagcgcg

SEQ ID NO: 1909618 - RNA, 15 nt, Shigella flexneri 2a str. 2457T
cauccagcagugacu

SEQ ID NO: 1909619 - RNA, 13 nt, Shigella flexneri 2a str. 2457T
cauccagcucgug

SEQ ID NO: 1909620 - RNA, 20 nt, Shigella flexneri 2a str. 2457T
cauccagcagcccuugcuuc

SEQ ID NO: 1909621 - RNA, 14 nt, Shigella flexneri 2a str. 2457T
cauccaucugcuuu

SEQ ID NO: 1909622 - RNA, 16 nt, Shigella flexneri 2a str. 2457T
cauccagugccgccug

SEQ ID NO: 1909623 - RNA, 12 nt, Shigella flexneri 2a str. 2457T
cauccaucaaau

SEQ ID NO: 1909624 - RNA, 17 nt, Shigella flexneri 2a str. 2457T
cauccaggaacuccaga

SEQ ID NO: 1909625 - RNA, 18 nt, Shigella flexneri 2a str. 2457T
cauccaggaacuccagau

SEQ ID NO: 1909626 - RNA, 20 nt, Shigella flexneri 2a str. 2457T
cauccagcuuuuagaucacu

SEQ ID NO: 1909627 - RNA, 21 nt, Shigella flexneri 2a str. 2457T
cauccagcuuuuuaaucgcca

SEQ ID NO: 1909628 - RNA, 15 nt, Shigella flexneri 2a str. 2457T
caaaauccgccaccg

SEQ ID NO: 1909629 - RNA, 20 nt, Shigella flexneri 2a str. 2457T
caaaaucuucguuaucccag

SEQ ID NO: 1909630 - RNA, 17 nt, Shigella flexneri 2a str. 2457T
caaaaucuuaaagaugc

SEQ ID NO: 1909631 - RNA, 14 nt, Shigella flexneri 2a str. 2457T
caaaaucuucguua

SEQ ID NO: 1909632 - RNA, 18 nt, Shigella flexneri 2a str. 2457T
caaaaucuauugcaacau

SEQ ID NO: 1909633 - RNA, 15 nt, Shigella flexneri 2a str. 2457T
caaaauguugucauu

SEQ ID NO: 1909634 - RNA, 22 nt, Shigella flexneri 2a str. 2457T
caaaauguugucauuacaacaa

SEQ ID NO: 1909635 - RNA, 19 nt, Shigella flexneri 2a str. 2457T
caaaauguuuaugccuggu

SEQ ID NO: 1909636 - RNA, 13 nt, Shigella flexneri 2a str. 2457T
caaaauguuuaug

SEQ ID NO: 1909637 - RNA, 23 nt, Shigella flexneri 2a str. 2457T
caaacaauuuucauugaaaaagu

SEQ ID NO: 1909638 - RNA, 16 nt, Shigella flexneri 2a str. 2457T
caaaauuagaaaggga

SEQ ID NO: 1909639 - RNA, 13 nt, Shigella flexneri 2a str. 2457T
caaaauuagagau

SEQ ID NO: 1909640 - RNA, 12 nt, Shigella flexneri 2a str. 2457T
caaaauuauucc

SEQ ID NO: 1909641 - RNA, 14 nt, Shigella flexneri 2a str. 2457T
caaaauacuguuua

SEQ ID NO: 1909642 - RNA, 23 nt, Shigella flexneri 2a str. 2457T
caaaauacuguuuaucuucccag

SEQ ID NO: 1909643 - RNA, 16 nt, Shigella flexneri 2a str. 2457T
caaaauacuguuuauc

SEQ ID NO: 1909644 - RNA, 22 nt, Shigella flexneri 2a str. 2457T
caaaauacuguuuaucuuccca

SEQ ID NO: 1909645 - RNA, 19 nt, Shigella flexneri 2a str. 2457T
caaaauagccaaucauucc

SEQ ID NO: 1909646 - RNA, 21 nt, Shigella flexneri 2a str. 2457T
caaaaucaggccgaggcacag

SEQ ID NO: 1909647 - RNA, 11 nt, Shigella flexneri 2a str. 2457T
caaaaucauca

SEQ ID NO: 1909648 - RNA, 17 nt, Shigella flexneri 2a str. 2457T
caaaaguagccauuuga

SEQ ID NO: 1909649 - RNA, 20 nt, Shigella flexneri 2a str. 2457T
auuuuuauauagccagccuc

SEQ ID NO: 1909650 - RNA, 22 nt, Shigella flexneri 2a str. 2457T
auuuuuaucucaaaaauuacuc

SEQ ID NO: 1909651 - RNA, 14 nt, Shigella flexneri 2a str. 2457T
auuuuucaauaucc

SEQ ID NO: 1909652 - RNA, 18 nt, Shigella flexneri 2a str. 2457T
auuuuucaauauccaaca

SEQ ID NO: 1909653 - RNA, 13 nt, Shigella flexneri 2a str. 2457T
caaacuaucccag

SEQ ID NO: 1909654 - RNA, 20 nt, Shigella flexneri 2a str. 2457T
caaacguggucgccagcauu

SEQ ID NO: 1909655 - RNA, 13 nt, Shigella flexneri 2a str. 2457T
caaacggcuggaa

SEQ ID NO: 1909656 - RNA, 20 nt, Shigella flexneri 2a str. 2457T
caaacgugacauucugacug

SEQ ID NO: 1909657 - RNA, 14 nt, Shigella flexneri 2a str. 2457T
caaacgguuguagc

SEQ ID NO: 1909658 - RNA, 21 nt, Shigella flexneri 2a str. 2457T
caaacgucgcaucugaccaga

SEQ ID NO: 1909659 - RNA, 19 nt, Shigella flexneri 2a str. 2457T
caaacuccgugaagcucac

SEQ ID NO: 1909660 - RNA, 15 nt, Shigella flexneri 2a str. 2457T
caaacuccgcgacca

SEQ ID NO: 1909661 - RNA, 13 nt, Shigella flexneri 2a str. 2457T
caaacucuuuucc

SEQ ID NO: 1909662 - RNA, 19 nt, Shigella flexneri 2a str. 2457T
caaacugaguggaguccag

SEQ ID NO: 1909663 - RNA, 23 nt, Shigella flexneri 2a str. 2457T
caaacgcuuuacucaacuccccg

SEQ ID NO: 1909664 - RNA, 15 nt, Shigella flexneri 2a str. 2457T
caaacgcuggugagu

SEQ ID NO: 1909665 - RNA, 19 nt, Shigella flexneri 2a str. 2457T
caaacgcugacauauuuuu

SEQ ID NO: 1909666 - RNA, 18 nt, Shigella flexneri 2a str. 2457T
caaacgcucccugccagu

SEQ ID NO: 1909667 - RNA, 17 nt, Shigella flexneri 2a str. 2457T
caaacgccacagcaauu

SEQ ID NO: 1909668 - RNA, 16 nt, Shigella flexneri 2a str. 2457T
caaacgccagauacau

SEQ ID NO: 1909669 - RNA, 18 nt, Shigella flexneri 2a str. 2457T
caaacgccuagaugcuca

SEQ ID NO: 1909670 - RNA, 17 nt, Shigella flexneri 2a str. 2457T
caaacgauucaaaagau

SEQ ID NO: 1909671 - RNA, 15 nt, Shigella flexneri 2a str. 2457T
caaacgcaaaacugc

SEQ ID NO: 1909672 - RNA, 14 nt, Shigella flexneri 2a str. 2457T
caaaccucaccgcu

SEQ ID NO: 1909673 - RNA, 17 nt, Shigella flexneri 2a str. 2457T
caaacgacgagcgcugg

SEQ ID NO: 1909674 - RNA, 23 nt, Shigella flexneri 2a str. 2457T
caaacgacgggccaguuucauag

SEQ ID NO: 1909675 - RNA, 15 nt, Shigella flexneri 2a str. 2457T
caaacgauaaaagug

SEQ ID NO: 1909676 - RNA, 19 nt, Shigella flexneri 2a str. 2457T
caaaccugcaaugauguca

SEQ ID NO: 1909677 - RNA, 18 nt, Shigella flexneri 2a str. 2457T
caaaccugcgggaugguu

SEQ ID NO: 1909678 - RNA, 23 nt, Shigella flexneri 2a str. 2457T
caaaccuggcauguggcggcgcg

SEQ ID NO: 1909679 - RNA, 20 nt, Shigella flexneri 2a str. 2457T
caaacaugccaacaaaaucu

SEQ ID NO: 1909680 - RNA, 12 nt, Shigella flexneri 2a str. 2457T
caaacaucaucc

SEQ ID NO: 1909681 - RNA, 20 nt, Shigella flexneri 2a str. 2457T
caaaccaauuaugaauaacc

SEQ ID NO: 1909682 - RNA, 14 nt, Shigella flexneri 2a str. 2457T
caaacccugaguga

SEQ ID NO: 1909683 - RNA, 22 nt, Shigella flexneri 2a str. 2457T
caaacccagggccaacuggcaa

SEQ ID NO: 1909684 - RNA, 18 nt, Shigella flexneri 2a str. 2457T
caaacaguucugcagcgu

SEQ ID NO: 1909685 - RNA, 21 nt, Shigella flexneri 2a str. 2457T
caaacaguuucugcagcucca

SEQ ID NO: 1909686 - RNA, 17 nt, Shigella flexneri 2a str. 2457T
caaacagucgcccgacc

SEQ ID NO: 1909687 - RNA, 23 nt, Shigella flexneri 2a str. 2457T
caaacagucacuuucgagcaauu

SEQ ID NO: 1909688 - RNA, 22 nt, Shigella flexneri 2a str. 2457T
caaacaguacaucuuccacuuu

SEQ ID NO: 1909689 - RNA, 21 nt, Shigella flexneri 2a str. 2457T
caaacagggcaauuaaaaauu

SEQ ID NO: 1909690 - RNA, 22 nt, Shigella flexneri 2a str. 2457T
caaacagcgccagauagccgac

SEQ ID NO: 1909691 - RNA, 22 nt, Shigella flexneri 2a str. 2457T
caaacacugaaccgaaauggcu

SEQ ID NO: 1909692 - RNA, 16 nt, Shigella flexneri 2a str. 2457T
caaacagcagaacgac

SEQ ID NO: 1909693 - RNA, 13 nt, Shigella flexneri 2a str. 2457T
caaacagcagaac

SEQ ID NO: 1909694 - RNA, 15 nt, Shigella flexneri 2a str. 2457T
caaacaccagcgaau

SEQ ID NO: 1909695 - RNA, 18 nt, Shigella flexneri 2a str. 2457T
caaacaccgaaccagaga

SEQ ID NO: 1909696 - RNA, 19 nt, Shigella flexneri 2a str. 2457T
caaacacaggcaaaacacu

SEQ ID NO: 1909697 - RNA, 17 nt, Shigella flexneri 2a str. 2457T
caaacacaaaacugccu

SEQ ID NO: 1909698 - RNA, 16 nt, Shigella flexneri 2a str. 2457T
caaagcggucuucugu

SEQ ID NO: 1909699 - RNA, 15 nt, Shigella flexneri 2a str. 2457T
caaagcugcuuuucc

SEQ ID NO: 1909700 - RNA, 21 nt, Shigella flexneri 2a str. 2457T
caaagcucauugcggcaacaa

SEQ ID NO: 1909701 - RNA, 20 nt, Shigella flexneri 2a str. 2457T
caaagcugguggcaagaccu

SEQ ID NO: 1909702 - RNA, 23 nt, Shigella flexneri 2a str. 2457T
caaagcgcacuuugucaaaaauc

SEQ ID NO: 1909703 - RNA, 22 nt, Shigella flexneri 2a str. 2457T
caaagcgcacuuugucaaaaau

SEQ ID NO: 1909704 - RNA, 23 nt, Shigella flexneri 2a str. 2457T
caaagcgcacuuuacuggucugu

SEQ ID NO: 1909705 - RNA, 21 nt, Shigella flexneri 2a str. 2457T
caaacuugaacuuaucaucag

SEQ ID NO: 1909706 - RNA, 20 nt, Shigella flexneri 2a str. 2457T
caaacuugauagaacaaaag

SEQ ID NO: 1909707 - RNA, 19 nt, Shigella flexneri 2a str. 2457T
caaacuucucgccaucaaa

SEQ ID NO: 1909708 - RNA, 22 nt, Shigella flexneri 2a str. 2457T
caaacugguauugagcgaccgc

SEQ ID NO: 1909709 - RNA, 12 nt, Shigella flexneri 2a str. 2457T
caaacuuaugca

SEQ ID NO: 1909710 - RNA, 19 nt, Shigella flexneri 2a str. 2457T
caaacugcucguucagcac

SEQ ID NO: 1909711 - RNA, 15 nt, Shigella flexneri 2a str. 2457T
caaagagagaagcca

SEQ ID NO: 1909712 - RNA, 18 nt, Shigella flexneri 2a str. 2457T
caaagacguuaaaaaagg

SEQ ID NO: 1909713 - RNA, 15 nt, Shigella flexneri 2a str. 2457T
caaauauucugccca

SEQ ID NO: 1909714 - RNA, 15 nt, Shigella flexneri 2a str. 2457T
caaauauuucuuuau

SEQ ID NO: 1909715 - RNA, 15 nt, Shigella flexneri 2a str. 2457T
caaauauuaauaaua

SEQ ID NO: 1909716 - RNA, 12 nt, Shigella flexneri 2a str. 2457T
caaauccagcgc

SEQ ID NO: 1909717 - RNA, 14 nt, Shigella flexneri 2a str. 2457T
caaauccagcgcca

SEQ ID NO: 1909718 - RNA, 17 nt, Shigella flexneri 2a str. 2457T
caaauccagcgccacau

SEQ ID NO: 1909719 - RNA, 14 nt, Shigella flexneri 2a str. 2457T
caaauccgcacuca

SEQ ID NO: 1909720 - RNA, 17 nt, Shigella flexneri 2a str. 2457T
caaauccgcacucaucu

SEQ ID NO: 1909721 - RNA, 21 nt, Shigella flexneri 2a str. 2457T
caaauaucuauuucaggucaa

SEQ ID NO: 1909722 - RNA, 14 nt, Shigella flexneri 2a str. 2457T
caaauacugacugg

SEQ ID NO: 1909723 - RNA, 17 nt, Shigella flexneri 2a str. 2457T
caaauacccaaaaaaua

SEQ ID NO: 1909724 - RNA, 19 nt, Shigella flexneri 2a str. 2457T
caaauacgcuuuuucccug

SEQ ID NO: 1909725 - RNA, 15 nt, Shigella flexneri 2a str. 2457T
caaauagacacaaga

SEQ ID NO: 1909726 - RNA, 16 nt, Shigella flexneri 2a str. 2457T
caaauacuucaauaua

SEQ ID NO: 1909727 - RNA, 20 nt, Shigella flexneri 2a str. 2457T
caaauacuuuuuccaguaga

SEQ ID NO: 1909728 - RNA, 21 nt, Shigella flexneri 2a str. 2457T
caaaggguuuuugagucacau

SEQ ID NO: 1909729 - RNA, 22 nt, Shigella flexneri 2a str. 2457T
caaauaccggacacacuucauu

SEQ ID NO: 1909730 - RNA, 10 nt, Shigella flexneri 2a str. 2457T
caaagggagc

SEQ ID NO: 1909731 - RNA, 13 nt, Shigella flexneri 2a str. 2457T
caaagggcaaagu

SEQ ID NO: 1909732 - RNA, 16 nt, Shigella flexneri 2a str. 2457T
caaagggcaaagucag

SEQ ID NO: 1909733 - RNA, 17 nt, Shigella flexneri 2a str. 2457T
caaaggcgaguucaauc

SEQ ID NO: 1909734 - RNA, 14 nt, Shigella flexneri 2a str. 2457T
caaaggccagccag

SEQ ID NO: 1909735 - RNA, 14 nt, Shigella flexneri 2a str. 2457T
caaaggccagcaau

SEQ ID NO: 1909736 - RNA, 16 nt, Shigella flexneri 2a str. 2457T
caacaaacgcaaacac

SEQ ID NO: 1909737 - RNA, 15 nt, Shigella flexneri 2a str. 2457T
caacaaacgauuuau

SEQ ID NO: 1909738 - RNA, 12 nt, Shigella flexneri 2a str. 2457T
caacaaagcgcg

SEQ ID NO: 1909739 - RNA, 13 nt, Shigella flexneri 2a str. 2457T
caacaaaguugca

SEQ ID NO: 1909740 - RNA, 19 nt, Shigella flexneri 2a str. 2457T
caacaaagccacuuaauaa

SEQ ID NO: 1909741 - RNA, 18 nt, Shigella flexneri 2a str. 2457T
caacaaauaaaagcaaaa

SEQ ID NO: 1909742 - RNA, 17 nt, Shigella flexneri 2a str. 2457T
caaauuugugcucuggc

SEQ ID NO: 1909743 - RNA, 15 nt, Shigella flexneri 2a str. 2457T
caaauuuugaacaga

SEQ ID NO: 1909744 - RNA, 17 nt, Shigella flexneri 2a str. 2457T
caaauuuugaacagaac

SEQ ID NO: 1909745 - RNA, 18 nt, Shigella flexneri 2a str. 2457T
caaauuuugaacagaacu

SEQ ID NO: 1909746 - RNA, 16 nt, Shigella flexneri 2a str. 2457T
caaauucaauauauug

SEQ ID NO: 1909747 - RNA, 16 nt, Shigella flexneri 2a str. 2457T
caaauuccgaacaaaa

SEQ ID NO: 1909748 - RNA, 15 nt, Shigella flexneri 2a str. 2457T
caaauccgcuguaau

SEQ ID NO: 1909749 - RNA, 14 nt, Shigella flexneri 2a str. 2457T
caaaucgaaaucaa

SEQ ID NO: 1909750 - RNA, 15 nt, Shigella flexneri 2a str. 2457T
caaauccuucagacu

SEQ ID NO: 1909751 - RNA, 19 nt, Shigella flexneri 2a str. 2457T
caaaucugauuaauauuga

SEQ ID NO: 1909752 - RNA, 14 nt, Shigella flexneri 2a str. 2457T
caaaucuuuucugc

SEQ ID NO: 1909753 - RNA, 17 nt, Shigella flexneri 2a str. 2457T
caaauuaaacgggcgau

SEQ ID NO: 1909754 - RNA, 22 nt, Shigella flexneri 2a str. 2457T
caaauguugcaucgccugcgcg

SEQ ID NO: 1909755 - RNA, 19 nt, Shigella flexneri 2a str. 2457T
caaauguugcguucaucag

SEQ ID NO: 1909756 - RNA, 13 nt, Shigella flexneri 2a str. 2457T
caaauggcauccu

SEQ ID NO: 1909757 - RNA, 14 nt, Shigella flexneri 2a str. 2457T
caacaauacaaaug

SEQ ID NO: 1909758 - RNA, 23 nt, Shigella flexneri 2a str. 2457T
caacaccgggugcagacaugacg

SEQ ID NO: 1909759 - RNA, 15 nt, Shigella flexneri 2a str. 2457T
caacaacgcaacucc

SEQ ID NO: 1909760 - RNA, 12 nt, Shigella flexneri 2a str. 2457T
caacaacaccca

SEQ ID NO: 1909761 - RNA, 15 nt, Shigella flexneri 2a str. 2457T
caacaacugaaaaaa

SEQ ID NO: 1909762 - RNA, 12 nt, Shigella flexneri 2a str. 2457T
caacaacugaaa

SEQ ID NO: 1909763 - RNA, 17 nt, Shigella flexneri 2a str. 2457T
caacauacugcuccaua

SEQ ID NO: 1909764 - RNA, 18 nt, Shigella flexneri 2a str. 2457T
caacauacuguaacugcg

SEQ ID NO: 1909765 - RNA, 19 nt, Shigella flexneri 2a str. 2457T
caacaguaauaaugcccau

SEQ ID NO: 1909766 - RNA, 23 nt, Shigella flexneri 2a str. 2457T
caacaguacgguaaagccgugcu

SEQ ID NO: 1909767 - RNA, 17 nt, Shigella flexneri 2a str. 2457T
caacagucgccacgcgc

SEQ ID NO: 1909768 - RNA, 18 nt, Shigella flexneri 2a str. 2457T
caaggcaggcaucaauga

SEQ ID NO: 1909769 - RNA, 17 nt, Shigella flexneri 2a str. 2457T
caagcuuacguuaccca

SEQ ID NO: 1909770 - RNA, 20 nt, Shigella flexneri 2a str. 2457T
caagcugcgugagccgaaau

SEQ ID NO: 1909771 - RNA, 14 nt, Shigella flexneri 2a str. 2457T
caagcuguucuucc

SEQ ID NO: 1909772 - RNA, 18 nt, Shigella flexneri 2a str. 2457T
caagcuuacguuacccag

SEQ ID NO: 1909773 - RNA, 15 nt, Shigella flexneri 2a str. 2457T
caagcaaggccaggu

SEQ ID NO: 1909774 - RNA, 17 nt, Shigella flexneri 2a str. 2457T
caagauugccugaugcg

SEQ ID NO: 1909775 - RNA, 17 nt, Shigella flexneri 2a str. 2457T
caagauugauccccgcu

SEQ ID NO: 1909776 - RNA, 19 nt, Shigella flexneri 2a str. 2457T
caagcgcugagacgcgcuu

SEQ ID NO: 1909777 - RNA, 13 nt, Shigella flexneri 2a str. 2457T
caagcgccgccag

SEQ ID NO: 1909778 - RNA, 17 nt, Shigella flexneri 2a str. 2457T
caaguaacugacaccga

SEQ ID NO: 1909779 - RNA, 23 nt, Shigella flexneri 2a str. 2457T
caaguaauagaacuauaauugcu

SEQ ID NO: 1909780 - RNA, 21 nt, Shigella flexneri 2a str. 2457T
caagggaaauaagaaaagcga

SEQ ID NO: 1909781 - RNA, 16 nt, Shigella flexneri 2a str. 2457T
caaggccaauccagcc

SEQ ID NO: 1909782 - RNA, 16 nt, Shigella flexneri 2a str. 2457T
caaguuacuccuggua

SEQ ID NO: 1909783 - RNA, 20 nt, Shigella flexneri 2a str. 2457T
caagugaauaaauuuuauuc

SEQ ID NO: 1909784 - RNA, 20 nt, Shigella flexneri 2a str. 2457T
caagugagucggcuuuuuug

SEQ ID NO: 1909785 - RNA, 15 nt, Shigella flexneri 2a str. 2457T
caagugagucggcuu

SEQ ID NO: 1909786 - RNA, 18 nt, Shigella flexneri 2a str. 2457T
caauaagauaacccugca

SEQ ID NO: 1909787 - RNA, 12 nt, Shigella flexneri 2a str. 2457T
caauaacuccau

SEQ ID NO: 1909788 - RNA, 22 nt, Shigella flexneri 2a str. 2457T
caauaacucuuugaugaaacau

SEQ ID NO: 1909789 - RNA, 21 nt, Shigella flexneri 2a str. 2457T
caauaaucaucucuccuuucg

SEQ ID NO: 1909790 - RNA, 18 nt, Shigella flexneri 2a str. 2457T
caauaagcgcagccaaaa

SEQ ID NO: 1909791 - RNA, 17 nt, Shigella flexneri 2a str. 2457T
caauaaccggcacuuca

SEQ ID NO: 1909792 - RNA, 18 nt, Shigella flexneri 2a str. 2457T
caauaacccgcuguaaau

SEQ ID NO: 1909793 - RNA, 21 nt, Shigella flexneri 2a str. 2457T
caauaacccgcuguaaaugcu

SEQ ID NO: 1909794 - RNA, 13 nt, Shigella flexneri 2a str. 2457T
caauaaccaucag

SEQ ID NO: 1909795 - RNA, 14 nt, Shigella flexneri 2a str. 2457T
caauaaccaucagc

SEQ ID NO: 1909796 - RNA, 17 nt, Shigella flexneri 2a str. 2457T
caaguucgaacgccgcc

SEQ ID NO: 1909797 - RNA, 15 nt, Shigella flexneri 2a str. 2457T
caaguugauuuuucg

SEQ ID NO: 1909798 - RNA, 23 nt, Shigella flexneri 2a str. 2457T
caaguucgaacgccgccaguacg

SEQ ID NO: 1909799 - RNA, 19 nt, Shigella flexneri 2a str. 2457T
caaguucuucgaagcacuc

SEQ ID NO: 1909800 - RNA, 23 nt, Shigella flexneri 2a str. 2457T
caauaaucucuuuacccagcgga

SEQ ID NO: 1909801 - RNA, 14 nt, Shigella flexneri 2a str. 2457T
caauaaucugauuu

SEQ ID NO: 1909802 - RNA, 23 nt, Shigella flexneri 2a str. 2457T
caauacagguuguugccuucacg

SEQ ID NO: 1909803 - RNA, 12 nt, Shigella flexneri 2a str. 2457T
caauacagccag

SEQ ID NO: 1909804 - RNA, 13 nt, Shigella flexneri 2a str. 2457T
caauacaucuuuu

SEQ ID NO: 1909805 - RNA, 21 nt, Shigella flexneri 2a str. 2457T
caauaccgccugcaaauaaau

SEQ ID NO: 1909806 - RNA, 16 nt, Shigella flexneri 2a str. 2457T
caauaccgccugcaaa

SEQ ID NO: 1909807 - RNA, 17 nt, Shigella flexneri 2a str. 2457T
caauaccgccugacggu

SEQ ID NO: 1909808 - RNA, 17 nt, Shigella flexneri 2a str. 2457T
caauaccauuaucauug

SEQ ID NO: 1909809 - RNA, 16 nt, Shigella flexneri 2a str. 2457T
caauacccgcaacaau

SEQ ID NO: 1909810 - RNA, 14 nt, Shigella flexneri 2a str. 2457T
caauaucaaauaaa

SEQ ID NO: 1909811 - RNA, 18 nt, Shigella flexneri 2a str. 2457T
caauauauugaauuugca

SEQ ID NO: 1909812 - RNA, 14 nt, Shigella flexneri 2a str. 2457T
caauagcaacugau

SEQ ID NO: 1909813 - RNA, 18 nt, Shigella flexneri 2a str. 2457T
caauagcaacugauuuau

SEQ ID NO: 1909814 - RNA, 22 nt, Shigella flexneri 2a str. 2457T
caauaccuucugcgcccgcccg

SEQ ID NO: 1909815 - RNA, 18 nt, Shigella flexneri 2a str. 2457T
caauagacaguucuuccu

SEQ ID NO: 1909816 - RNA, 19 nt, Shigella flexneri 2a str. 2457T
caauaugucguuauauaaa

SEQ ID NO: 1909817 - RNA, 13 nt, Shigella flexneri 2a str. 2457T
caauaugcauaaa

SEQ ID NO: 1909818 - RNA, 11 nt, Shigella flexneri 2a str. 2457T
caaucaccgca

SEQ ID NO: 1909819 - RNA, 15 nt, Shigella flexneri 2a str. 2457T
caaucaccgccagcg

SEQ ID NO: 1909820 - RNA, 17 nt, Shigella flexneri 2a str. 2457T
caaucaccgccagcggc

SEQ ID NO: 1909821 - RNA, 17 nt, Shigella flexneri 2a str. 2457T
caaucaccgcaaacaua

SEQ ID NO: 1909822 - RNA, 18 nt, Shigella flexneri 2a str. 2457T
caaucaccgccagcaagg

SEQ ID NO: 1909823 - RNA, 15 nt, Shigella flexneri 2a str. 2457T
caaucacaaaaagua

SEQ ID NO: 1909824 - RNA, 17 nt, Shigella flexneri 2a str. 2457T
caaucacaaaaccgucg

SEQ ID NO: 1909825 - RNA, 15 nt, Shigella flexneri 2a str. 2457T
caaucacaauagaaa

SEQ ID NO: 1909826 - RNA, 12 nt, Shigella flexneri 2a str. 2457T
caaucaccagau

SEQ ID NO: 1909827 - RNA, 16 nt, Shigella flexneri 2a str. 2457T
caagaaucaugccaaa

SEQ ID NO: 1909828 - RNA, 17 nt, Shigella flexneri 2a str. 2457T
caagaauacagggaaag

SEQ ID NO: 1909829 - RNA, 17 nt, Shigella flexneri 2a str. 2457T
caagaauacuguccaua

SEQ ID NO: 1909830 - RNA, 16 nt, Shigella flexneri 2a str. 2457T
caagaaacagcaguuc

SEQ ID NO: 1909831 - RNA, 19 nt, Shigella flexneri 2a str. 2457T
caagaaccaaagaaaucag

SEQ ID NO: 1909832 - RNA, 14 nt, Shigella flexneri 2a str. 2457T
caagaacgaugauu

SEQ ID NO: 1909833 - RNA, 21 nt, Shigella flexneri 2a str. 2457T
caagaacgcauaccccaucag

SEQ ID NO: 1909834 - RNA, 22 nt, Shigella flexneri 2a str. 2457T
caagaacgcauaccccaucagc

SEQ ID NO: 1909835 - RNA, 14 nt, Shigella flexneri 2a str. 2457T
caacuuucacgcgc

SEQ ID NO: 1909836 - RNA, 15 nt, Shigella flexneri 2a str. 2457T
caagaucgcgcauca

SEQ ID NO: 1909837 - RNA, 16 nt, Shigella flexneri 2a str. 2457T
caagaucgcccugagg

SEQ ID NO: 1909838 - RNA, 18 nt, Shigella flexneri 2a str. 2457T
caagaucgcgcaucagcu

SEQ ID NO: 1909839 - RNA, 21 nt, Shigella flexneri 2a str. 2457T
caagaucucauuccaccgaaa

SEQ ID NO: 1909840 - RNA, 21 nt, Shigella flexneri 2a str. 2457T
caagauauuucaccagcgcac

SEQ ID NO: 1909841 - RNA, 13 nt, Shigella flexneri 2a str. 2457T
caagauauuuugg

SEQ ID NO: 1909842 - RNA, 14 nt, Shigella flexneri 2a str. 2457T
caagaucauacuga

SEQ ID NO: 1909843 - RNA, 15 nt, Shigella flexneri 2a str. 2457T
caagauccugauacu

SEQ ID NO: 1909844 - RNA, 20 nt, Shigella flexneri 2a str. 2457T
caagauagcgcguugcgcca

SEQ ID NO: 1909845 - RNA, 21 nt, Shigella flexneri 2a str. 2457T
caagauacugccgauuacgua

SEQ ID NO: 1909846 - RNA, 15 nt, Shigella flexneri 2a str. 2457T
caagagugaacacgu

SEQ ID NO: 1909847 - RNA, 23 nt, Shigella flexneri 2a str. 2457T
caagaguaacccacguuagcgcu

SEQ ID NO: 1909848 - RNA, 23 nt, Shigella flexneri 2a str. 2457T
caagaggguuauuuguucagcaa

SEQ ID NO: 1909849 - RNA, 21 nt, Shigella flexneri 2a str. 2457T
caagacaucaauaaacaauga

SEQ ID NO: 1909850 - RNA, 17 nt, Shigella flexneri 2a str. 2457T
caagacgaaaaaugaau

SEQ ID NO: 1909851 - RNA, 16 nt, Shigella flexneri 2a str. 2457T
caagaauuaaaauauc

SEQ ID NO: 1909852 - RNA, 20 nt, Shigella flexneri 2a str. 2457T
caagaaucaugccaaaaaua

SEQ ID NO: 1909853 - RNA, 15 nt, Shigella flexneri 2a str. 2457T
caagagcaaauaaaa

SEQ ID NO: 1909854 - RNA, 16 nt, Shigella flexneri 2a str. 2457T
caagagacugcuggcu

SEQ ID NO: 1909855 - RNA, 23 nt, Shigella flexneri 2a str. 2457T
caacgacgcugaugucagcacuu

SEQ ID NO: 1909856 - RNA, 22 nt, Shigella flexneri 2a str. 2457T
caacgacauacucagcgccugc

SEQ ID NO: 1909857 - RNA, 13 nt, Shigella flexneri 2a str. 2457T
caacgaagaaaac

SEQ ID NO: 1909858 - RNA, 14 nt, Shigella flexneri 2a str. 2457T
caacgaagaaaacg

SEQ ID NO: 1909859 - RNA, 19 nt, Shigella flexneri 2a str. 2457T
caacgcaauaaacuucugg

SEQ ID NO: 1909860 - RNA, 16 nt, Shigella flexneri 2a str. 2457T
caacgcaaaggcuuuu

SEQ ID NO: 1909861 - RNA, 22 nt, Shigella flexneri 2a str. 2457T
caacgcaauauccgccacuucu

SEQ ID NO: 1909862 - RNA, 16 nt, Shigella flexneri 2a str. 2457T
caacgcaauccccucu

SEQ ID NO: 1909863 - RNA, 15 nt, Shigella flexneri 2a str. 2457T
caacgagauaaaauu

SEQ ID NO: 1909864 - RNA, 18 nt, Shigella flexneri 2a str. 2457T
caacgagccaauaaaaau

SEQ ID NO: 1909865 - RNA, 19 nt, Shigella flexneri 2a str. 2457T
caacauauaucgaaaaauc

SEQ ID NO: 1909866 - RNA, 23 nt, Shigella flexneri 2a str. 2457T
caacauauuccgcaccugccagc

SEQ ID NO: 1909867 - RNA, 21 nt, Shigella flexneri 2a str. 2457T
caacaucaaauuacagcaccu

SEQ ID NO: 1909868 - RNA, 22 nt, Shigella flexneri 2a str. 2457T
caacauccgaggacagcaucgu

SEQ ID NO: 1909869 - RNA, 20 nt, Shigella flexneri 2a str. 2457T
caacauccgggcgaacuggc

SEQ ID NO: 1909870 - RNA, 22 nt, Shigella flexneri 2a str. 2457T
caacauccuguaaacgaaaacu

SEQ ID NO: 1909871 - RNA, 20 nt, Shigella flexneri 2a str. 2457T
caaccugcacguuaucagac

SEQ ID NO: 1909872 - RNA, 18 nt, Shigella flexneri 2a str. 2457T
caaccuuauuuccagaua

SEQ ID NO: 1909873 - RNA, 20 nt, Shigella flexneri 2a str. 2457T
caaccuucuucuuucaguac

SEQ ID NO: 1909874 - RNA, 21 nt, Shigella flexneri 2a str. 2457T
caaccuucuucuuucaguacg

SEQ ID NO: 1909875 - RNA, 16 nt, Shigella flexneri 2a str. 2457T
caacucacgccccaga

SEQ ID NO: 1909876 - RNA, 19 nt, Shigella flexneri 2a str. 2457T
caacucauuuacagaaacu

SEQ ID NO: 1909877 - RNA, 19 nt, Shigella flexneri 2a str. 2457T
caacuccgccagcaacuga

SEQ ID NO: 1909878 - RNA, 16 nt, Shigella flexneri 2a str. 2457T
caacucccuauaguag

SEQ ID NO: 1909879 - RNA, 13 nt, Shigella flexneri 2a str. 2457T
caacuccgccagc

SEQ ID NO: 1909880 - RNA, 19 nt, Shigella flexneri 2a str. 2457T
caacuccccgcauuuacuc

SEQ ID NO: 1909881 - RNA, 13 nt, Shigella flexneri 2a str. 2457T
caacgugcuucgc

SEQ ID NO: 1909882 - RNA, 22 nt, Shigella flexneri 2a str. 2457T
caacguggaacaaauagacaca

SEQ ID NO: 1909883 - RNA, 18 nt, Shigella flexneri 2a str. 2457T
caacguuucgcugugauu

SEQ ID NO: 1909884 - RNA, 14 nt, Shigella flexneri 2a str. 2457T
caacgcgccaccga

SEQ ID NO: 1909885 - RNA, 13 nt, Shigella flexneri 2a str. 2457T
caacgcgcgguga

SEQ ID NO: 1909886 - RNA, 18 nt, Shigella flexneri 2a str. 2457T
caacgcgcgugaaguggc

SEQ ID NO: 1909887 - RNA, 16 nt, Shigella flexneri 2a str. 2457T
caacgcgcggaacuga

SEQ ID NO: 1909888 - RNA, 15 nt, Shigella flexneri 2a str. 2457T
caacgggcugaagaa

SEQ ID NO: 1909889 - RNA, 15 nt, Shigella flexneri 2a str. 2457T
caacguaacaaaacu

SEQ ID NO: 1909890 - RNA, 14 nt, Shigella flexneri 2a str. 2457T
caacguaacaaaac

SEQ ID NO: 1909891 - RNA, 13 nt, Shigella flexneri 2a str. 2457T
caacguaacaaaa

SEQ ID NO: 1909892 - RNA, 18 nt, Shigella flexneri 2a str. 2457T
caacgguugauggcaguc

SEQ ID NO: 1909893 - RNA, 13 nt, Shigella flexneri 2a str. 2457T
auuuuauacuuuu

SEQ ID NO: 1909894 - RNA, 20 nt, Shigella flexneri 2a str. 2457T
auuuuauuucuguauuacag

SEQ ID NO: 1909895 - RNA, 14 nt, Shigella flexneri 2a str. 2457T
auuuucucacccgc

SEQ ID NO: 1909896 - RNA, 22 nt, Shigella flexneri 2a str. 2457T
auuuucucacccgcaaacagga

SEQ ID NO: 1909897 - RNA, 19 nt, Shigella flexneri 2a str. 2457T
auuuugaagucuuuuuuca

SEQ ID NO: 1909898 - RNA, 17 nt, Shigella flexneri 2a str. 2457T
auuuugcugauauuuau

SEQ ID NO: 1909899 - RNA, 19 nt, Shigella flexneri 2a str. 2457T
auuuugcugccguuuucaa

SEQ ID NO: 1909900 - RNA, 15 nt, Shigella flexneri 2a str. 2457T
auuuugcuuccggca

SEQ ID NO: 1909901 - RNA, 13 nt, Shigella flexneri 2a str. 2457T
auuuugcgcuucu

SEQ ID NO: 1909902 - RNA, 13 nt, Shigella flexneri 2a str. 2457T
auuuugcauuuua

SEQ ID NO: 1909903 - RNA, 15 nt, Shigella flexneri 2a str. 2457T
auuuugcauuuuaaa

SEQ ID NO: 1909904 - RNA, 15 nt, Shigella flexneri 2a str. 2457T
auuuugccagcauga

SEQ ID NO: 1909905 - RNA, 17 nt, Shigella flexneri 2a str. 2457T
auuuugccagcaugacu

SEQ ID NO: 1909906 - RNA, 19 nt, Shigella flexneri 2a str. 2457T
auuuuggguuccacuucug

SEQ ID NO: 1909907 - RNA, 15 nt, Shigella flexneri 2a str. 2457T
auuuuuaagcgccau

SEQ ID NO: 1909908 - RNA, 15 nt, Shigella flexneri 2a str. 2457T
auuuuguaaaagaag

SEQ ID NO: 1909909 - RNA, 18 nt, Shigella flexneri 2a str. 2457T
auuuuuacuccacuuccu

SEQ ID NO: 1909910 - RNA, 14 nt, Shigella flexneri 2a str. 2457T
auuuuuaauuaaaa

SEQ ID NO: 1909911 - RNA, 19 nt, Shigella flexneri 2a str. 2457T
auuugacccaucugccagc

SEQ ID NO: 1909912 - RNA, 13 nt, Shigella flexneri 2a str. 2457T
auuugcugacaau

SEQ ID NO: 1909913 - RNA, 21 nt, Shigella flexneri 2a str. 2457T
auuugcuuguuucauuacucg

SEQ ID NO: 1909914 - RNA, 16 nt, Shigella flexneri 2a str. 2457T
auuuguagcuguugcu

SEQ ID NO: 1909915 - RNA, 22 nt, Shigella flexneri 2a str. 2457T
auuuguagcuguugcugaagaa

SEQ ID NO: 1909916 - RNA, 18 nt, Shigella flexneri 2a str. 2457T
auuuguuggcgaaaaucu

SEQ ID NO: 1909917 - RNA, 12 nt, Shigella flexneri 2a str. 2457T
auuuggaaagug

SEQ ID NO: 1909918 - RNA, 16 nt, Shigella flexneri 2a str. 2457T
auuugguggggcuugc

SEQ ID NO: 1909919 - RNA, 17 nt, Shigella flexneri 2a str. 2457T
auuuguaggccugauaa

SEQ ID NO: 1909920 - RNA, 18 nt, Shigella flexneri 2a str. 2457T
auuucugcgggggcggca

SEQ ID NO: 1909921 - RNA, 23 nt, Shigella flexneri 2a str. 2457T
auuucugcugccacuuucucacu

SEQ ID NO: 1909922 - RNA, 22 nt, Shigella flexneri 2a str. 2457T
auuucugaaggaauauucaggc

SEQ ID NO: 1909923 - RNA, 14 nt, Shigella flexneri 2a str. 2457T
auuucguccagcga

SEQ ID NO: 1909924 - RNA, 20 nt, Shigella flexneri 2a str. 2457T
auuucguccagcgaaccuuc

SEQ ID NO: 1909925 - RNA, 16 nt, Shigella flexneri 2a str. 2457T
auuucgucuucaucaa

SEQ ID NO: 1909926 - RNA, 17 nt, Shigella flexneri 2a str. 2457T
auuucugacugagcugg

SEQ ID NO: 1909927 - RNA, 18 nt, Shigella flexneri 2a str. 2457T
auuucugacugagcuggu

SEQ ID NO: 1909928 - RNA, 22 nt, Shigella flexneri 2a str. 2457T
auuuaacucaccgaugaucgcc

SEQ ID NO: 1909929 - RNA, 16 nt, Shigella flexneri 2a str. 2457T
auuuaagaaaaaagau

SEQ ID NO: 1909930 - RNA, 20 nt, Shigella flexneri 2a str. 2457T
auuuaaacaauuucagaaua

SEQ ID NO: 1909931 - RNA, 15 nt, Shigella flexneri 2a str. 2457T
auuuacaaaucuuua

SEQ ID NO: 1909932 - RNA, 21 nt, Shigella flexneri 2a str. 2457T
auuuaauggcgacauaaaaua

SEQ ID NO: 1909933 - RNA, 22 nt, Shigella flexneri 2a str. 2457T
auuuaauggcgacauaaaauaa

SEQ ID NO: 1909934 - RNA, 18 nt, Shigella flexneri 2a str. 2457T
auuuaagguuaugcaagu

SEQ ID NO: 1909935 - RNA, 19 nt, Shigella flexneri 2a str. 2457T
auuggucauuagugauuaa

SEQ ID NO: 1909936 - RNA, 23 nt, Shigella flexneri 2a str. 2457T
auuggcggcguccuggaacuggu

SEQ ID NO: 1909937 - RNA, 20 nt, Shigella flexneri 2a str. 2457T
auuuaaaaagaaaaaacuaa

SEQ ID NO: 1909938 - RNA, 11 nt, Shigella flexneri 2a str. 2457T
auuuaaaacca

SEQ ID NO: 1909939 - RNA, 20 nt, Shigella flexneri 2a str. 2457T
auuuaaaaccacuacccaua

SEQ ID NO: 1909940 - RNA, 12 nt, Shigella flexneri 2a str. 2457T
auuuaaaaagaa

SEQ ID NO: 1909941 - RNA, 13 nt, Shigella flexneri 2a str. 2457T
auuuaaaaagaaa

SEQ ID NO: 1909942 - RNA, 14 nt, Shigella flexneri 2a str. 2457T
auuuacuucugcug

SEQ ID NO: 1909943 - RNA, 20 nt, Shigella flexneri 2a str. 2457T
auuuacgccgcauccggcaa

SEQ ID NO: 1909944 - RNA, 16 nt, Shigella flexneri 2a str. 2457T
auuuacgguauaaccc

SEQ ID NO: 1909945 - RNA, 16 nt, Shigella flexneri 2a str. 2457T
auuuacgcuuuucuuc

SEQ ID NO: 1909946 - RNA, 18 nt, Shigella flexneri 2a str. 2457T
auuuacuauuauuuuuca

SEQ ID NO: 1909947 - RNA, 13 nt, Shigella flexneri 2a str. 2457T
auuuacuacguaa

SEQ ID NO: 1909948 - RNA, 15 nt, Shigella flexneri 2a str. 2457T
auuuacguucuuaca

SEQ ID NO: 1909949 - RNA, 19 nt, Shigella flexneri 2a str. 2457T
auuuacguuuuaaaccuac

SEQ ID NO: 1909950 - RNA, 17 nt, Shigella flexneri 2a str. 2457T
auuuaccagcauuuaag

SEQ ID NO: 1909951 - RNA, 20 nt, Shigella flexneri 2a str. 2457T
auuuaccagcauuuaagcau

SEQ ID NO: 1909952 - RNA, 20 nt, Shigella flexneri 2a str. 2457T
auuuaccggaaggauuaucc

SEQ ID NO: 1909953 - RNA, 16 nt, Shigella flexneri 2a str. 2457T
auuuacacaauuuugu

SEQ ID NO: 1909954 - RNA, 13 nt, Shigella flexneri 2a str. 2457T
auuuccguuugcg

SEQ ID NO: 1909955 - RNA, 21 nt, Shigella flexneri 2a str. 2457T
auuuccggcggcggaaaguau

SEQ ID NO: 1909956 - RNA, 23 nt, Shigella flexneri 2a str. 2457T
auuuccugacgucuggccucucu

SEQ ID NO: 1909957 - RNA, 22 nt, Shigella flexneri 2a str. 2457T
auuuccugccagaccuuaucac

SEQ ID NO: 1909958 - RNA, 17 nt, Shigella flexneri 2a str. 2457T
auuuccuucgcuuuaau

SEQ ID NO: 1909959 - RNA, 15 nt, Shigella flexneri 2a str. 2457T
auuuccuucagcagc

SEQ ID NO: 1909960 - RNA, 21 nt, Shigella flexneri 2a str. 2457T
auuuccuuccuuggauauuuu

SEQ ID NO: 1909961 - RNA, 13 nt, Shigella flexneri 2a str. 2457T
auuucgcagccau

SEQ ID NO: 1909962 - RNA, 12 nt, Shigella flexneri 2a str. 2457T
auuucgccgcac

SEQ ID NO: 1909963 - RNA, 15 nt, Shigella flexneri 2a str. 2457T
auuucgaauuuucca

SEQ ID NO: 1909964 - RNA, 20 nt, Shigella flexneri 2a str. 2457T
auuucgaagaaaccgaugac

SEQ ID NO: 1909965 - RNA, 13 nt, Shigella flexneri 2a str. 2457T
auuucccgcucau

SEQ ID NO: 1909966 - RNA, 15 nt, Shigella flexneri 2a str. 2457T
auuucccggccacgc

SEQ ID NO: 1909967 - RNA, 18 nt, Shigella flexneri 2a str. 2457T
auuuccgaaacgcaccuc

SEQ ID NO: 1909968 - RNA, 13 nt, Shigella flexneri 2a str. 2457T
auuucccugacaa

SEQ ID NO: 1909969 - RNA, 16 nt, Shigella flexneri 2a str. 2457T
auuucccugacaaauc

SEQ ID NO: 1909970 - RNA, 15 nt, Shigella flexneri 2a str. 2457T
auuuccgccaaucaa

SEQ ID NO: 1909971 - RNA, 23 nt, Shigella flexneri 2a str. 2457T
auuuccggauacgguuuuuugaa

SEQ ID NO: 1909972 - RNA, 16 nt, Shigella flexneri 2a str. 2457T
auuuccgcgaaacagg

SEQ ID NO: 1909973 - RNA, 23 nt, Shigella flexneri 2a str. 2457T
auuuccgcugauucaagauuagc

SEQ ID NO: 1909974 - RNA, 16 nt, Shigella flexneri 2a str. 2457T
auuuccgguacuggcu

SEQ ID NO: 1909975 - RNA, 23 nt, Shigella flexneri 2a str. 2457T
auuuccacgccaagcucauaacg

SEQ ID NO: 1909976 - RNA, 18 nt, Shigella flexneri 2a str. 2457T
auuuccagcucaaagaua

SEQ ID NO: 1909977 - RNA, 17 nt, Shigella flexneri 2a str. 2457T
auuuccagggccucucc

SEQ ID NO: 1909978 - RNA, 22 nt, Shigella flexneri 2a str. 2457T
auuuccagggccucuccuuuac

SEQ ID NO: 1909979 - RNA, 17 nt, Shigella flexneri 2a str. 2457T
auuuccaguuugcguuc

SEQ ID NO: 1909980 - RNA, 19 nt, Shigella flexneri 2a str. 2457T
auuuccaguccagcugccg

SEQ ID NO: 1909981 - RNA, 20 nt, Shigella flexneri 2a str. 2457T
auuuccaguccagcugccgu

SEQ ID NO: 1909982 - RNA, 15 nt, Shigella flexneri 2a str. 2457T
auuuccauuuuugac

SEQ ID NO: 1909983 - RNA, 22 nt, Shigella flexneri 2a str. 2457T
auuucccaccacuauuguugaa

SEQ ID NO: 1909984 - RNA, 19 nt, Shigella flexneri 2a str. 2457T
auuucccaacuguuugccg

SEQ ID NO: 1909985 - RNA, 22 nt, Shigella flexneri 2a str. 2457T
auuucccagcaagaaccaugca

SEQ ID NO: 1909986 - RNA, 16 nt, Shigella flexneri 2a str. 2457T
auuuccaucuccagcu

SEQ ID NO: 1909987 - RNA, 13 nt, Shigella flexneri 2a str. 2457T
auuuccaucucca

SEQ ID NO: 1909988 - RNA, 13 nt, Shigella flexneri 2a str. 2457T
auuuccaguuugc

SEQ ID NO: 1909989 - RNA, 15 nt, Shigella flexneri 2a str. 2457T
auuuccauaccuaaa

SEQ ID NO: 1909990 - RNA, 17 nt, Shigella flexneri 2a str. 2457T
auuuccauaccuaaaaa

SEQ ID NO: 1909991 - RNA, 20 nt, Shigella flexneri 2a str. 2457T
auuuccauugcucuggcaaa

SEQ ID NO: 1909992 - RNA, 21 nt, Shigella flexneri 2a str. 2457T
auuuccaucuccagcugcucg

SEQ ID NO: 1909993 - RNA, 17 nt, Shigella flexneri 2a str. 2457T
auuuccaccgcuauuga

SEQ ID NO: 1909994 - RNA, 22 nt, Shigella flexneri 2a str. 2457T
auuucauuaagaacuccugaaa

SEQ ID NO: 1909995 - RNA, 14 nt, Shigella flexneri 2a str. 2457T
auuucauuaauauc

SEQ ID NO: 1909996 - RNA, 15 nt, Shigella flexneri 2a str. 2457T
auuucacuucgccaa

SEQ ID NO: 1909997 - RNA, 21 nt, Shigella flexneri 2a str. 2457T
auuucacuugcuguaauuuca

SEQ ID NO: 1909998 - RNA, 20 nt, Shigella flexneri 2a str. 2457T
auuucaccgucaucgacaaa

SEQ ID NO: 1909999 - RNA, 15 nt, Shigella flexneri 2a str. 2457T
auuucaccagcgcac

SEQ ID NO: 1910000 - RNA, 13 nt, Shigella flexneri 2a str. 2457T
auuucaccaucuu

SEQ ID NO: 1910001 - RNA, 16 nt, Shigella flexneri 2a str. 2457T
auuucacaccaucaac

SEQ ID NO: 1910002 - RNA, 18 nt, Shigella flexneri 2a str. 2457T
auuucacaccaucaacaa

SEQ ID NO: 1910003 - RNA, 19 nt, Shigella flexneri 2a str. 2457T
auuuaugcgcuaaauguuu

SEQ ID NO: 1910004 - RNA, 17 nt, Shigella flexneri 2a str. 2457T
auuuaugggguggaacg

SEQ ID NO: 1910005 - RNA, 21 nt, Shigella flexneri 2a str. 2457T
auuuaucuuugauugaagaaa

SEQ ID NO: 1910006 - RNA, 18 nt, Shigella flexneri 2a str. 2457T
auuuauggugcuaguuau

SEQ ID NO: 1910007 - RNA, 22 nt, Shigella flexneri 2a str. 2457T
auuucaauggggugacagguuu

SEQ ID NO: 1910008 - RNA, 20 nt, Shigella flexneri 2a str. 2457T
auuuauguggauauuauuaa

SEQ ID NO: 1910009 - RNA, 14 nt, Shigella flexneri 2a str. 2457T
auuccguuucucca

SEQ ID NO: 1910010 - RNA, 14 nt, Shigella flexneri 2a str. 2457T
auuccuauuuuguu

SEQ ID NO: 1910011 - RNA, 20 nt, Shigella flexneri 2a str. 2457T
auuccuaugcaacaacugaa

SEQ ID NO: 1910012 - RNA, 21 nt, Shigella flexneri 2a str. 2457T
auuccucccguuaugaucagc

SEQ ID NO: 1910013 - RNA, 19 nt, Shigella flexneri 2a str. 2457T
auuccgggaauucgaagcu

SEQ ID NO: 1910014 - RNA, 23 nt, Shigella flexneri 2a str. 2457T
auuccgggaaacgaaccauaaaa

SEQ ID NO: 1910015 - RNA, 12 nt, Shigella flexneri 2a str. 2457T
auuccgaaucca

SEQ ID NO: 1910016 - RNA, 22 nt, Shigella flexneri 2a str. 2457T
auucccagucgcgcaauugcca

SEQ ID NO: 1910017 - RNA, 13 nt, Shigella flexneri 2a str. 2457T
auucccauuuauu

SEQ ID NO: 1910018 - RNA, 18 nt, Shigella flexneri 2a str. 2457T
auucccauuuauuuuucc

SEQ ID NO: 1910019 - RNA, 17 nt, Shigella flexneri 2a str. 2457T
auucccccuuugaccag

SEQ ID NO: 1910020 - RNA, 22 nt, Shigella flexneri 2a str. 2457T
auucccccuuugaccagccagu

SEQ ID NO: 1910021 - RNA, 24 nt, Shigella flexneri 2a str. 2457T
auucccugcagucaccugcccucc

SEQ ID NO: 1910022 - RNA, 15 nt, Shigella flexneri 2a str. 2457T
auucccuugcucugg

SEQ ID NO: 1910023 - RNA, 16 nt, Shigella flexneri 2a str. 2457T
auucccggaaauugcc

SEQ ID NO: 1910024 - RNA, 17 nt, Shigella flexneri 2a str. 2457T
auucccgggcacacuua

SEQ ID NO: 1910025 - RNA, 17 nt, Shigella flexneri 2a str. 2457T
auuccugacccagcacc

SEQ ID NO: 1910026 - RNA, 22 nt, Shigella flexneri 2a str. 2457T
auuccugcuuauuguauuucuu

SEQ ID NO: 1910027 - RNA, 18 nt, Shigella flexneri 2a str. 2457T
auuccuuucccuauuuuu

SEQ ID NO: 1910028 - RNA, 22 nt, Shigella flexneri 2a str. 2457T
auuccuuucccuauuuuuucgu

SEQ ID NO: 1910029 - RNA, 15 nt, Shigella flexneri 2a str. 2457T
auucgaaauagagaa

SEQ ID NO: 1910030 - RNA, 21 nt, Shigella flexneri 2a str. 2457T
auucgaaauagagaaaguaaa

SEQ ID NO: 1910031 - RNA, 23 nt, Shigella flexneri 2a str. 2457T
auucgaaugccgucgaggaacau

SEQ ID NO: 1910032 - RNA, 16 nt, Shigella flexneri 2a str. 2457T
auucgacgcgcgcaca

SEQ ID NO: 1910033 - RNA, 16 nt, Shigella flexneri 2a str. 2457T
auucgauucacauuua

SEQ ID NO: 1910034 - RNA, 20 nt, Shigella flexneri 2a str. 2457T
auucgaucaaacaauuuuca

SEQ ID NO: 1910035 - RNA, 12 nt, Shigella flexneri 2a str. 2457T
auucgccagcac

SEQ ID NO: 1910036 - RNA, 19 nt, Shigella flexneri 2a str. 2457T
auucgcuaacguuuuuaaa

SEQ ID NO: 1910037 - RNA, 20 nt, Shigella flexneri 2a str. 2457T
auucgcuaacguuuuuaaaa

SEQ ID NO: 1910038 - RNA, 20 nt, Shigella flexneri 2a str. 2457T
auucgcuccccugcaaauua

SEQ ID NO: 1910039 - RNA, 15 nt, Shigella flexneri 2a str. 2457T
auucgcgauauguac

SEQ ID NO: 1910040 - RNA, 23 nt, Shigella flexneri 2a str. 2457T
auucggguacugaugagacaaca

SEQ ID NO: 1910041 - RNA, 17 nt, Shigella flexneri 2a str. 2457T
auucggcuacuacggcg

SEQ ID NO: 1910042 - RNA, 14 nt, Shigella flexneri 2a str. 2457T
auucggcuccagau

SEQ ID NO: 1910043 - RNA, 16 nt, Shigella flexneri 2a str. 2457T
auucggcggcgugccu

SEQ ID NO: 1910044 - RNA, 16 nt, Shigella flexneri 2a str. 2457T
auucgcugcugcggcg

SEQ ID NO: 1910045 - RNA, 18 nt, Shigella flexneri 2a str. 2457T
auucgcuggauuuuugac

SEQ ID NO: 1910046 - RNA, 15 nt, Shigella flexneri 2a str. 2457T
auucauggugaauau

SEQ ID NO: 1910047 - RNA, 12 nt, Shigella flexneri 2a str. 2457T
auucaucaauuc

SEQ ID NO: 1910048 - RNA, 19 nt, Shigella flexneri 2a str. 2457T
auucaucgcccuuuuuuca

SEQ ID NO: 1910049 - RNA, 16 nt, Shigella flexneri 2a str. 2457T
auucaucgccuucuug

SEQ ID NO: 1910050 - RNA, 20 nt, Shigella flexneri 2a str. 2457T
auucauacagcggccagcca

SEQ ID NO: 1910051 - RNA, 21 nt, Shigella flexneri 2a str. 2457T
auucauacagcggccagccau

SEQ ID NO: 1910052 - RNA, 16 nt, Shigella flexneri 2a str. 2457T
auucauaaugcccagc

SEQ ID NO: 1910053 - RNA, 23 nt, Shigella flexneri 2a str. 2457T
auucaguucaacggugugagcac

SEQ ID NO: 1910054 - RNA, 17 nt, Shigella flexneri 2a str. 2457T
auucagugcaaaugcca

SEQ ID NO: 1910055 - RNA, 22 nt, Shigella flexneri 2a str. 2457T
auucagugcaaaugccagauaa

SEQ ID NO: 1910056 - RNA, 17 nt, Shigella flexneri 2a str. 2457T
auguucgccagauuuuu

SEQ ID NO: 1910057 - RNA, 13 nt, Shigella flexneri 2a str. 2457T
auguugccacacg

SEQ ID NO: 1910058 - RNA, 13 nt, Shigella flexneri 2a str. 2457T
auguugaaucuuc

SEQ ID NO: 1910059 - RNA, 14 nt, Shigella flexneri 2a str. 2457T
auuccacucauuaa

SEQ ID NO: 1910060 - RNA, 15 nt, Shigella flexneri 2a str. 2457T
auuccauuucccuga

SEQ ID NO: 1910061 - RNA, 21 nt, Shigella flexneri 2a str. 2457T
auuccauuucccugacaaauc

SEQ ID NO: 1910062 - RNA, 15 nt, Shigella flexneri 2a str. 2457T
auuccagugccgcau

SEQ ID NO: 1910063 - RNA, 22 nt, Shigella flexneri 2a str. 2457T
auuccauccugcucaaguaaua

SEQ ID NO: 1910064 - RNA, 22 nt, Shigella flexneri 2a str. 2457T
auucauuacuuaacgucaaacg

SEQ ID NO: 1910065 - RNA, 18 nt, Shigella flexneri 2a str. 2457T
auucauuugaauaguuaa

SEQ ID NO: 1910066 - RNA, 19 nt, Shigella flexneri 2a str. 2457T
auucauuuugcuggaaaag

SEQ ID NO: 1910067 - RNA, 16 nt, Shigella flexneri 2a str. 2457T
auugcagauaccacau

SEQ ID NO: 1910068 - RNA, 15 nt, Shigella flexneri 2a str. 2457T
auugauuuaucaggu

SEQ ID NO: 1910069 - RNA, 18 nt, Shigella flexneri 2a str. 2457T
auugauuuaacagcaaaa

SEQ ID NO: 1910070 - RNA, 16 nt, Shigella flexneri 2a str. 2457T
auugcaggaagguuuu

SEQ ID NO: 1910071 - RNA, 12 nt, Shigella flexneri 2a str. 2457T
auugcagcagcu

SEQ ID NO: 1910072 - RNA, 21 nt, Shigella flexneri 2a str. 2457T
auugcaggguuuuguuuaaau

SEQ ID NO: 1910073 - RNA, 22 nt, Shigella flexneri 2a str. 2457T
auugcaggguuuuguuuaaaua

SEQ ID NO: 1910074 - RNA, 19 nt, Shigella flexneri 2a str. 2457T
auugauucgaucaaacaau

SEQ ID NO: 1910075 - RNA, 21 nt, Shigella flexneri 2a str. 2457T
auugauucaucucuucuuccg

SEQ ID NO: 1910076 - RNA, 14 nt, Shigella flexneri 2a str. 2457T
auugaugugaaaac

SEQ ID NO: 1910077 - RNA, 15 nt, Shigella flexneri 2a str. 2457T
auugaugugaaaacu

SEQ ID NO: 1910078 - RNA, 17 nt, Shigella flexneri 2a str. 2457T
auugauuaaaggaaggu

SEQ ID NO: 1910079 - RNA, 22 nt, Shigella flexneri 2a str. 2457T
auugacaaagugcgcuuuguuu

SEQ ID NO: 1910080 - RNA, 22 nt, Shigella flexneri 2a str. 2457T
auugauaaccguacgcaucacc

SEQ ID NO: 1910081 - RNA, 22 nt, Shigella flexneri 2a str. 2457T
auugauaaucucccguuccugg

SEQ ID NO: 1910082 - RNA, 18 nt, Shigella flexneri 2a str. 2457T
auugauccgcgauaaguc

SEQ ID NO: 1910083 - RNA, 20 nt, Shigella flexneri 2a str. 2457T
auugaucuaccgcuucccuu

SEQ ID NO: 1910084 - RNA, 15 nt, Shigella flexneri 2a str. 2457T
auugaucucacaauc

SEQ ID NO: 1910085 - RNA, 16 nt, Shigella flexneri 2a str. 2457T
auugaucucacaauca

SEQ ID NO: 1910086 - RNA, 21 nt, Shigella flexneri 2a str. 2457T
auugcuuuuuuccauaagccc

SEQ ID NO: 1910087 - RNA, 22 nt, Shigella flexneri 2a str. 2457T
auugcugguacuuucacaggga

SEQ ID NO: 1910088 - RNA, 17 nt, Shigella flexneri 2a str. 2457T
auugcugaugcaccuuc

SEQ ID NO: 1910089 - RNA, 18 nt, Shigella flexneri 2a str. 2457T
auugcugcacauccggua

SEQ ID NO: 1910090 - RNA, 11 nt, Shigella flexneri 2a str. 2457T
auugcugccag

SEQ ID NO: 1910091 - RNA, 13 nt, Shigella flexneri 2a str. 2457T
auuggaauacaua

SEQ ID NO: 1910092 - RNA, 14 nt, Shigella flexneri 2a str. 2457T
auuggaauacauau

SEQ ID NO: 1910093 - RNA, 17 nt, Shigella flexneri 2a str. 2457T
auuggaauacauauauu

SEQ ID NO: 1910094 - RNA, 18 nt, Shigella flexneri 2a str. 2457T
auuggacgguaaaaagaa

SEQ ID NO: 1910095 - RNA, 24 nt, Shigella flexneri 2a str. 2457T
auuggcauccgugguggcagccag

SEQ ID NO: 1910096 - RNA, 18 nt, Shigella flexneri 2a str. 2457T
auugcgcagagaugccca

SEQ ID NO: 1910097 - RNA, 19 nt, Shigella flexneri 2a str. 2457T
auugcgcagagaugcccau

SEQ ID NO: 1910098 - RNA, 18 nt, Shigella flexneri 2a str. 2457T
auugccacuucguaacca

SEQ ID NO: 1910099 - RNA, 17 nt, Shigella flexneri 2a str. 2457T
auugccagagcccauca

SEQ ID NO: 1910100 - RNA, 13 nt, Shigella flexneri 2a str. 2457T
auugccagaugcg

SEQ ID NO: 1910101 - RNA, 22 nt, Shigella flexneri 2a str. 2457T
auugcgcuaaaaaguuccugua

SEQ ID NO: 1910102 - RNA, 21 nt, Shigella flexneri 2a str. 2457T
auugcggaacaucgccugccg

SEQ ID NO: 1910103 - RNA, 21 nt, Shigella flexneri 2a str. 2457T
auugcguccaggcccaggcau

SEQ ID NO: 1910104 - RNA, 12 nt, Shigella flexneri 2a str. 2457T
auugcugaaaua

SEQ ID NO: 1910105 - RNA, 15 nt, Shigella flexneri 2a str. 2457T
auugcgggccaggaa

SEQ ID NO: 1910106 - RNA, 16 nt, Shigella flexneri 2a str. 2457T
auugcguaaucuuuuc

SEQ ID NO: 1910107 - RNA, 22 nt, Shigella flexneri 2a str. 2457T
auucucagcugcaagaugaaua

SEQ ID NO: 1910108 - RNA, 17 nt, Shigella flexneri 2a str. 2457T
auucucaauaucaucau

SEQ ID NO: 1910109 - RNA, 16 nt, Shigella flexneri 2a str. 2457T
auucucacuccagcca

SEQ ID NO: 1910110 - RNA, 23 nt, Shigella flexneri 2a str. 2457T
auucucuuuucacgcaauaccug

SEQ ID NO: 1910111 - RNA, 22 nt, Shigella flexneri 2a str. 2457T
auucuccaaugccguucucugg

SEQ ID NO: 1910112 - RNA, 21 nt, Shigella flexneri 2a str. 2457T
auucguuuuucuucagcagcc

SEQ ID NO: 1910113 - RNA, 15 nt, Shigella flexneri 2a str. 2457T
auucguauuuaaaac

SEQ ID NO: 1910114 - RNA, 19 nt, Shigella flexneri 2a str. 2457T
auucgucguauagaucacu

SEQ ID NO: 1910115 - RNA, 20 nt, Shigella flexneri 2a str. 2457T
auucgucguauagaucacuu

SEQ ID NO: 1910116 - RNA, 15 nt, Shigella flexneri 2a str. 2457T
auugaagaauuuuug

SEQ ID NO: 1910117 - RNA, 19 nt, Shigella flexneri 2a str. 2457T
auucuugacgccauuuuuu

SEQ ID NO: 1910118 - RNA, 21 nt, Shigella flexneri 2a str. 2457T
auucuugacgccauuuuuuau

SEQ ID NO: 1910119 - RNA, 13 nt, Shigella flexneri 2a str. 2457T
auucugacugggu

SEQ ID NO: 1910120 - RNA, 16 nt, Shigella flexneri 2a str. 2457T
auucugagagcaugaa

SEQ ID NO: 1910121 - RNA, 21 nt, Shigella flexneri 2a str. 2457T
auucugagagcaugaaaugaa

SEQ ID NO: 1910122 - RNA, 14 nt, Shigella flexneri 2a str. 2457T
auucugauaugcag

SEQ ID NO: 1910123 - RNA, 17 nt, Shigella flexneri 2a str. 2457T
cacucgcccugaccugc

SEQ ID NO: 1910124 - RNA, 22 nt, Shigella flexneri 2a str. 2457T
cacucgcugcagguauugcuuc

SEQ ID NO: 1910125 - RNA, 19 nt, Shigella flexneri 2a str. 2457T
cacucggggcuuuucucua

SEQ ID NO: 1910126 - RNA, 20 nt, Shigella flexneri 2a str. 2457T
cacucuccaggaaacccggg

SEQ ID NO: 1910127 - RNA, 13 nt, Shigella flexneri 2a str. 2457T
cacucgcauccuc

SEQ ID NO: 1910128 - RNA, 16 nt, Shigella flexneri 2a str. 2457T
cacucccugccccauc

SEQ ID NO: 1910129 - RNA, 15 nt, Shigella flexneri 2a str. 2457T
cacugacgggaaacu

SEQ ID NO: 1910130 - RNA, 21 nt, Shigella flexneri 2a str. 2457T
cacugacgcccguuaaccgcu

SEQ ID NO: 1910131 - RNA, 20 nt, Shigella flexneri 2a str. 2457T
cacugacgcgucuuaucugg

SEQ ID NO: 1910132 - RNA, 18 nt, Shigella flexneri 2a str. 2457T
cacugacugccggaugca

SEQ ID NO: 1910133 - RNA, 20 nt, Shigella flexneri 2a str. 2457T
cacugacgaggcgucagcgu

SEQ ID NO: 1910134 - RNA, 20 nt, Shigella flexneri 2a str. 2457T
cacugaaccgaaauggcugc

SEQ ID NO: 1910135 - RNA, 17 nt, Shigella flexneri 2a str. 2457T
cacucugaaaacgcugu

SEQ ID NO: 1910136 - RNA, 12 nt, Shigella flexneri 2a str. 2457T
cacucuuucaau

SEQ ID NO: 1910137 - RNA, 16 nt, Shigella flexneri 2a str. 2457T
cacucuuuauugagau

SEQ ID NO: 1910138 - RNA, 15 nt, Shigella flexneri 2a str. 2457T
cacucuuucagcacc

SEQ ID NO: 1910139 - RNA, 16 nt, Shigella flexneri 2a str. 2457T
cacucaucacuccccg

SEQ ID NO: 1910140 - RNA, 16 nt, Shigella flexneri 2a str. 2457T
cacuccagccagagcc

SEQ ID NO: 1910141 - RNA, 22 nt, Shigella flexneri 2a str. 2457T
cacuccauccagcaacaacagc

SEQ ID NO: 1910142 - RNA, 18 nt, Shigella flexneri 2a str. 2457T
cacuauccgacaucccgc

SEQ ID NO: 1910143 - RNA, 20 nt, Shigella flexneri 2a str. 2457T
cacuauuucaauaugauaaa

SEQ ID NO: 1910144 - RNA, 14 nt, Shigella flexneri 2a str. 2457T
cacuagguuuucgu

SEQ ID NO: 1910145 - RNA, 23 nt, Shigella flexneri 2a str. 2457T
cacuagguuuucgucguacugac

SEQ ID NO: 1910146 - RNA, 17 nt, Shigella flexneri 2a str. 2457T
cacuaucgaaaguuuac

SEQ ID NO: 1910147 - RNA, 18 nt, Shigella flexneri 2a str. 2457T
cacuaucgccaucaggca

SEQ ID NO: 1910148 - RNA, 13 nt, Shigella flexneri 2a str. 2457T
cacuaugacugcc

SEQ ID NO: 1910149 - RNA, 15 nt, Shigella flexneri 2a str. 2457T
cacuacccauauuua

SEQ ID NO: 1910150 - RNA, 12 nt, Shigella flexneri 2a str. 2457T
cacuacacccca

SEQ ID NO: 1910151 - RNA, 22 nt, Shigella flexneri 2a str. 2457T
cacuaagaauguccauuauuuc

SEQ ID NO: 1910152 - RNA, 15 nt, Shigella flexneri 2a str. 2457T
cacuaacgcauugaa

SEQ ID NO: 1910153 - RNA, 20 nt, Shigella flexneri 2a str. 2457T
cacuaacgcauugaacucuu

SEQ ID NO: 1910154 - RNA, 18 nt, Shigella flexneri 2a str. 2457T
cacuaacgcgucuuaucu

SEQ ID NO: 1910155 - RNA, 18 nt, Shigella flexneri 2a str. 2457T
cacguuagaaacaaaaaa

SEQ ID NO: 1910156 - RNA, 22 nt, Shigella flexneri 2a str. 2457T
cacguuagaaacaaaaaaaccg

SEQ ID NO: 1910157 - RNA, 15 nt, Shigella flexneri 2a str. 2457T
cacgugccagauguu

SEQ ID NO: 1910158 - RNA, 20 nt, Shigella flexneri 2a str. 2457T
cacguugucagcaaccugcu

SEQ ID NO: 1910159 - RNA, 20 nt, Shigella flexneri 2a str. 2457T
cacguugcugcggcguuccc

SEQ ID NO: 1910160 - RNA, 16 nt, Shigella flexneri 2a str. 2457T
cacguugagagguaaa

SEQ ID NO: 1910161 - RNA, 13 nt, Shigella flexneri 2a str. 2457T
cacguucacccau

SEQ ID NO: 1910162 - RNA, 19 nt, Shigella flexneri 2a str. 2457T
cacguaccagaugcaucac

SEQ ID NO: 1910163 - RNA, 13 nt, Shigella flexneri 2a str. 2457T
cacguaccacggc

SEQ ID NO: 1910164 - RNA, 15 nt, Shigella flexneri 2a str. 2457T
cacguaccagaugca

SEQ ID NO: 1910165 - RNA, 13 nt, Shigella flexneri 2a str. 2457T
cacguaccagaug

SEQ ID NO: 1910166 - RNA, 16 nt, Shigella flexneri 2a str. 2457T
cacgguuuuuccagcu

SEQ ID NO: 1910167 - RNA, 13 nt, Shigella flexneri 2a str. 2457T
cacgucauccccc

SEQ ID NO: 1910168 - RNA, 22 nt, Shigella flexneri 2a str. 2457T
cacguccccuggggagugaccu

SEQ ID NO: 1910169 - RNA, 23 nt, Shigella flexneri 2a str. 2457T
cacggugaagaagcggaaaucac

SEQ ID NO: 1910170 - RNA, 21 nt, Shigella flexneri 2a str. 2457T
cacgggcaauuuucgccaucu

SEQ ID NO: 1910171 - RNA, 22 nt, Shigella flexneri 2a str. 2457T
cacgggccgagugccuugcuga

SEQ ID NO: 1910172 - RNA, 17 nt, Shigella flexneri 2a str. 2457T
cacgggcgcuuguuauc

SEQ ID NO: 1910173 - RNA, 13 nt, Shigella flexneri 2a str. 2457T
cacgauuuuguag

SEQ ID NO: 1910174 - RNA, 15 nt, Shigella flexneri 2a str. 2457T
cacgcaacagaccag

SEQ ID NO: 1910175 - RNA, 17 nt, Shigella flexneri 2a str. 2457T
cacgcaaacuucgguua

SEQ ID NO: 1910176 - RNA, 20 nt, Shigella flexneri 2a str. 2457T
cacgcaauuuauacugcgau

SEQ ID NO: 1910177 - RNA, 13 nt, Shigella flexneri 2a str. 2457T
cacgcaauaccag

SEQ ID NO: 1910178 - RNA, 20 nt, Shigella flexneri 2a str. 2457T
cacgcaauaccuggcgcagc

SEQ ID NO: 1910179 - RNA, 19 nt, Shigella flexneri 2a str. 2457T
cacgcaagguuucaguaac

SEQ ID NO: 1910180 - RNA, 21 nt, Shigella flexneri 2a str. 2457T
cacgcacaggugcaaaaaaac

SEQ ID NO: 1910181 - RNA, 12 nt, Shigella flexneri 2a str. 2457T
cacgcagcucac

SEQ ID NO: 1910182 - RNA, 12 nt, Shigella flexneri 2a str. 2457T
cacgauugcugc

SEQ ID NO: 1910183 - RNA, 14 nt, Shigella flexneri 2a str. 2457T
cacgaucucacgcu

SEQ ID NO: 1910184 - RNA, 18 nt, Shigella flexneri 2a str. 2457T
cacgaugacugaacaggc

SEQ ID NO: 1910185 - RNA, 14 nt, Shigella flexneri 2a str. 2457T
cacgaguguuacgc

SEQ ID NO: 1910186 - RNA, 19 nt, Shigella flexneri 2a str. 2457T
cacgaucgaugugauaaau

SEQ ID NO: 1910187 - RNA, 22 nt, Shigella flexneri 2a str. 2457T
cacgccauauguguuugugcug

SEQ ID NO: 1910188 - RNA, 12 nt, Shigella flexneri 2a str. 2457T
cacgccaucauc

SEQ ID NO: 1910189 - RNA, 17 nt, Shigella flexneri 2a str. 2457T
cacgcccagcucaaacg

SEQ ID NO: 1910190 - RNA, 14 nt, Shigella flexneri 2a str. 2457T
cacgcauuaauaag

SEQ ID NO: 1910191 - RNA, 12 nt, Shigella flexneri 2a str. 2457T
cacgccaacaaa

SEQ ID NO: 1910192 - RNA, 19 nt, Shigella flexneri 2a str. 2457T
cacgccaacaaacaguaca

SEQ ID NO: 1910193 - RNA, 22 nt, Shigella flexneri 2a str. 2457T
cacgccagacaucaccaguacc

SEQ ID NO: 1910194 - RNA, 21 nt, Shigella flexneri 2a str. 2457T
cacgccaauguguuuauaagc

SEQ ID NO: 1910195 - RNA, 18 nt, Shigella flexneri 2a str. 2457T
cacgccgguucccagacc

SEQ ID NO: 1910196 - RNA, 17 nt, Shigella flexneri 2a str. 2457T
cacgccgguucccagac

SEQ ID NO: 1910197 - RNA, 20 nt, Shigella flexneri 2a str. 2457T
cacgccgcugucuaccagca

SEQ ID NO: 1910198 - RNA, 24 nt, Shigella flexneri 2a str. 2457T
cacgccgcugucuaccagcaccug

SEQ ID NO: 1910199 - RNA, 20 nt, Shigella flexneri 2a str. 2457T
cacgccgaagugcgcgcagc

SEQ ID NO: 1910200 - RNA, 21 nt, Shigella flexneri 2a str. 2457T
cacgccgcauccggcaaaaaa

SEQ ID NO: 1910201 - RNA, 21 nt, Shigella flexneri 2a str. 2457T
cacgccgcauccggcagccgu

SEQ ID NO: 1910202 - RNA, 22 nt, Shigella flexneri 2a str. 2457T
cacgccgauaaucaacaaacca

SEQ ID NO: 1910203 - RNA, 14 nt, Shigella flexneri 2a str. 2457T
cacgcucuguucug

SEQ ID NO: 1910204 - RNA, 17 nt, Shigella flexneri 2a str. 2457T
cacgcucuguucugcgc

SEQ ID NO: 1910205 - RNA, 13 nt, Shigella flexneri 2a str. 2457T
cacgcugccccug

SEQ ID NO: 1910206 - RNA, 22 nt, Shigella flexneri 2a str. 2457T
cacgcucacucaucacuccccg

SEQ ID NO: 1910207 - RNA, 16 nt, Shigella flexneri 2a str. 2457T
cacgcucacucaucac

SEQ ID NO: 1910208 - RNA, 19 nt, Shigella flexneri 2a str. 2457T
cacgcucgcgguuggcaau

SEQ ID NO: 1910209 - RNA, 22 nt, Shigella flexneri 2a str. 2457T
cacgcgaacaacagaucaacau

SEQ ID NO: 1910210 - RNA, 15 nt, Shigella flexneri 2a str. 2457T
cacgccuucuccggc

SEQ ID NO: 1910211 - RNA, 23 nt, Shigella flexneri 2a str. 2457T
cacgccuugcggaaauuccagcg

SEQ ID NO: 1910212 - RNA, 13 nt, Shigella flexneri 2a str. 2457T
cacgccugccgcc

SEQ ID NO: 1910213 - RNA, 23 nt, Shigella flexneri 2a str. 2457T
cacgccguuuuuacccagcagca

SEQ ID NO: 1910214 - RNA, 19 nt, Shigella flexneri 2a str. 2457T
cacgccuccuggcucagcg

SEQ ID NO: 1910215 - RNA, 13 nt, Shigella flexneri 2a str. 2457T
cacgccuccuggc

SEQ ID NO: 1910216 - RNA, 13 nt, Shigella flexneri 2a str. 2457T
cacgcgcuucaca

SEQ ID NO: 1910217 - RNA, 14 nt, Shigella flexneri 2a str. 2457T
cacgcgcuccagga

SEQ ID NO: 1910218 - RNA, 17 nt, Shigella flexneri 2a str. 2457T
cacggagauauccagcg

SEQ ID NO: 1910219 - RNA, 19 nt, Shigella flexneri 2a str. 2457T
cacggaguugaccagcucc

SEQ ID NO: 1910220 - RNA, 18 nt, Shigella flexneri 2a str. 2457T
cacggaaucaccgccacg

SEQ ID NO: 1910221 - RNA, 17 nt, Shigella flexneri 2a str. 2457T
cacggaaagcagcauac

SEQ ID NO: 1910222 - RNA, 18 nt, Shigella flexneri 2a str. 2457T
cacggaaaggcaacauga

SEQ ID NO: 1910223 - RNA, 15 nt, Shigella flexneri 2a str. 2457T
cacgcuuaacaaccc

SEQ ID NO: 1910224 - RNA, 20 nt, Shigella flexneri 2a str. 2457T
cacggaucaggcggcucacc

SEQ ID NO: 1910225 - RNA, 15 nt, Shigella flexneri 2a str. 2457T
cacggcauaagccgu

SEQ ID NO: 1910226 - RNA, 15 nt, Shigella flexneri 2a str. 2457T
cacggccacagccag

SEQ ID NO: 1910227 - RNA, 16 nt, Shigella flexneri 2a str. 2457T
cacggcgcaugccuca

SEQ ID NO: 1910228 - RNA, 17 nt, Shigella flexneri 2a str. 2457T
cacggcgcagcuucaca

SEQ ID NO: 1910229 - RNA, 20 nt, Shigella flexneri 2a str. 2457T
cacggccacagccagccaac

SEQ ID NO: 1910230 - RNA, 15 nt, Shigella flexneri 2a str. 2457T
cacggcuccagcaau

SEQ ID NO: 1910231 - RNA, 18 nt, Shigella flexneri 2a str. 2457T
cacggcuaccguugcggc

SEQ ID NO: 1910232 - RNA, 15 nt, Shigella flexneri 2a str. 2457T
cacggcguggcauca

SEQ ID NO: 1910233 - RNA, 22 nt, Shigella flexneri 2a str. 2457T
cacccgccgcuauuauaucgcu

SEQ ID NO: 1910234 - RNA, 14 nt, Shigella flexneri 2a str. 2457T
cacccggaucucag

SEQ ID NO: 1910235 - RNA, 21 nt, Shigella flexneri 2a str. 2457T
cacccgguaucaaacccuucc

SEQ ID NO: 1910236 - RNA, 20 nt, Shigella flexneri 2a str. 2457T
cacccguaacauggcgguaa

SEQ ID NO: 1910237 - RNA, 15 nt, Shigella flexneri 2a str. 2457T
cacccuugaugcaga

SEQ ID NO: 1910238 - RNA, 23 nt, Shigella flexneri 2a str. 2457T
cacccugcccguuucucuuaaau

SEQ ID NO: 1910239 - RNA, 19 nt, Shigella flexneri 2a str. 2457T
cacccuaacccucucccca

SEQ ID NO: 1910240 - RNA, 15 nt, Shigella flexneri 2a str. 2457T
cacccgucguugcaa

SEQ ID NO: 1910241 - RNA, 22 nt, Shigella flexneri 2a str. 2457T
cacccguacagggugagggcaa

SEQ ID NO: 1910242 - RNA, 17 nt, Shigella flexneri 2a str. 2457T
caccgccacgcccuccu

SEQ ID NO: 1910243 - RNA, 13 nt, Shigella flexneri 2a str. 2457T
caccgccaccacc

SEQ ID NO: 1910244 - RNA, 18 nt, Shigella flexneri 2a str. 2457T
caccgauuuuguaaaaga

SEQ ID NO: 1910245 - RNA, 20 nt, Shigella flexneri 2a str. 2457T
caccgauuuuguaaaagaag

SEQ ID NO: 1910246 - RNA, 15 nt, Shigella flexneri 2a str. 2457T
caccgauugcaggaa

SEQ ID NO: 1910247 - RNA, 22 nt, Shigella flexneri 2a str. 2457T
caccgauuuuguaaaagaaggc

SEQ ID NO: 1910248 - RNA, 16 nt, Shigella flexneri 2a str. 2457T
caccgaugcacagcac

SEQ ID NO: 1910249 - RNA, 14 nt, Shigella flexneri 2a str. 2457T
caccgcaaacugcc

SEQ ID NO: 1910250 - RNA, 21 nt, Shigella flexneri 2a str. 2457T
caccgaugaucaacagcauca

SEQ ID NO: 1910251 - RNA, 17 nt, Shigella flexneri 2a str. 2457T
caccgcacagaccauca

SEQ ID NO: 1910252 - RNA, 13 nt, Shigella flexneri 2a str. 2457T
caccgcaccgccc

SEQ ID NO: 1910253 - RNA, 17 nt, Shigella flexneri 2a str. 2457T
caccgcaauaaccauca

SEQ ID NO: 1910254 - RNA, 15 nt, Shigella flexneri 2a str. 2457T
caccgcaaucgccag

SEQ ID NO: 1910255 - RNA, 15 nt, Shigella flexneri 2a str. 2457T
caccgcagccgccac

SEQ ID NO: 1910256 - RNA, 19 nt, Shigella flexneri 2a str. 2457T
caccgcagccgccacaaua

SEQ ID NO: 1910257 - RNA, 16 nt, Shigella flexneri 2a str. 2457T
caccgagcagcacaau

SEQ ID NO: 1910258 - RNA, 14 nt, Shigella flexneri 2a str. 2457T
caccgaguucuuca

SEQ ID NO: 1910259 - RNA, 17 nt, Shigella flexneri 2a str. 2457T
caccgaggccaaaacca

SEQ ID NO: 1910260 - RNA, 14 nt, Shigella flexneri 2a str. 2457T
caccgacgcaguca

SEQ ID NO: 1910261 - RNA, 15 nt, Shigella flexneri 2a str. 2457T
caccgaccaucggca

SEQ ID NO: 1910262 - RNA, 19 nt, Shigella flexneri 2a str. 2457T
caccggauaauuccggcuu

SEQ ID NO: 1910263 - RNA, 13 nt, Shigella flexneri 2a str. 2457T
caccggacgcaca

SEQ ID NO: 1910264 - RNA, 18 nt, Shigella flexneri 2a str. 2457T
caccggacuauccgccgc

SEQ ID NO: 1910265 - RNA, 16 nt, Shigella flexneri 2a str. 2457T
caccggcaaucugcug

SEQ ID NO: 1910266 - RNA, 14 nt, Shigella flexneri 2a str. 2457T
caccggcaccacuu

SEQ ID NO: 1910267 - RNA, 13 nt, Shigella flexneri 2a str. 2457T
caccggcaccacu

SEQ ID NO: 1910268 - RNA, 13 nt, Shigella flexneri 2a str. 2457T
caccgcuccaucg

SEQ ID NO: 1910269 - RNA, 13 nt, Shigella flexneri 2a str. 2457T
caccggaccagac

SEQ ID NO: 1910270 - RNA, 20 nt, Shigella flexneri 2a str. 2457T
caccggaaccgucgcgccag

SEQ ID NO: 1910271 - RNA, 15 nt, Shigella flexneri 2a str. 2457T
caccgggccgaugcg

SEQ ID NO: 1910272 - RNA, 20 nt, Shigella flexneri 2a str. 2457T
caccgcccuccgguccgccg

SEQ ID NO: 1910273 - RNA, 15 nt, Shigella flexneri 2a str. 2457T
caccgccgccgccac

SEQ ID NO: 1910274 - RNA, 14 nt, Shigella flexneri 2a str. 2457T
caccgccgccgcca

SEQ ID NO: 1910275 - RNA, 14 nt, Shigella flexneri 2a str. 2457T
caccgcccagagaa

SEQ ID NO: 1910276 - RNA, 15 nt, Shigella flexneri 2a str. 2457T
caccgccggauagcu

SEQ ID NO: 1910277 - RNA, 15 nt, Shigella flexneri 2a str. 2457T
caccgcgaucuucca

SEQ ID NO: 1910278 - RNA, 19 nt, Shigella flexneri 2a str. 2457T
caccgcgaucuuccacgcc

SEQ ID NO: 1910279 - RNA, 18 nt, Shigella flexneri 2a str. 2457T
caccgcgaggccuaacac

SEQ ID NO: 1910280 - RNA, 17 nt, Shigella flexneri 2a str. 2457T
caccuggggcuugccag

SEQ ID NO: 1910281 - RNA, 16 nt, Shigella flexneri 2a str. 2457T
caccuguaccagcccg

SEQ ID NO: 1910282 - RNA, 23 nt, Shigella flexneri 2a str. 2457T
caccuguaguguguugcaauaca

SEQ ID NO: 1910283 - RNA, 18 nt, Shigella flexneri 2a str. 2457T
caccuuacggcacuccuc

SEQ ID NO: 1910284 - RNA, 23 nt, Shigella flexneri 2a str. 2457T
caccuguugccauuucugcugcc

SEQ ID NO: 1910285 - RNA, 17 nt, Shigella flexneri 2a str. 2457T
caccuguuccaugacgu

SEQ ID NO: 1910286 - RNA, 21 nt, Shigella flexneri 2a str. 2457T
caccuggcgcauuaacggcaa

SEQ ID NO: 1910287 - RNA, 22 nt, Shigella flexneri 2a str. 2457T
caccugcucgucauccgccagu

SEQ ID NO: 1910288 - RNA, 20 nt, Shigella flexneri 2a str. 2457T
caccugcggugcagccggag

SEQ ID NO: 1910289 - RNA, 20 nt, Shigella flexneri 2a str. 2457T
caccugcgcaggcauucaga

SEQ ID NO: 1910290 - RNA, 20 nt, Shigella flexneri 2a str. 2457T
caccuuacggcacuccucuu

SEQ ID NO: 1910291 - RNA, 20 nt, Shigella flexneri 2a str. 2457T
caccuucaaguaauucauuc

SEQ ID NO: 1910292 - RNA, 15 nt, Shigella flexneri 2a str. 2457T
caccuucauccagca

SEQ ID NO: 1910293 - RNA, 20 nt, Shigella flexneri 2a str. 2457T
caccuucuuuacugcccgcu

SEQ ID NO: 1910294 - RNA, 16 nt, Shigella flexneri 2a str. 2457T
caccuucuguaacugg

SEQ ID NO: 1910295 - RNA, 17 nt, Shigella flexneri 2a str. 2457T
caccuucuuuacugccc

SEQ ID NO: 1910296 - RNA, 19 nt, Shigella flexneri 2a str. 2457T
caccuuucacgccgaagug

SEQ ID NO: 1910297 - RNA, 15 nt, Shigella flexneri 2a str. 2457T
cacgaauucaacgcg

SEQ ID NO: 1910298 - RNA, 16 nt, Shigella flexneri 2a str. 2457T
cacgaauuccaagcag

SEQ ID NO: 1910299 - RNA, 13 nt, Shigella flexneri 2a str. 2457T
cacgaagcauugc

SEQ ID NO: 1910300 - RNA, 19 nt, Shigella flexneri 2a str. 2457T
cacgacaaaugcgccgcca

SEQ ID NO: 1910301 - RNA, 18 nt, Shigella flexneri 2a str. 2457T
cacgacagaacucguuca

SEQ ID NO: 1910302 - RNA, 12 nt, Shigella flexneri 2a str. 2457T
cacgacacugcu

SEQ ID NO: 1910303 - RNA, 21 nt, Shigella flexneri 2a str. 2457T
cacgacauaaacauuccacuu

SEQ ID NO: 1910304 - RNA, 19 nt, Shigella flexneri 2a str. 2457T
cacgaaccguaaaagccug

SEQ ID NO: 1910305 - RNA, 21 nt, Shigella flexneri 2a str. 2457T
cacgaaccgucccucgccccu

SEQ ID NO: 1910306 - RNA, 16 nt, Shigella flexneri 2a str. 2457T
cacgaaccagagacag

SEQ ID NO: 1910307 - RNA, 14 nt, Shigella flexneri 2a str. 2457T
cacgaaacugcugg

SEQ ID NO: 1910308 - RNA, 13 nt, Shigella flexneri 2a str. 2457T
cacgaccgcagca

SEQ ID NO: 1910309 - RNA, 20 nt, Shigella flexneri 2a str. 2457T
cacgaccuguaccuucagcg

SEQ ID NO: 1910310 - RNA, 21 nt, Shigella flexneri 2a str. 2457T
cacgaccuguaccuucagcgg

SEQ ID NO: 1910311 - RNA, 18 nt, Shigella flexneri 2a str. 2457T
cacgacaaaugcgccgcc

SEQ ID NO: 1910312 - RNA, 16 nt, Shigella flexneri 2a str. 2457T
cacgaccuacgcgccc

SEQ ID NO: 1910313 - RNA, 23 nt, Shigella flexneri 2a str. 2457T
cacgaggcuggcuuuaucacuga

SEQ ID NO: 1910314 - RNA, 15 nt, Shigella flexneri 2a str. 2457T
cacgaggaagauuac

SEQ ID NO: 1910315 - RNA, 21 nt, Shigella flexneri 2a str. 2457T
cacgaggaagauuacgcugca

SEQ ID NO: 1910316 - RNA, 15 nt, Shigella flexneri 2a str. 2457T
caccucccagcgcgg

SEQ ID NO: 1910317 - RNA, 20 nt, Shigella flexneri 2a str. 2457T
caccucaucaccacagacaa

SEQ ID NO: 1910318 - RNA, 21 nt, Shigella flexneri 2a str. 2457T
caccucaucaccacagacaaa

SEQ ID NO: 1910319 - RNA, 19 nt, Shigella flexneri 2a str. 2457T
caccucugucgaugcgcuc

SEQ ID NO: 1910320 - RNA, 15 nt, Shigella flexneri 2a str. 2457T
caccucucgcccgcu

SEQ ID NO: 1910321 - RNA, 15 nt, Shigella flexneri 2a str. 2457T
caccucuuucaccaa

SEQ ID NO: 1910322 - RNA, 23 nt, Shigella flexneri 2a str. 2457T
caccucuuuuuccacuuccacca

SEQ ID NO: 1910323 - RNA, 19 nt, Shigella flexneri 2a str. 2457T
caccugaaauggucgcccc

SEQ ID NO: 1910324 - RNA, 20 nt, Shigella flexneri 2a str. 2457T
caccugaaauggucgccccg

SEQ ID NO: 1910325 - RNA, 14 nt, Shigella flexneri 2a str. 2457T
caccugagcuggca

SEQ ID NO: 1910326 - RNA, 20 nt, Shigella flexneri 2a str. 2457T
caccugcacaccaaccgcuu

SEQ ID NO: 1910327 - RNA, 14 nt, Shigella flexneri 2a str. 2457T
caccugcacaugca

SEQ ID NO: 1910328 - RNA, 19 nt, Shigella flexneri 2a str. 2457T
caccugauugaccgccagc

SEQ ID NO: 1910329 - RNA, 19 nt, Shigella flexneri 2a str. 2457T
caccugauccagcucuucu

SEQ ID NO: 1910330 - RNA, 14 nt, Shigella flexneri 2a str. 2457T
caccugccagcgcc

SEQ ID NO: 1910331 - RNA, 13 nt, Shigella flexneri 2a str. 2457T
caccugccaggga

SEQ ID NO: 1910332 - RNA, 20 nt, Shigella flexneri 2a str. 2457T
caccgugcauuucucacuuu

SEQ ID NO: 1910333 - RNA, 15 nt, Shigella flexneri 2a str. 2457T
caccguuaaauaacu

SEQ ID NO: 1910334 - RNA, 14 nt, Shigella flexneri 2a str. 2457T
caccguuauccuga

SEQ ID NO: 1910335 - RNA, 17 nt, Shigella flexneri 2a str. 2457T
caccguuucuacaagca

SEQ ID NO: 1910336 - RNA, 21 nt, Shigella flexneri 2a str. 2457T
caccguuucuacaagcagaga

SEQ ID NO: 1910337 - RNA, 20 nt, Shigella flexneri 2a str. 2457T
caccguuucuuugccgagga

SEQ ID NO: 1910338 - RNA, 23 nt, Shigella flexneri 2a str. 2457T
caccguuucuacaagcagagaga

SEQ ID NO: 1910339 - RNA, 21 nt, Shigella flexneri 2a str. 2457T
caccguuuuugccgaugucuc

SEQ ID NO: 1910340 - RNA, 12 nt, Shigella flexneri 2a str. 2457T
caccuacagcca

SEQ ID NO: 1910341 - RNA, 17 nt, Shigella flexneri 2a str. 2457T
caccgucaaacacagca

SEQ ID NO: 1910342 - RNA, 18 nt, Shigella flexneri 2a str. 2457T
caccgucaaacacagcac

SEQ ID NO: 1910343 - RNA, 22 nt, Shigella flexneri 2a str. 2457T
caccgucaucgacaaaaacccu

SEQ ID NO: 1910344 - RNA, 15 nt, Shigella flexneri 2a str. 2457T
caccgucacuucuuc

SEQ ID NO: 1910345 - RNA, 16 nt, Shigella flexneri 2a str. 2457T
caccgucacuucuucg

SEQ ID NO: 1910346 - RNA, 18 nt, Shigella flexneri 2a str. 2457T
caccguaccaucguaagc

SEQ ID NO: 1910347 - RNA, 17 nt, Shigella flexneri 2a str. 2457T
caccguauugcgccggu

SEQ ID NO: 1910348 - RNA, 18 nt, Shigella flexneri 2a str. 2457T
caccguaauaguuucuga

SEQ ID NO: 1910349 - RNA, 20 nt, Shigella flexneri 2a str. 2457T
caccaggaacgcgccaagau

SEQ ID NO: 1910350 - RNA, 14 nt, Shigella flexneri 2a str. 2457T
caccagggaaauaa

SEQ ID NO: 1910351 - RNA, 23 nt, Shigella flexneri 2a str. 2457T
caccaggcguucauaucuacacg

SEQ ID NO: 1910352 - RNA, 21 nt, Shigella flexneri 2a str. 2457T
caccauaaaucagaucgacgc

SEQ ID NO: 1910353 - RNA, 15 nt, Shigella flexneri 2a str. 2457T
caccaguucgcgcag

SEQ ID NO: 1910354 - RNA, 12 nt, Shigella flexneri 2a str. 2457T
caccaucacuuu

SEQ ID NO: 1910355 - RNA, 19 nt, Shigella flexneri 2a str. 2457T
caccaucaacaaacgccag

SEQ ID NO: 1910356 - RNA, 16 nt, Shigella flexneri 2a str. 2457T
caccaguaacaggauc

SEQ ID NO: 1910357 - RNA, 20 nt, Shigella flexneri 2a str. 2457T
caccaguaaggcaucuucuu

SEQ ID NO: 1910358 - RNA, 20 nt, Shigella flexneri 2a str. 2457T
caccaguucacccucauuca

SEQ ID NO: 1910359 - RNA, 22 nt, Shigella flexneri 2a str. 2457T
caccagugccauuaacaggcca

SEQ ID NO: 1910360 - RNA, 17 nt, Shigella flexneri 2a str. 2457T
caccagugcggauacca

SEQ ID NO: 1910361 - RNA, 17 nt, Shigella flexneri 2a str. 2457T
caccagcuccggcaccu

SEQ ID NO: 1910362 - RNA, 17 nt, Shigella flexneri 2a str. 2457T
caccagcgucagaaaca

SEQ ID NO: 1910363 - RNA, 21 nt, Shigella flexneri 2a str. 2457T
caccagcgucagaaacaguug

SEQ ID NO: 1910364 - RNA, 13 nt, Shigella flexneri 2a str. 2457T
caccagccugcaa

SEQ ID NO: 1910365 - RNA, 23 nt, Shigella flexneri 2a str. 2457T
caccagcgaaaguaacaccaucc

SEQ ID NO: 1910366 - RNA, 20 nt, Shigella flexneri 2a str. 2457T
caccagcgaaaucaccgcca

SEQ ID NO: 1910367 - RNA, 19 nt, Shigella flexneri 2a str. 2457T
caccagcgauguaacccac

SEQ ID NO: 1910368 - RNA, 20 nt, Shigella flexneri 2a str. 2457T
caccagcgcaauauguuucc

SEQ ID NO: 1910369 - RNA, 21 nt, Shigella flexneri 2a str. 2457T
caccagcaauaaugccagucc

SEQ ID NO: 1910370 - RNA, 16 nt, Shigella flexneri 2a str. 2457T
caccagcaaauccagc

SEQ ID NO: 1910371 - RNA, 22 nt, Shigella flexneri 2a str. 2457T
caccagcacaucaucaaagcca

SEQ ID NO: 1910372 - RNA, 16 nt, Shigella flexneri 2a str. 2457T
caccagccgaucauug

SEQ ID NO: 1910373 - RNA, 22 nt, Shigella flexneri 2a str. 2457T
caccagcaguaaaccacccacc

SEQ ID NO: 1910374 - RNA, 20 nt, Shigella flexneri 2a str. 2457T
caccccgcgccgcugagaaa

SEQ ID NO: 1910375 - RNA, 14 nt, Shigella flexneri 2a str. 2457T
cacccgcagugauu

SEQ ID NO: 1910376 - RNA, 24 nt, Shigella flexneri 2a str. 2457T
cacccgcauaugcggugcggagua

SEQ ID NO: 1910377 - RNA, 21 nt, Shigella flexneri 2a str. 2457T
cacccgcaagacgaaccggca

SEQ ID NO: 1910378 - RNA, 15 nt, Shigella flexneri 2a str. 2457T
cacccagcagcgccg

SEQ ID NO: 1910379 - RNA, 16 nt, Shigella flexneri 2a str. 2457T
cacccauugccgccuc

SEQ ID NO: 1910380 - RNA, 15 nt, Shigella flexneri 2a str. 2457T
cacccauagcuucaa

SEQ ID NO: 1910381 - RNA, 20 nt, Shigella flexneri 2a str. 2457T
cacccauguuuaauucacgc

SEQ ID NO: 1910382 - RNA, 19 nt, Shigella flexneri 2a str. 2457T
cacccauuuauccagcggc

SEQ ID NO: 1910383 - RNA, 22 nt, Shigella flexneri 2a str. 2457T
cacccauuuauccagcggcagc

SEQ ID NO: 1910384 - RNA, 11 nt, Shigella flexneri 2a str. 2457T
caccccagcag

SEQ ID NO: 1910385 - RNA, 16 nt, Shigella flexneri 2a str. 2457T
caccccagacuucccc

SEQ ID NO: 1910386 - RNA, 11 nt, Shigella flexneri 2a str. 2457T
cacccccaccc

SEQ ID NO: 1910387 - RNA, 19 nt, Shigella flexneri 2a str. 2457T
cacccacguuaguguggcc

SEQ ID NO: 1910388 - RNA, 22 nt, Shigella flexneri 2a str. 2457T
cacccacggcguuaacuguaca

SEQ ID NO: 1910389 - RNA, 14 nt, Shigella flexneri 2a str. 2457T
caccauugcugccg

SEQ ID NO: 1910390 - RNA, 18 nt, Shigella flexneri 2a str. 2457T
cacccaacacucaaacag

SEQ ID NO: 1910391 - RNA, 16 nt, Shigella flexneri 2a str. 2457T
caccauguucacugcc

SEQ ID NO: 1910392 - RNA, 17 nt, Shigella flexneri 2a str. 2457T
caccauuacgcaaugcg

SEQ ID NO: 1910393 - RNA, 14 nt, Shigella flexneri 2a str. 2457T
caccaucuuccuca

SEQ ID NO: 1910394 - RNA, 15 nt, Shigella flexneri 2a str. 2457T
caccaugccgauggc

SEQ ID NO: 1910395 - RNA, 11 nt, Shigella flexneri 2a str. 2457T
caccaccauca

SEQ ID NO: 1910396 - RNA, 12 nt, Shigella flexneri 2a str. 2457T
caccacccagcg

SEQ ID NO: 1910397 - RNA, 20 nt, Shigella flexneri 2a str. 2457T
caccaccgcaguaaucggcg

SEQ ID NO: 1910398 - RNA, 22 nt, Shigella flexneri 2a str. 2457T
caccaccgacggacccgccggc

SEQ ID NO: 1910399 - RNA, 24 nt, Shigella flexneri 2a str. 2457T
caccaccgacggacccgccggcgu

SEQ ID NO: 1910400 - RNA, 12 nt, Shigella flexneri 2a str. 2457T
caccaccaaaaa

SEQ ID NO: 1910401 - RNA, 11 nt, Shigella flexneri 2a str. 2457T
caccacauucu

SEQ ID NO: 1910402 - RNA, 15 nt, Shigella flexneri 2a str. 2457T
caccaccagcagcug

SEQ ID NO: 1910403 - RNA, 21 nt, Shigella flexneri 2a str. 2457T
caccacagacaaacagcucga

SEQ ID NO: 1910404 - RNA, 19 nt, Shigella flexneri 2a str. 2457T
caccacagacaaucgccag

SEQ ID NO: 1910405 - RNA, 18 nt, Shigella flexneri 2a str. 2457T
caccaauggcuggccugg

SEQ ID NO: 1910406 - RNA, 11 nt, Shigella flexneri 2a str. 2457T
caccagaauac

SEQ ID NO: 1910407 - RNA, 19 nt, Shigella flexneri 2a str. 2457T
caccacuuuuuucaccgag

SEQ ID NO: 1910408 - RNA, 18 nt, Shigella flexneri 2a str. 2457T
caccagaaacaauaagua

SEQ ID NO: 1910409 - RNA, 14 nt, Shigella flexneri 2a str. 2457T
caccagagaacuga

SEQ ID NO: 1910410 - RNA, 17 nt, Shigella flexneri 2a str. 2457T
caccagaaucgccagca

SEQ ID NO: 1910411 - RNA, 16 nt, Shigella flexneri 2a str. 2457T
caccagauaaugagaa

SEQ ID NO: 1910412 - RNA, 14 nt, Shigella flexneri 2a str. 2457T
caccagauggcuuu

SEQ ID NO: 1910413 - RNA, 19 nt, Shigella flexneri 2a str. 2457T
caccagaugucccaucuga

SEQ ID NO: 1910414 - RNA, 19 nt, Shigella flexneri 2a str. 2457T
caccagauuauaagccagu

SEQ ID NO: 1910415 - RNA, 13 nt, Shigella flexneri 2a str. 2457T
caccagcaaauau

SEQ ID NO: 1910416 - RNA, 16 nt, Shigella flexneri 2a str. 2457T
caccagcaacaagcca

SEQ ID NO: 1910417 - RNA, 20 nt, Shigella flexneri 2a str. 2457T
caccagcaacaagccagucc

SEQ ID NO: 1910418 - RNA, 22 nt, Shigella flexneri 2a str. 2457T
caccacgacaccuuucacgccg

SEQ ID NO: 1910419 - RNA, 17 nt, Shigella flexneri 2a str. 2457T
caccacgaccacgaacg

SEQ ID NO: 1910420 - RNA, 16 nt, Shigella flexneri 2a str. 2457T
caccaccugcaucucc

SEQ ID NO: 1910421 - RNA, 15 nt, Shigella flexneri 2a str. 2457T
caccacgcuccauca

SEQ ID NO: 1910422 - RNA, 20 nt, Shigella flexneri 2a str. 2457T
caccacgccugccgccagca

SEQ ID NO: 1910423 - RNA, 19 nt, Shigella flexneri 2a str. 2457T
caccacgcuguagccgccg

SEQ ID NO: 1910424 - RNA, 18 nt, Shigella flexneri 2a str. 2457T
caccacgguaagcggcgu

SEQ ID NO: 1910425 - RNA, 18 nt, Shigella flexneri 2a str. 2457T
caccacuccccuccugca

SEQ ID NO: 1910426 - RNA, 12 nt, Shigella flexneri 2a str. 2457T
caccacuccuca

SEQ ID NO: 1910427 - RNA, 23 nt, Shigella flexneri 2a str. 2457T
caccaaucaacaauugcgggcca

SEQ ID NO: 1910428 - RNA, 12 nt, Shigella flexneri 2a str. 2457T
caccaaucggca

SEQ ID NO: 1910429 - RNA, 23 nt, Shigella flexneri 2a str. 2457T
caccaauaccgcccaccaccagc

SEQ ID NO: 1910430 - RNA, 15 nt, Shigella flexneri 2a str. 2457T
caccaaggaacugug

SEQ ID NO: 1910431 - RNA, 17 nt, Shigella flexneri 2a str. 2457T
caccaacuccacuucac

SEQ ID NO: 1910432 - RNA, 16 nt, Shigella flexneri 2a str. 2457T
caccaacgauuuuuuc

SEQ ID NO: 1910433 - RNA, 17 nt, Shigella flexneri 2a str. 2457T
caccaacaucaugccag

SEQ ID NO: 1910434 - RNA, 14 nt, Shigella flexneri 2a str. 2457T
caccaaaggcacaa

SEQ ID NO: 1910435 - RNA, 15 nt, Shigella flexneri 2a str. 2457T
caccaaacagaccau

SEQ ID NO: 1910436 - RNA, 18 nt, Shigella flexneri 2a str. 2457T
caccaaacugauuuagca

SEQ ID NO: 1910437 - RNA, 13 nt, Shigella flexneri 2a str. 2457T
caccaacaaauag

SEQ ID NO: 1910438 - RNA, 14 nt, Shigella flexneri 2a str. 2457T
caccaaacagacca

SEQ ID NO: 1910439 - RNA, 20 nt, Shigella flexneri 2a str. 2457T
cacauugucggcaucguaau

SEQ ID NO: 1910440 - RNA, 17 nt, Shigella flexneri 2a str. 2457T
cacauuguuaaagccuu

SEQ ID NO: 1910441 - RNA, 13 nt, Shigella flexneri 2a str. 2457T
cacauuucaauca

SEQ ID NO: 1910442 - RNA, 22 nt, Shigella flexneri 2a str. 2457T
cacauucugcaucgcgcugaac

SEQ ID NO: 1910443 - RNA, 23 nt, Shigella flexneri 2a str. 2457T
cacauugauggcgcuuucguuuu

SEQ ID NO: 1910444 - RNA, 14 nt, Shigella flexneri 2a str. 2457T
cacauuaucaaacg

SEQ ID NO: 1910445 - RNA, 16 nt, Shigella flexneri 2a str. 2457T
cacauuagauaaaaau

SEQ ID NO: 1910446 - RNA, 18 nt, Shigella flexneri 2a str. 2457T
cacauguuuauaacuucc

SEQ ID NO: 1910447 - RNA, 22 nt, Shigella flexneri 2a str. 2457T
cacauccacgccuuuuuucacu

SEQ ID NO: 1910448 - RNA, 13 nt, Shigella flexneri 2a str. 2457T
cacauccaguggc

SEQ ID NO: 1910449 - RNA, 14 nt, Shigella flexneri 2a str. 2457T
cacaucccagcaga

SEQ ID NO: 1910450 - RNA, 22 nt, Shigella flexneri 2a str. 2457T
cacauccguggguugccagagg

SEQ ID NO: 1910451 - RNA, 21 nt, Shigella flexneri 2a str. 2457T
cacauccggccaguaagcagu

SEQ ID NO: 1910452 - RNA, 15 nt, Shigella flexneri 2a str. 2457T
cacauauugcagcuu

SEQ ID NO: 1910453 - RNA, 13 nt, Shigella flexneri 2a str. 2457T
cacaucaauuugc

SEQ ID NO: 1910454 - RNA, 14 nt, Shigella flexneri 2a str. 2457T
cacaucaauuugcc

SEQ ID NO: 1910455 - RNA, 15 nt, Shigella flexneri 2a str. 2457T
cacaucaccauagcc

SEQ ID NO: 1910456 - RNA, 23 nt, Shigella flexneri 2a str. 2457T
cacauauucgccgcccugcagca

SEQ ID NO: 1910457 - RNA, 17 nt, Shigella flexneri 2a str. 2457T
cacaucauccggcaccu

SEQ ID NO: 1910458 - RNA, 14 nt, Shigella flexneri 2a str. 2457T
cacaucaucaucgc

SEQ ID NO: 1910459 - RNA, 15 nt, Shigella flexneri 2a str. 2457T
cacaucaucaaagcc

SEQ ID NO: 1910460 - RNA, 20 nt, Shigella flexneri 2a str. 2457T
cacaucagccagaugcaccg

SEQ ID NO: 1910461 - RNA, 16 nt, Shigella flexneri 2a str. 2457T
cacaucaccuccagcg

SEQ ID NO: 1910462 - RNA, 18 nt, Shigella flexneri 2a str. 2457T
cacaucaacucugcaaug

SEQ ID NO: 1910463 - RNA, 17 nt, Shigella flexneri 2a str. 2457T
cacaucaccuccagcga

SEQ ID NO: 1910464 - RNA, 20 nt, Shigella flexneri 2a str. 2457T
cacaucgcugugcugcugac

SEQ ID NO: 1910465 - RNA, 15 nt, Shigella flexneri 2a str. 2457T
cacaucgcugugcug

SEQ ID NO: 1910466 - RNA, 15 nt, Shigella flexneri 2a str. 2457T
cacaugaugauggcu

SEQ ID NO: 1910467 - RNA, 19 nt, Shigella flexneri 2a str. 2457T
cacaugcaagucgaacggu

SEQ ID NO: 1910468 - RNA, 23 nt, Shigella flexneri 2a str. 2457T
cacaugcaacgucaucaccggcu

SEQ ID NO: 1910469 - RNA, 18 nt, Shigella flexneri 2a str. 2457T
cacaugcuggaaccacag

SEQ ID NO: 1910470 - RNA, 22 nt, Shigella flexneri 2a str. 2457T
cacaugguuuacggcggucugg

SEQ ID NO: 1910471 - RNA, 10 nt, Shigella flexneri 2a str. 2457T
cacauguugc

SEQ ID NO: 1910472 - RNA, 15 nt, Shigella flexneri 2a str. 2457T
cacagcagccuucgc

SEQ ID NO: 1910473 - RNA, 18 nt, Shigella flexneri 2a str. 2457T
cacagcaaaacacccgca

SEQ ID NO: 1910474 - RNA, 17 nt, Shigella flexneri 2a str. 2457T
cacagaugcaggauuuc

SEQ ID NO: 1910475 - RNA, 14 nt, Shigella flexneri 2a str. 2457T
cacagaaacgccau

SEQ ID NO: 1910476 - RNA, 20 nt, Shigella flexneri 2a str. 2457T
cacagaaucgggcugagaug

SEQ ID NO: 1910477 - RNA, 17 nt, Shigella flexneri 2a str. 2457T
cacagacaauaaacggc

SEQ ID NO: 1910478 - RNA, 19 nt, Shigella flexneri 2a str. 2457T
cacagaccggacugacucc

SEQ ID NO: 1910479 - RNA, 16 nt, Shigella flexneri 2a str. 2457T
cacagaggucuuuucu

SEQ ID NO: 1910480 - RNA, 14 nt, Shigella flexneri 2a str. 2457T
cacagaguauuucc

SEQ ID NO: 1910481 - RNA, 13 nt, Shigella flexneri 2a str. 2457T
cacagacgaaggu

SEQ ID NO: 1910482 - RNA, 14 nt, Shigella flexneri 2a str. 2457T
cacagacuuaauau

SEQ ID NO: 1910483 - RNA, 22 nt, Shigella flexneri 2a str. 2457T
cacagcggaguaaucgccagca

SEQ ID NO: 1910484 - RNA, 14 nt, Shigella flexneri 2a str. 2457T
cacagcgacguaaa

SEQ ID NO: 1910485 - RNA, 13 nt, Shigella flexneri 2a str. 2457T
cacagcucugcug

SEQ ID NO: 1910486 - RNA, 16 nt, Shigella flexneri 2a str. 2457T
cacagcgugcauagca

SEQ ID NO: 1910487 - RNA, 15 nt, Shigella flexneri 2a str. 2457T
cacagcccgccgcca

SEQ ID NO: 1910488 - RNA, 15 nt, Shigella flexneri 2a str. 2457T
cacagccgagcgcca

SEQ ID NO: 1910489 - RNA, 18 nt, Shigella flexneri 2a str. 2457T
cacagccgagcgccacca

SEQ ID NO: 1910490 - RNA, 13 nt, Shigella flexneri 2a str. 2457T
cacagccaacaca

SEQ ID NO: 1910491 - RNA, 18 nt, Shigella flexneri 2a str. 2457T
cacagugaugaaaacgaa

SEQ ID NO: 1910492 - RNA, 22 nt, Shigella flexneri 2a str. 2457T
cacagugcugauuuugcaacaa

SEQ ID NO: 1910493 - RNA, 20 nt, Shigella flexneri 2a str. 2457T
cacaguggcgagcuuccugu

SEQ ID NO: 1910494 - RNA, 14 nt, Shigella flexneri 2a str. 2457T
cacaguuauaaaau

SEQ ID NO: 1910495 - RNA, 21 nt, Shigella flexneri 2a str. 2457T
cacaguuaaguuaauucugag

SEQ ID NO: 1910496 - RNA, 21 nt, Shigella flexneri 2a str. 2457T
cacauaaacagguaaagacca

SEQ ID NO: 1910497 - RNA, 15 nt, Shigella flexneri 2a str. 2457T
cacauaauccagaca

SEQ ID NO: 1910498 - RNA, 13 nt, Shigella flexneri 2a str. 2457T
cacauaaauucug

SEQ ID NO: 1910499 - RNA, 17 nt, Shigella flexneri 2a str. 2457T
cacauaagaucaucggc

SEQ ID NO: 1910500 - RNA, 22 nt, Shigella flexneri 2a str. 2457T
cacauacgacgcuucaguucag

SEQ ID NO: 1910501 - RNA, 16 nt, Shigella flexneri 2a str. 2457T
cacauacuuauuauga

SEQ ID NO: 1910502 - RNA, 20 nt, Shigella flexneri 2a str. 2457T
cacaggccggagccagccgu

SEQ ID NO: 1910503 - RNA, 22 nt, Shigella flexneri 2a str. 2457T
cacaggaaaaacuuuuaccugc

SEQ ID NO: 1910504 - RNA, 20 nt, Shigella flexneri 2a str. 2457T
cacaggucagcaggagcagc

SEQ ID NO: 1910505 - RNA, 21 nt, Shigella flexneri 2a str. 2457T
cacaguaaugauuuaaaacca

SEQ ID NO: 1910506 - RNA, 21 nt, Shigella flexneri 2a str. 2457T
cacaguaaugcgccagguucu

SEQ ID NO: 1910507 - RNA, 13 nt, Shigella flexneri 2a str. 2457T
cacagggugauca

SEQ ID NO: 1910508 - RNA, 20 nt, Shigella flexneri 2a str. 2457T
cacaggguguauucaugccc

SEQ ID NO: 1910509 - RNA, 20 nt, Shigella flexneri 2a str. 2457T
cacaggguggcccaaauggc

SEQ ID NO: 1910510 - RNA, 17 nt, Shigella flexneri 2a str. 2457T
cacagggugaucaccag

SEQ ID NO: 1910511 - RNA, 19 nt, Shigella flexneri 2a str. 2457T
cacaaugccugaugcgcuu

SEQ ID NO: 1910512 - RNA, 22 nt, Shigella flexneri 2a str. 2457T
cacaaugucacaaauaaaaaau

SEQ ID NO: 1910513 - RNA, 22 nt, Shigella flexneri 2a str. 2457T
cacaauggcacaaauggcaaug

SEQ ID NO: 1910514 - RNA, 20 nt, Shigella flexneri 2a str. 2457T
cacaauggcggugaucccaa

SEQ ID NO: 1910515 - RNA, 14 nt, Shigella flexneri 2a str. 2457T
cacaauuaccuucc

SEQ ID NO: 1910516 - RNA, 16 nt, Shigella flexneri 2a str. 2457T
cacacauuucucggua

SEQ ID NO: 1910517 - RNA, 22 nt, Shigella flexneri 2a str. 2457T
cacacacugcuuaacugcgcuu

SEQ ID NO: 1910518 - RNA, 22 nt, Shigella flexneri 2a str. 2457T
cacaaucgcagcgcaagcugaa

SEQ ID NO: 1910519 - RNA, 17 nt, Shigella flexneri 2a str. 2457T
cacaaucccuuaguaac

SEQ ID NO: 1910520 - RNA, 20 nt, Shigella flexneri 2a str. 2457T
cacaaucggcuuucaccgcc

SEQ ID NO: 1910521 - RNA, 23 nt, Shigella flexneri 2a str. 2457T
cacaaucugauaauccagacuau

SEQ ID NO: 1910522 - RNA, 19 nt, Shigella flexneri 2a str. 2457T
cacaaucagacgcaggcgc

SEQ ID NO: 1910523 - RNA, 14 nt, Shigella flexneri 2a str. 2457T
cacaauaauuuuau

SEQ ID NO: 1910524 - RNA, 19 nt, Shigella flexneri 2a str. 2457T
cacaauacugaucaucauu

SEQ ID NO: 1910525 - RNA, 11 nt, Shigella flexneri 2a str. 2457T
cacaauaccuu

SEQ ID NO: 1910526 - RNA, 16 nt, Shigella flexneri 2a str. 2457T
cacaauagaaauauug

SEQ ID NO: 1910527 - RNA, 17 nt, Shigella flexneri 2a str. 2457T
cacaaggccauugacgc

SEQ ID NO: 1910528 - RNA, 21 nt, Shigella flexneri 2a str. 2457T
cacaaguuguuuacaguauga

SEQ ID NO: 1910529 - RNA, 19 nt, Shigella flexneri 2a str. 2457T
cacaaguuguuuacaguau

SEQ ID NO: 1910530 - RNA, 17 nt, Shigella flexneri 2a str. 2457T
cacaagcauuaaggcaa

SEQ ID NO: 1910531 - RNA, 13 nt, Shigella flexneri 2a str. 2457T
cacaagcuccggc

SEQ ID NO: 1910532 - RNA, 16 nt, Shigella flexneri 2a str. 2457T
cacaagcuaccagccc

SEQ ID NO: 1910533 - RNA, 13 nt, Shigella flexneri 2a str. 2457T
cacacccccgcug

SEQ ID NO: 1910534 - RNA, 20 nt, Shigella flexneri 2a str. 2457T
cacacccgguaucaaacccu

SEQ ID NO: 1910535 - RNA, 21 nt, Shigella flexneri 2a str. 2457T
cacaccacugcgcauaaucca

SEQ ID NO: 1910536 - RNA, 13 nt, Shigella flexneri 2a str. 2457T
cacaccaucaaca

SEQ ID NO: 1910537 - RNA, 13 nt, Shigella flexneri 2a str. 2457T
cacacgcgcugag

SEQ ID NO: 1910538 - RNA, 13 nt, Shigella flexneri 2a str. 2457T
cacaccugcucag

SEQ ID NO: 1910539 - RNA, 15 nt, Shigella flexneri 2a str. 2457T
cacaccgcggaacgc

SEQ ID NO: 1910540 - RNA, 18 nt, Shigella flexneri 2a str. 2457T
cacacugaugacaggcua

SEQ ID NO: 1910541 - RNA, 20 nt, Shigella flexneri 2a str. 2457T
cacacuccagucccaguuca

SEQ ID NO: 1910542 - RNA, 14 nt, Shigella flexneri 2a str. 2457T
cacacgcgcugagg

SEQ ID NO: 1910543 - RNA, 16 nt, Shigella flexneri 2a str. 2457T
cacacuuuccaguucc

SEQ ID NO: 1910544 - RNA, 16 nt, Shigella flexneri 2a str. 2457T
cacacuucuucagcca

SEQ ID NO: 1910545 - RNA, 17 nt, Shigella flexneri 2a str. 2457T
cacagaaccggagucag

SEQ ID NO: 1910546 - RNA, 13 nt, Shigella flexneri 2a str. 2457T
cacagaacaaaau

SEQ ID NO: 1910547 - RNA, 20 nt, Shigella flexneri 2a str. 2457T
cacacuucaauauuaaugcu

SEQ ID NO: 1910548 - RNA, 15 nt, Shigella flexneri 2a str. 2457T
cacacugguucccaa

SEQ ID NO: 1910549 - RNA, 20 nt, Shigella flexneri 2a str. 2457T
cacacugguucccaacaaca

SEQ ID NO: 1910550 - RNA, 19 nt, Shigella flexneri 2a str. 2457T
cacaacuggcuugguaaca

SEQ ID NO: 1910551 - RNA, 18 nt, Shigella flexneri 2a str. 2457T
cacaagacuguaaauacu

SEQ ID NO: 1910552 - RNA, 16 nt, Shigella flexneri 2a str. 2457T
cacaacgcuuucaaca

SEQ ID NO: 1910553 - RNA, 21 nt, Shigella flexneri 2a str. 2457T
cacaacauucccaucaguagc

SEQ ID NO: 1910554 - RNA, 14 nt, Shigella flexneri 2a str. 2457T
cacaaccacuuugu

SEQ ID NO: 1910555 - RNA, 12 nt, Shigella flexneri 2a str. 2457T
cacaacaggcua

SEQ ID NO: 1910556 - RNA, 17 nt, Shigella flexneri 2a str. 2457T
cacaaccugcacgaaac

SEQ ID NO: 1910557 - RNA, 18 nt, Shigella flexneri 2a str. 2457T
cacaacgagcgcaaugaa

SEQ ID NO: 1910558 - RNA, 14 nt, Shigella flexneri 2a str. 2457T
cacaaccguccucc

SEQ ID NO: 1910559 - RNA, 19 nt, Shigella flexneri 2a str. 2457T
cacaaagcuguaucccagc

SEQ ID NO: 1910560 - RNA, 18 nt, Shigella flexneri 2a str. 2457T
cacaaacucuuuuccgga

SEQ ID NO: 1910561 - RNA, 19 nt, Shigella flexneri 2a str. 2457T
cacaaaggcuugcugcauu

SEQ ID NO: 1910562 - RNA, 17 nt, Shigella flexneri 2a str. 2457T
cacaaauacgcuuuuuc

SEQ ID NO: 1910563 - RNA, 13 nt, Shigella flexneri 2a str. 2457T
cacaaacaauuug

SEQ ID NO: 1910564 - RNA, 15 nt, Shigella flexneri 2a str. 2457T
cacaaacgccgugca

SEQ ID NO: 1910565 - RNA, 19 nt, Shigella flexneri 2a str. 2457T
cacaaacccagggccaacu

SEQ ID NO: 1910566 - RNA, 20 nt, Shigella flexneri 2a str. 2457T
cacaaacgaauuaucacucu

SEQ ID NO: 1910567 - RNA, 14 nt, Shigella flexneri 2a str. 2457T
cacaaacagcgccu

SEQ ID NO: 1910568 - RNA, 12 nt, Shigella flexneri 2a str. 2457T
caauuuccaguu

SEQ ID NO: 1910569 - RNA, 19 nt, Shigella flexneri 2a str. 2457T
caauuucccgcguccgcuc

SEQ ID NO: 1910570 - RNA, 21 nt, Shigella flexneri 2a str. 2457T
caauuucccgcucauagccac

SEQ ID NO: 1910571 - RNA, 14 nt, Shigella flexneri 2a str. 2457T
caauuucacguuca

SEQ ID NO: 1910572 - RNA, 13 nt, Shigella flexneri 2a str. 2457T
caauuucaucacu

SEQ ID NO: 1910573 - RNA, 15 nt, Shigella flexneri 2a str. 2457T
caauuucaucacuga

SEQ ID NO: 1910574 - RNA, 16 nt, Shigella flexneri 2a str. 2457T
cacaaaaaccgcugau

SEQ ID NO: 1910575 - RNA, 14 nt, Shigella flexneri 2a str. 2457T
cacaaaagacgaua

SEQ ID NO: 1910576 - RNA, 13 nt, Shigella flexneri 2a str. 2457T
cacaaaaauaauu

SEQ ID NO: 1910577 - RNA, 17 nt, Shigella flexneri 2a str. 2457T
caauuuuuaccgccguc

SEQ ID NO: 1910578 - RNA, 16 nt, Shigella flexneri 2a str. 2457T
caauuuucauugaaaa

SEQ ID NO: 1910579 - RNA, 19 nt, Shigella flexneri 2a str. 2457T
caaucagcgcagcacccag

SEQ ID NO: 1910580 - RNA, 23 nt, Shigella flexneri 2a str. 2457T
caaucagguaagcgauaaaaaua

SEQ ID NO: 1910581 - RNA, 12 nt, Shigella flexneri 2a str. 2457T
caaucagaugug

SEQ ID NO: 1910582 - RNA, 15 nt, Shigella flexneri 2a str. 2457T
caaucagcacacaua

SEQ ID NO: 1910583 - RNA, 16 nt, Shigella flexneri 2a str. 2457T
caaucagauaaaauac

SEQ ID NO: 1910584 - RNA, 21 nt, Shigella flexneri 2a str. 2457T
caaucagauaaaauacacuuu

SEQ ID NO: 1910585 - RNA, 12 nt, Shigella flexneri 2a str. 2457T
caaucagccaga

SEQ ID NO: 1910586 - RNA, 12 nt, Shigella flexneri 2a str. 2457T
caaucagauaaa

SEQ ID NO: 1910587 - RNA, 17 nt, Shigella flexneri 2a str. 2457T
caaucacugccagaaua

SEQ ID NO: 1910588 - RNA, 13 nt, Shigella flexneri 2a str. 2457T
caauuaacaacac

SEQ ID NO: 1910589 - RNA, 17 nt, Shigella flexneri 2a str. 2457T
caauuaacgguaauaau

SEQ ID NO: 1910590 - RNA, 22 nt, Shigella flexneri 2a str. 2457T
caauuaacgguaauaauucucc

SEQ ID NO: 1910591 - RNA, 17 nt, Shigella flexneri 2a str. 2457T
caauuaauaacacauau

SEQ ID NO: 1910592 - RNA, 22 nt, Shigella flexneri 2a str. 2457T
caauuaaugcaccaacaaauag

SEQ ID NO: 1910593 - RNA, 17 nt, Shigella flexneri 2a str. 2457T
caauuaauucuccgcuc

SEQ ID NO: 1910594 - RNA, 23 nt, Shigella flexneri 2a str. 2457T
caauuagugggauucaccaaucg

SEQ ID NO: 1910595 - RNA, 22 nt, Shigella flexneri 2a str. 2457T
caauuagugggauucaccaauc

SEQ ID NO: 1910596 - RNA, 15 nt, Shigella flexneri 2a str. 2457T
caauuacaugcuggu

SEQ ID NO: 1910597 - RNA, 18 nt, Shigella flexneri 2a str. 2457T
caauuaccaacucaucgc

SEQ ID NO: 1910598 - RNA, 19 nt, Shigella flexneri 2a str. 2457T
caauuacgccgagcgccag

SEQ ID NO: 1910599 - RNA, 20 nt, Shigella flexneri 2a str. 2457T
caauuacugcauugaauuuc

SEQ ID NO: 1910600 - RNA, 14 nt, Shigella flexneri 2a str. 2457T
caauuaucuggaau

SEQ ID NO: 1910601 - RNA, 20 nt, Shigella flexneri 2a str. 2457T
caauuaucuggaauuccuuu

SEQ ID NO: 1910602 - RNA, 23 nt, Shigella flexneri 2a str. 2457T
caauucacacagugaaucucuua

SEQ ID NO: 1910603 - RNA, 20 nt, Shigella flexneri 2a str. 2457T
caauucaauuaauucuccgc

SEQ ID NO: 1910604 - RNA, 19 nt, Shigella flexneri 2a str. 2457T
caauuuaccgacgcugcuc

SEQ ID NO: 1910605 - RNA, 17 nt, Shigella flexneri 2a str. 2457T
caauugcucccugaaua

SEQ ID NO: 1910606 - RNA, 21 nt, Shigella flexneri 2a str. 2457T
caauuggccugauaagacagc

SEQ ID NO: 1910607 - RNA, 16 nt, Shigella flexneri 2a str. 2457T
caauugcgggccaaag

SEQ ID NO: 1910608 - RNA, 20 nt, Shigella flexneri 2a str. 2457T
caauugaagaauaucuucug

SEQ ID NO: 1910609 - RNA, 14 nt, Shigella flexneri 2a str. 2457T
caauugacaguuua

SEQ ID NO: 1910610 - RNA, 15 nt, Shigella flexneri 2a str. 2457T
caauugacaguuuau

SEQ ID NO: 1910611 - RNA, 15 nt, Shigella flexneri 2a str. 2457T
caauugaccaguaau

SEQ ID NO: 1910612 - RNA, 14 nt, Shigella flexneri 2a str. 2457T
caauuccagcgcca

SEQ ID NO: 1910613 - RNA, 17 nt, Shigella flexneri 2a str. 2457T
caauuccagcaagccac

SEQ ID NO: 1910614 - RNA, 16 nt, Shigella flexneri 2a str. 2457T
auccuucacacugccu

SEQ ID NO: 1910615 - RNA, 13 nt, Shigella flexneri 2a str. 2457T
auccuuccagcuc

SEQ ID NO: 1910616 - RNA, 14 nt, Shigella flexneri 2a str. 2457T
auccuuccagcucc

SEQ ID NO: 1910617 - RNA, 18 nt, Shigella flexneri 2a str. 2457T
auccuguucauccucuuc

SEQ ID NO: 1910618 - RNA, 21 nt, Shigella flexneri 2a str. 2457T
auccugugccggcaacaauau

SEQ ID NO: 1910619 - RNA, 18 nt, Shigella flexneri 2a str. 2457T
auccuguuuuuaagugau

SEQ ID NO: 1910620 - RNA, 20 nt, Shigella flexneri 2a str. 2457T
auccuuuccuuaagccagcg

SEQ ID NO: 1910621 - RNA, 16 nt, Shigella flexneri 2a str. 2457T
aucgacaaaaucggaa

SEQ ID NO: 1910622 - RNA, 19 nt, Shigella flexneri 2a str. 2457T
aucgacagcgccuuuucuu

SEQ ID NO: 1910623 - RNA, 19 nt, Shigella flexneri 2a str. 2457T
aucgacaguuucaccugcu

SEQ ID NO: 1910624 - RNA, 13 nt, Shigella flexneri 2a str. 2457T
aucgaccaaccuu

SEQ ID NO: 1910625 - RNA, 18 nt, Shigella flexneri 2a str. 2457T
aucgaugggauauaaccc

SEQ ID NO: 1910626 - RNA, 18 nt, Shigella flexneri 2a str. 2457T
aucgccaauaucaaucuu

SEQ ID NO: 1910627 - RNA, 18 nt, Shigella flexneri 2a str. 2457T
aucgccaacaaucucuuc

SEQ ID NO: 1910628 - RNA, 20 nt, Shigella flexneri 2a str. 2457T
aucgacuaacuucugaucua

SEQ ID NO: 1910629 - RNA, 17 nt, Shigella flexneri 2a str. 2457T
aucgacuucgaagguuc

SEQ ID NO: 1910630 - RNA, 16 nt, Shigella flexneri 2a str. 2457T
aucgacugcgcccuga

SEQ ID NO: 1910631 - RNA, 21 nt, Shigella flexneri 2a str. 2457T
aucgacgcguccaggcucgcc

SEQ ID NO: 1910632 - RNA, 18 nt, Shigella flexneri 2a str. 2457T
aucgaucauauuuccuuc

SEQ ID NO: 1910633 - RNA, 12 nt, Shigella flexneri 2a str. 2457T
aucgagaaucag

SEQ ID NO: 1910634 - RNA, 23 nt, Shigella flexneri 2a str. 2457T
aucgagagaauggggucagcagg

SEQ ID NO: 1910635 - RNA, 21 nt, Shigella flexneri 2a str. 2457T
aucgccaucuuuacaccuuac

SEQ ID NO: 1910636 - RNA, 23 nt, Shigella flexneri 2a str. 2457T
aucgccauggucggcagagaguu

SEQ ID NO: 1910637 - RNA, 18 nt, Shigella flexneri 2a str. 2457T
aucgccaguaguaaccac

SEQ ID NO: 1910638 - RNA, 17 nt, Shigella flexneri 2a str. 2457T
aucgccauauccgcaau

SEQ ID NO: 1910639 - RNA, 20 nt, Shigella flexneri 2a str. 2457T
aucgccauaauaagcgccau

SEQ ID NO: 1910640 - RNA, 14 nt, Shigella flexneri 2a str. 2457T
aucgccagcucaag

SEQ ID NO: 1910641 - RNA, 20 nt, Shigella flexneri 2a str. 2457T
aucgccagcaaaaucaccau

SEQ ID NO: 1910642 - RNA, 17 nt, Shigella flexneri 2a str. 2457T
aucgccagcaucggcag

SEQ ID NO: 1910643 - RNA, 12 nt, Shigella flexneri 2a str. 2457T
aucgccagcauc

SEQ ID NO: 1910644 - RNA, 15 nt, Shigella flexneri 2a str. 2457T
aucgccagcagccau

SEQ ID NO: 1910645 - RNA, 22 nt, Shigella flexneri 2a str. 2457T
aucgccgcacuuucuccucccu

SEQ ID NO: 1910646 - RNA, 17 nt, Shigella flexneri 2a str. 2457T
aucgccucuaaaguaug

SEQ ID NO: 1910647 - RNA, 17 nt, Shigella flexneri 2a str. 2457T
aucgccgcuggaaauga

SEQ ID NO: 1910648 - RNA, 14 nt, Shigella flexneri 2a str. 2457T
aucgccgcuggcca

SEQ ID NO: 1910649 - RNA, 18 nt, Shigella flexneri 2a str. 2457T
aucggcauugcucccugc

SEQ ID NO: 1910650 - RNA, 19 nt, Shigella flexneri 2a str. 2457T
aucggcauacagcgacaga

SEQ ID NO: 1910651 - RNA, 21 nt, Shigella flexneri 2a str. 2457T
aucggcaccauuuaaaucaau

SEQ ID NO: 1910652 - RNA, 13 nt, Shigella flexneri 2a str. 2457T
aucggcaccacca

SEQ ID NO: 1910653 - RNA, 14 nt, Shigella flexneri 2a str. 2457T
aucggcaaucacau

SEQ ID NO: 1910654 - RNA, 18 nt, Shigella flexneri 2a str. 2457T
aucggaaacaaauacaug

SEQ ID NO: 1910655 - RNA, 14 nt, Shigella flexneri 2a str. 2457T
aucgcugugcugcu

SEQ ID NO: 1910656 - RNA, 20 nt, Shigella flexneri 2a str. 2457T
aucgcuguccgcuucaccac

SEQ ID NO: 1910657 - RNA, 16 nt, Shigella flexneri 2a str. 2457T
aucgccugccgcagga

SEQ ID NO: 1910658 - RNA, 23 nt, Shigella flexneri 2a str. 2457T
aucgccuuuugcccggcaacaac

SEQ ID NO: 1910659 - RNA, 22 nt, Shigella flexneri 2a str. 2457T
aucgcuauuaacccgcaacagc

SEQ ID NO: 1910660 - RNA, 18 nt, Shigella flexneri 2a str. 2457T
aucgcucaucugcugcgu

SEQ ID NO: 1910661 - RNA, 17 nt, Shigella flexneri 2a str. 2457T
aucgcucagcgcauccu

SEQ ID NO: 1910662 - RNA, 15 nt, Shigella flexneri 2a str. 2457T
aucgcugcuaauuua

SEQ ID NO: 1910663 - RNA, 21 nt, Shigella flexneri 2a str. 2457T
aucgcugcuuauggagucugc

SEQ ID NO: 1910664 - RNA, 17 nt, Shigella flexneri 2a str. 2457T
aucgcugacacgggaaa

SEQ ID NO: 1910665 - RNA, 13 nt, Shigella flexneri 2a str. 2457T
aucgcugauauac

SEQ ID NO: 1910666 - RNA, 17 nt, Shigella flexneri 2a str. 2457T
aucgcucucagagagaa

SEQ ID NO: 1910667 - RNA, 16 nt, Shigella flexneri 2a str. 2457T
aucgcugaaagauggc

SEQ ID NO: 1910668 - RNA, 18 nt, Shigella flexneri 2a str. 2457T
aucguuugcauccagcuc

SEQ ID NO: 1910669 - RNA, 20 nt, Shigella flexneri 2a str. 2457T
aucuaaccuacuuuuuaauu

SEQ ID NO: 1910670 - RNA, 16 nt, Shigella flexneri 2a str. 2457T
aucuaacgcccgagcc

SEQ ID NO: 1910671 - RNA, 19 nt, Shigella flexneri 2a str. 2457T
aucuaaccauuauuaaauu

SEQ ID NO: 1910672 - RNA, 21 nt, Shigella flexneri 2a str. 2457T
aucuaaccauuauuaaauuua

SEQ ID NO: 1910673 - RNA, 16 nt, Shigella flexneri 2a str. 2457T
aucgucaguuuuucac

SEQ ID NO: 1910674 - RNA, 18 nt, Shigella flexneri 2a str. 2457T
aucgucugcgccaccaca

SEQ ID NO: 1910675 - RNA, 14 nt, Shigella flexneri 2a str. 2457T
aucgugaaaaauca

SEQ ID NO: 1910676 - RNA, 20 nt, Shigella flexneri 2a str. 2457T
aucguacaggcacaugucca

SEQ ID NO: 1910677 - RNA, 19 nt, Shigella flexneri 2a str. 2457T
aucguauccggcauuauca

SEQ ID NO: 1910678 - RNA, 15 nt, Shigella flexneri 2a str. 2457T
aucgucaaaauuaga

SEQ ID NO: 1910679 - RNA, 21 nt, Shigella flexneri 2a str. 2457T
aucggcggugaccagcagcau

SEQ ID NO: 1910680 - RNA, 22 nt, Shigella flexneri 2a str. 2457T
aucggcgcuacggcguuucacu

SEQ ID NO: 1910681 - RNA, 19 nt, Shigella flexneri 2a str. 2457T
aucggcggugaccagcagc

SEQ ID NO: 1910682 - RNA, 20 nt, Shigella flexneri 2a str. 2457T
aucggcggcgauguccagac

SEQ ID NO: 1910683 - RNA, 20 nt, Shigella flexneri 2a str. 2457T
aucggugguguaaccuucac

SEQ ID NO: 1910684 - RNA, 24 nt, Shigella flexneri 2a str. 2457T
auccuguacgacaaaagaauggcu

SEQ ID NO: 1910685 - RNA, 13 nt, Shigella flexneri 2a str. 2457T
auccugucaguuc

SEQ ID NO: 1910686 - RNA, 17 nt, Shigella flexneri 2a str. 2457T
auccugguuauuucacu

SEQ ID NO: 1910687 - RNA, 13 nt, Shigella flexneri 2a str. 2457T
auccuggcacagc

SEQ ID NO: 1910688 - RNA, 13 nt, Shigella flexneri 2a str. 2457T
auccugcagugcg

SEQ ID NO: 1910689 - RNA, 17 nt, Shigella flexneri 2a str. 2457T
auccugcggcagcucca

SEQ ID NO: 1910690 - RNA, 19 nt, Shigella flexneri 2a str. 2457T
auccugcgcuuccugcaac

SEQ ID NO: 1910691 - RNA, 23 nt, Shigella flexneri 2a str. 2457T
auccugaagacgccucgcauuuu

SEQ ID NO: 1910692 - RNA, 18 nt, Shigella flexneri 2a str. 2457T
auccucuuugcuuccuga

SEQ ID NO: 1910693 - RNA, 14 nt, Shigella flexneri 2a str. 2457T
auccugcaaauuca

SEQ ID NO: 1910694 - RNA, 21 nt, Shigella flexneri 2a str. 2457T
auccugcaccacgacaccuuu

SEQ ID NO: 1910695 - RNA, 19 nt, Shigella flexneri 2a str. 2457T
auccugauccugcaacagc

SEQ ID NO: 1910696 - RNA, 21 nt, Shigella flexneri 2a str. 2457T
auccugauaggauuucugauu

SEQ ID NO: 1910697 - RNA, 23 nt, Shigella flexneri 2a str. 2457T
auccugagccaguuuuucuuuuu

SEQ ID NO: 1910698 - RNA, 16 nt, Shigella flexneri 2a str. 2457T
auccggcacauuucac

SEQ ID NO: 1910699 - RNA, 15 nt, Shigella flexneri 2a str. 2457T
auccggcaccuuuuc

SEQ ID NO: 1910700 - RNA, 22 nt, Shigella flexneri 2a str. 2457T
auccggcaccuuuucaucaggu

SEQ ID NO: 1910701 - RNA, 12 nt, Shigella flexneri 2a str. 2457T
auccggcaccaa

SEQ ID NO: 1910702 - RNA, 19 nt, Shigella flexneri 2a str. 2457T
auccggcuauauugcagga

SEQ ID NO: 1910703 - RNA, 15 nt, Shigella flexneri 2a str. 2457T
auccggcucguaauc

SEQ ID NO: 1910704 - RNA, 15 nt, Shigella flexneri 2a str. 2457T
auccgucauccauac

SEQ ID NO: 1910705 - RNA, 21 nt, Shigella flexneri 2a str. 2457T
auccgucagcgaguugaucac

SEQ ID NO: 1910706 - RNA, 22 nt, Shigella flexneri 2a str. 2457T
auccggucuaccgauccggcac

SEQ ID NO: 1910707 - RNA, 13 nt, Shigella flexneri 2a str. 2457T
auccgguguggca

SEQ ID NO: 1910708 - RNA, 18 nt, Shigella flexneri 2a str. 2457T
auccgguuaucagaagau

SEQ ID NO: 1910709 - RNA, 15 nt, Shigella flexneri 2a str. 2457T
auccguuucucuguu

SEQ ID NO: 1910710 - RNA, 22 nt, Shigella flexneri 2a str. 2457T
auccgugguggcagccagccau

SEQ ID NO: 1910711 - RNA, 14 nt, Shigella flexneri 2a str. 2457T
auccuaaaggcaaa

SEQ ID NO: 1910712 - RNA, 23 nt, Shigella flexneri 2a str. 2457T
auccguuuuacugggaagaaugg

SEQ ID NO: 1910713 - RNA, 16 nt, Shigella flexneri 2a str. 2457T
auccucaacgccgcau

SEQ ID NO: 1910714 - RNA, 14 nt, Shigella flexneri 2a str. 2457T
auccuaccaaagaa

SEQ ID NO: 1910715 - RNA, 14 nt, Shigella flexneri 2a str. 2457T
auccuauauuccuu

SEQ ID NO: 1910716 - RNA, 14 nt, Shigella flexneri 2a str. 2457T
auccgacacuggca

SEQ ID NO: 1910717 - RNA, 20 nt, Shigella flexneri 2a str. 2457T
auccgacauuucugcugccu

SEQ ID NO: 1910718 - RNA, 19 nt, Shigella flexneri 2a str. 2457T
aucccuuucgcuucaagua

SEQ ID NO: 1910719 - RNA, 24 nt, Shigella flexneri 2a str. 2457T
aucccugaugcgacgcucacgcgu

SEQ ID NO: 1910720 - RNA, 12 nt, Shigella flexneri 2a str. 2457T
auccgagaaucg

SEQ ID NO: 1910721 - RNA, 19 nt, Shigella flexneri 2a str. 2457T
auccgcaauuucuggccau

SEQ ID NO: 1910722 - RNA, 17 nt, Shigella flexneri 2a str. 2457T
auccgcacaaucccuua

SEQ ID NO: 1910723 - RNA, 13 nt, Shigella flexneri 2a str. 2457T
auccgaugaguuc

SEQ ID NO: 1910724 - RNA, 22 nt, Shigella flexneri 2a str. 2457T
auccggcaacaaaauauccugu

SEQ ID NO: 1910725 - RNA, 22 nt, Shigella flexneri 2a str. 2457T
auccggauacagccccaggguu

SEQ ID NO: 1910726 - RNA, 18 nt, Shigella flexneri 2a str. 2457T
auccgcuuucgguuuuuc

SEQ ID NO: 1910727 - RNA, 20 nt, Shigella flexneri 2a str. 2457T
auccgcgcgguagagaaguu

SEQ ID NO: 1910728 - RNA, 16 nt, Shigella flexneri 2a str. 2457T
auccgcuggcccauca

SEQ ID NO: 1910729 - RNA, 14 nt, Shigella flexneri 2a str. 2457T
auccgccauuucuc

SEQ ID NO: 1910730 - RNA, 16 nt, Shigella flexneri 2a str. 2457T
auccgccauuucuccu

SEQ ID NO: 1910731 - RNA, 13 nt, Shigella flexneri 2a str. 2457T
auccgcccacacc

SEQ ID NO: 1910732 - RNA, 19 nt, Shigella flexneri 2a str. 2457T
auccgccaguuuguagcca

SEQ ID NO: 1910733 - RNA, 14 nt, Shigella flexneri 2a str. 2457T
auccgccagccaau

SEQ ID NO: 1910734 - RNA, 15 nt, Shigella flexneri 2a str. 2457T
auccgcgacuggcau

SEQ ID NO: 1910735 - RNA, 18 nt, Shigella flexneri 2a str. 2457T
auccccagccuaagccau

SEQ ID NO: 1910736 - RNA, 13 nt, Shigella flexneri 2a str. 2457T
auccccagccuaa

SEQ ID NO: 1910737 - RNA, 18 nt, Shigella flexneri 2a str. 2457T
auccccagacaaaagcga

SEQ ID NO: 1910738 - RNA, 20 nt, Shigella flexneri 2a str. 2457T
auccccaccaaaacagcgac

SEQ ID NO: 1910739 - RNA, 19 nt, Shigella flexneri 2a str. 2457T
auccccaccaaaacagcga

SEQ ID NO: 1910740 - RNA, 15 nt, Shigella flexneri 2a str. 2457T
auccccgccagcacg

SEQ ID NO: 1910741 - RNA, 19 nt, Shigella flexneri 2a str. 2457T
auccccgggcggccucuuc

SEQ ID NO: 1910742 - RNA, 15 nt, Shigella flexneri 2a str. 2457T
auccccgcuuccugc

SEQ ID NO: 1910743 - RNA, 21 nt, Shigella flexneri 2a str. 2457T
auccccgcucucccaguaacc

SEQ ID NO: 1910744 - RNA, 14 nt, Shigella flexneri 2a str. 2457T
aucccgccagcacc

SEQ ID NO: 1910745 - RNA, 17 nt, Shigella flexneri 2a str. 2457T
aucccggauaucaccac

SEQ ID NO: 1910746 - RNA, 14 nt, Shigella flexneri 2a str. 2457T
aucccggcacccgc

SEQ ID NO: 1910747 - RNA, 15 nt, Shigella flexneri 2a str. 2457T
aucccgcgauaugcc

SEQ ID NO: 1910748 - RNA, 18 nt, Shigella flexneri 2a str. 2457T
aucccgcgcguuuuucuu

SEQ ID NO: 1910749 - RNA, 22 nt, Shigella flexneri 2a str. 2457T
aucccuccacgacguguuccug

SEQ ID NO: 1910750 - RNA, 11 nt, Shigella flexneri 2a str. 2457T
aucccucuuuc

SEQ ID NO: 1910751 - RNA, 21 nt, Shigella flexneri 2a str. 2457T
auccagcgcggcgaaggugcc

SEQ ID NO: 1910752 - RNA, 21 nt, Shigella flexneri 2a str. 2457T
auccagcggugcgcgauuaug

SEQ ID NO: 1910753 - RNA, 17 nt, Shigella flexneri 2a str. 2457T
auccaggaacuccagau

SEQ ID NO: 1910754 - RNA, 13 nt, Shigella flexneri 2a str. 2457T
auccaggaacucc

SEQ ID NO: 1910755 - RNA, 17 nt, Shigella flexneri 2a str. 2457T
auccagcuuuucccagc

SEQ ID NO: 1910756 - RNA, 13 nt, Shigella flexneri 2a str. 2457T
auccagcucaucc

SEQ ID NO: 1910757 - RNA, 18 nt, Shigella flexneri 2a str. 2457T
auccagccacggcuccag

SEQ ID NO: 1910758 - RNA, 14 nt, Shigella flexneri 2a str. 2457T
auccagccacggcu

SEQ ID NO: 1910759 - RNA, 15 nt, Shigella flexneri 2a str. 2457T
auccagcauaccuuc

SEQ ID NO: 1910760 - RNA, 15 nt, Shigella flexneri 2a str. 2457T
auccagcccugccag

SEQ ID NO: 1910761 - RNA, 23 nt, Shigella flexneri 2a str. 2457T
auccagcccugccaggucaucau

SEQ ID NO: 1910762 - RNA, 17 nt, Shigella flexneri 2a str. 2457T
auccagccuacaaauuu

SEQ ID NO: 1910763 - RNA, 21 nt, Shigella flexneri 2a str. 2457T
auccagccuacaaauuugugc

SEQ ID NO: 1910764 - RNA, 16 nt, Shigella flexneri 2a str. 2457T
auccagcaccuuuugc

SEQ ID NO: 1910765 - RNA, 19 nt, Shigella flexneri 2a str. 2457T
auccagcagcccuugcuuc

SEQ ID NO: 1910766 - RNA, 22 nt, Shigella flexneri 2a str. 2457T
auccagcagcggaucgaacucc

SEQ ID NO: 1910767 - RNA, 19 nt, Shigella flexneri 2a str. 2457T
auccagcagugacucacga

SEQ ID NO: 1910768 - RNA, 20 nt, Shigella flexneri 2a str. 2457T
auccagcagugacucacgaa

SEQ ID NO: 1910769 - RNA, 16 nt, Shigella flexneri 2a str. 2457T
auccagguuucuucca

SEQ ID NO: 1910770 - RNA, 17 nt, Shigella flexneri 2a str. 2457T
auccagguguauuguuc

SEQ ID NO: 1910771 - RNA, 21 nt, Shigella flexneri 2a str. 2457T
auccaggguuuuauuauucca

SEQ ID NO: 1910772 - RNA, 16 nt, Shigella flexneri 2a str. 2457T
auccaggagcuccagg

SEQ ID NO: 1910773 - RNA, 20 nt, Shigella flexneri 2a str. 2457T
auccaggagcuccagguccu

SEQ ID NO: 1910774 - RNA, 15 nt, Shigella flexneri 2a str. 2457T
auccaggaacagaag

SEQ ID NO: 1910775 - RNA, 14 nt, Shigella flexneri 2a str. 2457T
auccaggagcucca

SEQ ID NO: 1910776 - RNA, 19 nt, Shigella flexneri 2a str. 2457T
auccagggaucaacauuca

SEQ ID NO: 1910777 - RNA, 17 nt, Shigella flexneri 2a str. 2457T
auccaguguaaaacagc

SEQ ID NO: 1910778 - RNA, 20 nt, Shigella flexneri 2a str. 2457T
auccagugcucauccuucag

SEQ ID NO: 1910779 - RNA, 16 nt, Shigella flexneri 2a str. 2457T
auccagugaaacgcuu

SEQ ID NO: 1910780 - RNA, 20 nt, Shigella flexneri 2a str. 2457T
auccaguucugcuucaacau

SEQ ID NO: 1910781 - RNA, 15 nt, Shigella flexneri 2a str. 2457T
auccaguuccuucaa

SEQ ID NO: 1910782 - RNA, 13 nt, Shigella flexneri 2a str. 2457T
auccauuuucuau

SEQ ID NO: 1910783 - RNA, 17 nt, Shigella flexneri 2a str. 2457T
aucccaauacccgcaac

SEQ ID NO: 1910784 - RNA, 15 nt, Shigella flexneri 2a str. 2457T
aucccagaagaauau

SEQ ID NO: 1910785 - RNA, 21 nt, Shigella flexneri 2a str. 2457T
aucccagcugccgccaggcuu

SEQ ID NO: 1910786 - RNA, 18 nt, Shigella flexneri 2a str. 2457T
aucccaucgccgguaaug

SEQ ID NO: 1910787 - RNA, 19 nt, Shigella flexneri 2a str. 2457T
aucccagugcggcaucgcu

SEQ ID NO: 1910788 - RNA, 19 nt, Shigella flexneri 2a str. 2457T
auccaugacgaggagcugc

SEQ ID NO: 1910789 - RNA, 22 nt, Shigella flexneri 2a str. 2457T
auccaugcgcauuaagccauga

SEQ ID NO: 1910790 - RNA, 19 nt, Shigella flexneri 2a str. 2457T
auccaugccgaguggcauu

SEQ ID NO: 1910791 - RNA, 20 nt, Shigella flexneri 2a str. 2457T
auccaugcgcauuaagccau

SEQ ID NO: 1910792 - RNA, 21 nt, Shigella flexneri 2a str. 2457T
auccauucggcgauuaacaag

SEQ ID NO: 1910793 - RNA, 19 nt, Shigella flexneri 2a str. 2457T
auccaucagacuuugcgcc

SEQ ID NO: 1910794 - RNA, 15 nt, Shigella flexneri 2a str. 2457T
auccauacucuuucc

SEQ ID NO: 1910795 - RNA, 14 nt, Shigella flexneri 2a str. 2457T
auccaucaaagguu

SEQ ID NO: 1910796 - RNA, 18 nt, Shigella flexneri 2a str. 2457T
auccaucaaagguuuuuc

SEQ ID NO: 1910797 - RNA, 15 nt, Shigella flexneri 2a str. 2457T
auccaucaacgccag

SEQ ID NO: 1910798 - RNA, 23 nt, Shigella flexneri 2a str. 2457T
auccauauuuucagcagugggua

SEQ ID NO: 1910799 - RNA, 18 nt, Shigella flexneri 2a str. 2457T
auccacgccuuuuuucac

SEQ ID NO: 1910800 - RNA, 19 nt, Shigella flexneri 2a str. 2457T
auccacgcauuaauaaggu

SEQ ID NO: 1910801 - RNA, 18 nt, Shigella flexneri 2a str. 2457T
auccacgauacgcugcac

SEQ ID NO: 1910802 - RNA, 19 nt, Shigella flexneri 2a str. 2457T
auccacugucaaauccaga

SEQ ID NO: 1910803 - RNA, 16 nt, Shigella flexneri 2a str. 2457T
auccagauuuauaaaa

SEQ ID NO: 1910804 - RNA, 20 nt, Shigella flexneri 2a str. 2457T
auccagauuuauaaaagaaa

SEQ ID NO: 1910805 - RNA, 14 nt, Shigella flexneri 2a str. 2457T
auccagauggcuau

SEQ ID NO: 1910806 - RNA, 20 nt, Shigella flexneri 2a str. 2457T
auccagaucugaaucauuca

SEQ ID NO: 1910807 - RNA, 15 nt, Shigella flexneri 2a str. 2457T
auccagauagaacau

SEQ ID NO: 1910808 - RNA, 16 nt, Shigella flexneri 2a str. 2457T
auccacagcaaugcau

SEQ ID NO: 1910809 - RNA, 14 nt, Shigella flexneri 2a str. 2457T
auccacagcaaugc

SEQ ID NO: 1910810 - RNA, 15 nt, Shigella flexneri 2a str. 2457T
auccacagcaaugca

SEQ ID NO: 1910811 - RNA, 14 nt, Shigella flexneri 2a str. 2457T
auccaccagcccca

SEQ ID NO: 1910812 - RNA, 19 nt, Shigella flexneri 2a str. 2457T
auccaccgaaauaaucaga

SEQ ID NO: 1910813 - RNA, 14 nt, Shigella flexneri 2a str. 2457T
auccacccgcagcc

SEQ ID NO: 1910814 - RNA, 15 nt, Shigella flexneri 2a str. 2457T
auccaccagcaugaa

SEQ ID NO: 1910815 - RNA, 14 nt, Shigella flexneri 2a str. 2457T
auccaccagugacu

SEQ ID NO: 1910816 - RNA, 20 nt, Shigella flexneri 2a str. 2457T
auccaccaguggacggcuga

SEQ ID NO: 1910817 - RNA, 21 nt, Shigella flexneri 2a str. 2457T
auccacaacggcauuauucau

SEQ ID NO: 1910818 - RNA, 20 nt, Shigella flexneri 2a str. 2457T
auccacaacgugggccuggc

SEQ ID NO: 1910819 - RNA, 12 nt, Shigella flexneri 2a str. 2457T
auccaaugccgc

SEQ ID NO: 1910820 - RNA, 14 nt, Shigella flexneri 2a str. 2457T
aucauuuuuuuaau

SEQ ID NO: 1910821 - RNA, 23 nt, Shigella flexneri 2a str. 2457T
aucauuuuacguugcauuuccau

SEQ ID NO: 1910822 - RNA, 19 nt, Shigella flexneri 2a str. 2457T
auccaacgguuugaaugaa

SEQ ID NO: 1910823 - RNA, 15 nt, Shigella flexneri 2a str. 2457T
auccaaacauggcac

SEQ ID NO: 1910824 - RNA, 13 nt, Shigella flexneri 2a str. 2457T
aucauuuaaaaag

SEQ ID NO: 1910825 - RNA, 20 nt, Shigella flexneri 2a str. 2457T
aucauuuaaaaagaaaaaac

SEQ ID NO: 1910826 - RNA, 21 nt, Shigella flexneri 2a str. 2457T
aucauuuaaaaagaaaaaacu

SEQ ID NO: 1910827 - RNA, 20 nt, Shigella flexneri 2a str. 2457T
aucauuggccggaauaccac

SEQ ID NO: 1910828 - RNA, 16 nt, Shigella flexneri 2a str. 2457T
aucauuucuggaagca

SEQ ID NO: 1910829 - RNA, 20 nt, Shigella flexneri 2a str. 2457T
aucauugccgguuggcgacu

SEQ ID NO: 1910830 - RNA, 23 nt, Shigella flexneri 2a str. 2457T
aucauucgccgguuccagcuuca

SEQ ID NO: 1910831 - RNA, 13 nt, Shigella flexneri 2a str. 2457T
aucauucccauuu

SEQ ID NO: 1910832 - RNA, 21 nt, Shigella flexneri 2a str. 2457T
aucauucccauuuauuuuucc

SEQ ID NO: 1910833 - RNA, 13 nt, Shigella flexneri 2a str. 2457T
aucauucccgccc

SEQ ID NO: 1910834 - RNA, 14 nt, Shigella flexneri 2a str. 2457T
aucauuacaaccgc

SEQ ID NO: 1910835 - RNA, 20 nt, Shigella flexneri 2a str. 2457T
aucauguggacgaggggaga

SEQ ID NO: 1910836 - RNA, 13 nt, Shigella flexneri 2a str. 2457T
aucauuagcccaa

SEQ ID NO: 1910837 - RNA, 22 nt, Shigella flexneri 2a str. 2457T
aucauuaguaccuuccuuauuu

SEQ ID NO: 1910838 - RNA, 15 nt, Shigella flexneri 2a str. 2457T
aucauuagucacaaa

SEQ ID NO: 1910839 - RNA, 13 nt, Shigella flexneri 2a str. 2457T
aucaugaccccag

SEQ ID NO: 1910840 - RNA, 17 nt, Shigella flexneri 2a str. 2457T
aucaugccaaaaauaau

SEQ ID NO: 1910841 - RNA, 17 nt, Shigella flexneri 2a str. 2457T
aucaugcaguaccagau

SEQ ID NO: 1910842 - RNA, 18 nt, Shigella flexneri 2a str. 2457T
aucaugcaguaccagaua

SEQ ID NO: 1910843 - RNA, 21 nt, Shigella flexneri 2a str. 2457T
aucauggcauccuguuuucug

SEQ ID NO: 1910844 - RNA, 22 nt, Shigella flexneri 2a str. 2457T
aucaugcucagaugccugaugc

SEQ ID NO: 1910845 - RNA, 16 nt, Shigella flexneri 2a str. 2457T
aucaugcaauaaauau

SEQ ID NO: 1910846 - RNA, 14 nt, Shigella flexneri 2a str. 2457T
aucaucauuauuaa

SEQ ID NO: 1910847 - RNA, 12 nt, Shigella flexneri 2a str. 2457T
aucaucaucgcg

SEQ ID NO: 1910848 - RNA, 17 nt, Shigella flexneri 2a str. 2457T
aucaucagugcuuuauc

SEQ ID NO: 1910849 - RNA, 15 nt, Shigella flexneri 2a str. 2457T
aucaucaggggcagc

SEQ ID NO: 1910850 - RNA, 12 nt, Shigella flexneri 2a str. 2457T
aucaucacuccc

SEQ ID NO: 1910851 - RNA, 19 nt, Shigella flexneri 2a str. 2457T
aucaucaggggcagcacca

SEQ ID NO: 1910852 - RNA, 13 nt, Shigella flexneri 2a str. 2457T
aucauccagcacg

SEQ ID NO: 1910853 - RNA, 23 nt, Shigella flexneri 2a str. 2457T
aucauccagaccgcucagcuccu

SEQ ID NO: 1910854 - RNA, 23 nt, Shigella flexneri 2a str. 2457T
aucaucccccugcgauugugaca

SEQ ID NO: 1910855 - RNA, 20 nt, Shigella flexneri 2a str. 2457T
aucauccccguaucuucaug

SEQ ID NO: 1910856 - RNA, 17 nt, Shigella flexneri 2a str. 2457T
aucauccccguaucuuc

SEQ ID NO: 1910857 - RNA, 14 nt, Shigella flexneri 2a str. 2457T
aucaucaaagccaa

SEQ ID NO: 1910858 - RNA, 19 nt, Shigella flexneri 2a str. 2457T
aucauauuuccuuccuugg

SEQ ID NO: 1910859 - RNA, 14 nt, Shigella flexneri 2a str. 2457T
aucaucaaaauuaa

SEQ ID NO: 1910860 - RNA, 16 nt, Shigella flexneri 2a str. 2457T
aucaucaaacuuuaau

SEQ ID NO: 1910861 - RNA, 12 nt, Shigella flexneri 2a str. 2457T
aucaucaauaug

SEQ ID NO: 1910862 - RNA, 20 nt, Shigella flexneri 2a str. 2457T
aucaucaauaccagcccguc

SEQ ID NO: 1910863 - RNA, 12 nt, Shigella flexneri 2a str. 2457T
aucaucagcaug

SEQ ID NO: 1910864 - RNA, 22 nt, Shigella flexneri 2a str. 2457T
aucaucagcauuuucuauuucu

SEQ ID NO: 1910865 - RNA, 13 nt, Shigella flexneri 2a str. 2457T
aucaucaccagaa

SEQ ID NO: 1910866 - RNA, 19 nt, Shigella flexneri 2a str. 2457T
aucaucacgccaauaccgc

SEQ ID NO: 1910867 - RNA, 21 nt, Shigella flexneri 2a str. 2457T
aucaucgguaccgccagcagg

SEQ ID NO: 1910868 - RNA, 22 nt, Shigella flexneri 2a str. 2457T
aucaucgggcugagauuuauga

SEQ ID NO: 1910869 - RNA, 22 nt, Shigella flexneri 2a str. 2457T
aucaucuggcugugauccauuc

SEQ ID NO: 1910870 - RNA, 23 nt, Shigella flexneri 2a str. 2457T
aucaucgcccaguugaucaccag

SEQ ID NO: 1910871 - RNA, 23 nt, Shigella flexneri 2a str. 2457T
aucaucgccgucacgguaauaac

SEQ ID NO: 1910872 - RNA, 17 nt, Shigella flexneri 2a str. 2457T
aucaucgcggcacacag

SEQ ID NO: 1910873 - RNA, 18 nt, Shigella flexneri 2a str. 2457T
aucaucgcggcacacagc

SEQ ID NO: 1910874 - RNA, 14 nt, Shigella flexneri 2a str. 2457T
aucaucgaccccag

SEQ ID NO: 1910875 - RNA, 16 nt, Shigella flexneri 2a str. 2457T
aucauccggcaccuuu

SEQ ID NO: 1910876 - RNA, 13 nt, Shigella flexneri 2a str. 2457T
aucauauuaaauu

SEQ ID NO: 1910877 - RNA, 22 nt, Shigella flexneri 2a str. 2457T
aucauauuaaauuuuuucacug

SEQ ID NO: 1910878 - RNA, 17 nt, Shigella flexneri 2a str. 2457T
aucauauugcucuggau

SEQ ID NO: 1910879 - RNA, 15 nt, Shigella flexneri 2a str. 2457T
aucauacugaacuua

SEQ ID NO: 1910880 - RNA, 16 nt, Shigella flexneri 2a str. 2457T
aucauagacuucccuc

SEQ ID NO: 1910881 - RNA, 14 nt, Shigella flexneri 2a str. 2457T
aucaguuccagcag

SEQ ID NO: 1910882 - RNA, 17 nt, Shigella flexneri 2a str. 2457T
aucaguuggggaaaagu

SEQ ID NO: 1910883 - RNA, 13 nt, Shigella flexneri 2a str. 2457T
aucauaaaaauua

SEQ ID NO: 1910884 - RNA, 19 nt, Shigella flexneri 2a str. 2457T
aucaguuguucagaaugcc

SEQ ID NO: 1910885 - RNA, 22 nt, Shigella flexneri 2a str. 2457T
aucaguuuuuucauugaaugcg

SEQ ID NO: 1910886 - RNA, 23 nt, Shigella flexneri 2a str. 2457T
aucaguguacuuaucuuuuacaa

SEQ ID NO: 1910887 - RNA, 17 nt, Shigella flexneri 2a str. 2457T
aucaguggcuugguugu

SEQ ID NO: 1910888 - RNA, 14 nt, Shigella flexneri 2a str. 2457T
aucagguaagcaaa

SEQ ID NO: 1910889 - RNA, 15 nt, Shigella flexneri 2a str. 2457T
aucagguauaccgaa

SEQ ID NO: 1910890 - RNA, 22 nt, Shigella flexneri 2a str. 2457T
aucagguugaugcgaguaauca

SEQ ID NO: 1910891 - RNA, 17 nt, Shigella flexneri 2a str. 2457T
aucaggcuaaagguauu

SEQ ID NO: 1910892 - RNA, 21 nt, Shigella flexneri 2a str. 2457T
aucaggcugaaaaucuucucu

SEQ ID NO: 1910893 - RNA, 18 nt, Shigella flexneri 2a str. 2457T
aucaggcuguguuuaaga

SEQ ID NO: 1910894 - RNA, 18 nt, Shigella flexneri 2a str. 2457T
aucaggcuucuguaccug

SEQ ID NO: 1910895 - RNA, 23 nt, Shigella flexneri 2a str. 2457T
aucaggcuuuuuuauugccaucu

SEQ ID NO: 1910896 - RNA, 21 nt, Shigella flexneri 2a str. 2457T
aucaggcaaugcuuccugcuu

SEQ ID NO: 1910897 - RNA, 14 nt, Shigella flexneri 2a str. 2457T
aucaggcaaaaaaa

SEQ ID NO: 1910898 - RNA, 12 nt, Shigella flexneri 2a str. 2457T
aucaggccaggu

SEQ ID NO: 1910899 - RNA, 20 nt, Shigella flexneri 2a str. 2457T
aucaggccuacaaaaugugc

SEQ ID NO: 1910900 - RNA, 17 nt, Shigella flexneri 2a str. 2457T
aucaggccuacagcaua

SEQ ID NO: 1910901 - RNA, 15 nt, Shigella flexneri 2a str. 2457T
aucaggcauucuuuu

SEQ ID NO: 1910902 - RNA, 16 nt, Shigella flexneri 2a str. 2457T
aucaggcaucgugcac

SEQ ID NO: 1910903 - RNA, 17 nt, Shigella flexneri 2a str. 2457T
aucaggcaucugagcau

SEQ ID NO: 1910904 - RNA, 15 nt, Shigella flexneri 2a str. 2457T
aucaaucccaucagg

SEQ ID NO: 1910905 - RNA, 13 nt, Shigella flexneri 2a str. 2457T
aucaggacgaaaa

SEQ ID NO: 1910906 - RNA, 15 nt, Shigella flexneri 2a str. 2457T
aucaggacgaaaaau

SEQ ID NO: 1910907 - RNA, 10 nt, Shigella flexneri 2a str. 2457T
aucaggaaac

SEQ ID NO: 1910908 - RNA, 21 nt, Shigella flexneri 2a str. 2457T
augcgcauugccagagugaaa

SEQ ID NO: 1910909 - RNA, 14 nt, Shigella flexneri 2a str. 2457T
augcgcgaacugga

SEQ ID NO: 1910910 - RNA, 13 nt, Shigella flexneri 2a str. 2457T
augcgcugggcaa

SEQ ID NO: 1910911 - RNA, 18 nt, Shigella flexneri 2a str. 2457T
augcgcuaaauguuuagu

SEQ ID NO: 1910912 - RNA, 21 nt, Shigella flexneri 2a str. 2457T
augcgcucuguugguaaaugc

SEQ ID NO: 1910913 - RNA, 22 nt, Shigella flexneri 2a str. 2457T
augcggcaucuucuccacgcca

SEQ ID NO: 1910914 - RNA, 16 nt, Shigella flexneri 2a str. 2457T
augcgauaacccgcuc

SEQ ID NO: 1910915 - RNA, 20 nt, Shigella flexneri 2a str. 2457T
augcgacguaaaaacuacaa

SEQ ID NO: 1910916 - RNA, 20 nt, Shigella flexneri 2a str. 2457T
augcgaguaaacaggggcug

SEQ ID NO: 1910917 - RNA, 16 nt, Shigella flexneri 2a str. 2457T
augcgcauuaagccau

SEQ ID NO: 1910918 - RNA, 17 nt, Shigella flexneri 2a str. 2457T
augcgcauugccagagu

SEQ ID NO: 1910919 - RNA, 13 nt, Shigella flexneri 2a str. 2457T
augcgacgcuugc

SEQ ID NO: 1910920 - RNA, 17 nt, Shigella flexneri 2a str. 2457T
augcgagauguccccug

SEQ ID NO: 1910921 - RNA, 22 nt, Shigella flexneri 2a str. 2457T
augcgacauagaucuaaaugcc

SEQ ID NO: 1910922 - RNA, 13 nt, Shigella flexneri 2a str. 2457T
augcgacacuguu

SEQ ID NO: 1910923 - RNA, 15 nt, Shigella flexneri 2a str. 2457T
augcgacaacagaaa

SEQ ID NO: 1910924 - RNA, 20 nt, Shigella flexneri 2a str. 2457T
augcauuuaagaaaaaagau

SEQ ID NO: 1910925 - RNA, 21 nt, Shigella flexneri 2a str. 2457T
augccaaaaauaaucuauuga

SEQ ID NO: 1910926 - RNA, 16 nt, Shigella flexneri 2a str. 2457T
augcgggugaacgcgu

SEQ ID NO: 1910927 - RNA, 22 nt, Shigella flexneri 2a str. 2457T
augcgguacugaccaucagcag

SEQ ID NO: 1910928 - RNA, 23 nt, Shigella flexneri 2a str. 2457T
augcggucguaaucgcccgcuuc

SEQ ID NO: 1910929 - RNA, 20 nt, Shigella flexneri 2a str. 2457T
augcguagcugagcaacaaa

SEQ ID NO: 1910930 - RNA, 21 nt, Shigella flexneri 2a str. 2457T
augcgguuaaaccgaaagugu

SEQ ID NO: 1910931 - RNA, 16 nt, Shigella flexneri 2a str. 2457T
augcggcgugaaugcc

SEQ ID NO: 1910932 - RNA, 17 nt, Shigella flexneri 2a str. 2457T
augcggcguaaaugccu

SEQ ID NO: 1910933 - RNA, 14 nt, Shigella flexneri 2a str. 2457T
augcuaaaaacauc

SEQ ID NO: 1910934 - RNA, 18 nt, Shigella flexneri 2a str. 2457T
augcgugcacuggcgcga

SEQ ID NO: 1910935 - RNA, 13 nt, Shigella flexneri 2a str. 2457T
augcucuccacca

SEQ ID NO: 1910936 - RNA, 14 nt, Shigella flexneri 2a str. 2457T
augcucugccagcg

SEQ ID NO: 1910937 - RNA, 16 nt, Shigella flexneri 2a str. 2457T
augcuccagcagaugg

SEQ ID NO: 1910938 - RNA, 16 nt, Shigella flexneri 2a str. 2457T
augcucgcuggcaggc

SEQ ID NO: 1910939 - RNA, 16 nt, Shigella flexneri 2a str. 2457T
augcuaagccgugcau

SEQ ID NO: 1910940 - RNA, 18 nt, Shigella flexneri 2a str. 2457T
augcucaacaauaaacug

SEQ ID NO: 1910941 - RNA, 21 nt, Shigella flexneri 2a str. 2457T
augcucauucuuccuccagcg

SEQ ID NO: 1910942 - RNA, 17 nt, Shigella flexneri 2a str. 2457T
augcuuaagaaauuauu

SEQ ID NO: 1910943 - RNA, 20 nt, Shigella flexneri 2a str. 2457T
augcuggucacugacaccau

SEQ ID NO: 1910944 - RNA, 14 nt, Shigella flexneri 2a str. 2457T
augcugguuuugug

SEQ ID NO: 1910945 - RNA, 15 nt, Shigella flexneri 2a str. 2457T
augcuguauucuuca

SEQ ID NO: 1910946 - RNA, 20 nt, Shigella flexneri 2a str. 2457T
augcugucggcugccagcca

SEQ ID NO: 1910947 - RNA, 16 nt, Shigella flexneri 2a str. 2457T
augcugugaagauggc

SEQ ID NO: 1910948 - RNA, 17 nt, Shigella flexneri 2a str. 2457T
augcugucggcugccag

SEQ ID NO: 1910949 - RNA, 22 nt, Shigella flexneri 2a str. 2457T
augcuugcgauauucuucagua

SEQ ID NO: 1910950 - RNA, 19 nt, Shigella flexneri 2a str. 2457T
augcuugcgauauucuuca

SEQ ID NO: 1910951 - RNA, 16 nt, Shigella flexneri 2a str. 2457T
augcuuccuuccuggg

SEQ ID NO: 1910952 - RNA, 16 nt, Shigella flexneri 2a str. 2457T
augcuugacucuguag

SEQ ID NO: 1910953 - RNA, 22 nt, Shigella flexneri 2a str. 2457T
augcuggcggcgcgauaaaaau

SEQ ID NO: 1910954 - RNA, 18 nt, Shigella flexneri 2a str. 2457T
augcuggccuuuuuggca

SEQ ID NO: 1910955 - RNA, 21 nt, Shigella flexneri 2a str. 2457T
augcugcuuuaucagaucacg

SEQ ID NO: 1910956 - RNA, 22 nt, Shigella flexneri 2a str. 2457T
augcugcuuuaucagaucacgc

SEQ ID NO: 1910957 - RNA, 15 nt, Shigella flexneri 2a str. 2457T
augcugcuuucugcg

SEQ ID NO: 1910958 - RNA, 12 nt, Shigella flexneri 2a str. 2457T
augcuggaagcg

SEQ ID NO: 1910959 - RNA, 17 nt, Shigella flexneri 2a str. 2457T
augcuggcugcgcucug

SEQ ID NO: 1910960 - RNA, 18 nt, Shigella flexneri 2a str. 2457T
augcugguaauccgagaa

SEQ ID NO: 1910961 - RNA, 14 nt, Shigella flexneri 2a str. 2457T
augcugccgucuuc

SEQ ID NO: 1910962 - RNA, 21 nt, Shigella flexneri 2a str. 2457T
augcugcggcggcggaaaaag

SEQ ID NO: 1910963 - RNA, 21 nt, Shigella flexneri 2a str. 2457T
augcucuuugauguacgcugc

SEQ ID NO: 1910964 - RNA, 20 nt, Shigella flexneri 2a str. 2457T
augcugaaauuacgcggugc

SEQ ID NO: 1910965 - RNA, 14 nt, Shigella flexneri 2a str. 2457T
augcugcaauaaaa

SEQ ID NO: 1910966 - RNA, 18 nt, Shigella flexneri 2a str. 2457T
auggaaaucacccagcga

SEQ ID NO: 1910967 - RNA, 21 nt, Shigella flexneri 2a str. 2457T
auggaaaaucaucaggggcag

SEQ ID NO: 1910968 - RNA, 18 nt, Shigella flexneri 2a str. 2457T
auggaagacauagcacau

SEQ ID NO: 1910969 - RNA, 17 nt, Shigella flexneri 2a str. 2457T
auggaaggucacgccag

SEQ ID NO: 1910970 - RNA, 18 nt, Shigella flexneri 2a str. 2457T
auggaaacagcaccaucc

SEQ ID NO: 1910971 - RNA, 15 nt, Shigella flexneri 2a str. 2457T
auggaaaaucaucag

SEQ ID NO: 1910972 - RNA, 20 nt, Shigella flexneri 2a str. 2457T
auggaucagaguugaaaaac

SEQ ID NO: 1910973 - RNA, 21 nt, Shigella flexneri 2a str. 2457T
auggaucagaguugaaaaaca

SEQ ID NO: 1910974 - RNA, 22 nt, Shigella flexneri 2a str. 2457T
auggaggcuucgguaaugacuc

SEQ ID NO: 1910975 - RNA, 11 nt, Shigella flexneri 2a str. 2457T
auggaucaacu

SEQ ID NO: 1910976 - RNA, 16 nt, Shigella flexneri 2a str. 2457T
auggacacuauuuccc

SEQ ID NO: 1910977 - RNA, 17 nt, Shigella flexneri 2a str. 2457T
auggacgcagaccaaag

SEQ ID NO: 1910978 - RNA, 11 nt, Shigella flexneri 2a str. 2457T
augugccauua

SEQ ID NO: 1910979 - RNA, 21 nt, Shigella flexneri 2a str. 2457T
augugccagcuucccgcuggu

SEQ ID NO: 1910980 - RNA, 20 nt, Shigella flexneri 2a str. 2457T
augucuggcgagcuccaggg

SEQ ID NO: 1910981 - RNA, 15 nt, Shigella flexneri 2a str. 2457T
augucuggcagagcc

SEQ ID NO: 1910982 - RNA, 16 nt, Shigella flexneri 2a str. 2457T
augucugaucggcaau

SEQ ID NO: 1910983 - RNA, 18 nt, Shigella flexneri 2a str. 2457T
auguguaaguaaugacaa

SEQ ID NO: 1910984 - RNA, 21 nt, Shigella flexneri 2a str. 2457T
auguguaaguaaugacaaaau

SEQ ID NO: 1910985 - RNA, 14 nt, Shigella flexneri 2a str. 2457T
augugcuucaucag

SEQ ID NO: 1910986 - RNA, 18 nt, Shigella flexneri 2a str. 2457T
auguguaagaaaggcaga

SEQ ID NO: 1910987 - RNA, 19 nt, Shigella flexneri 2a str. 2457T
augugcucuaacccuucca

SEQ ID NO: 1910988 - RNA, 15 nt, Shigella flexneri 2a str. 2457T
augugccguaaccaa

SEQ ID NO: 1910989 - RNA, 23 nt, Shigella flexneri 2a str. 2457T
auguuacugagcggaugcuuaac

SEQ ID NO: 1910990 - RNA, 18 nt, Shigella flexneri 2a str. 2457T
auguuacgaccuuccuga

SEQ ID NO: 1910991 - RNA, 21 nt, Shigella flexneri 2a str. 2457T
auguuacgugaagucucaauu

SEQ ID NO: 1910992 - RNA, 17 nt, Shigella flexneri 2a str. 2457T
auguuaggcaagccaca

SEQ ID NO: 1910993 - RNA, 13 nt, Shigella flexneri 2a str. 2457T
auguguuagcccu

SEQ ID NO: 1910994 - RNA, 17 nt, Shigella flexneri 2a str. 2457T
auguguuggcaccaucc

SEQ ID NO: 1910995 - RNA, 18 nt, Shigella flexneri 2a str. 2457T
auguuccuucugucauga

SEQ ID NO: 1910996 - RNA, 14 nt, Shigella flexneri 2a str. 2457T
auguucuaucuuuc

SEQ ID NO: 1910997 - RNA, 13 nt, Shigella flexneri 2a str. 2457T
auguuccuccucg

SEQ ID NO: 1910998 - RNA, 12 nt, Shigella flexneri 2a str. 2457T
auguuauucaug

SEQ ID NO: 1910999 - RNA, 19 nt, Shigella flexneri 2a str. 2457T
auguuaucaagauauuuca

SEQ ID NO: 1911000 - RNA, 14 nt, Shigella flexneri 2a str. 2457T
augucacagccgca

SEQ ID NO: 1911001 - RNA, 16 nt, Shigella flexneri 2a str. 2457T
augucagacaacaugc

SEQ ID NO: 1911002 - RNA, 15 nt, Shigella flexneri 2a str. 2457T
augucagcaaucacc

SEQ ID NO: 1911003 - RNA, 19 nt, Shigella flexneri 2a str. 2457T
augucacugcuuuggcucu

SEQ ID NO: 1911004 - RNA, 18 nt, Shigella flexneri 2a str. 2457T
augucgcuguuucuggac

SEQ ID NO: 1911005 - RNA, 15 nt, Shigella flexneri 2a str. 2457T
augucgcgccaggcg

SEQ ID NO: 1911006 - RNA, 23 nt, Shigella flexneri 2a str. 2457T
augucgcucaaugcgcugagugu

SEQ ID NO: 1911007 - RNA, 16 nt, Shigella flexneri 2a str. 2457T
augucgcucaaugugc

SEQ ID NO: 1911008 - RNA, 14 nt, Shigella flexneri 2a str. 2457T
augucaucagcauu

SEQ ID NO: 1911009 - RNA, 14 nt, Shigella flexneri 2a str. 2457T
auguagcgcugcaa

SEQ ID NO: 1911010 - RNA, 21 nt, Shigella flexneri 2a str. 2457T
auguacucuuuauugcaaaca

SEQ ID NO: 1911011 - RNA, 17 nt, Shigella flexneri 2a str. 2457T
auguacauggugcacau

SEQ ID NO: 1911012 - RNA, 22 nt, Shigella flexneri 2a str. 2457T
augguggcccggauucagauug

SEQ ID NO: 1911013 - RNA, 14 nt, Shigella flexneri 2a str. 2457T
augguggagauaaa

SEQ ID NO: 1911014 - RNA, 22 nt, Shigella flexneri 2a str. 2457T
auggucaaugauuucugccagc

SEQ ID NO: 1911015 - RNA, 14 nt, Shigella flexneri 2a str. 2457T
auggucagcuucac

SEQ ID NO: 1911016 - RNA, 21 nt, Shigella flexneri 2a str. 2457T
auggucagguauuuugucagc

SEQ ID NO: 1911017 - RNA, 14 nt, Shigella flexneri 2a str. 2457T
auggucagccagcg

SEQ ID NO: 1911018 - RNA, 17 nt, Shigella flexneri 2a str. 2457T
auggguuaacaucaugu

SEQ ID NO: 1911019 - RNA, 20 nt, Shigella flexneri 2a str. 2457T
augggugcaaugagaaugcg

SEQ ID NO: 1911020 - RNA, 17 nt, Shigella flexneri 2a str. 2457T
auggucaacauucccug

SEQ ID NO: 1911021 - RNA, 19 nt, Shigella flexneri 2a str. 2457T
auggucaacgucaacuuug

SEQ ID NO: 1911022 - RNA, 14 nt, Shigella flexneri 2a str. 2457T
auggcuuugcccuu

SEQ ID NO: 1911023 - RNA, 13 nt, Shigella flexneri 2a str. 2457T
auggguaugugac

SEQ ID NO: 1911024 - RNA, 18 nt, Shigella flexneri 2a str. 2457T
auggggguccugagcacu

SEQ ID NO: 1911025 - RNA, 21 nt, Shigella flexneri 2a str. 2457T
augggguggaacggugaaaac

SEQ ID NO: 1911026 - RNA, 19 nt, Shigella flexneri 2a str. 2457T
auggcccgccgcauuggua

SEQ ID NO: 1911027 - RNA, 12 nt, Shigella flexneri 2a str. 2457T
auggcacaaaug

SEQ ID NO: 1911028 - RNA, 17 nt, Shigella flexneri 2a str. 2457T
auggccgcuccaagguc

SEQ ID NO: 1911029 - RNA, 13 nt, Shigella flexneri 2a str. 2457T
auggccuuucugg

SEQ ID NO: 1911030 - RNA, 21 nt, Shigella flexneri 2a str. 2457T
auggcaauaaagacauccgcc

SEQ ID NO: 1911031 - RNA, 15 nt, Shigella flexneri 2a str. 2457T
auggcaaacaaacug

SEQ ID NO: 1911032 - RNA, 17 nt, Shigella flexneri 2a str. 2457T
auggauucgaugaucaa

SEQ ID NO: 1911033 - RNA, 13 nt, Shigella flexneri 2a str. 2457T
auggauugcugaa

SEQ ID NO: 1911034 - RNA, 16 nt, Shigella flexneri 2a str. 2457T
auggauugcugaaaua

SEQ ID NO: 1911035 - RNA, 16 nt, Shigella flexneri 2a str. 2457T
auggcaaaacggcucu

SEQ ID NO: 1911036 - RNA, 17 nt, Shigella flexneri 2a str. 2457T
auggcaaaaacuuccau

SEQ ID NO: 1911037 - RNA, 21 nt, Shigella flexneri 2a str. 2457T
auggauuugaaacgaaaucuu

SEQ ID NO: 1911038 - RNA, 22 nt, Shigella flexneri 2a str. 2457T
auggcggggagggaauccagca

SEQ ID NO: 1911039 - RNA, 17 nt, Shigella flexneri 2a str. 2457T
auggcgcccaucggcgc

SEQ ID NO: 1911040 - RNA, 17 nt, Shigella flexneri 2a str. 2457T
auggcgccaguuauuaa

SEQ ID NO: 1911041 - RNA, 16 nt, Shigella flexneri 2a str. 2457T
auggcgacuucugcuu

SEQ ID NO: 1911042 - RNA, 20 nt, Shigella flexneri 2a str. 2457T
auggcgauuucacaagacug

SEQ ID NO: 1911043 - RNA, 22 nt, Shigella flexneri 2a str. 2457T
auggcgcaauccggugauguuu

SEQ ID NO: 1911044 - RNA, 17 nt, Shigella flexneri 2a str. 2457T
auggcuggggaauauuu

SEQ ID NO: 1911045 - RNA, 20 nt, Shigella flexneri 2a str. 2457T
auggcuggcuauacacaagg

SEQ ID NO: 1911046 - RNA, 19 nt, Shigella flexneri 2a str. 2457T
auggcguucgcaacaccgu

SEQ ID NO: 1911047 - RNA, 19 nt, Shigella flexneri 2a str. 2457T
auggcggugagggggggau

SEQ ID NO: 1911048 - RNA, 12 nt, Shigella flexneri 2a str. 2457T
augauuuuccug

SEQ ID NO: 1911049 - RNA, 15 nt, Shigella flexneri 2a str. 2457T
augauuuuccugagg

SEQ ID NO: 1911050 - RNA, 17 nt, Shigella flexneri 2a str. 2457T
augauuuugauggaaga

SEQ ID NO: 1911051 - RNA, 15 nt, Shigella flexneri 2a str. 2457T
augcaccaucucuua

SEQ ID NO: 1911052 - RNA, 17 nt, Shigella flexneri 2a str. 2457T
augcaccaacaaauaga

SEQ ID NO: 1911053 - RNA, 20 nt, Shigella flexneri 2a str. 2457T
augcacucgcauccucuuua

SEQ ID NO: 1911054 - RNA, 14 nt, Shigella flexneri 2a str. 2457T
augcagauaaucgu

SEQ ID NO: 1911055 - RNA, 20 nt, Shigella flexneri 2a str. 2457T
augcacgcaagaacgcauac

SEQ ID NO: 1911056 - RNA, 22 nt, Shigella flexneri 2a str. 2457T
augcaccuggggcuugccagag

SEQ ID NO: 1911057 - RNA, 17 nt, Shigella flexneri 2a str. 2457T
augcacgcucuguucug

SEQ ID NO: 1911058 - RNA, 18 nt, Shigella flexneri 2a str. 2457T
augcacgcucuguucugc

SEQ ID NO: 1911059 - RNA, 19 nt, Shigella flexneri 2a str. 2457T
augaugcgacuugucauca

SEQ ID NO: 1911060 - RNA, 14 nt, Shigella flexneri 2a str. 2457T
augauuaauuacac

SEQ ID NO: 1911061 - RNA, 16 nt, Shigella flexneri 2a str. 2457T
augaugauacugacau

SEQ ID NO: 1911062 - RNA, 21 nt, Shigella flexneri 2a str. 2457T
augauaucgcuggcaggcaaa

SEQ ID NO: 1911063 - RNA, 19 nt, Shigella flexneri 2a str. 2457T
augaucagcgguuuugcca

SEQ ID NO: 1911064 - RNA, 13 nt, Shigella flexneri 2a str. 2457T
augaucaucaagg

SEQ ID NO: 1911065 - RNA, 20 nt, Shigella flexneri 2a str. 2457T
augaucaccugcauacaaau

SEQ ID NO: 1911066 - RNA, 15 nt, Shigella flexneri 2a str. 2457T
augaucaagcgcaca

SEQ ID NO: 1911067 - RNA, 17 nt, Shigella flexneri 2a str. 2457T
augaucaaaaucauaua

SEQ ID NO: 1911068 - RNA, 19 nt, Shigella flexneri 2a str. 2457T
augaggcguuaacagcgca

SEQ ID NO: 1911069 - RNA, 20 nt, Shigella flexneri 2a str. 2457T
augaggcuuuaauaccugcc

SEQ ID NO: 1911070 - RNA, 19 nt, Shigella flexneri 2a str. 2457T
augagcuuucgcuucuuga

SEQ ID NO: 1911071 - RNA, 13 nt, Shigella flexneri 2a str. 2457T
augauaaucagaa

SEQ ID NO: 1911072 - RNA, 21 nt, Shigella flexneri 2a str. 2457T
augauacagccgacaaugcca

SEQ ID NO: 1911073 - RNA, 16 nt, Shigella flexneri 2a str. 2457T
augauaccgauuacuc

SEQ ID NO: 1911074 - RNA, 14 nt, Shigella flexneri 2a str. 2457T
augauagccaggcg

SEQ ID NO: 1911075 - RNA, 21 nt, Shigella flexneri 2a str. 2457T
augauaucccugcuguccuga

SEQ ID NO: 1911076 - RNA, 14 nt, Shigella flexneri 2a str. 2457T
augauaucccugcu

SEQ ID NO: 1911077 - RNA, 22 nt, Shigella flexneri 2a str. 2457T
augauaucagccugcaaacgcu

SEQ ID NO: 1911078 - RNA, 22 nt, Shigella flexneri 2a str. 2457T
augauacguuuauuaccaacca

SEQ ID NO: 1911079 - RNA, 22 nt, Shigella flexneri 2a str. 2457T
augauacugacauuaacgugau

SEQ ID NO: 1911080 - RNA, 17 nt, Shigella flexneri 2a str. 2457T
augacuccaacuuacug

SEQ ID NO: 1911081 - RNA, 12 nt, Shigella flexneri 2a str. 2457T
augagcaccgca

SEQ ID NO: 1911082 - RNA, 18 nt, Shigella flexneri 2a str. 2457T
augagcaccgcaccuaaa

SEQ ID NO: 1911083 - RNA, 17 nt, Shigella flexneri 2a str. 2457T
augagcaguuugguuaa

SEQ ID NO: 1911084 - RNA, 20 nt, Shigella flexneri 2a str. 2457T
augaacggugcgcaggcuuu

SEQ ID NO: 1911085 - RNA, 17 nt, Shigella flexneri 2a str. 2457T
augacaagguugauauu

SEQ ID NO: 1911086 - RNA, 20 nt, Shigella flexneri 2a str. 2457T
augacacuucagccaucaaa

SEQ ID NO: 1911087 - RNA, 14 nt, Shigella flexneri 2a str. 2457T
augacacguuuauu

SEQ ID NO: 1911088 - RNA, 21 nt, Shigella flexneri 2a str. 2457T
augacacguuuauuauagaca

SEQ ID NO: 1911089 - RNA, 14 nt, Shigella flexneri 2a str. 2457T
augacacaucaccu

SEQ ID NO: 1911090 - RNA, 21 nt, Shigella flexneri 2a str. 2457T
augacacaucaccuccagcga

SEQ ID NO: 1911091 - RNA, 19 nt, Shigella flexneri 2a str. 2457T
augacguccuguacuguuu

SEQ ID NO: 1911092 - RNA, 14 nt, Shigella flexneri 2a str. 2457T
augacggcugccau

SEQ ID NO: 1911093 - RNA, 17 nt, Shigella flexneri 2a str. 2457T
augacagggcgcgggca

SEQ ID NO: 1911094 - RNA, 19 nt, Shigella flexneri 2a str. 2457T
augacagucuggaagccag

SEQ ID NO: 1911095 - RNA, 18 nt, Shigella flexneri 2a str. 2457T
augaccgaggcgcggcga

SEQ ID NO: 1911096 - RNA, 14 nt, Shigella flexneri 2a str. 2457T
augacccgagccac

SEQ ID NO: 1911097 - RNA, 15 nt, Shigella flexneri 2a str. 2457T
augaccccagguauc

SEQ ID NO: 1911098 - RNA, 15 nt, Shigella flexneri 2a str. 2457T
aucuuugaaaucacg

SEQ ID NO: 1911099 - RNA, 23 nt, Shigella flexneri 2a str. 2457T
aucuuugccagaucgccugccgc

SEQ ID NO: 1911100 - RNA, 16 nt, Shigella flexneri 2a str. 2457T
aucuuuaucaaucacc

SEQ ID NO: 1911101 - RNA, 10 nt, Shigella flexneri 2a str. 2457T
augaaauuca

SEQ ID NO: 1911102 - RNA, 20 nt, Shigella flexneri 2a str. 2457T
augaaaauaaccauauauga

SEQ ID NO: 1911103 - RNA, 16 nt, Shigella flexneri 2a str. 2457T
augaacacgaucucac

SEQ ID NO: 1911104 - RNA, 14 nt, Shigella flexneri 2a str. 2457T
augaacaaagcgca

SEQ ID NO: 1911105 - RNA, 18 nt, Shigella flexneri 2a str. 2457T
augaaaaaaccagaaagg

SEQ ID NO: 1911106 - RNA, 14 nt, Shigella flexneri 2a str. 2457T
augaaaaaauagaa

SEQ ID NO: 1911107 - RNA, 16 nt, Shigella flexneri 2a str. 2457T
aucuucgagauucuua

SEQ ID NO: 1911108 - RNA, 15 nt, Shigella flexneri 2a str. 2457T
aucuuccgucacagg

SEQ ID NO: 1911109 - RNA, 20 nt, Shigella flexneri 2a str. 2457T
aucuuccgucacaggcacac

SEQ ID NO: 1911110 - RNA, 15 nt, Shigella flexneri 2a str. 2457T
aucuuccucacaccc

SEQ ID NO: 1911111 - RNA, 18 nt, Shigella flexneri 2a str. 2457T
aucuuccucacacccuug

SEQ ID NO: 1911112 - RNA, 13 nt, Shigella flexneri 2a str. 2457T
aucuuccugauaa

SEQ ID NO: 1911113 - RNA, 15 nt, Shigella flexneri 2a str. 2457T
aucuuccugauaacc

SEQ ID NO: 1911114 - RNA, 15 nt, Shigella flexneri 2a str. 2457T
aucuucccagccaau

SEQ ID NO: 1911115 - RNA, 19 nt, Shigella flexneri 2a str. 2457T
aucuucccagcccagcgcu

SEQ ID NO: 1911116 - RNA, 14 nt, Shigella flexneri 2a str. 2457T
aucuucccagcgca

SEQ ID NO: 1911117 - RNA, 20 nt, Shigella flexneri 2a str. 2457T
aucuuccggcgggcaaacgg

SEQ ID NO: 1911118 - RNA, 15 nt, Shigella flexneri 2a str. 2457T
aucuucauggagaac

SEQ ID NO: 1911119 - RNA, 20 nt, Shigella flexneri 2a str. 2457T
aucuucauugugcgguccau

SEQ ID NO: 1911120 - RNA, 17 nt, Shigella flexneri 2a str. 2457T
aucuuccaccuggaacc

SEQ ID NO: 1911121 - RNA, 14 nt, Shigella flexneri 2a str. 2457T
aucuuccagaucac

SEQ ID NO: 1911122 - RNA, 21 nt, Shigella flexneri 2a str. 2457T
aucuuccagaucaccgcagaa

SEQ ID NO: 1911123 - RNA, 15 nt, Shigella flexneri 2a str. 2457T
aucuugcgaccgcuc

SEQ ID NO: 1911124 - RNA, 22 nt, Shigella flexneri 2a str. 2457T
aucuugcaaauucaauauauug

SEQ ID NO: 1911125 - RNA, 15 nt, Shigella flexneri 2a str. 2457T
aucuucguuauccca

SEQ ID NO: 1911126 - RNA, 16 nt, Shigella flexneri 2a str. 2457T
aucuaagaucccugcc

SEQ ID NO: 1911127 - RNA, 19 nt, Shigella flexneri 2a str. 2457T
aucuaauguuggugugaca

SEQ ID NO: 1911128 - RNA, 18 nt, Shigella flexneri 2a str. 2457T
aucugcuccuguugaugu

SEQ ID NO: 1911129 - RNA, 18 nt, Shigella flexneri 2a str. 2457T
aucuggaauggaaacagc

SEQ ID NO: 1911130 - RNA, 22 nt, Shigella flexneri 2a str. 2457T
aucugugugggcacucgaagau

SEQ ID NO: 1911131 - RNA, 18 nt, Shigella flexneri 2a str. 2457T
aucugucuguacggcagu

SEQ ID NO: 1911132 - RNA, 23 nt, Shigella flexneri 2a str. 2457T
aucugucuguacggcagugaaca

SEQ ID NO: 1911133 - RNA, 19 nt, Shigella flexneri 2a str. 2457T
aucugucugauaaaaaacc

SEQ ID NO: 1911134 - RNA, 18 nt, Shigella flexneri 2a str. 2457T
aucugucugauaaaaaac

SEQ ID NO: 1911135 - RNA, 15 nt, Shigella flexneri 2a str. 2457T
aucugucagguaaca

SEQ ID NO: 1911136 - RNA, 21 nt, Shigella flexneri 2a str. 2457T
aucuguaggccagauaagacg

SEQ ID NO: 1911137 - RNA, 15 nt, Shigella flexneri 2a str. 2457T
aucugucauaacaca

SEQ ID NO: 1911138 - RNA, 22 nt, Shigella flexneri 2a str. 2457T
aucugguguuaaaucuguucau

SEQ ID NO: 1911139 - RNA, 20 nt, Shigella flexneri 2a str. 2457T
aucuguuucuucgucaauuu

SEQ ID NO: 1911140 - RNA, 12 nt, Shigella flexneri 2a str. 2457T
aucuguuuuuug

SEQ ID NO: 1911141 - RNA, 11 nt, Shigella flexneri 2a str. 2457T
aucuguuuuag

SEQ ID NO: 1911142 - RNA, 14 nt, Shigella flexneri 2a str. 2457T
aucuguuaucacuu

SEQ ID NO: 1911143 - RNA, 16 nt, Shigella flexneri 2a str. 2457T
aucuguugugccacau

SEQ ID NO: 1911144 - RNA, 13 nt, Shigella flexneri 2a str. 2457T
aucuucagcugca

SEQ ID NO: 1911145 - RNA, 18 nt, Shigella flexneri 2a str. 2457T
aucuucaaucagaugugc

SEQ ID NO: 1911146 - RNA, 20 nt, Shigella flexneri 2a str. 2457T
aucuuauugcucgaccuaaa

SEQ ID NO: 1911147 - RNA, 13 nt, Shigella flexneri 2a str. 2457T
aucuuaucacgau

SEQ ID NO: 1911148 - RNA, 23 nt, Shigella flexneri 2a str. 2457T
aucuuaucacgaugcuaaaaaca

SEQ ID NO: 1911149 - RNA, 21 nt, Shigella flexneri 2a str. 2457T
aucuuauagaaagcaaaacgg

SEQ ID NO: 1911150 - RNA, 13 nt, Shigella flexneri 2a str. 2457T
auauggaaaaaua

SEQ ID NO: 1911151 - RNA, 14 nt, Shigella flexneri 2a str. 2457T
auaugcuuaauguu

SEQ ID NO: 1911152 - RNA, 22 nt, Shigella flexneri 2a str. 2457T
auauggaacggaugcagcauca

SEQ ID NO: 1911153 - RNA, 16 nt, Shigella flexneri 2a str. 2457T
auaugccggcaucaaa

SEQ ID NO: 1911154 - RNA, 15 nt, Shigella flexneri 2a str. 2457T
auaugccggcaucaa

SEQ ID NO: 1911155 - RNA, 20 nt, Shigella flexneri 2a str. 2457T
auaugccgcccuaaagggcg

SEQ ID NO: 1911156 - RNA, 15 nt, Shigella flexneri 2a str. 2457T
auaugcgcuggcagu

SEQ ID NO: 1911157 - RNA, 19 nt, Shigella flexneri 2a str. 2457T
auaugcgggcguuuugcuu

SEQ ID NO: 1911158 - RNA, 22 nt, Shigella flexneri 2a str. 2457T
auaugcgggcguuuugcuuuuu

SEQ ID NO: 1911159 - RNA, 22 nt, Shigella flexneri 2a str. 2457T
auaugcacaugaugauggcuau

SEQ ID NO: 1911160 - RNA, 22 nt, Shigella flexneri 2a str. 2457T
auaugcaacguuaccguaacca

SEQ ID NO: 1911161 - RNA, 14 nt, Shigella flexneri 2a str. 2457T
auaugauuuaaaaa

SEQ ID NO: 1911162 - RNA, 21 nt, Shigella flexneri 2a str. 2457T
auaugaccauugguaauggga

SEQ ID NO: 1911163 - RNA, 21 nt, Shigella flexneri 2a str. 2457T
auaucugccagauaauggcug

SEQ ID NO: 1911164 - RNA, 14 nt, Shigella flexneri 2a str. 2457T
auaucuccuauugu

SEQ ID NO: 1911165 - RNA, 19 nt, Shigella flexneri 2a str. 2457T
auaucuccuccgaugacgg

SEQ ID NO: 1911166 - RNA, 14 nt, Shigella flexneri 2a str. 2457T
auaucguuaucacc

SEQ ID NO: 1911167 - RNA, 13 nt, Shigella flexneri 2a str. 2457T
auauccugcaaau

SEQ ID NO: 1911168 - RNA, 16 nt, Shigella flexneri 2a str. 2457T
auauccugcaaauuca

SEQ ID NO: 1911169 - RNA, 14 nt, Shigella flexneri 2a str. 2457T
auauccugauacuc

SEQ ID NO: 1911170 - RNA, 16 nt, Shigella flexneri 2a str. 2457T
auauccucaagaauau

SEQ ID NO: 1911171 - RNA, 18 nt, Shigella flexneri 2a str. 2457T
auauccgucacuucagga

SEQ ID NO: 1911172 - RNA, 15 nt, Shigella flexneri 2a str. 2457T
auaucgcgcagaaau

SEQ ID NO: 1911173 - RNA, 20 nt, Shigella flexneri 2a str. 2457T
auauccugcgcuuccugcaa

SEQ ID NO: 1911174 - RNA, 22 nt, Shigella flexneri 2a str. 2457T
auauccugcgcuuccugcaacg

SEQ ID NO: 1911175 - RNA, 14 nt, Shigella flexneri 2a str. 2457T
auaucggcauugcu

SEQ ID NO: 1911176 - RNA, 19 nt, Shigella flexneri 2a str. 2457T
auaucggcccggcuuucuu

SEQ ID NO: 1911177 - RNA, 19 nt, Shigella flexneri 2a str. 2457T
auaucggccaucuguucug

SEQ ID NO: 1911178 - RNA, 19 nt, Shigella flexneri 2a str. 2457T
auauauccguggcuuuuua

SEQ ID NO: 1911179 - RNA, 15 nt, Shigella flexneri 2a str. 2457T
auaucaucauuugca

SEQ ID NO: 1911180 - RNA, 12 nt, Shigella flexneri 2a str. 2457T
auaucaucauuu

SEQ ID NO: 1911181 - RNA, 15 nt, Shigella flexneri 2a str. 2457T
auaucaucaaaauua

SEQ ID NO: 1911182 - RNA, 19 nt, Shigella flexneri 2a str. 2457T
auagucggcccggcgacua

SEQ ID NO: 1911183 - RNA, 22 nt, Shigella flexneri 2a str. 2457T
auaguucuguugcugaaauucc

SEQ ID NO: 1911184 - RNA, 18 nt, Shigella flexneri 2a str. 2457T
auaguucaaugauaguuc

SEQ ID NO: 1911185 - RNA, 15 nt, Shigella flexneri 2a str. 2457T
auauaaagcaucaau

SEQ ID NO: 1911186 - RNA, 14 nt, Shigella flexneri 2a str. 2457T
auagcgauaagaac

SEQ ID NO: 1911187 - RNA, 19 nt, Shigella flexneri 2a str. 2457T
auagcgaaguagacagcgu

SEQ ID NO: 1911188 - RNA, 15 nt, Shigella flexneri 2a str. 2457T
auagcgcaaaauuau

SEQ ID NO: 1911189 - RNA, 15 nt, Shigella flexneri 2a str. 2457T
auagcgccugcugcu

SEQ ID NO: 1911190 - RNA, 15 nt, Shigella flexneri 2a str. 2457T
auagucaucucuucc

SEQ ID NO: 1911191 - RNA, 17 nt, Shigella flexneri 2a str. 2457T
auauaagcauguucuuu

SEQ ID NO: 1911192 - RNA, 19 nt, Shigella flexneri 2a str. 2457T
auauaaauauuuucugaaa

SEQ ID NO: 1911193 - RNA, 20 nt, Shigella flexneri 2a str. 2457T
auauaaauauuuucugaaaa

SEQ ID NO: 1911194 - RNA, 14 nt, Shigella flexneri 2a str. 2457T
auauaaugcaacau

SEQ ID NO: 1911195 - RNA, 14 nt, Shigella flexneri 2a str. 2457T
auauaauaaaccug

SEQ ID NO: 1911196 - RNA, 15 nt, Shigella flexneri 2a str. 2457T
auauacccuucucag

SEQ ID NO: 1911197 - RNA, 20 nt, Shigella flexneri 2a str. 2457T
auauaccauggaagaaaaau

SEQ ID NO: 1911198 - RNA, 13 nt, Shigella flexneri 2a str. 2457T
auauagauaucau

SEQ ID NO: 1911199 - RNA, 17 nt, Shigella flexneri 2a str. 2457T
auauauaaaaaaacaau

SEQ ID NO: 1911200 - RNA, 18 nt, Shigella flexneri 2a str. 2457T
auauauaauuaaaaauag

SEQ ID NO: 1911201 - RNA, 17 nt, Shigella flexneri 2a str. 2457T
auauuagcauuaaguaa

SEQ ID NO: 1911202 - RNA, 20 nt, Shigella flexneri 2a str. 2457T
auauuagccgccagcucuuu

SEQ ID NO: 1911203 - RNA, 20 nt, Shigella flexneri 2a str. 2457T
auauuacgaauauaaauauu

SEQ ID NO: 1911204 - RNA, 19 nt, Shigella flexneri 2a str. 2457T
auauuacgagucacaaaca

SEQ ID NO: 1911205 - RNA, 23 nt, Shigella flexneri 2a str. 2457T
auauuacgagucacaaacaucau

SEQ ID NO: 1911206 - RNA, 16 nt, Shigella flexneri 2a str. 2457T
auauuacguuccuuua

SEQ ID NO: 1911207 - RNA, 18 nt, Shigella flexneri 2a str. 2457T
auauuacaacguauuaua

SEQ ID NO: 1911208 - RNA, 13 nt, Shigella flexneri 2a str. 2457T
auauguucagaaa

SEQ ID NO: 1911209 - RNA, 14 nt, Shigella flexneri 2a str. 2457T
auaugugaaauuua

SEQ ID NO: 1911210 - RNA, 15 nt, Shigella flexneri 2a str. 2457T
auaugugaaauuuau

SEQ ID NO: 1911211 - RNA, 15 nt, Shigella flexneri 2a str. 2457T
auaugucguuauaua

SEQ ID NO: 1911212 - RNA, 17 nt, Shigella flexneri 2a str. 2457T
auaugucguuauauaaa

SEQ ID NO: 1911213 - RNA, 13 nt, Shigella flexneri 2a str. 2457T
auauguuuuaaag

SEQ ID NO: 1911214 - RNA, 17 nt, Shigella flexneri 2a str. 2457T
auauguuuuugcaguag

SEQ ID NO: 1911215 - RNA, 14 nt, Shigella flexneri 2a str. 2457T
auauggugaaagua

SEQ ID NO: 1911216 - RNA, 18 nt, Shigella flexneri 2a str. 2457T
auauggccguuuucccca

SEQ ID NO: 1911217 - RNA, 16 nt, Shigella flexneri 2a str. 2457T
auauggcgcugcggcg

SEQ ID NO: 1911218 - RNA, 22 nt, Shigella flexneri 2a str. 2457T
auauuaucagcaaagcaaauuu

SEQ ID NO: 1911219 - RNA, 11 nt, Shigella flexneri 2a str. 2457T
auauucauuuu

SEQ ID NO: 1911220 - RNA, 11 nt, Shigella flexneri 2a str. 2457T
auauuccccag

SEQ ID NO: 1911221 - RNA, 16 nt, Shigella flexneri 2a str. 2457T
auauuccugacccagc

SEQ ID NO: 1911222 - RNA, 18 nt, Shigella flexneri 2a str. 2457T
auauuccugacccagcac

SEQ ID NO: 1911223 - RNA, 20 nt, Shigella flexneri 2a str. 2457T
auauuuaauggcgacauaaa

SEQ ID NO: 1911224 - RNA, 21 nt, Shigella flexneri 2a str. 2457T
auauuggagaguugcaccagc

SEQ ID NO: 1911225 - RNA, 12 nt, Shigella flexneri 2a str. 2457T
auauugguguug

SEQ ID NO: 1911226 - RNA, 18 nt, Shigella flexneri 2a str. 2457T
auauugguguugugaagu

SEQ ID NO: 1911227 - RNA, 13 nt, Shigella flexneri 2a str. 2457T
auauuggucacca

SEQ ID NO: 1911228 - RNA, 18 nt, Shigella flexneri 2a str. 2457T
auauugagccaacguuuc

SEQ ID NO: 1911229 - RNA, 15 nt, Shigella flexneri 2a str. 2457T
aucaagaaugcucgc

SEQ ID NO: 1911230 - RNA, 20 nt, Shigella flexneri 2a str. 2457T
aucaagacaugauguuuuaa

SEQ ID NO: 1911231 - RNA, 13 nt, Shigella flexneri 2a str. 2457T
aucaagacaugau

SEQ ID NO: 1911232 - RNA, 20 nt, Shigella flexneri 2a str. 2457T
aucaauacuuuccagcauau

SEQ ID NO: 1911233 - RNA, 21 nt, Shigella flexneri 2a str. 2457T
aucaauacuuuccagcauaug

SEQ ID NO: 1911234 - RNA, 22 nt, Shigella flexneri 2a str. 2457T
aucaauccaguguaaaacagca

SEQ ID NO: 1911235 - RNA, 13 nt, Shigella flexneri 2a str. 2457T
aucaauccaaaca

SEQ ID NO: 1911236 - RNA, 14 nt, Shigella flexneri 2a str. 2457T
aucaauaccagccc

SEQ ID NO: 1911237 - RNA, 23 nt, Shigella flexneri 2a str. 2457T
aucaauaccugguccuucaucuu

SEQ ID NO: 1911238 - RNA, 23 nt, Shigella flexneri 2a str. 2457T
aucaauacaggcgacgaguugcu

SEQ ID NO: 1911239 - RNA, 20 nt, Shigella flexneri 2a str. 2457T
aucaauaccauuaucauuga

SEQ ID NO: 1911240 - RNA, 18 nt, Shigella flexneri 2a str. 2457T
aucaacuccgccagcaac

SEQ ID NO: 1911241 - RNA, 17 nt, Shigella flexneri 2a str. 2457T
aucaacauauuccccug

SEQ ID NO: 1911242 - RNA, 20 nt, Shigella flexneri 2a str. 2457T
aucaacaugaaaauaaccau

SEQ ID NO: 1911243 - RNA, 22 nt, Shigella flexneri 2a str. 2457T
aucaacguaguaucguaaucag

SEQ ID NO: 1911244 - RNA, 15 nt, Shigella flexneri 2a str. 2457T
aucaacucugcaaug

SEQ ID NO: 1911245 - RNA, 22 nt, Shigella flexneri 2a str. 2457T
aucaacaauaaaaccaguaaug

SEQ ID NO: 1911246 - RNA, 14 nt, Shigella flexneri 2a str. 2457T
aucaacaaagugca

SEQ ID NO: 1911247 - RNA, 17 nt, Shigella flexneri 2a str. 2457T
aucaacaccacugccag

SEQ ID NO: 1911248 - RNA, 23 nt, Shigella flexneri 2a str. 2457T
aucaacaauugcgggccaaagac

SEQ ID NO: 1911249 - RNA, 14 nt, Shigella flexneri 2a str. 2457T
aucaacacauccag

SEQ ID NO: 1911250 - RNA, 15 nt, Shigella flexneri 2a str. 2457T
aucaacaguuuguug

SEQ ID NO: 1911251 - RNA, 18 nt, Shigella flexneri 2a str. 2457T
aucaacaguuuguugcau

SEQ ID NO: 1911252 - RNA, 21 nt, Shigella flexneri 2a str. 2457T
aucaaauacuucaauauaugc

SEQ ID NO: 1911253 - RNA, 14 nt, Shigella flexneri 2a str. 2457T
aucaaauucaagau

SEQ ID NO: 1911254 - RNA, 18 nt, Shigella flexneri 2a str. 2457T
aucaaaugcguuaucggc

SEQ ID NO: 1911255 - RNA, 16 nt, Shigella flexneri 2a str. 2457T
aucaaauuauuaccau

SEQ ID NO: 1911256 - RNA, 19 nt, Shigella flexneri 2a str. 2457T
aucaaagucuccuuugcca

SEQ ID NO: 1911257 - RNA, 16 nt, Shigella flexneri 2a str. 2457T
aucaaaguuuuuauga

SEQ ID NO: 1911258 - RNA, 21 nt, Shigella flexneri 2a str. 2457T
aucaaagauuguuggcaaaaa

SEQ ID NO: 1911259 - RNA, 22 nt, Shigella flexneri 2a str. 2457T
aucaaagaugaugucacagccg

SEQ ID NO: 1911260 - RNA, 15 nt, Shigella flexneri 2a str. 2457T
auauuucaggccaac

SEQ ID NO: 1911261 - RNA, 16 nt, Shigella flexneri 2a str. 2457T
auauuuccuuccuugg

SEQ ID NO: 1911262 - RNA, 13 nt, Shigella flexneri 2a str. 2457T
auauuucuauauc

SEQ ID NO: 1911263 - RNA, 17 nt, Shigella flexneri 2a str. 2457T
auacauagcacaacagg

SEQ ID NO: 1911264 - RNA, 16 nt, Shigella flexneri 2a str. 2457T
auacauagaaacucau

SEQ ID NO: 1911265 - RNA, 18 nt, Shigella flexneri 2a str. 2457T
auacauagaaacucauau

SEQ ID NO: 1911266 - RNA, 22 nt, Shigella flexneri 2a str. 2457T
auacauagcgccucuuuauaaa

SEQ ID NO: 1911267 - RNA, 19 nt, Shigella flexneri 2a str. 2457T
auacaucugcaaauccugu

SEQ ID NO: 1911268 - RNA, 22 nt, Shigella flexneri 2a str. 2457T
auacaucgcgcuuaucgccagc

SEQ ID NO: 1911269 - RNA, 14 nt, Shigella flexneri 2a str. 2457T
auacaugcuuagca

SEQ ID NO: 1911270 - RNA, 17 nt, Shigella flexneri 2a str. 2457T
auacaucuucaucaucc

SEQ ID NO: 1911271 - RNA, 21 nt, Shigella flexneri 2a str. 2457T
auacauguacauggugcacau

SEQ ID NO: 1911272 - RNA, 22 nt, Shigella flexneri 2a str. 2457T
auacaggcggguaaucuuucca

SEQ ID NO: 1911273 - RNA, 23 nt, Shigella flexneri 2a str. 2457T
auacaggaacagccacuggugag

SEQ ID NO: 1911274 - RNA, 18 nt, Shigella flexneri 2a str. 2457T
auacagcucaugggcuuu

SEQ ID NO: 1911275 - RNA, 15 nt, Shigella flexneri 2a str. 2457T
auacagcucagguuc

SEQ ID NO: 1911276 - RNA, 12 nt, Shigella flexneri 2a str. 2457T
auacagccgaag

SEQ ID NO: 1911277 - RNA, 20 nt, Shigella flexneri 2a str. 2457T
auacagccgacaaugccaca

SEQ ID NO: 1911278 - RNA, 17 nt, Shigella flexneri 2a str. 2457T
auacagcggacagccau

SEQ ID NO: 1911279 - RNA, 15 nt, Shigella flexneri 2a str. 2457T
auacagcaauggaaa

SEQ ID NO: 1911280 - RNA, 18 nt, Shigella flexneri 2a str. 2457T
auacagaugcugcucuuc

SEQ ID NO: 1911281 - RNA, 12 nt, Shigella flexneri 2a str. 2457T
auacaguuuuug

SEQ ID NO: 1911282 - RNA, 20 nt, Shigella flexneri 2a str. 2457T
auacaguuaucccguacucg

SEQ ID NO: 1911283 - RNA, 14 nt, Shigella flexneri 2a str. 2457T
auacagggaaagaa

SEQ ID NO: 1911284 - RNA, 14 nt, Shigella flexneri 2a str. 2457T
auaauuuuuucuuc

SEQ ID NO: 1911285 - RNA, 20 nt, Shigella flexneri 2a str. 2457T
auaauuuucgguaaugacuc

SEQ ID NO: 1911286 - RNA, 21 nt, Shigella flexneri 2a str. 2457T
auaauuuucgguaaugacucc

SEQ ID NO: 1911287 - RNA, 15 nt, Shigella flexneri 2a str. 2457T
auacaaauagccaau

SEQ ID NO: 1911288 - RNA, 13 nt, Shigella flexneri 2a str. 2457T
auacaacgccaug

SEQ ID NO: 1911289 - RNA, 18 nt, Shigella flexneri 2a str. 2457T
auacaaccagauaaccau

SEQ ID NO: 1911290 - RNA, 17 nt, Shigella flexneri 2a str. 2457T
auacaaggccaauccag

SEQ ID NO: 1911291 - RNA, 14 nt, Shigella flexneri 2a str. 2457T
auacaaucauuccc

SEQ ID NO: 1911292 - RNA, 15 nt, Shigella flexneri 2a str. 2457T
auacacgaggcauau

SEQ ID NO: 1911293 - RNA, 17 nt, Shigella flexneri 2a str. 2457T
auacacucuuucaauau

SEQ ID NO: 1911294 - RNA, 18 nt, Shigella flexneri 2a str. 2457T
auacacucuuucaauauu

SEQ ID NO: 1911295 - RNA, 17 nt, Shigella flexneri 2a str. 2457T
auaaugacggagaguac

SEQ ID NO: 1911296 - RNA, 14 nt, Shigella flexneri 2a str. 2457T
auaaugagcagaaa

SEQ ID NO: 1911297 - RNA, 17 nt, Shigella flexneri 2a str. 2457T
auaaugagcagaaaaac

SEQ ID NO: 1911298 - RNA, 13 nt, Shigella flexneri 2a str. 2457T
auaaugcccagca

SEQ ID NO: 1911299 - RNA, 20 nt, Shigella flexneri 2a str. 2457T
auaaugcaauggaauggcug

SEQ ID NO: 1911300 - RNA, 18 nt, Shigella flexneri 2a str. 2457T
auaaugaucaguggaaga

SEQ ID NO: 1911301 - RNA, 22 nt, Shigella flexneri 2a str. 2457T
auaaugaugucucuguuuugaa

SEQ ID NO: 1911302 - RNA, 17 nt, Shigella flexneri 2a str. 2457T
auaaucuguuucaucuc

SEQ ID NO: 1911303 - RNA, 19 nt, Shigella flexneri 2a str. 2457T
auaaucucccguuccuggu

SEQ ID NO: 1911304 - RNA, 14 nt, Shigella flexneri 2a str. 2457T
auaaucgaaaacau

SEQ ID NO: 1911305 - RNA, 20 nt, Shigella flexneri 2a str. 2457T
auaauccugccgagauacag

SEQ ID NO: 1911306 - RNA, 17 nt, Shigella flexneri 2a str. 2457T
auaauccaucacuucau

SEQ ID NO: 1911307 - RNA, 19 nt, Shigella flexneri 2a str. 2457T
auaauccaucacuucauca

SEQ ID NO: 1911308 - RNA, 15 nt, Shigella flexneri 2a str. 2457T
auaaucccggcacca

SEQ ID NO: 1911309 - RNA, 22 nt, Shigella flexneri 2a str. 2457T
auaauccccggccuuugauuau

SEQ ID NO: 1911310 - RNA, 16 nt, Shigella flexneri 2a str. 2457T
auaaucccggcaccaa

SEQ ID NO: 1911311 - RNA, 19 nt, Shigella flexneri 2a str. 2457T
auaaucauuucgccugaaa

SEQ ID NO: 1911312 - RNA, 13 nt, Shigella flexneri 2a str. 2457T
auaaucaucccac

SEQ ID NO: 1911313 - RNA, 15 nt, Shigella flexneri 2a str. 2457T
auaacggugcaaccc

SEQ ID NO: 1911314 - RNA, 23 nt, Shigella flexneri 2a str. 2457T
auaacggugcaacccgccagguu

SEQ ID NO: 1911315 - RNA, 14 nt, Shigella flexneri 2a str. 2457T
auaacggcucaaac

SEQ ID NO: 1911316 - RNA, 13 nt, Shigella flexneri 2a str. 2457T
auaacgcuggcag

SEQ ID NO: 1911317 - RNA, 15 nt, Shigella flexneri 2a str. 2457T
auaacggcagaagcu

SEQ ID NO: 1911318 - RNA, 23 nt, Shigella flexneri 2a str. 2457T
auaauuccucccguuaugaucag

SEQ ID NO: 1911319 - RNA, 13 nt, Shigella flexneri 2a str. 2457T
auaaugucugaug

SEQ ID NO: 1911320 - RNA, 21 nt, Shigella flexneri 2a str. 2457T
auaauuguuccguuauuaugc

SEQ ID NO: 1911321 - RNA, 17 nt, Shigella flexneri 2a str. 2457T
auaauugucaacggcac

SEQ ID NO: 1911322 - RNA, 13 nt, Shigella flexneri 2a str. 2457T
auaauuuuaaaua

SEQ ID NO: 1911323 - RNA, 14 nt, Shigella flexneri 2a str. 2457T
auaauuugugacga

SEQ ID NO: 1911324 - RNA, 21 nt, Shigella flexneri 2a str. 2457T
auaauuucugcacaucuaacc

SEQ ID NO: 1911325 - RNA, 14 nt, Shigella flexneri 2a str. 2457T
auaccaaugauugg

SEQ ID NO: 1911326 - RNA, 18 nt, Shigella flexneri 2a str. 2457T
auaccaaaaucaucaauu

SEQ ID NO: 1911327 - RNA, 17 nt, Shigella flexneri 2a str. 2457T
auaccacgccaucaacg

SEQ ID NO: 1911328 - RNA, 16 nt, Shigella flexneri 2a str. 2457T
auaccacuuccagcag

SEQ ID NO: 1911329 - RNA, 18 nt, Shigella flexneri 2a str. 2457T
auaccagcccgucucagc

SEQ ID NO: 1911330 - RNA, 17 nt, Shigella flexneri 2a str. 2457T
auaccagauuaauuauu

SEQ ID NO: 1911331 - RNA, 16 nt, Shigella flexneri 2a str. 2457T
auaccacccgcaguga

SEQ ID NO: 1911332 - RNA, 15 nt, Shigella flexneri 2a str. 2457T
auaccacgucugaag

SEQ ID NO: 1911333 - RNA, 12 nt, Shigella flexneri 2a str. 2457T
auaccacacccg

SEQ ID NO: 1911334 - RNA, 20 nt, Shigella flexneri 2a str. 2457T
auacccgcauucgccgcugg

SEQ ID NO: 1911335 - RNA, 12 nt, Shigella flexneri 2a str. 2457T
auacccagcacc

SEQ ID NO: 1911336 - RNA, 17 nt, Shigella flexneri 2a str. 2457T
auacccaccgguccuaa

SEQ ID NO: 1911337 - RNA, 17 nt, Shigella flexneri 2a str. 2457T
auacccaguuucaugau

SEQ ID NO: 1911338 - RNA, 21 nt, Shigella flexneri 2a str. 2457T
auaccaugccguucugggugg

SEQ ID NO: 1911339 - RNA, 20 nt, Shigella flexneri 2a str. 2457T
auaccaguccacccacguua

SEQ ID NO: 1911340 - RNA, 12 nt, Shigella flexneri 2a str. 2457T
auaccaugcacc

SEQ ID NO: 1911341 - RNA, 15 nt, Shigella flexneri 2a str. 2457T
auaccaucacaccuc

SEQ ID NO: 1911342 - RNA, 14 nt, Shigella flexneri 2a str. 2457T
auacgaacgccugc

SEQ ID NO: 1911343 - RNA, 14 nt, Shigella flexneri 2a str. 2457T
auaccgcaucagca

SEQ ID NO: 1911344 - RNA, 17 nt, Shigella flexneri 2a str. 2457T
auaccgcacgcucaaag

SEQ ID NO: 1911345 - RNA, 18 nt, Shigella flexneri 2a str. 2457T
auaccgaagaguaaccaa

SEQ ID NO: 1911346 - RNA, 22 nt, Shigella flexneri 2a str. 2457T
auaccgagcagccacugcggca

SEQ ID NO: 1911347 - RNA, 13 nt, Shigella flexneri 2a str. 2457T
auaccguucagac

SEQ ID NO: 1911348 - RNA, 18 nt, Shigella flexneri 2a str. 2457T
auaccguucucuuuaaaa

SEQ ID NO: 1911349 - RNA, 15 nt, Shigella flexneri 2a str. 2457T
auaccgcgaaucaua

SEQ ID NO: 1911350 - RNA, 16 nt, Shigella flexneri 2a str. 2457T
auaccgugcacaauau

SEQ ID NO: 1911351 - RNA, 18 nt, Shigella flexneri 2a str. 2457T
auaccgugcacaauauuu

SEQ ID NO: 1911352 - RNA, 14 nt, Shigella flexneri 2a str. 2457T
auacgccucacagg

SEQ ID NO: 1911353 - RNA, 19 nt, Shigella flexneri 2a str. 2457T
auacgccucacagggcucu

SEQ ID NO: 1911354 - RNA, 17 nt, Shigella flexneri 2a str. 2457T
auacgaccguuccauuc

SEQ ID NO: 1911355 - RNA, 15 nt, Shigella flexneri 2a str. 2457T
auacgcucgaacagc

SEQ ID NO: 1911356 - RNA, 14 nt, Shigella flexneri 2a str. 2457T
auacgcugaaaguu

SEQ ID NO: 1911357 - RNA, 16 nt, Shigella flexneri 2a str. 2457T
auacgcuggcugaaca

SEQ ID NO: 1911358 - RNA, 19 nt, Shigella flexneri 2a str. 2457T
auacggacaguauaacgaa

SEQ ID NO: 1911359 - RNA, 15 nt, Shigella flexneri 2a str. 2457T
auagcaacagcagcc

SEQ ID NO: 1911360 - RNA, 18 nt, Shigella flexneri 2a str. 2457T
auagcaacagcagccaac

SEQ ID NO: 1911361 - RNA, 19 nt, Shigella flexneri 2a str. 2457T
auagcaaaguaauaaugau

SEQ ID NO: 1911362 - RNA, 20 nt, Shigella flexneri 2a str. 2457T
auagauuuuuaaugcuuuuu

SEQ ID NO: 1911363 - RNA, 23 nt, Shigella flexneri 2a str. 2457T
auagccgcccccgacuccagcag

SEQ ID NO: 1911364 - RNA, 17 nt, Shigella flexneri 2a str. 2457T
auagauaucaugcucug

SEQ ID NO: 1911365 - RNA, 20 nt, Shigella flexneri 2a str. 2457T
auagaucagacgacaaucaa

SEQ ID NO: 1911366 - RNA, 19 nt, Shigella flexneri 2a str. 2457T
auagacaucuuuauaugca

SEQ ID NO: 1911367 - RNA, 12 nt, Shigella flexneri 2a str. 2457T
auagaccauugc

SEQ ID NO: 1911368 - RNA, 13 nt, Shigella flexneri 2a str. 2457T
auacuuauuauga

SEQ ID NO: 1911369 - RNA, 16 nt, Shigella flexneri 2a str. 2457T
auacuucaauauaugc

SEQ ID NO: 1911370 - RNA, 19 nt, Shigella flexneri 2a str. 2457T
auagaaacucauaugcagc

SEQ ID NO: 1911371 - RNA, 20 nt, Shigella flexneri 2a str. 2457T
auacuguuuaucuucccagc

SEQ ID NO: 1911372 - RNA, 21 nt, Shigella flexneri 2a str. 2457T
auacuuaaccccagaccaauc

SEQ ID NO: 1911373 - RNA, 17 nt, Shigella flexneri 2a str. 2457T
auacuuauaagcucaau

SEQ ID NO: 1911374 - RNA, 13 nt, Shigella flexneri 2a str. 2457T
auagaauggcguu

SEQ ID NO: 1911375 - RNA, 19 nt, Shigella flexneri 2a str. 2457T
auagaauggcguugggugc

SEQ ID NO: 1911376 - RNA, 17 nt, Shigella flexneri 2a str. 2457T
auagaaagugacagccc

SEQ ID NO: 1911377 - RNA, 15 nt, Shigella flexneri 2a str. 2457T
auagaaagugacugc

SEQ ID NO: 1911378 - RNA, 13 nt, Shigella flexneri 2a str. 2457T
auagaacggcaga

SEQ ID NO: 1911379 - RNA, 18 nt, Shigella flexneri 2a str. 2457T
auagaacaguuacgcaga

SEQ ID NO: 1911380 - RNA, 22 nt, Shigella flexneri 2a str. 2457T
aguuuggucuggcaaaaauaag

SEQ ID NO: 1911381 - RNA, 18 nt, Shigella flexneri 2a str. 2457T
aguuuggugagaacacca

SEQ ID NO: 1911382 - RNA, 22 nt, Shigella flexneri 2a str. 2457T
aguuuuauacucagucaggcuu

SEQ ID NO: 1911383 - RNA, 16 nt, Shigella flexneri 2a str. 2457T
aguuugccguugaucu

SEQ ID NO: 1911384 - RNA, 21 nt, Shigella flexneri 2a str. 2457T
aguuugccuucacaggccgcc

SEQ ID NO: 1911385 - RNA, 21 nt, Shigella flexneri 2a str. 2457T
aguuucauaucugccagauaa

SEQ ID NO: 1911386 - RNA, 16 nt, Shigella flexneri 2a str. 2457T
aguuucagccucugcc

SEQ ID NO: 1911387 - RNA, 16 nt, Shigella flexneri 2a str. 2457T
aguuucagccccauca

SEQ ID NO: 1911388 - RNA, 17 nt, Shigella flexneri 2a str. 2457T
aguuucagccccaucaa

SEQ ID NO: 1911389 - RNA, 17 nt, Shigella flexneri 2a str. 2457T
aguuucaccagcaguaa

SEQ ID NO: 1911390 - RNA, 18 nt, Shigella flexneri 2a str. 2457T
aguuucaccagcaguaaa

SEQ ID NO: 1911391 - RNA, 18 nt, Shigella flexneri 2a str. 2457T
aguuuucacccuuucguu

SEQ ID NO: 1911392 - RNA, 17 nt, Shigella flexneri 2a str. 2457T
aguuuuucaucccucuc

SEQ ID NO: 1911393 - RNA, 23 nt, Shigella flexneri 2a str. 2457T
aguuuuugcaaucagauaaaaua

SEQ ID NO: 1911394 - RNA, 15 nt, Shigella flexneri 2a str. 2457T
aguuggggaaaaguu

SEQ ID NO: 1911395 - RNA, 16 nt, Shigella flexneri 2a str. 2457T
aguuggggaaaaguug

SEQ ID NO: 1911396 - RNA, 12 nt, Shigella flexneri 2a str. 2457T
aguugccacccg

SEQ ID NO: 1911397 - RNA, 14 nt, Shigella flexneri 2a str. 2457T
aguugcgccaguag

SEQ ID NO: 1911398 - RNA, 17 nt, Shigella flexneri 2a str. 2457T
aguugcauuccagucca

SEQ ID NO: 1911399 - RNA, 18 nt, Shigella flexneri 2a str. 2457T
aguugccaucaucaccag

SEQ ID NO: 1911400 - RNA, 20 nt, Shigella flexneri 2a str. 2457T
aguugccaucaucaccagaa

SEQ ID NO: 1911401 - RNA, 18 nt, Shigella flexneri 2a str. 2457T
aguugagguuuuugacga

SEQ ID NO: 1911402 - RNA, 21 nt, Shigella flexneri 2a str. 2457T
aguugagcaguccccacauca

SEQ ID NO: 1911403 - RNA, 23 nt, Shigella flexneri 2a str. 2457T
aguuguaaucauauuaaauuuuu

SEQ ID NO: 1911404 - RNA, 20 nt, Shigella flexneri 2a str. 2457T
aguugucgauaaacaguuuc

SEQ ID NO: 1911405 - RNA, 17 nt, Shigella flexneri 2a str. 2457T
aguuguccaugugcugg

SEQ ID NO: 1911406 - RNA, 14 nt, Shigella flexneri 2a str. 2457T
aguuguaugcguuu

SEQ ID NO: 1911407 - RNA, 19 nt, Shigella flexneri 2a str. 2457T
aguuggggccagcauucca

SEQ ID NO: 1911408 - RNA, 14 nt, Shigella flexneri 2a str. 2457T
aguuuauccagcca

SEQ ID NO: 1911409 - RNA, 16 nt, Shigella flexneri 2a str. 2457T
aguuuacgcagcagau

SEQ ID NO: 1911410 - RNA, 20 nt, Shigella flexneri 2a str. 2457T
aguuaaccugaaaccggaaa

SEQ ID NO: 1911411 - RNA, 13 nt, Shigella flexneri 2a str. 2457T
aguuaagcaaaaa

SEQ ID NO: 1911412 - RNA, 20 nt, Shigella flexneri 2a str. 2457T
aguuaaccaaaaauuuccac

SEQ ID NO: 1911413 - RNA, 23 nt, Shigella flexneri 2a str. 2457T
aguuaauucugagagcaugaaau

SEQ ID NO: 1911414 - RNA, 23 nt, Shigella flexneri 2a str. 2457T
aguucacuugugcuguguggccu

SEQ ID NO: 1911415 - RNA, 12 nt, Shigella flexneri 2a str. 2457T
aguucacugccg

SEQ ID NO: 1911416 - RNA, 22 nt, Shigella flexneri 2a str. 2457T
aguucagaagcugaagcagaaa

SEQ ID NO: 1911417 - RNA, 20 nt, Shigella flexneri 2a str. 2457T
aguucacgcagguuagaaua

SEQ ID NO: 1911418 - RNA, 19 nt, Shigella flexneri 2a str. 2457T
aguucacaccagccaccgc

SEQ ID NO: 1911419 - RNA, 18 nt, Shigella flexneri 2a str. 2457T
aguuauuucauaaaucaa

SEQ ID NO: 1911420 - RNA, 19 nt, Shigella flexneri 2a str. 2457T
aguuacauuuuaauaauga

SEQ ID NO: 1911421 - RNA, 13 nt, Shigella flexneri 2a str. 2457T
aguuacacaucau

SEQ ID NO: 1911422 - RNA, 17 nt, Shigella flexneri 2a str. 2457T
aguuacagcucucacuu

SEQ ID NO: 1911423 - RNA, 20 nt, Shigella flexneri 2a str. 2457T
aguucuuucucugcaaauau

SEQ ID NO: 1911424 - RNA, 23 nt, Shigella flexneri 2a str. 2457T
aguucuuuuauuguuaaguuuau

SEQ ID NO: 1911425 - RNA, 20 nt, Shigella flexneri 2a str. 2457T
aguucuucgguggucauuuu

SEQ ID NO: 1911426 - RNA, 14 nt, Shigella flexneri 2a str. 2457T
aguucgcuuuccgu

SEQ ID NO: 1911427 - RNA, 18 nt, Shigella flexneri 2a str. 2457T
aguucuacaaucugcccg

SEQ ID NO: 1911428 - RNA, 14 nt, Shigella flexneri 2a str. 2457T
aguuccggcaucga

SEQ ID NO: 1911429 - RNA, 14 nt, Shigella flexneri 2a str. 2457T
aguuccggguuuuc

SEQ ID NO: 1911430 - RNA, 17 nt, Shigella flexneri 2a str. 2457T
aguuccgggaucaccag

SEQ ID NO: 1911431 - RNA, 22 nt, Shigella flexneri 2a str. 2457T
aguuccgggaucugauucugau

SEQ ID NO: 1911432 - RNA, 12 nt, Shigella flexneri 2a str. 2457T
aguucaucaacg

SEQ ID NO: 1911433 - RNA, 14 nt, Shigella flexneri 2a str. 2457T
aguucagcggcuga

SEQ ID NO: 1911434 - RNA, 19 nt, Shigella flexneri 2a str. 2457T
aguucaguaugaucuugcc

SEQ ID NO: 1911435 - RNA, 13 nt, Shigella flexneri 2a str. 2457T
aguucccccugcc

SEQ ID NO: 1911436 - RNA, 22 nt, Shigella flexneri 2a str. 2457T
aguucaugauuuaaaugaagau

SEQ ID NO: 1911437 - RNA, 16 nt, Shigella flexneri 2a str. 2457T
aguucauccccucuuc

SEQ ID NO: 1911438 - RNA, 17 nt, Shigella flexneri 2a str. 2457T
aguucauccccucuucc

SEQ ID NO: 1911439 - RNA, 21 nt, Shigella flexneri 2a str. 2457T
auaaaaauccgccagaaauca

SEQ ID NO: 1911440 - RNA, 13 nt, Shigella flexneri 2a str. 2457T
auaaaacagggcg

SEQ ID NO: 1911441 - RNA, 10 nt, Shigella flexneri 2a str. 2457T
auaaaacauc

SEQ ID NO: 1911442 - RNA, 22 nt, Shigella flexneri 2a str. 2457T
auaaaacaacggaacgaaaaaa

SEQ ID NO: 1911443 - RNA, 19 nt, Shigella flexneri 2a str. 2457T
auaaaacgcagucuuccca

SEQ ID NO: 1911444 - RNA, 21 nt, Shigella flexneri 2a str. 2457T
auaaaacgcagucuucccagc

SEQ ID NO: 1911445 - RNA, 15 nt, Shigella flexneri 2a str. 2457T
auaaaacgccugaua

SEQ ID NO: 1911446 - RNA, 21 nt, Shigella flexneri 2a str. 2457T
auaaaacguugucaguucuuu

SEQ ID NO: 1911447 - RNA, 22 nt, Shigella flexneri 2a str. 2457T
auaaaauaaccaaauaaaauaa

SEQ ID NO: 1911448 - RNA, 12 nt, Shigella flexneri 2a str. 2457T
auaaaacuuccc

SEQ ID NO: 1911449 - RNA, 13 nt, Shigella flexneri 2a str. 2457T
auaaaagaaaaaa

SEQ ID NO: 1911450 - RNA, 17 nt, Shigella flexneri 2a str. 2457T
auaaaagauaguaagau

SEQ ID NO: 1911451 - RNA, 22 nt, Shigella flexneri 2a str. 2457T
auaaaagauaguaagauuauau

SEQ ID NO: 1911452 - RNA, 19 nt, Shigella flexneri 2a str. 2457T
auaaaauggccguaauaga

SEQ ID NO: 1911453 - RNA, 17 nt, Shigella flexneri 2a str. 2457T
auaaaaugaguuuuuuu

SEQ ID NO: 1911454 - RNA, 22 nt, Shigella flexneri 2a str. 2457T
auaaacgccauauucugaucgu

SEQ ID NO: 1911455 - RNA, 20 nt, Shigella flexneri 2a str. 2457T
auaaacgcgaccgccgccaa

SEQ ID NO: 1911456 - RNA, 11 nt, Shigella flexneri 2a str. 2457T
auaaacagcag

SEQ ID NO: 1911457 - RNA, 12 nt, Shigella flexneri 2a str. 2457T
auaaacagcagg

SEQ ID NO: 1911458 - RNA, 15 nt, Shigella flexneri 2a str. 2457T
auaaacagcguaaau

SEQ ID NO: 1911459 - RNA, 23 nt, Shigella flexneri 2a str. 2457T
auaaacaucagcuauucuuauaa

SEQ ID NO: 1911460 - RNA, 23 nt, Shigella flexneri 2a str. 2457T
auaaaguguugagcuuuauccug

SEQ ID NO: 1911461 - RNA, 19 nt, Shigella flexneri 2a str. 2457T
auaaaguuagagccaggga

SEQ ID NO: 1911462 - RNA, 22 nt, Shigella flexneri 2a str. 2457T
auaaagacguuaacuacaauca

SEQ ID NO: 1911463 - RNA, 14 nt, Shigella flexneri 2a str. 2457T
auaaauaaaaagag

SEQ ID NO: 1911464 - RNA, 13 nt, Shigella flexneri 2a str. 2457T
auaaauaaaaauu

SEQ ID NO: 1911465 - RNA, 18 nt, Shigella flexneri 2a str. 2457T
auaaauacuccauaacua

SEQ ID NO: 1911466 - RNA, 20 nt, Shigella flexneri 2a str. 2457T
auaaauauaaucaacaugau

SEQ ID NO: 1911467 - RNA, 15 nt, Shigella flexneri 2a str. 2457T
auaaauaucaaagac

SEQ ID NO: 1911468 - RNA, 20 nt, Shigella flexneri 2a str. 2457T
auaaauauauaaaaaaacaa

SEQ ID NO: 1911469 - RNA, 20 nt, Shigella flexneri 2a str. 2457T
auaaauucccgcagauaaau

SEQ ID NO: 1911470 - RNA, 15 nt, Shigella flexneri 2a str. 2457T
auaaaugccgcaaug

SEQ ID NO: 1911471 - RNA, 11 nt, Shigella flexneri 2a str. 2457T
auaaaucagau

SEQ ID NO: 1911472 - RNA, 10 nt, Shigella flexneri 2a str. 2457T
auaaaucccg

SEQ ID NO: 1911473 - RNA, 23 nt, Shigella flexneri 2a str. 2457T
auaaccacguucauuucauacag

SEQ ID NO: 1911474 - RNA, 21 nt, Shigella flexneri 2a str. 2457T
auaaccagcguuuccagcacc

SEQ ID NO: 1911475 - RNA, 18 nt, Shigella flexneri 2a str. 2457T
auaaccugaauauuagua

SEQ ID NO: 1911476 - RNA, 10 nt, Shigella flexneri 2a str. 2457T
auaaccaucg

SEQ ID NO: 1911477 - RNA, 15 nt, Shigella flexneri 2a str. 2457T
auaacgaucucuuuc

SEQ ID NO: 1911478 - RNA, 22 nt, Shigella flexneri 2a str. 2457T
auaacgccaauucauuccuuga

SEQ ID NO: 1911479 - RNA, 16 nt, Shigella flexneri 2a str. 2457T
auaaauuucugccauu

SEQ ID NO: 1911480 - RNA, 21 nt, Shigella flexneri 2a str. 2457T
auaacaggauuuucuaauauu

SEQ ID NO: 1911481 - RNA, 19 nt, Shigella flexneri 2a str. 2457T
auaacaauacaucuuuuca

SEQ ID NO: 1911482 - RNA, 22 nt, Shigella flexneri 2a str. 2457T
agucgucugucgggaacacuuu

SEQ ID NO: 1911483 - RNA, 14 nt, Shigella flexneri 2a str. 2457T
agucggugccaugg

SEQ ID NO: 1911484 - RNA, 12 nt, Shigella flexneri 2a str. 2457T
agucguaaacaa

SEQ ID NO: 1911485 - RNA, 18 nt, Shigella flexneri 2a str. 2457T
agugaaaaccggacugaa

SEQ ID NO: 1911486 - RNA, 17 nt, Shigella flexneri 2a str. 2457T
agugaaacacaugguuu

SEQ ID NO: 1911487 - RNA, 22 nt, Shigella flexneri 2a str. 2457T
agugagcuuuguucaugccgga

SEQ ID NO: 1911488 - RNA, 15 nt, Shigella flexneri 2a str. 2457T
agugaauacagaaca

SEQ ID NO: 1911489 - RNA, 16 nt, Shigella flexneri 2a str. 2457T
agugaauacagaacag

SEQ ID NO: 1911490 - RNA, 18 nt, Shigella flexneri 2a str. 2457T
agugaauauuuaaccuga

SEQ ID NO: 1911491 - RNA, 22 nt, Shigella flexneri 2a str. 2457T
agugauccagggcaaauugcau

SEQ ID NO: 1911492 - RNA, 18 nt, Shigella flexneri 2a str. 2457T
agugaugccauacuucau

SEQ ID NO: 1911493 - RNA, 13 nt, Shigella flexneri 2a str. 2457T
agugaugcgcagg

SEQ ID NO: 1911494 - RNA, 19 nt, Shigella flexneri 2a str. 2457T
agugauuaacgcuuguaaa

SEQ ID NO: 1911495 - RNA, 17 nt, Shigella flexneri 2a str. 2457T
agugauuaacuguucug

SEQ ID NO: 1911496 - RNA, 23 nt, Shigella flexneri 2a str. 2457T
agugcaacgugacucaauggcau

SEQ ID NO: 1911497 - RNA, 13 nt, Shigella flexneri 2a str. 2457T
agugcaaauccac

SEQ ID NO: 1911498 - RNA, 14 nt, Shigella flexneri 2a str. 2457T
agugcaaaugccag

SEQ ID NO: 1911499 - RNA, 16 nt, Shigella flexneri 2a str. 2457T
agugcaaaugccagau

SEQ ID NO: 1911500 - RNA, 22 nt, Shigella flexneri 2a str. 2457T
agugcaaaugccagauaagaca

SEQ ID NO: 1911501 - RNA, 17 nt, Shigella flexneri 2a str. 2457T
agugcaaucaguggugu

SEQ ID NO: 1911502 - RNA, 18 nt, Shigella flexneri 2a str. 2457T
agugcaaucaguggugua

SEQ ID NO: 1911503 - RNA, 22 nt, Shigella flexneri 2a str. 2457T
agugccaugccaaucagcagaa

SEQ ID NO: 1911504 - RNA, 18 nt, Shigella flexneri 2a str. 2457T
agugcugcuuuugcuucu

SEQ ID NO: 1911505 - RNA, 19 nt, Shigella flexneri 2a str. 2457T
agugcuuucugaacugaac

SEQ ID NO: 1911506 - RNA, 17 nt, Shigella flexneri 2a str. 2457T
agugcuuucagcgaaaa

SEQ ID NO: 1911507 - RNA, 18 nt, Shigella flexneri 2a str. 2457T
agugcuuucugaacugaa

SEQ ID NO: 1911508 - RNA, 17 nt, Shigella flexneri 2a str. 2457T
agugcgcucuucaacuu

SEQ ID NO: 1911509 - RNA, 14 nt, Shigella flexneri 2a str. 2457T
agugccgaagaaca

SEQ ID NO: 1911510 - RNA, 18 nt, Shigella flexneri 2a str. 2457T
agugcggcagcggcuuca

SEQ ID NO: 1911511 - RNA, 17 nt, Shigella flexneri 2a str. 2457T
agugcgguaaauuuuuu

SEQ ID NO: 1911512 - RNA, 18 nt, Shigella flexneri 2a str. 2457T
agucauugagcuucucga

SEQ ID NO: 1911513 - RNA, 15 nt, Shigella flexneri 2a str. 2457T
agucauuccggcccc

SEQ ID NO: 1911514 - RNA, 16 nt, Shigella flexneri 2a str. 2457T
agucaugcgagaagca

SEQ ID NO: 1911515 - RNA, 20 nt, Shigella flexneri 2a str. 2457T
agucauguuguuccuuuuau

SEQ ID NO: 1911516 - RNA, 15 nt, Shigella flexneri 2a str. 2457T
agucaucagucugag

SEQ ID NO: 1911517 - RNA, 20 nt, Shigella flexneri 2a str. 2457T
agucaucaguugcaccugau

SEQ ID NO: 1911518 - RNA, 12 nt, Shigella flexneri 2a str. 2457T
agucaucaucag

SEQ ID NO: 1911519 - RNA, 16 nt, Shigella flexneri 2a str. 2457T
agucaucgcuuucgga

SEQ ID NO: 1911520 - RNA, 14 nt, Shigella flexneri 2a str. 2457T
agucaucaguugca

SEQ ID NO: 1911521 - RNA, 20 nt, Shigella flexneri 2a str. 2457T
agucauccuuaaagaaaaag

SEQ ID NO: 1911522 - RNA, 14 nt, Shigella flexneri 2a str. 2457T
aguccccaguaauc

SEQ ID NO: 1911523 - RNA, 15 nt, Shigella flexneri 2a str. 2457T
aguccccacaucacu

SEQ ID NO: 1911524 - RNA, 23 nt, Shigella flexneri 2a str. 2457T
aguccccacgccauaccugcaca

SEQ ID NO: 1911525 - RNA, 19 nt, Shigella flexneri 2a str. 2457T
aguccaggcugcaaagucu

SEQ ID NO: 1911526 - RNA, 16 nt, Shigella flexneri 2a str. 2457T
aguccaggcugcaaag

SEQ ID NO: 1911527 - RNA, 15 nt, Shigella flexneri 2a str. 2457T
aguccaaaagguccu

SEQ ID NO: 1911528 - RNA, 16 nt, Shigella flexneri 2a str. 2457T
aguccaaaagguccuu

SEQ ID NO: 1911529 - RNA, 17 nt, Shigella flexneri 2a str. 2457T
aguccagcgccugaaau

SEQ ID NO: 1911530 - RNA, 14 nt, Shigella flexneri 2a str. 2457T
aguccagcgccuga

SEQ ID NO: 1911531 - RNA, 15 nt, Shigella flexneri 2a str. 2457T
aguccagcgccugaa

SEQ ID NO: 1911532 - RNA, 24 nt, Shigella flexneri 2a str. 2457T
aguccagccccgcgcggcgcaggc

SEQ ID NO: 1911533 - RNA, 22 nt, Shigella flexneri 2a str. 2457T
aguccagacuccgagaaucaua

SEQ ID NO: 1911534 - RNA, 21 nt, Shigella flexneri 2a str. 2457T
aguccuguugucuuuccagac

SEQ ID NO: 1911535 - RNA, 22 nt, Shigella flexneri 2a str. 2457T
agucgaugaugcagccagugau

SEQ ID NO: 1911536 - RNA, 15 nt, Shigella flexneri 2a str. 2457T
aguccuguugucuuu

SEQ ID NO: 1911537 - RNA, 19 nt, Shigella flexneri 2a str. 2457T
agucgcuccugccacauau

SEQ ID NO: 1911538 - RNA, 16 nt, Shigella flexneri 2a str. 2457T
agucgggaccagcauu

SEQ ID NO: 1911539 - RNA, 20 nt, Shigella flexneri 2a str. 2457T
agucgggucgccguaagcaa

SEQ ID NO: 1911540 - RNA, 13 nt, Shigella flexneri 2a str. 2457T
agucggucacagu

SEQ ID NO: 1911541 - RNA, 13 nt, Shigella flexneri 2a str. 2457T
agucggggccagc

SEQ ID NO: 1911542 - RNA, 16 nt, Shigella flexneri 2a str. 2457T
agucggggccagcauu

SEQ ID NO: 1911543 - RNA, 19 nt, Shigella flexneri 2a str. 2457T
agucggggccagcauucca

SEQ ID NO: 1911544 - RNA, 21 nt, Shigella flexneri 2a str. 2457T
agucccgcgacaaucgccccc

SEQ ID NO: 1911545 - RNA, 14 nt, Shigella flexneri 2a str. 2457T
agucccggcaagau

SEQ ID NO: 1911546 - RNA, 18 nt, Shigella flexneri 2a str. 2457T
agucccguacccagcaag

SEQ ID NO: 1911547 - RNA, 18 nt, Shigella flexneri 2a str. 2457T
agucccggcaagauucca

SEQ ID NO: 1911548 - RNA, 14 nt, Shigella flexneri 2a str. 2457T
agucccuuucaggu

SEQ ID NO: 1911549 - RNA, 20 nt, Shigella flexneri 2a str. 2457T
aguccugaccgucaccccau

SEQ ID NO: 1911550 - RNA, 16 nt, Shigella flexneri 2a str. 2457T
aguccugagucagaaa

SEQ ID NO: 1911551 - RNA, 14 nt, Shigella flexneri 2a str. 2457T
aguccgccuucaac

SEQ ID NO: 1911552 - RNA, 18 nt, Shigella flexneri 2a str. 2457T
aguauucgcuccccugca

SEQ ID NO: 1911553 - RNA, 22 nt, Shigella flexneri 2a str. 2457T
aguauugucuccgcugagacgc

SEQ ID NO: 1911554 - RNA, 19 nt, Shigella flexneri 2a str. 2457T
aguauuaucugggcugccu

SEQ ID NO: 1911555 - RNA, 16 nt, Shigella flexneri 2a str. 2457T
aguauuaagccaguuc

SEQ ID NO: 1911556 - RNA, 22 nt, Shigella flexneri 2a str. 2457T
aguauuaagccaguucucacca

SEQ ID NO: 1911557 - RNA, 14 nt, Shigella flexneri 2a str. 2457T
aguaucuauucauc

SEQ ID NO: 1911558 - RNA, 17 nt, Shigella flexneri 2a str. 2457T
aguaucugacagcaaau

SEQ ID NO: 1911559 - RNA, 16 nt, Shigella flexneri 2a str. 2457T
aguaugagcaaacaau

SEQ ID NO: 1911560 - RNA, 21 nt, Shigella flexneri 2a str. 2457T
aguaugauacguuuauuacca

SEQ ID NO: 1911561 - RNA, 22 nt, Shigella flexneri 2a str. 2457T
aguauccaugcgcauuaagcca

SEQ ID NO: 1911562 - RNA, 12 nt, Shigella flexneri 2a str. 2457T
aguaucaccauc

SEQ ID NO: 1911563 - RNA, 22 nt, Shigella flexneri 2a str. 2457T
aguauccacacagacaauaaac

SEQ ID NO: 1911564 - RNA, 14 nt, Shigella flexneri 2a str. 2457T
agucacaaacauca

SEQ ID NO: 1911565 - RNA, 16 nt, Shigella flexneri 2a str. 2457T
agucaccugcggugca

SEQ ID NO: 1911566 - RNA, 16 nt, Shigella flexneri 2a str. 2457T
agucacgacaaagaca

SEQ ID NO: 1911567 - RNA, 15 nt, Shigella flexneri 2a str. 2457T
agucaauuucugcaa

SEQ ID NO: 1911568 - RNA, 17 nt, Shigella flexneri 2a str. 2457T
agucaccgcccagugca

SEQ ID NO: 1911569 - RNA, 12 nt, Shigella flexneri 2a str. 2457T
agucacaucagc

SEQ ID NO: 1911570 - RNA, 14 nt, Shigella flexneri 2a str. 2457T
agucaccagcauca

SEQ ID NO: 1911571 - RNA, 21 nt, Shigella flexneri 2a str. 2457T
agucaaaaugcccgaucuagg

SEQ ID NO: 1911572 - RNA, 18 nt, Shigella flexneri 2a str. 2457T
agucagugguuugcccuu

SEQ ID NO: 1911573 - RNA, 14 nt, Shigella flexneri 2a str. 2457T
agucaguuaagcaa

SEQ ID NO: 1911574 - RNA, 17 nt, Shigella flexneri 2a str. 2457T
agucagucucaagggag

SEQ ID NO: 1911575 - RNA, 21 nt, Shigella flexneri 2a str. 2457T
agucaguguuaucaaaucacc

SEQ ID NO: 1911576 - RNA, 15 nt, Shigella flexneri 2a str. 2457T
agucagcucucagcc

SEQ ID NO: 1911577 - RNA, 15 nt, Shigella flexneri 2a str. 2457T
agucagcccaacaaa

SEQ ID NO: 1911578 - RNA, 16 nt, Shigella flexneri 2a str. 2457T
agucagcgaacaccag

SEQ ID NO: 1911579 - RNA, 23 nt, Shigella flexneri 2a str. 2457T
agucacguuguaccacugguuga

SEQ ID NO: 1911580 - RNA, 17 nt, Shigella flexneri 2a str. 2457T
aguauauaaaaaacaau

SEQ ID NO: 1911581 - RNA, 14 nt, Shigella flexneri 2a str. 2457T
aguauagcggcaug

SEQ ID NO: 1911582 - RNA, 17 nt, Shigella flexneri 2a str. 2457T
aguauacgccacaucau

SEQ ID NO: 1911583 - RNA, 14 nt, Shigella flexneri 2a str. 2457T
aguauaaguaauga

SEQ ID NO: 1911584 - RNA, 15 nt, Shigella flexneri 2a str. 2457T
aguaguuccagcaug

SEQ ID NO: 1911585 - RNA, 14 nt, Shigella flexneri 2a str. 2457T
aguagucuuaguug

SEQ ID NO: 1911586 - RNA, 19 nt, Shigella flexneri 2a str. 2457T
aguagcgucgccagcaguu

SEQ ID NO: 1911587 - RNA, 12 nt, Shigella flexneri 2a str. 2457T
aguagcggguga

SEQ ID NO: 1911588 - RNA, 14 nt, Shigella flexneri 2a str. 2457T
aguagccauuugau

SEQ ID NO: 1911589 - RNA, 15 nt, Shigella flexneri 2a str. 2457T
aguagccaguaccac

SEQ ID NO: 1911590 - RNA, 20 nt, Shigella flexneri 2a str. 2457T
aguagcccaccuacaccggc

SEQ ID NO: 1911591 - RNA, 17 nt, Shigella flexneri 2a str. 2457T
aguagauucaacauaau

SEQ ID NO: 1911592 - RNA, 15 nt, Shigella flexneri 2a str. 2457T
aguagaaauuauuuc

SEQ ID NO: 1911593 - RNA, 14 nt, Shigella flexneri 2a str. 2457T
aguacuuuggaagu

SEQ ID NO: 1911594 - RNA, 18 nt, Shigella flexneri 2a str. 2457T
aguacuuuggaaguauaa

SEQ ID NO: 1911595 - RNA, 23 nt, Shigella flexneri 2a str. 2457T
aguacugugaaccucgaucagag

SEQ ID NO: 1911596 - RNA, 20 nt, Shigella flexneri 2a str. 2457T
aguacgcccacgccagccug

SEQ ID NO: 1911597 - RNA, 21 nt, Shigella flexneri 2a str. 2457T
aguacgcccacgccagccugc

SEQ ID NO: 1911598 - RNA, 13 nt, Shigella flexneri 2a str. 2457T
aguacggcagcaa

SEQ ID NO: 1911599 - RNA, 19 nt, Shigella flexneri 2a str. 2457T
aguacgcguacacuuuccu

SEQ ID NO: 1911600 - RNA, 22 nt, Shigella flexneri 2a str. 2457T
aguaccuguauaaacuauccug

SEQ ID NO: 1911601 - RNA, 14 nt, Shigella flexneri 2a str. 2457T
aguacgaaauaacu

SEQ ID NO: 1911602 - RNA, 21 nt, Shigella flexneri 2a str. 2457T
aguaccugaccagugaauuuc

SEQ ID NO: 1911603 - RNA, 16 nt, Shigella flexneri 2a str. 2457T
agcuggcgauauuauc

SEQ ID NO: 1911604 - RNA, 22 nt, Shigella flexneri 2a str. 2457T
agcuggcgacgccucuauuaaa

SEQ ID NO: 1911605 - RNA, 14 nt, Shigella flexneri 2a str. 2457T
agcuggcaucagca

SEQ ID NO: 1911606 - RNA, 18 nt, Shigella flexneri 2a str. 2457T
agcuggcaucagcaaaca

SEQ ID NO: 1911607 - RNA, 16 nt, Shigella flexneri 2a str. 2457T
agcuggcauugauguu

SEQ ID NO: 1911608 - RNA, 16 nt, Shigella flexneri 2a str. 2457T
agccgucaccgccugc

SEQ ID NO: 1911609 - RNA, 13 nt, Shigella flexneri 2a str. 2457T
agccguauucuga

SEQ ID NO: 1911610 - RNA, 12 nt, Shigella flexneri 2a str. 2457T
agccguacugca

SEQ ID NO: 1911611 - RNA, 13 nt, Shigella flexneri 2a str. 2457T
agccucgccgagc

SEQ ID NO: 1911612 - RNA, 21 nt, Shigella flexneri 2a str. 2457T
agccugacgcccguuuucacc

SEQ ID NO: 1911613 - RNA, 14 nt, Shigella flexneri 2a str. 2457T
agccugcgcuucuu

SEQ ID NO: 1911614 - RNA, 12 nt, Shigella flexneri 2a str. 2457T
agccugccagag

SEQ ID NO: 1911615 - RNA, 14 nt, Shigella flexneri 2a str. 2457T
agccugaugaugag

SEQ ID NO: 1911616 - RNA, 19 nt, Shigella flexneri 2a str. 2457T
agccugauacaggaaggcc

SEQ ID NO: 1911617 - RNA, 22 nt, Shigella flexneri 2a str. 2457T
agccugcagugaaauuaaacug

SEQ ID NO: 1911618 - RNA, 19 nt, Shigella flexneri 2a str. 2457T
agccucccugccuccauga

SEQ ID NO: 1911619 - RNA, 15 nt, Shigella flexneri 2a str. 2457T
agccucaaauuccuu

SEQ ID NO: 1911620 - RNA, 19 nt, Shigella flexneri 2a str. 2457T
agccucacgguucauuagu

SEQ ID NO: 1911621 - RNA, 13 nt, Shigella flexneri 2a str. 2457T
agccuaccagacc

SEQ ID NO: 1911622 - RNA, 14 nt, Shigella flexneri 2a str. 2457T
agccuauaacgaaa

SEQ ID NO: 1911623 - RNA, 23 nt, Shigella flexneri 2a str. 2457T
agccuaagccauuuaacucaccg

SEQ ID NO: 1911624 - RNA, 18 nt, Shigella flexneri 2a str. 2457T
agccuaagccauuuaacu

SEQ ID NO: 1911625 - RNA, 14 nt, Shigella flexneri 2a str. 2457T
agccuacaaaaacu

SEQ ID NO: 1911626 - RNA, 22 nt, Shigella flexneri 2a str. 2457T
agccuaagaagucauuggcuga

SEQ ID NO: 1911627 - RNA, 17 nt, Shigella flexneri 2a str. 2457T
agcgaagcggcacugcu

SEQ ID NO: 1911628 - RNA, 14 nt, Shigella flexneri 2a str. 2457T
agcgaaggaucacc

SEQ ID NO: 1911629 - RNA, 21 nt, Shigella flexneri 2a str. 2457T
agcgaauaccgggcaguacca

SEQ ID NO: 1911630 - RNA, 13 nt, Shigella flexneri 2a str. 2457T
agcgaacaccagc

SEQ ID NO: 1911631 - RNA, 19 nt, Shigella flexneri 2a str. 2457T
agcgacaaacgccugaaca

SEQ ID NO: 1911632 - RNA, 20 nt, Shigella flexneri 2a str. 2457T
agcgacaggucagcgccugg

SEQ ID NO: 1911633 - RNA, 19 nt, Shigella flexneri 2a str. 2457T
agcgacagggccaggaauc

SEQ ID NO: 1911634 - RNA, 12 nt, Shigella flexneri 2a str. 2457T
agcgaauuuuuc

SEQ ID NO: 1911635 - RNA, 14 nt, Shigella flexneri 2a str. 2457T
agcgaauuccaguu

SEQ ID NO: 1911636 - RNA, 23 nt, Shigella flexneri 2a str. 2457T
agcgaauccagcaugcucaccac

SEQ ID NO: 1911637 - RNA, 16 nt, Shigella flexneri 2a str. 2457T
agcgacugcgccgugu

SEQ ID NO: 1911638 - RNA, 19 nt, Shigella flexneri 2a str. 2457T
agcgacucgguugcacaga

SEQ ID NO: 1911639 - RNA, 21 nt, Shigella flexneri 2a str. 2457T
agcgagggagaaaacccggcc

SEQ ID NO: 1911640 - RNA, 12 nt, Shigella flexneri 2a str. 2457T
agccuuucacuu

SEQ ID NO: 1911641 - RNA, 12 nt, Shigella flexneri 2a str. 2457T
agccuuucucag

SEQ ID NO: 1911642 - RNA, 13 nt, Shigella flexneri 2a str. 2457T
agcgaaacagcug

SEQ ID NO: 1911643 - RNA, 17 nt, Shigella flexneri 2a str. 2457T
agcgaaaguaacaccau

SEQ ID NO: 1911644 - RNA, 21 nt, Shigella flexneri 2a str. 2457T
agccuucgccuuucaguucaa

SEQ ID NO: 1911645 - RNA, 21 nt, Shigella flexneri 2a str. 2457T
agccuucgccaccguguucau

SEQ ID NO: 1911646 - RNA, 13 nt, Shigella flexneri 2a str. 2457T
agccuugccagau

SEQ ID NO: 1911647 - RNA, 18 nt, Shigella flexneri 2a str. 2457T
agccugcuucaaacgcug

SEQ ID NO: 1911648 - RNA, 16 nt, Shigella flexneri 2a str. 2457T
agccuggcuaagccac

SEQ ID NO: 1911649 - RNA, 18 nt, Shigella flexneri 2a str. 2457T
agccugugucaggccggc

SEQ ID NO: 1911650 - RNA, 19 nt, Shigella flexneri 2a str. 2457T
agccuguuccagacgcugc

SEQ ID NO: 1911651 - RNA, 16 nt, Shigella flexneri 2a str. 2457T
agccuuccuugugcaa

SEQ ID NO: 1911652 - RNA, 17 nt, Shigella flexneri 2a str. 2457T
agccgagguagaacccu

SEQ ID NO: 1911653 - RNA, 13 nt, Shigella flexneri 2a str. 2457T
agccgaucaggcu

SEQ ID NO: 1911654 - RNA, 13 nt, Shigella flexneri 2a str. 2457T
agccgcaaaccug

SEQ ID NO: 1911655 - RNA, 12 nt, Shigella flexneri 2a str. 2457T
agccgauuaaaa

SEQ ID NO: 1911656 - RNA, 17 nt, Shigella flexneri 2a str. 2457T
agccgcagccaucagcg

SEQ ID NO: 1911657 - RNA, 14 nt, Shigella flexneri 2a str. 2457T
agccgaccgcaagg

SEQ ID NO: 1911658 - RNA, 12 nt, Shigella flexneri 2a str. 2457T
agcccuucacgc

SEQ ID NO: 1911659 - RNA, 18 nt, Shigella flexneri 2a str. 2457T
agcccuggcucugcacua

SEQ ID NO: 1911660 - RNA, 12 nt, Shigella flexneri 2a str. 2457T
agcccuuucuuu

SEQ ID NO: 1911661 - RNA, 18 nt, Shigella flexneri 2a str. 2457T
agccgaaacggaaaucgc

SEQ ID NO: 1911662 - RNA, 14 nt, Shigella flexneri 2a str. 2457T
agccggacccacac

SEQ ID NO: 1911663 - RNA, 15 nt, Shigella flexneri 2a str. 2457T
agccggacccacacc

SEQ ID NO: 1911664 - RNA, 17 nt, Shigella flexneri 2a str. 2457T
agccgcuucugcagcuu

SEQ ID NO: 1911665 - RNA, 17 nt, Shigella flexneri 2a str. 2457T
agccggaguugcagauu

SEQ ID NO: 1911666 - RNA, 15 nt, Shigella flexneri 2a str. 2457T
agccggaguggggga

SEQ ID NO: 1911667 - RNA, 14 nt, Shigella flexneri 2a str. 2457T
agccggagcuucac

SEQ ID NO: 1911668 - RNA, 17 nt, Shigella flexneri 2a str. 2457T
agccgcgcuuucuucuu

SEQ ID NO: 1911669 - RNA, 17 nt, Shigella flexneri 2a str. 2457T
agccgcuaacagcagca

SEQ ID NO: 1911670 - RNA, 14 nt, Shigella flexneri 2a str. 2457T
agccgccagacaau

SEQ ID NO: 1911671 - RNA, 15 nt, Shigella flexneri 2a str. 2457T
agccgccaucucuuc

SEQ ID NO: 1911672 - RNA, 13 nt, Shigella flexneri 2a str. 2457T
agccgcccuguuu

SEQ ID NO: 1911673 - RNA, 12 nt, Shigella flexneri 2a str. 2457T
agccccagcacu

SEQ ID NO: 1911674 - RNA, 22 nt, Shigella flexneri 2a str. 2457T
agcccaucaccgcgaggccuaa

SEQ ID NO: 1911675 - RNA, 23 nt, Shigella flexneri 2a str. 2457T
agcccauaccacagcaaaacacc

SEQ ID NO: 1911676 - RNA, 22 nt, Shigella flexneri 2a str. 2457T
agcccaguaccgccagugcagc

SEQ ID NO: 1911677 - RNA, 19 nt, Shigella flexneri 2a str. 2457T
agcccaguucagcggcuga

SEQ ID NO: 1911678 - RNA, 20 nt, Shigella flexneri 2a str. 2457T
agcccaucaguacaccaccu

SEQ ID NO: 1911679 - RNA, 23 nt, Shigella flexneri 2a str. 2457T
agcccaucaguacaccaccuaac

SEQ ID NO: 1911680 - RNA, 17 nt, Shigella flexneri 2a str. 2457T
agcccacgccgcccaga

SEQ ID NO: 1911681 - RNA, 19 nt, Shigella flexneri 2a str. 2457T
agcccacgccgcccagaga

SEQ ID NO: 1911682 - RNA, 16 nt, Shigella flexneri 2a str. 2457T
agcccacaugccugca

SEQ ID NO: 1911683 - RNA, 11 nt, Shigella flexneri 2a str. 2457T
agcccagaaca

SEQ ID NO: 1911684 - RNA, 14 nt, Shigella flexneri 2a str. 2457T
agcccaaccaaagc

SEQ ID NO: 1911685 - RNA, 14 nt, Shigella flexneri 2a str. 2457T
agcccggucaucag

SEQ ID NO: 1911686 - RNA, 12 nt, Shigella flexneri 2a str. 2457T
agcccuaauaaa

SEQ ID NO: 1911687 - RNA, 16 nt, Shigella flexneri 2a str. 2457T
agcccucgacauguuc

SEQ ID NO: 1911688 - RNA, 18 nt, Shigella flexneri 2a str. 2457T
agcccucaccgaagcgag

SEQ ID NO: 1911689 - RNA, 23 nt, Shigella flexneri 2a str. 2457T
agcccgaaucaguaaugauucgg

SEQ ID NO: 1911690 - RNA, 22 nt, Shigella flexneri 2a str. 2457T
agccccgcgaacggggcugcca

SEQ ID NO: 1911691 - RNA, 22 nt, Shigella flexneri 2a str. 2457T
agcccgcugccgcagauauucc

SEQ ID NO: 1911692 - RNA, 22 nt, Shigella flexneri 2a str. 2457T
agcccgccuuugaucucaaacg

SEQ ID NO: 1911693 - RNA, 23 nt, Shigella flexneri 2a str. 2457T
agcgccaccagcgccgcgccacu

SEQ ID NO: 1911694 - RNA, 21 nt, Shigella flexneri 2a str. 2457T
agcgccacgcuguucgcaacc

SEQ ID NO: 1911695 - RNA, 21 nt, Shigella flexneri 2a str. 2457T
agcgccagaaguugcucaagc

SEQ ID NO: 1911696 - RNA, 20 nt, Shigella flexneri 2a str. 2457T
agcgccagaaguugcucaag

SEQ ID NO: 1911697 - RNA, 22 nt, Shigella flexneri 2a str. 2457T
agcgccagcaagagcaaauaaa

SEQ ID NO: 1911698 - RNA, 15 nt, Shigella flexneri 2a str. 2457T
agcgccagccauuca

SEQ ID NO: 1911699 - RNA, 13 nt, Shigella flexneri 2a str. 2457T
agcgccagcgaag

SEQ ID NO: 1911700 - RNA, 19 nt, Shigella flexneri 2a str. 2457T
agcgccagcgaagccagcu

SEQ ID NO: 1911701 - RNA, 23 nt, Shigella flexneri 2a str. 2457T
agcgccaucccuaccgcccgcgc

SEQ ID NO: 1911702 - RNA, 19 nt, Shigella flexneri 2a str. 2457T
agcgccaguugcucgacac

SEQ ID NO: 1911703 - RNA, 17 nt, Shigella flexneri 2a str. 2457T
agcgcauucggcaagau

SEQ ID NO: 1911704 - RNA, 22 nt, Shigella flexneri 2a str. 2457T
agcgcaugaucguucaccuaaa

SEQ ID NO: 1911705 - RNA, 15 nt, Shigella flexneri 2a str. 2457T
agcgcaucugccgga

SEQ ID NO: 1911706 - RNA, 16 nt, Shigella flexneri 2a str. 2457T
agcgccaccaccagca

SEQ ID NO: 1911707 - RNA, 20 nt, Shigella flexneri 2a str. 2457T
agcgccaccaccagcacacu

SEQ ID NO: 1911708 - RNA, 19 nt, Shigella flexneri 2a str. 2457T
agcgcauuuccaagauuaa

SEQ ID NO: 1911709 - RNA, 17 nt, Shigella flexneri 2a str. 2457T
agcgcagcgaguaaaaa

SEQ ID NO: 1911710 - RNA, 21 nt, Shigella flexneri 2a str. 2457T
agcgcaggaaagauaagcgaa

SEQ ID NO: 1911711 - RNA, 21 nt, Shigella flexneri 2a str. 2457T
agcgcaucaggcaaucuuguu

SEQ ID NO: 1911712 - RNA, 19 nt, Shigella flexneri 2a str. 2457T
agcgcaucaggcaauguug

SEQ ID NO: 1911713 - RNA, 18 nt, Shigella flexneri 2a str. 2457T
agcgcagucaccagcauc

SEQ ID NO: 1911714 - RNA, 14 nt, Shigella flexneri 2a str. 2457T
agcgcauaaaagcu

SEQ ID NO: 1911715 - RNA, 15 nt, Shigella flexneri 2a str. 2457T
agcgcauaagccacc

SEQ ID NO: 1911716 - RNA, 16 nt, Shigella flexneri 2a str. 2457T
agcgcauaagccaccu

SEQ ID NO: 1911717 - RNA, 17 nt, Shigella flexneri 2a str. 2457T
agcgcauaagccaccuc

SEQ ID NO: 1911718 - RNA, 21 nt, Shigella flexneri 2a str. 2457T
agcgaguuugaucucgaugcc

SEQ ID NO: 1911719 - RNA, 23 nt, Shigella flexneri 2a str. 2457T
agcgaguuugaucucgaugccgc

SEQ ID NO: 1911720 - RNA, 12 nt, Shigella flexneri 2a str. 2457T
agcgaguuuuuc

SEQ ID NO: 1911721 - RNA, 19 nt, Shigella flexneri 2a str. 2457T
agcgaguuuuucaguccac

SEQ ID NO: 1911722 - RNA, 14 nt, Shigella flexneri 2a str. 2457T
agcgaguugaucac

SEQ ID NO: 1911723 - RNA, 15 nt, Shigella flexneri 2a str. 2457T
agcgauaauuuaugc

SEQ ID NO: 1911724 - RNA, 20 nt, Shigella flexneri 2a str. 2457T
agcgauaacguguuccaguu

SEQ ID NO: 1911725 - RNA, 22 nt, Shigella flexneri 2a str. 2457T
agcgauauccagugccagaaug

SEQ ID NO: 1911726 - RNA, 22 nt, Shigella flexneri 2a str. 2457T
agcgaucauuagcccaauaauc

SEQ ID NO: 1911727 - RNA, 21 nt, Shigella flexneri 2a str. 2457T
agcgaugcccagugaccaaag

SEQ ID NO: 1911728 - RNA, 22 nt, Shigella flexneri 2a str. 2457T
agcgaugcugauguacccgcug

SEQ ID NO: 1911729 - RNA, 11 nt, Shigella flexneri 2a str. 2457T
agcgaugcugc

SEQ ID NO: 1911730 - RNA, 22 nt, Shigella flexneri 2a str. 2457T
agcgaugguacuucaaucgcca

SEQ ID NO: 1911731 - RNA, 16 nt, Shigella flexneri 2a str. 2457T
agcgauuaugaaacaa

SEQ ID NO: 1911732 - RNA, 13 nt, Shigella flexneri 2a str. 2457T
agcgauucagcac

SEQ ID NO: 1911733 - RNA, 23 nt, Shigella flexneri 2a str. 2457T
agcgaugguacuucaaucgccac

SEQ ID NO: 1911734 - RNA, 16 nt, Shigella flexneri 2a str. 2457T
agcgcagauagcccgg

SEQ ID NO: 1911735 - RNA, 14 nt, Shigella flexneri 2a str. 2457T
agcgcagacaccag

SEQ ID NO: 1911736 - RNA, 13 nt, Shigella flexneri 2a str. 2457T
agcgcagcaccca

SEQ ID NO: 1911737 - RNA, 11 nt, Shigella flexneri 2a str. 2457T
agcgcacaugc

SEQ ID NO: 1911738 - RNA, 20 nt, Shigella flexneri 2a str. 2457T
agcgcaccugaucagcaauc

SEQ ID NO: 1911739 - RNA, 12 nt, Shigella flexneri 2a str. 2457T
agcgcaccagaa

SEQ ID NO: 1911740 - RNA, 17 nt, Shigella flexneri 2a str. 2457T
agcgcaccagaaacaau

SEQ ID NO: 1911741 - RNA, 16 nt, Shigella flexneri 2a str. 2457T
agcgauuuaugauauu

SEQ ID NO: 1911742 - RNA, 19 nt, Shigella flexneri 2a str. 2457T
agcgauucucgccgcccug

SEQ ID NO: 1911743 - RNA, 15 nt, Shigella flexneri 2a str. 2457T
agcgcaaauugcugg

SEQ ID NO: 1911744 - RNA, 17 nt, Shigella flexneri 2a str. 2457T
agcgccgcuuuccaggc

SEQ ID NO: 1911745 - RNA, 22 nt, Shigella flexneri 2a str. 2457T
agcgccgggaaugccacgcaaa

SEQ ID NO: 1911746 - RNA, 23 nt, Shigella flexneri 2a str. 2457T
agcgccgucaguuuuucacccgc

SEQ ID NO: 1911747 - RNA, 14 nt, Shigella flexneri 2a str. 2457T
agcgccugcugcug

SEQ ID NO: 1911748 - RNA, 19 nt, Shigella flexneri 2a str. 2457T
agcgccguugcgcccauca

SEQ ID NO: 1911749 - RNA, 12 nt, Shigella flexneri 2a str. 2457T
agcgccuaaauc

SEQ ID NO: 1911750 - RNA, 17 nt, Shigella flexneri 2a str. 2457T
agcgccuaaauccaccg

SEQ ID NO: 1911751 - RNA, 16 nt, Shigella flexneri 2a str. 2457T
agcgccucaagcucgc

SEQ ID NO: 1911752 - RNA, 21 nt, Shigella flexneri 2a str. 2457T
agcgccucgucguuguucuac

SEQ ID NO: 1911753 - RNA, 15 nt, Shigella flexneri 2a str. 2457T
agcgcccgcuugcga

SEQ ID NO: 1911754 - RNA, 14 nt, Shigella flexneri 2a str. 2457T
agcgcccgccagca

SEQ ID NO: 1911755 - RNA, 17 nt, Shigella flexneri 2a str. 2457T
agcgccgccuccucaga

SEQ ID NO: 1911756 - RNA, 19 nt, Shigella flexneri 2a str. 2457T
agcgccgccuccucagaaa

SEQ ID NO: 1911757 - RNA, 14 nt, Shigella flexneri 2a str. 2457T
agcgccgccacugc

SEQ ID NO: 1911758 - RNA, 19 nt, Shigella flexneri 2a str. 2457T
agcgccgccacugccacca

SEQ ID NO: 1911759 - RNA, 23 nt, Shigella flexneri 2a str. 2457T
agcgcccugcaaugucaucagca

SEQ ID NO: 1911760 - RNA, 19 nt, Shigella flexneri 2a str. 2457T
agcgccgacagcagcccuu

SEQ ID NO: 1911761 - RNA, 22 nt, Shigella flexneri 2a str. 2457T
agcgccgaguaaaaaaacauca

SEQ ID NO: 1911762 - RNA, 14 nt, Shigella flexneri 2a str. 2457T
agcggagguaauaa

SEQ ID NO: 1911763 - RNA, 19 nt, Shigella flexneri 2a str. 2457T
agcggaucaguuccagcag

SEQ ID NO: 1911764 - RNA, 22 nt, Shigella flexneri 2a str. 2457T
agcggauacaggaagcgaauca

SEQ ID NO: 1911765 - RNA, 18 nt, Shigella flexneri 2a str. 2457T
agcgcgaagcuggcggcg

SEQ ID NO: 1911766 - RNA, 19 nt, Shigella flexneri 2a str. 2457T
agcgccuucuacagcuuca

SEQ ID NO: 1911767 - RNA, 15 nt, Shigella flexneri 2a str. 2457T
agcgccuuauccugc

SEQ ID NO: 1911768 - RNA, 23 nt, Shigella flexneri 2a str. 2457T
agcgcgugaccgaaauggagccg

SEQ ID NO: 1911769 - RNA, 19 nt, Shigella flexneri 2a str. 2457T
agcuauaaaccugcuggcg

SEQ ID NO: 1911770 - RNA, 13 nt, Shigella flexneri 2a str. 2457T
agcuaccagcccc

SEQ ID NO: 1911771 - RNA, 15 nt, Shigella flexneri 2a str. 2457T
agcuaaacagcccaa

SEQ ID NO: 1911772 - RNA, 20 nt, Shigella flexneri 2a str. 2457T
agcuaaacagcccaaucauc

SEQ ID NO: 1911773 - RNA, 16 nt, Shigella flexneri 2a str. 2457T
agcgugcauagcagca

SEQ ID NO: 1911774 - RNA, 15 nt, Shigella flexneri 2a str. 2457T
agcgugcaaauauac

SEQ ID NO: 1911775 - RNA, 17 nt, Shigella flexneri 2a str. 2457T
agcguucgccaaaccca

SEQ ID NO: 1911776 - RNA, 14 nt, Shigella flexneri 2a str. 2457T
agcgugacuggcag

SEQ ID NO: 1911777 - RNA, 15 nt, Shigella flexneri 2a str. 2457T
agcgucgccuggugu

SEQ ID NO: 1911778 - RNA, 18 nt, Shigella flexneri 2a str. 2457T
agcgugaaacaaaucacu

SEQ ID NO: 1911779 - RNA, 15 nt, Shigella flexneri 2a str. 2457T
agcgugacaccagca

SEQ ID NO: 1911780 - RNA, 21 nt, Shigella flexneri 2a str. 2457T
agcguugcccgauugguucag

SEQ ID NO: 1911781 - RNA, 15 nt, Shigella flexneri 2a str. 2457T
agcguuugcggcugu

SEQ ID NO: 1911782 - RNA, 13 nt, Shigella flexneri 2a str. 2457T
agcguuuucucaa

SEQ ID NO: 1911783 - RNA, 15 nt, Shigella flexneri 2a str. 2457T
agcguuuccagccag

SEQ ID NO: 1911784 - RNA, 18 nt, Shigella flexneri 2a str. 2457T
agcggcauaaaacgaaug

SEQ ID NO: 1911785 - RNA, 20 nt, Shigella flexneri 2a str. 2457T
agcggcaaugcguuccagca

SEQ ID NO: 1911786 - RNA, 17 nt, Shigella flexneri 2a str. 2457T
agcgggguguauuucac

SEQ ID NO: 1911787 - RNA, 20 nt, Shigella flexneri 2a str. 2457T
agcgggguucuccugagaau

SEQ ID NO: 1911788 - RNA, 18 nt, Shigella flexneri 2a str. 2457T
agcgucagccagaaagaa

SEQ ID NO: 1911789 - RNA, 21 nt, Shigella flexneri 2a str. 2457T
agcgucagccagaaagaaccg

SEQ ID NO: 1911790 - RNA, 19 nt, Shigella flexneri 2a str. 2457T
agcguccacagccaacaca

SEQ ID NO: 1911791 - RNA, 16 nt, Shigella flexneri 2a str. 2457T
agcguccagcccuccg

SEQ ID NO: 1911792 - RNA, 20 nt, Shigella flexneri 2a str. 2457T
agcgguuuacccugcucgcu

SEQ ID NO: 1911793 - RNA, 16 nt, Shigella flexneri 2a str. 2457T
agcgguuuugccagcg

SEQ ID NO: 1911794 - RNA, 20 nt, Shigella flexneri 2a str. 2457T
agcguaaaggcggcagaaca

SEQ ID NO: 1911795 - RNA, 22 nt, Shigella flexneri 2a str. 2457T
agcguaacggcucacgcccauc

SEQ ID NO: 1911796 - RNA, 20 nt, Shigella flexneri 2a str. 2457T
agcucgcaagccacgccgaa

SEQ ID NO: 1911797 - RNA, 16 nt, Shigella flexneri 2a str. 2457T
agcucgacuccugacu

SEQ ID NO: 1911798 - RNA, 17 nt, Shigella flexneri 2a str. 2457T
agcuccucuuucaucuc

SEQ ID NO: 1911799 - RNA, 23 nt, Shigella flexneri 2a str. 2457T
agcuccucgaguccuuccagguc

SEQ ID NO: 1911800 - RNA, 17 nt, Shigella flexneri 2a str. 2457T
agcucggcaaucuguua

SEQ ID NO: 1911801 - RNA, 16 nt, Shigella flexneri 2a str. 2457T
agcucgcuucaucugc

SEQ ID NO: 1911802 - RNA, 14 nt, Shigella flexneri 2a str. 2457T
agcuccagcaaaaa

SEQ ID NO: 1911803 - RNA, 22 nt, Shigella flexneri 2a str. 2457T
agcuccacaagaaugccugcca

SEQ ID NO: 1911804 - RNA, 18 nt, Shigella flexneri 2a str. 2457T
agcuccaccgauuuugag

SEQ ID NO: 1911805 - RNA, 21 nt, Shigella flexneri 2a str. 2457T
agcuccacaagaaugccugcc

SEQ ID NO: 1911806 - RNA, 18 nt, Shigella flexneri 2a str. 2457T
agcuccacaagaaugccu

SEQ ID NO: 1911807 - RNA, 18 nt, Shigella flexneri 2a str. 2457T
agcuccauccaccagccc

SEQ ID NO: 1911808 - RNA, 13 nt, Shigella flexneri 2a str. 2457T
agcucccaggcuc

SEQ ID NO: 1911809 - RNA, 20 nt, Shigella flexneri 2a str. 2457T
agcucccggagggguuuuug

SEQ ID NO: 1911810 - RNA, 20 nt, Shigella flexneri 2a str. 2457T
agcuccguuaaccgugggaa

SEQ ID NO: 1911811 - RNA, 19 nt, Shigella flexneri 2a str. 2457T
agcuccguccagccaccgc

SEQ ID NO: 1911812 - RNA, 15 nt, Shigella flexneri 2a str. 2457T
agcuccguccagcca

SEQ ID NO: 1911813 - RNA, 23 nt, Shigella flexneri 2a str. 2457T
agcucuucuucacucucaccacg

SEQ ID NO: 1911814 - RNA, 19 nt, Shigella flexneri 2a str. 2457T
agcucuuucgacagcgauu

SEQ ID NO: 1911815 - RNA, 15 nt, Shigella flexneri 2a str. 2457T
agcucuuucgacagc

SEQ ID NO: 1911816 - RNA, 19 nt, Shigella flexneri 2a str. 2457T
agcucgguauggccuuucu

SEQ ID NO: 1911817 - RNA, 23 nt, Shigella flexneri 2a str. 2457T
agcugauucgcgacguaagaaag

SEQ ID NO: 1911818 - RNA, 16 nt, Shigella flexneri 2a str. 2457T
agcugauucagauaau

SEQ ID NO: 1911819 - RNA, 19 nt, Shigella flexneri 2a str. 2457T
agcugauccuucuguucuu

SEQ ID NO: 1911820 - RNA, 18 nt, Shigella flexneri 2a str. 2457T
agcugaugauuaacagca

SEQ ID NO: 1911821 - RNA, 20 nt, Shigella flexneri 2a str. 2457T
agcugauugaaauagccaau

SEQ ID NO: 1911822 - RNA, 17 nt, Shigella flexneri 2a str. 2457T
agcugcgcguuaucuac

SEQ ID NO: 1911823 - RNA, 22 nt, Shigella flexneri 2a str. 2457T
agcugcggauccugagcaaaca

SEQ ID NO: 1911824 - RNA, 16 nt, Shigella flexneri 2a str. 2457T
agcugcucccagcgca

SEQ ID NO: 1911825 - RNA, 12 nt, Shigella flexneri 2a str. 2457T
agcuggcaaagu

SEQ ID NO: 1911826 - RNA, 14 nt, Shigella flexneri 2a str. 2457T
agcaaggccagguu

SEQ ID NO: 1911827 - RNA, 22 nt, Shigella flexneri 2a str. 2457T
agcaauaaacgguagauaauug

SEQ ID NO: 1911828 - RNA, 14 nt, Shigella flexneri 2a str. 2457T
agcaagugaauaaa

SEQ ID NO: 1911829 - RNA, 15 nt, Shigella flexneri 2a str. 2457T
agcaaggcaaucugc

SEQ ID NO: 1911830 - RNA, 22 nt, Shigella flexneri 2a str. 2457T
agcaagcgucgccagcgcgcag

SEQ ID NO: 1911831 - RNA, 23 nt, Shigella flexneri 2a str. 2457T
agcaagagcaaauaaaacaucac

SEQ ID NO: 1911832 - RNA, 16 nt, Shigella flexneri 2a str. 2457T
agcaagagcaaauaaa

SEQ ID NO: 1911833 - RNA, 14 nt, Shigella flexneri 2a str. 2457T
agcaagagcaaaua

SEQ ID NO: 1911834 - RNA, 15 nt, Shigella flexneri 2a str. 2457T
agcaaugaucucaau

SEQ ID NO: 1911835 - RNA, 14 nt, Shigella flexneri 2a str. 2457T
agcaaugagcuaug

SEQ ID NO: 1911836 - RNA, 18 nt, Shigella flexneri 2a str. 2457T
agcaaugcaggcaccugc

SEQ ID NO: 1911837 - RNA, 14 nt, Shigella flexneri 2a str. 2457T
agcaauuaacagug

SEQ ID NO: 1911838 - RNA, 17 nt, Shigella flexneri 2a str. 2457T
agcaauuaacagugaca

SEQ ID NO: 1911839 - RNA, 14 nt, Shigella flexneri 2a str. 2457T
agcaaucaccagau

SEQ ID NO: 1911840 - RNA, 23 nt, Shigella flexneri 2a str. 2457T
agcaauagccgccauacggaaaa

SEQ ID NO: 1911841 - RNA, 19 nt, Shigella flexneri 2a str. 2457T
agcaauaccgcgaaucaua

SEQ ID NO: 1911842 - RNA, 21 nt, Shigella flexneri 2a str. 2457T
agcaauagccgccauacggaa

SEQ ID NO: 1911843 - RNA, 17 nt, Shigella flexneri 2a str. 2457T
agcaaucucuucaagcu

SEQ ID NO: 1911844 - RNA, 19 nt, Shigella flexneri 2a str. 2457T
agcaaucugauugacauca

SEQ ID NO: 1911845 - RNA, 22 nt, Shigella flexneri 2a str. 2457T
agcaacgagacgguuaaaaaca

SEQ ID NO: 1911846 - RNA, 13 nt, Shigella flexneri 2a str. 2457T
agcaagagcaaau

SEQ ID NO: 1911847 - RNA, 22 nt, Shigella flexneri 2a str. 2457T
agcaacuuaaucaucaaugcca

SEQ ID NO: 1911848 - RNA, 12 nt, Shigella flexneri 2a str. 2457T
agcaacuggcaa

SEQ ID NO: 1911849 - RNA, 21 nt, Shigella flexneri 2a str. 2457T
agcaacugacugacuucaaca

SEQ ID NO: 1911850 - RNA, 16 nt, Shigella flexneri 2a str. 2457T
agcaacugauuuauag

SEQ ID NO: 1911851 - RNA, 21 nt, Shigella flexneri 2a str. 2457T
agcaacucuuuuuccugcugc

SEQ ID NO: 1911852 - RNA, 16 nt, Shigella flexneri 2a str. 2457T
agcaaauccaucauau

SEQ ID NO: 1911853 - RNA, 12 nt, Shigella flexneri 2a str. 2457T
agcaacaacagc

SEQ ID NO: 1911854 - RNA, 11 nt, Shigella flexneri 2a str. 2457T
agcaacaacag

SEQ ID NO: 1911855 - RNA, 14 nt, Shigella flexneri 2a str. 2457T
agcaacaaauaacc

SEQ ID NO: 1911856 - RNA, 19 nt, Shigella flexneri 2a str. 2457T
agcaacaagccaguccaga

SEQ ID NO: 1911857 - RNA, 18 nt, Shigella flexneri 2a str. 2457T
agcaaccaacgccagcag

SEQ ID NO: 1911858 - RNA, 21 nt, Shigella flexneri 2a str. 2457T
agcaaccaaugccaccaggga

SEQ ID NO: 1911859 - RNA, 17 nt, Shigella flexneri 2a str. 2457T
agcaaccaacgccagca

SEQ ID NO: 1911860 - RNA, 21 nt, Shigella flexneri 2a str. 2457T
agcaacaggccaguucgaaau

SEQ ID NO: 1911861 - RNA, 13 nt, Shigella flexneri 2a str. 2457T
agcaacaggccag

SEQ ID NO: 1911862 - RNA, 18 nt, Shigella flexneri 2a str. 2457T
agcaaccgguaaagaaga

SEQ ID NO: 1911863 - RNA, 21 nt, Shigella flexneri 2a str. 2457T
agcaaccucgcccauuuuuca

SEQ ID NO: 1911864 - RNA, 14 nt, Shigella flexneri 2a str. 2457T
agauuuuuauccag

SEQ ID NO: 1911865 - RNA, 11 nt, Shigella flexneri 2a str. 2457T
agauuuugcuu

SEQ ID NO: 1911866 - RNA, 12 nt, Shigella flexneri 2a str. 2457T
agcaaaaucacc

SEQ ID NO: 1911867 - RNA, 14 nt, Shigella flexneri 2a str. 2457T
agcaaaaucaccau

SEQ ID NO: 1911868 - RNA, 19 nt, Shigella flexneri 2a str. 2457T
agcaaaauagcuguuuauu

SEQ ID NO: 1911869 - RNA, 20 nt, Shigella flexneri 2a str. 2457T
agcaaaaauaaaugcuugac

SEQ ID NO: 1911870 - RNA, 22 nt, Shigella flexneri 2a str. 2457T
agcaaacaugccaacaaaaucu

SEQ ID NO: 1911871 - RNA, 18 nt, Shigella flexneri 2a str. 2457T
agcaaacaggauaaugca

SEQ ID NO: 1911872 - RNA, 17 nt, Shigella flexneri 2a str. 2457T
agcaaaggaauggucgg

SEQ ID NO: 1911873 - RNA, 16 nt, Shigella flexneri 2a str. 2457T
agcaaauagauaaaau

SEQ ID NO: 1911874 - RNA, 18 nt, Shigella flexneri 2a str. 2457T
agcaaaguaauaaugauc

SEQ ID NO: 1911875 - RNA, 12 nt, Shigella flexneri 2a str. 2457T
agcaaaggugcc

SEQ ID NO: 1911876 - RNA, 17 nt, Shigella flexneri 2a str. 2457T
agcaaaugaauuacacg

SEQ ID NO: 1911877 - RNA, 22 nt, Shigella flexneri 2a str. 2457T
agcaaaucaaauaauuacuucg

SEQ ID NO: 1911878 - RNA, 20 nt, Shigella flexneri 2a str. 2457T
agcaaaucgcggcaguggcu

SEQ ID NO: 1911879 - RNA, 21 nt, Shigella flexneri 2a str. 2457T
agcaaaucgcggcaguggcua

SEQ ID NO: 1911880 - RNA, 12 nt, Shigella flexneri 2a str. 2457T
agauaauaggua

SEQ ID NO: 1911881 - RNA, 14 nt, Shigella flexneri 2a str. 2457T
agauaaucaccugc

SEQ ID NO: 1911882 - RNA, 15 nt, Shigella flexneri 2a str. 2457T
agauaaggcguucac

SEQ ID NO: 1911883 - RNA, 18 nt, Shigella flexneri 2a str. 2457T
agauaaggcguucacgcc

SEQ ID NO: 1911884 - RNA, 19 nt, Shigella flexneri 2a str. 2457T
agauaaggugccaauccuu

SEQ ID NO: 1911885 - RNA, 22 nt, Shigella flexneri 2a str. 2457T
agauaaggugccaauccuucuu

SEQ ID NO: 1911886 - RNA, 22 nt, Shigella flexneri 2a str. 2457T
agauaauuaugccgaucaucau

SEQ ID NO: 1911887 - RNA, 18 nt, Shigella flexneri 2a str. 2457T
agauugucggcagccagu

SEQ ID NO: 1911888 - RNA, 20 nt, Shigella flexneri 2a str. 2457T
agauuuacuauuauuuuuca

SEQ ID NO: 1911889 - RNA, 18 nt, Shigella flexneri 2a str. 2457T
agauuuaacggcagcaag

SEQ ID NO: 1911890 - RNA, 16 nt, Shigella flexneri 2a str. 2457T
agauuuaacggcagca

SEQ ID NO: 1911891 - RNA, 17 nt, Shigella flexneri 2a str. 2457T
agauuucccauucuugg

SEQ ID NO: 1911892 - RNA, 21 nt, Shigella flexneri 2a str. 2457T
agauuuccaagcgcggcaggc

SEQ ID NO: 1911893 - RNA, 15 nt, Shigella flexneri 2a str. 2457T
agauuuauaaaagaa

SEQ ID NO: 1911894 - RNA, 20 nt, Shigella flexneri 2a str. 2457T
agcagaccaauguuacgacc

SEQ ID NO: 1911895 - RNA, 13 nt, Shigella flexneri 2a str. 2457T
agcagacaaccca

SEQ ID NO: 1911896 - RNA, 17 nt, Shigella flexneri 2a str. 2457T
agcagacaacccacaca

SEQ ID NO: 1911897 - RNA, 22 nt, Shigella flexneri 2a str. 2457T
agcagaccccagguuuucaacg

SEQ ID NO: 1911898 - RNA, 13 nt, Shigella flexneri 2a str. 2457T
agcagaccagcaa

SEQ ID NO: 1911899 - RNA, 14 nt, Shigella flexneri 2a str. 2457T
agcagaccagcaaa

SEQ ID NO: 1911900 - RNA, 15 nt, Shigella flexneri 2a str. 2457T
agcagaccagcaaua

SEQ ID NO: 1911901 - RNA, 16 nt, Shigella flexneri 2a str. 2457T
agcagaccagcaaaaa

SEQ ID NO: 1911902 - RNA, 20 nt, Shigella flexneri 2a str. 2457T
agcacuucgccaucugccag

SEQ ID NO: 1911903 - RNA, 18 nt, Shigella flexneri 2a str. 2457T
agcacuucacccaucgcc

SEQ ID NO: 1911904 - RNA, 18 nt, Shigella flexneri 2a str. 2457T
agcacuuucgccugcggc

SEQ ID NO: 1911905 - RNA, 17 nt, Shigella flexneri 2a str. 2457T
agcacuugcaggaacag

SEQ ID NO: 1911906 - RNA, 14 nt, Shigella flexneri 2a str. 2457T
agcacuugcaggcg

SEQ ID NO: 1911907 - RNA, 18 nt, Shigella flexneri 2a str. 2457T
agcagaaccagggaaaaa

SEQ ID NO: 1911908 - RNA, 14 nt, Shigella flexneri 2a str. 2457T
agcagcacaccaca

SEQ ID NO: 1911909 - RNA, 13 nt, Shigella flexneri 2a str. 2457T
agcagcagcaaga

SEQ ID NO: 1911910 - RNA, 15 nt, Shigella flexneri 2a str. 2457T
agcagcagagcaauc

SEQ ID NO: 1911911 - RNA, 16 nt, Shigella flexneri 2a str. 2457T
agcagcagagcaauca

SEQ ID NO: 1911912 - RNA, 14 nt, Shigella flexneri 2a str. 2457T
agcagagaucuuuc

SEQ ID NO: 1911913 - RNA, 17 nt, Shigella flexneri 2a str. 2457T
agcagagcaaucaccag

SEQ ID NO: 1911914 - RNA, 15 nt, Shigella flexneri 2a str. 2457T
agcagagcaugguua

SEQ ID NO: 1911915 - RNA, 20 nt, Shigella flexneri 2a str. 2457T
agcagagaaacgccagcagc

SEQ ID NO: 1911916 - RNA, 16 nt, Shigella flexneri 2a str. 2457T
agcagagaaacgccag

SEQ ID NO: 1911917 - RNA, 22 nt, Shigella flexneri 2a str. 2457T
agcagauauugccccacaccgc

SEQ ID NO: 1911918 - RNA, 18 nt, Shigella flexneri 2a str. 2457T
agcacguaaaucuuuacc

SEQ ID NO: 1911919 - RNA, 16 nt, Shigella flexneri 2a str. 2457T
agcacgucaucugcac

SEQ ID NO: 1911920 - RNA, 19 nt, Shigella flexneri 2a str. 2457T
agcacuguaaaccucuuuc

SEQ ID NO: 1911921 - RNA, 17 nt, Shigella flexneri 2a str. 2457T
agcacuguaaaccucuu

SEQ ID NO: 1911922 - RNA, 15 nt, Shigella flexneri 2a str. 2457T
agcacuguaaaccuc

SEQ ID NO: 1911923 - RNA, 19 nt, Shigella flexneri 2a str. 2457T
agcacuggcggcagcaggu

SEQ ID NO: 1911924 - RNA, 22 nt, Shigella flexneri 2a str. 2457T
agcacugccagaaucaagguga

SEQ ID NO: 1911925 - RNA, 13 nt, Shigella flexneri 2a str. 2457T
agcacugcaucaa

SEQ ID NO: 1911926 - RNA, 21 nt, Shigella flexneri 2a str. 2457T
agcacugauuuuuuccaacag

SEQ ID NO: 1911927 - RNA, 15 nt, Shigella flexneri 2a str. 2457T
agcacuccugccacc

SEQ ID NO: 1911928 - RNA, 17 nt, Shigella flexneri 2a str. 2457T
agcacgcuuuucagugc

SEQ ID NO: 1911929 - RNA, 17 nt, Shigella flexneri 2a str. 2457T
agcacggucaggcuaaa

SEQ ID NO: 1911930 - RNA, 15 nt, Shigella flexneri 2a str. 2457T
agcacggcgcugacg

SEQ ID NO: 1911931 - RNA, 21 nt, Shigella flexneri 2a str. 2457T
agcacgcagugagaagccacc

SEQ ID NO: 1911932 - RNA, 13 nt, Shigella flexneri 2a str. 2457T
agcacgauuuugu

SEQ ID NO: 1911933 - RNA, 17 nt, Shigella flexneri 2a str. 2457T
agcacgacuuucucuuc

SEQ ID NO: 1911934 - RNA, 12 nt, Shigella flexneri 2a str. 2457T
agcaccagcaac

SEQ ID NO: 1911935 - RNA, 13 nt, Shigella flexneri 2a str. 2457T
agcaccagauaau

SEQ ID NO: 1911936 - RNA, 15 nt, Shigella flexneri 2a str. 2457T
agcaccagcagguga

SEQ ID NO: 1911937 - RNA, 18 nt, Shigella flexneri 2a str. 2457T
agcaccaggguaaaugca

SEQ ID NO: 1911938 - RNA, 17 nt, Shigella flexneri 2a str. 2457T
agcaccagggaaauaau

SEQ ID NO: 1911939 - RNA, 19 nt, Shigella flexneri 2a str. 2457T
agcacccagaacgccgaau

SEQ ID NO: 1911940 - RNA, 14 nt, Shigella flexneri 2a str. 2457T
agcacccagcaauc

SEQ ID NO: 1911941 - RNA, 21 nt, Shigella flexneri 2a str. 2457T
agcaccauccgcccacaccag

SEQ ID NO: 1911942 - RNA, 14 nt, Shigella flexneri 2a str. 2457T
agcacccgccagcg

SEQ ID NO: 1911943 - RNA, 16 nt, Shigella flexneri 2a str. 2457T
agcacccugaguuuuc

SEQ ID NO: 1911944 - RNA, 17 nt, Shigella flexneri 2a str. 2457T
agcaccgcgcuauuuuc

SEQ ID NO: 1911945 - RNA, 18 nt, Shigella flexneri 2a str. 2457T
agcaccgcgaauuuuuuc

SEQ ID NO: 1911946 - RNA, 13 nt, Shigella flexneri 2a str. 2457T
agcacaucacuca

SEQ ID NO: 1911947 - RNA, 13 nt, Shigella flexneri 2a str. 2457T
agcacaucagcca

SEQ ID NO: 1911948 - RNA, 21 nt, Shigella flexneri 2a str. 2457T
agcacaucagccagaugcacc

SEQ ID NO: 1911949 - RNA, 14 nt, Shigella flexneri 2a str. 2457T
agcacaucaucaaa

SEQ ID NO: 1911950 - RNA, 12 nt, Shigella flexneri 2a str. 2457T
agcacagcauca

SEQ ID NO: 1911951 - RNA, 20 nt, Shigella flexneri 2a str. 2457T
agcacacuguaagccaccga

SEQ ID NO: 1911952 - RNA, 16 nt, Shigella flexneri 2a str. 2457T
agcacaugcugacauu

SEQ ID NO: 1911953 - RNA, 13 nt, Shigella flexneri 2a str. 2457T
agcacaaacccag

SEQ ID NO: 1911954 - RNA, 19 nt, Shigella flexneri 2a str. 2457T
agcacaaacccagggccaa

SEQ ID NO: 1911955 - RNA, 17 nt, Shigella flexneri 2a str. 2457T
agcaauuuuaguaucca

SEQ ID NO: 1911956 - RNA, 21 nt, Shigella flexneri 2a str. 2457T
agcaauuuuccuugaaaaaga

SEQ ID NO: 1911957 - RNA, 22 nt, Shigella flexneri 2a str. 2457T
agcaauuuuccuugaaaaagag

SEQ ID NO: 1911958 - RNA, 12 nt, Shigella flexneri 2a str. 2457T
agcaauuuugcc

SEQ ID NO: 1911959 - RNA, 20 nt, Shigella flexneri 2a str. 2457T
agcaauuccagcgccaguaa

SEQ ID NO: 1911960 - RNA, 23 nt, Shigella flexneri 2a str. 2457T
agcacacauuauaggccugauaa

SEQ ID NO: 1911961 - RNA, 23 nt, Shigella flexneri 2a str. 2457T
agcacacauaagagcgggacaac

SEQ ID NO: 1911962 - RNA, 24 nt, Shigella flexneri 2a str. 2457T
agcacacugguucccaacaacagc

SEQ ID NO: 1911963 - RNA, 20 nt, Shigella flexneri 2a str. 2457T
agcacaauaaucagcccaac

SEQ ID NO: 1911964 - RNA, 16 nt, Shigella flexneri 2a str. 2457T
agcacaauaaucagcc

SEQ ID NO: 1911965 - RNA, 18 nt, Shigella flexneri 2a str. 2457T
agcacaacaggcuauuuu

SEQ ID NO: 1911966 - RNA, 18 nt, Shigella flexneri 2a str. 2457T
agcaggcguuaaaacagg

SEQ ID NO: 1911967 - RNA, 20 nt, Shigella flexneri 2a str. 2457T
agcaggcuaguaaaaagcau

SEQ ID NO: 1911968 - RNA, 13 nt, Shigella flexneri 2a str. 2457T
agcaggcucagaa

SEQ ID NO: 1911969 - RNA, 19 nt, Shigella flexneri 2a str. 2457T
agcaguaaaccacccacca

SEQ ID NO: 1911970 - RNA, 15 nt, Shigella flexneri 2a str. 2457T
agcagguaaucugcc

SEQ ID NO: 1911971 - RNA, 16 nt, Shigella flexneri 2a str. 2457T
agcagguaaucugcca

SEQ ID NO: 1911972 - RNA, 22 nt, Shigella flexneri 2a str. 2457T
agcaggguuucaucgguggugu

SEQ ID NO: 1911973 - RNA, 17 nt, Shigella flexneri 2a str. 2457T
agcaggcauccugaucg

SEQ ID NO: 1911974 - RNA, 22 nt, Shigella flexneri 2a str. 2457T
agcaggccggguuuucucccuc

SEQ ID NO: 1911975 - RNA, 20 nt, Shigella flexneri 2a str. 2457T
agcaggcgauuuacuggcag

SEQ ID NO: 1911976 - RNA, 21 nt, Shigella flexneri 2a str. 2457T
agcaggauguuccggcaaagu

SEQ ID NO: 1911977 - RNA, 21 nt, Shigella flexneri 2a str. 2457T
agcaggaauguuguccagggc

SEQ ID NO: 1911978 - RNA, 17 nt, Shigella flexneri 2a str. 2457T
agcaggagaagcaaauu

SEQ ID NO: 1911979 - RNA, 12 nt, Shigella flexneri 2a str. 2457T
agcaggagucau

SEQ ID NO: 1911980 - RNA, 12 nt, Shigella flexneri 2a str. 2457T
agcagcuuucag

SEQ ID NO: 1911981 - RNA, 16 nt, Shigella flexneri 2a str. 2457T
agcagcuuucagcagc

SEQ ID NO: 1911982 - RNA, 13 nt, Shigella flexneri 2a str. 2457T
agcagcuccgcca

SEQ ID NO: 1911983 - RNA, 17 nt, Shigella flexneri 2a str. 2457T
agcagcuacuggugccu

SEQ ID NO: 1911984 - RNA, 16 nt, Shigella flexneri 2a str. 2457T
agcagcugcucccagc

SEQ ID NO: 1911985 - RNA, 19 nt, Shigella flexneri 2a str. 2457T
agcagcugcucccagcgca

SEQ ID NO: 1911986 - RNA, 20 nt, Shigella flexneri 2a str. 2457T
agcagcgccacacgagucau

SEQ ID NO: 1911987 - RNA, 15 nt, Shigella flexneri 2a str. 2457T
agcagcggagaaaug

SEQ ID NO: 1911988 - RNA, 16 nt, Shigella flexneri 2a str. 2457T
agcagcggcagaucaa

SEQ ID NO: 1911989 - RNA, 19 nt, Shigella flexneri 2a str. 2457T
agcagcgguugagagaaga

SEQ ID NO: 1911990 - RNA, 22 nt, Shigella flexneri 2a str. 2457T
agcagcguaacggcucacgccc

SEQ ID NO: 1911991 - RNA, 23 nt, Shigella flexneri 2a str. 2457T
agcagcguaccucuaucuugauu

SEQ ID NO: 1911992 - RNA, 13 nt, Shigella flexneri 2a str. 2457T
agcagccaccacu

SEQ ID NO: 1911993 - RNA, 15 nt, Shigella flexneri 2a str. 2457T
agcagcauacccacc

SEQ ID NO: 1911994 - RNA, 16 nt, Shigella flexneri 2a str. 2457T
agcagcagucaggcgc

SEQ ID NO: 1911995 - RNA, 12 nt, Shigella flexneri 2a str. 2457T
agcagcccugcc

SEQ ID NO: 1911996 - RNA, 16 nt, Shigella flexneri 2a str. 2457T
agcagcgaagcauuca

SEQ ID NO: 1911997 - RNA, 21 nt, Shigella flexneri 2a str. 2457T
agcaguagcgucgccagcagu

SEQ ID NO: 1911998 - RNA, 20 nt, Shigella flexneri 2a str. 2457T
agcagugaauacccagaauc

SEQ ID NO: 1911999 - RNA, 22 nt, Shigella flexneri 2a str. 2457T
agcagugaauacccagaaucuc

SEQ ID NO: 1912000 - RNA, 18 nt, Shigella flexneri 2a str. 2457T
agcagugacucacgaauc

SEQ ID NO: 1912001 - RNA, 17 nt, Shigella flexneri 2a str. 2457T
agcagugaauacccaga

SEQ ID NO: 1912002 - RNA, 18 nt, Shigella flexneri 2a str. 2457T
agcaguguuuccggcauu

SEQ ID NO: 1912003 - RNA, 13 nt, Shigella flexneri 2a str. 2457T
agcaguucacgca

SEQ ID NO: 1912004 - RNA, 15 nt, Shigella flexneri 2a str. 2457T
agcaguucacgcagc

SEQ ID NO: 1912005 - RNA, 17 nt, Shigella flexneri 2a str. 2457T
agcaguucacgcagcuu

SEQ ID NO: 1912006 - RNA, 19 nt, Shigella flexneri 2a str. 2457T
agcaguucagucagcagug

SEQ ID NO: 1912007 - RNA, 16 nt, Shigella flexneri 2a str. 2457T
agcaguucaugcacuu

SEQ ID NO: 1912008 - RNA, 21 nt, Shigella flexneri 2a str. 2457T
agcaguucaugcacuugguuc

SEQ ID NO: 1912009 - RNA, 15 nt, Shigella flexneri 2a str. 2457T
agcaguuccagcauc

SEQ ID NO: 1912010 - RNA, 15 nt, Shigella flexneri 2a str. 2457T
agcauaccuuccagc

SEQ ID NO: 1912011 - RNA, 18 nt, Shigella flexneri 2a str. 2457T
agcauagccccagcgcag

SEQ ID NO: 1912012 - RNA, 23 nt, Shigella flexneri 2a str. 2457T
agcauagccccagcgcagacggc

SEQ ID NO: 1912013 - RNA, 15 nt, Shigella flexneri 2a str. 2457T
agcauaggcauuaaa

SEQ ID NO: 1912014 - RNA, 18 nt, Shigella flexneri 2a str. 2457T
agcauaggcauuaaacau

SEQ ID NO: 1912015 - RNA, 19 nt, Shigella flexneri 2a str. 2457T
agcauauaggaggccucgg

SEQ ID NO: 1912016 - RNA, 22 nt, Shigella flexneri 2a str. 2457T
agcauauaaugcaacauuuuga

SEQ ID NO: 1912017 - RNA, 18 nt, Shigella flexneri 2a str. 2457T
agcaguuucaccagcagu

SEQ ID NO: 1912018 - RNA, 19 nt, Shigella flexneri 2a str. 2457T
agcaguuucaccagcagua

SEQ ID NO: 1912019 - RNA, 16 nt, Shigella flexneri 2a str. 2457T
agcaguuucaccagca

SEQ ID NO: 1912020 - RNA, 17 nt, Shigella flexneri 2a str. 2457T
agcaguuucaccagcag

SEQ ID NO: 1912021 - RNA, 18 nt, Shigella flexneri 2a str. 2457T
agcaguuuauaaaauucu

SEQ ID NO: 1912022 - RNA, 15 nt, Shigella flexneri 2a str. 2457T
agcaguuucaccagc

SEQ ID NO: 1912023 - RNA, 16 nt, Shigella flexneri 2a str. 2457T
agcauaauaagcuuuu

SEQ ID NO: 1912024 - RNA, 21 nt, Shigella flexneri 2a str. 2457T
agcauaaucaccaucagcagc

SEQ ID NO: 1912025 - RNA, 18 nt, Shigella flexneri 2a str. 2457T
agcauaaugugcgcacau

SEQ ID NO: 1912026 - RNA, 17 nt, Shigella flexneri 2a str. 2457T
agcaucugcaaaauuuc

SEQ ID NO: 1912027 - RNA, 18 nt, Shigella flexneri 2a str. 2457T
agcaucucuacagcgccc

SEQ ID NO: 1912028 - RNA, 19 nt, Shigella flexneri 2a str. 2457T
agcaucucauccaucaaau

SEQ ID NO: 1912029 - RNA, 14 nt, Shigella flexneri 2a str. 2457T
agcaucgucaucag

SEQ ID NO: 1912030 - RNA, 15 nt, Shigella flexneri 2a str. 2457T
agcaucguccgccag

SEQ ID NO: 1912031 - RNA, 15 nt, Shigella flexneri 2a str. 2457T
agcaucugccagcca

SEQ ID NO: 1912032 - RNA, 22 nt, Shigella flexneri 2a str. 2457T
agcaucggcagcgccagcgaag

SEQ ID NO: 1912033 - RNA, 18 nt, Shigella flexneri 2a str. 2457T
agcaucggugaggaucac

SEQ ID NO: 1912034 - RNA, 21 nt, Shigella flexneri 2a str. 2457T
agcaucggugaggaucaccag

SEQ ID NO: 1912035 - RNA, 15 nt, Shigella flexneri 2a str. 2457T
agcauccccauaucc

SEQ ID NO: 1912036 - RNA, 23 nt, Shigella flexneri 2a str. 2457T
agcaucccggcagccccaaacag

SEQ ID NO: 1912037 - RNA, 20 nt, Shigella flexneri 2a str. 2457T
agcaucgaccaggauuugau

SEQ ID NO: 1912038 - RNA, 19 nt, Shigella flexneri 2a str. 2457T
agcaucgcccaggcgacca

SEQ ID NO: 1912039 - RNA, 16 nt, Shigella flexneri 2a str. 2457T
agcaucgcaacaugcu

SEQ ID NO: 1912040 - RNA, 19 nt, Shigella flexneri 2a str. 2457T
agcaucccggcagccccaa

SEQ ID NO: 1912041 - RNA, 22 nt, Shigella flexneri 2a str. 2457T
agcauccccggcaaccacaccc

SEQ ID NO: 1912042 - RNA, 14 nt, Shigella flexneri 2a str. 2457T
agcauccaacugau

SEQ ID NO: 1912043 - RNA, 22 nt, Shigella flexneri 2a str. 2457T
agcaucaguucggaaacagugc

SEQ ID NO: 1912044 - RNA, 14 nt, Shigella flexneri 2a str. 2457T
agcaucauaagacu

SEQ ID NO: 1912045 - RNA, 23 nt, Shigella flexneri 2a str. 2457T
agcaucauauggaagaaacgcuu

SEQ ID NO: 1912046 - RNA, 15 nt, Shigella flexneri 2a str. 2457T
agcaucaucgcaaug

SEQ ID NO: 1912047 - RNA, 23 nt, Shigella flexneri 2a str. 2457T
agcaucaucgcaaugauuuugau

SEQ ID NO: 1912048 - RNA, 13 nt, Shigella flexneri 2a str. 2457T
agcaucagcgcca

SEQ ID NO: 1912049 - RNA, 23 nt, Shigella flexneri 2a str. 2457T
agcaucaacccgcucauaauaca

SEQ ID NO: 1912050 - RNA, 12 nt, Shigella flexneri 2a str. 2457T
agcaucaaugac

SEQ ID NO: 1912051 - RNA, 14 nt, Shigella flexneri 2a str. 2457T
agcaucaauugcua

SEQ ID NO: 1912052 - RNA, 21 nt, Shigella flexneri 2a str. 2457T
agcauaucgacgaaccauuuc

SEQ ID NO: 1912053 - RNA, 18 nt, Shigella flexneri 2a str. 2457T
agccagggucaacauaaa

SEQ ID NO: 1912054 - RNA, 22 nt, Shigella flexneri 2a str. 2457T
agccaggagccaacacuuucac

SEQ ID NO: 1912055 - RNA, 17 nt, Shigella flexneri 2a str. 2457T
agccaggagccaacacu

SEQ ID NO: 1912056 - RNA, 17 nt, Shigella flexneri 2a str. 2457T
agccaggacgcagucca

SEQ ID NO: 1912057 - RNA, 14 nt, Shigella flexneri 2a str. 2457T
agccagcuggcaga

SEQ ID NO: 1912058 - RNA, 24 nt, Shigella flexneri 2a str. 2457T
agccaggaaauacgcuggcugaac

SEQ ID NO: 1912059 - RNA, 19 nt, Shigella flexneri 2a str. 2457T
agccaggaaccaccgaugc

SEQ ID NO: 1912060 - RNA, 14 nt, Shigella flexneri 2a str. 2457T
agccagucaguaac

SEQ ID NO: 1912061 - RNA, 15 nt, Shigella flexneri 2a str. 2457T
agccagucaguaacg

SEQ ID NO: 1912062 - RNA, 16 nt, Shigella flexneri 2a str. 2457T
agccaguccagaaaug

SEQ ID NO: 1912063 - RNA, 17 nt, Shigella flexneri 2a str. 2457T
agccaguuuuucuuuuu

SEQ ID NO: 1912064 - RNA, 20 nt, Shigella flexneri 2a str. 2457T
agccaguuuuucuuuuucaa

SEQ ID NO: 1912065 - RNA, 22 nt, Shigella flexneri 2a str. 2457T
agccauaaagaaaucaccugcc

SEQ ID NO: 1912066 - RNA, 18 nt, Shigella flexneri 2a str. 2457T
agccaguucucaccaaag

SEQ ID NO: 1912067 - RNA, 15 nt, Shigella flexneri 2a str. 2457T
agccaucaaucccau

SEQ ID NO: 1912068 - RNA, 12 nt, Shigella flexneri 2a str. 2457T
agccaucaccau

SEQ ID NO: 1912069 - RNA, 16 nt, Shigella flexneri 2a str. 2457T
agccaucccagacacc

SEQ ID NO: 1912070 - RNA, 11 nt, Shigella flexneri 2a str. 2457T
agccaucaucc

SEQ ID NO: 1912071 - RNA, 20 nt, Shigella flexneri 2a str. 2457T
agccaugcccgugcugacag

SEQ ID NO: 1912072 - RNA, 23 nt, Shigella flexneri 2a str. 2457T
agccaugcuuugcaucccagaaa

SEQ ID NO: 1912073 - RNA, 15 nt, Shigella flexneri 2a str. 2457T
agccaugcccgugcu

SEQ ID NO: 1912074 - RNA, 19 nt, Shigella flexneri 2a str. 2457T
agccaugcccgugcugaca

SEQ ID NO: 1912075 - RNA, 14 nt, Shigella flexneri 2a str. 2457T
agccauucccccuu

SEQ ID NO: 1912076 - RNA, 18 nt, Shigella flexneri 2a str. 2457T
agccauucccucuacauu

SEQ ID NO: 1912077 - RNA, 17 nt, Shigella flexneri 2a str. 2457T
agccauguuuaacuccu

SEQ ID NO: 1912078 - RNA, 20 nt, Shigella flexneri 2a str. 2457T
agccauguuuaacuccuucu

SEQ ID NO: 1912079 - RNA, 20 nt, Shigella flexneri 2a str. 2457T
agccagagaagcgacuugug

SEQ ID NO: 1912080 - RNA, 18 nt, Shigella flexneri 2a str. 2457T
agccagccaagcauguca

SEQ ID NO: 1912081 - RNA, 16 nt, Shigella flexneri 2a str. 2457T
agccagcaccaggcuu

SEQ ID NO: 1912082 - RNA, 14 nt, Shigella flexneri 2a str. 2457T
agccagcgcauccu

SEQ ID NO: 1912083 - RNA, 18 nt, Shigella flexneri 2a str. 2457T
agccagcgcgccuucauu

SEQ ID NO: 1912084 - RNA, 15 nt, Shigella flexneri 2a str. 2457T
agccagcucgcgcca

SEQ ID NO: 1912085 - RNA, 17 nt, Shigella flexneri 2a str. 2457T
agccagccccacagcag

SEQ ID NO: 1912086 - RNA, 15 nt, Shigella flexneri 2a str. 2457T
agccagccccacagc

SEQ ID NO: 1912087 - RNA, 14 nt, Shigella flexneri 2a str. 2457T
agccagccagaauc

SEQ ID NO: 1912088 - RNA, 13 nt, Shigella flexneri 2a str. 2457T
agccacugcgcca

SEQ ID NO: 1912089 - RNA, 13 nt, Shigella flexneri 2a str. 2457T
agccagacgccag

SEQ ID NO: 1912090 - RNA, 21 nt, Shigella flexneri 2a str. 2457T
agccacuucuuccagcggcag

SEQ ID NO: 1912091 - RNA, 18 nt, Shigella flexneri 2a str. 2457T
agccaccgcccagagaau

SEQ ID NO: 1912092 - RNA, 12 nt, Shigella flexneri 2a str. 2457T
agccaccgccag

SEQ ID NO: 1912093 - RNA, 20 nt, Shigella flexneri 2a str. 2457T
agccaccuggcugcguuuuc

SEQ ID NO: 1912094 - RNA, 19 nt, Shigella flexneri 2a str. 2457T
agccacgccgaaccauguc

SEQ ID NO: 1912095 - RNA, 20 nt, Shigella flexneri 2a str. 2457T
agccacggcuccagcaaugu

SEQ ID NO: 1912096 - RNA, 19 nt, Shigella flexneri 2a str. 2457T
agccacggcuccagcaaug

SEQ ID NO: 1912097 - RNA, 14 nt, Shigella flexneri 2a str. 2457T
agcaugauauucac

SEQ ID NO: 1912098 - RNA, 21 nt, Shigella flexneri 2a str. 2457T
agcaugacuaccggggacagg

SEQ ID NO: 1912099 - RNA, 18 nt, Shigella flexneri 2a str. 2457T
agcaugaacauugcugcu

SEQ ID NO: 1912100 - RNA, 22 nt, Shigella flexneri 2a str. 2457T
agcaugaaaugaaaaucaccau

SEQ ID NO: 1912101 - RNA, 19 nt, Shigella flexneri 2a str. 2457T
agcaugauauucacgggga

SEQ ID NO: 1912102 - RNA, 24 nt, Shigella flexneri 2a str. 2457T
agcaugauauucacggggaauagc

SEQ ID NO: 1912103 - RNA, 14 nt, Shigella flexneri 2a str. 2457T
agcaugcacccuca

SEQ ID NO: 1912104 - RNA, 14 nt, Shigella flexneri 2a str. 2457T
agcauggcuucuuc

SEQ ID NO: 1912105 - RNA, 18 nt, Shigella flexneri 2a str. 2457T
agcauggcuucuuccccg

SEQ ID NO: 1912106 - RNA, 14 nt, Shigella flexneri 2a str. 2457T
agcauggacuggcu

SEQ ID NO: 1912107 - RNA, 13 nt, Shigella flexneri 2a str. 2457T
agcauucaguuac

SEQ ID NO: 1912108 - RNA, 23 nt, Shigella flexneri 2a str. 2457T
agcauuucaaaacggucacggcu

SEQ ID NO: 1912109 - RNA, 21 nt, Shigella flexneri 2a str. 2457T
agcauugaugcguuagaugau

SEQ ID NO: 1912110 - RNA, 12 nt, Shigella flexneri 2a str. 2457T
agcauuccagau

SEQ ID NO: 1912111 - RNA, 14 nt, Shigella flexneri 2a str. 2457T
agcauuccagauac

SEQ ID NO: 1912112 - RNA, 14 nt, Shigella flexneri 2a str. 2457T
agcauuacacgcgg

SEQ ID NO: 1912113 - RNA, 18 nt, Shigella flexneri 2a str. 2457T
agcauuacccagauaaua

SEQ ID NO: 1912114 - RNA, 18 nt, Shigella flexneri 2a str. 2457T
agcauguguaaccgcuuu

SEQ ID NO: 1912115 - RNA, 17 nt, Shigella flexneri 2a str. 2457T
agcauguguaaccgcuu

SEQ ID NO: 1912116 - RNA, 22 nt, Shigella flexneri 2a str. 2457T
agcauuauuuuuaaacaucaaa

SEQ ID NO: 1912117 - RNA, 20 nt, Shigella flexneri 2a str. 2457T
agcauucagacacgccgcca

SEQ ID NO: 1912118 - RNA, 15 nt, Shigella flexneri 2a str. 2457T
agcauuauuuuuaaa

SEQ ID NO: 1912119 - RNA, 19 nt, Shigella flexneri 2a str. 2457T
agcauuacuuucggugacu

SEQ ID NO: 1912120 - RNA, 13 nt, Shigella flexneri 2a str. 2457T
agccaaucccgga

SEQ ID NO: 1912121 - RNA, 22 nt, Shigella flexneri 2a str. 2457T
agccaauggggacaaucaccau

SEQ ID NO: 1912122 - RNA, 19 nt, Shigella flexneri 2a str. 2457T
agccaauuaacgaaaucuc

SEQ ID NO: 1912123 - RNA, 19 nt, Shigella flexneri 2a str. 2457T
agccaagcgccgccucagc

SEQ ID NO: 1912124 - RNA, 20 nt, Shigella flexneri 2a str. 2457T
agccaauaaaugccaccaca

SEQ ID NO: 1912125 - RNA, 18 nt, Shigella flexneri 2a str. 2457T
agccacaaucgcagcgca

SEQ ID NO: 1912126 - RNA, 14 nt, Shigella flexneri 2a str. 2457T
agccacaccacuuu

SEQ ID NO: 1912127 - RNA, 20 nt, Shigella flexneri 2a str. 2457T
agccaccacgccaagaaaca

SEQ ID NO: 1912128 - RNA, 20 nt, Shigella flexneri 2a str. 2457T
agccacagggugaucaccag

SEQ ID NO: 1912129 - RNA, 16 nt, Shigella flexneri 2a str. 2457T
agccaccacgccaaga

SEQ ID NO: 1912130 - RNA, 17 nt, Shigella flexneri 2a str. 2457T
agccaccacgccaagaa

SEQ ID NO: 1912131 - RNA, 13 nt, Shigella flexneri 2a str. 2457T
agccaccagcacc

SEQ ID NO: 1912132 - RNA, 19 nt, Shigella flexneri 2a str. 2457T
agcauuucgcgauauugcu

SEQ ID NO: 1912133 - RNA, 13 nt, Shigella flexneri 2a str. 2457T
agccaaaaugccu

SEQ ID NO: 1912134 - RNA, 13 nt, Shigella flexneri 2a str. 2457T
agccaaaacugca

SEQ ID NO: 1912135 - RNA, 14 nt, Shigella flexneri 2a str. 2457T
agcauuuuuucaca

SEQ ID NO: 1912136 - RNA, 12 nt, Shigella flexneri 2a str. 2457T
agccaaaaauga

SEQ ID NO: 1912137 - RNA, 12 nt, Shigella flexneri 2a str. 2457T
agccaacagcag

SEQ ID NO: 1912138 - RNA, 22 nt, Shigella flexneri 2a str. 2457T
agccaacgaugaugacguaauc

SEQ ID NO: 1912139 - RNA, 14 nt, Shigella flexneri 2a str. 2457T
agccaaauaaaauc

SEQ ID NO: 1912140 - RNA, 13 nt, Shigella flexneri 2a str. 2457T
agccaaaucaucc

SEQ ID NO: 1912141 - RNA, 16 nt, Shigella flexneri 2a str. 2457T
agccaaaucauccaga

SEQ ID NO: 1912142 - RNA, 13 nt, Shigella flexneri 2a str. 2457T
agccaaauccagc

SEQ ID NO: 1912143 - RNA, 15 nt, Shigella flexneri 2a str. 2457T
acuugcuuaaaaaau

SEQ ID NO: 1912144 - RNA, 19 nt, Shigella flexneri 2a str. 2457T
acuugcuuaaaaaaucaca

SEQ ID NO: 1912145 - RNA, 14 nt, Shigella flexneri 2a str. 2457T
acuugccuccagcg

SEQ ID NO: 1912146 - RNA, 21 nt, Shigella flexneri 2a str. 2457T
acuugcucaaucgcauggcug

SEQ ID NO: 1912147 - RNA, 16 nt, Shigella flexneri 2a str. 2457T
acuugcggacccggcg

SEQ ID NO: 1912148 - RNA, 18 nt, Shigella flexneri 2a str. 2457T
acuugccagauaaacaua

SEQ ID NO: 1912149 - RNA, 13 nt, Shigella flexneri 2a str. 2457T
acuugagcccugg

SEQ ID NO: 1912150 - RNA, 14 nt, Shigella flexneri 2a str. 2457T
acuugauacugaac

SEQ ID NO: 1912151 - RNA, 23 nt, Shigella flexneri 2a str. 2457T
acuucucuucuuccgcuucaauc

SEQ ID NO: 1912152 - RNA, 12 nt, Shigella flexneri 2a str. 2457T
acuucucuuucg

SEQ ID NO: 1912153 - RNA, 18 nt, Shigella flexneri 2a str. 2457T
acuucugauguuguuuuu

SEQ ID NO: 1912154 - RNA, 16 nt, Shigella flexneri 2a str. 2457T
acuucugccagcugcu

SEQ ID NO: 1912155 - RNA, 23 nt, Shigella flexneri 2a str. 2457T
acuucugcucgcgguuaaguucc

SEQ ID NO: 1912156 - RNA, 20 nt, Shigella flexneri 2a str. 2457T
acuucuuaaugcccaucucu

SEQ ID NO: 1912157 - RNA, 16 nt, Shigella flexneri 2a str. 2457T
acuucuuaccgcuuca

SEQ ID NO: 1912158 - RNA, 11 nt, Shigella flexneri 2a str. 2457T
acuucuucagc

SEQ ID NO: 1912159 - RNA, 16 nt, Shigella flexneri 2a str. 2457T
acuucuucauucaucc

SEQ ID NO: 1912160 - RNA, 16 nt, Shigella flexneri 2a str. 2457T
acuucuuuuaccuuca

SEQ ID NO: 1912161 - RNA, 19 nt, Shigella flexneri 2a str. 2457T
acuucuauaaugagauauu

SEQ ID NO: 1912162 - RNA, 18 nt, Shigella flexneri 2a str. 2457T
acuuccaccacuuccugc

SEQ ID NO: 1912163 - RNA, 20 nt, Shigella flexneri 2a str. 2457T
acuuccagcagaccagcaau

SEQ ID NO: 1912164 - RNA, 20 nt, Shigella flexneri 2a str. 2457T
acuuccagcaguucgcccgc

SEQ ID NO: 1912165 - RNA, 17 nt, Shigella flexneri 2a str. 2457T
acuuccacguuccccag

SEQ ID NO: 1912166 - RNA, 15 nt, Shigella flexneri 2a str. 2457T
acuucgguuaccaca

SEQ ID NO: 1912167 - RNA, 23 nt, Shigella flexneri 2a str. 2457T
acuuccagcguagugaaggcaaa

SEQ ID NO: 1912168 - RNA, 19 nt, Shigella flexneri 2a str. 2457T
acuucgcuuacgccugcca

SEQ ID NO: 1912169 - RNA, 12 nt, Shigella flexneri 2a str. 2457T
acugucagaugc

SEQ ID NO: 1912170 - RNA, 21 nt, Shigella flexneri 2a str. 2457T
acuguauacgggcuuuuuaau

SEQ ID NO: 1912171 - RNA, 15 nt, Shigella flexneri 2a str. 2457T
acuguagugaucaaa

SEQ ID NO: 1912172 - RNA, 19 nt, Shigella flexneri 2a str. 2457T
acuguagugaucaaacaca

SEQ ID NO: 1912173 - RNA, 22 nt, Shigella flexneri 2a str. 2457T
acugacggaucccgccaacagg

SEQ ID NO: 1912174 - RNA, 16 nt, Shigella flexneri 2a str. 2457T
acugacgcgucuuauc

SEQ ID NO: 1912175 - RNA, 23 nt, Shigella flexneri 2a str. 2457T
acugacgcccguuaaccgcucug

SEQ ID NO: 1912176 - RNA, 16 nt, Shigella flexneri 2a str. 2457T
acuguaaaucgccaug

SEQ ID NO: 1912177 - RNA, 13 nt, Shigella flexneri 2a str. 2457T
acuguaccagcaa

SEQ ID NO: 1912178 - RNA, 22 nt, Shigella flexneri 2a str. 2457T
acugugcacccgcuucagugac

SEQ ID NO: 1912179 - RNA, 22 nt, Shigella flexneri 2a str. 2457T
acuguuuuaccaaauuggcaaa

SEQ ID NO: 1912180 - RNA, 14 nt, Shigella flexneri 2a str. 2457T
acuuaauugguugc

SEQ ID NO: 1912181 - RNA, 14 nt, Shigella flexneri 2a str. 2457T
acuuaaugaaucau

SEQ ID NO: 1912182 - RNA, 16 nt, Shigella flexneri 2a str. 2457T
acuguuuaucuuccca

SEQ ID NO: 1912183 - RNA, 17 nt, Shigella flexneri 2a str. 2457T
acuucaucacgaugcaa

SEQ ID NO: 1912184 - RNA, 23 nt, Shigella flexneri 2a str. 2457T
acuucaucgcccacguuuacugc

SEQ ID NO: 1912185 - RNA, 12 nt, Shigella flexneri 2a str. 2457T
acuucaugcccc

SEQ ID NO: 1912186 - RNA, 16 nt, Shigella flexneri 2a str. 2457T
acuucauuaaccacga

SEQ ID NO: 1912187 - RNA, 12 nt, Shigella flexneri 2a str. 2457T
acuucaaacaaa

SEQ ID NO: 1912188 - RNA, 14 nt, Shigella flexneri 2a str. 2457T
acuuacuucagcaa

SEQ ID NO: 1912189 - RNA, 16 nt, Shigella flexneri 2a str. 2457T
acuuauggcuggcugg

SEQ ID NO: 1912190 - RNA, 19 nt, Shigella flexneri 2a str. 2457T
acuuauuaaaauugcauga

SEQ ID NO: 1912191 - RNA, 21 nt, Shigella flexneri 2a str. 2457T
acuuacaucugucugauaaaa

SEQ ID NO: 1912192 - RNA, 17 nt, Shigella flexneri 2a str. 2457T
acuuacucauuaaugca

SEQ ID NO: 1912193 - RNA, 18 nt, Shigella flexneri 2a str. 2457T
acuuacugauaguguuuu

SEQ ID NO: 1912194 - RNA, 21 nt, Shigella flexneri 2a str. 2457T
acuuucgagcaauuuuccuug

SEQ ID NO: 1912195 - RNA, 22 nt, Shigella flexneri 2a str. 2457T
acuuucggcagaaaauccacca

SEQ ID NO: 1912196 - RNA, 15 nt, Shigella flexneri 2a str. 2457T
acuuuccagccacag

SEQ ID NO: 1912197 - RNA, 16 nt, Shigella flexneri 2a str. 2457T
acuuuccaucuuuccu

SEQ ID NO: 1912198 - RNA, 13 nt, Shigella flexneri 2a str. 2457T
acuuuccagccac

SEQ ID NO: 1912199 - RNA, 22 nt, Shigella flexneri 2a str. 2457T
acuuucuuuuuguugcgcugaa

SEQ ID NO: 1912200 - RNA, 16 nt, Shigella flexneri 2a str. 2457T
acuuucucuucaucua

SEQ ID NO: 1912201 - RNA, 24 nt, Shigella flexneri 2a str. 2457T
acuuucugagauucaauuauagua

SEQ ID NO: 1912202 - RNA, 18 nt, Shigella flexneri 2a str. 2457T
acuuucucuucaucuaua

SEQ ID NO: 1912203 - RNA, 17 nt, Shigella flexneri 2a str. 2457T
acuuuuaaaucgccaag

SEQ ID NO: 1912204 - RNA, 13 nt, Shigella flexneri 2a str. 2457T
acuuugucaaaaa

SEQ ID NO: 1912205 - RNA, 20 nt, Shigella flexneri 2a str. 2457T
acuuugugcaauugcucccu

SEQ ID NO: 1912206 - RNA, 15 nt, Shigella flexneri 2a str. 2457T
acuuuuacucauuuc

SEQ ID NO: 1912207 - RNA, 18 nt, Shigella flexneri 2a str. 2457T
acuuuagccgguuuuuca

SEQ ID NO: 1912208 - RNA, 19 nt, Shigella flexneri 2a str. 2457T
acuuuaucgcgcaaaaaau

SEQ ID NO: 1912209 - RNA, 16 nt, Shigella flexneri 2a str. 2457T
acuuuaucugauuuga

SEQ ID NO: 1912210 - RNA, 17 nt, Shigella flexneri 2a str. 2457T
acuuucacgccgccaaa

SEQ ID NO: 1912211 - RNA, 16 nt, Shigella flexneri 2a str. 2457T
acuuucagaccgccaa

SEQ ID NO: 1912212 - RNA, 16 nt, Shigella flexneri 2a str. 2457T
acuuucacgcccauaa

SEQ ID NO: 1912213 - RNA, 17 nt, Shigella flexneri 2a str. 2457T
acuuucacaaaaauaau

SEQ ID NO: 1912214 - RNA, 18 nt, Shigella flexneri 2a str. 2457T
acuuucaaacgccacagc

SEQ ID NO: 1912215 - RNA, 21 nt, Shigella flexneri 2a str. 2457T
acuuuaccgguuucaauccag

SEQ ID NO: 1912216 - RNA, 22 nt, Shigella flexneri 2a str. 2457T
acuuuacccgguuugugaaugu

SEQ ID NO: 1912217 - RNA, 14 nt, Shigella flexneri 2a str. 2457T
acuuuaauuuugug

SEQ ID NO: 1912218 - RNA, 23 nt, Shigella flexneri 2a str. 2457T
acuuuaauuuugugcagcaugca

SEQ ID NO: 1912219 - RNA, 17 nt, Shigella flexneri 2a str. 2457T
acuuuaaauucagcauu

SEQ ID NO: 1912220 - RNA, 23 nt, Shigella flexneri 2a str. 2457T
agaaauaccacccgucgggcaga

SEQ ID NO: 1912221 - RNA, 20 nt, Shigella flexneri 2a str. 2457T
agaaaucagcuuuggugaaa

SEQ ID NO: 1912222 - RNA, 9 nt, Shigella flexneri 2a str. 2457T
agaaaucag

SEQ ID NO: 1912223 - RNA, 17 nt, Shigella flexneri 2a str. 2457T
agaaaucauucaauacu

SEQ ID NO: 1912224 - RNA, 18 nt, Shigella flexneri 2a str. 2457T
agaaaucaguaaauugca

SEQ ID NO: 1912225 - RNA, 16 nt, Shigella flexneri 2a str. 2457T
agaaaugaaaaaauag

SEQ ID NO: 1912226 - RNA, 14 nt, Shigella flexneri 2a str. 2457T
agaaaugaaaaaau

SEQ ID NO: 1912227 - RNA, 22 nt, Shigella flexneri 2a str. 2457T
agaaaucccccagcaucacgcc

SEQ ID NO: 1912228 - RNA, 16 nt, Shigella flexneri 2a str. 2457T
agaaacagucuggagc

SEQ ID NO: 1912229 - RNA, 21 nt, Shigella flexneri 2a str. 2457T
agaaacagucuggagcaaaaa

SEQ ID NO: 1912230 - RNA, 14 nt, Shigella flexneri 2a str. 2457T
agaaaguuuuucaa

SEQ ID NO: 1912231 - RNA, 22 nt, Shigella flexneri 2a str. 2457T
agaaaguugccagauaaauauu

SEQ ID NO: 1912232 - RNA, 17 nt, Shigella flexneri 2a str. 2457T
agaaagaggcggauaaa

SEQ ID NO: 1912233 - RNA, 12 nt, Shigella flexneri 2a str. 2457T
agaaacaaaaaa

SEQ ID NO: 1912234 - RNA, 22 nt, Shigella flexneri 2a str. 2457T
agaaacaaaaaaaacagcgccc

SEQ ID NO: 1912235 - RNA, 16 nt, Shigella flexneri 2a str. 2457T
agaaaagccaaccugc

SEQ ID NO: 1912236 - RNA, 23 nt, Shigella flexneri 2a str. 2457T
agaaaagcgagaguuacagcucu

SEQ ID NO: 1912237 - RNA, 15 nt, Shigella flexneri 2a str. 2457T
agaaaacguuucaac

SEQ ID NO: 1912238 - RNA, 23 nt, Shigella flexneri 2a str. 2457T
agaaaacgaaagcgccaucaaug

SEQ ID NO: 1912239 - RNA, 14 nt, Shigella flexneri 2a str. 2457T
agaaaacgaauacu

SEQ ID NO: 1912240 - RNA, 22 nt, Shigella flexneri 2a str. 2457T
acuuuucccuacugcugacaua

SEQ ID NO: 1912241 - RNA, 22 nt, Shigella flexneri 2a str. 2457T
acuuuucaccgcuuugccaaac

SEQ ID NO: 1912242 - RNA, 14 nt, Shigella flexneri 2a str. 2457T
acuuuuauuucacc

SEQ ID NO: 1912243 - RNA, 22 nt, Shigella flexneri 2a str. 2457T
agaaaaaaugaccggccagcau

SEQ ID NO: 1912244 - RNA, 21 nt, Shigella flexneri 2a str. 2457T
agagacguucgcguacugcug

SEQ ID NO: 1912245 - RNA, 14 nt, Shigella flexneri 2a str. 2457T
agagcaucaugaau

SEQ ID NO: 1912246 - RNA, 18 nt, Shigella flexneri 2a str. 2457T
agagcaugaaaugaaaau

SEQ ID NO: 1912247 - RNA, 20 nt, Shigella flexneri 2a str. 2457T
agagcaugaaaugaaaauca

SEQ ID NO: 1912248 - RNA, 12 nt, Shigella flexneri 2a str. 2457T
agagcauuacac

SEQ ID NO: 1912249 - RNA, 13 nt, Shigella flexneri 2a str. 2457T
agagccagcccca

SEQ ID NO: 1912250 - RNA, 19 nt, Shigella flexneri 2a str. 2457T
agagccagccccacagcag

SEQ ID NO: 1912251 - RNA, 13 nt, Shigella flexneri 2a str. 2457T
agagccaccaacu

SEQ ID NO: 1912252 - RNA, 23 nt, Shigella flexneri 2a str. 2457T
agagccaccaacucugggcugaa

SEQ ID NO: 1912253 - RNA, 19 nt, Shigella flexneri 2a str. 2457T
agagcaucaugaauauaua

SEQ ID NO: 1912254 - RNA, 13 nt, Shigella flexneri 2a str. 2457T
agagcuaacugga

SEQ ID NO: 1912255 - RNA, 17 nt, Shigella flexneri 2a str. 2457T
agagcugaagcauggug

SEQ ID NO: 1912256 - RNA, 15 nt, Shigella flexneri 2a str. 2457T
agaggaaucgcuguu

SEQ ID NO: 1912257 - RNA, 13 nt, Shigella flexneri 2a str. 2457T
agaggagccauca

SEQ ID NO: 1912258 - RNA, 18 nt, Shigella flexneri 2a str. 2457T
agaggcguuccugcaacg

SEQ ID NO: 1912259 - RNA, 16 nt, Shigella flexneri 2a str. 2457T
agaggcgcagaugaag

SEQ ID NO: 1912260 - RNA, 17 nt, Shigella flexneri 2a str. 2457T
agagguuauaaauaaaa

SEQ ID NO: 1912261 - RNA, 19 nt, Shigella flexneri 2a str. 2457T
agagguuauaaauaaaaau

SEQ ID NO: 1912262 - RNA, 18 nt, Shigella flexneri 2a str. 2457T
agagugauuaacuguucu

SEQ ID NO: 1912263 - RNA, 20 nt, Shigella flexneri 2a str. 2457T
agagugccgaagaacauaaa

SEQ ID NO: 1912264 - RNA, 18 nt, Shigella flexneri 2a str. 2457T
agaguggauuaucuucac

SEQ ID NO: 1912265 - RNA, 13 nt, Shigella flexneri 2a str. 2457T
agaguuauuucau

SEQ ID NO: 1912266 - RNA, 16 nt, Shigella flexneri 2a str. 2457T
agaguucaaagccgaa

SEQ ID NO: 1912267 - RNA, 22 nt, Shigella flexneri 2a str. 2457T
agagugguuagccggauaaaca

SEQ ID NO: 1912268 - RNA, 22 nt, Shigella flexneri 2a str. 2457T
agauaaaucacgcuucacccuu

SEQ ID NO: 1912269 - RNA, 17 nt, Shigella flexneri 2a str. 2457T
agauaaaacgacaccac

SEQ ID NO: 1912270 - RNA, 13 nt, Shigella flexneri 2a str. 2457T
agauaaaaaugaa

SEQ ID NO: 1912271 - RNA, 16 nt, Shigella flexneri 2a str. 2457T
agauaaaauuaacgac

SEQ ID NO: 1912272 - RNA, 13 nt, Shigella flexneri 2a str. 2457T
agauaaaaaguuu

SEQ ID NO: 1912273 - RNA, 21 nt, Shigella flexneri 2a str. 2457T
agauaacuacccaaccgauaa

SEQ ID NO: 1912274 - RNA, 21 nt, Shigella flexneri 2a str. 2457T
agauaacgccuggcaguggug

SEQ ID NO: 1912275 - RNA, 13 nt, Shigella flexneri 2a str. 2457T
agauaaauuacug

SEQ ID NO: 1912276 - RNA, 15 nt, Shigella flexneri 2a str. 2457T
agauaaauuacugcc

SEQ ID NO: 1912277 - RNA, 23 nt, Shigella flexneri 2a str. 2457T
agauaaccccgcuugcuguuccu

SEQ ID NO: 1912278 - RNA, 19 nt, Shigella flexneri 2a str. 2457T
agauaaccacguucauuuc

SEQ ID NO: 1912279 - RNA, 20 nt, Shigella flexneri 2a str. 2457T
agagaacaucaauccaaaca

SEQ ID NO: 1912280 - RNA, 20 nt, Shigella flexneri 2a str. 2457T
agagaacuguagacaaaaug

SEQ ID NO: 1912281 - RNA, 13 nt, Shigella flexneri 2a str. 2457T
agagaaguuugac

SEQ ID NO: 1912282 - RNA, 14 nt, Shigella flexneri 2a str. 2457T
agagacacaacaau

SEQ ID NO: 1912283 - RNA, 23 nt, Shigella flexneri 2a str. 2457T
agacuuuuuucauggguaccaga

SEQ ID NO: 1912284 - RNA, 13 nt, Shigella flexneri 2a str. 2457T
agagaaaaccaau

SEQ ID NO: 1912285 - RNA, 14 nt, Shigella flexneri 2a str. 2457T
agagaaaaucacac

SEQ ID NO: 1912286 - RNA, 13 nt, Shigella flexneri 2a str. 2457T
agagaaaaucaca

SEQ ID NO: 1912287 - RNA, 16 nt, Shigella flexneri 2a str. 2457T
agagaaaccacaucaa

SEQ ID NO: 1912288 - RNA, 21 nt, Shigella flexneri 2a str. 2457T
agagaaagaacgaguaaaagg

SEQ ID NO: 1912289 - RNA, 16 nt, Shigella flexneri 2a str. 2457T
agacuuugcugccuuu

SEQ ID NO: 1912290 - RNA, 17 nt, Shigella flexneri 2a str. 2457T
agacuuggcuuucucuu

SEQ ID NO: 1912291 - RNA, 19 nt, Shigella flexneri 2a str. 2457T
agacugaugacaaacggaa

SEQ ID NO: 1912292 - RNA, 16 nt, Shigella flexneri 2a str. 2457T
agacugaugacuaaag

SEQ ID NO: 1912293 - RNA, 20 nt, Shigella flexneri 2a str. 2457T
agacuguagaugaucgccgc

SEQ ID NO: 1912294 - RNA, 13 nt, Shigella flexneri 2a str. 2457T
agacugggcaaga

SEQ ID NO: 1912295 - RNA, 15 nt, Shigella flexneri 2a str. 2457T
agacugcgcuaccag

SEQ ID NO: 1912296 - RNA, 15 nt, Shigella flexneri 2a str. 2457T
agacugcaagaauag

SEQ ID NO: 1912297 - RNA, 15 nt, Shigella flexneri 2a str. 2457T
agacugcuccuguau

SEQ ID NO: 1912298 - RNA, 17 nt, Shigella flexneri 2a str. 2457T
agacugcgcuaccagga

SEQ ID NO: 1912299 - RNA, 13 nt, Shigella flexneri 2a str. 2457T
agacucccagccu

SEQ ID NO: 1912300 - RNA, 14 nt, Shigella flexneri 2a str. 2457T
agacucccagccuc

SEQ ID NO: 1912301 - RNA, 20 nt, Shigella flexneri 2a str. 2457T
agacucccagccucccauuu

SEQ ID NO: 1912302 - RNA, 17 nt, Shigella flexneri 2a str. 2457T
agacucauauaaaaacc

SEQ ID NO: 1912303 - RNA, 13 nt, Shigella flexneri 2a str. 2457T
agacgcuggaagc

SEQ ID NO: 1912304 - RNA, 16 nt, Shigella flexneri 2a str. 2457T
agacgcgcagcuucac

SEQ ID NO: 1912305 - RNA, 19 nt, Shigella flexneri 2a str. 2457T
agacgcguuaauaccugau

SEQ ID NO: 1912306 - RNA, 18 nt, Shigella flexneri 2a str. 2457T
agacgcgcuugcauuacu

SEQ ID NO: 1912307 - RNA, 20 nt, Shigella flexneri 2a str. 2457T
agacgcgcagcuucacuucu

SEQ ID NO: 1912308 - RNA, 21 nt, Shigella flexneri 2a str. 2457T
agacgcuacuuuuuucaccca

SEQ ID NO: 1912309 - RNA, 15 nt, Shigella flexneri 2a str. 2457T
agacgcucugcggua

SEQ ID NO: 1912310 - RNA, 19 nt, Shigella flexneri 2a str. 2457T
agacgcucgccauuuuuca

SEQ ID NO: 1912311 - RNA, 17 nt, Shigella flexneri 2a str. 2457T
agacgcugcauugacaa

SEQ ID NO: 1912312 - RNA, 14 nt, Shigella flexneri 2a str. 2457T
agacaugguaaaac

SEQ ID NO: 1912313 - RNA, 18 nt, Shigella flexneri 2a str. 2457T
agacauguggauuaaauu

SEQ ID NO: 1912314 - RNA, 22 nt, Shigella flexneri 2a str. 2457T
agacauuacguccaucacaauc

SEQ ID NO: 1912315 - RNA, 21 nt, Shigella flexneri 2a str. 2457T
agaccaaaacgugcagcugcc

SEQ ID NO: 1912316 - RNA, 19 nt, Shigella flexneri 2a str. 2457T
agacauuccuuuacuuaga

SEQ ID NO: 1912317 - RNA, 12 nt, Shigella flexneri 2a str. 2457T
agacccaguuuu

SEQ ID NO: 1912318 - RNA, 18 nt, Shigella flexneri 2a str. 2457T
agaccaauccgccagcca

SEQ ID NO: 1912319 - RNA, 16 nt, Shigella flexneri 2a str. 2457T
agaccaauccgccagc

SEQ ID NO: 1912320 - RNA, 19 nt, Shigella flexneri 2a str. 2457T
agacccugcucuuucagca

SEQ ID NO: 1912321 - RNA, 21 nt, Shigella flexneri 2a str. 2457T
agacccugcucuuucagcacc

SEQ ID NO: 1912322 - RNA, 20 nt, Shigella flexneri 2a str. 2457T
agacgaacguuuaauaaaac

SEQ ID NO: 1912323 - RNA, 14 nt, Shigella flexneri 2a str. 2457T
agacgccagccaca

SEQ ID NO: 1912324 - RNA, 22 nt, Shigella flexneri 2a str. 2457T
agaccuuaucacaaucggcuuu

SEQ ID NO: 1912325 - RNA, 14 nt, Shigella flexneri 2a str. 2457T
agaccuuaauugcu

SEQ ID NO: 1912326 - RNA, 18 nt, Shigella flexneri 2a str. 2457T
agaccuuucgaacccaac

SEQ ID NO: 1912327 - RNA, 17 nt, Shigella flexneri 2a str. 2457T
agaccugggcgaugcug

SEQ ID NO: 1912328 - RNA, 13 nt, Shigella flexneri 2a str. 2457T
agaccggcaacca

SEQ ID NO: 1912329 - RNA, 17 nt, Shigella flexneri 2a str. 2457T
agaccggcaaccagcac

SEQ ID NO: 1912330 - RNA, 13 nt, Shigella flexneri 2a str. 2457T
agaccgcaucacg

SEQ ID NO: 1912331 - RNA, 17 nt, Shigella flexneri 2a str. 2457T
agaccgauacacaucgu

SEQ ID NO: 1912332 - RNA, 17 nt, Shigella flexneri 2a str. 2457T
agacagcgucacaucag

SEQ ID NO: 1912333 - RNA, 16 nt, Shigella flexneri 2a str. 2457T
agacagccuaccagac

SEQ ID NO: 1912334 - RNA, 15 nt, Shigella flexneri 2a str. 2457T
agacagcgacucucu

SEQ ID NO: 1912335 - RNA, 17 nt, Shigella flexneri 2a str. 2457T
agacaucccagugcaau

SEQ ID NO: 1912336 - RNA, 15 nt, Shigella flexneri 2a str. 2457T
agacaacaacaucag

SEQ ID NO: 1912337 - RNA, 14 nt, Shigella flexneri 2a str. 2457T
agacaacccacaca

SEQ ID NO: 1912338 - RNA, 16 nt, Shigella flexneri 2a str. 2457T
agacaacccacacauu

SEQ ID NO: 1912339 - RNA, 21 nt, Shigella flexneri 2a str. 2457T
agacaauugauggaaaauugu

SEQ ID NO: 1912340 - RNA, 18 nt, Shigella flexneri 2a str. 2457T
agacaccuugcaacuccg

SEQ ID NO: 1912341 - RNA, 17 nt, Shigella flexneri 2a str. 2457T
agacaccgcccaacaga

SEQ ID NO: 1912342 - RNA, 11 nt, Shigella flexneri 2a str. 2457T
agacaccagaa

SEQ ID NO: 1912343 - RNA, 15 nt, Shigella flexneri 2a str. 2457T
agaauuacuggcaga

SEQ ID NO: 1912344 - RNA, 13 nt, Shigella flexneri 2a str. 2457T
agaauuaaucgag

SEQ ID NO: 1912345 - RNA, 16 nt, Shigella flexneri 2a str. 2457T
agaauuaaaauaucag

SEQ ID NO: 1912346 - RNA, 22 nt, Shigella flexneri 2a str. 2457T
agaauuuuauacuuuuucgcca

SEQ ID NO: 1912347 - RNA, 15 nt, Shigella flexneri 2a str. 2457T
agacaaccaaaauca

SEQ ID NO: 1912348 - RNA, 12 nt, Shigella flexneri 2a str. 2457T
agacaaaguaac

SEQ ID NO: 1912349 - RNA, 17 nt, Shigella flexneri 2a str. 2457T
agacaaaauccugccag

SEQ ID NO: 1912350 - RNA, 13 nt, Shigella flexneri 2a str. 2457T
agacaaaauguuc

SEQ ID NO: 1912351 - RNA, 14 nt, Shigella flexneri 2a str. 2457T
agaauuuuucacuc

SEQ ID NO: 1912352 - RNA, 23 nt, Shigella flexneri 2a str. 2457T
agaaggcauaacuccccgagaaa

SEQ ID NO: 1912353 - RNA, 14 nt, Shigella flexneri 2a str. 2457T
agaagggcuggcca

SEQ ID NO: 1912354 - RNA, 15 nt, Shigella flexneri 2a str. 2457T
agaagcggaaaucac

SEQ ID NO: 1912355 - RNA, 20 nt, Shigella flexneri 2a str. 2457T
agaagcggaaaucacgcauc

SEQ ID NO: 1912356 - RNA, 23 nt, Shigella flexneri 2a str. 2457T
agaaggauugaucaauucuaaau

SEQ ID NO: 1912357 - RNA, 19 nt, Shigella flexneri 2a str. 2457T
agaagccauuaaacaccag

SEQ ID NO: 1912358 - RNA, 22 nt, Shigella flexneri 2a str. 2457T
agaagccauuaaacaccaguac

SEQ ID NO: 1912359 - RNA, 15 nt, Shigella flexneri 2a str. 2457T
agaagagagauaauu

SEQ ID NO: 1912360 - RNA, 22 nt, Shigella flexneri 2a str. 2457T
agaagaucagaaauuuccugag

SEQ ID NO: 1912361 - RNA, 21 nt, Shigella flexneri 2a str. 2457T
agaagaucguggagaacaaua

SEQ ID NO: 1912362 - RNA, 15 nt, Shigella flexneri 2a str. 2457T
agaaauggcccaaaa

SEQ ID NO: 1912363 - RNA, 17 nt, Shigella flexneri 2a str. 2457T
agaaauggcccaaaagg

SEQ ID NO: 1912364 - RNA, 16 nt, Shigella flexneri 2a str. 2457T
agaaaugguaaagaag

SEQ ID NO: 1912365 - RNA, 14 nt, Shigella flexneri 2a str. 2457T
agaaaugccaguaa

SEQ ID NO: 1912366 - RNA, 16 nt, Shigella flexneri 2a str. 2457T
agaaaugccaguaacu

SEQ ID NO: 1912367 - RNA, 13 nt, Shigella flexneri 2a str. 2457T
agaaauuauuucu

SEQ ID NO: 1912368 - RNA, 17 nt, Shigella flexneri 2a str. 2457T
agaaucacgccaacaaa

SEQ ID NO: 1912369 - RNA, 13 nt, Shigella flexneri 2a str. 2457T
agaaucaccucuu

SEQ ID NO: 1912370 - RNA, 20 nt, Shigella flexneri 2a str. 2457T
agaaucaccucuuuuuccac

SEQ ID NO: 1912371 - RNA, 15 nt, Shigella flexneri 2a str. 2457T
agaauccaggaaagc

SEQ ID NO: 1912372 - RNA, 18 nt, Shigella flexneri 2a str. 2457T
agaauccaggaaagccau

SEQ ID NO: 1912373 - RNA, 20 nt, Shigella flexneri 2a str. 2457T
agaauguuaacgccaauuaa

SEQ ID NO: 1912374 - RNA, 22 nt, Shigella flexneri 2a str. 2457T
agaaugaugccgccagaaaugg

SEQ ID NO: 1912375 - RNA, 13 nt, Shigella flexneri 2a str. 2457T
agaauaaaacagg

SEQ ID NO: 1912376 - RNA, 13 nt, Shigella flexneri 2a str. 2457T
agaaguucugcag

SEQ ID NO: 1912377 - RNA, 22 nt, Shigella flexneri 2a str. 2457T
agaauaacggcugauaacaaua

SEQ ID NO: 1912378 - RNA, 23 nt, Shigella flexneri 2a str. 2457T
agaauauacggaaugauauuggu

SEQ ID NO: 1912379 - RNA, 16 nt, Shigella flexneri 2a str. 2457T
acggcauaagccgucc

SEQ ID NO: 1912380 - RNA, 13 nt, Shigella flexneri 2a str. 2457T
acggcagugaaca

SEQ ID NO: 1912381 - RNA, 13 nt, Shigella flexneri 2a str. 2457T
acggcagugaacg

SEQ ID NO: 1912382 - RNA, 18 nt, Shigella flexneri 2a str. 2457T
acggcaucccaacucauu

SEQ ID NO: 1912383 - RNA, 15 nt, Shigella flexneri 2a str. 2457T
acggcgcaccagaau

SEQ ID NO: 1912384 - RNA, 22 nt, Shigella flexneri 2a str. 2457T
acggcgcgacuuuaaucaccug

SEQ ID NO: 1912385 - RNA, 13 nt, Shigella flexneri 2a str. 2457T
acggcauuauuca

SEQ ID NO: 1912386 - RNA, 23 nt, Shigella flexneri 2a str. 2457T
acggcgcagcuucacaaaggcuu

SEQ ID NO: 1912387 - RNA, 15 nt, Shigella flexneri 2a str. 2457T
acggcgcaugccuca

SEQ ID NO: 1912388 - RNA, 15 nt, Shigella flexneri 2a str. 2457T
acggcgcauugccag

SEQ ID NO: 1912389 - RNA, 21 nt, Shigella flexneri 2a str. 2457T
acggcuguuggaaucacucau

SEQ ID NO: 1912390 - RNA, 19 nt, Shigella flexneri 2a str. 2457T
acggcugucauccagcagc

SEQ ID NO: 1912391 - RNA, 15 nt, Shigella flexneri 2a str. 2457T
acggcugggaaauca

SEQ ID NO: 1912392 - RNA, 18 nt, Shigella flexneri 2a str. 2457T
acggcugucauccagcag

SEQ ID NO: 1912393 - RNA, 12 nt, Shigella flexneri 2a str. 2457T
acggcuggaaca

SEQ ID NO: 1912394 - RNA, 15 nt, Shigella flexneri 2a str. 2457T
acggcuuugcgcaug

SEQ ID NO: 1912395 - RNA, 20 nt, Shigella flexneri 2a str. 2457T
acggcuucgccuccuguucu

SEQ ID NO: 1912396 - RNA, 14 nt, Shigella flexneri 2a str. 2457T
acggcgugccgucg

SEQ ID NO: 1912397 - RNA, 19 nt, Shigella flexneri 2a str. 2457T
acggcgugcugaugcacga

SEQ ID NO: 1912398 - RNA, 17 nt, Shigella flexneri 2a str. 2457T
acggcguggcaucaaua

SEQ ID NO: 1912399 - RNA, 13 nt, Shigella flexneri 2a str. 2457T
acggcuaaaaaaa

SEQ ID NO: 1912400 - RNA, 17 nt, Shigella flexneri 2a str. 2457T
acggcguuuccagcucg

SEQ ID NO: 1912401 - RNA, 18 nt, Shigella flexneri 2a str. 2457T
acggcugauaugccagac

SEQ ID NO: 1912402 - RNA, 14 nt, Shigella flexneri 2a str. 2457T
acggcucagcucug

SEQ ID NO: 1912403 - RNA, 17 nt, Shigella flexneri 2a str. 2457T
acgcuuugcaggcuggu

SEQ ID NO: 1912404 - RNA, 14 nt, Shigella flexneri 2a str. 2457T
acgcuuuucagugc

SEQ ID NO: 1912405 - RNA, 14 nt, Shigella flexneri 2a str. 2457T
acgcuuucucacca

SEQ ID NO: 1912406 - RNA, 22 nt, Shigella flexneri 2a str. 2457T
acgcuuucacccggaucaauua

SEQ ID NO: 1912407 - RNA, 22 nt, Shigella flexneri 2a str. 2457T
acggacucggcgucgguaaaga

SEQ ID NO: 1912408 - RNA, 17 nt, Shigella flexneri 2a str. 2457T
acggaguugaccagcuc

SEQ ID NO: 1912409 - RNA, 22 nt, Shigella flexneri 2a str. 2457T
acggagcaggcguuaaaacagg

SEQ ID NO: 1912410 - RNA, 12 nt, Shigella flexneri 2a str. 2457T
acggcaccaccc

SEQ ID NO: 1912411 - RNA, 18 nt, Shigella flexneri 2a str. 2457T
acggcacucgcuggcacu

SEQ ID NO: 1912412 - RNA, 21 nt, Shigella flexneri 2a str. 2457T
acgcuuauuuauuggugagaa

SEQ ID NO: 1912413 - RNA, 20 nt, Shigella flexneri 2a str. 2457T
acgcuucaaucugauauuua

SEQ ID NO: 1912414 - RNA, 19 nt, Shigella flexneri 2a str. 2457T
acgcuucaaucugauauuu

SEQ ID NO: 1912415 - RNA, 12 nt, Shigella flexneri 2a str. 2457T
acgcuugucauc

SEQ ID NO: 1912416 - RNA, 18 nt, Shigella flexneri 2a str. 2457T
acgcugaugucagcacuu

SEQ ID NO: 1912417 - RNA, 18 nt, Shigella flexneri 2a str. 2457T
acgcugcaucgccaaucu

SEQ ID NO: 1912418 - RNA, 19 nt, Shigella flexneri 2a str. 2457T
acgcgauucccagucgcgc

SEQ ID NO: 1912419 - RNA, 19 nt, Shigella flexneri 2a str. 2457T
acgcgauuucucaucaaau

SEQ ID NO: 1912420 - RNA, 17 nt, Shigella flexneri 2a str. 2457T
acgcgaccaaaggcgag

SEQ ID NO: 1912421 - RNA, 13 nt, Shigella flexneri 2a str. 2457T
acgcgaccaucaa

SEQ ID NO: 1912422 - RNA, 15 nt, Shigella flexneri 2a str. 2457T
acgcgaccaucaagg

SEQ ID NO: 1912423 - RNA, 22 nt, Shigella flexneri 2a str. 2457T
acgcgcccguagucggugccau

SEQ ID NO: 1912424 - RNA, 17 nt, Shigella flexneri 2a str. 2457T
acgcgccacgcacgccu

SEQ ID NO: 1912425 - RNA, 16 nt, Shigella flexneri 2a str. 2457T
acgcgccagcaccgca

SEQ ID NO: 1912426 - RNA, 21 nt, Shigella flexneri 2a str. 2457T
acgcgccagagagaacugcgc

SEQ ID NO: 1912427 - RNA, 15 nt, Shigella flexneri 2a str. 2457T
acgcgccaccgacca

SEQ ID NO: 1912428 - RNA, 13 nt, Shigella flexneri 2a str. 2457T
acgcggcacagca

SEQ ID NO: 1912429 - RNA, 23 nt, Shigella flexneri 2a str. 2457T
acgcggcaauaauagccccaacc

SEQ ID NO: 1912430 - RNA, 17 nt, Shigella flexneri 2a str. 2457T
acgcgguauuggugaaa

SEQ ID NO: 1912431 - RNA, 15 nt, Shigella flexneri 2a str. 2457T
acgcgguagcgggca

SEQ ID NO: 1912432 - RNA, 17 nt, Shigella flexneri 2a str. 2457T
acgcggggguaaaaccc

SEQ ID NO: 1912433 - RNA, 16 nt, Shigella flexneri 2a str. 2457T
acgcgguuaucccaaa

SEQ ID NO: 1912434 - RNA, 18 nt, Shigella flexneri 2a str. 2457T
acgcucuuccaggguaaa

SEQ ID NO: 1912435 - RNA, 16 nt, Shigella flexneri 2a str. 2457T
acgcucuuccagggua

SEQ ID NO: 1912436 - RNA, 20 nt, Shigella flexneri 2a str. 2457T
acgcugaauacgcaccgcuc

SEQ ID NO: 1912437 - RNA, 23 nt, Shigella flexneri 2a str. 2457T
acgcucuucaauggucagccaca

SEQ ID NO: 1912438 - RNA, 15 nt, Shigella flexneri 2a str. 2457T
acgcugacgcgucuu

SEQ ID NO: 1912439 - RNA, 23 nt, Shigella flexneri 2a str. 2457T
acgcucaggcuacuuuuccaggu

SEQ ID NO: 1912440 - RNA, 13 nt, Shigella flexneri 2a str. 2457T
acgcuccagcagg

SEQ ID NO: 1912441 - RNA, 18 nt, Shigella flexneri 2a str. 2457T
acgcuccccggcacuuaa

SEQ ID NO: 1912442 - RNA, 21 nt, Shigella flexneri 2a str. 2457T
acgcuccaguguggccagagu

SEQ ID NO: 1912443 - RNA, 19 nt, Shigella flexneri 2a str. 2457T
acgcuccgcaccugaguaa

SEQ ID NO: 1912444 - RNA, 16 nt, Shigella flexneri 2a str. 2457T
acgcucgaacagcugg

SEQ ID NO: 1912445 - RNA, 17 nt, Shigella flexneri 2a str. 2457T
acgcucgccauuuuuca

SEQ ID NO: 1912446 - RNA, 17 nt, Shigella flexneri 2a str. 2457T
acgcguuaauaccugau

SEQ ID NO: 1912447 - RNA, 14 nt, Shigella flexneri 2a str. 2457T
acgcguuacucugg

SEQ ID NO: 1912448 - RNA, 16 nt, Shigella flexneri 2a str. 2457T
acgcgucugaccgucu

SEQ ID NO: 1912449 - RNA, 12 nt, Shigella flexneri 2a str. 2457T
acgcgucuuauc

SEQ ID NO: 1912450 - RNA, 20 nt, Shigella flexneri 2a str. 2457T
acgcgucuugagagugcgaa

SEQ ID NO: 1912451 - RNA, 12 nt, Shigella flexneri 2a str. 2457T
acgcucacugca

SEQ ID NO: 1912452 - RNA, 14 nt, Shigella flexneri 2a str. 2457T
acgcucaacguuua

SEQ ID NO: 1912453 - RNA, 17 nt, Shigella flexneri 2a str. 2457T
acgcuacuuuuuucacc

SEQ ID NO: 1912454 - RNA, 13 nt, Shigella flexneri 2a str. 2457T
acgccagguuguu

SEQ ID NO: 1912455 - RNA, 21 nt, Shigella flexneri 2a str. 2457T
acgccagucgcacacaacaga

SEQ ID NO: 1912456 - RNA, 18 nt, Shigella flexneri 2a str. 2457T
acgccauacggcuaugaa

SEQ ID NO: 1912457 - RNA, 23 nt, Shigella flexneri 2a str. 2457T
acgccauacggcuaugaaagaaa

SEQ ID NO: 1912458 - RNA, 16 nt, Shigella flexneri 2a str. 2457T
acgccaucgccaggaa

SEQ ID NO: 1912459 - RNA, 14 nt, Shigella flexneri 2a str. 2457T
acgccagacugcgc

SEQ ID NO: 1912460 - RNA, 20 nt, Shigella flexneri 2a str. 2457T
acgccagacugcgcuaccag

SEQ ID NO: 1912461 - RNA, 16 nt, Shigella flexneri 2a str. 2457T
acgccacgcucacuca

SEQ ID NO: 1912462 - RNA, 15 nt, Shigella flexneri 2a str. 2457T
acgccaggccacgcu

SEQ ID NO: 1912463 - RNA, 15 nt, Shigella flexneri 2a str. 2457T
acgccagauacauca

SEQ ID NO: 1912464 - RNA, 21 nt, Shigella flexneri 2a str. 2457T
acgccaaucugcaaaauacca

SEQ ID NO: 1912465 - RNA, 18 nt, Shigella flexneri 2a str. 2457T
acgccaauaccgcccaga

SEQ ID NO: 1912466 - RNA, 20 nt, Shigella flexneri 2a str. 2457T
acgccaauaccgcccagacc

SEQ ID NO: 1912467 - RNA, 13 nt, Shigella flexneri 2a str. 2457T
acgcauugcauuu

SEQ ID NO: 1912468 - RNA, 15 nt, Shigella flexneri 2a str. 2457T
acgccaaccagcuga

SEQ ID NO: 1912469 - RNA, 17 nt, Shigella flexneri 2a str. 2457T
acgcauccaccagauaa

SEQ ID NO: 1912470 - RNA, 17 nt, Shigella flexneri 2a str. 2457T
acgcaucggcuaaacca

SEQ ID NO: 1912471 - RNA, 20 nt, Shigella flexneri 2a str. 2457T
acgcagugguuaacaaucac

SEQ ID NO: 1912472 - RNA, 23 nt, Shigella flexneri 2a str. 2457T
acgcaguuaacgcggauccccug

SEQ ID NO: 1912473 - RNA, 22 nt, Shigella flexneri 2a str. 2457T
acgcauaaugcgccccgcaacg

SEQ ID NO: 1912474 - RNA, 18 nt, Shigella flexneri 2a str. 2457T
acgcaggcggcuggcauc

SEQ ID NO: 1912475 - RNA, 15 nt, Shigella flexneri 2a str. 2457T
acgcagucuucccag

SEQ ID NO: 1912476 - RNA, 19 nt, Shigella flexneri 2a str. 2457T
acgcaggaugcaauuguug

SEQ ID NO: 1912477 - RNA, 16 nt, Shigella flexneri 2a str. 2457T
acgcagagacaucacc

SEQ ID NO: 1912478 - RNA, 14 nt, Shigella flexneri 2a str. 2457T
acgcacgcugucac

SEQ ID NO: 1912479 - RNA, 15 nt, Shigella flexneri 2a str. 2457T
acgcacgccugcauc

SEQ ID NO: 1912480 - RNA, 19 nt, Shigella flexneri 2a str. 2457T
acgcaccgcguauugcucu

SEQ ID NO: 1912481 - RNA, 13 nt, Shigella flexneri 2a str. 2457T
acgcagaccaaag

SEQ ID NO: 1912482 - RNA, 14 nt, Shigella flexneri 2a str. 2457T
acgcagacacugcu

SEQ ID NO: 1912483 - RNA, 14 nt, Shigella flexneri 2a str. 2457T
acgcacugcuugaa

SEQ ID NO: 1912484 - RNA, 22 nt, Shigella flexneri 2a str. 2457T
acgcacuguuggcgaaaauccu

SEQ ID NO: 1912485 - RNA, 16 nt, Shigella flexneri 2a str. 2457T
acgcagaaccagaagc

SEQ ID NO: 1912486 - RNA, 16 nt, Shigella flexneri 2a str. 2457T
acgcacagaacaaaau

SEQ ID NO: 1912487 - RNA, 18 nt, Shigella flexneri 2a str. 2457T
acgcacaggugcaaaaaa

SEQ ID NO: 1912488 - RNA, 15 nt, Shigella flexneri 2a str. 2457T
acgcaccaugcacgg

SEQ ID NO: 1912489 - RNA, 12 nt, Shigella flexneri 2a str. 2457T
acgcaccaugca

SEQ ID NO: 1912490 - RNA, 15 nt, Shigella flexneri 2a str. 2457T
accggagucugugcu

SEQ ID NO: 1912491 - RNA, 22 nt, Shigella flexneri 2a str. 2457T
acgccuuaguuauaaacuuuuc

SEQ ID NO: 1912492 - RNA, 14 nt, Shigella flexneri 2a str. 2457T
acgccuucccuuuc

SEQ ID NO: 1912493 - RNA, 22 nt, Shigella flexneri 2a str. 2457T
acgccuuguuccugcuuggcgc

SEQ ID NO: 1912494 - RNA, 13 nt, Shigella flexneri 2a str. 2457T
acgcgaacaacag

SEQ ID NO: 1912495 - RNA, 17 nt, Shigella flexneri 2a str. 2457T
acgccugcucuuauuac

SEQ ID NO: 1912496 - RNA, 21 nt, Shigella flexneri 2a str. 2457T
acgccugcgggcauuucgcuu

SEQ ID NO: 1912497 - RNA, 14 nt, Shigella flexneri 2a str. 2457T
acgccugccgcauc

SEQ ID NO: 1912498 - RNA, 15 nt, Shigella flexneri 2a str. 2457T
acgccugccagcucu

SEQ ID NO: 1912499 - RNA, 16 nt, Shigella flexneri 2a str. 2457T
acgccugcuucgucca

SEQ ID NO: 1912500 - RNA, 15 nt, Shigella flexneri 2a str. 2457T
acgccuggaaagugu

SEQ ID NO: 1912501 - RNA, 20 nt, Shigella flexneri 2a str. 2457T
acgccugggcgagguggaua

SEQ ID NO: 1912502 - RNA, 15 nt, Shigella flexneri 2a str. 2457T
acgccucguaaugcu

SEQ ID NO: 1912503 - RNA, 22 nt, Shigella flexneri 2a str. 2457T
acgccucguaaugcuccggcuc

SEQ ID NO: 1912504 - RNA, 23 nt, Shigella flexneri 2a str. 2457T
acgccucgggaaggucagguuug

SEQ ID NO: 1912505 - RNA, 14 nt, Shigella flexneri 2a str. 2457T
acgccucuauuaaa

SEQ ID NO: 1912506 - RNA, 23 nt, Shigella flexneri 2a str. 2457T
acgccgcugucuaccagcaccug

SEQ ID NO: 1912507 - RNA, 19 nt, Shigella flexneri 2a str. 2457T
acgccgcuuuuuuuacguc

SEQ ID NO: 1912508 - RNA, 24 nt, Shigella flexneri 2a str. 2457T
acgccgggaaauuuuuccguuuuc

SEQ ID NO: 1912509 - RNA, 23 nt, Shigella flexneri 2a str. 2457T
acgccggugaccaucagcaugac

SEQ ID NO: 1912510 - RNA, 20 nt, Shigella flexneri 2a str. 2457T
acgccguuauuaaaaagccu

SEQ ID NO: 1912511 - RNA, 23 nt, Shigella flexneri 2a str. 2457T
acgccguuggcguaaaucaaacc

SEQ ID NO: 1912512 - RNA, 21 nt, Shigella flexneri 2a str. 2457T
acgccguuuuuacccagcagc

SEQ ID NO: 1912513 - RNA, 12 nt, Shigella flexneri 2a str. 2457T
acgccuaauaaa

SEQ ID NO: 1912514 - RNA, 15 nt, Shigella flexneri 2a str. 2457T
acgccguaaguaagg

SEQ ID NO: 1912515 - RNA, 14 nt, Shigella flexneri 2a str. 2457T
acgcccgccgacca

SEQ ID NO: 1912516 - RNA, 20 nt, Shigella flexneri 2a str. 2457T
acgcccgucaacggugccau

SEQ ID NO: 1912517 - RNA, 19 nt, Shigella flexneri 2a str. 2457T
acgcccaacuaaaugcugc

SEQ ID NO: 1912518 - RNA, 12 nt, Shigella flexneri 2a str. 2457T
acgcccagcgcg

SEQ ID NO: 1912519 - RNA, 19 nt, Shigella flexneri 2a str. 2457T
acgccccacagacccaggu

SEQ ID NO: 1912520 - RNA, 19 nt, Shigella flexneri 2a str. 2457T
acgccgccguuagcuucag

SEQ ID NO: 1912521 - RNA, 20 nt, Shigella flexneri 2a str. 2457T
acgccgccguuagcuucagc

SEQ ID NO: 1912522 - RNA, 15 nt, Shigella flexneri 2a str. 2457T
acgccgcgcgccacc

SEQ ID NO: 1912523 - RNA, 20 nt, Shigella flexneri 2a str. 2457T
acgccgcccagagaacuggc

SEQ ID NO: 1912524 - RNA, 19 nt, Shigella flexneri 2a str. 2457T
acgccgcauccggcaugaa

SEQ ID NO: 1912525 - RNA, 21 nt, Shigella flexneri 2a str. 2457T
acgccgcaucuggcauaaaca

SEQ ID NO: 1912526 - RNA, 21 nt, Shigella flexneri 2a str. 2457T
acgccgccagaccaauagaaa

SEQ ID NO: 1912527 - RNA, 19 nt, Shigella flexneri 2a str. 2457T
acgccgagaauaaaacagg

SEQ ID NO: 1912528 - RNA, 20 nt, Shigella flexneri 2a str. 2457T
acgccgacgggucagcgggg

SEQ ID NO: 1912529 - RNA, 20 nt, Shigella flexneri 2a str. 2457T
acgccgaggugcucuccacg

SEQ ID NO: 1912530 - RNA, 19 nt, Shigella flexneri 2a str. 2457T
acgccgauaaucaacgcgc

SEQ ID NO: 1912531 - RNA, 22 nt, Shigella flexneri 2a str. 2457T
acgccgcaauggcuucauccac

SEQ ID NO: 1912532 - RNA, 21 nt, Shigella flexneri 2a str. 2457T
acgccgaagugcgcgcagcug

SEQ ID NO: 1912533 - RNA, 17 nt, Shigella flexneri 2a str. 2457T
acgccgacgcccugcgc

SEQ ID NO: 1912534 - RNA, 13 nt, Shigella flexneri 2a str. 2457T
acgccgaaucagu

SEQ ID NO: 1912535 - RNA, 16 nt, Shigella flexneri 2a str. 2457T
acugaagcauugccga

SEQ ID NO: 1912536 - RNA, 16 nt, Shigella flexneri 2a str. 2457T
acugaacaaaaaagag

SEQ ID NO: 1912537 - RNA, 21 nt, Shigella flexneri 2a str. 2457T
acugaacaacuuaacuugcuu

SEQ ID NO: 1912538 - RNA, 15 nt, Shigella flexneri 2a str. 2457T
acugacauugccuuc

SEQ ID NO: 1912539 - RNA, 17 nt, Shigella flexneri 2a str. 2457T
acugaccccaaaaaguu

SEQ ID NO: 1912540 - RNA, 20 nt, Shigella flexneri 2a str. 2457T
acugacauuacggauuaaau

SEQ ID NO: 1912541 - RNA, 21 nt, Shigella flexneri 2a str. 2457T
acugacagggugagcagggca

SEQ ID NO: 1912542 - RNA, 19 nt, Shigella flexneri 2a str. 2457T
acugacaucagcauccgca

SEQ ID NO: 1912543 - RNA, 14 nt, Shigella flexneri 2a str. 2457T
acugacaucaaacc

SEQ ID NO: 1912544 - RNA, 18 nt, Shigella flexneri 2a str. 2457T
acugacauuacggauuaa

SEQ ID NO: 1912545 - RNA, 19 nt, Shigella flexneri 2a str. 2457T
acugacaauucaggggcau

SEQ ID NO: 1912546 - RNA, 15 nt, Shigella flexneri 2a str. 2457T
acugacaaacugcgc

SEQ ID NO: 1912547 - RNA, 15 nt, Shigella flexneri 2a str. 2457T
acugaaugaucacuu

SEQ ID NO: 1912548 - RNA, 20 nt, Shigella flexneri 2a str. 2457T
acugaaugacgacguaccag

SEQ ID NO: 1912549 - RNA, 23 nt, Shigella flexneri 2a str. 2457T
acucuuucgacggcaucagaaac

SEQ ID NO: 1912550 - RNA, 20 nt, Shigella flexneri 2a str. 2457T
acucuuugaugaaacaugau

SEQ ID NO: 1912551 - RNA, 22 nt, Shigella flexneri 2a str. 2457T
acuccgcauuuguaggcaggau

SEQ ID NO: 1912552 - RNA, 23 nt, Shigella flexneri 2a str. 2457T
acucgcacguucaguuuugggga

SEQ ID NO: 1912553 - RNA, 19 nt, Shigella flexneri 2a str. 2457T
acucgcccccgaagagggg

SEQ ID NO: 1912554 - RNA, 18 nt, Shigella flexneri 2a str. 2457T
acucgcguucuguugccg

SEQ ID NO: 1912555 - RNA, 16 nt, Shigella flexneri 2a str. 2457T
acucccugccccaucu

SEQ ID NO: 1912556 - RNA, 14 nt, Shigella flexneri 2a str. 2457T
acucccgcgccgca

SEQ ID NO: 1912557 - RNA, 17 nt, Shigella flexneri 2a str. 2457T
acuccccgcaacaguga

SEQ ID NO: 1912558 - RNA, 17 nt, Shigella flexneri 2a str. 2457T
acuccccgcacaacggc

SEQ ID NO: 1912559 - RNA, 16 nt, Shigella flexneri 2a str. 2457T
acuccccgcacaacgg

SEQ ID NO: 1912560 - RNA, 20 nt, Shigella flexneri 2a str. 2457T
acuccccgcauuuacucuca

SEQ ID NO: 1912561 - RNA, 22 nt, Shigella flexneri 2a str. 2457T
acucgucacgucgucaggcaac

SEQ ID NO: 1912562 - RNA, 21 nt, Shigella flexneri 2a str. 2457T
acucgguugauucgcucugcg

SEQ ID NO: 1912563 - RNA, 16 nt, Shigella flexneri 2a str. 2457T
acucggggcuuuucuc

SEQ ID NO: 1912564 - RNA, 13 nt, Shigella flexneri 2a str. 2457T
acucucagccgca

SEQ ID NO: 1912565 - RNA, 22 nt, Shigella flexneri 2a str. 2457T
acucucagccgcacaccugcau

SEQ ID NO: 1912566 - RNA, 19 nt, Shigella flexneri 2a str. 2457T
acucaccgaugaucgccau

SEQ ID NO: 1912567 - RNA, 23 nt, Shigella flexneri 2a str. 2457T
acucaccgaugaucgccaucagu

SEQ ID NO: 1912568 - RNA, 20 nt, Shigella flexneri 2a str. 2457T
acucaccgagcagcacaaug

SEQ ID NO: 1912569 - RNA, 16 nt, Shigella flexneri 2a str. 2457T
acucacgaaucgccuc

SEQ ID NO: 1912570 - RNA, 16 nt, Shigella flexneri 2a str. 2457T
acucaccuuuuuuguu

SEQ ID NO: 1912571 - RNA, 12 nt, Shigella flexneri 2a str. 2457T
acucacagggcu

SEQ ID NO: 1912572 - RNA, 12 nt, Shigella flexneri 2a str. 2457T
acucaccagaca

SEQ ID NO: 1912573 - RNA, 22 nt, Shigella flexneri 2a str. 2457T
acucaccagacaucccagugca

SEQ ID NO: 1912574 - RNA, 21 nt, Shigella flexneri 2a str. 2457T
acucaccagacaucccagugc

SEQ ID NO: 1912575 - RNA, 15 nt, Shigella flexneri 2a str. 2457T
acuaucuugccgaag

SEQ ID NO: 1912576 - RNA, 16 nt, Shigella flexneri 2a str. 2457T
acucacgauuguuaau

SEQ ID NO: 1912577 - RNA, 22 nt, Shigella flexneri 2a str. 2457T
acucaguguuggauggcggcuu

SEQ ID NO: 1912578 - RNA, 17 nt, Shigella flexneri 2a str. 2457T
acucagcgccugcugca

SEQ ID NO: 1912579 - RNA, 16 nt, Shigella flexneri 2a str. 2457T
acuccacuccugcuau

SEQ ID NO: 1912580 - RNA, 12 nt, Shigella flexneri 2a str. 2457T
acuccagcagac

SEQ ID NO: 1912581 - RNA, 15 nt, Shigella flexneri 2a str. 2457T
acuccagcagaccag

SEQ ID NO: 1912582 - RNA, 21 nt, Shigella flexneri 2a str. 2457T
acuccagcagaccagcaaaaa

SEQ ID NO: 1912583 - RNA, 22 nt, Shigella flexneri 2a str. 2457T
acuccagaauaccgccaauauc

SEQ ID NO: 1912584 - RNA, 15 nt, Shigella flexneri 2a str. 2457T
acuccagcagugccg

SEQ ID NO: 1912585 - RNA, 17 nt, Shigella flexneri 2a str. 2457T
acucccagaacaacccg

SEQ ID NO: 1912586 - RNA, 15 nt, Shigella flexneri 2a str. 2457T
acuccagcgcuucgc

SEQ ID NO: 1912587 - RNA, 14 nt, Shigella flexneri 2a str. 2457T
acuccauccagcaa

SEQ ID NO: 1912588 - RNA, 14 nt, Shigella flexneri 2a str. 2457T
acuccaguuucaca

SEQ ID NO: 1912589 - RNA, 21 nt, Shigella flexneri 2a str. 2457T
acuccaguuuguucagcugcg

SEQ ID NO: 1912590 - RNA, 19 nt, Shigella flexneri 2a str. 2457T
acucaucaacguuuuuuug

SEQ ID NO: 1912591 - RNA, 13 nt, Shigella flexneri 2a str. 2457T
acucauuucugua

SEQ ID NO: 1912592 - RNA, 16 nt, Shigella flexneri 2a str. 2457T
acucauuucuguauaa

SEQ ID NO: 1912593 - RNA, 21 nt, Shigella flexneri 2a str. 2457T
acucauuucuguauaaucacc

SEQ ID NO: 1912594 - RNA, 13 nt, Shigella flexneri 2a str. 2457T
acucauugccagu

SEQ ID NO: 1912595 - RNA, 15 nt, Shigella flexneri 2a str. 2457T
acucauugccagucc

SEQ ID NO: 1912596 - RNA, 22 nt, Shigella flexneri 2a str. 2457T
acguucggugauauacgucacu

SEQ ID NO: 1912597 - RNA, 15 nt, Shigella flexneri 2a str. 2457T
acguuccuuucuugc

SEQ ID NO: 1912598 - RNA, 19 nt, Shigella flexneri 2a str. 2457T
acguucugcguaauguuua

SEQ ID NO: 1912599 - RNA, 16 nt, Shigella flexneri 2a str. 2457T
acguucuuacauuccg

SEQ ID NO: 1912600 - RNA, 15 nt, Shigella flexneri 2a str. 2457T
acguucuccugaagu

SEQ ID NO: 1912601 - RNA, 14 nt, Shigella flexneri 2a str. 2457T
acguucucuucacu

SEQ ID NO: 1912602 - RNA, 18 nt, Shigella flexneri 2a str. 2457T
acguucugaucuuucuuc

SEQ ID NO: 1912603 - RNA, 19 nt, Shigella flexneri 2a str. 2457T
acguucugaucuuucuuca

SEQ ID NO: 1912604 - RNA, 21 nt, Shigella flexneri 2a str. 2457T
acguucuucgcugacaguacc

SEQ ID NO: 1912605 - RNA, 18 nt, Shigella flexneri 2a str. 2457T
acguugaacugacuguuu

SEQ ID NO: 1912606 - RNA, 22 nt, Shigella flexneri 2a str. 2457T
acguugccguaugcgccacagg

SEQ ID NO: 1912607 - RNA, 18 nt, Shigella flexneri 2a str. 2457T
acguugcucaaggguuuc

SEQ ID NO: 1912608 - RNA, 18 nt, Shigella flexneri 2a str. 2457T
acguugccggauauaccc

SEQ ID NO: 1912609 - RNA, 13 nt, Shigella flexneri 2a str. 2457T
acuaaaugugcaa

SEQ ID NO: 1912610 - RNA, 19 nt, Shigella flexneri 2a str. 2457T
acuaacacuucaucacuac

SEQ ID NO: 1912611 - RNA, 13 nt, Shigella flexneri 2a str. 2457T
acuaacagaacaa

SEQ ID NO: 1912612 - RNA, 16 nt, Shigella flexneri 2a str. 2457T
acuaacagaacaauaa

SEQ ID NO: 1912613 - RNA, 22 nt, Shigella flexneri 2a str. 2457T
acuaagaauguccauuauuuca

SEQ ID NO: 1912614 - RNA, 14 nt, Shigella flexneri 2a str. 2457T
acuaagauaaucca

SEQ ID NO: 1912615 - RNA, 22 nt, Shigella flexneri 2a str. 2457T
acuaacuucugaucuacagccu

SEQ ID NO: 1912616 - RNA, 16 nt, Shigella flexneri 2a str. 2457T
acuaacgcgucuuauc

SEQ ID NO: 1912617 - RNA, 23 nt, Shigella flexneri 2a str. 2457T
acuaaucgacaguugcugcguga

SEQ ID NO: 1912618 - RNA, 23 nt, Shigella flexneri 2a str. 2457T
acuaucgaaaguuuaccagccaa

SEQ ID NO: 1912619 - RNA, 19 nt, Shigella flexneri 2a str. 2457T
acuauacuccugauggucu

SEQ ID NO: 1912620 - RNA, 18 nt, Shigella flexneri 2a str. 2457T
acuagaugugcaguuccu

SEQ ID NO: 1912621 - RNA, 19 nt, Shigella flexneri 2a str. 2457T
acuagacgaugaaaaagaa

SEQ ID NO: 1912622 - RNA, 21 nt, Shigella flexneri 2a str. 2457T
acguuaacaauguugucgcca

SEQ ID NO: 1912623 - RNA, 16 nt, Shigella flexneri 2a str. 2457T
acguucacgcagcuca

SEQ ID NO: 1912624 - RNA, 15 nt, Shigella flexneri 2a str. 2457T
acguuacccagcacg

SEQ ID NO: 1912625 - RNA, 13 nt, Shigella flexneri 2a str. 2457T
acguucaguucac

SEQ ID NO: 1912626 - RNA, 12 nt, Shigella flexneri 2a str. 2457T
acguucaguucc

SEQ ID NO: 1912627 - RNA, 15 nt, Shigella flexneri 2a str. 2457T
acguuccauggcagg

SEQ ID NO: 1912628 - RNA, 12 nt, Shigella flexneri 2a str. 2457T
acguuccagcaa

SEQ ID NO: 1912629 - RNA, 18 nt, Shigella flexneri 2a str. 2457T
acguguggucuuuucaac

SEQ ID NO: 1912630 - RNA, 22 nt, Shigella flexneri 2a str. 2457T
acguguggucuuuucaacaguu

SEQ ID NO: 1912631 - RNA, 23 nt, Shigella flexneri 2a str. 2457T
acguguggucuuuucaacaguuu

SEQ ID NO: 1912632 - RNA, 18 nt, Shigella flexneri 2a str. 2457T
acguguguugagauaaug

SEQ ID NO: 1912633 - RNA, 15 nt, Shigella flexneri 2a str. 2457T
acguguaaguacagu

SEQ ID NO: 1912634 - RNA, 18 nt, Shigella flexneri 2a str. 2457T
acguguaggccugauaag

SEQ ID NO: 1912635 - RNA, 14 nt, Shigella flexneri 2a str. 2457T
acgugcacaggcaa

SEQ ID NO: 1912636 - RNA, 20 nt, Shigella flexneri 2a str. 2457T
acgugcaaaaucaaacagaa

SEQ ID NO: 1912637 - RNA, 18 nt, Shigella flexneri 2a str. 2457T
acgugaucgaacaucugc

SEQ ID NO: 1912638 - RNA, 18 nt, Shigella flexneri 2a str. 2457T
acgugaacggcuucgccu

SEQ ID NO: 1912639 - RNA, 15 nt, Shigella flexneri 2a str. 2457T
acgugaccaguacca

SEQ ID NO: 1912640 - RNA, 17 nt, Shigella flexneri 2a str. 2457T
acgugacagcauaccuu

SEQ ID NO: 1912641 - RNA, 22 nt, Shigella flexneri 2a str. 2457T
acguccagccaggaaucagaua

SEQ ID NO: 1912642 - RNA, 20 nt, Shigella flexneri 2a str. 2457T
acgucuugcugauaagugau

SEQ ID NO: 1912643 - RNA, 16 nt, Shigella flexneri 2a str. 2457T
acgucaugaugaugcc

SEQ ID NO: 1912644 - RNA, 19 nt, Shigella flexneri 2a str. 2457T
acgucaucugucauaacac

SEQ ID NO: 1912645 - RNA, 17 nt, Shigella flexneri 2a str. 2457T
acgucauuaccgcgaag

SEQ ID NO: 1912646 - RNA, 21 nt, Shigella flexneri 2a str. 2457T
acgucauugcuaucuccuguu

SEQ ID NO: 1912647 - RNA, 23 nt, Shigella flexneri 2a str. 2457T
acgucaguaaccgcuuuuucaau

SEQ ID NO: 1912648 - RNA, 16 nt, Shigella flexneri 2a str. 2457T
acgucagcacaaacau

SEQ ID NO: 1912649 - RNA, 14 nt, Shigella flexneri 2a str. 2457T
acguauuauauaua

SEQ ID NO: 1912650 - RNA, 16 nt, Shigella flexneri 2a str. 2457T
acguauugagaucacc

SEQ ID NO: 1912651 - RNA, 20 nt, Shigella flexneri 2a str. 2457T
acguagcguaaggauuauuu

SEQ ID NO: 1912652 - RNA, 15 nt, Shigella flexneri 2a str. 2457T
acguaggccugauaa

SEQ ID NO: 1912653 - RNA, 16 nt, Shigella flexneri 2a str. 2457T
acguaggcgaucccgg

SEQ ID NO: 1912654 - RNA, 20 nt, Shigella flexneri 2a str. 2457T
acgggaagggguucuccuua

SEQ ID NO: 1912655 - RNA, 20 nt, Shigella flexneri 2a str. 2457T
acgggagaaacccggccaca

SEQ ID NO: 1912656 - RNA, 14 nt, Shigella flexneri 2a str. 2457T
acgggcaaucuccu

SEQ ID NO: 1912657 - RNA, 22 nt, Shigella flexneri 2a str. 2457T
acgggcaauuucacguucaccc

SEQ ID NO: 1912658 - RNA, 16 nt, Shigella flexneri 2a str. 2457T
acgggcaccaguaacg

SEQ ID NO: 1912659 - RNA, 13 nt, Shigella flexneri 2a str. 2457T
acgggcauggugu

SEQ ID NO: 1912660 - RNA, 22 nt, Shigella flexneri 2a str. 2457T
acgggccauccaucaacgccag

SEQ ID NO: 1912661 - RNA, 13 nt, Shigella flexneri 2a str. 2457T
acccucucccgaa

SEQ ID NO: 1912662 - RNA, 16 nt, Shigella flexneri 2a str. 2457T
acccugacccagaccg

SEQ ID NO: 1912663 - RNA, 13 nt, Shigella flexneri 2a str. 2457T
acccugacccaga

SEQ ID NO: 1912664 - RNA, 11 nt, Shigella flexneri 2a str. 2457T
acccugaguga

SEQ ID NO: 1912665 - RNA, 18 nt, Shigella flexneri 2a str. 2457T
acccugagugaauuguuu

SEQ ID NO: 1912666 - RNA, 21 nt, Shigella flexneri 2a str. 2457T
acccugaguuuucaguaccgc

SEQ ID NO: 1912667 - RNA, 17 nt, Shigella flexneri 2a str. 2457T
acccuucgucaaucagc

SEQ ID NO: 1912668 - RNA, 17 nt, Shigella flexneri 2a str. 2457T
acccuugauguggcgga

SEQ ID NO: 1912669 - RNA, 16 nt, Shigella flexneri 2a str. 2457T
acccuugcguuucuga

SEQ ID NO: 1912670 - RNA, 14 nt, Shigella flexneri 2a str. 2457T
acccuugugcucaa

SEQ ID NO: 1912671 - RNA, 17 nt, Shigella flexneri 2a str. 2457T
acccuucauauuccuga

SEQ ID NO: 1912672 - RNA, 13 nt, Shigella flexneri 2a str. 2457T
acccuuacucacu

SEQ ID NO: 1912673 - RNA, 17 nt, Shigella flexneri 2a str. 2457T
acccucauucaccaguu

SEQ ID NO: 1912674 - RNA, 13 nt, Shigella flexneri 2a str. 2457T
acccuaccagcug

SEQ ID NO: 1912675 - RNA, 16 nt, Shigella flexneri 2a str. 2457T
accgaacagaucacgu

SEQ ID NO: 1912676 - RNA, 15 nt, Shigella flexneri 2a str. 2457T
accgaacaaaacagc

SEQ ID NO: 1912677 - RNA, 13 nt, Shigella flexneri 2a str. 2457T
acccuuuuuuaaa

SEQ ID NO: 1912678 - RNA, 24 nt, Shigella flexneri 2a str. 2457T
accgaaucccgcugcaaucuuuaa

SEQ ID NO: 1912679 - RNA, 12 nt, Shigella flexneri 2a str. 2457T
accgaaguugua

SEQ ID NO: 1912680 - RNA, 22 nt, Shigella flexneri 2a str. 2457T
accgacaauccgguagguucaa

SEQ ID NO: 1912681 - RNA, 17 nt, Shigella flexneri 2a str. 2457T
accgacaauauugaugc

SEQ ID NO: 1912682 - RNA, 16 nt, Shigella flexneri 2a str. 2457T
accgaaccuguuuuca

SEQ ID NO: 1912683 - RNA, 19 nt, Shigella flexneri 2a str. 2457T
accgagcagccacugcggc

SEQ ID NO: 1912684 - RNA, 23 nt, Shigella flexneri 2a str. 2457T
accgaggccaaaaccacagugac

SEQ ID NO: 1912685 - RNA, 17 nt, Shigella flexneri 2a str. 2457T
accgagauaaugguuuc

SEQ ID NO: 1912686 - RNA, 21 nt, Shigella flexneri 2a str. 2457T
accgacuccgacgcagugggu

SEQ ID NO: 1912687 - RNA, 19 nt, Shigella flexneri 2a str. 2457T
accgacugcggccugaguu

SEQ ID NO: 1912688 - RNA, 14 nt, Shigella flexneri 2a str. 2457T
accgaccagaaugu

SEQ ID NO: 1912689 - RNA, 15 nt, Shigella flexneri 2a str. 2457T
accgacgcugcucaa

SEQ ID NO: 1912690 - RNA, 21 nt, Shigella flexneri 2a str. 2457T
accgauauucgccgcgacaca

SEQ ID NO: 1912691 - RNA, 21 nt, Shigella flexneri 2a str. 2457T
accgauccccggauucaugcu

SEQ ID NO: 1912692 - RNA, 22 nt, Shigella flexneri 2a str. 2457T
accgcaaucgaucuguuuauca

SEQ ID NO: 1912693 - RNA, 15 nt, Shigella flexneri 2a str. 2457T
accgcagcauugcuc

SEQ ID NO: 1912694 - RNA, 17 nt, Shigella flexneri 2a str. 2457T
accgcaagccaaauaca

SEQ ID NO: 1912695 - RNA, 18 nt, Shigella flexneri 2a str. 2457T
accgcaauaaccaucagc

SEQ ID NO: 1912696 - RNA, 23 nt, Shigella flexneri 2a str. 2457T
accgcaauaaccaucagcucugg

SEQ ID NO: 1912697 - RNA, 20 nt, Shigella flexneri 2a str. 2457T
accgauuuucagccaucauc

SEQ ID NO: 1912698 - RNA, 15 nt, Shigella flexneri 2a str. 2457T
accgauuuuguaaaa

SEQ ID NO: 1912699 - RNA, 18 nt, Shigella flexneri 2a str. 2457T
accgcaaaaccaacgccu

SEQ ID NO: 1912700 - RNA, 23 nt, Shigella flexneri 2a str. 2457T
accgcaaagguugcugcgcccca

SEQ ID NO: 1912701 - RNA, 15 nt, Shigella flexneri 2a str. 2457T
accgcaacucauuua

SEQ ID NO: 1912702 - RNA, 15 nt, Shigella flexneri 2a str. 2457T
accgccagcaggaac

SEQ ID NO: 1912703 - RNA, 15 nt, Shigella flexneri 2a str. 2457T
accgccgccaugcuu

SEQ ID NO: 1912704 - RNA, 15 nt, Shigella flexneri 2a str. 2457T
accgccgaggaacau

SEQ ID NO: 1912705 - RNA, 22 nt, Shigella flexneri 2a str. 2457T
accgcccgcgcgguaucaccac

SEQ ID NO: 1912706 - RNA, 12 nt, Shigella flexneri 2a str. 2457T
accgccccugca

SEQ ID NO: 1912707 - RNA, 14 nt, Shigella flexneri 2a str. 2457T
accgccccugcacu

SEQ ID NO: 1912708 - RNA, 14 nt, Shigella flexneri 2a str. 2457T
accgcucagcuccu

SEQ ID NO: 1912709 - RNA, 16 nt, Shigella flexneri 2a str. 2457T
accgcucaucgcccgg

SEQ ID NO: 1912710 - RNA, 17 nt, Shigella flexneri 2a str. 2457T
accgcucccagcaugac

SEQ ID NO: 1912711 - RNA, 13 nt, Shigella flexneri 2a str. 2457T
accgcguuuucca

SEQ ID NO: 1912712 - RNA, 15 nt, Shigella flexneri 2a str. 2457T
accgcguaugcccag

SEQ ID NO: 1912713 - RNA, 23 nt, Shigella flexneri 2a str. 2457T
accgcguaauacaucagcuaaau

SEQ ID NO: 1912714 - RNA, 14 nt, Shigella flexneri 2a str. 2457T
accggagagaauau

SEQ ID NO: 1912715 - RNA, 22 nt, Shigella flexneri 2a str. 2457T
accggagaauuagcguccggcu

SEQ ID NO: 1912716 - RNA, 12 nt, Shigella flexneri 2a str. 2457T
accggaaccagc

SEQ ID NO: 1912717 - RNA, 13 nt, Shigella flexneri 2a str. 2457T
accggaaccagcg

SEQ ID NO: 1912718 - RNA, 12 nt, Shigella flexneri 2a str. 2457T
accgcuuuucca

SEQ ID NO: 1912719 - RNA, 16 nt, Shigella flexneri 2a str. 2457T
accggaaaaggcguuc

SEQ ID NO: 1912720 - RNA, 21 nt, Shigella flexneri 2a str. 2457T
accggaaaaggugauuuuuga

SEQ ID NO: 1912721 - RNA, 17 nt, Shigella flexneri 2a str. 2457T
accgcgccauguugccu

SEQ ID NO: 1912722 - RNA, 14 nt, Shigella flexneri 2a str. 2457T
accgcgaucuucca

SEQ ID NO: 1912723 - RNA, 14 nt, Shigella flexneri 2a str. 2457T
accgcgcaguacca

SEQ ID NO: 1912724 - RNA, 21 nt, Shigella flexneri 2a str. 2457T
accgccgcuccagaaucucaa

SEQ ID NO: 1912725 - RNA, 22 nt, Shigella flexneri 2a str. 2457T
accgcgaggccuaacaccauca

SEQ ID NO: 1912726 - RNA, 13 nt, Shigella flexneri 2a str. 2457T
accgcgaguaauc

SEQ ID NO: 1912727 - RNA, 14 nt, Shigella flexneri 2a str. 2457T
acccgcgacgcgcu

SEQ ID NO: 1912728 - RNA, 13 nt, Shigella flexneri 2a str. 2457T
acccgccugauag

SEQ ID NO: 1912729 - RNA, 18 nt, Shigella flexneri 2a str. 2457T
acccggaggaaagcaccu

SEQ ID NO: 1912730 - RNA, 20 nt, Shigella flexneri 2a str. 2457T
acccgcuguaaaugcugcuc

SEQ ID NO: 1912731 - RNA, 17 nt, Shigella flexneri 2a str. 2457T
acccgcucaaacaccgu

SEQ ID NO: 1912732 - RNA, 20 nt, Shigella flexneri 2a str. 2457T
acccgcucgccauaucuucu

SEQ ID NO: 1912733 - RNA, 16 nt, Shigella flexneri 2a str. 2457T
acccggccugcucccg

SEQ ID NO: 1912734 - RNA, 21 nt, Shigella flexneri 2a str. 2457T
acccggccuguuuauccauca

SEQ ID NO: 1912735 - RNA, 18 nt, Shigella flexneri 2a str. 2457T
acccggccacagcgccag

SEQ ID NO: 1912736 - RNA, 13 nt, Shigella flexneri 2a str. 2457T
acccggccacagc

SEQ ID NO: 1912737 - RNA, 19 nt, Shigella flexneri 2a str. 2457T
acccguauguucccaccag

SEQ ID NO: 1912738 - RNA, 16 nt, Shigella flexneri 2a str. 2457T
acccguacuucugacc

SEQ ID NO: 1912739 - RNA, 19 nt, Shigella flexneri 2a str. 2457T
acccggucccuucagccac

SEQ ID NO: 1912740 - RNA, 20 nt, Shigella flexneri 2a str. 2457T
acccgguacaucaauaccau

SEQ ID NO: 1912741 - RNA, 18 nt, Shigella flexneri 2a str. 2457T
accccgcuugcuguuccu

SEQ ID NO: 1912742 - RNA, 21 nt, Shigella flexneri 2a str. 2457T
accccaaaaagauuaaaaaaa

SEQ ID NO: 1912743 - RNA, 22 nt, Shigella flexneri 2a str. 2457T
accccggcggccggaugacaga

SEQ ID NO: 1912744 - RNA, 20 nt, Shigella flexneri 2a str. 2457T
accccuuucucgcccagcag

SEQ ID NO: 1912745 - RNA, 21 nt, Shigella flexneri 2a str. 2457T
accccuuucucgcccagcaga

SEQ ID NO: 1912746 - RNA, 22 nt, Shigella flexneri 2a str. 2457T
accccuuucucgcccagcagac

SEQ ID NO: 1912747 - RNA, 15 nt, Shigella flexneri 2a str. 2457T
acccaugaacaaaau

SEQ ID NO: 1912748 - RNA, 22 nt, Shigella flexneri 2a str. 2457T
acccauguuuaauucacgcagg

SEQ ID NO: 1912749 - RNA, 17 nt, Shigella flexneri 2a str. 2457T
acccaucugccagcgcc

SEQ ID NO: 1912750 - RNA, 17 nt, Shigella flexneri 2a str. 2457T
acccaucgccagauaga

SEQ ID NO: 1912751 - RNA, 14 nt, Shigella flexneri 2a str. 2457T
acccgcagccagca

SEQ ID NO: 1912752 - RNA, 21 nt, Shigella flexneri 2a str. 2457T
acccgcacggccgcaagcaga

SEQ ID NO: 1912753 - RNA, 13 nt, Shigella flexneri 2a str. 2457T
acccgcaaucauc

SEQ ID NO: 1912754 - RNA, 18 nt, Shigella flexneri 2a str. 2457T
acccgcaaacaggaacac

SEQ ID NO: 1912755 - RNA, 12 nt, Shigella flexneri 2a str. 2457T
acccgcaacagc

SEQ ID NO: 1912756 - RNA, 19 nt, Shigella flexneri 2a str. 2457T
acccgcaacauacugcccg

SEQ ID NO: 1912757 - RNA, 14 nt, Shigella flexneri 2a str. 2457T
acccgcacagucac

SEQ ID NO: 1912758 - RNA, 21 nt, Shigella flexneri 2a str. 2457T
acccgcagugauugccgcaac

SEQ ID NO: 1912759 - RNA, 15 nt, Shigella flexneri 2a str. 2457T
acccgcagccagcac

SEQ ID NO: 1912760 - RNA, 22 nt, Shigella flexneri 2a str. 2457T
acccgcccaccauguucacugc

SEQ ID NO: 1912761 - RNA, 14 nt, Shigella flexneri 2a str. 2457T
acccgaugcgcuuu

SEQ ID NO: 1912762 - RNA, 17 nt, Shigella flexneri 2a str. 2457T
acccgauggcgugcccg

SEQ ID NO: 1912763 - RNA, 14 nt, Shigella flexneri 2a str. 2457T
acccgaccacuucc

SEQ ID NO: 1912764 - RNA, 16 nt, Shigella flexneri 2a str. 2457T
acccgacgcacaccag

SEQ ID NO: 1912765 - RNA, 16 nt, Shigella flexneri 2a str. 2457T
acccgacgugcagcau

SEQ ID NO: 1912766 - RNA, 18 nt, Shigella flexneri 2a str. 2457T
accccgucaccacuucac

SEQ ID NO: 1912767 - RNA, 19 nt, Shigella flexneri 2a str. 2457T
acccacguuagcgcuuggc

SEQ ID NO: 1912768 - RNA, 20 nt, Shigella flexneri 2a str. 2457T
acccacggauagauuuuuaa

SEQ ID NO: 1912769 - RNA, 20 nt, Shigella flexneri 2a str. 2457T
acccacgguacucaucacgu

SEQ ID NO: 1912770 - RNA, 22 nt, Shigella flexneri 2a str. 2457T
acccaccgggcagacgugacca

SEQ ID NO: 1912771 - RNA, 21 nt, Shigella flexneri 2a str. 2457T
acccaccgguccuaacaacca

SEQ ID NO: 1912772 - RNA, 14 nt, Shigella flexneri 2a str. 2457T
acccauaaucagac

SEQ ID NO: 1912773 - RNA, 22 nt, Shigella flexneri 2a str. 2457T
acccaguuucaugauauguuuu

SEQ ID NO: 1912774 - RNA, 23 nt, Shigella flexneri 2a str. 2457T
acccaguuucggcaucagcagaa

SEQ ID NO: 1912775 - RNA, 15 nt, Shigella flexneri 2a str. 2457T
accauuuaaaucaau

SEQ ID NO: 1912776 - RNA, 14 nt, Shigella flexneri 2a str. 2457T
accauuucugcgag

SEQ ID NO: 1912777 - RNA, 12 nt, Shigella flexneri 2a str. 2457T
acccaccgcagc

SEQ ID NO: 1912778 - RNA, 15 nt, Shigella flexneri 2a str. 2457T
acccaaaaaauagca

SEQ ID NO: 1912779 - RNA, 21 nt, Shigella flexneri 2a str. 2457T
accauuaaggcugaugaagca

SEQ ID NO: 1912780 - RNA, 15 nt, Shigella flexneri 2a str. 2457T
accaugcgcaucauc

SEQ ID NO: 1912781 - RNA, 18 nt, Shigella flexneri 2a str. 2457T
accauggcagaagcauuu

SEQ ID NO: 1912782 - RNA, 12 nt, Shigella flexneri 2a str. 2457T
accaucaaagaa

SEQ ID NO: 1912783 - RNA, 18 nt, Shigella flexneri 2a str. 2457T
accaucaaagaagcucuu

SEQ ID NO: 1912784 - RNA, 19 nt, Shigella flexneri 2a str. 2457T
accaucaaagaagcucuuu

SEQ ID NO: 1912785 - RNA, 19 nt, Shigella flexneri 2a str. 2457T
accauauuuaugcagugca

SEQ ID NO: 1912786 - RNA, 14 nt, Shigella flexneri 2a str. 2457T
accaggaaacccaa

SEQ ID NO: 1912787 - RNA, 23 nt, Shigella flexneri 2a str. 2457T
accaggaaacccaacgcaaagag

SEQ ID NO: 1912788 - RNA, 20 nt, Shigella flexneri 2a str. 2457T
accaggaagcgacccgguuc

SEQ ID NO: 1912789 - RNA, 23 nt, Shigella flexneri 2a str. 2457T
accagcuuucgcuuaacgcccau

SEQ ID NO: 1912790 - RNA, 21 nt, Shigella flexneri 2a str. 2457T
accagcuuaugccuguccucu

SEQ ID NO: 1912791 - RNA, 11 nt, Shigella flexneri 2a str. 2457T
accagcugccg

SEQ ID NO: 1912792 - RNA, 15 nt, Shigella flexneri 2a str. 2457T
accauauucagcagc

SEQ ID NO: 1912793 - RNA, 13 nt, Shigella flexneri 2a str. 2457T
accaucuuugcug

SEQ ID NO: 1912794 - RNA, 13 nt, Shigella flexneri 2a str. 2457T
accaucuuuuuug

SEQ ID NO: 1912795 - RNA, 21 nt, Shigella flexneri 2a str. 2457T
accaugacacuucagccauca

SEQ ID NO: 1912796 - RNA, 21 nt, Shigella flexneri 2a str. 2457T
accaucuucuucacuucuuca

SEQ ID NO: 1912797 - RNA, 15 nt, Shigella flexneri 2a str. 2457T
accaucuucuucacu

SEQ ID NO: 1912798 - RNA, 17 nt, Shigella flexneri 2a str. 2457T
accaucuugagaaaaac

SEQ ID NO: 1912799 - RNA, 19 nt, Shigella flexneri 2a str. 2457T
accaugcaauuaccgccac

SEQ ID NO: 1912800 - RNA, 21 nt, Shigella flexneri 2a str. 2457T
accaugcaaaaugguuccugg

SEQ ID NO: 1912801 - RNA, 22 nt, Shigella flexneri 2a str. 2457T
accaucguugcuaacggccacg

SEQ ID NO: 1912802 - RNA, 20 nt, Shigella flexneri 2a str. 2457T
accaucuuccaguugcacgc

SEQ ID NO: 1912803 - RNA, 18 nt, Shigella flexneri 2a str. 2457T
accaucgcaaacaguaca

SEQ ID NO: 1912804 - RNA, 17 nt, Shigella flexneri 2a str. 2457T
accaucguaagcgccag

SEQ ID NO: 1912805 - RNA, 23 nt, Shigella flexneri 2a str. 2457T
accaucgagaaucagcgagacaa

SEQ ID NO: 1912806 - RNA, 21 nt, Shigella flexneri 2a str. 2457T
accaucggcaccaccaaaaac

SEQ ID NO: 1912807 - RNA, 23 nt, Shigella flexneri 2a str. 2457T
accaccagugccauuaacaggcc

SEQ ID NO: 1912808 - RNA, 11 nt, Shigella flexneri 2a str. 2457T
accaccaucac

SEQ ID NO: 1912809 - RNA, 23 nt, Shigella flexneri 2a str. 2457T
accaccaucacuuucaaaagccc

SEQ ID NO: 1912810 - RNA, 11 nt, Shigella flexneri 2a str. 2457T
accaccaugcu

SEQ ID NO: 1912811 - RNA, 20 nt, Shigella flexneri 2a str. 2457T
accaccaugcuaauagcugc

SEQ ID NO: 1912812 - RNA, 13 nt, Shigella flexneri 2a str. 2457T
accaccagcacug

SEQ ID NO: 1912813 - RNA, 14 nt, Shigella flexneri 2a str. 2457T
accaccagcacacu

SEQ ID NO: 1912814 - RNA, 15 nt, Shigella flexneri 2a str. 2457T
accaccagcaccgcg

SEQ ID NO: 1912815 - RNA, 20 nt, Shigella flexneri 2a str. 2457T
accaccuuacuuacacauca

SEQ ID NO: 1912816 - RNA, 17 nt, Shigella flexneri 2a str. 2457T
accacguugacaaacug

SEQ ID NO: 1912817 - RNA, 13 nt, Shigella flexneri 2a str. 2457T
accacguuuuuca

SEQ ID NO: 1912818 - RNA, 20 nt, Shigella flexneri 2a str. 2457T
accacuuccacguuccccag

SEQ ID NO: 1912819 - RNA, 13 nt, Shigella flexneri 2a str. 2457T
accacuucaugcc

SEQ ID NO: 1912820 - RNA, 21 nt, Shigella flexneri 2a str. 2457T
accacuucaugccccauggac

SEQ ID NO: 1912821 - RNA, 20 nt, Shigella flexneri 2a str. 2457T
accacuuccagcagaccagc

SEQ ID NO: 1912822 - RNA, 15 nt, Shigella flexneri 2a str. 2457T
accacuuaauuauua

SEQ ID NO: 1912823 - RNA, 16 nt, Shigella flexneri 2a str. 2457T
accacuuaauuauuaa

SEQ ID NO: 1912824 - RNA, 18 nt, Shigella flexneri 2a str. 2457T
accacgccugccgccagc

SEQ ID NO: 1912825 - RNA, 17 nt, Shigella flexneri 2a str. 2457T
accacgccugccgccag

SEQ ID NO: 1912826 - RNA, 15 nt, Shigella flexneri 2a str. 2457T
accacguccagagug

SEQ ID NO: 1912827 - RNA, 21 nt, Shigella flexneri 2a str. 2457T
accacguaccacggcauuucc

SEQ ID NO: 1912828 - RNA, 14 nt, Shigella flexneri 2a str. 2457T
accacuuccugcuc

SEQ ID NO: 1912829 - RNA, 19 nt, Shigella flexneri 2a str. 2457T
accagcaaccaacgccagc

SEQ ID NO: 1912830 - RNA, 22 nt, Shigella flexneri 2a str. 2457T
accagcaaccaacgccagcagc

SEQ ID NO: 1912831 - RNA, 12 nt, Shigella flexneri 2a str. 2457T
accagcaaauau

SEQ ID NO: 1912832 - RNA, 12 nt, Shigella flexneri 2a str. 2457T
accagcaacaaa

SEQ ID NO: 1912833 - RNA, 23 nt, Shigella flexneri 2a str. 2457T
accagcaacgcuucguagaagcc

SEQ ID NO: 1912834 - RNA, 17 nt, Shigella flexneri 2a str. 2457T
accagcaauaacaacac

SEQ ID NO: 1912835 - RNA, 22 nt, Shigella flexneri 2a str. 2457T
accagcacaucaucaaagccaa

SEQ ID NO: 1912836 - RNA, 14 nt, Shigella flexneri 2a str. 2457T
accagcacuucacu

SEQ ID NO: 1912837 - RNA, 15 nt, Shigella flexneri 2a str. 2457T
accagcacuucgcca

SEQ ID NO: 1912838 - RNA, 17 nt, Shigella flexneri 2a str. 2457T
accagccaggccgccag

SEQ ID NO: 1912839 - RNA, 18 nt, Shigella flexneri 2a str. 2457T
accagcguuuccagcacc

SEQ ID NO: 1912840 - RNA, 17 nt, Shigella flexneri 2a str. 2457T
accagcguuuccagcac

SEQ ID NO: 1912841 - RNA, 18 nt, Shigella flexneri 2a str. 2457T
accagcggguugcugaga

SEQ ID NO: 1912842 - RNA, 14 nt, Shigella flexneri 2a str. 2457T
accagcugccacau

SEQ ID NO: 1912843 - RNA, 15 nt, Shigella flexneri 2a str. 2457T
accagcuccagcaga

SEQ ID NO: 1912844 - RNA, 20 nt, Shigella flexneri 2a str. 2457T
accagccgcgacaucuucuc

SEQ ID NO: 1912845 - RNA, 23 nt, Shigella flexneri 2a str. 2457T
accagccgcuaccagcgcggcac

SEQ ID NO: 1912846 - RNA, 21 nt, Shigella flexneri 2a str. 2457T
accagccauuaaccagccacu

SEQ ID NO: 1912847 - RNA, 19 nt, Shigella flexneri 2a str. 2457T
accacaccggaccagacga

SEQ ID NO: 1912848 - RNA, 20 nt, Shigella flexneri 2a str. 2457T
accacacccgcaagacgaac

SEQ ID NO: 1912849 - RNA, 15 nt, Shigella flexneri 2a str. 2457T
accacagcaaaacac

SEQ ID NO: 1912850 - RNA, 14 nt, Shigella flexneri 2a str. 2457T
accacacuucuuca

SEQ ID NO: 1912851 - RNA, 18 nt, Shigella flexneri 2a str. 2457T
accacagugacccgcagc

SEQ ID NO: 1912852 - RNA, 21 nt, Shigella flexneri 2a str. 2457T
accacagaccggacugacucc

SEQ ID NO: 1912853 - RNA, 20 nt, Shigella flexneri 2a str. 2457T
accacaggccggagccagcc

SEQ ID NO: 1912854 - RNA, 13 nt, Shigella flexneri 2a str. 2457T
accaauggcaaua

SEQ ID NO: 1912855 - RNA, 17 nt, Shigella flexneri 2a str. 2457T
accaacacuccuaucac

SEQ ID NO: 1912856 - RNA, 14 nt, Shigella flexneri 2a str. 2457T
accaagaccaaucc

SEQ ID NO: 1912857 - RNA, 17 nt, Shigella flexneri 2a str. 2457T
accaauaacgcuuuucu

SEQ ID NO: 1912858 - RNA, 16 nt, Shigella flexneri 2a str. 2457T
accaauaaacgccagg

SEQ ID NO: 1912859 - RNA, 14 nt, Shigella flexneri 2a str. 2457T
accaauaccaauga

SEQ ID NO: 1912860 - RNA, 17 nt, Shigella flexneri 2a str. 2457T
accaauaacuacggcuc

SEQ ID NO: 1912861 - RNA, 22 nt, Shigella flexneri 2a str. 2457T
accaauaccgcccaccaccagc

SEQ ID NO: 1912862 - RNA, 18 nt, Shigella flexneri 2a str. 2457T
accaauaccgcccaccac

SEQ ID NO: 1912863 - RNA, 21 nt, Shigella flexneri 2a str. 2457T
accaaugaaagccccaccagc

SEQ ID NO: 1912864 - RNA, 14 nt, Shigella flexneri 2a str. 2457T
accaaacagcgcca

SEQ ID NO: 1912865 - RNA, 12 nt, Shigella flexneri 2a str. 2457T
acauuuucucua

SEQ ID NO: 1912866 - RNA, 22 nt, Shigella flexneri 2a str. 2457T
accaaaucuccaguggugauac

SEQ ID NO: 1912867 - RNA, 12 nt, Shigella flexneri 2a str. 2457T
accaaaugacuc

SEQ ID NO: 1912868 - RNA, 14 nt, Shigella flexneri 2a str. 2457T
accaacaaagccac

SEQ ID NO: 1912869 - RNA, 22 nt, Shigella flexneri 2a str. 2457T
accaacaaauagagauagaaug

SEQ ID NO: 1912870 - RNA, 20 nt, Shigella flexneri 2a str. 2457T
acauuugcggcgaacugccg

SEQ ID NO: 1912871 - RNA, 18 nt, Shigella flexneri 2a str. 2457T
acauuugcuuuuguuaau

SEQ ID NO: 1912872 - RNA, 11 nt, Shigella flexneri 2a str. 2457T
acauuuuccau

SEQ ID NO: 1912873 - RNA, 19 nt, Shigella flexneri 2a str. 2457T
acauuguuaaagccuugcu

SEQ ID NO: 1912874 - RNA, 14 nt, Shigella flexneri 2a str. 2457T
acauuggugccgga

SEQ ID NO: 1912875 - RNA, 23 nt, Shigella flexneri 2a str. 2457T
acauuaggaauaaugucuuuaau

SEQ ID NO: 1912876 - RNA, 16 nt, Shigella flexneri 2a str. 2457T
acauuauuuaucugcc

SEQ ID NO: 1912877 - RNA, 12 nt, Shigella flexneri 2a str. 2457T
acauucaaugau

SEQ ID NO: 1912878 - RNA, 16 nt, Shigella flexneri 2a str. 2457T
acauucauagagggaa

SEQ ID NO: 1912879 - RNA, 20 nt, Shigella flexneri 2a str. 2457T
acauucgagaagcccauacc

SEQ ID NO: 1912880 - RNA, 12 nt, Shigella flexneri 2a str. 2457T
acauucccauca

SEQ ID NO: 1912881 - RNA, 15 nt, Shigella flexneri 2a str. 2457T
acauugagcuugcgu

SEQ ID NO: 1912882 - RNA, 21 nt, Shigella flexneri 2a str. 2457T
acauugagcuuugacgaccuu

SEQ ID NO: 1912883 - RNA, 13 nt, Shigella flexneri 2a str. 2457T
acauugauauaca

SEQ ID NO: 1912884 - RNA, 15 nt, Shigella flexneri 2a str. 2457T
acauugauguuuuca

SEQ ID NO: 1912885 - RNA, 16 nt, Shigella flexneri 2a str. 2457T
acauugcaucugauaa

SEQ ID NO: 1912886 - RNA, 15 nt, Shigella flexneri 2a str. 2457T
acauugcugcacauc

SEQ ID NO: 1912887 - RNA, 20 nt, Shigella flexneri 2a str. 2457T
acauugccguaauggucugc

SEQ ID NO: 1912888 - RNA, 18 nt, Shigella flexneri 2a str. 2457T
acauugcguaaccaauca

SEQ ID NO: 1912889 - RNA, 17 nt, Shigella flexneri 2a str. 2457T
acauugcguccaggccc

SEQ ID NO: 1912890 - RNA, 12 nt, Shigella flexneri 2a str. 2457T
acauugcugcug

SEQ ID NO: 1912891 - RNA, 21 nt, Shigella flexneri 2a str. 2457T
acauuaacgugaucaaaucau

SEQ ID NO: 1912892 - RNA, 14 nt, Shigella flexneri 2a str. 2457T
acauuaaauugaua

SEQ ID NO: 1912893 - RNA, 13 nt, Shigella flexneri 2a str. 2457T
acauuaaaauucu

SEQ ID NO: 1912894 - RNA, 17 nt, Shigella flexneri 2a str. 2457T
acaugcgcgacaaaaau

SEQ ID NO: 1912895 - RNA, 21 nt, Shigella flexneri 2a str. 2457T
acaugcgcgacaaaaauuacu

SEQ ID NO: 1912896 - RNA, 23 nt, Shigella flexneri 2a str. 2457T
acaugcgcgacaaaaauuacugc

SEQ ID NO: 1912897 - RNA, 15 nt, Shigella flexneri 2a str. 2457T
acaugccugcauaaa

SEQ ID NO: 1912898 - RNA, 18 nt, Shigella flexneri 2a str. 2457T
acaugcgauaaagcauac

SEQ ID NO: 1912899 - RNA, 18 nt, Shigella flexneri 2a str. 2457T
acaugcgaucccacgccg

SEQ ID NO: 1912900 - RNA, 19 nt, Shigella flexneri 2a str. 2457T
acaugcggugauuuugccu

SEQ ID NO: 1912901 - RNA, 23 nt, Shigella flexneri 2a str. 2457T
acaugcgguucacgcgccagaga

SEQ ID NO: 1912902 - RNA, 14 nt, Shigella flexneri 2a str. 2457T
acauguugaaauuc

SEQ ID NO: 1912903 - RNA, 15 nt, Shigella flexneri 2a str. 2457T
acauguugaaauucg

SEQ ID NO: 1912904 - RNA, 16 nt, Shigella flexneri 2a str. 2457T
acauguugaaucuuca

SEQ ID NO: 1912905 - RNA, 19 nt, Shigella flexneri 2a str. 2457T
acauguucggcgguuuuuu

SEQ ID NO: 1912906 - RNA, 16 nt, Shigella flexneri 2a str. 2457T
acauguugaaucuucg

SEQ ID NO: 1912907 - RNA, 23 nt, Shigella flexneri 2a str. 2457T
acauguugaaucuucgugcguuu

SEQ ID NO: 1912908 - RNA, 16 nt, Shigella flexneri 2a str. 2457T
acaucguuccugcaau

SEQ ID NO: 1912909 - RNA, 16 nt, Shigella flexneri 2a str. 2457T
acaucguaucuggcaa

SEQ ID NO: 1912910 - RNA, 14 nt, Shigella flexneri 2a str. 2457T
acaucgcuuuccag

SEQ ID NO: 1912911 - RNA, 13 nt, Shigella flexneri 2a str. 2457T
acaucgcuuucca

SEQ ID NO: 1912912 - RNA, 18 nt, Shigella flexneri 2a str. 2457T
acaugaaaauaaccauau

SEQ ID NO: 1912913 - RNA, 24 nt, Shigella flexneri 2a str. 2457T
acaugaaaauaaccauauaugaua

SEQ ID NO: 1912914 - RNA, 15 nt, Shigella flexneri 2a str. 2457T
acaugaaacagaaaa

SEQ ID NO: 1912915 - RNA, 20 nt, Shigella flexneri 2a str. 2457T
acaucguugacauuugcuuu

SEQ ID NO: 1912916 - RNA, 22 nt, Shigella flexneri 2a str. 2457T
acaucuuucugcgcaucuuccc

SEQ ID NO: 1912917 - RNA, 15 nt, Shigella flexneri 2a str. 2457T
acaucuuuauaugca

SEQ ID NO: 1912918 - RNA, 16 nt, Shigella flexneri 2a str. 2457T
acaucuuuauaugcaa

SEQ ID NO: 1912919 - RNA, 23 nt, Shigella flexneri 2a str. 2457T
acauccaugcacugcaacgccuu

SEQ ID NO: 1912920 - RNA, 17 nt, Shigella flexneri 2a str. 2457T
acauccucuucaagaau

SEQ ID NO: 1912921 - RNA, 16 nt, Shigella flexneri 2a str. 2457T
acaucaugccagugau

SEQ ID NO: 1912922 - RNA, 20 nt, Shigella flexneri 2a str. 2457T
acaucaugcgucaccaacag

SEQ ID NO: 1912923 - RNA, 20 nt, Shigella flexneri 2a str. 2457T
acaucaucagaaaugccagu

SEQ ID NO: 1912924 - RNA, 11 nt, Shigella flexneri 2a str. 2457T
acaucaucaga

SEQ ID NO: 1912925 - RNA, 16 nt, Shigella flexneri 2a str. 2457T
acaucauccagugccg

SEQ ID NO: 1912926 - RNA, 13 nt, Shigella flexneri 2a str. 2457T
acaucaucugcca

SEQ ID NO: 1912927 - RNA, 15 nt, Shigella flexneri 2a str. 2457T
acaucaucugccacu

SEQ ID NO: 1912928 - RNA, 14 nt, Shigella flexneri 2a str. 2457T
acauauaucgaaaa

SEQ ID NO: 1912929 - RNA, 22 nt, Shigella flexneri 2a str. 2457T
acauauauuacaacguauuaua

SEQ ID NO: 1912930 - RNA, 15 nt, Shigella flexneri 2a str. 2457T
acaucaagauaacua

SEQ ID NO: 1912931 - RNA, 16 nt, Shigella flexneri 2a str. 2457T
acaucaacucugcaau

SEQ ID NO: 1912932 - RNA, 14 nt, Shigella flexneri 2a str. 2457T
acaucaacccgccc

SEQ ID NO: 1912933 - RNA, 13 nt, Shigella flexneri 2a str. 2457T
acaucaccgccac

SEQ ID NO: 1912934 - RNA, 21 nt, Shigella flexneri 2a str. 2457T
acaucaccaaugaaagcccca

SEQ ID NO: 1912935 - RNA, 22 nt, Shigella flexneri 2a str. 2457T
acaucacaccugcucagcccgu

SEQ ID NO: 1912936 - RNA, 13 nt, Shigella flexneri 2a str. 2457T
acaucacaugcug

SEQ ID NO: 1912937 - RNA, 13 nt, Shigella flexneri 2a str. 2457T
acaucaccaacac

SEQ ID NO: 1912938 - RNA, 13 nt, Shigella flexneri 2a str. 2457T
acagccaacugga

SEQ ID NO: 1912939 - RNA, 15 nt, Shigella flexneri 2a str. 2457T
acagccaaaucauca

SEQ ID NO: 1912940 - RNA, 14 nt, Shigella flexneri 2a str. 2457T
acagccaacacauu

SEQ ID NO: 1912941 - RNA, 13 nt, Shigella flexneri 2a str. 2457T
acagccaacacau

SEQ ID NO: 1912942 - RNA, 19 nt, Shigella flexneri 2a str. 2457T
acaguuucggaccagccgc

SEQ ID NO: 1912943 - RNA, 14 nt, Shigella flexneri 2a str. 2457T
acauaacugccucg

SEQ ID NO: 1912944 - RNA, 18 nt, Shigella flexneri 2a str. 2457T
acauacugagaaccuuua

SEQ ID NO: 1912945 - RNA, 18 nt, Shigella flexneri 2a str. 2457T
acauagaucuaaaugcca

SEQ ID NO: 1912946 - RNA, 15 nt, Shigella flexneri 2a str. 2457T
acauaccuaaaagca

SEQ ID NO: 1912947 - RNA, 13 nt, Shigella flexneri 2a str. 2457T
acauaauauaaau

SEQ ID NO: 1912948 - RNA, 14 nt, Shigella flexneri 2a str. 2457T
acagauaggcauca

SEQ ID NO: 1912949 - RNA, 14 nt, Shigella flexneri 2a str. 2457T
acagagaaagcaaa

SEQ ID NO: 1912950 - RNA, 23 nt, Shigella flexneri 2a str. 2457T
acagagaaagcaaaaauaaaugc

SEQ ID NO: 1912951 - RNA, 17 nt, Shigella flexneri 2a str. 2457T
acagaaucugaaggaug

SEQ ID NO: 1912952 - RNA, 18 nt, Shigella flexneri 2a str. 2457T
acagaauauaagucaggg

SEQ ID NO: 1912953 - RNA, 17 nt, Shigella flexneri 2a str. 2457T
acagaagugaagcaugg

SEQ ID NO: 1912954 - RNA, 20 nt, Shigella flexneri 2a str. 2457T
acagaccuuucgaacccaac

SEQ ID NO: 1912955 - RNA, 21 nt, Shigella flexneri 2a str. 2457T
acagaccuuucgaacccaacc

SEQ ID NO: 1912956 - RNA, 11 nt, Shigella flexneri 2a str. 2457T
acagacgacga

SEQ ID NO: 1912957 - RNA, 17 nt, Shigella flexneri 2a str. 2457T
acagacgagggaaaaua

SEQ ID NO: 1912958 - RNA, 20 nt, Shigella flexneri 2a str. 2457T
acagaccugcgucaccacau

SEQ ID NO: 1912959 - RNA, 19 nt, Shigella flexneri 2a str. 2457T
acagacucaaaccaauggc

SEQ ID NO: 1912960 - RNA, 15 nt, Shigella flexneri 2a str. 2457T
acagacucaaaccaa

SEQ ID NO: 1912961 - RNA, 12 nt, Shigella flexneri 2a str. 2457T
acagcaaaacac

SEQ ID NO: 1912962 - RNA, 14 nt, Shigella flexneri 2a str. 2457T
acagauuuugccag

SEQ ID NO: 1912963 - RNA, 16 nt, Shigella flexneri 2a str. 2457T
acagauuuugccagca

SEQ ID NO: 1912964 - RNA, 20 nt, Shigella flexneri 2a str. 2457T
acagcaaagcgugcaaauau

SEQ ID NO: 1912965 - RNA, 20 nt, Shigella flexneri 2a str. 2457T
acagcaaagugcccccaacu

SEQ ID NO: 1912966 - RNA, 20 nt, Shigella flexneri 2a str. 2457T
acagcaucguccgccagccu

SEQ ID NO: 1912967 - RNA, 21 nt, Shigella flexneri 2a str. 2457T
acagcauggcuucuuccccgg

SEQ ID NO: 1912968 - RNA, 21 nt, Shigella flexneri 2a str. 2457T
acagcauaccuucacagaagg

SEQ ID NO: 1912969 - RNA, 21 nt, Shigella flexneri 2a str. 2457T
acagcaucaggcuaaucgcca

SEQ ID NO: 1912970 - RNA, 17 nt, Shigella flexneri 2a str. 2457T
acagcaucaucgcaaug

SEQ ID NO: 1912971 - RNA, 20 nt, Shigella flexneri 2a str. 2457T
acagcagguguuacccgcua

SEQ ID NO: 1912972 - RNA, 19 nt, Shigella flexneri 2a str. 2457T
acagcaggcagauccaguu

SEQ ID NO: 1912973 - RNA, 17 nt, Shigella flexneri 2a str. 2457T
acagcaggcucagaaga

SEQ ID NO: 1912974 - RNA, 13 nt, Shigella flexneri 2a str. 2457T
acagcaguccagc

SEQ ID NO: 1912975 - RNA, 21 nt, Shigella flexneri 2a str. 2457T
acacgcugcgguuuacgccag

SEQ ID NO: 1912976 - RNA, 20 nt, Shigella flexneri 2a str. 2457T
acacgcuaccacaagccacc

SEQ ID NO: 1912977 - RNA, 20 nt, Shigella flexneri 2a str. 2457T
acacgcucuggcaggcuuca

SEQ ID NO: 1912978 - RNA, 19 nt, Shigella flexneri 2a str. 2457T
acacggcagcaaccgcuuc

SEQ ID NO: 1912979 - RNA, 19 nt, Shigella flexneri 2a str. 2457T
acacguuaaugcaaucaaa

SEQ ID NO: 1912980 - RNA, 14 nt, Shigella flexneri 2a str. 2457T
acacuaacagaaca

SEQ ID NO: 1912981 - RNA, 13 nt, Shigella flexneri 2a str. 2457T
acagaacaauaau

SEQ ID NO: 1912982 - RNA, 15 nt, Shigella flexneri 2a str. 2457T
acagaaaugaaaaaa

SEQ ID NO: 1912983 - RNA, 19 nt, Shigella flexneri 2a str. 2457T
acagaagaaagcaaugaaa

SEQ ID NO: 1912984 - RNA, 19 nt, Shigella flexneri 2a str. 2457T
acagaaaugaaaaaauaga

SEQ ID NO: 1912985 - RNA, 12 nt, Shigella flexneri 2a str. 2457T
acagaaauggua

SEQ ID NO: 1912986 - RNA, 18 nt, Shigella flexneri 2a str. 2457T
acacuaacgcgucuuauc

SEQ ID NO: 1912987 - RNA, 20 nt, Shigella flexneri 2a str. 2457T
acacuaacgcgucuuaucug

SEQ ID NO: 1912988 - RNA, 22 nt, Shigella flexneri 2a str. 2457T
acacuauuuccccggaaccuga

SEQ ID NO: 1912989 - RNA, 17 nt, Shigella flexneri 2a str. 2457T
acacuccagucccaguu

SEQ ID NO: 1912990 - RNA, 18 nt, Shigella flexneri 2a str. 2457T
acacuauucgccagcacg

SEQ ID NO: 1912991 - RNA, 15 nt, Shigella flexneri 2a str. 2457T
acaccaacaucacgc

SEQ ID NO: 1912992 - RNA, 13 nt, Shigella flexneri 2a str. 2457T
acaccaaacagac

SEQ ID NO: 1912993 - RNA, 16 nt, Shigella flexneri 2a str. 2457T
acacauuaucucaaca

SEQ ID NO: 1912994 - RNA, 17 nt, Shigella flexneri 2a str. 2457T
acacauuacgccaguaa

SEQ ID NO: 1912995 - RNA, 20 nt, Shigella flexneri 2a str. 2457T
acacauucaaacgauuuuuu

SEQ ID NO: 1912996 - RNA, 19 nt, Shigella flexneri 2a str. 2457T
acacauuaucucaacacac

SEQ ID NO: 1912997 - RNA, 14 nt, Shigella flexneri 2a str. 2457T
acaccaacgccccg

SEQ ID NO: 1912998 - RNA, 20 nt, Shigella flexneri 2a str. 2457T
acaccaccaauggcuggccu

SEQ ID NO: 1912999 - RNA, 14 nt, Shigella flexneri 2a str. 2457T
acaccacugcgcau

SEQ ID NO: 1913000 - RNA, 17 nt, Shigella flexneri 2a str. 2457T
acaccacugcgcauaau

SEQ ID NO: 1913001 - RNA, 17 nt, Shigella flexneri 2a str. 2457T
acaccaccuaacccgcu

SEQ ID NO: 1913002 - RNA, 14 nt, Shigella flexneri 2a str. 2457T
acaccaccugccag

SEQ ID NO: 1913003 - RNA, 15 nt, Shigella flexneri 2a str. 2457T
acaccagcacaucau

SEQ ID NO: 1913004 - RNA, 22 nt, Shigella flexneri 2a str. 2457T
acaccagcaguaaaccacccac

SEQ ID NO: 1913005 - RNA, 15 nt, Shigella flexneri 2a str. 2457T
acaccccuucauuca

SEQ ID NO: 1913006 - RNA, 22 nt, Shigella flexneri 2a str. 2457T
acaccauaacagaggccacccu

SEQ ID NO: 1913007 - RNA, 17 nt, Shigella flexneri 2a str. 2457T
acacccgguaucaaacc

SEQ ID NO: 1913008 - RNA, 20 nt, Shigella flexneri 2a str. 2457T
acaccauugauaauccauca

SEQ ID NO: 1913009 - RNA, 12 nt, Shigella flexneri 2a str. 2457T
acacccagcccc

SEQ ID NO: 1913010 - RNA, 15 nt, Shigella flexneri 2a str. 2457T
acaccgauugccccu

SEQ ID NO: 1913011 - RNA, 14 nt, Shigella flexneri 2a str. 2457T
acaccgauuuugua

SEQ ID NO: 1913012 - RNA, 21 nt, Shigella flexneri 2a str. 2457T
acaccgauuuuguaaaagaag

SEQ ID NO: 1913013 - RNA, 15 nt, Shigella flexneri 2a str. 2457T
acaccgcacgcagaa

SEQ ID NO: 1913014 - RNA, 16 nt, Shigella flexneri 2a str. 2457T
acaccgauugccccug

SEQ ID NO: 1913015 - RNA, 22 nt, Shigella flexneri 2a str. 2457T
acaccgcugacuuucaaacgcc

SEQ ID NO: 1913016 - RNA, 16 nt, Shigella flexneri 2a str. 2457T
acaccggcaauaauua

SEQ ID NO: 1913017 - RNA, 19 nt, Shigella flexneri 2a str. 2457T
acacgccaggccacgcuuu

SEQ ID NO: 1913018 - RNA, 13 nt, Shigella flexneri 2a str. 2457T
acacgaucucacg

SEQ ID NO: 1913019 - RNA, 16 nt, Shigella flexneri 2a str. 2457T
acaccuguuccagugg

SEQ ID NO: 1913020 - RNA, 23 nt, Shigella flexneri 2a str. 2457T
acaccuguugcgcgucgcccagu

SEQ ID NO: 1913021 - RNA, 14 nt, Shigella flexneri 2a str. 2457T
acaccuucauccag

SEQ ID NO: 1913022 - RNA, 19 nt, Shigella flexneri 2a str. 2457T
acaccugcauucgagccaa

SEQ ID NO: 1913023 - RNA, 18 nt, Shigella flexneri 2a str. 2457T
acaaucguugccugaugc

SEQ ID NO: 1913024 - RNA, 17 nt, Shigella flexneri 2a str. 2457T
acaaucguuucaugcca

SEQ ID NO: 1913025 - RNA, 23 nt, Shigella flexneri 2a str. 2457T
acaaucgggaaaaucugcgggaa

SEQ ID NO: 1913026 - RNA, 14 nt, Shigella flexneri 2a str. 2457T
acaaucgcuuaauc

SEQ ID NO: 1913027 - RNA, 23 nt, Shigella flexneri 2a str. 2457T
acaaucgcuucaucgcccacauc

SEQ ID NO: 1913028 - RNA, 13 nt, Shigella flexneri 2a str. 2457T
acaaucugauaau

SEQ ID NO: 1913029 - RNA, 14 nt, Shigella flexneri 2a str. 2457T
acaaugagauauuu

SEQ ID NO: 1913030 - RNA, 18 nt, Shigella flexneri 2a str. 2457T
acaauccgguagguucaa

SEQ ID NO: 1913031 - RNA, 20 nt, Shigella flexneri 2a str. 2457T
acaaucccuuaguaacgcca

SEQ ID NO: 1913032 - RNA, 21 nt, Shigella flexneri 2a str. 2457T
acaaucccgcuuacaucaacu

SEQ ID NO: 1913033 - RNA, 20 nt, Shigella flexneri 2a str. 2457T
acaaucaccaggucaccaga

SEQ ID NO: 1913034 - RNA, 13 nt, Shigella flexneri 2a str. 2457T
acaaucaaauccu

SEQ ID NO: 1913035 - RNA, 18 nt, Shigella flexneri 2a str. 2457T
acaaucacgauagccaga

SEQ ID NO: 1913036 - RNA, 16 nt, Shigella flexneri 2a str. 2457T
acaauaugcucuccac

SEQ ID NO: 1913037 - RNA, 13 nt, Shigella flexneri 2a str. 2457T
acaaguucuucga

SEQ ID NO: 1913038 - RNA, 15 nt, Shigella flexneri 2a str. 2457T
acaauacgcccacgu

SEQ ID NO: 1913039 - RNA, 16 nt, Shigella flexneri 2a str. 2457T
acaauacugaucauca

SEQ ID NO: 1913040 - RNA, 18 nt, Shigella flexneri 2a str. 2457T
acaauagcaaucuguaac

SEQ ID NO: 1913041 - RNA, 19 nt, Shigella flexneri 2a str. 2457T
acaauagcgaacagacaaa

SEQ ID NO: 1913042 - RNA, 17 nt, Shigella flexneri 2a str. 2457T
acaauaauacccagcac

SEQ ID NO: 1913043 - RNA, 15 nt, Shigella flexneri 2a str. 2457T
acaauacaucuuuuc

SEQ ID NO: 1913044 - RNA, 18 nt, Shigella flexneri 2a str. 2457T
acaauacauagaaacuca

SEQ ID NO: 1913045 - RNA, 20 nt, Shigella flexneri 2a str. 2457T
acaagguuugaaaaaaccug

SEQ ID NO: 1913046 - RNA, 17 nt, Shigella flexneri 2a str. 2457T
acaagugggugcuucac

SEQ ID NO: 1913047 - RNA, 17 nt, Shigella flexneri 2a str. 2457T
acaagucuuuuuugguu

SEQ ID NO: 1913048 - RNA, 21 nt, Shigella flexneri 2a str. 2457T
acaagcuuacguuacccagca

SEQ ID NO: 1913049 - RNA, 14 nt, Shigella flexneri 2a str. 2457T
acaagcuccggcuu

SEQ ID NO: 1913050 - RNA, 19 nt, Shigella flexneri 2a str. 2457T
acaaggaauguggcaauga

SEQ ID NO: 1913051 - RNA, 20 nt, Shigella flexneri 2a str. 2457T
acacacuucauuuuccacaa

SEQ ID NO: 1913052 - RNA, 12 nt, Shigella flexneri 2a str. 2457T
acacacaucacg

SEQ ID NO: 1913053 - RNA, 15 nt, Shigella flexneri 2a str. 2457T
acacacuaucccaac

SEQ ID NO: 1913054 - RNA, 14 nt, Shigella flexneri 2a str. 2457T
acacacauuuaucc

SEQ ID NO: 1913055 - RNA, 14 nt, Shigella flexneri 2a str. 2457T
acacaauuuuguag

SEQ ID NO: 1913056 - RNA, 19 nt, Shigella flexneri 2a str. 2457T
acacaauauugcggauaaa

SEQ ID NO: 1913057 - RNA, 17 nt, Shigella flexneri 2a str. 2457T
acacaacagacauuacc

SEQ ID NO: 1913058 - RNA, 22 nt, Shigella flexneri 2a str. 2457T
acacaagguauccagacggcgc

SEQ ID NO: 1913059 - RNA, 17 nt, Shigella flexneri 2a str. 2457T
acacaaccgaggcucaa

SEQ ID NO: 1913060 - RNA, 19 nt, Shigella flexneri 2a str. 2457T
acacagcgacguaaaaaac

SEQ ID NO: 1913061 - RNA, 15 nt, Shigella flexneri 2a str. 2457T
acacaggcagcaauc

SEQ ID NO: 1913062 - RNA, 19 nt, Shigella flexneri 2a str. 2457T
acacagauugauaaaaaua

SEQ ID NO: 1913063 - RNA, 21 nt, Shigella flexneri 2a str. 2457T
acacagauugauaaaaauagu

SEQ ID NO: 1913064 - RNA, 14 nt, Shigella flexneri 2a str. 2457T
acacagcacuauga

SEQ ID NO: 1913065 - RNA, 19 nt, Shigella flexneri 2a str. 2457T
acacaguucuucaaaaaua

SEQ ID NO: 1913066 - RNA, 15 nt, Shigella flexneri 2a str. 2457T
acacauacuuauuau

SEQ ID NO: 1913067 - RNA, 18 nt, Shigella flexneri 2a str. 2457T
acaaugcgacaaacagga

SEQ ID NO: 1913068 - RNA, 21 nt, Shigella flexneri 2a str. 2457T
acaauggucaacauucccugc

SEQ ID NO: 1913069 - RNA, 21 nt, Shigella flexneri 2a str. 2457T
acaauggcggugaucccaaua

SEQ ID NO: 1913070 - RNA, 21 nt, Shigella flexneri 2a str. 2457T
acaauggcauuuaucuucugg

SEQ ID NO: 1913071 - RNA, 21 nt, Shigella flexneri 2a str. 2457T
acaauggagcuaaacagcgcu

SEQ ID NO: 1913072 - RNA, 18 nt, Shigella flexneri 2a str. 2457T
acaauggagcuaaacagc

SEQ ID NO: 1913073 - RNA, 11 nt, Shigella flexneri 2a str. 2457T
acaauucaggg

SEQ ID NO: 1913074 - RNA, 15 nt, Shigella flexneri 2a str. 2457T
acaauucgccagggc

SEQ ID NO: 1913075 - RNA, 22 nt, Shigella flexneri 2a str. 2457T
acaauucgcguaguaaagccuu

SEQ ID NO: 1913076 - RNA, 18 nt, Shigella flexneri 2a str. 2457T
acaauucccaguuacugc

SEQ ID NO: 1913077 - RNA, 19 nt, Shigella flexneri 2a str. 2457T
acaauugccgccagcucac

SEQ ID NO: 1913078 - RNA, 19 nt, Shigella flexneri 2a str. 2457T
acaauugaagaauaucuuc

SEQ ID NO: 1913079 - RNA, 15 nt, Shigella flexneri 2a str. 2457T
acaauugaccaguaa

SEQ ID NO: 1913080 - RNA, 21 nt, Shigella flexneri 2a str. 2457T
acaauuuaccgacgcugcuca

SEQ ID NO: 1913081 - RNA, 21 nt, Shigella flexneri 2a str. 2457T
acaauuucagaauagacaaaa

SEQ ID NO: 1913082 - RNA, 20 nt, Shigella flexneri 2a str. 2457T
acaauugcgggccaaagacc

SEQ ID NO: 1913083 - RNA, 14 nt, Shigella flexneri 2a str. 2457T
acaauuguugaccg

SEQ ID NO: 1913084 - RNA, 16 nt, Shigella flexneri 2a str. 2457T
acaauuucagcaauaa

SEQ ID NO: 1913085 - RNA, 22 nt, Shigella flexneri 2a str. 2457T
acaauuucagaauagacaaaaa

SEQ ID NO: 1913086 - RNA, 18 nt, Shigella flexneri 2a str. 2457T
aauuuccgccaccugauc

SEQ ID NO: 1913087 - RNA, 17 nt, Shigella flexneri 2a str. 2457T
aauuuccagaaagugag

SEQ ID NO: 1913088 - RNA, 23 nt, Shigella flexneri 2a str. 2457T
aauuucaucaucacgaaauccca

SEQ ID NO: 1913089 - RNA, 21 nt, Shigella flexneri 2a str. 2457T
aauuucaucgcuacaccaauc

SEQ ID NO: 1913090 - RNA, 22 nt, Shigella flexneri 2a str. 2457T
aauuucucgcccagaucaccaa

SEQ ID NO: 1913091 - RNA, 18 nt, Shigella flexneri 2a str. 2457T
aauuucuccuucacucua

SEQ ID NO: 1913092 - RNA, 18 nt, Shigella flexneri 2a str. 2457T
aauuucuuaccacugccg

SEQ ID NO: 1913093 - RNA, 19 nt, Shigella flexneri 2a str. 2457T
aauuucuucugguuucagu

SEQ ID NO: 1913094 - RNA, 22 nt, Shigella flexneri 2a str. 2457T
aauuucugugcagccaaaaaug

SEQ ID NO: 1913095 - RNA, 16 nt, Shigella flexneri 2a str. 2457T
aauuucugcaaaauag

SEQ ID NO: 1913096 - RNA, 18 nt, Shigella flexneri 2a str. 2457T
aauuuguaggcuaaaaac

SEQ ID NO: 1913097 - RNA, 17 nt, Shigella flexneri 2a str. 2457T
aauuuguccaccaauag

SEQ ID NO: 1913098 - RNA, 17 nt, Shigella flexneri 2a str. 2457T
aauuuguuggcgaaaau

SEQ ID NO: 1913099 - RNA, 12 nt, Shigella flexneri 2a str. 2457T
aauuuuacagcc

SEQ ID NO: 1913100 - RNA, 22 nt, Shigella flexneri 2a str. 2457T
aauuuuaaauaucaucaaaauu

SEQ ID NO: 1913101 - RNA, 12 nt, Shigella flexneri 2a str. 2457T
aauuuuaggaug

SEQ ID NO: 1913102 - RNA, 20 nt, Shigella flexneri 2a str. 2457T
aauuuuaccuagcacuguaa

SEQ ID NO: 1913103 - RNA, 18 nt, Shigella flexneri 2a str. 2457T
aauuuuauguuucgcauc

SEQ ID NO: 1913104 - RNA, 15 nt, Shigella flexneri 2a str. 2457T
aauuuuaggaugcug

SEQ ID NO: 1913105 - RNA, 17 nt, Shigella flexneri 2a str. 2457T
aauuuuaggaugcugca

SEQ ID NO: 1913106 - RNA, 13 nt, Shigella flexneri 2a str. 2457T
aauuugaggaagc

SEQ ID NO: 1913107 - RNA, 12 nt, Shigella flexneri 2a str. 2457T
aauuuguaacug

SEQ ID NO: 1913108 - RNA, 14 nt, Shigella flexneri 2a str. 2457T
aauuuguaacuguc

SEQ ID NO: 1913109 - RNA, 22 nt, Shigella flexneri 2a str. 2457T
aauuugccguuaaucccagacu

SEQ ID NO: 1913110 - RNA, 20 nt, Shigella flexneri 2a str. 2457T
aauuugcgcucaauaaucaa

SEQ ID NO: 1913111 - RNA, 18 nt, Shigella flexneri 2a str. 2457T
aauuugcuaccccugaga

SEQ ID NO: 1913112 - RNA, 18 nt, Shigella flexneri 2a str. 2457T
acaaacaccgaaccagag

SEQ ID NO: 1913113 - RNA, 14 nt, Shigella flexneri 2a str. 2457T
acaaacacaaaacu

SEQ ID NO: 1913114 - RNA, 16 nt, Shigella flexneri 2a str. 2457T
acaaaauuuucagcgu

SEQ ID NO: 1913115 - RNA, 12 nt, Shigella flexneri 2a str. 2457T
acaaaauuuaac

SEQ ID NO: 1913116 - RNA, 17 nt, Shigella flexneri 2a str. 2457T
acaaaagcggugauaaa

SEQ ID NO: 1913117 - RNA, 16 nt, Shigella flexneri 2a str. 2457T
acaaaagcgaagcgaa

SEQ ID NO: 1913118 - RNA, 15 nt, Shigella flexneri 2a str. 2457T
acaaaauaaccuaua

SEQ ID NO: 1913119 - RNA, 17 nt, Shigella flexneri 2a str. 2457T
acaaaaucggaaacaaa

SEQ ID NO: 1913120 - RNA, 15 nt, Shigella flexneri 2a str. 2457T
acaaaaucuuaaaga

SEQ ID NO: 1913121 - RNA, 14 nt, Shigella flexneri 2a str. 2457T
acaaaauccugcca

SEQ ID NO: 1913122 - RNA, 21 nt, Shigella flexneri 2a str. 2457T
acaaaauccugccagcgugag

SEQ ID NO: 1913123 - RNA, 19 nt, Shigella flexneri 2a str. 2457T
acaaaaucuauugcaacau

SEQ ID NO: 1913124 - RNA, 21 nt, Shigella flexneri 2a str. 2457T
acaaaaaguaguuccagcaug

SEQ ID NO: 1913125 - RNA, 13 nt, Shigella flexneri 2a str. 2457T
acaaaaacucaua

SEQ ID NO: 1913126 - RNA, 15 nt, Shigella flexneri 2a str. 2457T
acaaaaacucauaaa

SEQ ID NO: 1913127 - RNA, 14 nt, Shigella flexneri 2a str. 2457T
acaaaaaagaguaa

SEQ ID NO: 1913128 - RNA, 22 nt, Shigella flexneri 2a str. 2457T
acaaaaaagccaaucacaaaaa

SEQ ID NO: 1913129 - RNA, 15 nt, Shigella flexneri 2a str. 2457T
acaaaaaaugugaag

SEQ ID NO: 1913130 - RNA, 21 nt, Shigella flexneri 2a str. 2457T
acaaaaccacgacuuuuuguc

SEQ ID NO: 1913131 - RNA, 16 nt, Shigella flexneri 2a str. 2457T
acaaaaauaccaccaa

SEQ ID NO: 1913132 - RNA, 21 nt, Shigella flexneri 2a str. 2457T
acaaaagaauggcuguagggu

SEQ ID NO: 1913133 - RNA, 20 nt, Shigella flexneri 2a str. 2457T
acaaaagacgauaguaauuu

SEQ ID NO: 1913134 - RNA, 12 nt, Shigella flexneri 2a str. 2457T
acaaaaccugcu

SEQ ID NO: 1913135 - RNA, 21 nt, Shigella flexneri 2a str. 2457T
aauuuuuccagcauuucuucc

SEQ ID NO: 1913136 - RNA, 14 nt, Shigella flexneri 2a str. 2457T
aauuuuuauuauuu

SEQ ID NO: 1913137 - RNA, 14 nt, Shigella flexneri 2a str. 2457T
acaaaaaaaacagc

SEQ ID NO: 1913138 - RNA, 17 nt, Shigella flexneri 2a str. 2457T
aauuuuuguuguuuaaa

SEQ ID NO: 1913139 - RNA, 19 nt, Shigella flexneri 2a str. 2457T
aauuuugcauucacccggg

SEQ ID NO: 1913140 - RNA, 19 nt, Shigella flexneri 2a str. 2457T
aauuuucgccaucucaaaa

SEQ ID NO: 1913141 - RNA, 13 nt, Shigella flexneri 2a str. 2457T
aauuuucucuuuc

SEQ ID NO: 1913142 - RNA, 14 nt, Shigella flexneri 2a str. 2457T
acaacccacacauu

SEQ ID NO: 1913143 - RNA, 23 nt, Shigella flexneri 2a str. 2457T
acaacaugcuauugcgccagccu

SEQ ID NO: 1913144 - RNA, 17 nt, Shigella flexneri 2a str. 2457T
acaacauuuugcggcua

SEQ ID NO: 1913145 - RNA, 13 nt, Shigella flexneri 2a str. 2457T
acaacacucucug

SEQ ID NO: 1913146 - RNA, 17 nt, Shigella flexneri 2a str. 2457T
acaacacucucugaagu

SEQ ID NO: 1913147 - RNA, 19 nt, Shigella flexneri 2a str. 2457T
acaacagaaauaaucgcaa

SEQ ID NO: 1913148 - RNA, 18 nt, Shigella flexneri 2a str. 2457T
acaacaugagaacaguuc

SEQ ID NO: 1913149 - RNA, 14 nt, Shigella flexneri 2a str. 2457T
acaacaucaucugc

SEQ ID NO: 1913150 - RNA, 16 nt, Shigella flexneri 2a str. 2457T
acaacccuaaagcacc

SEQ ID NO: 1913151 - RNA, 15 nt, Shigella flexneri 2a str. 2457T
acaaccgaggcucaa

SEQ ID NO: 1913152 - RNA, 12 nt, Shigella flexneri 2a str. 2457T
acaaccggauau

SEQ ID NO: 1913153 - RNA, 20 nt, Shigella flexneri 2a str. 2457T
acaaccugcuggaaaggccg

SEQ ID NO: 1913154 - RNA, 22 nt, Shigella flexneri 2a str. 2457T
acaaccuugccauuccacaaaa

SEQ ID NO: 1913155 - RNA, 13 nt, Shigella flexneri 2a str. 2457T
acaacgagcgcaa

SEQ ID NO: 1913156 - RNA, 20 nt, Shigella flexneri 2a str. 2457T
acaacgcaauauccgccacu

SEQ ID NO: 1913157 - RNA, 13 nt, Shigella flexneri 2a str. 2457T
acaacggaacgaa

SEQ ID NO: 1913158 - RNA, 17 nt, Shigella flexneri 2a str. 2457T
acaacggaacgaaaaaa

SEQ ID NO: 1913159 - RNA, 19 nt, Shigella flexneri 2a str. 2457T
acaacggaacgaaaaaaau

SEQ ID NO: 1913160 - RNA, 17 nt, Shigella flexneri 2a str. 2457T
acaacgcuuucaacaac

SEQ ID NO: 1913161 - RNA, 19 nt, Shigella flexneri 2a str. 2457T
acaacgcuuuuugguucau

SEQ ID NO: 1913162 - RNA, 18 nt, Shigella flexneri 2a str. 2457T
acaacguaucuugcguca

SEQ ID NO: 1913163 - RNA, 16 nt, Shigella flexneri 2a str. 2457T
acaacugaaaaaaaau

SEQ ID NO: 1913164 - RNA, 14 nt, Shigella flexneri 2a str. 2457T
acaacguuuuucua

SEQ ID NO: 1913165 - RNA, 15 nt, Shigella flexneri 2a str. 2457T
acaacguuuuucuaa

SEQ ID NO: 1913166 - RNA, 12 nt, Shigella flexneri 2a str. 2457T
acaacucaucac

SEQ ID NO: 1913167 - RNA, 20 nt, Shigella flexneri 2a str. 2457T
acaacuccguugaaauugcu

SEQ ID NO: 1913168 - RNA, 13 nt, Shigella flexneri 2a str. 2457T
acaacuucccugu

SEQ ID NO: 1913169 - RNA, 21 nt, Shigella flexneri 2a str. 2457T
acaacuucaacguugaauuuc

SEQ ID NO: 1913170 - RNA, 21 nt, Shigella flexneri 2a str. 2457T
acaacucaucacuguaggcca

SEQ ID NO: 1913171 - RNA, 18 nt, Shigella flexneri 2a str. 2457T
acaacuuaauaggggcac

SEQ ID NO: 1913172 - RNA, 13 nt, Shigella flexneri 2a str. 2457T
acaagacuguaaa

SEQ ID NO: 1913173 - RNA, 14 nt, Shigella flexneri 2a str. 2457T
acaagacuguaaau

SEQ ID NO: 1913174 - RNA, 17 nt, Shigella flexneri 2a str. 2457T
acaagaucgcccugagg

SEQ ID NO: 1913175 - RNA, 20 nt, Shigella flexneri 2a str. 2457T
acaagcccgcugccgcagau

SEQ ID NO: 1913176 - RNA, 14 nt, Shigella flexneri 2a str. 2457T
acaagccaccaucc

SEQ ID NO: 1913177 - RNA, 15 nt, Shigella flexneri 2a str. 2457T
acaagcguaagagaa

SEQ ID NO: 1913178 - RNA, 23 nt, Shigella flexneri 2a str. 2457T
acaaacagcgccuguuuaccgcu

SEQ ID NO: 1913179 - RNA, 22 nt, Shigella flexneri 2a str. 2457T
acaaacagcucgacaccaaaca

SEQ ID NO: 1913180 - RNA, 20 nt, Shigella flexneri 2a str. 2457T
acaaacaucauccagugccg

SEQ ID NO: 1913181 - RNA, 18 nt, Shigella flexneri 2a str. 2457T
acaaacauugcugccaga

SEQ ID NO: 1913182 - RNA, 22 nt, Shigella flexneri 2a str. 2457T
acaaaccgaguuaguccacacg

SEQ ID NO: 1913183 - RNA, 18 nt, Shigella flexneri 2a str. 2457T
acaaaccauaagguggga

SEQ ID NO: 1913184 - RNA, 15 nt, Shigella flexneri 2a str. 2457T
acaaagaagggaaug

SEQ ID NO: 1913185 - RNA, 14 nt, Shigella flexneri 2a str. 2457T
acaaagacaucaaa

SEQ ID NO: 1913186 - RNA, 16 nt, Shigella flexneri 2a str. 2457T
acaaacgccagauaca

SEQ ID NO: 1913187 - RNA, 19 nt, Shigella flexneri 2a str. 2457T
acaaacgccagauacauca

SEQ ID NO: 1913188 - RNA, 14 nt, Shigella flexneri 2a str. 2457T
acaaacggaaaaca

SEQ ID NO: 1913189 - RNA, 19 nt, Shigella flexneri 2a str. 2457T
acaaacgcuguaauuacca

SEQ ID NO: 1913190 - RNA, 18 nt, Shigella flexneri 2a str. 2457T
acaaacguugcugacugu

SEQ ID NO: 1913191 - RNA, 12 nt, Shigella flexneri 2a str. 2457T
acaaagcaugau

SEQ ID NO: 1913192 - RNA, 20 nt, Shigella flexneri 2a str. 2457T
acaaagggcgucgcuuaauu

SEQ ID NO: 1913193 - RNA, 17 nt, Shigella flexneri 2a str. 2457T
acaaauggcaaugacua

SEQ ID NO: 1913194 - RNA, 10 nt, Shigella flexneri 2a str. 2457T
acaaauuccg

SEQ ID NO: 1913195 - RNA, 18 nt, Shigella flexneri 2a str. 2457T
acaaauuccgaacaaaac

SEQ ID NO: 1913196 - RNA, 21 nt, Shigella flexneri 2a str. 2457T
acaaauucacgccuucuucca

SEQ ID NO: 1913197 - RNA, 16 nt, Shigella flexneri 2a str. 2457T
acaaauuugugcucug

SEQ ID NO: 1913198 - RNA, 14 nt, Shigella flexneri 2a str. 2457T
acaacaacacccau

SEQ ID NO: 1913199 - RNA, 18 nt, Shigella flexneri 2a str. 2457T
acaacaacuucuaauuuu

SEQ ID NO: 1913200 - RNA, 22 nt, Shigella flexneri 2a str. 2457T
acaacacccggucagccauugc

SEQ ID NO: 1913201 - RNA, 13 nt, Shigella flexneri 2a str. 2457T
acaacaccgugca

SEQ ID NO: 1913202 - RNA, 13 nt, Shigella flexneri 2a str. 2457T
acaaauaaaaaau

SEQ ID NO: 1913203 - RNA, 18 nt, Shigella flexneri 2a str. 2457T
acaaauaaaagcaaaaau

SEQ ID NO: 1913204 - RNA, 15 nt, Shigella flexneri 2a str. 2457T
acaaauagccaauuc

SEQ ID NO: 1913205 - RNA, 21 nt, Shigella flexneri 2a str. 2457T
acaaauagacacaagaaauau

SEQ ID NO: 1913206 - RNA, 21 nt, Shigella flexneri 2a str. 2457T
acaaauccuucacuuuugcca

SEQ ID NO: 1913207 - RNA, 16 nt, Shigella flexneri 2a str. 2457T
acaaaugaacaccaaa

SEQ ID NO: 1913208 - RNA, 21 nt, Shigella flexneri 2a str. 2457T
acaaaugaccgacguuaugcu

SEQ ID NO: 1913209 - RNA, 18 nt, Shigella flexneri 2a str. 2457T
aaggccagcaauccccag

SEQ ID NO: 1913210 - RNA, 20 nt, Shigella flexneri 2a str. 2457T
aaggccguuuucaacaccgc

SEQ ID NO: 1913211 - RNA, 21 nt, Shigella flexneri 2a str. 2457T
aaggccggagaagaugcguca

SEQ ID NO: 1913212 - RNA, 16 nt, Shigella flexneri 2a str. 2457T
aaggccgacagcaggc

SEQ ID NO: 1913213 - RNA, 23 nt, Shigella flexneri 2a str. 2457T
aaggccgacagcaggcucagaag

SEQ ID NO: 1913214 - RNA, 22 nt, Shigella flexneri 2a str. 2457T
aaggccgcgaaccggaccagca

SEQ ID NO: 1913215 - RNA, 21 nt, Shigella flexneri 2a str. 2457T
aaggccuuaguagaagaggaa

SEQ ID NO: 1913216 - RNA, 18 nt, Shigella flexneri 2a str. 2457T
aaggcgcucauuuucucu

SEQ ID NO: 1913217 - RNA, 18 nt, Shigella flexneri 2a str. 2457T
aaggcgcgagguuuuccu

SEQ ID NO: 1913218 - RNA, 17 nt, Shigella flexneri 2a str. 2457T
aaggcacaacugcgacc

SEQ ID NO: 1913219 - RNA, 20 nt, Shigella flexneri 2a str. 2457T
aaggcaacgccccuucugcc

SEQ ID NO: 1913220 - RNA, 23 nt, Shigella flexneri 2a str. 2457T
aaggccagaccguggucagaaaa

SEQ ID NO: 1913221 - RNA, 22 nt, Shigella flexneri 2a str. 2457T
aaggcagacguauccuggaaca

SEQ ID NO: 1913222 - RNA, 12 nt, Shigella flexneri 2a str. 2457T
aaggcagccuuu

SEQ ID NO: 1913223 - RNA, 12 nt, Shigella flexneri 2a str. 2457T
aaggcaguucag

SEQ ID NO: 1913224 - RNA, 12 nt, Shigella flexneri 2a str. 2457T
aaggugaagaag

SEQ ID NO: 1913225 - RNA, 17 nt, Shigella flexneri 2a str. 2457T
aaggugccggaauauau

SEQ ID NO: 1913226 - RNA, 18 nt, Shigella flexneri 2a str. 2457T
aaggugccggaauauauu

SEQ ID NO: 1913227 - RNA, 19 nt, Shigella flexneri 2a str. 2457T
aaggugccggaauauauuc

SEQ ID NO: 1913228 - RNA, 18 nt, Shigella flexneri 2a str. 2457T
aagguggcauaaauuucu

SEQ ID NO: 1913229 - RNA, 14 nt, Shigella flexneri 2a str. 2457T
aaggugggaggcgg

SEQ ID NO: 1913230 - RNA, 21 nt, Shigella flexneri 2a str. 2457T
aagguggcgucaaaaagcuca

SEQ ID NO: 1913231 - RNA, 18 nt, Shigella flexneri 2a str. 2457T
aagguuaauaaauauuaa

SEQ ID NO: 1913232 - RNA, 16 nt, Shigella flexneri 2a str. 2457T
aagguuacccgcacgg

SEQ ID NO: 1913233 - RNA, 14 nt, Shigella flexneri 2a str. 2457T
aagguguuugacug

SEQ ID NO: 1913234 - RNA, 17 nt, Shigella flexneri 2a str. 2457T
aagguuaacuguggcgu

SEQ ID NO: 1913235 - RNA, 14 nt, Shigella flexneri 2a str. 2457T
aagguuguugaaag

SEQ ID NO: 1913236 - RNA, 14 nt, Shigella flexneri 2a str. 2457T
aagguugccugucu

SEQ ID NO: 1913237 - RNA, 19 nt, Shigella flexneri 2a str. 2457T
aagguugccauaucuuccc

SEQ ID NO: 1913238 - RNA, 12 nt, Shigella flexneri 2a str. 2457T
aagguuucugca

SEQ ID NO: 1913239 - RNA, 18 nt, Shigella flexneri 2a str. 2457T
aagguuugaaaaaaccug

SEQ ID NO: 1913240 - RNA, 19 nt, Shigella flexneri 2a str. 2457T
aagguucacuuaaucucug

SEQ ID NO: 1913241 - RNA, 13 nt, Shigella flexneri 2a str. 2457T
aagguagaauaag

SEQ ID NO: 1913242 - RNA, 13 nt, Shigella flexneri 2a str. 2457T
aagguacgaaaaa

SEQ ID NO: 1913243 - RNA, 18 nt, Shigella flexneri 2a str. 2457T
aagguaaggauaaaaaag

SEQ ID NO: 1913244 - RNA, 17 nt, Shigella flexneri 2a str. 2457T
aaggcuuucgugaagcu

SEQ ID NO: 1913245 - RNA, 12 nt, Shigella flexneri 2a str. 2457T
aaggcugaugaa

SEQ ID NO: 1913246 - RNA, 18 nt, Shigella flexneri 2a str. 2457T
aaggcugaugaagcaagc

SEQ ID NO: 1913247 - RNA, 21 nt, Shigella flexneri 2a str. 2457T
aagcugcggauccugagcaaa

SEQ ID NO: 1913248 - RNA, 20 nt, Shigella flexneri 2a str. 2457T
aagcugcggauccugagcaa

SEQ ID NO: 1913249 - RNA, 22 nt, Shigella flexneri 2a str. 2457T
aagcugcugacggugauaauca

SEQ ID NO: 1913250 - RNA, 24 nt, Shigella flexneri 2a str. 2457T
aagcuguaucccagcccagcggaa

SEQ ID NO: 1913251 - RNA, 14 nt, Shigella flexneri 2a str. 2457T
aagcuguaucccag

SEQ ID NO: 1913252 - RNA, 18 nt, Shigella flexneri 2a str. 2457T
aagcuguaucccagccca

SEQ ID NO: 1913253 - RNA, 20 nt, Shigella flexneri 2a str. 2457T
aaggagcuaauaaugagcag

SEQ ID NO: 1913254 - RNA, 22 nt, Shigella flexneri 2a str. 2457T
aaggagcuaauaaugagcagaa

SEQ ID NO: 1913255 - RNA, 13 nt, Shigella flexneri 2a str. 2457T
aaggauaugugaa

SEQ ID NO: 1913256 - RNA, 22 nt, Shigella flexneri 2a str. 2457T
aaggauaaaaaagggugcugca

SEQ ID NO: 1913257 - RNA, 22 nt, Shigella flexneri 2a str. 2457T
aagcgucaaguugacucucauc

SEQ ID NO: 1913258 - RNA, 13 nt, Shigella flexneri 2a str. 2457T
aagcgucagcuuu

SEQ ID NO: 1913259 - RNA, 14 nt, Shigella flexneri 2a str. 2457T
aagcguauguggug

SEQ ID NO: 1913260 - RNA, 18 nt, Shigella flexneri 2a str. 2457T
aagcgucgcaucaggcau

SEQ ID NO: 1913261 - RNA, 13 nt, Shigella flexneri 2a str. 2457T
aagcggcacugcu

SEQ ID NO: 1913262 - RNA, 16 nt, Shigella flexneri 2a str. 2457T
aagcgcuggggaaaau

SEQ ID NO: 1913263 - RNA, 16 nt, Shigella flexneri 2a str. 2457T
aagccaccgaacaaaa

SEQ ID NO: 1913264 - RNA, 18 nt, Shigella flexneri 2a str. 2457T
aagccaccacgccaagaa

SEQ ID NO: 1913265 - RNA, 14 nt, Shigella flexneri 2a str. 2457T
aagccaacagcagc

SEQ ID NO: 1913266 - RNA, 16 nt, Shigella flexneri 2a str. 2457T
aagcgugcaaauauac

SEQ ID NO: 1913267 - RNA, 14 nt, Shigella flexneri 2a str. 2457T
aagcucguuguuua

SEQ ID NO: 1913268 - RNA, 23 nt, Shigella flexneri 2a str. 2457T
aagcucugguguggagugcagca

SEQ ID NO: 1913269 - RNA, 12 nt, Shigella flexneri 2a str. 2457T
aagcuccagcau

SEQ ID NO: 1913270 - RNA, 18 nt, Shigella flexneri 2a str. 2457T
aagugcguucaccccuuu

SEQ ID NO: 1913271 - RNA, 20 nt, Shigella flexneri 2a str. 2457T
aagugaauagcgcccggaaa

SEQ ID NO: 1913272 - RNA, 17 nt, Shigella flexneri 2a str. 2457T
aagugaauacagaacag

SEQ ID NO: 1913273 - RNA, 22 nt, Shigella flexneri 2a str. 2457T
aagugaauacagaacagugcca

SEQ ID NO: 1913274 - RNA, 13 nt, Shigella flexneri 2a str. 2457T
aagucuuuguauu

SEQ ID NO: 1913275 - RNA, 19 nt, Shigella flexneri 2a str. 2457T
aagucuuuuuucaacuuua

SEQ ID NO: 1913276 - RNA, 22 nt, Shigella flexneri 2a str. 2457T
aagucuuuuuucaacuuuaucu

SEQ ID NO: 1913277 - RNA, 16 nt, Shigella flexneri 2a str. 2457T
aaguguugcaggaaaa

SEQ ID NO: 1913278 - RNA, 17 nt, Shigella flexneri 2a str. 2457T
aaguggcgauacagugc

SEQ ID NO: 1913279 - RNA, 23 nt, Shigella flexneri 2a str. 2457T
aaguggcgcagagccugaauaaa

SEQ ID NO: 1913280 - RNA, 23 nt, Shigella flexneri 2a str. 2457T
aaguggcggggucgugcagaacg

SEQ ID NO: 1913281 - RNA, 14 nt, Shigella flexneri 2a str. 2457T
aaguggacgaacag

SEQ ID NO: 1913282 - RNA, 15 nt, Shigella flexneri 2a str. 2457T
aaguaauaaugauca

SEQ ID NO: 1913283 - RNA, 18 nt, Shigella flexneri 2a str. 2457T
aaguaaggcgggaauaau

SEQ ID NO: 1913284 - RNA, 19 nt, Shigella flexneri 2a str. 2457T
aaguaagaauugauaaaaa

SEQ ID NO: 1913285 - RNA, 18 nt, Shigella flexneri 2a str. 2457T
aagucagauaaaaaguuu

SEQ ID NO: 1913286 - RNA, 14 nt, Shigella flexneri 2a str. 2457T
aagucggucacagu

SEQ ID NO: 1913287 - RNA, 16 nt, Shigella flexneri 2a str. 2457T
aagucggucacagucu

SEQ ID NO: 1913288 - RNA, 20 nt, Shigella flexneri 2a str. 2457T
aagucguaggccugauaaga

SEQ ID NO: 1913289 - RNA, 22 nt, Shigella flexneri 2a str. 2457T
aagucguucagaucuuucacga

SEQ ID NO: 1913290 - RNA, 18 nt, Shigella flexneri 2a str. 2457T
aaguccguugaaaaugcu

SEQ ID NO: 1913291 - RNA, 18 nt, Shigella flexneri 2a str. 2457T
aagucucaagagugaaca

SEQ ID NO: 1913292 - RNA, 15 nt, Shigella flexneri 2a str. 2457T
aagucucagaaagua

SEQ ID NO: 1913293 - RNA, 16 nt, Shigella flexneri 2a str. 2457T
aagucucagaaaguaa

SEQ ID NO: 1913294 - RNA, 17 nt, Shigella flexneri 2a str. 2457T
aagucucaauuaguaau

SEQ ID NO: 1913295 - RNA, 22 nt, Shigella flexneri 2a str. 2457T
aaguuucacugggcgauuaaua

SEQ ID NO: 1913296 - RNA, 17 nt, Shigella flexneri 2a str. 2457T
aaguuugcuucagaaua

SEQ ID NO: 1913297 - RNA, 12 nt, Shigella flexneri 2a str. 2457T
aaguuuuuauga

SEQ ID NO: 1913298 - RNA, 14 nt, Shigella flexneri 2a str. 2457T
aaguuuuucaacac

SEQ ID NO: 1913299 - RNA, 12 nt, Shigella flexneri 2a str. 2457T
aaguuuuccuca

SEQ ID NO: 1913300 - RNA, 13 nt, Shigella flexneri 2a str. 2457T
aaguuuuccucag

SEQ ID NO: 1913301 - RNA, 22 nt, Shigella flexneri 2a str. 2457T
aaguuagaguagccaauaccaa

SEQ ID NO: 1913302 - RNA, 21 nt, Shigella flexneri 2a str. 2457T
aaguucuucgaagcacucgua

SEQ ID NO: 1913303 - RNA, 22 nt, Shigella flexneri 2a str. 2457T
aaguuuaauugccauuucuggc

SEQ ID NO: 1913304 - RNA, 20 nt, Shigella flexneri 2a str. 2457T
aaguuggugauguauaucgg

SEQ ID NO: 1913305 - RNA, 15 nt, Shigella flexneri 2a str. 2457T
aauaaaaucuauuau

SEQ ID NO: 1913306 - RNA, 14 nt, Shigella flexneri 2a str. 2457T
aauaaaauaucuuc

SEQ ID NO: 1913307 - RNA, 15 nt, Shigella flexneri 2a str. 2457T
aauaaacaucagcua

SEQ ID NO: 1913308 - RNA, 21 nt, Shigella flexneri 2a str. 2457T
aauaaacaaugagauauuuaa

SEQ ID NO: 1913309 - RNA, 14 nt, Shigella flexneri 2a str. 2457T
aauaaaaauacaua

SEQ ID NO: 1913310 - RNA, 13 nt, Shigella flexneri 2a str. 2457T
aauaaaaaaagaa

SEQ ID NO: 1913311 - RNA, 14 nt, Shigella flexneri 2a str. 2457T
aaguuuuuucuucc

SEQ ID NO: 1913312 - RNA, 14 nt, Shigella flexneri 2a str. 2457T
aauaaaaauugaau

SEQ ID NO: 1913313 - RNA, 14 nt, Shigella flexneri 2a str. 2457T
aauaaaacagggcg

SEQ ID NO: 1913314 - RNA, 14 nt, Shigella flexneri 2a str. 2457T
aauaaaacaucacc

SEQ ID NO: 1913315 - RNA, 14 nt, Shigella flexneri 2a str. 2457T
aauaaaacagaaac

SEQ ID NO: 1913316 - RNA, 11 nt, Shigella flexneri 2a str. 2457T
aauaaaacagg

SEQ ID NO: 1913317 - RNA, 16 nt, Shigella flexneri 2a str. 2457T
aauaaaacaggcagcu

SEQ ID NO: 1913318 - RNA, 14 nt, Shigella flexneri 2a str. 2457T
aauaaaagccagga

SEQ ID NO: 1913319 - RNA, 14 nt, Shigella flexneri 2a str. 2457T
aauaaaaggaaaca

SEQ ID NO: 1913320 - RNA, 22 nt, Shigella flexneri 2a str. 2457T
aagauuagcgacgaacagcgau

SEQ ID NO: 1913321 - RNA, 19 nt, Shigella flexneri 2a str. 2457T
aagauuauauaauaugcau

SEQ ID NO: 1913322 - RNA, 20 nt, Shigella flexneri 2a str. 2457T
aagauucaguucaacggugu

SEQ ID NO: 1913323 - RNA, 22 nt, Shigella flexneri 2a str. 2457T
aagauuuugcugugcuuuacac

SEQ ID NO: 1913324 - RNA, 22 nt, Shigella flexneri 2a str. 2457T
aagauuugacccaucugccagc

SEQ ID NO: 1913325 - RNA, 23 nt, Shigella flexneri 2a str. 2457T
aagauggauugcugaaauacaga

SEQ ID NO: 1913326 - RNA, 22 nt, Shigella flexneri 2a str. 2457T
aagauuaagagaaccagcugcc

SEQ ID NO: 1913327 - RNA, 14 nt, Shigella flexneri 2a str. 2457T
aagauguugccaca

SEQ ID NO: 1913328 - RNA, 19 nt, Shigella flexneri 2a str. 2457T
aagaugcggaauuugauga

SEQ ID NO: 1913329 - RNA, 22 nt, Shigella flexneri 2a str. 2457T
aagaugcggaauuugaugagaa

SEQ ID NO: 1913330 - RNA, 12 nt, Shigella flexneri 2a str. 2457T
aagaugcuacaa

SEQ ID NO: 1913331 - RNA, 19 nt, Shigella flexneri 2a str. 2457T
aagaugcaucauuaaugug

SEQ ID NO: 1913332 - RNA, 17 nt, Shigella flexneri 2a str. 2457T
aagaugaauaauguuua

SEQ ID NO: 1913333 - RNA, 14 nt, Shigella flexneri 2a str. 2457T
aagaugaaacuuau

SEQ ID NO: 1913334 - RNA, 17 nt, Shigella flexneri 2a str. 2457T
aagaugaaacuuauuca

SEQ ID NO: 1913335 - RNA, 19 nt, Shigella flexneri 2a str. 2457T
aagaucuuugcgcuuauac

SEQ ID NO: 1913336 - RNA, 16 nt, Shigella flexneri 2a str. 2457T
aagaucaucaaacuuu

SEQ ID NO: 1913337 - RNA, 21 nt, Shigella flexneri 2a str. 2457T
aagaucgcccuuuuuuacuuu

SEQ ID NO: 1913338 - RNA, 17 nt, Shigella flexneri 2a str. 2457T
aagauccguaaugccug

SEQ ID NO: 1913339 - RNA, 22 nt, Shigella flexneri 2a str. 2457T
aagauccagguuacgcaccaga

SEQ ID NO: 1913340 - RNA, 15 nt, Shigella flexneri 2a str. 2457T
aagauaauccaggac

SEQ ID NO: 1913341 - RNA, 18 nt, Shigella flexneri 2a str. 2457T
aagauacggauucuuaac

SEQ ID NO: 1913342 - RNA, 22 nt, Shigella flexneri 2a str. 2457T
aagauauuguuuuccguugugc

SEQ ID NO: 1913343 - RNA, 18 nt, Shigella flexneri 2a str. 2457T
aagauauuucaccagcgc

SEQ ID NO: 1913344 - RNA, 24 nt, Shigella flexneri 2a str. 2457T
aagauauuuugggaucggugcaga

SEQ ID NO: 1913345 - RNA, 18 nt, Shigella flexneri 2a str. 2457T
aagauauuuuuaugcaug

SEQ ID NO: 1913346 - RNA, 12 nt, Shigella flexneri 2a str. 2457T
aagcagcuugcu

SEQ ID NO: 1913347 - RNA, 20 nt, Shigella flexneri 2a str. 2457T
aagcagcgcgcagaacauau

SEQ ID NO: 1913348 - RNA, 13 nt, Shigella flexneri 2a str. 2457T
aagcagacaaccc

SEQ ID NO: 1913349 - RNA, 17 nt, Shigella flexneri 2a str. 2457T
aagcagcauacccaccg

SEQ ID NO: 1913350 - RNA, 23 nt, Shigella flexneri 2a str. 2457T
aagcagcaaauagccgagcgcgu

SEQ ID NO: 1913351 - RNA, 16 nt, Shigella flexneri 2a str. 2457T
aagcagauucuucgau

SEQ ID NO: 1913352 - RNA, 18 nt, Shigella flexneri 2a str. 2457T
aagcagaucggcauucac

SEQ ID NO: 1913353 - RNA, 19 nt, Shigella flexneri 2a str. 2457T
aagcaguuucaccagcagu

SEQ ID NO: 1913354 - RNA, 15 nt, Shigella flexneri 2a str. 2457T
aagcaguuucaccag

SEQ ID NO: 1913355 - RNA, 21 nt, Shigella flexneri 2a str. 2457T
aagcaguccagcgccugacgc

SEQ ID NO: 1913356 - RNA, 12 nt, Shigella flexneri 2a str. 2457T
aagcaguccagc

SEQ ID NO: 1913357 - RNA, 13 nt, Shigella flexneri 2a str. 2457T
aagcauagcccca

SEQ ID NO: 1913358 - RNA, 14 nt, Shigella flexneri 2a str. 2457T
aagcauuuuuucac

SEQ ID NO: 1913359 - RNA, 20 nt, Shigella flexneri 2a str. 2457T
aagcaugucauacaugguuu

SEQ ID NO: 1913360 - RNA, 16 nt, Shigella flexneri 2a str. 2457T
aagcauuagcaaagcu

SEQ ID NO: 1913361 - RNA, 18 nt, Shigella flexneri 2a str. 2457T
aagcaccugcgcaggcau

SEQ ID NO: 1913362 - RNA, 16 nt, Shigella flexneri 2a str. 2457T
aagcacugcaucaaug

SEQ ID NO: 1913363 - RNA, 16 nt, Shigella flexneri 2a str. 2457T
aagcacccagcaaucc

SEQ ID NO: 1913364 - RNA, 15 nt, Shigella flexneri 2a str. 2457T
aagcacccagcaauc

SEQ ID NO: 1913365 - RNA, 13 nt, Shigella flexneri 2a str. 2457T
aagcaccacuccu

SEQ ID NO: 1913366 - RNA, 22 nt, Shigella flexneri 2a str. 2457T
aagcacaugcugacauuuugga

SEQ ID NO: 1913367 - RNA, 22 nt, Shigella flexneri 2a str. 2457T
aagcaaaaauaaaugcuugacu

SEQ ID NO: 1913368 - RNA, 13 nt, Shigella flexneri 2a str. 2457T
aagcaaaauguua

SEQ ID NO: 1913369 - RNA, 12 nt, Shigella flexneri 2a str. 2457T
aagcaaaaaaac

SEQ ID NO: 1913370 - RNA, 14 nt, Shigella flexneri 2a str. 2457T
aagcaaaaaaacau

SEQ ID NO: 1913371 - RNA, 18 nt, Shigella flexneri 2a str. 2457T
aagcaacugacuggcucu

SEQ ID NO: 1913372 - RNA, 15 nt, Shigella flexneri 2a str. 2457T
aagcaauuaacagug

SEQ ID NO: 1913373 - RNA, 21 nt, Shigella flexneri 2a str. 2457T
aagaguaaauugcaaaccuca

SEQ ID NO: 1913374 - RNA, 15 nt, Shigella flexneri 2a str. 2457T
aagaguaaccaaacg

SEQ ID NO: 1913375 - RNA, 14 nt, Shigella flexneri 2a str. 2457T
aagaguaaauugca

SEQ ID NO: 1913376 - RNA, 15 nt, Shigella flexneri 2a str. 2457T
aagaguucaaagccg

SEQ ID NO: 1913377 - RNA, 23 nt, Shigella flexneri 2a str. 2457T
aagaguugccccucuaacucuuc

SEQ ID NO: 1913378 - RNA, 18 nt, Shigella flexneri 2a str. 2457T
aagagcgggacaacaaac

SEQ ID NO: 1913379 - RNA, 15 nt, Shigella flexneri 2a str. 2457T
aagagcgacaauccc

SEQ ID NO: 1913380 - RNA, 21 nt, Shigella flexneri 2a str. 2457T
aagaggcggagguuuuuuccu

SEQ ID NO: 1913381 - RNA, 13 nt, Shigella flexneri 2a str. 2457T
aagaggaaauaag

SEQ ID NO: 1913382 - RNA, 16 nt, Shigella flexneri 2a str. 2457T
aagaggaaauaagcau

SEQ ID NO: 1913383 - RNA, 14 nt, Shigella flexneri 2a str. 2457T
aagacugaugacaa

SEQ ID NO: 1913384 - RNA, 15 nt, Shigella flexneri 2a str. 2457T
aagacuguaaauacu

SEQ ID NO: 1913385 - RNA, 13 nt, Shigella flexneri 2a str. 2457T
aagacgcagcaug

SEQ ID NO: 1913386 - RNA, 17 nt, Shigella flexneri 2a str. 2457T
aagacgccauucacugg

SEQ ID NO: 1913387 - RNA, 14 nt, Shigella flexneri 2a str. 2457T
aagacgcgccagcg

SEQ ID NO: 1913388 - RNA, 14 nt, Shigella flexneri 2a str. 2457T
aagacgcgucaagc

SEQ ID NO: 1913389 - RNA, 17 nt, Shigella flexneri 2a str. 2457T
aagacguugauucacuu

SEQ ID NO: 1913390 - RNA, 19 nt, Shigella flexneri 2a str. 2457T
aagagauggaaugagcauc

SEQ ID NO: 1913391 - RNA, 13 nt, Shigella flexneri 2a str. 2457T
aagagcaaauaaa

SEQ ID NO: 1913392 - RNA, 16 nt, Shigella flexneri 2a str. 2457T
aagagcaaauaaaaca

SEQ ID NO: 1913393 - RNA, 19 nt, Shigella flexneri 2a str. 2457T
aagagcaaauaaaacauca

SEQ ID NO: 1913394 - RNA, 20 nt, Shigella flexneri 2a str. 2457T
aagagacgcuggaagcccug

SEQ ID NO: 1913395 - RNA, 23 nt, Shigella flexneri 2a str. 2457T
aagagacagccgaaaagguagaa

SEQ ID NO: 1913396 - RNA, 20 nt, Shigella flexneri 2a str. 2457T
aagagacagaaucaggccau

SEQ ID NO: 1913397 - RNA, 16 nt, Shigella flexneri 2a str. 2457T
aagagaaccagcugcc

SEQ ID NO: 1913398 - RNA, 14 nt, Shigella flexneri 2a str. 2457T
aagagaaaaccccc

SEQ ID NO: 1913399 - RNA, 16 nt, Shigella flexneri 2a str. 2457T
aagacuguagcaggau

SEQ ID NO: 1913400 - RNA, 14 nt, Shigella flexneri 2a str. 2457T
aagaauagccgcaa

SEQ ID NO: 1913401 - RNA, 14 nt, Shigella flexneri 2a str. 2457T
aagaauacagcauu

SEQ ID NO: 1913402 - RNA, 20 nt, Shigella flexneri 2a str. 2457T
aaauugacuacaccauuaac

SEQ ID NO: 1913403 - RNA, 17 nt, Shigella flexneri 2a str. 2457T
aagaauaaaacgccuga

SEQ ID NO: 1913404 - RNA, 13 nt, Shigella flexneri 2a str. 2457T
aaauugaagaguu

SEQ ID NO: 1913405 - RNA, 21 nt, Shigella flexneri 2a str. 2457T
aagaauuaaaauaucaggcug

SEQ ID NO: 1913406 - RNA, 16 nt, Shigella flexneri 2a str. 2457T
aagaaugcgaaaacga

SEQ ID NO: 1913407 - RNA, 14 nt, Shigella flexneri 2a str. 2457T
aagaauggaaaaaa

SEQ ID NO: 1913408 - RNA, 19 nt, Shigella flexneri 2a str. 2457T
aagaaucgggcaacguuga

SEQ ID NO: 1913409 - RNA, 14 nt, Shigella flexneri 2a str. 2457T
aagaaucaugccaa

SEQ ID NO: 1913410 - RNA, 21 nt, Shigella flexneri 2a str. 2457T
aagaauaugcuuugccuuauu

SEQ ID NO: 1913411 - RNA, 12 nt, Shigella flexneri 2a str. 2457T
aagaauuuuugc

SEQ ID NO: 1913412 - RNA, 22 nt, Shigella flexneri 2a str. 2457T
aagacacugacgcgucuuaucu

SEQ ID NO: 1913413 - RNA, 22 nt, Shigella flexneri 2a str. 2457T
aagacacuaacgcgucuuaucu

SEQ ID NO: 1913414 - RNA, 17 nt, Shigella flexneri 2a str. 2457T
aagaauugauaaaaaaa

SEQ ID NO: 1913415 - RNA, 22 nt, Shigella flexneri 2a str. 2457T
aagaauugcagauaccacauca

SEQ ID NO: 1913416 - RNA, 23 nt, Shigella flexneri 2a str. 2457T
aagaauugcagauaccacaucaa

SEQ ID NO: 1913417 - RNA, 21 nt, Shigella flexneri 2a str. 2457T
aagaauuucuuuacugacagg

SEQ ID NO: 1913418 - RNA, 14 nt, Shigella flexneri 2a str. 2457T
aagacgaaaaauga

SEQ ID NO: 1913419 - RNA, 20 nt, Shigella flexneri 2a str. 2457T
aagaccugacuguuccagca

SEQ ID NO: 1913420 - RNA, 19 nt, Shigella flexneri 2a str. 2457T
aagaccguuucggugauga

SEQ ID NO: 1913421 - RNA, 17 nt, Shigella flexneri 2a str. 2457T
aagacagcgucacauca

SEQ ID NO: 1913422 - RNA, 22 nt, Shigella flexneri 2a str. 2457T
aagaccaauccgccagccaauu

SEQ ID NO: 1913423 - RNA, 23 nt, Shigella flexneri 2a str. 2457T
aaugucaucucuggcacgagauc

SEQ ID NO: 1913424 - RNA, 20 nt, Shigella flexneri 2a str. 2457T
aaugucaucucuggcacgag

SEQ ID NO: 1913425 - RNA, 13 nt, Shigella flexneri 2a str. 2457T
aaugucaucagca

SEQ ID NO: 1913426 - RNA, 18 nt, Shigella flexneri 2a str. 2457T
aaugucggcccgcauuau

SEQ ID NO: 1913427 - RNA, 17 nt, Shigella flexneri 2a str. 2457T
aaugugaugaaaaaagu

SEQ ID NO: 1913428 - RNA, 21 nt, Shigella flexneri 2a str. 2457T
aaugugacagagccauugccc

SEQ ID NO: 1913429 - RNA, 16 nt, Shigella flexneri 2a str. 2457T
aaugugaagaggaaca

SEQ ID NO: 1913430 - RNA, 15 nt, Shigella flexneri 2a str. 2457T
aauggucccgacaac

SEQ ID NO: 1913431 - RNA, 17 nt, Shigella flexneri 2a str. 2457T
aaugguaacuuucugcc

SEQ ID NO: 1913432 - RNA, 21 nt, Shigella flexneri 2a str. 2457T
aauggcugcgggcgaccaauc

SEQ ID NO: 1913433 - RNA, 13 nt, Shigella flexneri 2a str. 2457T
aauggcuuuugcc

SEQ ID NO: 1913434 - RNA, 14 nt, Shigella flexneri 2a str. 2457T
aauggcuggcuaua

SEQ ID NO: 1913435 - RNA, 20 nt, Shigella flexneri 2a str. 2457T
aauggucuggugaccuggga

SEQ ID NO: 1913436 - RNA, 15 nt, Shigella flexneri 2a str. 2457T
aauggugagauggcc

SEQ ID NO: 1913437 - RNA, 16 nt, Shigella flexneri 2a str. 2457T
aaugcugacaaaaccg

SEQ ID NO: 1913438 - RNA, 16 nt, Shigella flexneri 2a str. 2457T
aaugcucucuucgcca

SEQ ID NO: 1913439 - RNA, 20 nt, Shigella flexneri 2a str. 2457T
aaugcucugcacguuuugcu

SEQ ID NO: 1913440 - RNA, 19 nt, Shigella flexneri 2a str. 2457T
aaugcuguaaccagcgcag

SEQ ID NO: 1913441 - RNA, 18 nt, Shigella flexneri 2a str. 2457T
aaugcugugaagauggcu

SEQ ID NO: 1913442 - RNA, 15 nt, Shigella flexneri 2a str. 2457T
aauggcgucaacaac

SEQ ID NO: 1913443 - RNA, 17 nt, Shigella flexneri 2a str. 2457T
aauggcacaaauggcaa

SEQ ID NO: 1913444 - RNA, 17 nt, Shigella flexneri 2a str. 2457T
aaugcacuuccagcggc

SEQ ID NO: 1913445 - RNA, 15 nt, Shigella flexneri 2a str. 2457T
aaugcguuccagcau

SEQ ID NO: 1913446 - RNA, 21 nt, Shigella flexneri 2a str. 2457T
aaugcguugcuggcagauaaa

SEQ ID NO: 1913447 - RNA, 22 nt, Shigella flexneri 2a str. 2457T
aaugcuacgcgcaauauccugc

SEQ ID NO: 1913448 - RNA, 13 nt, Shigella flexneri 2a str. 2457T
aauguuacgaccu

SEQ ID NO: 1913449 - RNA, 23 nt, Shigella flexneri 2a str. 2457T
aauguuauuuaauuacugagaac

SEQ ID NO: 1913450 - RNA, 21 nt, Shigella flexneri 2a str. 2457T
aauguuccggguuugccacau

SEQ ID NO: 1913451 - RNA, 19 nt, Shigella flexneri 2a str. 2457T
aauguuccaucaccagauu

SEQ ID NO: 1913452 - RNA, 23 nt, Shigella flexneri 2a str. 2457T
aauguucguccauuucagcgcag

SEQ ID NO: 1913453 - RNA, 23 nt, Shigella flexneri 2a str. 2457T
aauguguuuacgcguuuuucaga

SEQ ID NO: 1913454 - RNA, 16 nt, Shigella flexneri 2a str. 2457T
aaugugccguaaccaa

SEQ ID NO: 1913455 - RNA, 15 nt, Shigella flexneri 2a str. 2457T
aaugugcugagaaca

SEQ ID NO: 1913456 - RNA, 19 nt, Shigella flexneri 2a str. 2457T
aauguuucugcaauauauu

SEQ ID NO: 1913457 - RNA, 11 nt, Shigella flexneri 2a str. 2457T
aauguuugcca

SEQ ID NO: 1913458 - RNA, 21 nt, Shigella flexneri 2a str. 2457T
aauuaauccuuucgaaaaacc

SEQ ID NO: 1913459 - RNA, 19 nt, Shigella flexneri 2a str. 2457T
aauuaccgcaccaccagca

SEQ ID NO: 1913460 - RNA, 22 nt, Shigella flexneri 2a str. 2457T
aauuaccgcaccaccagcagcu

SEQ ID NO: 1913461 - RNA, 17 nt, Shigella flexneri 2a str. 2457T
aauuaccuguaaaguag

SEQ ID NO: 1913462 - RNA, 15 nt, Shigella flexneri 2a str. 2457T
aauuacuucucuuuc

SEQ ID NO: 1913463 - RNA, 17 nt, Shigella flexneri 2a str. 2457T
aauuaacgguaauaauu

SEQ ID NO: 1913464 - RNA, 18 nt, Shigella flexneri 2a str. 2457T
aauuaaaccuaaaaagaa

SEQ ID NO: 1913465 - RNA, 19 nt, Shigella flexneri 2a str. 2457T
aauuaaaccuaaaaagaaa

SEQ ID NO: 1913466 - RNA, 22 nt, Shigella flexneri 2a str. 2457T
aauuaaacgccucugucagaaa

SEQ ID NO: 1913467 - RNA, 15 nt, Shigella flexneri 2a str. 2457T
aaucgcaagaucuca

SEQ ID NO: 1913468 - RNA, 20 nt, Shigella flexneri 2a str. 2457T
aaucgaucgcguaauaaaau

SEQ ID NO: 1913469 - RNA, 13 nt, Shigella flexneri 2a str. 2457T
aaucgcagcgcaa

SEQ ID NO: 1913470 - RNA, 16 nt, Shigella flexneri 2a str. 2457T
aaucggaaacaaauac

SEQ ID NO: 1913471 - RNA, 20 nt, Shigella flexneri 2a str. 2457T
aaucgggagagauaagauaa

SEQ ID NO: 1913472 - RNA, 19 nt, Shigella flexneri 2a str. 2457T
aaucaucccacaugaauuc

SEQ ID NO: 1913473 - RNA, 15 nt, Shigella flexneri 2a str. 2457T
aaucauccauauuuu

SEQ ID NO: 1913474 - RNA, 15 nt, Shigella flexneri 2a str. 2457T
aaucaucaguaccag

SEQ ID NO: 1913475 - RNA, 23 nt, Shigella flexneri 2a str. 2457T
aaucaucauugcuguuuuacagc

SEQ ID NO: 1913476 - RNA, 17 nt, Shigella flexneri 2a str. 2457T
aaucgaaaucaacaugu

SEQ ID NO: 1913477 - RNA, 19 nt, Shigella flexneri 2a str. 2457T
aaucgagauacguuugcca

SEQ ID NO: 1913478 - RNA, 21 nt, Shigella flexneri 2a str. 2457T
aaucgaaccaaacagcgccag

SEQ ID NO: 1913479 - RNA, 23 nt, Shigella flexneri 2a str. 2457T
aaucgaccaggccaucagcagcg

SEQ ID NO: 1913480 - RNA, 16 nt, Shigella flexneri 2a str. 2457T
aaucugaauggcugca

SEQ ID NO: 1913481 - RNA, 22 nt, Shigella flexneri 2a str. 2457T
aaucucugguuuguuuucagau

SEQ ID NO: 1913482 - RNA, 16 nt, Shigella flexneri 2a str. 2457T
aaucucuucacagaca

SEQ ID NO: 1913483 - RNA, 17 nt, Shigella flexneri 2a str. 2457T
aaucugcaaaauaccaa

SEQ ID NO: 1913484 - RNA, 15 nt, Shigella flexneri 2a str. 2457T
aaucucgcguuucga

SEQ ID NO: 1913485 - RNA, 21 nt, Shigella flexneri 2a str. 2457T
aaucucgucucccgucaggag

SEQ ID NO: 1913486 - RNA, 14 nt, Shigella flexneri 2a str. 2457T
aaucucuacaccaa

SEQ ID NO: 1913487 - RNA, 21 nt, Shigella flexneri 2a str. 2457T
aaucucacccgguacaucaau

SEQ ID NO: 1913488 - RNA, 20 nt, Shigella flexneri 2a str. 2457T
aaucucacuccggccagagc

SEQ ID NO: 1913489 - RNA, 20 nt, Shigella flexneri 2a str. 2457T
aaucucagcccgaugauaaa

SEQ ID NO: 1913490 - RNA, 15 nt, Shigella flexneri 2a str. 2457T
aaucucaauguauuc

SEQ ID NO: 1913491 - RNA, 24 nt, Shigella flexneri 2a str. 2457T
aaucucacccgguacaucaauacc

SEQ ID NO: 1913492 - RNA, 23 nt, Shigella flexneri 2a str. 2457T
aaucucccguuccugguuuucca

SEQ ID NO: 1913493 - RNA, 13 nt, Shigella flexneri 2a str. 2457T
aaugacuccaacu

SEQ ID NO: 1913494 - RNA, 18 nt, Shigella flexneri 2a str. 2457T
aaugacuucgcuuucgcc

SEQ ID NO: 1913495 - RNA, 23 nt, Shigella flexneri 2a str. 2457T
aaugacuucgcuuucgccagauc

SEQ ID NO: 1913496 - RNA, 15 nt, Shigella flexneri 2a str. 2457T
aaugagugaugauga

SEQ ID NO: 1913497 - RNA, 15 nt, Shigella flexneri 2a str. 2457T
aaugagacacuuuau

SEQ ID NO: 1913498 - RNA, 18 nt, Shigella flexneri 2a str. 2457T
aaugaggcagcaaggaaa

SEQ ID NO: 1913499 - RNA, 23 nt, Shigella flexneri 2a str. 2457T
aaugaggcagcaaggaaaaccag

SEQ ID NO: 1913500 - RNA, 18 nt, Shigella flexneri 2a str. 2457T
aaugaguggugaaaaaaa

SEQ ID NO: 1913501 - RNA, 17 nt, Shigella flexneri 2a str. 2457T
aaugcacauauucugga

SEQ ID NO: 1913502 - RNA, 17 nt, Shigella flexneri 2a str. 2457T
aaugauguaaaaauacu

SEQ ID NO: 1913503 - RNA, 15 nt, Shigella flexneri 2a str. 2457T
aaugauauuuucugc

SEQ ID NO: 1913504 - RNA, 14 nt, Shigella flexneri 2a str. 2457T
aaugacaacauuuu

SEQ ID NO: 1913505 - RNA, 18 nt, Shigella flexneri 2a str. 2457T
aaugaagaaccgcaccag

SEQ ID NO: 1913506 - RNA, 20 nt, Shigella flexneri 2a str. 2457T
aaucuggcagccuaauuccu

SEQ ID NO: 1913507 - RNA, 13 nt, Shigella flexneri 2a str. 2457T
aaucugcugccug

SEQ ID NO: 1913508 - RNA, 12 nt, Shigella flexneri 2a str. 2457T
aaucugccagaa

SEQ ID NO: 1913509 - RNA, 20 nt, Shigella flexneri 2a str. 2457T
aaucugccagcguaaauccu

SEQ ID NO: 1913510 - RNA, 19 nt, Shigella flexneri 2a str. 2457T
aaucugcccguuaaccaua

SEQ ID NO: 1913511 - RNA, 16 nt, Shigella flexneri 2a str. 2457T
aaucacacaaccaugc

SEQ ID NO: 1913512 - RNA, 21 nt, Shigella flexneri 2a str. 2457T
aaucacaauagaaauauugau

SEQ ID NO: 1913513 - RNA, 17 nt, Shigella flexneri 2a str. 2457T
aaucacaucaccauaaa

SEQ ID NO: 1913514 - RNA, 11 nt, Shigella flexneri 2a str. 2457T
aaucaccagau

SEQ ID NO: 1913515 - RNA, 22 nt, Shigella flexneri 2a str. 2457T
aaucaccauauucagcagcaga

SEQ ID NO: 1913516 - RNA, 21 nt, Shigella flexneri 2a str. 2457T
aaucaccaucagcagcaacaa

SEQ ID NO: 1913517 - RNA, 19 nt, Shigella flexneri 2a str. 2457T
aaucaccacccauuuuaau

SEQ ID NO: 1913518 - RNA, 17 nt, Shigella flexneri 2a str. 2457T
aaucaccaucagcagca

SEQ ID NO: 1913519 - RNA, 20 nt, Shigella flexneri 2a str. 2457T
aaucacccgugagaacugcu

SEQ ID NO: 1913520 - RNA, 20 nt, Shigella flexneri 2a str. 2457T
aaucacccccaccccggccc

SEQ ID NO: 1913521 - RNA, 17 nt, Shigella flexneri 2a str. 2457T
aaucaccgccagcaagg

SEQ ID NO: 1913522 - RNA, 22 nt, Shigella flexneri 2a str. 2457T
aaucaccgcuucacucccugcc

SEQ ID NO: 1913523 - RNA, 17 nt, Shigella flexneri 2a str. 2457T
aaucaaugcccaucacu

SEQ ID NO: 1913524 - RNA, 18 nt, Shigella flexneri 2a str. 2457T
aaucaaucuuuacacaca

SEQ ID NO: 1913525 - RNA, 20 nt, Shigella flexneri 2a str. 2457T
aaucaauccaguguaaaaca

SEQ ID NO: 1913526 - RNA, 13 nt, Shigella flexneri 2a str. 2457T
aaucaaucccauc

SEQ ID NO: 1913527 - RNA, 16 nt, Shigella flexneri 2a str. 2457T
aaucaauaugcauaaa

SEQ ID NO: 1913528 - RNA, 19 nt, Shigella flexneri 2a str. 2457T
aaucaauaauuaaucuggu

SEQ ID NO: 1913529 - RNA, 20 nt, Shigella flexneri 2a str. 2457T
aaucaauaaguuacacauca

SEQ ID NO: 1913530 - RNA, 15 nt, Shigella flexneri 2a str. 2457T
aaucaagucuauuug

SEQ ID NO: 1913531 - RNA, 18 nt, Shigella flexneri 2a str. 2457T
aaucaacgcgauauaaua

SEQ ID NO: 1913532 - RNA, 21 nt, Shigella flexneri 2a str. 2457T
aaucaacuuauugguaaacuc

SEQ ID NO: 1913533 - RNA, 22 nt, Shigella flexneri 2a str. 2457T
aaucaucacgcgguuacgcacc

SEQ ID NO: 1913534 - RNA, 15 nt, Shigella flexneri 2a str. 2457T
aaucaucaaugccag

SEQ ID NO: 1913535 - RNA, 18 nt, Shigella flexneri 2a str. 2457T
aaucaguucuaccaucaa

SEQ ID NO: 1913536 - RNA, 22 nt, Shigella flexneri 2a str. 2457T
aaucagugguguagggcaggcg

SEQ ID NO: 1913537 - RNA, 16 nt, Shigella flexneri 2a str. 2457T
aaucaguucaaauuca

SEQ ID NO: 1913538 - RNA, 22 nt, Shigella flexneri 2a str. 2457T
aaucagcguaacgauggcaauu

SEQ ID NO: 1913539 - RNA, 20 nt, Shigella flexneri 2a str. 2457T
aaucagcagauaucccgcca

SEQ ID NO: 1913540 - RNA, 14 nt, Shigella flexneri 2a str. 2457T
aaucagcacaauaa

SEQ ID NO: 1913541 - RNA, 20 nt, Shigella flexneri 2a str. 2457T
aaucagcaucucauccauca

SEQ ID NO: 1913542 - RNA, 12 nt, Shigella flexneri 2a str. 2457T
aaucagauaaaa

SEQ ID NO: 1913543 - RNA, 14 nt, Shigella flexneri 2a str. 2457T
aaucacugccagaa

SEQ ID NO: 1913544 - RNA, 23 nt, Shigella flexneri 2a str. 2457T
aaucacgcuucacccuugaugca

SEQ ID NO: 1913545 - RNA, 22 nt, Shigella flexneri 2a str. 2457T
aaucaccucaucaccacagaca

SEQ ID NO: 1913546 - RNA, 19 nt, Shigella flexneri 2a str. 2457T
aaucacgacaaacacaaua

SEQ ID NO: 1913547 - RNA, 21 nt, Shigella flexneri 2a str. 2457T
aauauuuuuaucccucauauu

SEQ ID NO: 1913548 - RNA, 13 nt, Shigella flexneri 2a str. 2457T
aauauuuuuaugc

SEQ ID NO: 1913549 - RNA, 12 nt, Shigella flexneri 2a str. 2457T
aaucaaaaaacu

SEQ ID NO: 1913550 - RNA, 20 nt, Shigella flexneri 2a str. 2457T
aaucaaaaaacuggaaaaau

SEQ ID NO: 1913551 - RNA, 22 nt, Shigella flexneri 2a str. 2457T
aaucaaaaaacuggaaaaauaa

SEQ ID NO: 1913552 - RNA, 22 nt, Shigella flexneri 2a str. 2457T
aauauuucccggccagucguag

SEQ ID NO: 1913553 - RNA, 21 nt, Shigella flexneri 2a str. 2457T
aauauuucucggcaaauucau

SEQ ID NO: 1913554 - RNA, 20 nt, Shigella flexneri 2a str. 2457T
aaucaaaaaaggcugacaaa

SEQ ID NO: 1913555 - RNA, 23 nt, Shigella flexneri 2a str. 2457T
aaucaaaaaaggcugacaaauca

SEQ ID NO: 1913556 - RNA, 12 nt, Shigella flexneri 2a str. 2457T
aaucaaaaaugg

SEQ ID NO: 1913557 - RNA, 15 nt, Shigella flexneri 2a str. 2457T
aaucaaaaauggcuu

SEQ ID NO: 1913558 - RNA, 16 nt, Shigella flexneri 2a str. 2457T
aaucaaaauaauguga

SEQ ID NO: 1913559 - RNA, 17 nt, Shigella flexneri 2a str. 2457T
aaucaaaccaagcagca

SEQ ID NO: 1913560 - RNA, 22 nt, Shigella flexneri 2a str. 2457T
aaucaaagaugaugucacagcc

SEQ ID NO: 1913561 - RNA, 14 nt, Shigella flexneri 2a str. 2457T
aaucaaagucagau

SEQ ID NO: 1913562 - RNA, 16 nt, Shigella flexneri 2a str. 2457T
aaucaacauauucccc

SEQ ID NO: 1913563 - RNA, 21 nt, Shigella flexneri 2a str. 2457T
aaucaaccagcacuucgccau

SEQ ID NO: 1913564 - RNA, 16 nt, Shigella flexneri 2a str. 2457T
aaucaacgaugucaau

SEQ ID NO: 1913565 - RNA, 16 nt, Shigella flexneri 2a str. 2457T
aaucaacaugaaaaua

SEQ ID NO: 1913566 - RNA, 22 nt, Shigella flexneri 2a str. 2457T
aaucaacaugaaaauaaccaua

SEQ ID NO: 1913567 - RNA, 13 nt, Shigella flexneri 2a str. 2457T
aaucaaauacccu

SEQ ID NO: 1913568 - RNA, 14 nt, Shigella flexneri 2a str. 2457T
aaucaacaaaccaa

SEQ ID NO: 1913569 - RNA, 12 nt, Shigella flexneri 2a str. 2457T
aaucaaaugacu

SEQ ID NO: 1913570 - RNA, 20 nt, Shigella flexneri 2a str. 2457T
aauauucugaagcaaacuug

SEQ ID NO: 1913571 - RNA, 21 nt, Shigella flexneri 2a str. 2457T
aauauugaauugcucaguaca

SEQ ID NO: 1913572 - RNA, 18 nt, Shigella flexneri 2a str. 2457T
aauauucauuaaaacuga

SEQ ID NO: 1913573 - RNA, 18 nt, Shigella flexneri 2a str. 2457T
aauauuccuuaugguuca

SEQ ID NO: 1913574 - RNA, 15 nt, Shigella flexneri 2a str. 2457T
aauauugauuauugg

SEQ ID NO: 1913575 - RNA, 21 nt, Shigella flexneri 2a str. 2457T
aauauugcacaguauagcauc

SEQ ID NO: 1913576 - RNA, 18 nt, Shigella flexneri 2a str. 2457T
aauauuguuauucgccag

SEQ ID NO: 1913577 - RNA, 14 nt, Shigella flexneri 2a str. 2457T
aauauuuaggucag

SEQ ID NO: 1913578 - RNA, 15 nt, Shigella flexneri 2a str. 2457T
aauauuagaucgagu

SEQ ID NO: 1913579 - RNA, 20 nt, Shigella flexneri 2a str. 2457T
aauauuaaggguaaaaggau

SEQ ID NO: 1913580 - RNA, 18 nt, Shigella flexneri 2a str. 2457T
aauauuauggcugucaug

SEQ ID NO: 1913581 - RNA, 20 nt, Shigella flexneri 2a str. 2457T
aauauuaacuuaauaaacau

SEQ ID NO: 1913582 - RNA, 17 nt, Shigella flexneri 2a str. 2457T
aauauuaacuuaauaaa

SEQ ID NO: 1913583 - RNA, 19 nt, Shigella flexneri 2a str. 2457T
aauauuaacuuaauaaaca

SEQ ID NO: 1913584 - RNA, 15 nt, Shigella flexneri 2a str. 2457T
aauaugauaaaccuc

SEQ ID NO: 1913585 - RNA, 13 nt, Shigella flexneri 2a str. 2457T
aauaugaacauga

SEQ ID NO: 1913586 - RNA, 18 nt, Shigella flexneri 2a str. 2457T
aauaucaagaucaucaaa

SEQ ID NO: 1913587 - RNA, 21 nt, Shigella flexneri 2a str. 2457T
aauauauugcaaucaucuugu

SEQ ID NO: 1913588 - RNA, 22 nt, Shigella flexneri 2a str. 2457T
aauauauuccccggucagcagc

SEQ ID NO: 1913589 - RNA, 15 nt, Shigella flexneri 2a str. 2457T
aauauauucucuuuu

SEQ ID NO: 1913590 - RNA, 21 nt, Shigella flexneri 2a str. 2457T
aauauauucucuuuuguuacu

SEQ ID NO: 1913591 - RNA, 23 nt, Shigella flexneri 2a str. 2457T
aauauaaaacaacggaacgaaaa

SEQ ID NO: 1913592 - RNA, 22 nt, Shigella flexneri 2a str. 2457T
aauauccuguggacgcagcuca

SEQ ID NO: 1913593 - RNA, 16 nt, Shigella flexneri 2a str. 2457T
aauaucgacauucaau

SEQ ID NO: 1913594 - RNA, 23 nt, Shigella flexneri 2a str. 2457T
aauaucgagacgggcgaggaaau

SEQ ID NO: 1913595 - RNA, 15 nt, Shigella flexneri 2a str. 2457T
aauaucgauaucgua

SEQ ID NO: 1913596 - RNA, 13 nt, Shigella flexneri 2a str. 2457T
aauaucaaucuuc

SEQ ID NO: 1913597 - RNA, 21 nt, Shigella flexneri 2a str. 2457T
aauaucacucggggcuuuucu

SEQ ID NO: 1913598 - RNA, 12 nt, Shigella flexneri 2a str. 2457T
aauaucuuuucu

SEQ ID NO: 1913599 - RNA, 20 nt, Shigella flexneri 2a str. 2457T
aauaucuuuucuuaacaaaa

SEQ ID NO: 1913600 - RNA, 18 nt, Shigella flexneri 2a str. 2457T
aauaucgcggcacagaaa

SEQ ID NO: 1913601 - RNA, 19 nt, Shigella flexneri 2a str. 2457T
aauaguuucagccucugcc

SEQ ID NO: 1913602 - RNA, 14 nt, Shigella flexneri 2a str. 2457T
aauaguuucaguau

SEQ ID NO: 1913603 - RNA, 20 nt, Shigella flexneri 2a str. 2457T
aauaguuuccgcuucugcuu

SEQ ID NO: 1913604 - RNA, 22 nt, Shigella flexneri 2a str. 2457T
aauaguuccacuauuucaauau

SEQ ID NO: 1913605 - RNA, 15 nt, Shigella flexneri 2a str. 2457T
aauagagauagaaug

SEQ ID NO: 1913606 - RNA, 17 nt, Shigella flexneri 2a str. 2457T
aauagacacaagaaaua

SEQ ID NO: 1913607 - RNA, 16 nt, Shigella flexneri 2a str. 2457T
aauagaauccgcgacu

SEQ ID NO: 1913608 - RNA, 16 nt, Shigella flexneri 2a str. 2457T
aauagaauggcaucag

SEQ ID NO: 1913609 - RNA, 19 nt, Shigella flexneri 2a str. 2457T
aauagcguuaaucaucaac

SEQ ID NO: 1913610 - RNA, 20 nt, Shigella flexneri 2a str. 2457T
aauagcgucuacuaacgcuu

SEQ ID NO: 1913611 - RNA, 18 nt, Shigella flexneri 2a str. 2457T
aauagagaucucucuugc

SEQ ID NO: 1913612 - RNA, 14 nt, Shigella flexneri 2a str. 2457T
aauagcucaaugaa

SEQ ID NO: 1913613 - RNA, 13 nt, Shigella flexneri 2a str. 2457T
aauagcucaauga

SEQ ID NO: 1913614 - RNA, 12 nt, Shigella flexneri 2a str. 2457T
aauaccagccuu

SEQ ID NO: 1913615 - RNA, 17 nt, Shigella flexneri 2a str. 2457T
aauaccagccuucuuca

SEQ ID NO: 1913616 - RNA, 14 nt, Shigella flexneri 2a str. 2457T
aauaccaucaccaa

SEQ ID NO: 1913617 - RNA, 19 nt, Shigella flexneri 2a str. 2457T
aauaccaucggcagcgcca

SEQ ID NO: 1913618 - RNA, 23 nt, Shigella flexneri 2a str. 2457T
aauaccauggcucaccagcagcg

SEQ ID NO: 1913619 - RNA, 15 nt, Shigella flexneri 2a str. 2457T
aauacccaaaaaaua

SEQ ID NO: 1913620 - RNA, 22 nt, Shigella flexneri 2a str. 2457T
aauacccaaaaaauagcaaagu

SEQ ID NO: 1913621 - RNA, 15 nt, Shigella flexneri 2a str. 2457T
aauacgucuuuagga

SEQ ID NO: 1913622 - RNA, 19 nt, Shigella flexneri 2a str. 2457T
aauacguugcuucaugccg

SEQ ID NO: 1913623 - RNA, 17 nt, Shigella flexneri 2a str. 2457T
aauacguuucauauccg

SEQ ID NO: 1913624 - RNA, 19 nt, Shigella flexneri 2a str. 2457T
aauacuccccuuucuuauu

SEQ ID NO: 1913625 - RNA, 17 nt, Shigella flexneri 2a str. 2457T
aauacauugauauacag

SEQ ID NO: 1913626 - RNA, 13 nt, Shigella flexneri 2a str. 2457T
aauacaucuuuuc

SEQ ID NO: 1913627 - RNA, 17 nt, Shigella flexneri 2a str. 2457T
aauacauacgcaaaaaa

SEQ ID NO: 1913628 - RNA, 19 nt, Shigella flexneri 2a str. 2457T
aauacauacgcaaaaaaca

SEQ ID NO: 1913629 - RNA, 21 nt, Shigella flexneri 2a str. 2457T
aauacagcccagacaaaugaa

SEQ ID NO: 1913630 - RNA, 19 nt, Shigella flexneri 2a str. 2457T
aauacacuaacagaacaau

SEQ ID NO: 1913631 - RNA, 20 nt, Shigella flexneri 2a str. 2457T
aauacagcaauggaaaaagu

SEQ ID NO: 1913632 - RNA, 15 nt, Shigella flexneri 2a str. 2457T
aauacagcaauggaa

SEQ ID NO: 1913633 - RNA, 17 nt, Shigella flexneri 2a str. 2457T
aauacaacaacacccau

SEQ ID NO: 1913634 - RNA, 13 nt, Shigella flexneri 2a str. 2457T
aauacaaaugccu

SEQ ID NO: 1913635 - RNA, 13 nt, Shigella flexneri 2a str. 2457T
aaauuauuuuaaa

SEQ ID NO: 1913636 - RNA, 14 nt, Shigella flexneri 2a str. 2457T
aaauuauccagcuu

SEQ ID NO: 1913637 - RNA, 19 nt, Shigella flexneri 2a str. 2457T
aaauuaucucuguuuugca

SEQ ID NO: 1913638 - RNA, 14 nt, Shigella flexneri 2a str. 2457T
aaauuauuaccauc

SEQ ID NO: 1913639 - RNA, 20 nt, Shigella flexneri 2a str. 2457T
aaauuaggucaaagaaucaa

SEQ ID NO: 1913640 - RNA, 14 nt, Shigella flexneri 2a str. 2457T
aaauuauaucuuau

SEQ ID NO: 1913641 - RNA, 13 nt, Shigella flexneri 2a str. 2457T
uuuuuucuuccca

SEQ ID NO: 1913642 - RNA, 10 nt, Shigella flexneri 2a str. 2457T
uuuuuuccug

SEQ ID NO: 1913643 - RNA, 15 nt, Shigella flexneri 2a str. 2457T
aaauuacgcaaccag

SEQ ID NO: 1913644 - RNA, 22 nt, Shigella flexneri 2a str. 2457T
aaauuaccgcaccaccagcagc

SEQ ID NO: 1913645 - RNA, 23 nt, Shigella flexneri 2a str. 2457T
aaauuacucccgugccagagcau

SEQ ID NO: 1913646 - RNA, 19 nt, Shigella flexneri 2a str. 2457T
aaauucccgcagauaaaua

SEQ ID NO: 1913647 - RNA, 15 nt, Shigella flexneri 2a str. 2457T
aaauuccgaacaaaa

SEQ ID NO: 1913648 - RNA, 19 nt, Shigella flexneri 2a str. 2457T
aaauuccuaugcaacaacu

SEQ ID NO: 1913649 - RNA, 15 nt, Shigella flexneri 2a str. 2457T
aaauucgaaauagag

SEQ ID NO: 1913650 - RNA, 13 nt, Shigella flexneri 2a str. 2457T
aaauucgcuucau

SEQ ID NO: 1913651 - RNA, 23 nt, Shigella flexneri 2a str. 2457T
aaauucagaugaugauacugaca

SEQ ID NO: 1913652 - RNA, 18 nt, Shigella flexneri 2a str. 2457T
aaauucagcaguuuuugc

SEQ ID NO: 1913653 - RNA, 19 nt, Shigella flexneri 2a str. 2457T
aaauucagcaguuuuugca

SEQ ID NO: 1913654 - RNA, 18 nt, Shigella flexneri 2a str. 2457T
aaauucaggaauucagaa

SEQ ID NO: 1913655 - RNA, 15 nt, Shigella flexneri 2a str. 2457T
aaauucauuugaaua

SEQ ID NO: 1913656 - RNA, 15 nt, Shigella flexneri 2a str. 2457T
aaauuauuuuaaauu

SEQ ID NO: 1913657 - RNA, 20 nt, Shigella flexneri 2a str. 2457T
aaauucaagacaucaauaaa

SEQ ID NO: 1913658 - RNA, 18 nt, Shigella flexneri 2a str. 2457T
uuuuugccccagaauuuu

SEQ ID NO: 1913659 - RNA, 19 nt, Shigella flexneri 2a str. 2457T
uuuuugccugccagucaau

SEQ ID NO: 1913660 - RNA, 16 nt, Shigella flexneri 2a str. 2457T
uuuuugcgcgaagaaa

SEQ ID NO: 1913661 - RNA, 15 nt, Shigella flexneri 2a str. 2457T
uuuuugcauuuccgc

SEQ ID NO: 1913662 - RNA, 22 nt, Shigella flexneri 2a str. 2457T
uuuuugcaaucagauaaaauac

SEQ ID NO: 1913663 - RNA, 18 nt, Shigella flexneri 2a str. 2457T
uuuuugcguccuggcaac

SEQ ID NO: 1913664 - RNA, 20 nt, Shigella flexneri 2a str. 2457T
uuuuuggaggugaagguaag

SEQ ID NO: 1913665 - RNA, 16 nt, Shigella flexneri 2a str. 2457T
uuuuugguaaugacuc

SEQ ID NO: 1913666 - RNA, 18 nt, Shigella flexneri 2a str. 2457T
uuuuucggacgauauuuu

SEQ ID NO: 1913667 - RNA, 14 nt, Shigella flexneri 2a str. 2457T
uuuuucgccaugaa

SEQ ID NO: 1913668 - RNA, 22 nt, Shigella flexneri 2a str. 2457T
uuuuucgacaucaagaaaugca

SEQ ID NO: 1913669 - RNA, 21 nt, Shigella flexneri 2a str. 2457T
uuuuucgacaaacaccgaacc

SEQ ID NO: 1913670 - RNA, 22 nt, Shigella flexneri 2a str. 2457T
uuuuucgaacgcugcacgcaac

SEQ ID NO: 1913671 - RNA, 16 nt, Shigella flexneri 2a str. 2457T
uuuuucucggcaauaa

SEQ ID NO: 1913672 - RNA, 12 nt, Shigella flexneri 2a str. 2457T
uuuuucuucagu

SEQ ID NO: 1913673 - RNA, 19 nt, Shigella flexneri 2a str. 2457T
uuuuugacuaaaguuucuu

SEQ ID NO: 1913674 - RNA, 12 nt, Shigella flexneri 2a str. 2457T
uuuuugaacaga

SEQ ID NO: 1913675 - RNA, 11 nt, Shigella flexneri 2a str. 2457T
uuuuugaagcg

SEQ ID NO: 1913676 - RNA, 23 nt, Shigella flexneri 2a str. 2457T
aaauuaaacugucgucgcuuuca

SEQ ID NO: 1913677 - RNA, 22 nt, Shigella flexneri 2a str. 2457T
aaaugugaagaggaacaaauuu

SEQ ID NO: 1913678 - RNA, 21 nt, Shigella flexneri 2a str. 2457T
aaaugugccggaugcaucaca

SEQ ID NO: 1913679 - RNA, 12 nt, Shigella flexneri 2a str. 2457T
uuuuuucacaug

SEQ ID NO: 1913680 - RNA, 19 nt, Shigella flexneri 2a str. 2457T
aaauguuuaguauuguuaa

SEQ ID NO: 1913681 - RNA, 11 nt, Shigella flexneri 2a str. 2457T
uuuugugggca

SEQ ID NO: 1913682 - RNA, 14 nt, Shigella flexneri 2a str. 2457T
uuuuguuuaaauau

SEQ ID NO: 1913683 - RNA, 17 nt, Shigella flexneri 2a str. 2457T
uuuuguaucgaacaaga

SEQ ID NO: 1913684 - RNA, 12 nt, Shigella flexneri 2a str. 2457T
uuuuggugcuuu

SEQ ID NO: 1913685 - RNA, 14 nt, Shigella flexneri 2a str. 2457T
uuuuuaaauuuccc

SEQ ID NO: 1913686 - RNA, 16 nt, Shigella flexneri 2a str. 2457T
uuuuuaaacaucaaac

SEQ ID NO: 1913687 - RNA, 12 nt, Shigella flexneri 2a str. 2457T
uuuuuaauaaua

SEQ ID NO: 1913688 - RNA, 22 nt, Shigella flexneri 2a str. 2457T
uuuuuaacgccgcuauacgccu

SEQ ID NO: 1913689 - RNA, 21 nt, Shigella flexneri 2a str. 2457T
uuuuuaugguggaguuaccag

SEQ ID NO: 1913690 - RNA, 23 nt, Shigella flexneri 2a str. 2457T
uuuuuaugaguuuggugccacgc

SEQ ID NO: 1913691 - RNA, 12 nt, Shigella flexneri 2a str. 2457T
uuuuuaugcuuc

SEQ ID NO: 1913692 - RNA, 18 nt, Shigella flexneri 2a str. 2457T
uuuuuaugcuuccuuccu

SEQ ID NO: 1913693 - RNA, 12 nt, Shigella flexneri 2a str. 2457T
uuuuuaucuuca

SEQ ID NO: 1913694 - RNA, 17 nt, Shigella flexneri 2a str. 2457T
uuuuuauagcuuauucu

SEQ ID NO: 1913695 - RNA, 13 nt, Shigella flexneri 2a str. 2457T
uuuuuacccagca

SEQ ID NO: 1913696 - RNA, 19 nt, Shigella flexneri 2a str. 2457T
uuuuucacugcggcaagaa

SEQ ID NO: 1913697 - RNA, 21 nt, Shigella flexneri 2a str. 2457T
uuuuucaagaaucggcuuugu

SEQ ID NO: 1913698 - RNA, 15 nt, Shigella flexneri 2a str. 2457T
uuuuuccgcaaaaac

SEQ ID NO: 1913699 - RNA, 22 nt, Shigella flexneri 2a str. 2457T
uuuuucaucgcuaauaauaagc

SEQ ID NO: 1913700 - RNA, 12 nt, Shigella flexneri 2a str. 2457T
uuuuucaucccu

SEQ ID NO: 1913701 - RNA, 23 nt, Shigella flexneri 2a str. 2457T
uuuuuccacuuccaccagcggcu

SEQ ID NO: 1913702 - RNA, 18 nt, Shigella flexneri 2a str. 2457T
uuuucugaaaaucauaca

SEQ ID NO: 1913703 - RNA, 16 nt, Shigella flexneri 2a str. 2457T
uuuucuggaugccauc

SEQ ID NO: 1913704 - RNA, 24 nt, Shigella flexneri 2a str. 2457T
uuuucugucacaccuuauuuacau

SEQ ID NO: 1913705 - RNA, 18 nt, Shigella flexneri 2a str. 2457T
uuuucuauuuugcauuau

SEQ ID NO: 1913706 - RNA, 15 nt, Shigella flexneri 2a str. 2457T
uuuucuacacagacg

SEQ ID NO: 1913707 - RNA, 11 nt, Shigella flexneri 2a str. 2457T
uuuugaacaga

SEQ ID NO: 1913708 - RNA, 23 nt, Shigella flexneri 2a str. 2457T
uuuucuuugacaaauuccgucau

SEQ ID NO: 1913709 - RNA, 11 nt, Shigella flexneri 2a str. 2457T
uuuucuuucac

SEQ ID NO: 1913710 - RNA, 17 nt, Shigella flexneri 2a str. 2457T
uuuucuuaacaaaaacu

SEQ ID NO: 1913711 - RNA, 13 nt, Shigella flexneri 2a str. 2457T
uuuucuuccaacc

SEQ ID NO: 1913712 - RNA, 15 nt, Shigella flexneri 2a str. 2457T
uuuugagcgguacac

SEQ ID NO: 1913713 - RNA, 14 nt, Shigella flexneri 2a str. 2457T
uuuugauagugcgu

SEQ ID NO: 1913714 - RNA, 17 nt, Shigella flexneri 2a str. 2457T
uuuugacgcccccaaac

SEQ ID NO: 1913715 - RNA, 21 nt, Shigella flexneri 2a str. 2457T
uuuugcagaaacauaauauaa

SEQ ID NO: 1913716 - RNA, 22 nt, Shigella flexneri 2a str. 2457T
uuuugcaggaaaaacugcccgu

SEQ ID NO: 1913717 - RNA, 20 nt, Shigella flexneri 2a str. 2457T
uuuugcaguuaaaauaggaa

SEQ ID NO: 1913718 - RNA, 16 nt, Shigella flexneri 2a str. 2457T
uuuugcauaauuucca

SEQ ID NO: 1913719 - RNA, 13 nt, Shigella flexneri 2a str. 2457T
uuuugcaauaaug

SEQ ID NO: 1913720 - RNA, 22 nt, Shigella flexneri 2a str. 2457T
uuuugccggacggcuguaaaug

SEQ ID NO: 1913721 - RNA, 20 nt, Shigella flexneri 2a str. 2457T
uuuugcccggcaacaacagg

SEQ ID NO: 1913722 - RNA, 15 nt, Shigella flexneri 2a str. 2457T
uuuugccaaauaucu

SEQ ID NO: 1913723 - RNA, 22 nt, Shigella flexneri 2a str. 2457T
uuuugccaccccuuuugacuuu

SEQ ID NO: 1913724 - RNA, 18 nt, Shigella flexneri 2a str. 2457T
uuuugcgcauccagcgcu

SEQ ID NO: 1913725 - RNA, 20 nt, Shigella flexneri 2a str. 2457T
uuuugcguccgguaauuuuu

SEQ ID NO: 1913726 - RNA, 16 nt, Shigella flexneri 2a str. 2457T
uuuugcggaucugcuc

SEQ ID NO: 1913727 - RNA, 17 nt, Shigella flexneri 2a str. 2457T
uuuuggcgagagacgcu

SEQ ID NO: 1913728 - RNA, 16 nt, Shigella flexneri 2a str. 2457T
uuuugcuugaauguuc

SEQ ID NO: 1913729 - RNA, 22 nt, Shigella flexneri 2a str. 2457T
uuuugcuugaauguuccgucaa

SEQ ID NO: 1913730 - RNA, 21 nt, Shigella flexneri 2a str. 2457T
uuuugcuuucuauaagauacu

SEQ ID NO: 1913731 - RNA, 17 nt, Shigella flexneri 2a str. 2457T
uuuuaaacgaauaguuu

SEQ ID NO: 1913732 - RNA, 14 nt, Shigella flexneri 2a str. 2457T
uuuuaaauauaaaa

SEQ ID NO: 1913733 - RNA, 20 nt, Shigella flexneri 2a str. 2457T
uuuuaaauaucaucaaaauu

SEQ ID NO: 1913734 - RNA, 20 nt, Shigella flexneri 2a str. 2457T
uuuguuguucugucagccca

SEQ ID NO: 1913735 - RNA, 18 nt, Shigella flexneri 2a str. 2457T
uuuguuacuuauuucuau

SEQ ID NO: 1913736 - RNA, 16 nt, Shigella flexneri 2a str. 2457T
uuuguuacgauagaau

SEQ ID NO: 1913737 - RNA, 22 nt, Shigella flexneri 2a str. 2457T
uuuguuacgauagaauauuucu

SEQ ID NO: 1913738 - RNA, 14 nt, Shigella flexneri 2a str. 2457T
uuuguugauuuccc

SEQ ID NO: 1913739 - RNA, 12 nt, Shigella flexneri 2a str. 2457T
uuuguugccgcc

SEQ ID NO: 1913740 - RNA, 20 nt, Shigella flexneri 2a str. 2457T
uuuguugcgcugaaacuuua

SEQ ID NO: 1913741 - RNA, 19 nt, Shigella flexneri 2a str. 2457T
uuuguuggcgaaaaucuuu

SEQ ID NO: 1913742 - RNA, 12 nt, Shigella flexneri 2a str. 2457T
uuuuaagugaug

SEQ ID NO: 1913743 - RNA, 20 nt, Shigella flexneri 2a str. 2457T
uuuuaagauccaguugaccu

SEQ ID NO: 1913744 - RNA, 23 nt, Shigella flexneri 2a str. 2457T
uuuuaagauccaguugaccugcg

SEQ ID NO: 1913745 - RNA, 16 nt, Shigella flexneri 2a str. 2457T
uuuuaagcaagugcaa

SEQ ID NO: 1913746 - RNA, 21 nt, Shigella flexneri 2a str. 2457T
uuuuaaucaucugauaucuca

SEQ ID NO: 1913747 - RNA, 13 nt, Shigella flexneri 2a str. 2457T
uuuuaacuuuaau

SEQ ID NO: 1913748 - RNA, 11 nt, Shigella flexneri 2a str. 2457T
uuuuaacuuac

SEQ ID NO: 1913749 - RNA, 13 nt, Shigella flexneri 2a str. 2457T
uuuuaaauugaag

SEQ ID NO: 1913750 - RNA, 23 nt, Shigella flexneri 2a str. 2457T
uuuuaccggucaggauuuccagc

SEQ ID NO: 1913751 - RNA, 14 nt, Shigella flexneri 2a str. 2457T
uuuuaccagcgccu

SEQ ID NO: 1913752 - RNA, 20 nt, Shigella flexneri 2a str. 2457T
uuuuacauuauccagcgacu

SEQ ID NO: 1913753 - RNA, 12 nt, Shigella flexneri 2a str. 2457T
uuuuacaucauc

SEQ ID NO: 1913754 - RNA, 21 nt, Shigella flexneri 2a str. 2457T
uuuggcaaaugcaucagugac

SEQ ID NO: 1913755 - RNA, 22 nt, Shigella flexneri 2a str. 2457T
uuuggccgaagaggaacuguua

SEQ ID NO: 1913756 - RNA, 20 nt, Shigella flexneri 2a str. 2457T
uuugggaucggugcagacac

SEQ ID NO: 1913757 - RNA, 11 nt, Shigella flexneri 2a str. 2457T
uuuggcucuuc

SEQ ID NO: 1913758 - RNA, 14 nt, Shigella flexneri 2a str. 2457T
uuuggcugccgcca

SEQ ID NO: 1913759 - RNA, 16 nt, Shigella flexneri 2a str. 2457T
uuuggugagaacacca

SEQ ID NO: 1913760 - RNA, 21 nt, Shigella flexneri 2a str. 2457T
uuuggugaagacguuuauccc

SEQ ID NO: 1913761 - RNA, 17 nt, Shigella flexneri 2a str. 2457T
uuugguucaauuuguuc

SEQ ID NO: 1913762 - RNA, 13 nt, Shigella flexneri 2a str. 2457T
uuugcuuccugag

SEQ ID NO: 1913763 - RNA, 16 nt, Shigella flexneri 2a str. 2457T
uuugcugauauuuauc

SEQ ID NO: 1913764 - RNA, 13 nt, Shigella flexneri 2a str. 2457T
uuugcugaugcag

SEQ ID NO: 1913765 - RNA, 14 nt, Shigella flexneri 2a str. 2457T
uuugcuuuguaaag

SEQ ID NO: 1913766 - RNA, 20 nt, Shigella flexneri 2a str. 2457T
uuugcuuuugucaucagacu

SEQ ID NO: 1913767 - RNA, 16 nt, Shigella flexneri 2a str. 2457T
uuuggcaaacuacaaa

SEQ ID NO: 1913768 - RNA, 18 nt, Shigella flexneri 2a str. 2457T
uuuggcaaacuacaaauc

SEQ ID NO: 1913769 - RNA, 20 nt, Shigella flexneri 2a str. 2457T
uuuguauuaauuaacaacgu

SEQ ID NO: 1913770 - RNA, 12 nt, Shigella flexneri 2a str. 2457T
uuuguauuuuau

SEQ ID NO: 1913771 - RNA, 21 nt, Shigella flexneri 2a str. 2457T
uuuguacaggauauauuucau

SEQ ID NO: 1913772 - RNA, 20 nt, Shigella flexneri 2a str. 2457T
uuugugccugaauuuugguc

SEQ ID NO: 1913773 - RNA, 12 nt, Shigella flexneri 2a str. 2457T
uuugucuucaau

SEQ ID NO: 1913774 - RNA, 21 nt, Shigella flexneri 2a str. 2457T
uuuguggcuucuauauucugg

SEQ ID NO: 1913775 - RNA, 16 nt, Shigella flexneri 2a str. 2457T
uuugugggaauaacca

SEQ ID NO: 1913776 - RNA, 17 nt, Shigella flexneri 2a str. 2457T
uuugucucuucaugccu

SEQ ID NO: 1913777 - RNA, 21 nt, Shigella flexneri 2a str. 2457T
uuugucgugggcaggaaaauc

SEQ ID NO: 1913778 - RNA, 15 nt, Shigella flexneri 2a str. 2457T
uuuguccccucauca

SEQ ID NO: 1913779 - RNA, 21 nt, Shigella flexneri 2a str. 2457T
uuugucguugcuaacaaugga

SEQ ID NO: 1913780 - RNA, 20 nt, Shigella flexneri 2a str. 2457T
uuugucgccaacuucaugac

SEQ ID NO: 1913781 - RNA, 20 nt, Shigella flexneri 2a str. 2457T
uuugucaugacgacaaggca

SEQ ID NO: 1913782 - RNA, 22 nt, Shigella flexneri 2a str. 2457T
uuugucaugacuacacuaaacg

SEQ ID NO: 1913783 - RNA, 11 nt, Shigella flexneri 2a str. 2457T
uuuuauuuaac

SEQ ID NO: 1913784 - RNA, 19 nt, Shigella flexneri 2a str. 2457T
uuuuauugcuucaccagca

SEQ ID NO: 1913785 - RNA, 23 nt, Shigella flexneri 2a str. 2457T
uuuuaugauaggucauaucacaa

SEQ ID NO: 1913786 - RNA, 13 nt, Shigella flexneri 2a str. 2457T
uuuuacuuguuuu

SEQ ID NO: 1913787 - RNA, 21 nt, Shigella flexneri 2a str. 2457T
uuuuacgcaaccacaaaacac

SEQ ID NO: 1913788 - RNA, 18 nt, Shigella flexneri 2a str. 2457T
uuuuacgucugcaauuua

SEQ ID NO: 1913789 - RNA, 15 nt, Shigella flexneri 2a str. 2457T
uuuuacguuuuaauc

SEQ ID NO: 1913790 - RNA, 21 nt, Shigella flexneri 2a str. 2457T
uuuuauaaagaacucgaggau

SEQ ID NO: 1913791 - RNA, 14 nt, Shigella flexneri 2a str. 2457T
uuuuauaguacuuc

SEQ ID NO: 1913792 - RNA, 14 nt, Shigella flexneri 2a str. 2457T
uuuuccugcugcau

SEQ ID NO: 1913793 - RNA, 21 nt, Shigella flexneri 2a str. 2457T
uuuuccugcugcaucugaaac

SEQ ID NO: 1913794 - RNA, 22 nt, Shigella flexneri 2a str. 2457T
uuuuccugcugcaucugaaacu

SEQ ID NO: 1913795 - RNA, 12 nt, Shigella flexneri 2a str. 2457T
uuuucgccgcau

SEQ ID NO: 1913796 - RNA, 16 nt, Shigella flexneri 2a str. 2457T
uuuucgccacuucagc

SEQ ID NO: 1913797 - RNA, 15 nt, Shigella flexneri 2a str. 2457T
uuuucggauuuaccg

SEQ ID NO: 1913798 - RNA, 19 nt, Shigella flexneri 2a str. 2457T
uuuucggcaaccgcaucca

SEQ ID NO: 1913799 - RNA, 15 nt, Shigella flexneri 2a str. 2457T
uuuucguucaggccu

SEQ ID NO: 1913800 - RNA, 22 nt, Shigella flexneri 2a str. 2457T
uuuucgucguacccggcgacuu

SEQ ID NO: 1913801 - RNA, 19 nt, Shigella flexneri 2a str. 2457T
uuuucguuuggggcauauu

SEQ ID NO: 1913802 - RNA, 13 nt, Shigella flexneri 2a str. 2457T
uuuucguuuuaau

SEQ ID NO: 1913803 - RNA, 14 nt, Shigella flexneri 2a str. 2457T
uuuuccacaaugcc

SEQ ID NO: 1913804 - RNA, 15 nt, Shigella flexneri 2a str. 2457T
uuuucauugccgcau

SEQ ID NO: 1913805 - RNA, 19 nt, Shigella flexneri 2a str. 2457T
uuuuccaguagauucaaca

SEQ ID NO: 1913806 - RNA, 18 nt, Shigella flexneri 2a str. 2457T
uuuucccuuccgccauca

SEQ ID NO: 1913807 - RNA, 19 nt, Shigella flexneri 2a str. 2457T
uuuuccccaccucaucaga

SEQ ID NO: 1913808 - RNA, 21 nt, Shigella flexneri 2a str. 2457T
uuuuccgcacguuagaaacaa

SEQ ID NO: 1913809 - RNA, 22 nt, Shigella flexneri 2a str. 2457T
uuuuccuauugcugcugaucca

SEQ ID NO: 1913810 - RNA, 16 nt, Shigella flexneri 2a str. 2457T
uuuucaaauaucuauu

SEQ ID NO: 1913811 - RNA, 19 nt, Shigella flexneri 2a str. 2457T
uuuucaacgugucuuuuac

SEQ ID NO: 1913812 - RNA, 23 nt, Shigella flexneri 2a str. 2457T
uuuucaaccauccuaaaaaagca

SEQ ID NO: 1913813 - RNA, 18 nt, Shigella flexneri 2a str. 2457T
uuuucaacauguugaaau

SEQ ID NO: 1913814 - RNA, 13 nt, Shigella flexneri 2a str. 2457T
uuuucaauucucu

SEQ ID NO: 1913815 - RNA, 23 nt, Shigella flexneri 2a str. 2457T
uuuucaauucacgaauauuuccc

SEQ ID NO: 1913816 - RNA, 19 nt, Shigella flexneri 2a str. 2457T
uuuucaccaacgcaaaaag

SEQ ID NO: 1913817 - RNA, 12 nt, Shigella flexneri 2a str. 2457T
uuuucacauguu

SEQ ID NO: 1913818 - RNA, 15 nt, Shigella flexneri 2a str. 2457T
uuucugagcaucaca

SEQ ID NO: 1913819 - RNA, 17 nt, Shigella flexneri 2a str. 2457T
uuucugagucaauuucu

SEQ ID NO: 1913820 - RNA, 16 nt, Shigella flexneri 2a str. 2457T
uuucugagauucaauu

SEQ ID NO: 1913821 - RNA, 22 nt, Shigella flexneri 2a str. 2457T
uuucugcagcgcggcgagagcu

SEQ ID NO: 1913822 - RNA, 13 nt, Shigella flexneri 2a str. 2457T
uuucucuucaucu

SEQ ID NO: 1913823 - RNA, 17 nt, Shigella flexneri 2a str. 2457T
uuucucuuuaaacagau

SEQ ID NO: 1913824 - RNA, 23 nt, Shigella flexneri 2a str. 2457T
uuucugacauuauuuaucugccu

SEQ ID NO: 1913825 - RNA, 13 nt, Shigella flexneri 2a str. 2457T
uuucugaauuuca

SEQ ID NO: 1913826 - RNA, 21 nt, Shigella flexneri 2a str. 2457T
uuucuggguggcguuccagca

SEQ ID NO: 1913827 - RNA, 17 nt, Shigella flexneri 2a str. 2457T
uuucuggcaucacuucu

SEQ ID NO: 1913828 - RNA, 15 nt, Shigella flexneri 2a str. 2457T
uuucugcugccacuu

SEQ ID NO: 1913829 - RNA, 16 nt, Shigella flexneri 2a str. 2457T
uuucuggaugccaucg

SEQ ID NO: 1913830 - RNA, 17 nt, Shigella flexneri 2a str. 2457T
uuucuccuucacucuau

SEQ ID NO: 1913831 - RNA, 22 nt, Shigella flexneri 2a str. 2457T
uuucucgccaccggcacaucca

SEQ ID NO: 1913832 - RNA, 20 nt, Shigella flexneri 2a str. 2457T
uuucuccccauggacgcguc

SEQ ID NO: 1913833 - RNA, 14 nt, Shigella flexneri 2a str. 2457T
uuucucauuuuuua

SEQ ID NO: 1913834 - RNA, 17 nt, Shigella flexneri 2a str. 2457T
uuucucaagucugggua

SEQ ID NO: 1913835 - RNA, 12 nt, Shigella flexneri 2a str. 2457T
uuucuacaagca

SEQ ID NO: 1913836 - RNA, 17 nt, Shigella flexneri 2a str. 2457T
uuucguuugaaaacugg

SEQ ID NO: 1913837 - RNA, 22 nt, Shigella flexneri 2a str. 2457T
uuucgucugguucgccaaaugu

SEQ ID NO: 1913838 - RNA, 16 nt, Shigella flexneri 2a str. 2457T
uuucgguauacaacau

SEQ ID NO: 1913839 - RNA, 17 nt, Shigella flexneri 2a str. 2457T
uuucgcuucuucagccu

SEQ ID NO: 1913840 - RNA, 20 nt, Shigella flexneri 2a str. 2457T
uuucggaaacggcuuccauu

SEQ ID NO: 1913841 - RNA, 17 nt, Shigella flexneri 2a str. 2457T
uuucgcuuuacucccgu

SEQ ID NO: 1913842 - RNA, 22 nt, Shigella flexneri 2a str. 2457T
uuucgcuucaaccaccucagua

SEQ ID NO: 1913843 - RNA, 13 nt, Shigella flexneri 2a str. 2457T
uuucgcuucuuca

SEQ ID NO: 1913844 - RNA, 20 nt, Shigella flexneri 2a str. 2457T
uuucgaaccacaaaagacga

SEQ ID NO: 1913845 - RNA, 19 nt, Shigella flexneri 2a str. 2457T
uuucgaaugcucaugaucg

SEQ ID NO: 1913846 - RNA, 20 nt, Shigella flexneri 2a str. 2457T
uuucgaccggguuucuuauu

SEQ ID NO: 1913847 - RNA, 23 nt, Shigella flexneri 2a str. 2457T
uuucgccgcauccggcaauucuc

SEQ ID NO: 1913848 - RNA, 12 nt, Shigella flexneri 2a str. 2457T
uuucgcaaacca

SEQ ID NO: 1913849 - RNA, 16 nt, Shigella flexneri 2a str. 2457T
uuucgcugucgguacu

SEQ ID NO: 1913850 - RNA, 17 nt, Shigella flexneri 2a str. 2457T
uuucgcggcauaacaga

SEQ ID NO: 1913851 - RNA, 14 nt, Shigella flexneri 2a str. 2457T
uuuccguuaaccua

SEQ ID NO: 1913852 - RNA, 17 nt, Shigella flexneri 2a str. 2457T
uuuccuauugcugcuga

SEQ ID NO: 1913853 - RNA, 21 nt, Shigella flexneri 2a str. 2457T
uuuccucaguaccgugcagcg

SEQ ID NO: 1913854 - RNA, 15 nt, Shigella flexneri 2a str. 2457T
uuuccugagcacugg

SEQ ID NO: 1913855 - RNA, 18 nt, Shigella flexneri 2a str. 2457T
uuuccugacgucuggccu

SEQ ID NO: 1913856 - RNA, 16 nt, Shigella flexneri 2a str. 2457T
uuuccugagcacuggg

SEQ ID NO: 1913857 - RNA, 19 nt, Shigella flexneri 2a str. 2457T
uuuccugcggaugcgccau

SEQ ID NO: 1913858 - RNA, 16 nt, Shigella flexneri 2a str. 2457T
uuuccugguucucacu

SEQ ID NO: 1913859 - RNA, 13 nt, Shigella flexneri 2a str. 2457T
uuuccuuaacucc

SEQ ID NO: 1913860 - RNA, 16 nt, Shigella flexneri 2a str. 2457T
uuuccaugaccugcca

SEQ ID NO: 1913861 - RNA, 16 nt, Shigella flexneri 2a str. 2457T
uuuccaguuugcguuc

SEQ ID NO: 1913862 - RNA, 17 nt, Shigella flexneri 2a str. 2457T
uuuccagguuauuuuau

SEQ ID NO: 1913863 - RNA, 21 nt, Shigella flexneri 2a str. 2457T
uuuccaggcuggcaggccuca

SEQ ID NO: 1913864 - RNA, 16 nt, Shigella flexneri 2a str. 2457T
uuuccagggccucucc

SEQ ID NO: 1913865 - RNA, 13 nt, Shigella flexneri 2a str. 2457T
uuucccaccacua

SEQ ID NO: 1913866 - RNA, 17 nt, Shigella flexneri 2a str. 2457T
uuucccauuaccauucc

SEQ ID NO: 1913867 - RNA, 14 nt, Shigella flexneri 2a str. 2457T
uuucccauucuugg

SEQ ID NO: 1913868 - RNA, 13 nt, Shigella flexneri 2a str. 2457T
uuuccauugcauc

SEQ ID NO: 1913869 - RNA, 23 nt, Shigella flexneri 2a str. 2457T
uuucccccacagcucugcuguca

SEQ ID NO: 1913870 - RNA, 13 nt, Shigella flexneri 2a str. 2457T
uuucccuucucgu

SEQ ID NO: 1913871 - RNA, 16 nt, Shigella flexneri 2a str. 2457T
uuucccuguucagccu

SEQ ID NO: 1913872 - RNA, 22 nt, Shigella flexneri 2a str. 2457T
uuucccuucacucugcugccac

SEQ ID NO: 1913873 - RNA, 23 nt, Shigella flexneri 2a str. 2457T
uuucccgcacguuggcggugcca

SEQ ID NO: 1913874 - RNA, 19 nt, Shigella flexneri 2a str. 2457T
uuucccuauuuuuucgugu

SEQ ID NO: 1913875 - RNA, 17 nt, Shigella flexneri 2a str. 2457T
uuuccgggagcaauuug

SEQ ID NO: 1913876 - RNA, 17 nt, Shigella flexneri 2a str. 2457T
uuuccggcagaagcaau

SEQ ID NO: 1913877 - RNA, 21 nt, Shigella flexneri 2a str. 2457T
uuugaaaugaugucgcugucu

SEQ ID NO: 1913878 - RNA, 14 nt, Shigella flexneri 2a str. 2457T
uuugaaaaaaccug

SEQ ID NO: 1913879 - RNA, 22 nt, Shigella flexneri 2a str. 2457T
uuugaacauaucagcgcaaaga

SEQ ID NO: 1913880 - RNA, 18 nt, Shigella flexneri 2a str. 2457T
uuugaaauugugauaaaa

SEQ ID NO: 1913881 - RNA, 17 nt, Shigella flexneri 2a str. 2457T
uuugaauaucuccucug

SEQ ID NO: 1913882 - RNA, 17 nt, Shigella flexneri 2a str. 2457T
uuugagccaaaaugccu

SEQ ID NO: 1913883 - RNA, 16 nt, Shigella flexneri 2a str. 2457T
uuugacaacucaucac

SEQ ID NO: 1913884 - RNA, 17 nt, Shigella flexneri 2a str. 2457T
uuugacaacaucaucug

SEQ ID NO: 1913885 - RNA, 13 nt, Shigella flexneri 2a str. 2457T
uuucuuaaauuaa

SEQ ID NO: 1913886 - RNA, 23 nt, Shigella flexneri 2a str. 2457T
uuucuggugggugcuuuaaaaaa

SEQ ID NO: 1913887 - RNA, 14 nt, Shigella flexneri 2a str. 2457T
uuucuucauuaaau

SEQ ID NO: 1913888 - RNA, 13 nt, Shigella flexneri 2a str. 2457T
uuucuucaacacc

SEQ ID NO: 1913889 - RNA, 20 nt, Shigella flexneri 2a str. 2457T
uuucuucauuaaauuuccgc

SEQ ID NO: 1913890 - RNA, 12 nt, Shigella flexneri 2a str. 2457T
uuucuucauucg

SEQ ID NO: 1913891 - RNA, 13 nt, Shigella flexneri 2a str. 2457T
uuucuuucaucag

SEQ ID NO: 1913892 - RNA, 19 nt, Shigella flexneri 2a str. 2457T
uuucuugcagcucuugcag

SEQ ID NO: 1913893 - RNA, 15 nt, Shigella flexneri 2a str. 2457T
uuugaggaagcugcc

SEQ ID NO: 1913894 - RNA, 20 nt, Shigella flexneri 2a str. 2457T
uuugaugaguugaaaaccuc

SEQ ID NO: 1913895 - RNA, 21 nt, Shigella flexneri 2a str. 2457T
uuugcaaucagauaaaauaca

SEQ ID NO: 1913896 - RNA, 18 nt, Shigella flexneri 2a str. 2457T
uuugcaacgcuuugcuga

SEQ ID NO: 1913897 - RNA, 15 nt, Shigella flexneri 2a str. 2457T
uuugcaacuuucgcu

SEQ ID NO: 1913898 - RNA, 16 nt, Shigella flexneri 2a str. 2457T
uuugcacauuccagau

SEQ ID NO: 1913899 - RNA, 15 nt, Shigella flexneri 2a str. 2457T
uuugcagcuuugcug

SEQ ID NO: 1913900 - RNA, 14 nt, Shigella flexneri 2a str. 2457T
uuugcaggaaaaac

SEQ ID NO: 1913901 - RNA, 18 nt, Shigella flexneri 2a str. 2457T
uuugcaggaaaaacugcc

SEQ ID NO: 1913902 - RNA, 23 nt, Shigella flexneri 2a str. 2457T
uuugcagaaacauaauauaaauu

SEQ ID NO: 1913903 - RNA, 13 nt, Shigella flexneri 2a str. 2457T
uuugcacgcuuuc

SEQ ID NO: 1913904 - RNA, 14 nt, Shigella flexneri 2a str. 2457T
uuugauuuugcauu

SEQ ID NO: 1913905 - RNA, 20 nt, Shigella flexneri 2a str. 2457T
uuugcgagucugcuccagaa

SEQ ID NO: 1913906 - RNA, 20 nt, Shigella flexneri 2a str. 2457T
uuugcgaacgcguucacugc

SEQ ID NO: 1913907 - RNA, 23 nt, Shigella flexneri 2a str. 2457T
uuugcgccaucgccacaccagua

SEQ ID NO: 1913908 - RNA, 20 nt, Shigella flexneri 2a str. 2457T
uuugcgcuuuuggcaggaac

SEQ ID NO: 1913909 - RNA, 18 nt, Shigella flexneri 2a str. 2457T
uuugcgcguaaacaaaca

SEQ ID NO: 1913910 - RNA, 21 nt, Shigella flexneri 2a str. 2457T
uuugcguccgguaauuuuuau

SEQ ID NO: 1913911 - RNA, 18 nt, Shigella flexneri 2a str. 2457T
uuugcgucagcucacaaa

SEQ ID NO: 1913912 - RNA, 20 nt, Shigella flexneri 2a str. 2457T
uuugcguugcacgcagacac

SEQ ID NO: 1913913 - RNA, 14 nt, Shigella flexneri 2a str. 2457T
uuugcguguuucag

SEQ ID NO: 1913914 - RNA, 16 nt, Shigella flexneri 2a str. 2457T
uuugcccgcagaucca

SEQ ID NO: 1913915 - RNA, 19 nt, Shigella flexneri 2a str. 2457T
uuugccgcagcaguugcca

SEQ ID NO: 1913916 - RNA, 15 nt, Shigella flexneri 2a str. 2457T
uuugccaucucugca

SEQ ID NO: 1913917 - RNA, 21 nt, Shigella flexneri 2a str. 2457T
uuugccaucagcgccugaugg

SEQ ID NO: 1913918 - RNA, 16 nt, Shigella flexneri 2a str. 2457T
uuugccaugcauaucc

SEQ ID NO: 1913919 - RNA, 18 nt, Shigella flexneri 2a str. 2457T
uuugccggaacauccggc

SEQ ID NO: 1913920 - RNA, 17 nt, Shigella flexneri 2a str. 2457T
uuugccucguucuuccc

SEQ ID NO: 1913921 - RNA, 20 nt, Shigella flexneri 2a str. 2457T
uuugccaauagcguuuugcg

SEQ ID NO: 1913922 - RNA, 24 nt, Shigella flexneri 2a str. 2457T
uuugcauuacugcuaucugccaga

SEQ ID NO: 1913923 - RNA, 19 nt, Shigella flexneri 2a str. 2457T
uuugcauucggauugcuau

SEQ ID NO: 1913924 - RNA, 15 nt, Shigella flexneri 2a str. 2457T
uuugccaaacgcguc

SEQ ID NO: 1913925 - RNA, 16 nt, Shigella flexneri 2a str. 2457T
uuugcaguuccugcca

SEQ ID NO: 1913926 - RNA, 16 nt, Shigella flexneri 2a str. 2457T
uuugcagugcuuguua

SEQ ID NO: 1913927 - RNA, 14 nt, Shigella flexneri 2a str. 2457T
uuugcagcuuugcu

SEQ ID NO: 1913928 - RNA, 19 nt, Shigella flexneri 2a str. 2457T
uuugcaggucguccugcaa

SEQ ID NO: 1913929 - RNA, 22 nt, Shigella flexneri 2a str. 2457T
uuucagauguuccgccauuuua

SEQ ID NO: 1913930 - RNA, 19 nt, Shigella flexneri 2a str. 2457T
uuucagauuauugacaaag

SEQ ID NO: 1913931 - RNA, 19 nt, Shigella flexneri 2a str. 2457T
uuucagauuggugacaaag

SEQ ID NO: 1913932 - RNA, 22 nt, Shigella flexneri 2a str. 2457T
uuucagaagcaugaacauugcu

SEQ ID NO: 1913933 - RNA, 11 nt, Shigella flexneri 2a str. 2457T
uuucagcagcg

SEQ ID NO: 1913934 - RNA, 16 nt, Shigella flexneri 2a str. 2457T
uuucacuuucugcaau

SEQ ID NO: 1913935 - RNA, 14 nt, Shigella flexneri 2a str. 2457T
uuucacuucugagu

SEQ ID NO: 1913936 - RNA, 20 nt, Shigella flexneri 2a str. 2457T
uuucacuucaaccacauuca

SEQ ID NO: 1913937 - RNA, 17 nt, Shigella flexneri 2a str. 2457T
uuucagaauagacaaaa

SEQ ID NO: 1913938 - RNA, 17 nt, Shigella flexneri 2a str. 2457T
uuucagaaauuuggcuc

SEQ ID NO: 1913939 - RNA, 19 nt, Shigella flexneri 2a str. 2457T
uuucagaaaacgguugaua

SEQ ID NO: 1913940 - RNA, 23 nt, Shigella flexneri 2a str. 2457T
uuucagacggcugucuuccugug

SEQ ID NO: 1913941 - RNA, 19 nt, Shigella flexneri 2a str. 2457T
uuucaguggggcaggggcu

SEQ ID NO: 1913942 - RNA, 18 nt, Shigella flexneri 2a str. 2457T
uuucaguggguuaugaaa

SEQ ID NO: 1913943 - RNA, 19 nt, Shigella flexneri 2a str. 2457T
uuucauagauuaauuuccc

SEQ ID NO: 1913944 - RNA, 20 nt, Shigella flexneri 2a str. 2457T
uuucauagauuaauuuccca

SEQ ID NO: 1913945 - RNA, 19 nt, Shigella flexneri 2a str. 2457T
uuucauaucugccagauaa

SEQ ID NO: 1913946 - RNA, 17 nt, Shigella flexneri 2a str. 2457T
uuucaggucaaaagauu

SEQ ID NO: 1913947 - RNA, 16 nt, Shigella flexneri 2a str. 2457T
uuucaggccagcggcu

SEQ ID NO: 1913948 - RNA, 18 nt, Shigella flexneri 2a str. 2457T
uuucaggaaauaaauaau

SEQ ID NO: 1913949 - RNA, 15 nt, Shigella flexneri 2a str. 2457T
uuucaguaauccuuu

SEQ ID NO: 1913950 - RNA, 21 nt, Shigella flexneri 2a str. 2457T
uuucaguaauccuuucucaau

SEQ ID NO: 1913951 - RNA, 17 nt, Shigella flexneri 2a str. 2457T
uuucaguauuuccacaa

SEQ ID NO: 1913952 - RNA, 13 nt, Shigella flexneri 2a str. 2457T
uuuccaaaacugg

SEQ ID NO: 1913953 - RNA, 13 nt, Shigella flexneri 2a str. 2457T
uuuccacuuccac

SEQ ID NO: 1913954 - RNA, 17 nt, Shigella flexneri 2a str. 2457T
uuuccacgcugauugca

SEQ ID NO: 1913955 - RNA, 13 nt, Shigella flexneri 2a str. 2457T
uuuccaccgcaaa

SEQ ID NO: 1913956 - RNA, 21 nt, Shigella flexneri 2a str. 2457T
uuucaugguuacgccggugau

SEQ ID NO: 1913957 - RNA, 16 nt, Shigella flexneri 2a str. 2457T
uuucaugguugucacc

SEQ ID NO: 1913958 - RNA, 16 nt, Shigella flexneri 2a str. 2457T
uuucaugcuauuccuu

SEQ ID NO: 1913959 - RNA, 22 nt, Shigella flexneri 2a str. 2457T
uuucauucagaacacuucuucu

SEQ ID NO: 1913960 - RNA, 16 nt, Shigella flexneri 2a str. 2457T
uuucauuccaguaagg

SEQ ID NO: 1913961 - RNA, 21 nt, Shigella flexneri 2a str. 2457T
uuucauugaaugcggcaggca

SEQ ID NO: 1913962 - RNA, 21 nt, Shigella flexneri 2a str. 2457T
uuucaucaacugacuauccug

SEQ ID NO: 1913963 - RNA, 22 nt, Shigella flexneri 2a str. 2457T
uuucaucgcccaggcaaguagc

SEQ ID NO: 1913964 - RNA, 21 nt, Shigella flexneri 2a str. 2457T
uuucaucgcuuucuuuauaga

SEQ ID NO: 1913965 - RNA, 15 nt, Shigella flexneri 2a str. 2457T
uuucaucccucucau

SEQ ID NO: 1913966 - RNA, 14 nt, Shigella flexneri 2a str. 2457T
uuucauccugccau

SEQ ID NO: 1913967 - RNA, 15 nt, Shigella flexneri 2a str. 2457T
uuucauccuucauua

SEQ ID NO: 1913968 - RNA, 13 nt, Shigella flexneri 2a str. 2457T
uuuauuuccgaaa

SEQ ID NO: 1913969 - RNA, 20 nt, Shigella flexneri 2a str. 2457T
uuuauuaugccacagagaau

SEQ ID NO: 1913970 - RNA, 11 nt, Shigella flexneri 2a str. 2457T
uuuauuauucc

SEQ ID NO: 1913971 - RNA, 14 nt, Shigella flexneri 2a str. 2457T
uuucaaacaggcug

SEQ ID NO: 1913972 - RNA, 19 nt, Shigella flexneri 2a str. 2457T
uuuauuucuguauuacaga

SEQ ID NO: 1913973 - RNA, 21 nt, Shigella flexneri 2a str. 2457T
uuuauuugacccgcaguaaau

SEQ ID NO: 1913974 - RNA, 19 nt, Shigella flexneri 2a str. 2457T
uuucaaccauccuaaaaaa

SEQ ID NO: 1913975 - RNA, 23 nt, Shigella flexneri 2a str. 2457T
uuucaacaaccuugcguuuuuca

SEQ ID NO: 1913976 - RNA, 18 nt, Shigella flexneri 2a str. 2457T
uuucaacaauacaaaugc

SEQ ID NO: 1913977 - RNA, 20 nt, Shigella flexneri 2a str. 2457T
uuucaacaauacaaaugccu

SEQ ID NO: 1913978 - RNA, 20 nt, Shigella flexneri 2a str. 2457T
uuucaauauugcacaguaua

SEQ ID NO: 1913979 - RNA, 16 nt, Shigella flexneri 2a str. 2457T
uuucaaucgacuuuuc

SEQ ID NO: 1913980 - RNA, 16 nt, Shigella flexneri 2a str. 2457T
uuucaauuccauuucc

SEQ ID NO: 1913981 - RNA, 19 nt, Shigella flexneri 2a str. 2457T
uuucaauuccauuucccug

SEQ ID NO: 1913982 - RNA, 12 nt, Shigella flexneri 2a str. 2457T
uuucaauuauca

SEQ ID NO: 1913983 - RNA, 23 nt, Shigella flexneri 2a str. 2457T
uuucaauucacgaauauuucccg

SEQ ID NO: 1913984 - RNA, 13 nt, Shigella flexneri 2a str. 2457T
uuucaagauuagc

SEQ ID NO: 1913985 - RNA, 22 nt, Shigella flexneri 2a str. 2457T
uuucacgccgggaaauuuuucc

SEQ ID NO: 1913986 - RNA, 13 nt, Shigella flexneri 2a str. 2457T
uuucaccugcuga

SEQ ID NO: 1913987 - RNA, 21 nt, Shigella flexneri 2a str. 2457T
uuucacgagagauacgcuugc

SEQ ID NO: 1913988 - RNA, 17 nt, Shigella flexneri 2a str. 2457T
uuucaccgaugcacaga

SEQ ID NO: 1913989 - RNA, 15 nt, Shigella flexneri 2a str. 2457T
uuucacccacuaauc

SEQ ID NO: 1913990 - RNA, 19 nt, Shigella flexneri 2a str. 2457T
uuucacccgcgaccaccag

SEQ ID NO: 1913991 - RNA, 11 nt, Shigella flexneri 2a str. 2457T
uuucaccagcg

SEQ ID NO: 1913992 - RNA, 20 nt, Shigella flexneri 2a str. 2457T
uuucacaggaaaaacuuuua

SEQ ID NO: 1913993 - RNA, 13 nt, Shigella flexneri 2a str. 2457T
uuuaaacagagau

SEQ ID NO: 1913994 - RNA, 22 nt, Shigella flexneri 2a str. 2457T
uuuaaacaucaaaccacuuaau

SEQ ID NO: 1913995 - RNA, 23 nt, Shigella flexneri 2a str. 2457T
uuuaaacaucaaaccacuuaauu

SEQ ID NO: 1913996 - RNA, 23 nt, Shigella flexneri 2a str. 2457T
uuuaaacccuacccggcaaguaa

SEQ ID NO: 1913997 - RNA, 18 nt, Shigella flexneri 2a str. 2457T
uuuaaacaauuucagaau

SEQ ID NO: 1913998 - RNA, 23 nt, Shigella flexneri 2a str. 2457T
uuuaaagagacagaaucaggcca

SEQ ID NO: 1913999 - RNA, 17 nt, Shigella flexneri 2a str. 2457T
uuuaaagugcaaaaauu

SEQ ID NO: 1914000 - RNA, 13 nt, Shigella flexneri 2a str. 2457T
uuuaaauuuccca

SEQ ID NO: 1914001 - RNA, 20 nt, Shigella flexneri 2a str. 2457T
uuuaacaguuguccaaacgu

SEQ ID NO: 1914002 - RNA, 16 nt, Shigella flexneri 2a str. 2457T
uuuaaccagucgcuga

SEQ ID NO: 1914003 - RNA, 19 nt, Shigella flexneri 2a str. 2457T
uuuaaauaucaucaaaauu

SEQ ID NO: 1914004 - RNA, 15 nt, Shigella flexneri 2a str. 2457T
uuuaaaaaguaaaac

SEQ ID NO: 1914005 - RNA, 18 nt, Shigella flexneri 2a str. 2457T
uuuaaaaagaaaaaacua

SEQ ID NO: 1914006 - RNA, 13 nt, Shigella flexneri 2a str. 2457T
uuuaaaaaagaau

SEQ ID NO: 1914007 - RNA, 15 nt, Shigella flexneri 2a str. 2457T
uuguuuccauaugua

SEQ ID NO: 1914008 - RNA, 19 nt, Shigella flexneri 2a str. 2457T
uuguuuagauccauaucca

SEQ ID NO: 1914009 - RNA, 19 nt, Shigella flexneri 2a str. 2457T
uuguuuaauggcaaaaacu

SEQ ID NO: 1914010 - RNA, 19 nt, Shigella flexneri 2a str. 2457T
uugcugcguggaauuuguc

SEQ ID NO: 1914011 - RNA, 19 nt, Shigella flexneri 2a str. 2457T
uugcugccguuuucaaagg

SEQ ID NO: 1914012 - RNA, 20 nt, Shigella flexneri 2a str. 2457T
uugcugccgccaguucuucc

SEQ ID NO: 1914013 - RNA, 23 nt, Shigella flexneri 2a str. 2457T
uugcugagaucaaacucuuucaa

SEQ ID NO: 1914014 - RNA, 20 nt, Shigella flexneri 2a str. 2457T
uuguuauccaccgaaauaau

SEQ ID NO: 1914015 - RNA, 20 nt, Shigella flexneri 2a str. 2457T
uuguugcuauggggaaaaau

SEQ ID NO: 1914016 - RNA, 20 nt, Shigella flexneri 2a str. 2457T
uuguugcgcuaagccugcug

SEQ ID NO: 1914017 - RNA, 17 nt, Shigella flexneri 2a str. 2457T
uuuagguacaaagccaa

SEQ ID NO: 1914018 - RNA, 23 nt, Shigella flexneri 2a str. 2457T
uuuauaaagaacucgaggauaaa

SEQ ID NO: 1914019 - RNA, 17 nt, Shigella flexneri 2a str. 2457T
uuuacugauaauuuuuu

SEQ ID NO: 1914020 - RNA, 18 nt, Shigella flexneri 2a str. 2457T
uuuacgcucccacggaau

SEQ ID NO: 1914021 - RNA, 19 nt, Shigella flexneri 2a str. 2457T
uuuacgccgcauccggcaa

SEQ ID NO: 1914022 - RNA, 13 nt, Shigella flexneri 2a str. 2457T
uuuacgcaaccac

SEQ ID NO: 1914023 - RNA, 14 nt, Shigella flexneri 2a str. 2457T
uuuacgcaaccaca

SEQ ID NO: 1914024 - RNA, 16 nt, Shigella flexneri 2a str. 2457T
uuuacgcaaccacaaa

SEQ ID NO: 1914025 - RNA, 11 nt, Shigella flexneri 2a str. 2457T
uuuagcgccag

SEQ ID NO: 1914026 - RNA, 23 nt, Shigella flexneri 2a str. 2457T
uuuagcuaaucaaaucaaugccu

SEQ ID NO: 1914027 - RNA, 13 nt, Shigella flexneri 2a str. 2457T
uuuaauugccauu

SEQ ID NO: 1914028 - RNA, 20 nt, Shigella flexneri 2a str. 2457T
uuuaccaauauaauuccauu

SEQ ID NO: 1914029 - RNA, 13 nt, Shigella flexneri 2a str. 2457T
uuuacccaggccu

SEQ ID NO: 1914030 - RNA, 21 nt, Shigella flexneri 2a str. 2457T
uuuaccccacgucaucuguca

SEQ ID NO: 1914031 - RNA, 21 nt, Shigella flexneri 2a str. 2457T
uuuacgaagaaagcaauauug

SEQ ID NO: 1914032 - RNA, 18 nt, Shigella flexneri 2a str. 2457T
uuuaccaccgucaaaaaa

SEQ ID NO: 1914033 - RNA, 20 nt, Shigella flexneri 2a str. 2457T
uuuaccaccgucaaaaaaac

SEQ ID NO: 1914034 - RNA, 22 nt, Shigella flexneri 2a str. 2457T
uugaccacacggucuaucauca

SEQ ID NO: 1914035 - RNA, 20 nt, Shigella flexneri 2a str. 2457T
uugacaaagugcgcguuuuu

SEQ ID NO: 1914036 - RNA, 13 nt, Shigella flexneri 2a str. 2457T
uugacaaagugcg

SEQ ID NO: 1914037 - RNA, 18 nt, Shigella flexneri 2a str. 2457T
uugaauuuggaagaauuu

SEQ ID NO: 1914038 - RNA, 12 nt, Shigella flexneri 2a str. 2457T
uugacucucauc

SEQ ID NO: 1914039 - RNA, 17 nt, Shigella flexneri 2a str. 2457T
uugacucgccugaaagu

SEQ ID NO: 1914040 - RNA, 22 nt, Shigella flexneri 2a str. 2457T
uugacgagauagcgaaguagac

SEQ ID NO: 1914041 - RNA, 15 nt, Shigella flexneri 2a str. 2457T
uugacgccaaggagu

SEQ ID NO: 1914042 - RNA, 16 nt, Shigella flexneri 2a str. 2457T
uugacgcccccaaacu

SEQ ID NO: 1914043 - RNA, 18 nt, Shigella flexneri 2a str. 2457T
uugacgcgucuuaucagg

SEQ ID NO: 1914044 - RNA, 16 nt, Shigella flexneri 2a str. 2457T
uugaaggcagcauucg

SEQ ID NO: 1914045 - RNA, 22 nt, Shigella flexneri 2a str. 2457T
uugaagcgcggaacaaauacuu

SEQ ID NO: 1914046 - RNA, 23 nt, Shigella flexneri 2a str. 2457T
uugaacgggugauuaaagaaaau

SEQ ID NO: 1914047 - RNA, 21 nt, Shigella flexneri 2a str. 2457T
uugaacggauauuuugccagg

SEQ ID NO: 1914048 - RNA, 12 nt, Shigella flexneri 2a str. 2457T
uugaacuaucau

SEQ ID NO: 1914049 - RNA, 13 nt, Shigella flexneri 2a str. 2457T
uugaagaaaucag

SEQ ID NO: 1914050 - RNA, 23 nt, Shigella flexneri 2a str. 2457T
uucuugcgauuuugucucucucu

SEQ ID NO: 1914051 - RNA, 18 nt, Shigella flexneri 2a str. 2457T
uucugcgcacacacgccc

SEQ ID NO: 1914052 - RNA, 20 nt, Shigella flexneri 2a str. 2457T
uucugcgcuugguuuugcca

SEQ ID NO: 1914053 - RNA, 19 nt, Shigella flexneri 2a str. 2457T
uucugccgcgcacgucagc

SEQ ID NO: 1914054 - RNA, 17 nt, Shigella flexneri 2a str. 2457T
uucugccgcuuccagca

SEQ ID NO: 1914055 - RNA, 17 nt, Shigella flexneri 2a str. 2457T
uucugccaggcuggcag

SEQ ID NO: 1914056 - RNA, 21 nt, Shigella flexneri 2a str. 2457T
uucuuuauugauuaaaggaag

SEQ ID NO: 1914057 - RNA, 22 nt, Shigella flexneri 2a str. 2457T
uucuuuacugcccgcuugcgcc

SEQ ID NO: 1914058 - RNA, 21 nt, Shigella flexneri 2a str. 2457T
uucuuuauaucugguuugcca

SEQ ID NO: 1914059 - RNA, 21 nt, Shigella flexneri 2a str. 2457T
uucuuugcugccguuaacccg

SEQ ID NO: 1914060 - RNA, 23 nt, Shigella flexneri 2a str. 2457T
uucuuugcugccguuaacccguc

SEQ ID NO: 1914061 - RNA, 17 nt, Shigella flexneri 2a str. 2457T
uucuuucucgccuuucu

SEQ ID NO: 1914062 - RNA, 15 nt, Shigella flexneri 2a str. 2457T
uucuuuugagcgucc

SEQ ID NO: 1914063 - RNA, 19 nt, Shigella flexneri 2a str. 2457T
uucuuuugcgguuaauggu

SEQ ID NO: 1914064 - RNA, 11 nt, Shigella flexneri 2a str. 2457T
uucuuuuucau

SEQ ID NO: 1914065 - RNA, 23 nt, Shigella flexneri 2a str. 2457T
uugaaaaaucaaaaaacuggaaa

SEQ ID NO: 1914066 - RNA, 21 nt, Shigella flexneri 2a str. 2457T
uugaaaaaguucgacuuaaau

SEQ ID NO: 1914067 - RNA, 12 nt, Shigella flexneri 2a str. 2457T
uugaaaaacaug

SEQ ID NO: 1914068 - RNA, 23 nt, Shigella flexneri 2a str. 2457T
uugaaacgaguggugucgucaaa

SEQ ID NO: 1914069 - RNA, 17 nt, Shigella flexneri 2a str. 2457T
uugaaacacuuaauggu

SEQ ID NO: 1914070 - RNA, 19 nt, Shigella flexneri 2a str. 2457T
uugaacccggcaucaacca

SEQ ID NO: 1914071 - RNA, 18 nt, Shigella flexneri 2a str. 2457T
uugaaaucgaacagguug

SEQ ID NO: 1914072 - RNA, 22 nt, Shigella flexneri 2a str. 2457T
uugaaaugugguuucacuuucu

SEQ ID NO: 1914073 - RNA, 14 nt, Shigella flexneri 2a str. 2457T
uugauaugcaccuu

SEQ ID NO: 1914074 - RNA, 18 nt, Shigella flexneri 2a str. 2457T
uugauauuuauuuccuuc

SEQ ID NO: 1914075 - RNA, 21 nt, Shigella flexneri 2a str. 2457T
uugauccaggagcuccagguc

SEQ ID NO: 1914076 - RNA, 17 nt, Shigella flexneri 2a str. 2457T
uugauccaggagcucca

SEQ ID NO: 1914077 - RNA, 13 nt, Shigella flexneri 2a str. 2457T
uugaucauaaaaa

SEQ ID NO: 1914078 - RNA, 23 nt, Shigella flexneri 2a str. 2457T
uugaucagccaggcgaugaaauu

SEQ ID NO: 1914079 - RNA, 19 nt, Shigella flexneri 2a str. 2457T
uugaucaauucuaaauguu

SEQ ID NO: 1914080 - RNA, 13 nt, Shigella flexneri 2a str. 2457T
uugaucaccagug

SEQ ID NO: 1914081 - RNA, 22 nt, Shigella flexneri 2a str. 2457T
uugaucacccacaucagcggca

SEQ ID NO: 1914082 - RNA, 19 nt, Shigella flexneri 2a str. 2457T
uugaucaaauacuucaaua

SEQ ID NO: 1914083 - RNA, 23 nt, Shigella flexneri 2a str. 2457T
uugacuuauaugcgcgaauacga

SEQ ID NO: 1914084 - RNA, 17 nt, Shigella flexneri 2a str. 2457T
uugagagugcgaaacga

SEQ ID NO: 1914085 - RNA, 21 nt, Shigella flexneri 2a str. 2457T
uugaguuuuucaucccucuca

SEQ ID NO: 1914086 - RNA, 22 nt, Shigella flexneri 2a str. 2457T
uugagaugguuacuuuuuaugu

SEQ ID NO: 1914087 - RNA, 22 nt, Shigella flexneri 2a str. 2457T
uugcaauacaccuccggcuggg

SEQ ID NO: 1914088 - RNA, 16 nt, Shigella flexneri 2a str. 2457T
uugcacacuuuccaua

SEQ ID NO: 1914089 - RNA, 16 nt, Shigella flexneri 2a str. 2457T
uugcacagacuuaaua

SEQ ID NO: 1914090 - RNA, 18 nt, Shigella flexneri 2a str. 2457T
uugcaaucagauaaaaua

SEQ ID NO: 1914091 - RNA, 20 nt, Shigella flexneri 2a str. 2457T
uugcaaucagauaaaauaca

SEQ ID NO: 1914092 - RNA, 23 nt, Shigella flexneri 2a str. 2457T
uugcaagaucgcgcaucagcucc

SEQ ID NO: 1914093 - RNA, 16 nt, Shigella flexneri 2a str. 2457T
uugcaacauguugaau

SEQ ID NO: 1914094 - RNA, 24 nt, Shigella flexneri 2a str. 2457T
uugcaacgaacgcauccgcuggcc

SEQ ID NO: 1914095 - RNA, 20 nt, Shigella flexneri 2a str. 2457T
uugaugaguugaaaaccucu

SEQ ID NO: 1914096 - RNA, 21 nt, Shigella flexneri 2a str. 2457T
uugaugcacugggagaacgcu

SEQ ID NO: 1914097 - RNA, 20 nt, Shigella flexneri 2a str. 2457T
uugauucaucucuucuuccg

SEQ ID NO: 1914098 - RNA, 22 nt, Shigella flexneri 2a str. 2457T
uugaugcgaguaaucaggcuau

SEQ ID NO: 1914099 - RNA, 23 nt, Shigella flexneri 2a str. 2457T
uugaugcgugagguaacaauaaa

SEQ ID NO: 1914100 - RNA, 18 nt, Shigella flexneri 2a str. 2457T
uugauuuuuuugauaaac

SEQ ID NO: 1914101 - RNA, 16 nt, Shigella flexneri 2a str. 2457T
uugauuuugcauuuua

SEQ ID NO: 1914102 - RNA, 16 nt, Shigella flexneri 2a str. 2457T
uugauucuguucagua

SEQ ID NO: 1914103 - RNA, 17 nt, Shigella flexneri 2a str. 2457T
uugcaccgggcuuuuuu

SEQ ID NO: 1914104 - RNA, 21 nt, Shigella flexneri 2a str. 2457T
uugcaccagcaacaagccagu

SEQ ID NO: 1914105 - RNA, 20 nt, Shigella flexneri 2a str. 2457T
uugcacgcagacacugcuga

SEQ ID NO: 1914106 - RNA, 21 nt, Shigella flexneri 2a str. 2457T
uugcccccugaagcaguuuca

SEQ ID NO: 1914107 - RNA, 17 nt, Shigella flexneri 2a str. 2457T
uugccccucuaacucuu

SEQ ID NO: 1914108 - RNA, 19 nt, Shigella flexneri 2a str. 2457T
uugccaccccuuuugacuu

SEQ ID NO: 1914109 - RNA, 15 nt, Shigella flexneri 2a str. 2457T
uugccggaugcgaca

SEQ ID NO: 1914110 - RNA, 19 nt, Shigella flexneri 2a str. 2457T
uugccgcuuaaauuuccac

SEQ ID NO: 1914111 - RNA, 14 nt, Shigella flexneri 2a str. 2457T
uugccgcuacauca

SEQ ID NO: 1914112 - RNA, 15 nt, Shigella flexneri 2a str. 2457T
uugccgcacuuaaua

SEQ ID NO: 1914113 - RNA, 16 nt, Shigella flexneri 2a str. 2457T
uugccgaugucucgug

SEQ ID NO: 1914114 - RNA, 17 nt, Shigella flexneri 2a str. 2457T
uugcccuguuacaaacc

SEQ ID NO: 1914115 - RNA, 19 nt, Shigella flexneri 2a str. 2457T
uugcccgggcgagcaaugu

SEQ ID NO: 1914116 - RNA, 21 nt, Shigella flexneri 2a str. 2457T
uugcccucugaauaacaccca

SEQ ID NO: 1914117 - RNA, 13 nt, Shigella flexneri 2a str. 2457T
uugcucuguuuuc

SEQ ID NO: 1914118 - RNA, 23 nt, Shigella flexneri 2a str. 2457T
uugcucgacaagauacugccgau

SEQ ID NO: 1914119 - RNA, 23 nt, Shigella flexneri 2a str. 2457T
uugcucuaacggucgcggaacau

SEQ ID NO: 1914120 - RNA, 23 nt, Shigella flexneri 2a str. 2457T
uugcucuucuccggcuguuucag

SEQ ID NO: 1914121 - RNA, 16 nt, Shigella flexneri 2a str. 2457T
uugcucauccauugcu

SEQ ID NO: 1914122 - RNA, 19 nt, Shigella flexneri 2a str. 2457T
uugcucagaaucacgccaa

SEQ ID NO: 1914123 - RNA, 15 nt, Shigella flexneri 2a str. 2457T
uugcgccuuuaauau

SEQ ID NO: 1914124 - RNA, 21 nt, Shigella flexneri 2a str. 2457T
uugcgccgguuuaucuccgcu

SEQ ID NO: 1914125 - RNA, 12 nt, Shigella flexneri 2a str. 2457T
uugcgucauggu

SEQ ID NO: 1914126 - RNA, 20 nt, Shigella flexneri 2a str. 2457T
uugcguuauuuucggcaccu

SEQ ID NO: 1914127 - RNA, 18 nt, Shigella flexneri 2a str. 2457T
uugcguucaucaguucca

SEQ ID NO: 1914128 - RNA, 20 nt, Shigella flexneri 2a str. 2457T
uugccugaugcgcugggcaa

SEQ ID NO: 1914129 - RNA, 18 nt, Shigella flexneri 2a str. 2457T
uugccugcgaagcucuuu

SEQ ID NO: 1914130 - RNA, 14 nt, Shigella flexneri 2a str. 2457T
uugccugggugcaa

SEQ ID NO: 1914131 - RNA, 19 nt, Shigella flexneri 2a str. 2457T
uugccugugcaaccuuuuc

SEQ ID NO: 1914132 - RNA, 17 nt, Shigella flexneri 2a str. 2457T
uugccugugcaaccuuu

SEQ ID NO: 1914133 - RNA, 21 nt, Shigella flexneri 2a str. 2457T
uugcgcacaucaauuugccca

SEQ ID NO: 1914134 - RNA, 16 nt, Shigella flexneri 2a str. 2457T
uugcgcauggcauuuu

SEQ ID NO: 1914135 - RNA, 19 nt, Shigella flexneri 2a str. 2457T
uuccgacagaauauaaguc

SEQ ID NO: 1914136 - RNA, 14 nt, Shigella flexneri 2a str. 2457T
uuccgcaauacagc

SEQ ID NO: 1914137 - RNA, 15 nt, Shigella flexneri 2a str. 2457T
uuccccuugauaacg

SEQ ID NO: 1914138 - RNA, 21 nt, Shigella flexneri 2a str. 2457T
uucccgccagcggcccggaga

SEQ ID NO: 1914139 - RNA, 13 nt, Shigella flexneri 2a str. 2457T
uucccgcaacacc

SEQ ID NO: 1914140 - RNA, 17 nt, Shigella flexneri 2a str. 2457T
uucccgauaagggagca

SEQ ID NO: 1914141 - RNA, 21 nt, Shigella flexneri 2a str. 2457T
uucccgagacauuccuuuacu

SEQ ID NO: 1914142 - RNA, 16 nt, Shigella flexneri 2a str. 2457T
uucccaucucaauauu

SEQ ID NO: 1914143 - RNA, 20 nt, Shigella flexneri 2a str. 2457T
uucccacugcucaaucauca

SEQ ID NO: 1914144 - RNA, 15 nt, Shigella flexneri 2a str. 2457T
uucccagcaagaacc

SEQ ID NO: 1914145 - RNA, 17 nt, Shigella flexneri 2a str. 2457T
uuccauuuuucacuuaa

SEQ ID NO: 1914146 - RNA, 20 nt, Shigella flexneri 2a str. 2457T
uucccacgucagaccaaaac

SEQ ID NO: 1914147 - RNA, 21 nt, Shigella flexneri 2a str. 2457T
uuccuggaaccagugaauacu

SEQ ID NO: 1914148 - RNA, 21 nt, Shigella flexneri 2a str. 2457T
uuccugguucucacuguucac

SEQ ID NO: 1914149 - RNA, 22 nt, Shigella flexneri 2a str. 2457T
uuccuggucggcaaacugcuga

SEQ ID NO: 1914150 - RNA, 15 nt, Shigella flexneri 2a str. 2457T
uuccuggcuuggcug

SEQ ID NO: 1914151 - RNA, 23 nt, Shigella flexneri 2a str. 2457T
uuccuggggaaaaugggcaucag

SEQ ID NO: 1914152 - RNA, 14 nt, Shigella flexneri 2a str. 2457T
uuccuuaaaaguga

SEQ ID NO: 1914153 - RNA, 12 nt, Shigella flexneri 2a str. 2457T
uuccucugcccu

SEQ ID NO: 1914154 - RNA, 19 nt, Shigella flexneri 2a str. 2457T
uuccugcaacuucucuuuc

SEQ ID NO: 1914155 - RNA, 15 nt, Shigella flexneri 2a str. 2457T
uuccugccaguuuuu

SEQ ID NO: 1914156 - RNA, 20 nt, Shigella flexneri 2a str. 2457T
uuccugcuuuauaaucccuc

SEQ ID NO: 1914157 - RNA, 15 nt, Shigella flexneri 2a str. 2457T
uuccugcugcaucug

SEQ ID NO: 1914158 - RNA, 21 nt, Shigella flexneri 2a str. 2457T
uuccgcugcaaguuuugucag

SEQ ID NO: 1914159 - RNA, 14 nt, Shigella flexneri 2a str. 2457T
uuccgcuucugcuu

SEQ ID NO: 1914160 - RNA, 20 nt, Shigella flexneri 2a str. 2457T
uuccgcgucaaucugcccga

SEQ ID NO: 1914161 - RNA, 17 nt, Shigella flexneri 2a str. 2457T
uuccggcaagcaaauga

SEQ ID NO: 1914162 - RNA, 14 nt, Shigella flexneri 2a str. 2457T
uuccuacugcuccu

SEQ ID NO: 1914163 - RNA, 22 nt, Shigella flexneri 2a str. 2457T
uuccggaucgccaaagcggcag

SEQ ID NO: 1914164 - RNA, 15 nt, Shigella flexneri 2a str. 2457T
uuccggcaccacaaa

SEQ ID NO: 1914165 - RNA, 11 nt, Shigella flexneri 2a str. 2457T
uuccuccauuu

SEQ ID NO: 1914166 - RNA, 22 nt, Shigella flexneri 2a str. 2457T
uuccuaugcaacaacugaaaaa

SEQ ID NO: 1914167 - RNA, 19 nt, Shigella flexneri 2a str. 2457T
uuccagcauaaugacucuc

SEQ ID NO: 1914168 - RNA, 22 nt, Shigella flexneri 2a str. 2457T
uuccagcagaccagcaauaacu

SEQ ID NO: 1914169 - RNA, 14 nt, Shigella flexneri 2a str. 2457T
uuccagcaguucca

SEQ ID NO: 1914170 - RNA, 20 nt, Shigella flexneri 2a str. 2457T
uuccagcagaccagcaauaa

SEQ ID NO: 1914171 - RNA, 22 nt, Shigella flexneri 2a str. 2457T
uuccagcgccgccagaagggaa

SEQ ID NO: 1914172 - RNA, 23 nt, Shigella flexneri 2a str. 2457T
uuccagaucaccgcagaagcgau

SEQ ID NO: 1914173 - RNA, 19 nt, Shigella flexneri 2a str. 2457T
uuccagacucaacaggccc

SEQ ID NO: 1914174 - RNA, 14 nt, Shigella flexneri 2a str. 2457T
uuccagacucaaca

SEQ ID NO: 1914175 - RNA, 15 nt, Shigella flexneri 2a str. 2457T
uuccagaauaucuuc

SEQ ID NO: 1914176 - RNA, 13 nt, Shigella flexneri 2a str. 2457T
uuccagaauaucu

SEQ ID NO: 1914177 - RNA, 12 nt, Shigella flexneri 2a str. 2457T
uuccacuucauc

SEQ ID NO: 1914178 - RNA, 15 nt, Shigella flexneri 2a str. 2457T
uuccacuucacggcu

SEQ ID NO: 1914179 - RNA, 13 nt, Shigella flexneri 2a str. 2457T
uuccacuucauca

SEQ ID NO: 1914180 - RNA, 19 nt, Shigella flexneri 2a str. 2457T
uuccacucauuaauuuccu

SEQ ID NO: 1914181 - RNA, 19 nt, Shigella flexneri 2a str. 2457T
uuccaccaccacagacaau

SEQ ID NO: 1914182 - RNA, 17 nt, Shigella flexneri 2a str. 2457T
uuccacauaaaguagcc

SEQ ID NO: 1914183 - RNA, 18 nt, Shigella flexneri 2a str. 2457T
uuccacagcucacggccc

SEQ ID NO: 1914184 - RNA, 21 nt, Shigella flexneri 2a str. 2457T
uuccacccacggcguuaacug

SEQ ID NO: 1914185 - RNA, 20 nt, Shigella flexneri 2a str. 2457T
uuccaccagcggcugaauau

SEQ ID NO: 1914186 - RNA, 17 nt, Shigella flexneri 2a str. 2457T
uucaggccgcgcaguuc

SEQ ID NO: 1914187 - RNA, 13 nt, Shigella flexneri 2a str. 2457T
uucaggcgcugaa

SEQ ID NO: 1914188 - RNA, 17 nt, Shigella flexneri 2a str. 2457T
uuccauauugucuucaa

SEQ ID NO: 1914189 - RNA, 15 nt, Shigella flexneri 2a str. 2457T
uuccauaccuaaaaa

SEQ ID NO: 1914190 - RNA, 18 nt, Shigella flexneri 2a str. 2457T
uuccauaccgaccaugua

SEQ ID NO: 1914191 - RNA, 23 nt, Shigella flexneri 2a str. 2457T
uuccauccggcaacaucaaauua

SEQ ID NO: 1914192 - RNA, 17 nt, Shigella flexneri 2a str. 2457T
uuccaucuuuccucacu

SEQ ID NO: 1914193 - RNA, 17 nt, Shigella flexneri 2a str. 2457T
uuccauuucccugacaa

SEQ ID NO: 1914194 - RNA, 16 nt, Shigella flexneri 2a str. 2457T
uuccauugccgcuuuc

SEQ ID NO: 1914195 - RNA, 14 nt, Shigella flexneri 2a str. 2457T
uuccagcugugcca

SEQ ID NO: 1914196 - RNA, 20 nt, Shigella flexneri 2a str. 2457T
uuccagcuucgcuaccugag

SEQ ID NO: 1914197 - RNA, 13 nt, Shigella flexneri 2a str. 2457T
uuccaggcaucag

SEQ ID NO: 1914198 - RNA, 22 nt, Shigella flexneri 2a str. 2457T
uuccaggcuggcaggccucaug

SEQ ID NO: 1914199 - RNA, 14 nt, Shigella flexneri 2a str. 2457T
uuccagggcagcag

SEQ ID NO: 1914200 - RNA, 12 nt, Shigella flexneri 2a str. 2457T
uuccagcggcag

SEQ ID NO: 1914201 - RNA, 15 nt, Shigella flexneri 2a str. 2457T
uuccagcggcaggcc

SEQ ID NO: 1914202 - RNA, 16 nt, Shigella flexneri 2a str. 2457T
uuccagcggcaggccg

SEQ ID NO: 1914203 - RNA, 18 nt, Shigella flexneri 2a str. 2457T
uuccagcgguaacuuauc

SEQ ID NO: 1914204 - RNA, 18 nt, Shigella flexneri 2a str. 2457T
uuccagcucaaccagauu

SEQ ID NO: 1914205 - RNA, 21 nt, Shigella flexneri 2a str. 2457T
uuccagcguagugaaggcaaa

SEQ ID NO: 1914206 - RNA, 23 nt, Shigella flexneri 2a str. 2457T
uuccagucggcguaauccugaaa

SEQ ID NO: 1914207 - RNA, 22 nt, Shigella flexneri 2a str. 2457T
uuccaguguuuccggaauuaaa

SEQ ID NO: 1914208 - RNA, 18 nt, Shigella flexneri 2a str. 2457T
uuccauaagcccagaaca

SEQ ID NO: 1914209 - RNA, 23 nt, Shigella flexneri 2a str. 2457T
uuccauaaucgacucccgcgccg

SEQ ID NO: 1914210 - RNA, 16 nt, Shigella flexneri 2a str. 2457T
uuccagggccucuccu

SEQ ID NO: 1914211 - RNA, 22 nt, Shigella flexneri 2a str. 2457T
uuccagguuauuuuauuucugu

SEQ ID NO: 1914212 - RNA, 22 nt, Shigella flexneri 2a str. 2457T
uuccagucggcguaauccugaa

SEQ ID NO: 1914213 - RNA, 22 nt, Shigella flexneri 2a str. 2457T
uuccaguuccggcaucgacagu

SEQ ID NO: 1914214 - RNA, 20 nt, Shigella flexneri 2a str. 2457T
uucgcagagugauucuuugu

SEQ ID NO: 1914215 - RNA, 15 nt, Shigella flexneri 2a str. 2457T
uucgcaccaaaucca

SEQ ID NO: 1914216 - RNA, 13 nt, Shigella flexneri 2a str. 2457T
uucgaacauuucg

SEQ ID NO: 1914217 - RNA, 19 nt, Shigella flexneri 2a str. 2457T
uucgaaauagagaaaguaa

SEQ ID NO: 1914218 - RNA, 16 nt, Shigella flexneri 2a str. 2457T
uuccuuggauauuuua

SEQ ID NO: 1914219 - RNA, 14 nt, Shigella flexneri 2a str. 2457T
uucgcugccacacc

SEQ ID NO: 1914220 - RNA, 16 nt, Shigella flexneri 2a str. 2457T
uucgcuggaauaaucg

SEQ ID NO: 1914221 - RNA, 20 nt, Shigella flexneri 2a str. 2457T
uucgcuacgaucgauaacca

SEQ ID NO: 1914222 - RNA, 19 nt, Shigella flexneri 2a str. 2457T
uucgcuaacguuuuuaaaa

SEQ ID NO: 1914223 - RNA, 16 nt, Shigella flexneri 2a str. 2457T
uucgccuuucaguuca

SEQ ID NO: 1914224 - RNA, 23 nt, Shigella flexneri 2a str. 2457T
uucgccgcagcaucgucaucauu

SEQ ID NO: 1914225 - RNA, 20 nt, Shigella flexneri 2a str. 2457T
uucgccaaaucgcugcugcu

SEQ ID NO: 1914226 - RNA, 16 nt, Shigella flexneri 2a str. 2457T
uucgccgguuccagcu

SEQ ID NO: 1914227 - RNA, 15 nt, Shigella flexneri 2a str. 2457T
uucgccugccugcag

SEQ ID NO: 1914228 - RNA, 23 nt, Shigella flexneri 2a str. 2457T
uucuaacgacauuuucugcccau

SEQ ID NO: 1914229 - RNA, 22 nt, Shigella flexneri 2a str. 2457T
uucguuaacaacaacuucuaau

SEQ ID NO: 1914230 - RNA, 19 nt, Shigella flexneri 2a str. 2457T
uucguguggaguaauaauu

SEQ ID NO: 1914231 - RNA, 14 nt, Shigella flexneri 2a str. 2457T
uucguaauaauuca

SEQ ID NO: 1914232 - RNA, 17 nt, Shigella flexneri 2a str. 2457T
uucguaaguacauuaaa

SEQ ID NO: 1914233 - RNA, 19 nt, Shigella flexneri 2a str. 2457T
uucguaaguacauuaaaau

SEQ ID NO: 1914234 - RNA, 22 nt, Shigella flexneri 2a str. 2457T
uucgguguuuuuacgaaacaga

SEQ ID NO: 1914235 - RNA, 15 nt, Shigella flexneri 2a str. 2457T
uucgguugccagcgc

SEQ ID NO: 1914236 - RNA, 23 nt, Shigella flexneri 2a str. 2457T
uucguaaacgacugauugaacug

SEQ ID NO: 1914237 - RNA, 17 nt, Shigella flexneri 2a str. 2457T
uucgcuuucacucagug

SEQ ID NO: 1914238 - RNA, 16 nt, Shigella flexneri 2a str. 2457T
uucgcuggauuuuuga

SEQ ID NO: 1914239 - RNA, 16 nt, Shigella flexneri 2a str. 2457T
uucgcuuaccaugcca

SEQ ID NO: 1914240 - RNA, 18 nt, Shigella flexneri 2a str. 2457T
uucgcuuacgccugccag

SEQ ID NO: 1914241 - RNA, 17 nt, Shigella flexneri 2a str. 2457T
uucggacguuugccaug

SEQ ID NO: 1914242 - RNA, 22 nt, Shigella flexneri 2a str. 2457T
uucggugauauacgucacuuca

SEQ ID NO: 1914243 - RNA, 23 nt, Shigella flexneri 2a str. 2457T
uucggugauauacgucacuucau

SEQ ID NO: 1914244 - RNA, 18 nt, Shigella flexneri 2a str. 2457T
uucugcacuuuucugggu

SEQ ID NO: 1914245 - RNA, 13 nt, Shigella flexneri 2a str. 2457T
uucugcagcucca

SEQ ID NO: 1914246 - RNA, 19 nt, Shigella flexneri 2a str. 2457T
uucugcaagaggaaauaag

SEQ ID NO: 1914247 - RNA, 20 nt, Shigella flexneri 2a str. 2457T
uucugauuuaaucuguauca

SEQ ID NO: 1914248 - RNA, 20 nt, Shigella flexneri 2a str. 2457T
uucugauugccgcuuucggc

SEQ ID NO: 1914249 - RNA, 17 nt, Shigella flexneri 2a str. 2457T
uucucuguucagccuga

SEQ ID NO: 1914250 - RNA, 17 nt, Shigella flexneri 2a str. 2457T
uucucugacgcucucua

SEQ ID NO: 1914251 - RNA, 15 nt, Shigella flexneri 2a str. 2457T
uucucggcaauaauu

SEQ ID NO: 1914252 - RNA, 19 nt, Shigella flexneri 2a str. 2457T
uucucggcaucacgcuuga

SEQ ID NO: 1914253 - RNA, 14 nt, Shigella flexneri 2a str. 2457T
uucucuauuucacc

SEQ ID NO: 1914254 - RNA, 15 nt, Shigella flexneri 2a str. 2457T
uucucuacgcccucg

SEQ ID NO: 1914255 - RNA, 18 nt, Shigella flexneri 2a str. 2457T
uucucgccguggcuguug

SEQ ID NO: 1914256 - RNA, 14 nt, Shigella flexneri 2a str. 2457T
uucucaccagcuga

SEQ ID NO: 1914257 - RNA, 22 nt, Shigella flexneri 2a str. 2457T
uucucagagacucuuaaaauau

SEQ ID NO: 1914258 - RNA, 20 nt, Shigella flexneri 2a str. 2457T
uucucagguagcgcauaagc

SEQ ID NO: 1914259 - RNA, 12 nt, Shigella flexneri 2a str. 2457T
uucucauaaaac

SEQ ID NO: 1914260 - RNA, 15 nt, Shigella flexneri 2a str. 2457T
uucuacacccagccc

SEQ ID NO: 1914261 - RNA, 20 nt, Shigella flexneri 2a str. 2457T
uucuaauuuuuccagcauuu

SEQ ID NO: 1914262 - RNA, 21 nt, Shigella flexneri 2a str. 2457T
uucuauaccgugcacaauauu

SEQ ID NO: 1914263 - RNA, 12 nt, Shigella flexneri 2a str. 2457T
uuaucaauuccu

SEQ ID NO: 1914264 - RNA, 19 nt, Shigella flexneri 2a str. 2457T
uuaucaccuguugcccuuu

SEQ ID NO: 1914265 - RNA, 21 nt, Shigella flexneri 2a str. 2457T
uuaucagcaacuggcaaaaac

SEQ ID NO: 1914266 - RNA, 17 nt, Shigella flexneri 2a str. 2457T
uuaucagaaccgcccag

SEQ ID NO: 1914267 - RNA, 22 nt, Shigella flexneri 2a str. 2457T
uuaucagacaccgauugccccu

SEQ ID NO: 1914268 - RNA, 13 nt, Shigella flexneri 2a str. 2457T
uuaucagaucacg

SEQ ID NO: 1914269 - RNA, 23 nt, Shigella flexneri 2a str. 2457T
uuaucacgaugcuaaaaacauca

SEQ ID NO: 1914270 - RNA, 22 nt, Shigella flexneri 2a str. 2457T
uuaucacgcaaccacaacgcac

SEQ ID NO: 1914271 - RNA, 11 nt, Shigella flexneri 2a str. 2457T
uuaucaggccu

SEQ ID NO: 1914272 - RNA, 18 nt, Shigella flexneri 2a str. 2457T
uuaucaggccuacaaaau

SEQ ID NO: 1914273 - RNA, 22 nt, Shigella flexneri 2a str. 2457T
uuaucaggccuacaauguuucu

SEQ ID NO: 1914274 - RNA, 14 nt, Shigella flexneri 2a str. 2457T
uuaucaggccuaca

SEQ ID NO: 1914275 - RNA, 17 nt, Shigella flexneri 2a str. 2457T
uuaucaggccuacaaaa

SEQ ID NO: 1914276 - RNA, 21 nt, Shigella flexneri 2a str. 2457T
uuaucaggccuacauuuucuc

SEQ ID NO: 1914277 - RNA, 20 nt, Shigella flexneri 2a str. 2457T
uuaucaggccuacgacuuuc

SEQ ID NO: 1914278 - RNA, 11 nt, Shigella flexneri 2a str. 2457T
uuaucaucacc

SEQ ID NO: 1914279 - RNA, 11 nt, Shigella flexneri 2a str. 2457T
uuaucaugccu

SEQ ID NO: 1914280 - RNA, 23 nt, Shigella flexneri 2a str. 2457T
uuauccgccagugccaaagccag

SEQ ID NO: 1914281 - RNA, 22 nt, Shigella flexneri 2a str. 2457T
uuauccgcaucacuccacacca

SEQ ID NO: 1914282 - RNA, 20 nt, Shigella flexneri 2a str. 2457T
uuaucccaauuaucuggaau

SEQ ID NO: 1914283 - RNA, 21 nt, Shigella flexneri 2a str. 2457T
uuaucccgauuaaucagugca

SEQ ID NO: 1914284 - RNA, 17 nt, Shigella flexneri 2a str. 2457T
uuauccagccuacaaaa

SEQ ID NO: 1914285 - RNA, 23 nt, Shigella flexneri 2a str. 2457T
uuauccaucaaagguuuuucagu

SEQ ID NO: 1914286 - RNA, 11 nt, Shigella flexneri 2a str. 2457T
uuauccagcaa

SEQ ID NO: 1914287 - RNA, 22 nt, Shigella flexneri 2a str. 2457T
uuauccuucgauaaaagccauc

SEQ ID NO: 1914288 - RNA, 19 nt, Shigella flexneri 2a str. 2457T
uuaucgacugccagaguca

SEQ ID NO: 1914289 - RNA, 17 nt, Shigella flexneri 2a str. 2457T
uuauccgucagccacuc

SEQ ID NO: 1914290 - RNA, 11 nt, Shigella flexneri 2a str. 2457T
uuauccggccu

SEQ ID NO: 1914291 - RNA, 17 nt, Shigella flexneri 2a str. 2457T
uuauccggcuaacaaaa

SEQ ID NO: 1914292 - RNA, 13 nt, Shigella flexneri 2a str. 2457T
uuaucaagauauu

SEQ ID NO: 1914293 - RNA, 16 nt, Shigella flexneri 2a str. 2457T
uuauauuugaacaucg

SEQ ID NO: 1914294 - RNA, 11 nt, Shigella flexneri 2a str. 2457T
uuauauuguuu

SEQ ID NO: 1914295 - RNA, 23 nt, Shigella flexneri 2a str. 2457T
uuauauuacgaauauaaauauuu

SEQ ID NO: 1914296 - RNA, 21 nt, Shigella flexneri 2a str. 2457T
uuauauugauuaccaauauca

SEQ ID NO: 1914297 - RNA, 14 nt, Shigella flexneri 2a str. 2457T
uuauaucucagaua

SEQ ID NO: 1914298 - RNA, 16 nt, Shigella flexneri 2a str. 2457T
uuauaucccauuuuug

SEQ ID NO: 1914299 - RNA, 16 nt, Shigella flexneri 2a str. 2457T
uuauaucagugauaua

SEQ ID NO: 1914300 - RNA, 19 nt, Shigella flexneri 2a str. 2457T
uuauaucagugauauauuu

SEQ ID NO: 1914301 - RNA, 17 nt, Shigella flexneri 2a str. 2457T
uuauauaacgccauauu

SEQ ID NO: 1914302 - RNA, 17 nt, Shigella flexneri 2a str. 2457T
uuauaggguaaauuacc

SEQ ID NO: 1914303 - RNA, 17 nt, Shigella flexneri 2a str. 2457T
uuauagcucaacgcugc

SEQ ID NO: 1914304 - RNA, 14 nt, Shigella flexneri 2a str. 2457T
uuauagcaguaauu

SEQ ID NO: 1914305 - RNA, 23 nt, Shigella flexneri 2a str. 2457T
uuauagcauagcguugauuagac

SEQ ID NO: 1914306 - RNA, 19 nt, Shigella flexneri 2a str. 2457T
uuaugaaauaucuucaaua

SEQ ID NO: 1914307 - RNA, 13 nt, Shigella flexneri 2a str. 2457T
uuaugaggaugca

SEQ ID NO: 1914308 - RNA, 14 nt, Shigella flexneri 2a str. 2457T
uuaugaucaucaag

SEQ ID NO: 1914309 - RNA, 11 nt, Shigella flexneri 2a str. 2457T
uuaucuucaca

SEQ ID NO: 1914310 - RNA, 17 nt, Shigella flexneri 2a str. 2457T
uuaucuucgcacuuacc

SEQ ID NO: 1914311 - RNA, 21 nt, Shigella flexneri 2a str. 2457T
uuaucuggcauuugcacugaa

SEQ ID NO: 1914312 - RNA, 22 nt, Shigella flexneri 2a str. 2457T
uuaucuggaauuccuuucccua

SEQ ID NO: 1914313 - RNA, 20 nt, Shigella flexneri 2a str. 2457T
uuaucugccgaacaggcugc

SEQ ID NO: 1914314 - RNA, 22 nt, Shigella flexneri 2a str. 2457T
uuaucgcgucuaaauuuugcau

SEQ ID NO: 1914315 - RNA, 16 nt, Shigella flexneri 2a str. 2457T
uuaucgcgccaucaaa

SEQ ID NO: 1914316 - RNA, 20 nt, Shigella flexneri 2a str. 2457T
uuaucucccuguaucccagu

SEQ ID NO: 1914317 - RNA, 15 nt, Shigella flexneri 2a str. 2457T
uuaucucaacacacg

SEQ ID NO: 1914318 - RNA, 20 nt, Shigella flexneri 2a str. 2457T
uuaucuacagcauuuccuua

SEQ ID NO: 1914319 - RNA, 13 nt, Shigella flexneri 2a str. 2457T
uuauuaaacagac

SEQ ID NO: 1914320 - RNA, 17 nt, Shigella flexneri 2a str. 2457T
uuauuaaauuuaauaau

SEQ ID NO: 1914321 - RNA, 20 nt, Shigella flexneri 2a str. 2457T
uuauguucagccgucaucca

SEQ ID NO: 1914322 - RNA, 19 nt, Shigella flexneri 2a str. 2457T
uuauguggcccuauugauu

SEQ ID NO: 1914323 - RNA, 21 nt, Shigella flexneri 2a str. 2457T
uuauggauaaaggccugccgc

SEQ ID NO: 1914324 - RNA, 14 nt, Shigella flexneri 2a str. 2457T
uuauggaucuggag

SEQ ID NO: 1914325 - RNA, 23 nt, Shigella flexneri 2a str. 2457T
uuaugcaauagcgccugcugcug

SEQ ID NO: 1914326 - RNA, 21 nt, Shigella flexneri 2a str. 2457T
uuaugcacaccccgcgcagcu

SEQ ID NO: 1914327 - RNA, 22 nt, Shigella flexneri 2a str. 2457T
uuauguaacaacuggcggucau

SEQ ID NO: 1914328 - RNA, 21 nt, Shigella flexneri 2a str. 2457T
uuauggcuggcuggcaucuug

SEQ ID NO: 1914329 - RNA, 18 nt, Shigella flexneri 2a str. 2457T
uuauggcucgccauccag

SEQ ID NO: 1914330 - RNA, 14 nt, Shigella flexneri 2a str. 2457T
uucagcagcggcac

SEQ ID NO: 1914331 - RNA, 18 nt, Shigella flexneri 2a str. 2457T
uucagcagcggcacacaa

SEQ ID NO: 1914332 - RNA, 20 nt, Shigella flexneri 2a str. 2457T
uucagcagcggcucggucag

SEQ ID NO: 1914333 - RNA, 13 nt, Shigella flexneri 2a str. 2457T
uucagcaguuuuu

SEQ ID NO: 1914334 - RNA, 23 nt, Shigella flexneri 2a str. 2457T
uucagccgcaaaccuggcaacaa

SEQ ID NO: 1914335 - RNA, 14 nt, Shigella flexneri 2a str. 2457T
uucagcucaagaau

SEQ ID NO: 1914336 - RNA, 16 nt, Shigella flexneri 2a str. 2457T
uucagccggaauaauc

SEQ ID NO: 1914337 - RNA, 16 nt, Shigella flexneri 2a str. 2457T
uucaggaacaccgcac

SEQ ID NO: 1914338 - RNA, 20 nt, Shigella flexneri 2a str. 2457T
uucagcuuuuuagcgaucuc

SEQ ID NO: 1914339 - RNA, 17 nt, Shigella flexneri 2a str. 2457T
uucagcuuauucaucaa

SEQ ID NO: 1914340 - RNA, 22 nt, Shigella flexneri 2a str. 2457T
uucaggcaguaugcucagaaua

SEQ ID NO: 1914341 - RNA, 23 nt, Shigella flexneri 2a str. 2457T
uucaggauggucaacgucaacuu

SEQ ID NO: 1914342 - RNA, 15 nt, Shigella flexneri 2a str. 2457T
uucaggaugguauug

SEQ ID NO: 1914343 - RNA, 21 nt, Shigella flexneri 2a str. 2457T
uucaggauauuuauauuuugc

SEQ ID NO: 1914344 - RNA, 14 nt, Shigella flexneri 2a str. 2457T
uucagaaucaaguc

SEQ ID NO: 1914345 - RNA, 17 nt, Shigella flexneri 2a str. 2457T
uucagaagcugaagcag

SEQ ID NO: 1914346 - RNA, 13 nt, Shigella flexneri 2a str. 2457T
uucacuauuucuu

SEQ ID NO: 1914347 - RNA, 14 nt, Shigella flexneri 2a str. 2457T
uucagaccaauaau

SEQ ID NO: 1914348 - RNA, 13 nt, Shigella flexneri 2a str. 2457T
uucagaccaauaa

SEQ ID NO: 1914349 - RNA, 20 nt, Shigella flexneri 2a str. 2457T
uucagcaauucucucuucag

SEQ ID NO: 1914350 - RNA, 11 nt, Shigella flexneri 2a str. 2457T
uucagcaauac

SEQ ID NO: 1914351 - RNA, 13 nt, Shigella flexneri 2a str. 2457T
uucagcagcccau

SEQ ID NO: 1914352 - RNA, 12 nt, Shigella flexneri 2a str. 2457T
uucagcaaaugg

SEQ ID NO: 1914353 - RNA, 21 nt, Shigella flexneri 2a str. 2457T
uucacccaucacuaccugauu

SEQ ID NO: 1914354 - RNA, 15 nt, Shigella flexneri 2a str. 2457T
uucacccaccggaau

SEQ ID NO: 1914355 - RNA, 22 nt, Shigella flexneri 2a str. 2457T
uucacaucauccggcaccuuuu

SEQ ID NO: 1914356 - RNA, 20 nt, Shigella flexneri 2a str. 2457T
uucaccguaauaguuucuga

SEQ ID NO: 1914357 - RNA, 19 nt, Shigella flexneri 2a str. 2457T
uucaccgauaaaagcccug

SEQ ID NO: 1914358 - RNA, 23 nt, Shigella flexneri 2a str. 2457T
uucaccggauaaucggcaauacu

SEQ ID NO: 1914359 - RNA, 14 nt, Shigella flexneri 2a str. 2457T
uucacgcacuuccg

SEQ ID NO: 1914360 - RNA, 13 nt, Shigella flexneri 2a str. 2457T
uucacguucaccc

SEQ ID NO: 1914361 - RNA, 16 nt, Shigella flexneri 2a str. 2457T
uucacgaauauuuccc

SEQ ID NO: 1914362 - RNA, 22 nt, Shigella flexneri 2a str. 2457T
uucacgagagauacgcuugccg

SEQ ID NO: 1914363 - RNA, 15 nt, Shigella flexneri 2a str. 2457T
uucacgaauauuucc

SEQ ID NO: 1914364 - RNA, 20 nt, Shigella flexneri 2a str. 2457T
uucaccucuucauuaaacca

SEQ ID NO: 1914365 - RNA, 21 nt, Shigella flexneri 2a str. 2457T
uucaauauauugaauuugcau

SEQ ID NO: 1914366 - RNA, 14 nt, Shigella flexneri 2a str. 2457T
uucaauauauugca

SEQ ID NO: 1914367 - RNA, 21 nt, Shigella flexneri 2a str. 2457T
uucaauauauugcugaaauaa

SEQ ID NO: 1914368 - RNA, 23 nt, Shigella flexneri 2a str. 2457T
uucacacccgguaucaaacccuu

SEQ ID NO: 1914369 - RNA, 22 nt, Shigella flexneri 2a str. 2457T
uucacaguuaaguuaauucuga

SEQ ID NO: 1914370 - RNA, 16 nt, Shigella flexneri 2a str. 2457T
uucacauauugcagcu

SEQ ID NO: 1914371 - RNA, 19 nt, Shigella flexneri 2a str. 2457T
uucacaggccgccaggcag

SEQ ID NO: 1914372 - RNA, 18 nt, Shigella flexneri 2a str. 2457T
uucacaggccgccaggca

SEQ ID NO: 1914373 - RNA, 12 nt, Shigella flexneri 2a str. 2457T
uuauuugcugca

SEQ ID NO: 1914374 - RNA, 17 nt, Shigella flexneri 2a str. 2457T
uucaaaaaccugaccua

SEQ ID NO: 1914375 - RNA, 21 nt, Shigella flexneri 2a str. 2457T
uucaaaagccccggaauucuc

SEQ ID NO: 1914376 - RNA, 19 nt, Shigella flexneri 2a str. 2457T
uucaaaagaugagaaaaau

SEQ ID NO: 1914377 - RNA, 16 nt, Shigella flexneri 2a str. 2457T
uucaaaagaugagaaa

SEQ ID NO: 1914378 - RNA, 18 nt, Shigella flexneri 2a str. 2457T
uucaacaucaucucccac

SEQ ID NO: 1914379 - RNA, 22 nt, Shigella flexneri 2a str. 2457T
uucaacauauccuucacacaua

SEQ ID NO: 1914380 - RNA, 23 nt, Shigella flexneri 2a str. 2457T
uucaaacacccgaccaucaacua

SEQ ID NO: 1914381 - RNA, 18 nt, Shigella flexneri 2a str. 2457T
uucaacauguugaaauuc

SEQ ID NO: 1914382 - RNA, 18 nt, Shigella flexneri 2a str. 2457T
uucaauaaauugcaggaa

SEQ ID NO: 1914383 - RNA, 15 nt, Shigella flexneri 2a str. 2457T
uucaauaacuccauc

SEQ ID NO: 1914384 - RNA, 22 nt, Shigella flexneri 2a str. 2457T
uucaauaaccugcaaaauaguc

SEQ ID NO: 1914385 - RNA, 16 nt, Shigella flexneri 2a str. 2457T
uucaauaaccugcaaa

SEQ ID NO: 1914386 - RNA, 18 nt, Shigella flexneri 2a str. 2457T
uucaauaccgccugcaaa

SEQ ID NO: 1914387 - RNA, 21 nt, Shigella flexneri 2a str. 2457T
uucaauaccgccugcaaauaa

SEQ ID NO: 1914388 - RNA, 23 nt, Shigella flexneri 2a str. 2457T
uucaauaccgccugcaaauaaau

SEQ ID NO: 1914389 - RNA, 19 nt, Shigella flexneri 2a str. 2457T
uucaagacaucaauaaaca

SEQ ID NO: 1914390 - RNA, 23 nt, Shigella flexneri 2a str. 2457T
uucaagacgaauaccuucuuccu

SEQ ID NO: 1914391 - RNA, 17 nt, Shigella flexneri 2a str. 2457T
uucaagacgccguccau

SEQ ID NO: 1914392 - RNA, 21 nt, Shigella flexneri 2a str. 2457T
uucaacgccgcuaucagauuc

SEQ ID NO: 1914393 - RNA, 19 nt, Shigella flexneri 2a str. 2457T
uucaacgcacccuauuuuu

SEQ ID NO: 1914394 - RNA, 20 nt, Shigella flexneri 2a str. 2457T
uucaacgcagcgccauauaa

SEQ ID NO: 1914395 - RNA, 23 nt, Shigella flexneri 2a str. 2457T
uucaacgacccagccagacgcca

SEQ ID NO: 1914396 - RNA, 16 nt, Shigella flexneri 2a str. 2457T
uuagcaucagcgccac

SEQ ID NO: 1914397 - RNA, 16 nt, Shigella flexneri 2a str. 2457T
uuagaggucaguuuga

SEQ ID NO: 1914398 - RNA, 17 nt, Shigella flexneri 2a str. 2457T
uuagaauaccugccugu

SEQ ID NO: 1914399 - RNA, 14 nt, Shigella flexneri 2a str. 2457T
uuagagcacaucac

SEQ ID NO: 1914400 - RNA, 13 nt, Shigella flexneri 2a str. 2457T
uuagacuuuaguc

SEQ ID NO: 1914401 - RNA, 23 nt, Shigella flexneri 2a str. 2457T
uuagacuuuagucaucagucuga

SEQ ID NO: 1914402 - RNA, 16 nt, Shigella flexneri 2a str. 2457T
uuagccgccagcucuu

SEQ ID NO: 1914403 - RNA, 21 nt, Shigella flexneri 2a str. 2457T
uuagccaggcaccgaaaauca

SEQ ID NO: 1914404 - RNA, 14 nt, Shigella flexneri 2a str. 2457T
uuagcccaauaauc

SEQ ID NO: 1914405 - RNA, 21 nt, Shigella flexneri 2a str. 2457T
uuagcaucagcgccaccagcg

SEQ ID NO: 1914406 - RNA, 13 nt, Shigella flexneri 2a str. 2457T
uuagggugagggg

SEQ ID NO: 1914407 - RNA, 20 nt, Shigella flexneri 2a str. 2457T
uuagggugaggggaacccgu

SEQ ID NO: 1914408 - RNA, 16 nt, Shigella flexneri 2a str. 2457T
uuagcuuucuuuuucu

SEQ ID NO: 1914409 - RNA, 13 nt, Shigella flexneri 2a str. 2457T
uuagccgguuuuu

SEQ ID NO: 1914410 - RNA, 18 nt, Shigella flexneri 2a str. 2457T
uuacuggaguuauucauu

SEQ ID NO: 1914411 - RNA, 22 nt, Shigella flexneri 2a str. 2457T
uuacugcguauuuccugccaga

SEQ ID NO: 1914412 - RNA, 15 nt, Shigella flexneri 2a str. 2457T
uuacugccaccaucc

SEQ ID NO: 1914413 - RNA, 20 nt, Shigella flexneri 2a str. 2457T
uuacugcauugaauuucuau

SEQ ID NO: 1914414 - RNA, 11 nt, Shigella flexneri 2a str. 2457T
uuacuccagau

SEQ ID NO: 1914415 - RNA, 20 nt, Shigella flexneri 2a str. 2457T
uuacugacuagaugugcagu

SEQ ID NO: 1914416 - RNA, 17 nt, Shigella flexneri 2a str. 2457T
uuacuggcuuucauuuu

SEQ ID NO: 1914417 - RNA, 23 nt, Shigella flexneri 2a str. 2457T
uuacuucugcugcacgaaauugc

SEQ ID NO: 1914418 - RNA, 23 nt, Shigella flexneri 2a str. 2457T
uuacuugcugcucugaagguugu

SEQ ID NO: 1914419 - RNA, 13 nt, Shigella flexneri 2a str. 2457T
uuacucauaaaua

SEQ ID NO: 1914420 - RNA, 19 nt, Shigella flexneri 2a str. 2457T
uuacucauuucuguauaau

SEQ ID NO: 1914421 - RNA, 21 nt, Shigella flexneri 2a str. 2457T
uuacucauuucuguauaauca

SEQ ID NO: 1914422 - RNA, 21 nt, Shigella flexneri 2a str. 2457T
uuacucauccacugccuguca

SEQ ID NO: 1914423 - RNA, 23 nt, Shigella flexneri 2a str. 2457T
uuacccuacaccaugccggugau

SEQ ID NO: 1914424 - RNA, 15 nt, Shigella flexneri 2a str. 2457T
uuacccugugacaga

SEQ ID NO: 1914425 - RNA, 22 nt, Shigella flexneri 2a str. 2457T
uuaccgauccccggauucaugc

SEQ ID NO: 1914426 - RNA, 19 nt, Shigella flexneri 2a str. 2457T
uuaccgcccccgcuaucca

SEQ ID NO: 1914427 - RNA, 14 nt, Shigella flexneri 2a str. 2457T
uuaccgccaccagg

SEQ ID NO: 1914428 - RNA, 13 nt, Shigella flexneri 2a str. 2457T
uuaccgcaucuua

SEQ ID NO: 1914429 - RNA, 17 nt, Shigella flexneri 2a str. 2457T
uuacgugcacaggcaac

SEQ ID NO: 1914430 - RNA, 21 nt, Shigella flexneri 2a str. 2457T
uuauacagacucaaaccaaug

SEQ ID NO: 1914431 - RNA, 18 nt, Shigella flexneri 2a str. 2457T
uuauaagccaguaagaca

SEQ ID NO: 1914432 - RNA, 12 nt, Shigella flexneri 2a str. 2457T
uuauaagccaug

SEQ ID NO: 1914433 - RNA, 16 nt, Shigella flexneri 2a str. 2457T
uuauaagccauguuua

SEQ ID NO: 1914434 - RNA, 13 nt, Shigella flexneri 2a str. 2457T
uuauaaauaaaaa

SEQ ID NO: 1914435 - RNA, 16 nt, Shigella flexneri 2a str. 2457T
uuauaaauaaaaagag

SEQ ID NO: 1914436 - RNA, 14 nt, Shigella flexneri 2a str. 2457T
uuauaaauaaaaau

SEQ ID NO: 1914437 - RNA, 21 nt, Shigella flexneri 2a str. 2457T
uuagugcugcuggaagguaag

SEQ ID NO: 1914438 - RNA, 22 nt, Shigella flexneri 2a str. 2457T
uuagugccgcuggcauacaguu

SEQ ID NO: 1914439 - RNA, 16 nt, Shigella flexneri 2a str. 2457T
uuaguuuuauacucag

SEQ ID NO: 1914440 - RNA, 19 nt, Shigella flexneri 2a str. 2457T
uuaguaaacgcguagaucu

SEQ ID NO: 1914441 - RNA, 22 nt, Shigella flexneri 2a str. 2457T
uuagguacaaagccaacagcag

SEQ ID NO: 1914442 - RNA, 14 nt, Shigella flexneri 2a str. 2457T
uuagguaaugacuc

SEQ ID NO: 1914443 - RNA, 17 nt, Shigella flexneri 2a str. 2457T
uuagguacaaagccaac

SEQ ID NO: 1914444 - RNA, 13 nt, Shigella flexneri 2a str. 2457T
uuaguaugaagaa

SEQ ID NO: 1914445 - RNA, 18 nt, Shigella flexneri 2a str. 2457T
uuagucccaaacagcaga

SEQ ID NO: 1914446 - RNA, 20 nt, Shigella flexneri 2a str. 2457T
uuagucgcccauuuugccac

SEQ ID NO: 1914447 - RNA, 19 nt, Shigella flexneri 2a str. 2457T
uuagucgucgccgauaauu

SEQ ID NO: 1914448 - RNA, 23 nt, Shigella flexneri 2a str. 2457T
uuagucgucgccgauaauuuuca

SEQ ID NO: 1914449 - RNA, 12 nt, Shigella flexneri 2a str. 2457T
uuaguaucuauu

SEQ ID NO: 1914450 - RNA, 19 nt, Shigella flexneri 2a str. 2457T
uuacaugcugguguaacuu

SEQ ID NO: 1914451 - RNA, 21 nt, Shigella flexneri 2a str. 2457T
uuacaugcgcgacaaaaauua

SEQ ID NO: 1914452 - RNA, 20 nt, Shigella flexneri 2a str. 2457T
uuacaugcgcgacaaaaauu

SEQ ID NO: 1914453 - RNA, 17 nt, Shigella flexneri 2a str. 2457T
uuacauuuuaauaauga

SEQ ID NO: 1914454 - RNA, 22 nt, Shigella flexneri 2a str. 2457T
uuacauuaucgcgucuaaauuu

SEQ ID NO: 1914455 - RNA, 23 nt, Shigella flexneri 2a str. 2457T
uuaccaccuuacuuacacaucaa

SEQ ID NO: 1914456 - RNA, 18 nt, Shigella flexneri 2a str. 2457T
uuaccaccgucaaaaaaa

SEQ ID NO: 1914457 - RNA, 19 nt, Shigella flexneri 2a str. 2457T
uuaccacaccggcaauaau

SEQ ID NO: 1914458 - RNA, 22 nt, Shigella flexneri 2a str. 2457T
uuaccaaauaaacgaaucugca

SEQ ID NO: 1914459 - RNA, 14 nt, Shigella flexneri 2a str. 2457T
uuacagcucucacu

SEQ ID NO: 1914460 - RNA, 23 nt, Shigella flexneri 2a str. 2457T
uuaauggcgauuagaaacagaau

SEQ ID NO: 1914461 - RNA, 16 nt, Shigella flexneri 2a str. 2457T
uuaauggcaaaaacuu

SEQ ID NO: 1914462 - RNA, 13 nt, Shigella flexneri 2a str. 2457T
uuaaugcgcuuuu

SEQ ID NO: 1914463 - RNA, 19 nt, Shigella flexneri 2a str. 2457T
uuaaugccucuccccagcg

SEQ ID NO: 1914464 - RNA, 19 nt, Shigella flexneri 2a str. 2457T
uuaaugccacauuagauaa

SEQ ID NO: 1914465 - RNA, 22 nt, Shigella flexneri 2a str. 2457T
uuaaugccacauuagauaaaaa

SEQ ID NO: 1914466 - RNA, 18 nt, Shigella flexneri 2a str. 2457T
uuaaugcaccaacaaaua

SEQ ID NO: 1914467 - RNA, 13 nt, Shigella flexneri 2a str. 2457T
uuaauuaaaaugg

SEQ ID NO: 1914468 - RNA, 12 nt, Shigella flexneri 2a str. 2457T
uuaauucuaaaa

SEQ ID NO: 1914469 - RNA, 14 nt, Shigella flexneri 2a str. 2457T
uuaauuccggugaa

SEQ ID NO: 1914470 - RNA, 16 nt, Shigella flexneri 2a str. 2457T
uuaauucauacaucgc

SEQ ID NO: 1914471 - RNA, 21 nt, Shigella flexneri 2a str. 2457T
uuaauugcccgaagccaauuu

SEQ ID NO: 1914472 - RNA, 19 nt, Shigella flexneri 2a str. 2457T
uuaauugaaccuaagcuuu

SEQ ID NO: 1914473 - RNA, 20 nt, Shigella flexneri 2a str. 2457T
uuaauaacacauauauuaau

SEQ ID NO: 1914474 - RNA, 14 nt, Shigella flexneri 2a str. 2457T
uuaauaaucacaua

SEQ ID NO: 1914475 - RNA, 13 nt, Shigella flexneri 2a str. 2457T
uuaaguuuauccc

SEQ ID NO: 1914476 - RNA, 22 nt, Shigella flexneri 2a str. 2457T
uuaaguuauauugcgacgauaa

SEQ ID NO: 1914477 - RNA, 20 nt, Shigella flexneri 2a str. 2457T
uuaaguguccgccaauuuca

SEQ ID NO: 1914478 - RNA, 15 nt, Shigella flexneri 2a str. 2457T
uuaaggaaaaacgaa

SEQ ID NO: 1914479 - RNA, 19 nt, Shigella flexneri 2a str. 2457T
uuaagcuuuccggcaucac

SEQ ID NO: 1914480 - RNA, 17 nt, Shigella flexneri 2a str. 2457T
uuaagucgacgguauaa

SEQ ID NO: 1914481 - RNA, 16 nt, Shigella flexneri 2a str. 2457T
uuaagucggucaagua

SEQ ID NO: 1914482 - RNA, 18 nt, Shigella flexneri 2a str. 2457T
uuaauauuaacuuaauaa

SEQ ID NO: 1914483 - RNA, 22 nt, Shigella flexneri 2a str. 2457T
uuaaucgccguauaauaucuuu

SEQ ID NO: 1914484 - RNA, 19 nt, Shigella flexneri 2a str. 2457T
uuaaucguugucuuacuuu

SEQ ID NO: 1914485 - RNA, 23 nt, Shigella flexneri 2a str. 2457T
uuaauccgcaaauaacguaaaaa

SEQ ID NO: 1914486 - RNA, 14 nt, Shigella flexneri 2a str. 2457T
uuaacgguaucuuu

SEQ ID NO: 1914487 - RNA, 14 nt, Shigella flexneri 2a str. 2457T
uuaacgguaagcgc

SEQ ID NO: 1914488 - RNA, 19 nt, Shigella flexneri 2a str. 2457T
uuaaccgugggaaacagua

SEQ ID NO: 1914489 - RNA, 17 nt, Shigella flexneri 2a str. 2457T
uuaacccgcaacagcaa

SEQ ID NO: 1914490 - RNA, 19 nt, Shigella flexneri 2a str. 2457T
uguggagugcagcaugcac

SEQ ID NO: 1914491 - RNA, 20 nt, Shigella flexneri 2a str. 2457T
uguggagugcagcaugcacc

SEQ ID NO: 1914492 - RNA, 17 nt, Shigella flexneri 2a str. 2457T
uuaaccacuucagaacc

SEQ ID NO: 1914493 - RNA, 14 nt, Shigella flexneri 2a str. 2457T
ugugcuuuguucau

SEQ ID NO: 1914494 - RNA, 18 nt, Shigella flexneri 2a str. 2457T
ugugcuuuacaccaugcc

SEQ ID NO: 1914495 - RNA, 14 nt, Shigella flexneri 2a str. 2457T
ugugccguaaccaa

SEQ ID NO: 1914496 - RNA, 13 nt, Shigella flexneri 2a str. 2457T
uuaacguuaucug

SEQ ID NO: 1914497 - RNA, 14 nt, Shigella flexneri 2a str. 2457T
uuaagacacacuau

SEQ ID NO: 1914498 - RNA, 18 nt, Shigella flexneri 2a str. 2457T
uuaacuccuucuaaagca

SEQ ID NO: 1914499 - RNA, 22 nt, Shigella flexneri 2a str. 2457T
uuaagaagaucguggagaacaa

SEQ ID NO: 1914500 - RNA, 14 nt, Shigella flexneri 2a str. 2457T
uggcccaaaaggca

SEQ ID NO: 1914501 - RNA, 13 nt, Shigella flexneri 2a str. 2457T
uggcccaucaucu

SEQ ID NO: 1914502 - RNA, 17 nt, Shigella flexneri 2a str. 2457T
uggcauucucacuccag

SEQ ID NO: 1914503 - RNA, 20 nt, Shigella flexneri 2a str. 2457T
uggcauucucacuccagcca

SEQ ID NO: 1914504 - RNA, 19 nt, Shigella flexneri 2a str. 2457T
uggcaugccgguagaagcc

SEQ ID NO: 1914505 - RNA, 20 nt, Shigella flexneri 2a str. 2457T
uggcaugccgguagaagcca

SEQ ID NO: 1914506 - RNA, 20 nt, Shigella flexneri 2a str. 2457T
uggcaucugauaagcccagc

SEQ ID NO: 1914507 - RNA, 18 nt, Shigella flexneri 2a str. 2457T
uggcaucugauaagccca

SEQ ID NO: 1914508 - RNA, 18 nt, Shigella flexneri 2a str. 2457T
uggcauaaacaaagcgca

SEQ ID NO: 1914509 - RNA, 14 nt, Shigella flexneri 2a str. 2457T
uggcauauuccgcc

SEQ ID NO: 1914510 - RNA, 21 nt, Shigella flexneri 2a str. 2457T
uggcaucagaggaaugauuuc

SEQ ID NO: 1914511 - RNA, 17 nt, Shigella flexneri 2a str. 2457T
uggcaucgauaucaacc

SEQ ID NO: 1914512 - RNA, 19 nt, Shigella flexneri 2a str. 2457T
uggcaucgauaucaaccag

SEQ ID NO: 1914513 - RNA, 13 nt, Shigella flexneri 2a str. 2457T
uggauucagcacc

SEQ ID NO: 1914514 - RNA, 19 nt, Shigella flexneri 2a str. 2457T
uggauuuucaugaagcaag

SEQ ID NO: 1914515 - RNA, 16 nt, Shigella flexneri 2a str. 2457T
uggcaaaaaaauucag

SEQ ID NO: 1914516 - RNA, 17 nt, Shigella flexneri 2a str. 2457T
uggcaaaacggcucuua

SEQ ID NO: 1914517 - RNA, 16 nt, Shigella flexneri 2a str. 2457T
uggaugucuggcagag

SEQ ID NO: 1914518 - RNA, 13 nt, Shigella flexneri 2a str. 2457T
uggauuaaauugc

SEQ ID NO: 1914519 - RNA, 13 nt, Shigella flexneri 2a str. 2457T
uggauuaucuuca

SEQ ID NO: 1914520 - RNA, 18 nt, Shigella flexneri 2a str. 2457T
uggcagagccuguuacau

SEQ ID NO: 1914521 - RNA, 19 nt, Shigella flexneri 2a str. 2457T
uggcagaguaucgccaucc

SEQ ID NO: 1914522 - RNA, 14 nt, Shigella flexneri 2a str. 2457T
uggcagaguugcca

SEQ ID NO: 1914523 - RNA, 17 nt, Shigella flexneri 2a str. 2457T
uggcagaguugccaccc

SEQ ID NO: 1914524 - RNA, 13 nt, Shigella flexneri 2a str. 2457T
uggcaggcucaga

SEQ ID NO: 1914525 - RNA, 20 nt, Shigella flexneri 2a str. 2457T
uggcaguagcgccucuucca

SEQ ID NO: 1914526 - RNA, 14 nt, Shigella flexneri 2a str. 2457T
uggcagucuggccu

SEQ ID NO: 1914527 - RNA, 19 nt, Shigella flexneri 2a str. 2457T
uggcagggaaucagauuca

SEQ ID NO: 1914528 - RNA, 10 nt, Shigella flexneri 2a str. 2457T
uggcaagcag

SEQ ID NO: 1914529 - RNA, 21 nt, Shigella flexneri 2a str. 2457T
uggaguuaaauuaauaaucac

SEQ ID NO: 1914530 - RNA, 22 nt, Shigella flexneri 2a str. 2457T
uggaguuccuggaugacccgga

SEQ ID NO: 1914531 - RNA, 21 nt, Shigella flexneri 2a str. 2457T
uggauaacguuuaucccaguc

SEQ ID NO: 1914532 - RNA, 14 nt, Shigella flexneri 2a str. 2457T
uggaucaaaucucg

SEQ ID NO: 1914533 - RNA, 14 nt, Shigella flexneri 2a str. 2457T
uggauauuuuaauc

SEQ ID NO: 1914534 - RNA, 20 nt, Shigella flexneri 2a str. 2457T
uggaucaacgaccagcgcgu

SEQ ID NO: 1914535 - RNA, 13 nt, Shigella flexneri 2a str. 2457T
uggaucaagcccc

SEQ ID NO: 1914536 - RNA, 13 nt, Shigella flexneri 2a str. 2457T
uggauaaucauac

SEQ ID NO: 1914537 - RNA, 20 nt, Shigella flexneri 2a str. 2457T
uggauaauccaucccgcucu

SEQ ID NO: 1914538 - RNA, 21 nt, Shigella flexneri 2a str. 2457T
uggauaagaugcuacaacauc

SEQ ID NO: 1914539 - RNA, 15 nt, Shigella flexneri 2a str. 2457T
uggaucguggugaag

SEQ ID NO: 1914540 - RNA, 15 nt, Shigella flexneri 2a str. 2457T
uggaugcggaaccau

SEQ ID NO: 1914541 - RNA, 21 nt, Shigella flexneri 2a str. 2457T
uggaugcgccauaccaugcac

SEQ ID NO: 1914542 - RNA, 18 nt, Shigella flexneri 2a str. 2457T
uggaugagucggaccauc

SEQ ID NO: 1914543 - RNA, 23 nt, Shigella flexneri 2a str. 2457T
uggaucaaggauugcagcacuga

SEQ ID NO: 1914544 - RNA, 19 nt, Shigella flexneri 2a str. 2457T
uggaucaagccccagcagg

SEQ ID NO: 1914545 - RNA, 21 nt, Shigella flexneri 2a str. 2457T
uggaucaagccccagcaggau

SEQ ID NO: 1914546 - RNA, 15 nt, Shigella flexneri 2a str. 2457T
uggaucccucuuucu

SEQ ID NO: 1914547 - RNA, 18 nt, Shigella flexneri 2a str. 2457T
uggaucgagauugucggc

SEQ ID NO: 1914548 - RNA, 17 nt, Shigella flexneri 2a str. 2457T
uggagcuaaacagcgcu

SEQ ID NO: 1914549 - RNA, 19 nt, Shigella flexneri 2a str. 2457T
uggagcuaaacagcgcugc

SEQ ID NO: 1914550 - RNA, 20 nt, Shigella flexneri 2a str. 2457T
uggagcacauugccugaugc

SEQ ID NO: 1914551 - RNA, 19 nt, Shigella flexneri 2a str. 2457T
uggagcaacacgccagcgu

SEQ ID NO: 1914552 - RNA, 18 nt, Shigella flexneri 2a str. 2457T
uggagaguugcaccagca

SEQ ID NO: 1914553 - RNA, 16 nt, Shigella flexneri 2a str. 2457T
uggagauaaacuccac

SEQ ID NO: 1914554 - RNA, 16 nt, Shigella flexneri 2a str. 2457T
uggagagcagcaucaa

SEQ ID NO: 1914555 - RNA, 16 nt, Shigella flexneri 2a str. 2457T
uggagaacgccugugu

SEQ ID NO: 1914556 - RNA, 18 nt, Shigella flexneri 2a str. 2457T
uggacucccagaacaacc

SEQ ID NO: 1914557 - RNA, 22 nt, Shigella flexneri 2a str. 2457T
uggacgguggagcaacagggaa

SEQ ID NO: 1914558 - RNA, 21 nt, Shigella flexneri 2a str. 2457T
uggacgcucaggcuacuuuuc

SEQ ID NO: 1914559 - RNA, 16 nt, Shigella flexneri 2a str. 2457T
uggacgcgccaacaaa

SEQ ID NO: 1914560 - RNA, 18 nt, Shigella flexneri 2a str. 2457T
uggccugcucaacugcca

SEQ ID NO: 1914561 - RNA, 14 nt, Shigella flexneri 2a str. 2457T
uggcgacaaggcgu

SEQ ID NO: 1914562 - RNA, 15 nt, Shigella flexneri 2a str. 2457T
uggcgacuucugcuu

SEQ ID NO: 1914563 - RNA, 22 nt, Shigella flexneri 2a str. 2457T
uggcgacgccgcgguucuucca

SEQ ID NO: 1914564 - RNA, 19 nt, Shigella flexneri 2a str. 2457T
uggcgauuuugaagucuuu

SEQ ID NO: 1914565 - RNA, 12 nt, Shigella flexneri 2a str. 2457T
uggcgagagccg

SEQ ID NO: 1914566 - RNA, 16 nt, Shigella flexneri 2a str. 2457T
uggcgauuauuuuccg

SEQ ID NO: 1914567 - RNA, 18 nt, Shigella flexneri 2a str. 2457T
uggcgauguaauucagcc

SEQ ID NO: 1914568 - RNA, 19 nt, Shigella flexneri 2a str. 2457T
uggcgauguaauucagcca

SEQ ID NO: 1914569 - RNA, 16 nt, Shigella flexneri 2a str. 2457T
uggcgauguaauucag

SEQ ID NO: 1914570 - RNA, 19 nt, Shigella flexneri 2a str. 2457T
uggcgcaucggucagaccc

SEQ ID NO: 1914571 - RNA, 17 nt, Shigella flexneri 2a str. 2457T
uggcgcacauccgcguc

SEQ ID NO: 1914572 - RNA, 16 nt, Shigella flexneri 2a str. 2457T
uggcguacccaucaac

SEQ ID NO: 1914573 - RNA, 21 nt, Shigella flexneri 2a str. 2457T
uggcgucacgccgaccagacc

SEQ ID NO: 1914574 - RNA, 21 nt, Shigella flexneri 2a str. 2457T
uggcguuuuuccaaaacugga

SEQ ID NO: 1914575 - RNA, 18 nt, Shigella flexneri 2a str. 2457T
uggcuauaaucacucaaa

SEQ ID NO: 1914576 - RNA, 21 nt, Shigella flexneri 2a str. 2457T
uggcuauaaaugaacugggca

SEQ ID NO: 1914577 - RNA, 18 nt, Shigella flexneri 2a str. 2457T
uggcucagauugaacgcu

SEQ ID NO: 1914578 - RNA, 16 nt, Shigella flexneri 2a str. 2457T
uggcucaucaagcaca

SEQ ID NO: 1914579 - RNA, 18 nt, Shigella flexneri 2a str. 2457T
uggcucaaucgccaccac

SEQ ID NO: 1914580 - RNA, 15 nt, Shigella flexneri 2a str. 2457T
uggcuaugggauauu

SEQ ID NO: 1914581 - RNA, 21 nt, Shigella flexneri 2a str. 2457T
uggcgcgaaaacaacuggcaa

SEQ ID NO: 1914582 - RNA, 22 nt, Shigella flexneri 2a str. 2457T
uggcgcgaagcccucaaacaac

SEQ ID NO: 1914583 - RNA, 17 nt, Shigella flexneri 2a str. 2457T
ugggaagaauggaaaaa

SEQ ID NO: 1914584 - RNA, 14 nt, Shigella flexneri 2a str. 2457T
ugggaaggugcgga

SEQ ID NO: 1914585 - RNA, 16 nt, Shigella flexneri 2a str. 2457T
uggcugugcguuaccc

SEQ ID NO: 1914586 - RNA, 19 nt, Shigella flexneri 2a str. 2457T
uggcuggggaauauuuaau

SEQ ID NO: 1914587 - RNA, 18 nt, Shigella flexneri 2a str. 2457T
uggcuguuuucagcacca

SEQ ID NO: 1914588 - RNA, 19 nt, Shigella flexneri 2a str. 2457T
uggcuuaaacgcagagaca

SEQ ID NO: 1914589 - RNA, 19 nt, Shigella flexneri 2a str. 2457T
uggcuguuuucagcaccag

SEQ ID NO: 1914590 - RNA, 13 nt, Shigella flexneri 2a str. 2457T
ugggaaauccaac

SEQ ID NO: 1914591 - RNA, 21 nt, Shigella flexneri 2a str. 2457T
ugggaacaguacauuguuuuc

SEQ ID NO: 1914592 - RNA, 20 nt, Shigella flexneri 2a str. 2457T
uggcugacauaaacaccagc

SEQ ID NO: 1914593 - RNA, 16 nt, Shigella flexneri 2a str. 2457T
uggcucuucaccugcc

SEQ ID NO: 1914594 - RNA, 20 nt, Shigella flexneri 2a str. 2457T
uggcuccgggugugacaaca

SEQ ID NO: 1914595 - RNA, 15 nt, Shigella flexneri 2a str. 2457T
uggcucgccauccag

SEQ ID NO: 1914596 - RNA, 21 nt, Shigella flexneri 2a str. 2457T
uggcugacauaaacaccagca

SEQ ID NO: 1914597 - RNA, 15 nt, Shigella flexneri 2a str. 2457T
uggcugauauuaagc

SEQ ID NO: 1914598 - RNA, 16 nt, Shigella flexneri 2a str. 2457T
uggcugccaugguuug

SEQ ID NO: 1914599 - RNA, 18 nt, Shigella flexneri 2a str. 2457T
ugggcauugaaggcagca

SEQ ID NO: 1914600 - RNA, 14 nt, Shigella flexneri 2a str. 2457T
ugggcaucaguaug

SEQ ID NO: 1914601 - RNA, 17 nt, Shigella flexneri 2a str. 2457T
ugggcaucggcaaucac

SEQ ID NO: 1914602 - RNA, 18 nt, Shigella flexneri 2a str. 2457T
ugggcaguugcgcgcgca

SEQ ID NO: 1914603 - RNA, 15 nt, Shigella flexneri 2a str. 2457T
ugggacgcagacugg

SEQ ID NO: 1914604 - RNA, 23 nt, Shigella flexneri 2a str. 2457T
ugggagcgagaaguauucuuuua

SEQ ID NO: 1914605 - RNA, 20 nt, Shigella flexneri 2a str. 2457T
ugggagcgauucggcuacua

SEQ ID NO: 1914606 - RNA, 16 nt, Shigella flexneri 2a str. 2457T
uggggaaaaacacaaa

SEQ ID NO: 1914607 - RNA, 15 nt, Shigella flexneri 2a str. 2457T
ugggcuucuuuauga

SEQ ID NO: 1914608 - RNA, 16 nt, Shigella flexneri 2a str. 2457T
uggggaaaaugggcau

SEQ ID NO: 1914609 - RNA, 20 nt, Shigella flexneri 2a str. 2457T
uggguaauaacaauacaucu

SEQ ID NO: 1914610 - RNA, 20 nt, Shigella flexneri 2a str. 2457T
ugggcugacauuaucagaca

SEQ ID NO: 1914611 - RNA, 15 nt, Shigella flexneri 2a str. 2457T
ugggcugccccagcc

SEQ ID NO: 1914612 - RNA, 13 nt, Shigella flexneri 2a str. 2457T
ugugaucuuuauc

SEQ ID NO: 1914613 - RNA, 14 nt, Shigella flexneri 2a str. 2457T
ugugaucuuuuucg

SEQ ID NO: 1914614 - RNA, 22 nt, Shigella flexneri 2a str. 2457T
ugugaugaaaaaaguuuuauug

SEQ ID NO: 1914615 - RNA, 15 nt, Shigella flexneri 2a str. 2457T
ugugccauuaauguc

SEQ ID NO: 1914616 - RNA, 16 nt, Shigella flexneri 2a str. 2457T
ugugccgcgacagauu

SEQ ID NO: 1914617 - RNA, 19 nt, Shigella flexneri 2a str. 2457T
ugugccagcucgugcagaa

SEQ ID NO: 1914618 - RNA, 19 nt, Shigella flexneri 2a str. 2457T
ugugcacgugccagauguu

SEQ ID NO: 1914619 - RNA, 17 nt, Shigella flexneri 2a str. 2457T
ugugcaaauucaauaaa

SEQ ID NO: 1914620 - RNA, 20 nt, Shigella flexneri 2a str. 2457T
ugugaacgagaaaaugacga

SEQ ID NO: 1914621 - RNA, 16 nt, Shigella flexneri 2a str. 2457T
ugugaaaucagcacau

SEQ ID NO: 1914622 - RNA, 15 nt, Shigella flexneri 2a str. 2457T
ugugauacuucuucg

SEQ ID NO: 1914623 - RNA, 17 nt, Shigella flexneri 2a str. 2457T
ugugaacgagaaaauga

SEQ ID NO: 1914624 - RNA, 23 nt, Shigella flexneri 2a str. 2457T
ugugaacucaggcugccagauca

SEQ ID NO: 1914625 - RNA, 22 nt, Shigella flexneri 2a str. 2457T
ugucugaugcgcugcgcuuauc

SEQ ID NO: 1914626 - RNA, 22 nt, Shigella flexneri 2a str. 2457T
ugucuuucucaucuuucagaau

SEQ ID NO: 1914627 - RNA, 23 nt, Shigella flexneri 2a str. 2457T
ugucuuuaaauugcguaaagccu

SEQ ID NO: 1914628 - RNA, 13 nt, Shigella flexneri 2a str. 2457T
ugucucucagcac

SEQ ID NO: 1914629 - RNA, 18 nt, Shigella flexneri 2a str. 2457T
ugucuccggcauccagcg

SEQ ID NO: 1914630 - RNA, 14 nt, Shigella flexneri 2a str. 2457T
ugucggauuucgca

SEQ ID NO: 1914631 - RNA, 15 nt, Shigella flexneri 2a str. 2457T
ugucggcaagauacu

SEQ ID NO: 1914632 - RNA, 20 nt, Shigella flexneri 2a str. 2457T
ugucggcccgcauuauucag

SEQ ID NO: 1914633 - RNA, 14 nt, Shigella flexneri 2a str. 2457T
ugucguuauauaaa

SEQ ID NO: 1914634 - RNA, 17 nt, Shigella flexneri 2a str. 2457T
ugucgaaagccccagcc

SEQ ID NO: 1914635 - RNA, 16 nt, Shigella flexneri 2a str. 2457T
ugucgcuguuucugga

SEQ ID NO: 1914636 - RNA, 14 nt, Shigella flexneri 2a str. 2457T
ugucgcagccagcg

SEQ ID NO: 1914637 - RNA, 12 nt, Shigella flexneri 2a str. 2457T
ugucgagugaau

SEQ ID NO: 1914638 - RNA, 19 nt, Shigella flexneri 2a str. 2457T
ugucgagauuaaacaaggu

SEQ ID NO: 1914639 - RNA, 17 nt, Shigella flexneri 2a str. 2457T
uguccggcgcacuggug

SEQ ID NO: 1914640 - RNA, 23 nt, Shigella flexneri 2a str. 2457T
uguccucgccguuuucuggggcg

SEQ ID NO: 1914641 - RNA, 16 nt, Shigella flexneri 2a str. 2457T
ugucagguaacaagcc

SEQ ID NO: 1914642 - RNA, 15 nt, Shigella flexneri 2a str. 2457T
ugucagcucauccag

SEQ ID NO: 1914643 - RNA, 16 nt, Shigella flexneri 2a str. 2457T
ugucagcgugacuggc

SEQ ID NO: 1914644 - RNA, 16 nt, Shigella flexneri 2a str. 2457T
ugucagcacuuccagc

SEQ ID NO: 1914645 - RNA, 19 nt, Shigella flexneri 2a str. 2457T
ugucagcaaucugauugac

SEQ ID NO: 1914646 - RNA, 23 nt, Shigella flexneri 2a str. 2457T
ugucccacuggucgcccugggua

SEQ ID NO: 1914647 - RNA, 13 nt, Shigella flexneri 2a str. 2457T
uguauucaugccc

SEQ ID NO: 1914648 - RNA, 19 nt, Shigella flexneri 2a str. 2457T
uguaucugcagauuaugcc

SEQ ID NO: 1914649 - RNA, 13 nt, Shigella flexneri 2a str. 2457T
uguauccggcaaa

SEQ ID NO: 1914650 - RNA, 14 nt, Shigella flexneri 2a str. 2457T
uguauugauuuagc

SEQ ID NO: 1914651 - RNA, 17 nt, Shigella flexneri 2a str. 2457T
uguauucaugcccugcc

SEQ ID NO: 1914652 - RNA, 18 nt, Shigella flexneri 2a str. 2457T
uguauuuauuuucaggau

SEQ ID NO: 1914653 - RNA, 21 nt, Shigella flexneri 2a str. 2457T
ugucaauacuuucacaaaaau

SEQ ID NO: 1914654 - RNA, 14 nt, Shigella flexneri 2a str. 2457T
ugucaccagccgau

SEQ ID NO: 1914655 - RNA, 16 nt, Shigella flexneri 2a str. 2457T
ugucaccacccugccc

SEQ ID NO: 1914656 - RNA, 17 nt, Shigella flexneri 2a str. 2457T
uggucgugaucaaugug

SEQ ID NO: 1914657 - RNA, 18 nt, Shigella flexneri 2a str. 2457T
ugggucggcgauaaccau

SEQ ID NO: 1914658 - RNA, 15 nt, Shigella flexneri 2a str. 2457T
uggucucaagcaagu

SEQ ID NO: 1914659 - RNA, 18 nt, Shigella flexneri 2a str. 2457T
uggucuggaacuggcugc

SEQ ID NO: 1914660 - RNA, 16 nt, Shigella flexneri 2a str. 2457T
uggucugcaugacggc

SEQ ID NO: 1914661 - RNA, 19 nt, Shigella flexneri 2a str. 2457T
uggucuggaacuggcugcc

SEQ ID NO: 1914662 - RNA, 14 nt, Shigella flexneri 2a str. 2457T
uggguacgaaaagg

SEQ ID NO: 1914663 - RNA, 20 nt, Shigella flexneri 2a str. 2457T
uggguacgaaaagggcugga

SEQ ID NO: 1914664 - RNA, 19 nt, Shigella flexneri 2a str. 2457T
uggugacuggcaacaacgc

SEQ ID NO: 1914665 - RNA, 20 nt, Shigella flexneri 2a str. 2457T
uggugacuuuugcccggcau

SEQ ID NO: 1914666 - RNA, 12 nt, Shigella flexneri 2a str. 2457T
uggugauuuucg

SEQ ID NO: 1914667 - RNA, 17 nt, Shigella flexneri 2a str. 2457T
uggugcaaggaaauaau

SEQ ID NO: 1914668 - RNA, 22 nt, Shigella flexneri 2a str. 2457T
uggugccagauuuaacggcagc

SEQ ID NO: 1914669 - RNA, 21 nt, Shigella flexneri 2a str. 2457T
uggugggugcuuuaaaaaaga

SEQ ID NO: 1914670 - RNA, 14 nt, Shigella flexneri 2a str. 2457T
ugguggcagccagc

SEQ ID NO: 1914671 - RNA, 16 nt, Shigella flexneri 2a str. 2457T
ugguggacaaccauaa

SEQ ID NO: 1914672 - RNA, 20 nt, Shigella flexneri 2a str. 2457T
ugguguggagugcagcaugc

SEQ ID NO: 1914673 - RNA, 15 nt, Shigella flexneri 2a str. 2457T
ugguggucaccauga

SEQ ID NO: 1914674 - RNA, 15 nt, Shigella flexneri 2a str. 2457T
ugguuaccaucaacc

SEQ ID NO: 1914675 - RNA, 17 nt, Shigella flexneri 2a str. 2457T
ugguuaacgaaucaauc

SEQ ID NO: 1914676 - RNA, 11 nt, Shigella flexneri 2a str. 2457T
ugguuaacaau

SEQ ID NO: 1914677 - RNA, 18 nt, Shigella flexneri 2a str. 2457T
ugguuaaauaaggcuuua

SEQ ID NO: 1914678 - RNA, 23 nt, Shigella flexneri 2a str. 2457T
ugguguuauaggccccugccuca

SEQ ID NO: 1914679 - RNA, 23 nt, Shigella flexneri 2a str. 2457T
ugguguugcguuuuuaucuucac

SEQ ID NO: 1914680 - RNA, 21 nt, Shigella flexneri 2a str. 2457T
ugguuacgcauaaaaccagca

SEQ ID NO: 1914681 - RNA, 19 nt, Shigella flexneri 2a str. 2457T
ugguuagcggcgguaaaau

SEQ ID NO: 1914682 - RNA, 23 nt, Shigella flexneri 2a str. 2457T
ugguuagcggcgguaaaaucauc

SEQ ID NO: 1914683 - RNA, 14 nt, Shigella flexneri 2a str. 2457T
ugguuauauuuccc

SEQ ID NO: 1914684 - RNA, 14 nt, Shigella flexneri 2a str. 2457T
ugguucaagagaga

SEQ ID NO: 1914685 - RNA, 22 nt, Shigella flexneri 2a str. 2457T
ugguucagacgcuacuuuuuuc

SEQ ID NO: 1914686 - RNA, 22 nt, Shigella flexneri 2a str. 2457T
ugguuauuucacuucaaccaca

SEQ ID NO: 1914687 - RNA, 17 nt, Shigella flexneri 2a str. 2457T
ugguuauuucacuucaa

SEQ ID NO: 1914688 - RNA, 17 nt, Shigella flexneri 2a str. 2457T
uguaaguggaugcccgg

SEQ ID NO: 1914689 - RNA, 22 nt, Shigella flexneri 2a str. 2457T
uguaauuaaauuaucaacuauc

SEQ ID NO: 1914690 - RNA, 16 nt, Shigella flexneri 2a str. 2457T
uguaagguggcgucaa

SEQ ID NO: 1914691 - RNA, 18 nt, Shigella flexneri 2a str. 2457T
uguaagggcuaaucugaa

SEQ ID NO: 1914692 - RNA, 22 nt, Shigella flexneri 2a str. 2457T
uguaagccaagcgccgccucag

SEQ ID NO: 1914693 - RNA, 20 nt, Shigella flexneri 2a str. 2457T
uguacuccagcagaccagca

SEQ ID NO: 1914694 - RNA, 19 nt, Shigella flexneri 2a str. 2457T
uguacuccagcagaccagc

SEQ ID NO: 1914695 - RNA, 18 nt, Shigella flexneri 2a str. 2457T
uguacgucauccguggcg

SEQ ID NO: 1914696 - RNA, 14 nt, Shigella flexneri 2a str. 2457T
uguacaugcugcuu

SEQ ID NO: 1914697 - RNA, 19 nt, Shigella flexneri 2a str. 2457T
uguacauuaucuuuauuau

SEQ ID NO: 1914698 - RNA, 16 nt, Shigella flexneri 2a str. 2457T
uguacaggcuccugua

SEQ ID NO: 1914699 - RNA, 22 nt, Shigella flexneri 2a str. 2457T
uguacagauccgccauuucucc

SEQ ID NO: 1914700 - RNA, 16 nt, Shigella flexneri 2a str. 2457T
uguacaggauauauuu

SEQ ID NO: 1914701 - RNA, 14 nt, Shigella flexneri 2a str. 2457T
ugguugccagccac

SEQ ID NO: 1914702 - RNA, 13 nt, Shigella flexneri 2a str. 2457T
ugguuguaaucca

SEQ ID NO: 1914703 - RNA, 15 nt, Shigella flexneri 2a str. 2457T
ugguuguaauccacc

SEQ ID NO: 1914704 - RNA, 20 nt, Shigella flexneri 2a str. 2457T
ugguuucugguggaaaagaa

SEQ ID NO: 1914705 - RNA, 16 nt, Shigella flexneri 2a str. 2457T
ugguucccaacaacag

SEQ ID NO: 1914706 - RNA, 14 nt, Shigella flexneri 2a str. 2457T
ugguuccugacucc

SEQ ID NO: 1914707 - RNA, 14 nt, Shigella flexneri 2a str. 2457T
uguaaaugaacuca

SEQ ID NO: 1914708 - RNA, 22 nt, Shigella flexneri 2a str. 2457T
uguaaauacucuugugccaguu

SEQ ID NO: 1914709 - RNA, 14 nt, Shigella flexneri 2a str. 2457T
ugguuugcauccac

SEQ ID NO: 1914710 - RNA, 13 nt, Shigella flexneri 2a str. 2457T
uguaaaccucuuu

SEQ ID NO: 1914711 - RNA, 17 nt, Shigella flexneri 2a str. 2457T
ugguuuucaauuaucac

SEQ ID NO: 1914712 - RNA, 16 nt, Shigella flexneri 2a str. 2457T
ugguuuuccugagcaa

SEQ ID NO: 1914713 - RNA, 17 nt, Shigella flexneri 2a str. 2457T
ugguuuucgccggaacc

SEQ ID NO: 1914714 - RNA, 17 nt, Shigella flexneri 2a str. 2457T
ugccgucugggcaaaau

SEQ ID NO: 1914715 - RNA, 21 nt, Shigella flexneri 2a str. 2457T
ugccucuccuguucucacuaa

SEQ ID NO: 1914716 - RNA, 16 nt, Shigella flexneri 2a str. 2457T
ugccucuccccagcgg

SEQ ID NO: 1914717 - RNA, 22 nt, Shigella flexneri 2a str. 2457T
ugccucggggaacgcaaaauuc

SEQ ID NO: 1914718 - RNA, 18 nt, Shigella flexneri 2a str. 2457T
ugccugccagucaaucau

SEQ ID NO: 1914719 - RNA, 17 nt, Shigella flexneri 2a str. 2457T
ugccugccagcuugcga

SEQ ID NO: 1914720 - RNA, 18 nt, Shigella flexneri 2a str. 2457T
ugccugcacuuuguguca

SEQ ID NO: 1914721 - RNA, 13 nt, Shigella flexneri 2a str. 2457T
ugccugcagcugc

SEQ ID NO: 1914722 - RNA, 17 nt, Shigella flexneri 2a str. 2457T
ugccugauggccugcuc

SEQ ID NO: 1914723 - RNA, 21 nt, Shigella flexneri 2a str. 2457T
ugccugacguuguacauuauc

SEQ ID NO: 1914724 - RNA, 19 nt, Shigella flexneri 2a str. 2457T
ugccugagacagacagccu

SEQ ID NO: 1914725 - RNA, 18 nt, Shigella flexneri 2a str. 2457T
ugccuucacaggccgcca

SEQ ID NO: 1914726 - RNA, 21 nt, Shigella flexneri 2a str. 2457T
ugccuucacaggccgccaggc

SEQ ID NO: 1914727 - RNA, 19 nt, Shigella flexneri 2a str. 2457T
ugccuuaaacaugagcgaa

SEQ ID NO: 1914728 - RNA, 21 nt, Shigella flexneri 2a str. 2457T
ugccuguccucuucagcauca

SEQ ID NO: 1914729 - RNA, 19 nt, Shigella flexneri 2a str. 2457T
ugccuguacggcagugaac

SEQ ID NO: 1914730 - RNA, 17 nt, Shigella flexneri 2a str. 2457T
ugccuguacggcaguga

SEQ ID NO: 1914731 - RNA, 18 nt, Shigella flexneri 2a str. 2457T
ugccagaggagccaucac

SEQ ID NO: 1914732 - RNA, 19 nt, Shigella flexneri 2a str. 2457T
ugccagaggagccaucacc

SEQ ID NO: 1914733 - RNA, 22 nt, Shigella flexneri 2a str. 2457T
ugccagaggagccaucaccauc

SEQ ID NO: 1914734 - RNA, 16 nt, Shigella flexneri 2a str. 2457T
ugccagauaauggcug

SEQ ID NO: 1914735 - RNA, 15 nt, Shigella flexneri 2a str. 2457T
ugccagauaagacac

SEQ ID NO: 1914736 - RNA, 21 nt, Shigella flexneri 2a str. 2457T
ugccggcaucaaacgguugau

SEQ ID NO: 1914737 - RNA, 18 nt, Shigella flexneri 2a str. 2457T
ugccagaccaaacagcau

SEQ ID NO: 1914738 - RNA, 22 nt, Shigella flexneri 2a str. 2457T
ugccagaaauccaggcccgcau

SEQ ID NO: 1914739 - RNA, 19 nt, Shigella flexneri 2a str. 2457T
ugccagacccauaaucaga

SEQ ID NO: 1914740 - RNA, 16 nt, Shigella flexneri 2a str. 2457T
ugccagaccaaacagc

SEQ ID NO: 1914741 - RNA, 19 nt, Shigella flexneri 2a str. 2457T
ugccagacgaauaaaacag

SEQ ID NO: 1914742 - RNA, 14 nt, Shigella flexneri 2a str. 2457T
ugccagaccuccgu

SEQ ID NO: 1914743 - RNA, 14 nt, Shigella flexneri 2a str. 2457T
ugccagagcagcaa

SEQ ID NO: 1914744 - RNA, 15 nt, Shigella flexneri 2a str. 2457T
ugccagagcccauca

SEQ ID NO: 1914745 - RNA, 14 nt, Shigella flexneri 2a str. 2457T
ugccgguuccugca

SEQ ID NO: 1914746 - RNA, 14 nt, Shigella flexneri 2a str. 2457T
ugccguacagacag

SEQ ID NO: 1914747 - RNA, 14 nt, Shigella flexneri 2a str. 2457T
ugccguacaggcag

SEQ ID NO: 1914748 - RNA, 15 nt, Shigella flexneri 2a str. 2457T
ugccguacaggcagc

SEQ ID NO: 1914749 - RNA, 16 nt, Shigella flexneri 2a str. 2457T
ugccguacaggcagcu

SEQ ID NO: 1914750 - RNA, 17 nt, Shigella flexneri 2a str. 2457T
ugccgguggccuugccg

SEQ ID NO: 1914751 - RNA, 13 nt, Shigella flexneri 2a str. 2457T
ugccgguuauuuu

SEQ ID NO: 1914752 - RNA, 21 nt, Shigella flexneri 2a str. 2457T
ugccggucgcgcgggaaauca

SEQ ID NO: 1914753 - RNA, 17 nt, Shigella flexneri 2a str. 2457T
ugccgguagaagccagu

SEQ ID NO: 1914754 - RNA, 18 nt, Shigella flexneri 2a str. 2457T
ugccgguagaagccaguc

SEQ ID NO: 1914755 - RNA, 19 nt, Shigella flexneri 2a str. 2457T
ugccgguagaagccaguca

SEQ ID NO: 1914756 - RNA, 14 nt, Shigella flexneri 2a str. 2457T
ugccgguaaugcug

SEQ ID NO: 1914757 - RNA, 22 nt, Shigella flexneri 2a str. 2457T
ugcgauaucgacggcgugcuga

SEQ ID NO: 1914758 - RNA, 14 nt, Shigella flexneri 2a str. 2457T
ugcgaucaggcauu

SEQ ID NO: 1914759 - RNA, 14 nt, Shigella flexneri 2a str. 2457T
ugcgauccugcaga

SEQ ID NO: 1914760 - RNA, 18 nt, Shigella flexneri 2a str. 2457T
ugcgaauggcaugcuccc

SEQ ID NO: 1914761 - RNA, 16 nt, Shigella flexneri 2a str. 2457T
ugcgaauaaugguauc

SEQ ID NO: 1914762 - RNA, 17 nt, Shigella flexneri 2a str. 2457T
ugcgaaguuuuuccgcc

SEQ ID NO: 1914763 - RNA, 15 nt, Shigella flexneri 2a str. 2457T
ugcgaaguuuuuccg

SEQ ID NO: 1914764 - RNA, 14 nt, Shigella flexneri 2a str. 2457T
ugcgaaaaaaaagc

SEQ ID NO: 1914765 - RNA, 18 nt, Shigella flexneri 2a str. 2457T
ugcgaaaaaaucauccau

SEQ ID NO: 1914766 - RNA, 18 nt, Shigella flexneri 2a str. 2457T
ugcgaaaguaccauuaau

SEQ ID NO: 1914767 - RNA, 22 nt, Shigella flexneri 2a str. 2457T
ugcgaaagcgucagcuuucaga

SEQ ID NO: 1914768 - RNA, 14 nt, Shigella flexneri 2a str. 2457T
ugccuuugaaaucg

SEQ ID NO: 1914769 - RNA, 17 nt, Shigella flexneri 2a str. 2457T
ugccuuuccuccugucu

SEQ ID NO: 1914770 - RNA, 15 nt, Shigella flexneri 2a str. 2457T
ugcgcccugggcuuc

SEQ ID NO: 1914771 - RNA, 14 nt, Shigella flexneri 2a str. 2457T
ugcgcccuguucug

SEQ ID NO: 1914772 - RNA, 12 nt, Shigella flexneri 2a str. 2457T
ugcgccagcucg

SEQ ID NO: 1914773 - RNA, 21 nt, Shigella flexneri 2a str. 2457T
ugcgccaucgccacaccagua

SEQ ID NO: 1914774 - RNA, 18 nt, Shigella flexneri 2a str. 2457T
ugcgccaucggcagcauc

SEQ ID NO: 1914775 - RNA, 22 nt, Shigella flexneri 2a str. 2457T
ugcgccauaccaugcaccaacc

SEQ ID NO: 1914776 - RNA, 12 nt, Shigella flexneri 2a str. 2457T
ugcgcaauuaaa

SEQ ID NO: 1914777 - RNA, 12 nt, Shigella flexneri 2a str. 2457T
ugcgcacaucaa

SEQ ID NO: 1914778 - RNA, 14 nt, Shigella flexneri 2a str. 2457T
ugcgauggauuauc

SEQ ID NO: 1914779 - RNA, 22 nt, Shigella flexneri 2a str. 2457T
ugcgauggcaaaagacaccauc

SEQ ID NO: 1914780 - RNA, 11 nt, Shigella flexneri 2a str. 2457T
ugcgcaauaac

SEQ ID NO: 1914781 - RNA, 20 nt, Shigella flexneri 2a str. 2457T
ugcgcaauacguugcaaaau

SEQ ID NO: 1914782 - RNA, 18 nt, Shigella flexneri 2a str. 2457T
ugcgccacaggucagcag

SEQ ID NO: 1914783 - RNA, 19 nt, Shigella flexneri 2a str. 2457T
ugcgccacaggucagcagg

SEQ ID NO: 1914784 - RNA, 17 nt, Shigella flexneri 2a str. 2457T
ugcgccacuucccagcc

SEQ ID NO: 1914785 - RNA, 20 nt, Shigella flexneri 2a str. 2457T
ugcgcauuucccagcaagaa

SEQ ID NO: 1914786 - RNA, 12 nt, Shigella flexneri 2a str. 2457T
ugcgccaauacc

SEQ ID NO: 1914787 - RNA, 17 nt, Shigella flexneri 2a str. 2457T
ugcgccacaggucagca

SEQ ID NO: 1914788 - RNA, 15 nt, Shigella flexneri 2a str. 2457T
ugcgccaauugccag

SEQ ID NO: 1914789 - RNA, 17 nt, Shigella flexneri 2a str. 2457T
ugcgccacaccacugcg

SEQ ID NO: 1914790 - RNA, 14 nt, Shigella flexneri 2a str. 2457T
ugcuccacgcugca

SEQ ID NO: 1914791 - RNA, 19 nt, Shigella flexneri 2a str. 2457T
ugcucauuacaguagcuau

SEQ ID NO: 1914792 - RNA, 21 nt, Shigella flexneri 2a str. 2457T
ugcucaucgauaucgaccacu

SEQ ID NO: 1914793 - RNA, 13 nt, Shigella flexneri 2a str. 2457T
ugcuccagucguu

SEQ ID NO: 1914794 - RNA, 17 nt, Shigella flexneri 2a str. 2457T
ugcuccagcagauggca

SEQ ID NO: 1914795 - RNA, 12 nt, Shigella flexneri 2a str. 2457T
ugcuccauccau

SEQ ID NO: 1914796 - RNA, 21 nt, Shigella flexneri 2a str. 2457T
ugcuccauccauugcauaaac

SEQ ID NO: 1914797 - RNA, 20 nt, Shigella flexneri 2a str. 2457T
ugcuccccagaauccaggaa

SEQ ID NO: 1914798 - RNA, 14 nt, Shigella flexneri 2a str. 2457T
ugcuccuccuucuc

SEQ ID NO: 1914799 - RNA, 17 nt, Shigella flexneri 2a str. 2457T
ugcucaauugacaguuu

SEQ ID NO: 1914800 - RNA, 20 nt, Shigella flexneri 2a str. 2457T
ugcucaauugacaguuuauu

SEQ ID NO: 1914801 - RNA, 19 nt, Shigella flexneri 2a str. 2457T
ugcucagcccguaacucac

SEQ ID NO: 1914802 - RNA, 14 nt, Shigella flexneri 2a str. 2457T
ugcucauaaacgcg

SEQ ID NO: 1914803 - RNA, 16 nt, Shigella flexneri 2a str. 2457T
ugcucauaaaaugauu

SEQ ID NO: 1914804 - RNA, 14 nt, Shigella flexneri 2a str. 2457T
ugcucaucgauauc

SEQ ID NO: 1914805 - RNA, 18 nt, Shigella flexneri 2a str. 2457T
ugcucaucagcccggcaa

SEQ ID NO: 1914806 - RNA, 23 nt, Shigella flexneri 2a str. 2457T
ugcucaucuggcguaccaaucag

SEQ ID NO: 1914807 - RNA, 19 nt, Shigella flexneri 2a str. 2457T
ugcucaaacuucgucacag

SEQ ID NO: 1914808 - RNA, 11 nt, Shigella flexneri 2a str. 2457T
ugcucaaagcc

SEQ ID NO: 1914809 - RNA, 17 nt, Shigella flexneri 2a str. 2457T
ugcuauuuuagaaaaac

SEQ ID NO: 1914810 - RNA, 15 nt, Shigella flexneri 2a str. 2457T
ugcuauuccuugaaa

SEQ ID NO: 1914811 - RNA, 15 nt, Shigella flexneri 2a str. 2457T
ugcuauucaccagca

SEQ ID NO: 1914812 - RNA, 18 nt, Shigella flexneri 2a str. 2457T
ugcuauuuaccacuacug

SEQ ID NO: 1914813 - RNA, 16 nt, Shigella flexneri 2a str. 2457T
ugcuaugcugaaugau

SEQ ID NO: 1914814 - RNA, 23 nt, Shigella flexneri 2a str. 2457T
ugcuaguaaguuacauuuuaaua

SEQ ID NO: 1914815 - RNA, 23 nt, Shigella flexneri 2a str. 2457T
ugcuaucuccuguugugaugcaa

SEQ ID NO: 1914816 - RNA, 19 nt, Shigella flexneri 2a str. 2457T
ugcuacggcaauucccaga

SEQ ID NO: 1914817 - RNA, 23 nt, Shigella flexneri 2a str. 2457T
ugcuaccgcuucgcucacaucau

SEQ ID NO: 1914818 - RNA, 14 nt, Shigella flexneri 2a str. 2457T
ugcuacccacuucc

SEQ ID NO: 1914819 - RNA, 18 nt, Shigella flexneri 2a str. 2457T
ugcuaaaaacaucaugau

SEQ ID NO: 1914820 - RNA, 13 nt, Shigella flexneri 2a str. 2457T
ugcggcaggcaca

SEQ ID NO: 1914821 - RNA, 18 nt, Shigella flexneri 2a str. 2457T
ugcggcgcaccagcaggc

SEQ ID NO: 1914822 - RNA, 19 nt, Shigella flexneri 2a str. 2457T
ugcggcucucuuucuccag

SEQ ID NO: 1914823 - RNA, 13 nt, Shigella flexneri 2a str. 2457T
ugcggcugcaucu

SEQ ID NO: 1914824 - RNA, 16 nt, Shigella flexneri 2a str. 2457T
ugcggcguaaaugccu

SEQ ID NO: 1914825 - RNA, 18 nt, Shigella flexneri 2a str. 2457T
ugcggcggcgcaccggcc

SEQ ID NO: 1914826 - RNA, 17 nt, Shigella flexneri 2a str. 2457T
ugcgcuuuaucgccgcu

SEQ ID NO: 1914827 - RNA, 21 nt, Shigella flexneri 2a str. 2457T
ugcgcuuccagcuccauccac

SEQ ID NO: 1914828 - RNA, 15 nt, Shigella flexneri 2a str. 2457T
ugcgcugugugugcu

SEQ ID NO: 1914829 - RNA, 15 nt, Shigella flexneri 2a str. 2457T
ugcgcugggcaacaa

SEQ ID NO: 1914830 - RNA, 12 nt, Shigella flexneri 2a str. 2457T
ugcgcuuccagc

SEQ ID NO: 1914831 - RNA, 14 nt, Shigella flexneri 2a str. 2457T
ugcgcuuccugcag

SEQ ID NO: 1914832 - RNA, 18 nt, Shigella flexneri 2a str. 2457T
ugcgcuuccugcagcuuc

SEQ ID NO: 1914833 - RNA, 16 nt, Shigella flexneri 2a str. 2457T
ugcgguuucagcucac

SEQ ID NO: 1914834 - RNA, 23 nt, Shigella flexneri 2a str. 2457T
ugcgucaagcgguaaccauccau

SEQ ID NO: 1914835 - RNA, 15 nt, Shigella flexneri 2a str. 2457T
ugcgguuaaugguug

SEQ ID NO: 1914836 - RNA, 14 nt, Shigella flexneri 2a str. 2457T
ugcgguuaaugguu

SEQ ID NO: 1914837 - RNA, 20 nt, Shigella flexneri 2a str. 2457T
ugcgguccaugcgaagaccg

SEQ ID NO: 1914838 - RNA, 22 nt, Shigella flexneri 2a str. 2457T
ugcguugucaucgaauaaauug

SEQ ID NO: 1914839 - RNA, 21 nt, Shigella flexneri 2a str. 2457T
ugcguggcagauuaggauuaa

SEQ ID NO: 1914840 - RNA, 19 nt, Shigella flexneri 2a str. 2457T
ugcgugcgcugcuuguucc

SEQ ID NO: 1914841 - RNA, 16 nt, Shigella flexneri 2a str. 2457T
ugcgugacuaaaaccc

SEQ ID NO: 1914842 - RNA, 14 nt, Shigella flexneri 2a str. 2457T
ugcgucauccagca

SEQ ID NO: 1914843 - RNA, 16 nt, Shigella flexneri 2a str. 2457T
ugcgugagguaacaau

SEQ ID NO: 1914844 - RNA, 20 nt, Shigella flexneri 2a str. 2457T
ugcgucucuuguugcaacaa

SEQ ID NO: 1914845 - RNA, 16 nt, Shigella flexneri 2a str. 2457T
ugcgucauccagcacu

SEQ ID NO: 1914846 - RNA, 13 nt, Shigella flexneri 2a str. 2457T
ugcgucgccgccu

SEQ ID NO: 1914847 - RNA, 17 nt, Shigella flexneri 2a str. 2457T
ugcgucgcauccggcaa

SEQ ID NO: 1914848 - RNA, 19 nt, Shigella flexneri 2a str. 2457T
ugcgucucugguuuuacaa

SEQ ID NO: 1914849 - RNA, 19 nt, Shigella flexneri 2a str. 2457T
ugcgucucuuguugcaaca

SEQ ID NO: 1914850 - RNA, 21 nt, Shigella flexneri 2a str. 2457T
uggaauuuguccaccaauagc

SEQ ID NO: 1914851 - RNA, 19 nt, Shigella flexneri 2a str. 2457T
uggaauuacugauugcuca

SEQ ID NO: 1914852 - RNA, 14 nt, Shigella flexneri 2a str. 2457T
uggaaugagcaucu

SEQ ID NO: 1914853 - RNA, 15 nt, Shigella flexneri 2a str. 2457T
uggaauggaaacagc

SEQ ID NO: 1914854 - RNA, 14 nt, Shigella flexneri 2a str. 2457T
uggaaggguugaaa

SEQ ID NO: 1914855 - RNA, 19 nt, Shigella flexneri 2a str. 2457T
uggaagguaaggauaaaaa

SEQ ID NO: 1914856 - RNA, 22 nt, Shigella flexneri 2a str. 2457T
uggaagguaaggauaaaaaagg

SEQ ID NO: 1914857 - RNA, 15 nt, Shigella flexneri 2a str. 2457T
uggaaguuacucaaa

SEQ ID NO: 1914858 - RNA, 19 nt, Shigella flexneri 2a str. 2457T
uggaaucacucaucaugca

SEQ ID NO: 1914859 - RNA, 16 nt, Shigella flexneri 2a str. 2457T
uggaaucacucaucau

SEQ ID NO: 1914860 - RNA, 14 nt, Shigella flexneri 2a str. 2457T
uggaaucaauaauu

SEQ ID NO: 1914861 - RNA, 22 nt, Shigella flexneri 2a str. 2457T
uggaauauccgucacuucagga

SEQ ID NO: 1914862 - RNA, 21 nt, Shigella flexneri 2a str. 2457T
uggaauaagccaaauccagcg

SEQ ID NO: 1914863 - RNA, 17 nt, Shigella flexneri 2a str. 2457T
uggaauaccuuucgauu

SEQ ID NO: 1914864 - RNA, 19 nt, Shigella flexneri 2a str. 2457T
uggaauacauauauuacaa

SEQ ID NO: 1914865 - RNA, 14 nt, Shigella flexneri 2a str. 2457T
uggacaacauuccu

SEQ ID NO: 1914866 - RNA, 13 nt, Shigella flexneri 2a str. 2457T
uggacauucuccg

SEQ ID NO: 1914867 - RNA, 17 nt, Shigella flexneri 2a str. 2457T
uggacauagcucugcca

SEQ ID NO: 1914868 - RNA, 16 nt, Shigella flexneri 2a str. 2457T
uggacagacuggcuau

SEQ ID NO: 1914869 - RNA, 13 nt, Shigella flexneri 2a str. 2457T
uggacgaacaguu

SEQ ID NO: 1914870 - RNA, 15 nt, Shigella flexneri 2a str. 2457T
uggacgaacuggcgc

SEQ ID NO: 1914871 - RNA, 15 nt, Shigella flexneri 2a str. 2457T
uggaagccagucaca

SEQ ID NO: 1914872 - RNA, 21 nt, Shigella flexneri 2a str. 2457T
uggaagagcgacaaucccugc

SEQ ID NO: 1914873 - RNA, 20 nt, Shigella flexneri 2a str. 2457T
uggaagaccugacuguucca

SEQ ID NO: 1914874 - RNA, 17 nt, Shigella flexneri 2a str. 2457T
uggaacgcguacagaaa

SEQ ID NO: 1914875 - RNA, 22 nt, Shigella flexneri 2a str. 2457T
uggaacgcguacagaaaacuca

SEQ ID NO: 1914876 - RNA, 17 nt, Shigella flexneri 2a str. 2457T
uggaacggcagauccaa

SEQ ID NO: 1914877 - RNA, 22 nt, Shigella flexneri 2a str. 2457T
uggaacacuuugccgucagcca

SEQ ID NO: 1914878 - RNA, 12 nt, Shigella flexneri 2a str. 2457T
uggaaaucaaaa

SEQ ID NO: 1914879 - RNA, 19 nt, Shigella flexneri 2a str. 2457T
uggaaacggacagaccugc

SEQ ID NO: 1914880 - RNA, 14 nt, Shigella flexneri 2a str. 2457T
uggaaacagcacca

SEQ ID NO: 1914881 - RNA, 12 nt, Shigella flexneri 2a str. 2457T
uggaaaacaaca

SEQ ID NO: 1914882 - RNA, 14 nt, Shigella flexneri 2a str. 2457T
ugcuuuuuccugcg

SEQ ID NO: 1914883 - RNA, 13 nt, Shigella flexneri 2a str. 2457T
ugcuuuugcuucu

SEQ ID NO: 1914884 - RNA, 18 nt, Shigella flexneri 2a str. 2457T
ugcuuuucccuccacucc

SEQ ID NO: 1914885 - RNA, 17 nt, Shigella flexneri 2a str. 2457T
ugcuuuucauacaaucg

SEQ ID NO: 1914886 - RNA, 15 nt, Shigella flexneri 2a str. 2457T
ugcuuuggcugccgc

SEQ ID NO: 1914887 - RNA, 14 nt, Shigella flexneri 2a str. 2457T
ugcuuucagcgaaa

SEQ ID NO: 1914888 - RNA, 16 nt, Shigella flexneri 2a str. 2457T
ugcuuuaaaaaagaau

SEQ ID NO: 1914889 - RNA, 14 nt, Shigella flexneri 2a str. 2457T
ugcuuuaaaugcug

SEQ ID NO: 1914890 - RNA, 20 nt, Shigella flexneri 2a str. 2457T
ugcuuucaucaaaaaaugaa

SEQ ID NO: 1914891 - RNA, 15 nt, Shigella flexneri 2a str. 2457T
ugcuuuaucaaucac

SEQ ID NO: 1914892 - RNA, 15 nt, Shigella flexneri 2a str. 2457T
ugcuugccccuuccc

SEQ ID NO: 1914893 - RNA, 20 nt, Shigella flexneri 2a str. 2457T
ugcuugccggaagcaaaaua

SEQ ID NO: 1914894 - RNA, 18 nt, Shigella flexneri 2a str. 2457T
ugcuugcgauauucuuca

SEQ ID NO: 1914895 - RNA, 19 nt, Shigella flexneri 2a str. 2457T
ugcuuccggcaagcaaaug

SEQ ID NO: 1914896 - RNA, 22 nt, Shigella flexneri 2a str. 2457T
ugcuuccugaguaauaacuucc

SEQ ID NO: 1914897 - RNA, 15 nt, Shigella flexneri 2a str. 2457T
ugcuuccgccagcgg

SEQ ID NO: 1914898 - RNA, 17 nt, Shigella flexneri 2a str. 2457T
ugcuuccgccagcggcg

SEQ ID NO: 1914899 - RNA, 15 nt, Shigella flexneri 2a str. 2457T
ugcuucggucagcac

SEQ ID NO: 1914900 - RNA, 22 nt, Shigella flexneri 2a str. 2457T
ugcuucucuucagccaacgcau

SEQ ID NO: 1914901 - RNA, 13 nt, Shigella flexneri 2a str. 2457T
ugcuucugccugg

SEQ ID NO: 1914902 - RNA, 16 nt, Shigella flexneri 2a str. 2457T
ugcuugaagggcuggc

SEQ ID NO: 1914903 - RNA, 13 nt, Shigella flexneri 2a str. 2457T
ugcuucugcuuca

SEQ ID NO: 1914904 - RNA, 22 nt, Shigella flexneri 2a str. 2457T
ugcuucagccgcacuuuuuaaa

SEQ ID NO: 1914905 - RNA, 18 nt, Shigella flexneri 2a str. 2457T
ugcuucacgcccagaucc

SEQ ID NO: 1914906 - RNA, 21 nt, Shigella flexneri 2a str. 2457T
ugcuucacgcggguugccacc

SEQ ID NO: 1914907 - RNA, 17 nt, Shigella flexneri 2a str. 2457T
ugcuucaauuuccugac

SEQ ID NO: 1914908 - RNA, 14 nt, Shigella flexneri 2a str. 2457T
ugcuucacacuggg

SEQ ID NO: 1914909 - RNA, 15 nt, Shigella flexneri 2a str. 2457T
ugcuucaagaugcca

SEQ ID NO: 1914910 - RNA, 16 nt, Shigella flexneri 2a str. 2457T
ugcuuauggagucugc

SEQ ID NO: 1914911 - RNA, 14 nt, Shigella flexneri 2a str. 2457T
ugcuuauccagcac

SEQ ID NO: 1914912 - RNA, 21 nt, Shigella flexneri 2a str. 2457T
ugcuuaguaaaaauagugcgu

SEQ ID NO: 1914913 - RNA, 12 nt, Shigella flexneri 2a str. 2457T
ugcuuacguugu

SEQ ID NO: 1914914 - RNA, 17 nt, Shigella flexneri 2a str. 2457T
ugcuuacgcaacugcca

SEQ ID NO: 1914915 - RNA, 23 nt, Shigella flexneri 2a str. 2457T
ugcuuaaggcagaaacaaacgca

SEQ ID NO: 1914916 - RNA, 22 nt, Shigella flexneri 2a str. 2457T
ugcuuaacauuggucagagcau

SEQ ID NO: 1914917 - RNA, 23 nt, Shigella flexneri 2a str. 2457T
ugcuuaaauuucuuaccacugcc

SEQ ID NO: 1914918 - RNA, 18 nt, Shigella flexneri 2a str. 2457T
ugcuuaaauuucuuacca

SEQ ID NO: 1914919 - RNA, 19 nt, Shigella flexneri 2a str. 2457T
ugcuguuuuuucaggcccu

SEQ ID NO: 1914920 - RNA, 16 nt, Shigella flexneri 2a str. 2457T
ugcuguugcgucucga

SEQ ID NO: 1914921 - RNA, 12 nt, Shigella flexneri 2a str. 2457T
ugcuguuuuaca

SEQ ID NO: 1914922 - RNA, 17 nt, Shigella flexneri 2a str. 2457T
ugcugucggcaaaucaa

SEQ ID NO: 1914923 - RNA, 17 nt, Shigella flexneri 2a str. 2457T
ugcugucggcugccagc

SEQ ID NO: 1914924 - RNA, 19 nt, Shigella flexneri 2a str. 2457T
ugcugugacagauuuugcc

SEQ ID NO: 1914925 - RNA, 17 nt, Shigella flexneri 2a str. 2457T
ugcugucaccgaagcgg

SEQ ID NO: 1914926 - RNA, 21 nt, Shigella flexneri 2a str. 2457T
ugcugugcgccacagacauaa

SEQ ID NO: 1914927 - RNA, 20 nt, Shigella flexneri 2a str. 2457T
ugcuguuaauucaggauucg

SEQ ID NO: 1914928 - RNA, 18 nt, Shigella flexneri 2a str. 2457T
ugcuguuccuaucuucau

SEQ ID NO: 1914929 - RNA, 16 nt, Shigella flexneri 2a str. 2457T
ugcuguucuucugcug

SEQ ID NO: 1914930 - RNA, 21 nt, Shigella flexneri 2a str. 2457T
ugcuggggauucguuuuucuu

SEQ ID NO: 1914931 - RNA, 16 nt, Shigella flexneri 2a str. 2457T
ugcugggauaauugcg

SEQ ID NO: 1914932 - RNA, 17 nt, Shigella flexneri 2a str. 2457T
ugcuggguuauuucauu

SEQ ID NO: 1914933 - RNA, 15 nt, Shigella flexneri 2a str. 2457T
ugcugguacuuucac

SEQ ID NO: 1914934 - RNA, 14 nt, Shigella flexneri 2a str. 2457T
ugcugguacuggug

SEQ ID NO: 1914935 - RNA, 19 nt, Shigella flexneri 2a str. 2457T
ugcuguaaauucucaauau

SEQ ID NO: 1914936 - RNA, 11 nt, Shigella flexneri 2a str. 2457T
ugcugguuuug

SEQ ID NO: 1914937 - RNA, 13 nt, Shigella flexneri 2a str. 2457T
ugcuggugguggu

SEQ ID NO: 1914938 - RNA, 20 nt, Shigella flexneri 2a str. 2457T
ugcuggacucccagaacaac

SEQ ID NO: 1914939 - RNA, 13 nt, Shigella flexneri 2a str. 2457T
ugcuggaagcugg

SEQ ID NO: 1914940 - RNA, 18 nt, Shigella flexneri 2a str. 2457T
ugcuggaaccacagcgcc

SEQ ID NO: 1914941 - RNA, 20 nt, Shigella flexneri 2a str. 2457T
ugcuggaccuuaucgaagag

SEQ ID NO: 1914942 - RNA, 22 nt, Shigella flexneri 2a str. 2457T
ugcuggcaacauggauucgaug

SEQ ID NO: 1914943 - RNA, 12 nt, Shigella flexneri 2a str. 2457T
ugcuggaugaag

SEQ ID NO: 1914944 - RNA, 19 nt, Shigella flexneri 2a str. 2457T
ugcuggaucaaggauugca

SEQ ID NO: 1914945 - RNA, 14 nt, Shigella flexneri 2a str. 2457T
ugcuggauaagaug

SEQ ID NO: 1914946 - RNA, 19 nt, Shigella flexneri 2a str. 2457T
ugcugcuuuugcuucuaug

SEQ ID NO: 1914947 - RNA, 23 nt, Shigella flexneri 2a str. 2457T
ugcugcugauccagcuuccaggc

SEQ ID NO: 1914948 - RNA, 20 nt, Shigella flexneri 2a str. 2457T
ugcugcuggaagguaaggau

SEQ ID NO: 1914949 - RNA, 18 nt, Shigella flexneri 2a str. 2457T
ugcugcucaaaggcauua

SEQ ID NO: 1914950 - RNA, 17 nt, Shigella flexneri 2a str. 2457T
ugcuggcguugucaucg

SEQ ID NO: 1914951 - RNA, 22 nt, Shigella flexneri 2a str. 2457T
ugcuggcugcgggaguugcucc

SEQ ID NO: 1914952 - RNA, 23 nt, Shigella flexneri 2a str. 2457T
ugcuggcagaagcccagcgacug

SEQ ID NO: 1914953 - RNA, 18 nt, Shigella flexneri 2a str. 2457T
ugcuggcaugaaugguca

SEQ ID NO: 1914954 - RNA, 12 nt, Shigella flexneri 2a str. 2457T
aaaugucacugc

SEQ ID NO: 1914955 - RNA, 17 nt, Shigella flexneri 2a str. 2457T
ugcugauucgucaauau

SEQ ID NO: 1914956 - RNA, 16 nt, Shigella flexneri 2a str. 2457T
ugcugcaauugcggca

SEQ ID NO: 1914957 - RNA, 16 nt, Shigella flexneri 2a str. 2457T
ugcugccguuuuuauu

SEQ ID NO: 1914958 - RNA, 20 nt, Shigella flexneri 2a str. 2457T
ugcugcauugagguaaacag

SEQ ID NO: 1914959 - RNA, 21 nt, Shigella flexneri 2a str. 2457T
ugcugacuuugauccagccau

SEQ ID NO: 1914960 - RNA, 16 nt, Shigella flexneri 2a str. 2457T
ugcugaugcacgcaga

SEQ ID NO: 1914961 - RNA, 21 nt, Shigella flexneri 2a str. 2457T
ugcugauggcgggauguguaa

SEQ ID NO: 1914962 - RNA, 15 nt, Shigella flexneri 2a str. 2457T
ugcugauaacgugca

SEQ ID NO: 1914963 - RNA, 17 nt, Shigella flexneri 2a str. 2457T
ugcugauaacgugcagc

SEQ ID NO: 1914964 - RNA, 19 nt, Shigella flexneri 2a str. 2457T
ugcugauaacgugcagcuu

SEQ ID NO: 1914965 - RNA, 16 nt, Shigella flexneri 2a str. 2457T
ugcugaauccccuucu

SEQ ID NO: 1914966 - RNA, 14 nt, Shigella flexneri 2a str. 2457T
ugcugaccaccagc

SEQ ID NO: 1914967 - RNA, 15 nt, Shigella flexneri 2a str. 2457T
ugcugaccaccagca

SEQ ID NO: 1914968 - RNA, 18 nt, Shigella flexneri 2a str. 2457T
ugcugaaagggcaaauaa

SEQ ID NO: 1914969 - RNA, 14 nt, Shigella flexneri 2a str. 2457T
ugcucuucuuucau

SEQ ID NO: 1914970 - RNA, 13 nt, Shigella flexneri 2a str. 2457T
ugcucuucuuuca

SEQ ID NO: 1914971 - RNA, 12 nt, Shigella flexneri 2a str. 2457T
ugcucuucuuuc

SEQ ID NO: 1914972 - RNA, 22 nt, Shigella flexneri 2a str. 2457T
ugcucuuuucuuuaucuauuaa

SEQ ID NO: 1914973 - RNA, 11 nt, Shigella flexneri 2a str. 2457T
ugcucuuucag

SEQ ID NO: 1914974 - RNA, 18 nt, Shigella flexneri 2a str. 2457T
ugcucugcagcagccugc

SEQ ID NO: 1914975 - RNA, 22 nt, Shigella flexneri 2a str. 2457T
ugcucugccagacgguaacccc

SEQ ID NO: 1914976 - RNA, 20 nt, Shigella flexneri 2a str. 2457T
ugcucuggugcggcaaaaac

SEQ ID NO: 1914977 - RNA, 21 nt, Shigella flexneri 2a str. 2457T
ugcucucaaagacguuaaaaa

SEQ ID NO: 1914978 - RNA, 22 nt, Shigella flexneri 2a str. 2457T
ugcucucaucacuacagcgaaa

SEQ ID NO: 1914979 - RNA, 17 nt, Shigella flexneri 2a str. 2457T
ugcucucgggcaguaaa

SEQ ID NO: 1914980 - RNA, 22 nt, Shigella flexneri 2a str. 2457T
ugcucugaagguuguuaaccac

SEQ ID NO: 1914981 - RNA, 12 nt, Shigella flexneri 2a str. 2457T
ugcucguacguu

SEQ ID NO: 1914982 - RNA, 16 nt, Shigella flexneri 2a str. 2457T
ugcucgcccuggaugc

SEQ ID NO: 1914983 - RNA, 16 nt, Shigella flexneri 2a str. 2457T
ugcucgcuggcaggcc

SEQ ID NO: 1914984 - RNA, 14 nt, Shigella flexneri 2a str. 2457T
ugaaaauuauaucu

SEQ ID NO: 1914985 - RNA, 13 nt, Shigella flexneri 2a str. 2457T
ugaaaauguggua

SEQ ID NO: 1914986 - RNA, 14 nt, Shigella flexneri 2a str. 2457T
ugaaacaaaucacu

SEQ ID NO: 1914987 - RNA, 20 nt, Shigella flexneri 2a str. 2457T
ugaaacaacguggaacaaau

SEQ ID NO: 1914988 - RNA, 13 nt, Shigella flexneri 2a str. 2457T
ugaaacucagcca

SEQ ID NO: 1914989 - RNA, 15 nt, Shigella flexneri 2a str. 2457T
ugaaauaaugcagcg

SEQ ID NO: 1914990 - RNA, 12 nt, Shigella flexneri 2a str. 2457T
ugaaaucacuaa

SEQ ID NO: 1914991 - RNA, 23 nt, Shigella flexneri 2a str. 2457T
ugaaaucagcacauaagucagcc

SEQ ID NO: 1914992 - RNA, 18 nt, Shigella flexneri 2a str. 2457T
ugaaacucgauacgacac

SEQ ID NO: 1914993 - RNA, 19 nt, Shigella flexneri 2a str. 2457T
ugaaagcguuguguuuuuu

SEQ ID NO: 1914994 - RNA, 24 nt, Shigella flexneri 2a str. 2457T
ugaaagcguuuaugcgcauugcca

SEQ ID NO: 1914995 - RNA, 19 nt, Shigella flexneri 2a str. 2457T
ugaaagccccaccagcaaa

SEQ ID NO: 1914996 - RNA, 17 nt, Shigella flexneri 2a str. 2457T
ugaaacugauaauuuuc

SEQ ID NO: 1914997 - RNA, 16 nt, Shigella flexneri 2a str. 2457T
ugaaagcgugucaugu

SEQ ID NO: 1914998 - RNA, 22 nt, Shigella flexneri 2a str. 2457T
ugaaaggcgcucauuuucucuu

SEQ ID NO: 1914999 - RNA, 23 nt, Shigella flexneri 2a str. 2457T
ugaaaggcgcucauuuucucuuu

SEQ ID NO: 1915000 - RNA, 22 nt, Shigella flexneri 2a str. 2457T
ugaaaaaucaaaaaacuggaaa

SEQ ID NO: 1915001 - RNA, 12 nt, Shigella flexneri 2a str. 2457T
ugaaaaauaaaa

SEQ ID NO: 1915002 - RNA, 17 nt, Shigella flexneri 2a str. 2457T
ugaaaaccucucuggaa

SEQ ID NO: 1915003 - RNA, 22 nt, Shigella flexneri 2a str. 2457T
ugaaaacccuauuuuuggaggu

SEQ ID NO: 1915004 - RNA, 14 nt, Shigella flexneri 2a str. 2457T
ugaaaacgaaggcc

SEQ ID NO: 1915005 - RNA, 21 nt, Shigella flexneri 2a str. 2457T
ugaaaaccggacugaaaguac

SEQ ID NO: 1915006 - RNA, 17 nt, Shigella flexneri 2a str. 2457T
ugaaaacggacaugcca

SEQ ID NO: 1915007 - RNA, 17 nt, Shigella flexneri 2a str. 2457T
ugaaaagaguaguaauu

SEQ ID NO: 1915008 - RNA, 21 nt, Shigella flexneri 2a str. 2457T
ugaaaagaguaguaauugcuu

SEQ ID NO: 1915009 - RNA, 19 nt, Shigella flexneri 2a str. 2457T
ugaaaacucuuagcaaaca

SEQ ID NO: 1915010 - RNA, 17 nt, Shigella flexneri 2a str. 2457T
ugaaaaguccaggcugc

SEQ ID NO: 1915011 - RNA, 20 nt, Shigella flexneri 2a str. 2457T
ugaaaaggucacucccggau

SEQ ID NO: 1915012 - RNA, 18 nt, Shigella flexneri 2a str. 2457T
ugaaaagguugccugucu

SEQ ID NO: 1915013 - RNA, 23 nt, Shigella flexneri 2a str. 2457T
ugaaaaaaaggcgaaaggcuggc

SEQ ID NO: 1915014 - RNA, 19 nt, Shigella flexneri 2a str. 2457T
ucuuuuuucaacauguuga

SEQ ID NO: 1915015 - RNA, 14 nt, Shigella flexneri 2a str. 2457T
ugaaaaaaugauga

SEQ ID NO: 1915016 - RNA, 20 nt, Shigella flexneri 2a str. 2457T
ugaaaaagccaaaacugcac

SEQ ID NO: 1915017 - RNA, 20 nt, Shigella flexneri 2a str. 2457T
ugaaaaagcucccuaaaaua

SEQ ID NO: 1915018 - RNA, 23 nt, Shigella flexneri 2a str. 2457T
ugaaaaaguucgacuuaaaucuu

SEQ ID NO: 1915019 - RNA, 22 nt, Shigella flexneri 2a str. 2457T
ugaaaaagugccaaaaaucgca

SEQ ID NO: 1915020 - RNA, 13 nt, Shigella flexneri 2a str. 2457T
ugaacuucacgua

SEQ ID NO: 1915021 - RNA, 18 nt, Shigella flexneri 2a str. 2457T
ugaagaagcggaaaucac

SEQ ID NO: 1915022 - RNA, 19 nt, Shigella flexneri 2a str. 2457T
ugaacugcuuuuuaaucuc

SEQ ID NO: 1915023 - RNA, 16 nt, Shigella flexneri 2a str. 2457T
ugaacuggcuuuuuuc

SEQ ID NO: 1915024 - RNA, 19 nt, Shigella flexneri 2a str. 2457T
ugaacugggcgcggcccac

SEQ ID NO: 1915025 - RNA, 19 nt, Shigella flexneri 2a str. 2457T
ugaagcccaguaccgccag

SEQ ID NO: 1915026 - RNA, 17 nt, Shigella flexneri 2a str. 2457T
ugaagcaguuucaccag

SEQ ID NO: 1915027 - RNA, 18 nt, Shigella flexneri 2a str. 2457T
ugaagccaaaucauccag

SEQ ID NO: 1915028 - RNA, 22 nt, Shigella flexneri 2a str. 2457T
ugaagccaaaucauccagaccg

SEQ ID NO: 1915029 - RNA, 21 nt, Shigella flexneri 2a str. 2457T
ugaagcaagcgucgccagcgc

SEQ ID NO: 1915030 - RNA, 15 nt, Shigella flexneri 2a str. 2457T
ugaaguacacauaaa

SEQ ID NO: 1915031 - RNA, 23 nt, Shigella flexneri 2a str. 2457T
ugaaggcgacguagcccgguaca

SEQ ID NO: 1915032 - RNA, 20 nt, Shigella flexneri 2a str. 2457T
ugaaggcgcauugcuggcug

SEQ ID NO: 1915033 - RNA, 19 nt, Shigella flexneri 2a str. 2457T
ugaagucuuuuuucaacuu

SEQ ID NO: 1915034 - RNA, 20 nt, Shigella flexneri 2a str. 2457T
ugaagucagggucuuccagc

SEQ ID NO: 1915035 - RNA, 15 nt, Shigella flexneri 2a str. 2457T
ugaagucucaauuag

SEQ ID NO: 1915036 - RNA, 22 nt, Shigella flexneri 2a str. 2457T
ugaacgugggucugucccauuu

SEQ ID NO: 1915037 - RNA, 19 nt, Shigella flexneri 2a str. 2457T
ugaacucgccgcacaggcg

SEQ ID NO: 1915038 - RNA, 19 nt, Shigella flexneri 2a str. 2457T
ugaacuggcuuuuuucaau

SEQ ID NO: 1915039 - RNA, 15 nt, Shigella flexneri 2a str. 2457T
ugaacugaacaaaaa

SEQ ID NO: 1915040 - RNA, 20 nt, Shigella flexneri 2a str. 2457T
ugaacucuuaagguucacuu

SEQ ID NO: 1915041 - RNA, 13 nt, Shigella flexneri 2a str. 2457T
ugaacucuucuuc

SEQ ID NO: 1915042 - RNA, 17 nt, Shigella flexneri 2a str. 2457T
ugaacucuucuuccggc

SEQ ID NO: 1915043 - RNA, 14 nt, Shigella flexneri 2a str. 2457T
ugaacgccuuaucu

SEQ ID NO: 1915044 - RNA, 20 nt, Shigella flexneri 2a str. 2457T
ugaacgccuuauccggccua

SEQ ID NO: 1915045 - RNA, 21 nt, Shigella flexneri 2a str. 2457T
ugaacgugcaaaaucaaacag

SEQ ID NO: 1915046 - RNA, 18 nt, Shigella flexneri 2a str. 2457T
ugaacguggcaacccgcg

SEQ ID NO: 1915047 - RNA, 18 nt, Shigella flexneri 2a str. 2457T
ugaacgugcaaaaucaaa

SEQ ID NO: 1915048 - RNA, 19 nt, Shigella flexneri 2a str. 2457T
ugaacgugcaaaaucaaac

SEQ ID NO: 1915049 - RNA, 20 nt, Shigella flexneri 2a str. 2457T
ugaacgugcaaaaucaaaca

SEQ ID NO: 1915050 - RNA, 15 nt, Shigella flexneri 2a str. 2457T
ugaacggugaugcuc

SEQ ID NO: 1915051 - RNA, 16 nt, Shigella flexneri 2a str. 2457T
ugaacggcuucgccuc

SEQ ID NO: 1915052 - RNA, 17 nt, Shigella flexneri 2a str. 2457T
ugaacagcuuuuuccug

SEQ ID NO: 1915053 - RNA, 22 nt, Shigella flexneri 2a str. 2457T
ugaacagcagaacaucagcugg

SEQ ID NO: 1915054 - RNA, 12 nt, Shigella flexneri 2a str. 2457T
ugaacagccaga

SEQ ID NO: 1915055 - RNA, 13 nt, Shigella flexneri 2a str. 2457T
ugaacagccugug

SEQ ID NO: 1915056 - RNA, 14 nt, Shigella flexneri 2a str. 2457T
ugaaaugaaaauca

SEQ ID NO: 1915057 - RNA, 15 nt, Shigella flexneri 2a str. 2457T
ugaaccgcacagguu

SEQ ID NO: 1915058 - RNA, 13 nt, Shigella flexneri 2a str. 2457T
ucuuuguucggca

SEQ ID NO: 1915059 - RNA, 12 nt, Shigella flexneri 2a str. 2457T
ucuuugucggug

SEQ ID NO: 1915060 - RNA, 23 nt, Shigella flexneri 2a str. 2457T
ucuuuguaucgcugaaagauggc

SEQ ID NO: 1915061 - RNA, 14 nt, Shigella flexneri 2a str. 2457T
ucuuuucacgcaau

SEQ ID NO: 1915062 - RNA, 12 nt, Shigella flexneri 2a str. 2457T
ucuuuucaggcg

SEQ ID NO: 1915063 - RNA, 19 nt, Shigella flexneri 2a str. 2457T
ucuuuuacagcgccagaag

SEQ ID NO: 1915064 - RNA, 20 nt, Shigella flexneri 2a str. 2457T
ucuuuuacagcgccagaagg

SEQ ID NO: 1915065 - RNA, 23 nt, Shigella flexneri 2a str. 2457T
ucuuuccagcaaccaaugccacc

SEQ ID NO: 1915066 - RNA, 13 nt, Shigella flexneri 2a str. 2457T
ucuuucaucuccc

SEQ ID NO: 1915067 - RNA, 17 nt, Shigella flexneri 2a str. 2457T
ucuuucagcaccagccc

SEQ ID NO: 1915068 - RNA, 11 nt, Shigella flexneri 2a str. 2457T
ucuuucaguac

SEQ ID NO: 1915069 - RNA, 20 nt, Shigella flexneri 2a str. 2457T
ucuuucucgccuuucuuaaa

SEQ ID NO: 1915070 - RNA, 14 nt, Shigella flexneri 2a str. 2457T
ucuuucuaugagaa

SEQ ID NO: 1915071 - RNA, 14 nt, Shigella flexneri 2a str. 2457T
ucuuuggcaucaau

SEQ ID NO: 1915072 - RNA, 15 nt, Shigella flexneri 2a str. 2457T
ucuuuggcaucaauc

SEQ ID NO: 1915073 - RNA, 21 nt, Shigella flexneri 2a str. 2457T
ucuuugauugaagaaaucagu

SEQ ID NO: 1915074 - RNA, 23 nt, Shigella flexneri 2a str. 2457T
ucuuugccugaucggugaaagua

SEQ ID NO: 1915075 - RNA, 22 nt, Shigella flexneri 2a str. 2457T
ucuuugcgcccccgauccagcg

SEQ ID NO: 1915076 - RNA, 21 nt, Shigella flexneri 2a str. 2457T
ucuuucucugcaaauauuaau

SEQ ID NO: 1915077 - RNA, 21 nt, Shigella flexneri 2a str. 2457T
ucuugucaggccggaauaacu

SEQ ID NO: 1915078 - RNA, 15 nt, Shigella flexneri 2a str. 2457T
ucuuguaggccugau

SEQ ID NO: 1915079 - RNA, 15 nt, Shigella flexneri 2a str. 2457T
ucuuuaaacaguuuu

SEQ ID NO: 1915080 - RNA, 21 nt, Shigella flexneri 2a str. 2457T
ucuuguucauagugccugaug

SEQ ID NO: 1915081 - RNA, 14 nt, Shigella flexneri 2a str. 2457T
ucuuguuugaugag

SEQ ID NO: 1915082 - RNA, 13 nt, Shigella flexneri 2a str. 2457T
ucuuuauaugcaa

SEQ ID NO: 1915083 - RNA, 19 nt, Shigella flexneri 2a str. 2457T
ucuuuauagagauuuuucc

SEQ ID NO: 1915084 - RNA, 19 nt, Shigella flexneri 2a str. 2457T
ucuuuauggguuucuaauu

SEQ ID NO: 1915085 - RNA, 13 nt, Shigella flexneri 2a str. 2457T
ucuuucacaaaga

SEQ ID NO: 1915086 - RNA, 21 nt, Shigella flexneri 2a str. 2457T
ucuuuacuaaacggucccuca

SEQ ID NO: 1915087 - RNA, 16 nt, Shigella flexneri 2a str. 2457T
ucuuuaguuaauuucg

SEQ ID NO: 1915088 - RNA, 17 nt, Shigella flexneri 2a str. 2457T
ucuuuaguuaauuucgc

SEQ ID NO: 1915089 - RNA, 13 nt, Shigella flexneri 2a str. 2457T
ucuuuacuaaacg

SEQ ID NO: 1915090 - RNA, 22 nt, Shigella flexneri 2a str. 2457T
ucuugcaggaagggauugugca

SEQ ID NO: 1915091 - RNA, 18 nt, Shigella flexneri 2a str. 2457T
ucuugccaucaaucacuu

SEQ ID NO: 1915092 - RNA, 18 nt, Shigella flexneri 2a str. 2457T
ucuugcguuauuuucggc

SEQ ID NO: 1915093 - RNA, 20 nt, Shigella flexneri 2a str. 2457T
ucuugaugugcuucaucaga

SEQ ID NO: 1915094 - RNA, 21 nt, Shigella flexneri 2a str. 2457T
ucuugauuugcuuguuucauu

SEQ ID NO: 1915095 - RNA, 13 nt, Shigella flexneri 2a str. 2457T
ucuugaaaccaga

SEQ ID NO: 1915096 - RNA, 13 nt, Shigella flexneri 2a str. 2457T
ucuugagaaaaac

SEQ ID NO: 1915097 - RNA, 20 nt, Shigella flexneri 2a str. 2457T
ucuucuaacgacauuuucug

SEQ ID NO: 1915098 - RNA, 17 nt, Shigella flexneri 2a str. 2457T
ucuucuaccggagagaa

SEQ ID NO: 1915099 - RNA, 14 nt, Shigella flexneri 2a str. 2457T
ucuucgaaucuuug

SEQ ID NO: 1915100 - RNA, 19 nt, Shigella flexneri 2a str. 2457T
ucuucgaguaaaaauauuu

SEQ ID NO: 1915101 - RNA, 18 nt, Shigella flexneri 2a str. 2457T
ucuucgccgaacacacau

SEQ ID NO: 1915102 - RNA, 20 nt, Shigella flexneri 2a str. 2457T
ucuucuugaccguuuuacuc

SEQ ID NO: 1915103 - RNA, 20 nt, Shigella flexneri 2a str. 2457T
ucuucuugcagcuuaaucau

SEQ ID NO: 1915104 - RNA, 15 nt, Shigella flexneri 2a str. 2457T
ucuucuugaccguuu

SEQ ID NO: 1915105 - RNA, 14 nt, Shigella flexneri 2a str. 2457T
ucuucuuccgcuuc

SEQ ID NO: 1915106 - RNA, 14 nt, Shigella flexneri 2a str. 2457T
ucuucuucacucuc

SEQ ID NO: 1915107 - RNA, 14 nt, Shigella flexneri 2a str. 2457T
ucuucugcaagcau

SEQ ID NO: 1915108 - RNA, 18 nt, Shigella flexneri 2a str. 2457T
ucuucugcagucaccugc

SEQ ID NO: 1915109 - RNA, 18 nt, Shigella flexneri 2a str. 2457T
ucuucuggguugccugau

SEQ ID NO: 1915110 - RNA, 19 nt, Shigella flexneri 2a str. 2457T
ucuucugucgggcaucacu

SEQ ID NO: 1915111 - RNA, 15 nt, Shigella flexneri 2a str. 2457T
ucuucucgauaaaac

SEQ ID NO: 1915112 - RNA, 21 nt, Shigella flexneri 2a str. 2457T
ucuucugaaaaggucacuccc

SEQ ID NO: 1915113 - RNA, 14 nt, Shigella flexneri 2a str. 2457T
ucuucagccugcac

SEQ ID NO: 1915114 - RNA, 23 nt, Shigella flexneri 2a str. 2457T
ucuucagcgacugucuuucaggc

SEQ ID NO: 1915115 - RNA, 14 nt, Shigella flexneri 2a str. 2457T
ucuucagcaguuca

SEQ ID NO: 1915116 - RNA, 14 nt, Shigella flexneri 2a str. 2457T
ucuucagcaucaau

SEQ ID NO: 1915117 - RNA, 13 nt, Shigella flexneri 2a str. 2457T
ucuucaacacacu

SEQ ID NO: 1915118 - RNA, 18 nt, Shigella flexneri 2a str. 2457T
ucuucaacaauugaagaa

SEQ ID NO: 1915119 - RNA, 16 nt, Shigella flexneri 2a str. 2457T
ucuucaaacugaagau

SEQ ID NO: 1915120 - RNA, 17 nt, Shigella flexneri 2a str. 2457T
ucuucaaaaaagucaga

SEQ ID NO: 1915121 - RNA, 17 nt, Shigella flexneri 2a str. 2457T
ucuucaucauccucuuc

SEQ ID NO: 1915122 - RNA, 18 nt, Shigella flexneri 2a str. 2457T
ucuucaucgauacugcuc

SEQ ID NO: 1915123 - RNA, 17 nt, Shigella flexneri 2a str. 2457T
ucuucaucgcuaaaaua

SEQ ID NO: 1915124 - RNA, 20 nt, Shigella flexneri 2a str. 2457T
ucuucaugccucguuucccu

SEQ ID NO: 1915125 - RNA, 19 nt, Shigella flexneri 2a str. 2457T
ucuucauuaaaccagugcc

SEQ ID NO: 1915126 - RNA, 21 nt, Shigella flexneri 2a str. 2457T
ucuucauuaaauuuccgcgaa

SEQ ID NO: 1915127 - RNA, 15 nt, Shigella flexneri 2a str. 2457T
ucuucauuaccuuca

SEQ ID NO: 1915128 - RNA, 13 nt, Shigella flexneri 2a str. 2457T
ucuucccuuucug

SEQ ID NO: 1915129 - RNA, 14 nt, Shigella flexneri 2a str. 2457T
ucuuccgcuucaau

SEQ ID NO: 1915130 - RNA, 17 nt, Shigella flexneri 2a str. 2457T
ucuuccgcgccaaacau

SEQ ID NO: 1915131 - RNA, 21 nt, Shigella flexneri 2a str. 2457T
ucuucccugcugaauccccuu

SEQ ID NO: 1915132 - RNA, 24 nt, Shigella flexneri 2a str. 2457T
ucuucccgagacauuccuuuacuu

SEQ ID NO: 1915133 - RNA, 20 nt, Shigella flexneri 2a str. 2457T
ucuucccgagacauuccuuu

SEQ ID NO: 1915134 - RNA, 20 nt, Shigella flexneri 2a str. 2457T
ucuuccccugcgauaacggu

SEQ ID NO: 1915135 - RNA, 20 nt, Shigella flexneri 2a str. 2457T
ucuuauuaaauugucuuaaa

SEQ ID NO: 1915136 - RNA, 13 nt, Shigella flexneri 2a str. 2457T
ucuuacuucaaca

SEQ ID NO: 1915137 - RNA, 17 nt, Shigella flexneri 2a str. 2457T
ucuuacucuuucaauuu

SEQ ID NO: 1915138 - RNA, 17 nt, Shigella flexneri 2a str. 2457T
ucuuaaucgcuucuucu

SEQ ID NO: 1915139 - RNA, 17 nt, Shigella flexneri 2a str. 2457T
ucugguaaaccuuccac

SEQ ID NO: 1915140 - RNA, 14 nt, Shigella flexneri 2a str. 2457T
ucugguauuaaccg

SEQ ID NO: 1915141 - RNA, 22 nt, Shigella flexneri 2a str. 2457T
ucuguuugccucguucuucccu

SEQ ID NO: 1915142 - RNA, 15 nt, Shigella flexneri 2a str. 2457T
ucuuaacgucgcaag

SEQ ID NO: 1915143 - RNA, 19 nt, Shigella flexneri 2a str. 2457T
ucuuaaaggggugaaaaaa

SEQ ID NO: 1915144 - RNA, 23 nt, Shigella flexneri 2a str. 2457T
ucugccauccguaauuuuuacuc

SEQ ID NO: 1915145 - RNA, 21 nt, Shigella flexneri 2a str. 2457T
ucugccaucauggcauccugu

SEQ ID NO: 1915146 - RNA, 18 nt, Shigella flexneri 2a str. 2457T
ucugcaaauauuaauaau

SEQ ID NO: 1915147 - RNA, 14 nt, Shigella flexneri 2a str. 2457T
ucugcaaaaaugcc

SEQ ID NO: 1915148 - RNA, 23 nt, Shigella flexneri 2a str. 2457T
ucugauuuaaccaacaauaaaau

SEQ ID NO: 1915149 - RNA, 14 nt, Shigella flexneri 2a str. 2457T
ucugauugccuucc

SEQ ID NO: 1915150 - RNA, 16 nt, Shigella flexneri 2a str. 2457T
ucugaugcauaaaaaa

SEQ ID NO: 1915151 - RNA, 21 nt, Shigella flexneri 2a str. 2457T
ucugaugauauuuuucccuga

SEQ ID NO: 1915152 - RNA, 22 nt, Shigella flexneri 2a str. 2457T
ucugauuacuuccuucaugggg

SEQ ID NO: 1915153 - RNA, 17 nt, Shigella flexneri 2a str. 2457T
ucugauguuguuuuuaa

SEQ ID NO: 1915154 - RNA, 20 nt, Shigella flexneri 2a str. 2457T
ucugcgccgagggaaauaga

SEQ ID NO: 1915155 - RNA, 15 nt, Shigella flexneri 2a str. 2457T
ucugcgcccagcaac

SEQ ID NO: 1915156 - RNA, 23 nt, Shigella flexneri 2a str. 2457T
ucugcgccaccacaacauuccca

SEQ ID NO: 1915157 - RNA, 13 nt, Shigella flexneri 2a str. 2457T
ucugcgccagcga

SEQ ID NO: 1915158 - RNA, 16 nt, Shigella flexneri 2a str. 2457T
ucugcgcacacacgcc

SEQ ID NO: 1915159 - RNA, 22 nt, Shigella flexneri 2a str. 2457T
ucugccggagggauguggccca

SEQ ID NO: 1915160 - RNA, 13 nt, Shigella flexneri 2a str. 2457T
ucugccgcaauuc

SEQ ID NO: 1915161 - RNA, 23 nt, Shigella flexneri 2a str. 2457T
ucugccgggaagcucucuuccag

SEQ ID NO: 1915162 - RNA, 20 nt, Shigella flexneri 2a str. 2457T
ucugccugcugggcgcaccu

SEQ ID NO: 1915163 - RNA, 23 nt, Shigella flexneri 2a str. 2457T
ucuggaauggaaacagcaccauc

SEQ ID NO: 1915164 - RNA, 18 nt, Shigella flexneri 2a str. 2457T
ucuggccugagacugaug

SEQ ID NO: 1915165 - RNA, 18 nt, Shigella flexneri 2a str. 2457T
ucuggcgaaccgcuuugc

SEQ ID NO: 1915166 - RNA, 17 nt, Shigella flexneri 2a str. 2457T
ucuggcgagucaccaua

SEQ ID NO: 1915167 - RNA, 15 nt, Shigella flexneri 2a str. 2457T
ucuggcgauuuugaa

SEQ ID NO: 1915168 - RNA, 12 nt, Shigella flexneri 2a str. 2457T
ucugcuggcaaa

SEQ ID NO: 1915169 - RNA, 14 nt, Shigella flexneri 2a str. 2457T
ucugcugccugacg

SEQ ID NO: 1915170 - RNA, 20 nt, Shigella flexneri 2a str. 2457T
ucugcucuucuuucaucaug

SEQ ID NO: 1915171 - RNA, 12 nt, Shigella flexneri 2a str. 2457T
ucugcgcuuugu

SEQ ID NO: 1915172 - RNA, 23 nt, Shigella flexneri 2a str. 2457T
ucugcgcuauccagcgcauagcu

SEQ ID NO: 1915173 - RNA, 18 nt, Shigella flexneri 2a str. 2457T
ucugcggguuagucugca

SEQ ID NO: 1915174 - RNA, 19 nt, Shigella flexneri 2a str. 2457T
ucugcguaucgcccugcca

SEQ ID NO: 1915175 - RNA, 21 nt, Shigella flexneri 2a str. 2457T
ucugcgugaguuuuugucccc

SEQ ID NO: 1915176 - RNA, 12 nt, Shigella flexneri 2a str. 2457T
ucugcguucuga

SEQ ID NO: 1915177 - RNA, 18 nt, Shigella flexneri 2a str. 2457T
ucucguccaguuugccuu

SEQ ID NO: 1915178 - RNA, 22 nt, Shigella flexneri 2a str. 2457T
ucucgucgaacucauacaccag

SEQ ID NO: 1915179 - RNA, 12 nt, Shigella flexneri 2a str. 2457T
ucucgucucccg

SEQ ID NO: 1915180 - RNA, 17 nt, Shigella flexneri 2a str. 2457T
ucucgggaaggcccuuu

SEQ ID NO: 1915181 - RNA, 13 nt, Shigella flexneri 2a str. 2457T
ucucgggaaggcc

SEQ ID NO: 1915182 - RNA, 15 nt, Shigella flexneri 2a str. 2457T
ucucggcuuugguau

SEQ ID NO: 1915183 - RNA, 16 nt, Shigella flexneri 2a str. 2457T
ucgcauuaacagccag

SEQ ID NO: 1915184 - RNA, 17 nt, Shigella flexneri 2a str. 2457T
ucgcauggcggaucacg

SEQ ID NO: 1915185 - RNA, 22 nt, Shigella flexneri 2a str. 2457T
ucgcaucgaugguugcccugcu

SEQ ID NO: 1915186 - RNA, 19 nt, Shigella flexneri 2a str. 2457T
ucgcauccgacaucaaccg

SEQ ID NO: 1915187 - RNA, 15 nt, Shigella flexneri 2a str. 2457T
ucgcaucaggcauuu

SEQ ID NO: 1915188 - RNA, 23 nt, Shigella flexneri 2a str. 2457T
ucgcaucaggcaucaugcucaga

SEQ ID NO: 1915189 - RNA, 21 nt, Shigella flexneri 2a str. 2457T
ucucuguuuccagauuuugcu

SEQ ID NO: 1915190 - RNA, 18 nt, Shigella flexneri 2a str. 2457T
ucucuguuuugcaugggg

SEQ ID NO: 1915191 - RNA, 19 nt, Shigella flexneri 2a str. 2457T
ucucuucggcuucugccuu

SEQ ID NO: 1915192 - RNA, 22 nt, Shigella flexneri 2a str. 2457T
aaaugcguggcgcguaccgccg

SEQ ID NO: 1915193 - RNA, 14 nt, Shigella flexneri 2a str. 2457T
ucucuucagccaac

SEQ ID NO: 1915194 - RNA, 13 nt, Shigella flexneri 2a str. 2457T
ucucuuaucaucc

SEQ ID NO: 1915195 - RNA, 17 nt, Shigella flexneri 2a str. 2457T
ucugaaaucaucaauac

SEQ ID NO: 1915196 - RNA, 12 nt, Shigella flexneri 2a str. 2457T
ucugaacugaac

SEQ ID NO: 1915197 - RNA, 22 nt, Shigella flexneri 2a str. 2457T
ucugaaaucaucaauaccagcc

SEQ ID NO: 1915198 - RNA, 11 nt, Shigella flexneri 2a str. 2457T
ucugaauaaac

SEQ ID NO: 1915199 - RNA, 17 nt, Shigella flexneri 2a str. 2457T
ucugaauaacacccaua

SEQ ID NO: 1915200 - RNA, 19 nt, Shigella flexneri 2a str. 2457T
aaaugcugcuuuauauucu

SEQ ID NO: 1915201 - RNA, 11 nt, Shigella flexneri 2a str. 2457T
aaaugcuggau

SEQ ID NO: 1915202 - RNA, 15 nt, Shigella flexneri 2a str. 2457T
aaaugcugguuuugu

SEQ ID NO: 1915203 - RNA, 12 nt, Shigella flexneri 2a str. 2457T
ucugaauuucag

SEQ ID NO: 1915204 - RNA, 22 nt, Shigella flexneri 2a str. 2457T
ucugacaacguagcguuaaaac

SEQ ID NO: 1915205 - RNA, 23 nt, Shigella flexneri 2a str. 2457T
ucugaauaucaucccccugcgau

SEQ ID NO: 1915206 - RNA, 20 nt, Shigella flexneri 2a str. 2457T
ucugaugaggcauaagcgac

SEQ ID NO: 1915207 - RNA, 17 nt, Shigella flexneri 2a str. 2457T
ucugagauucaauuaua

SEQ ID NO: 1915208 - RNA, 14 nt, Shigella flexneri 2a str. 2457T
ucugauaguuaaaa

SEQ ID NO: 1915209 - RNA, 17 nt, Shigella flexneri 2a str. 2457T
ucugagagcaugaaaug

SEQ ID NO: 1915210 - RNA, 13 nt, Shigella flexneri 2a str. 2457T
ucugacugucaga

SEQ ID NO: 1915211 - RNA, 18 nt, Shigella flexneri 2a str. 2457T
ugacauuaucagacaccg

SEQ ID NO: 1915212 - RNA, 13 nt, Shigella flexneri 2a str. 2457T
ugaccaaaaacau

SEQ ID NO: 1915213 - RNA, 23 nt, Shigella flexneri 2a str. 2457T
ugacauuugcuuuuguuaauugc

SEQ ID NO: 1915214 - RNA, 14 nt, Shigella flexneri 2a str. 2457T
ugaauaacaccagc

SEQ ID NO: 1915215 - RNA, 15 nt, Shigella flexneri 2a str. 2457T
ugaauaaauuuuauu

SEQ ID NO: 1915216 - RNA, 15 nt, Shigella flexneri 2a str. 2457T
ugacaucgcccugau

SEQ ID NO: 1915217 - RNA, 14 nt, Shigella flexneri 2a str. 2457T
ugacaucuccagcg

SEQ ID NO: 1915218 - RNA, 18 nt, Shigella flexneri 2a str. 2457T
ugacccaguagacgagcc

SEQ ID NO: 1915219 - RNA, 16 nt, Shigella flexneri 2a str. 2457T
ugacccaucugccagc

SEQ ID NO: 1915220 - RNA, 18 nt, Shigella flexneri 2a str. 2457T
ugacccgcagccagcacu

SEQ ID NO: 1915221 - RNA, 22 nt, Shigella flexneri 2a str. 2457T
ugacccgcaccguccucacugu

SEQ ID NO: 1915222 - RNA, 21 nt, Shigella flexneri 2a str. 2457T
ugaccaccaccaccugcaucu

SEQ ID NO: 1915223 - RNA, 12 nt, Shigella flexneri 2a str. 2457T
ugacccagaccg

SEQ ID NO: 1915224 - RNA, 20 nt, Shigella flexneri 2a str. 2457T
ugaccacggccacagccagc

SEQ ID NO: 1915225 - RNA, 16 nt, Shigella flexneri 2a str. 2457T
ugacgacgacuggccg

SEQ ID NO: 1915226 - RNA, 14 nt, Shigella flexneri 2a str. 2457T
ugaccgaaugcagu

SEQ ID NO: 1915227 - RNA, 22 nt, Shigella flexneri 2a str. 2457T
ugaccgauaugaauaauuucgg

SEQ ID NO: 1915228 - RNA, 19 nt, Shigella flexneri 2a str. 2457T
ugaccgguugcuggaucaa

SEQ ID NO: 1915229 - RNA, 21 nt, Shigella flexneri 2a str. 2457T
ugacgcucucuacgcccugua

SEQ ID NO: 1915230 - RNA, 16 nt, Shigella flexneri 2a str. 2457T
ugacgcgggcagcaga

SEQ ID NO: 1915231 - RNA, 22 nt, Shigella flexneri 2a str. 2457T
ugacgccccuggcgaugccccc

SEQ ID NO: 1915232 - RNA, 21 nt, Shigella flexneri 2a str. 2457T
ugacgccaaaauaacuuaaug

SEQ ID NO: 1915233 - RNA, 20 nt, Shigella flexneri 2a str. 2457T
ugacgccaccauucaccaag

SEQ ID NO: 1915234 - RNA, 17 nt, Shigella flexneri 2a str. 2457T
ugacgauagcgccgcca

SEQ ID NO: 1915235 - RNA, 13 nt, Shigella flexneri 2a str. 2457T
ugacgaugacugg

SEQ ID NO: 1915236 - RNA, 15 nt, Shigella flexneri 2a str. 2457T
ugacgauuguagaaa

SEQ ID NO: 1915237 - RNA, 14 nt, Shigella flexneri 2a str. 2457T
ugagacgcacccuc

SEQ ID NO: 1915238 - RNA, 19 nt, Shigella flexneri 2a str. 2457T
ugagagugaagccugauca

SEQ ID NO: 1915239 - RNA, 17 nt, Shigella flexneri 2a str. 2457T
ugagagggcgauaaauc

SEQ ID NO: 1915240 - RNA, 20 nt, Shigella flexneri 2a str. 2457T
ugagagugauuaacuguucu

SEQ ID NO: 1915241 - RNA, 19 nt, Shigella flexneri 2a str. 2457T
ugagagcaugaaaugaaaa

SEQ ID NO: 1915242 - RNA, 14 nt, Shigella flexneri 2a str. 2457T
ugagaacaccaccu

SEQ ID NO: 1915243 - RNA, 17 nt, Shigella flexneri 2a str. 2457T
ugagaacgacagugacu

SEQ ID NO: 1915244 - RNA, 19 nt, Shigella flexneri 2a str. 2457T
ugagaaccuuuaucacugu

SEQ ID NO: 1915245 - RNA, 11 nt, Shigella flexneri 2a str. 2457T
ugagaagcuuc

SEQ ID NO: 1915246 - RNA, 21 nt, Shigella flexneri 2a str. 2457T
ugagaacgacagugacuuccg

SEQ ID NO: 1915247 - RNA, 14 nt, Shigella flexneri 2a str. 2457T
ugagaacgcccauc

SEQ ID NO: 1915248 - RNA, 23 nt, Shigella flexneri 2a str. 2457T
ugacugaagaaaucccccagcau

SEQ ID NO: 1915249 - RNA, 14 nt, Shigella flexneri 2a str. 2457T
ugacucucauccaa

SEQ ID NO: 1915250 - RNA, 21 nt, Shigella flexneri 2a str. 2457T
ugacucggcucauuauuugcc

SEQ ID NO: 1915251 - RNA, 16 nt, Shigella flexneri 2a str. 2457T
ugacucgccugaaagu

SEQ ID NO: 1915252 - RNA, 21 nt, Shigella flexneri 2a str. 2457T
ugacucggacgcguuucauuc

SEQ ID NO: 1915253 - RNA, 16 nt, Shigella flexneri 2a str. 2457T
ugacuucgccgugaaa

SEQ ID NO: 1915254 - RNA, 18 nt, Shigella flexneri 2a str. 2457T
ugacuucgccgugaaagu

SEQ ID NO: 1915255 - RNA, 19 nt, Shigella flexneri 2a str. 2457T
ugacuucgccgugaaagug

SEQ ID NO: 1915256 - RNA, 20 nt, Shigella flexneri 2a str. 2457T
ugacuuccguaccagccuug

SEQ ID NO: 1915257 - RNA, 19 nt, Shigella flexneri 2a str. 2457T
ugacuucaauuugagcgaa

SEQ ID NO: 1915258 - RNA, 14 nt, Shigella flexneri 2a str. 2457T
ugacuuccacuucc

SEQ ID NO: 1915259 - RNA, 22 nt, Shigella flexneri 2a str. 2457T
ugacuuccacuuccugcggagc

SEQ ID NO: 1915260 - RNA, 21 nt, Shigella flexneri 2a str. 2457T
ugacugaaucaggaaccacaa

SEQ ID NO: 1915261 - RNA, 17 nt, Shigella flexneri 2a str. 2457T
ugacugauaacgcggca

SEQ ID NO: 1915262 - RNA, 22 nt, Shigella flexneri 2a str. 2457T
ugacguagcagcuccgccagcu

SEQ ID NO: 1915263 - RNA, 20 nt, Shigella flexneri 2a str. 2457T
ugacggucuggugcuguugc

SEQ ID NO: 1915264 - RNA, 15 nt, Shigella flexneri 2a str. 2457T
ugacgggcaaggcug

SEQ ID NO: 1915265 - RNA, 15 nt, Shigella flexneri 2a str. 2457T
ugacggcugccauca

SEQ ID NO: 1915266 - RNA, 16 nt, Shigella flexneri 2a str. 2457T
ugacggaaaucaucca

SEQ ID NO: 1915267 - RNA, 18 nt, Shigella flexneri 2a str. 2457T
ugacggaucccgccaaca

SEQ ID NO: 1915268 - RNA, 19 nt, Shigella flexneri 2a str. 2457T
ugacggaucccgccaacag

SEQ ID NO: 1915269 - RNA, 16 nt, Shigella flexneri 2a str. 2457T
ugacgcuggcagaaag

SEQ ID NO: 1915270 - RNA, 18 nt, Shigella flexneri 2a str. 2457T
ugacuacacuaaacgucu

SEQ ID NO: 1915271 - RNA, 20 nt, Shigella flexneri 2a str. 2457T
ugacuagaugugcaguuccu

SEQ ID NO: 1915272 - RNA, 13 nt, Shigella flexneri 2a str. 2457T
ugacuacaccauu

SEQ ID NO: 1915273 - RNA, 14 nt, Shigella flexneri 2a str. 2457T
ugacuaacacuuca

SEQ ID NO: 1915274 - RNA, 20 nt, Shigella flexneri 2a str. 2457T
ugacucaauggcauccgcca

SEQ ID NO: 1915275 - RNA, 23 nt, Shigella flexneri 2a str. 2457T
ugacuauuuccgauauucaggcg

SEQ ID NO: 1915276 - RNA, 21 nt, Shigella flexneri 2a str. 2457T
ugacuauccuggacuuuaaac

SEQ ID NO: 1915277 - RNA, 17 nt, Shigella flexneri 2a str. 2457T
ugacuaaaguuucuuua

SEQ ID NO: 1915278 - RNA, 18 nt, Shigella flexneri 2a str. 2457T
ugacguuuacuucgcuuu

SEQ ID NO: 1915279 - RNA, 17 nt, Shigella flexneri 2a str. 2457T
ugacgucuuaauaaaug

SEQ ID NO: 1915280 - RNA, 18 nt, Shigella flexneri 2a str. 2457T
ugauauguuuuaaagcga

SEQ ID NO: 1915281 - RNA, 15 nt, Shigella flexneri 2a str. 2457T
ugaucaggucagauu

SEQ ID NO: 1915282 - RNA, 14 nt, Shigella flexneri 2a str. 2457T
ugaucgaaaaugcg

SEQ ID NO: 1915283 - RNA, 17 nt, Shigella flexneri 2a str. 2457T
ugauccugcaacagcac

SEQ ID NO: 1915284 - RNA, 20 nt, Shigella flexneri 2a str. 2457T
ugauccgccgcgcggugggc

SEQ ID NO: 1915285 - RNA, 19 nt, Shigella flexneri 2a str. 2457T
ugaucauagcgaauaaucc

SEQ ID NO: 1915286 - RNA, 21 nt, Shigella flexneri 2a str. 2457T
ugaucugcgucgcuuuccagu

SEQ ID NO: 1915287 - RNA, 16 nt, Shigella flexneri 2a str. 2457T
ugaugaaguccacgcg

SEQ ID NO: 1915288 - RNA, 13 nt, Shigella flexneri 2a str. 2457T
ugauaucccugcu

SEQ ID NO: 1915289 - RNA, 22 nt, Shigella flexneri 2a str. 2457T
ugauaucccgcgcguuuuucuu

SEQ ID NO: 1915290 - RNA, 22 nt, Shigella flexneri 2a str. 2457T
ugauauccaccgcguucagcag

SEQ ID NO: 1915291 - RNA, 16 nt, Shigella flexneri 2a str. 2457T
ugauauauuuuuaaau

SEQ ID NO: 1915292 - RNA, 19 nt, Shigella flexneri 2a str. 2457T
ugauauauuuuuaaauaua

SEQ ID NO: 1915293 - RNA, 18 nt, Shigella flexneri 2a str. 2457T
ugauaguuuacuucuaua

SEQ ID NO: 1915294 - RNA, 14 nt, Shigella flexneri 2a str. 2457T
ugauaggcuuccac

SEQ ID NO: 1915295 - RNA, 18 nt, Shigella flexneri 2a str. 2457T
ugauagcccggauuucca

SEQ ID NO: 1915296 - RNA, 21 nt, Shigella flexneri 2a str. 2457T
ugauaccgggcguccugcuug

SEQ ID NO: 1915297 - RNA, 15 nt, Shigella flexneri 2a str. 2457T
ugauacugacauuaa

SEQ ID NO: 1915298 - RNA, 15 nt, Shigella flexneri 2a str. 2457T
ugauacguaaaccac

SEQ ID NO: 1915299 - RNA, 20 nt, Shigella flexneri 2a str. 2457T
ugauacgcgccaaucggcaa

SEQ ID NO: 1915300 - RNA, 19 nt, Shigella flexneri 2a str. 2457T
ugauacgcgcaccggaaca

SEQ ID NO: 1915301 - RNA, 16 nt, Shigella flexneri 2a str. 2457T
ugaguuaagcaaaaaa

SEQ ID NO: 1915302 - RNA, 15 nt, Shigella flexneri 2a str. 2457T
ugaguucacugccgu

SEQ ID NO: 1915303 - RNA, 14 nt, Shigella flexneri 2a str. 2457T
ugaguuaagaagau

SEQ ID NO: 1915304 - RNA, 21 nt, Shigella flexneri 2a str. 2457T
ugaguuacgccaucccaacug

SEQ ID NO: 1915305 - RNA, 15 nt, Shigella flexneri 2a str. 2457T
ugaguguauuuacca

SEQ ID NO: 1915306 - RNA, 18 nt, Shigella flexneri 2a str. 2457T
ugaguggugaaaaaaagg

SEQ ID NO: 1915307 - RNA, 16 nt, Shigella flexneri 2a str. 2457T
ugauaaaccuccagca

SEQ ID NO: 1915308 - RNA, 21 nt, Shigella flexneri 2a str. 2457T
ugauaaaauucauucaauuaa

SEQ ID NO: 1915309 - RNA, 13 nt, Shigella flexneri 2a str. 2457T
ugauaaacaagcg

SEQ ID NO: 1915310 - RNA, 15 nt, Shigella flexneri 2a str. 2457T
ugauaaaaaacccgc

SEQ ID NO: 1915311 - RNA, 22 nt, Shigella flexneri 2a str. 2457T
ugagguccggccauacccgcca

SEQ ID NO: 1915312 - RNA, 16 nt, Shigella flexneri 2a str. 2457T
ugagggcgcaauuucc

SEQ ID NO: 1915313 - RNA, 23 nt, Shigella flexneri 2a str. 2457T
ugaggguguuggaacccgcagcc

SEQ ID NO: 1915314 - RNA, 17 nt, Shigella flexneri 2a str. 2457T
ugaggaucacaaaacga

SEQ ID NO: 1915315 - RNA, 14 nt, Shigella flexneri 2a str. 2457T
ugagcguuucaaaa

SEQ ID NO: 1915316 - RNA, 20 nt, Shigella flexneri 2a str. 2457T
ugagcguuacccgcagccau

SEQ ID NO: 1915317 - RNA, 14 nt, Shigella flexneri 2a str. 2457T
ugagcucuaucucc

SEQ ID NO: 1915318 - RNA, 17 nt, Shigella flexneri 2a str. 2457T
ugagcucuaucucccug

SEQ ID NO: 1915319 - RNA, 14 nt, Shigella flexneri 2a str. 2457T
ugaggaagcgcagc

SEQ ID NO: 1915320 - RNA, 15 nt, Shigella flexneri 2a str. 2457T
ugagauuucaccaau

SEQ ID NO: 1915321 - RNA, 21 nt, Shigella flexneri 2a str. 2457T
ugagauuuauuuaccgcuacu

SEQ ID NO: 1915322 - RNA, 13 nt, Shigella flexneri 2a str. 2457T
ugagcaaacaguu

SEQ ID NO: 1915323 - RNA, 19 nt, Shigella flexneri 2a str. 2457T
ugagcaaacaguucugcag

SEQ ID NO: 1915324 - RNA, 21 nt, Shigella flexneri 2a str. 2457T
ugagcaaacaguucugcagcg

SEQ ID NO: 1915325 - RNA, 19 nt, Shigella flexneri 2a str. 2457T
ugagaucaaacucuuucaa

SEQ ID NO: 1915326 - RNA, 23 nt, Shigella flexneri 2a str. 2457T
ugagauaauucuguaauccucuu

SEQ ID NO: 1915327 - RNA, 22 nt, Shigella flexneri 2a str. 2457T
ugagauacucaagcagccaggu

SEQ ID NO: 1915328 - RNA, 16 nt, Shigella flexneri 2a str. 2457T
ugagcggccuuuuccu

SEQ ID NO: 1915329 - RNA, 15 nt, Shigella flexneri 2a str. 2457T
ugagcguauccagca

SEQ ID NO: 1915330 - RNA, 13 nt, Shigella flexneri 2a str. 2457T
ugagcgucauuau

SEQ ID NO: 1915331 - RNA, 17 nt, Shigella flexneri 2a str. 2457T
ugcaucuucacacugau

SEQ ID NO: 1915332 - RNA, 21 nt, Shigella flexneri 2a str. 2457T
ugcauucaacuggauaaaauu

SEQ ID NO: 1915333 - RNA, 20 nt, Shigella flexneri 2a str. 2457T
ugcauuccaguccacaucaa

SEQ ID NO: 1915334 - RNA, 13 nt, Shigella flexneri 2a str. 2457T
ugcaucuguuuuc

SEQ ID NO: 1915335 - RNA, 23 nt, Shigella flexneri 2a str. 2457T
ugcaucgucuguuuuaucucccu

SEQ ID NO: 1915336 - RNA, 23 nt, Shigella flexneri 2a str. 2457T
ugcaucuccggcgcauccaugau

SEQ ID NO: 1915337 - RNA, 18 nt, Shigella flexneri 2a str. 2457T
ugcaucgcuugaaaaggu

SEQ ID NO: 1915338 - RNA, 13 nt, Shigella flexneri 2a str. 2457T
ugcaucagugaca

SEQ ID NO: 1915339 - RNA, 22 nt, Shigella flexneri 2a str. 2457T
ugcaucauaaccugcucugcca

SEQ ID NO: 1915340 - RNA, 15 nt, Shigella flexneri 2a str. 2457T
ugcauuucauugagc

SEQ ID NO: 1915341 - RNA, 17 nt, Shigella flexneri 2a str. 2457T
ugcauuuccauaaauug

SEQ ID NO: 1915342 - RNA, 19 nt, Shigella flexneri 2a str. 2457T
ugcauuuccgcugauucaa

SEQ ID NO: 1915343 - RNA, 15 nt, Shigella flexneri 2a str. 2457T
ugcauuuauauuaca

SEQ ID NO: 1915344 - RNA, 16 nt, Shigella flexneri 2a str. 2457T
ugcauuuaagaaaaaa

SEQ ID NO: 1915345 - RNA, 21 nt, Shigella flexneri 2a str. 2457T
ugccaaucuucacaucaucau

SEQ ID NO: 1915346 - RNA, 14 nt, Shigella flexneri 2a str. 2457T
ugccaaucagcaga

SEQ ID NO: 1915347 - RNA, 15 nt, Shigella flexneri 2a str. 2457T
ugccaaucagcagaa

SEQ ID NO: 1915348 - RNA, 16 nt, Shigella flexneri 2a str. 2457T
ugccaauggcaggcuc

SEQ ID NO: 1915349 - RNA, 15 nt, Shigella flexneri 2a str. 2457T
ugccaccagcgcaau

SEQ ID NO: 1915350 - RNA, 18 nt, Shigella flexneri 2a str. 2457T
ugccaccacugcaaugac

SEQ ID NO: 1915351 - RNA, 15 nt, Shigella flexneri 2a str. 2457T
ugccaccagcagcgu

SEQ ID NO: 1915352 - RNA, 22 nt, Shigella flexneri 2a str. 2457T
ugccaccaccagcguaccgaua

SEQ ID NO: 1915353 - RNA, 14 nt, Shigella flexneri 2a str. 2457T
ugccaccagggaua

SEQ ID NO: 1915354 - RNA, 21 nt, Shigella flexneri 2a str. 2457T
ugcagugaucgugugccacca

SEQ ID NO: 1915355 - RNA, 16 nt, Shigella flexneri 2a str. 2457T
ugcaguuaaaauagga

SEQ ID NO: 1915356 - RNA, 20 nt, Shigella flexneri 2a str. 2457T
ugcauacccagaacuaucau

SEQ ID NO: 1915357 - RNA, 13 nt, Shigella flexneri 2a str. 2457T
ugcauaauuucuu

SEQ ID NO: 1915358 - RNA, 18 nt, Shigella flexneri 2a str. 2457T
ugcauagcagcacaccac

SEQ ID NO: 1915359 - RNA, 18 nt, Shigella flexneri 2a str. 2457T
ugcaucaaguugauuuuu

SEQ ID NO: 1915360 - RNA, 23 nt, Shigella flexneri 2a str. 2457T
ugcaucacauccggcaauauuca

SEQ ID NO: 1915361 - RNA, 22 nt, Shigella flexneri 2a str. 2457T
ugcaucaggcaaacuucacgca

SEQ ID NO: 1915362 - RNA, 19 nt, Shigella flexneri 2a str. 2457T
ugcaucagcacgacuauua

SEQ ID NO: 1915363 - RNA, 17 nt, Shigella flexneri 2a str. 2457T
ugcaucagaucggcagg

SEQ ID NO: 1915364 - RNA, 21 nt, Shigella flexneri 2a str. 2457T
ugcauaaacgccgucaucaca

SEQ ID NO: 1915365 - RNA, 18 nt, Shigella flexneri 2a str. 2457T
ugcauaaagcgguuuuca

SEQ ID NO: 1915366 - RNA, 15 nt, Shigella flexneri 2a str. 2457T
ugcauaaaugccgca

SEQ ID NO: 1915367 - RNA, 14 nt, Shigella flexneri 2a str. 2457T
ugcauaauccugcc

SEQ ID NO: 1915368 - RNA, 22 nt, Shigella flexneri 2a str. 2457T
ugcaguuccugccagauuugcu

SEQ ID NO: 1915369 - RNA, 12 nt, Shigella flexneri 2a str. 2457T
ugcacaggcaau

SEQ ID NO: 1915370 - RNA, 22 nt, Shigella flexneri 2a str. 2457T
ugcacaguauagcaucauaaga

SEQ ID NO: 1915371 - RNA, 12 nt, Shigella flexneri 2a str. 2457T
ugcacaggcaac

SEQ ID NO: 1915372 - RNA, 14 nt, Shigella flexneri 2a str. 2457T
ugcacauuccagau

SEQ ID NO: 1915373 - RNA, 20 nt, Shigella flexneri 2a str. 2457T
ugcacauucccugcagucac

SEQ ID NO: 1915374 - RNA, 22 nt, Shigella flexneri 2a str. 2457T
ugcaccaacccuaacccaacau

SEQ ID NO: 1915375 - RNA, 19 nt, Shigella flexneri 2a str. 2457T
ugcacacagggcgcuagcc

SEQ ID NO: 1915376 - RNA, 18 nt, Shigella flexneri 2a str. 2457T
ugcacaaauagccagcag

SEQ ID NO: 1915377 - RNA, 18 nt, Shigella flexneri 2a str. 2457T
ugcacaccccgcgcagcu

SEQ ID NO: 1915378 - RNA, 22 nt, Shigella flexneri 2a str. 2457T
ugcacaccccgcgcagcugaga

SEQ ID NO: 1915379 - RNA, 17 nt, Shigella flexneri 2a str. 2457T
ugcacagacuuaauauu

SEQ ID NO: 1915380 - RNA, 17 nt, Shigella flexneri 2a str. 2457T
ugcacguuguuauccag

SEQ ID NO: 1915381 - RNA, 18 nt, Shigella flexneri 2a str. 2457T
ugcaccugauccagcucu

SEQ ID NO: 1915382 - RNA, 15 nt, Shigella flexneri 2a str. 2457T
ugcaccauugcugcc

SEQ ID NO: 1915383 - RNA, 18 nt, Shigella flexneri 2a str. 2457T
ugcaccaucaggcauauu

SEQ ID NO: 1915384 - RNA, 13 nt, Shigella flexneri 2a str. 2457T
ugcaccgggcuuu

SEQ ID NO: 1915385 - RNA, 20 nt, Shigella flexneri 2a str. 2457T
ugcaccggcgacaucccagg

SEQ ID NO: 1915386 - RNA, 19 nt, Shigella flexneri 2a str. 2457T
ugcaccagcaacaagccag

SEQ ID NO: 1915387 - RNA, 16 nt, Shigella flexneri 2a str. 2457T
ugcaccagcaacaagc

SEQ ID NO: 1915388 - RNA, 20 nt, Shigella flexneri 2a str. 2457T
ugcagcaaacgauucaaaag

SEQ ID NO: 1915389 - RNA, 13 nt, Shigella flexneri 2a str. 2457T
ugcacugggagaa

SEQ ID NO: 1915390 - RNA, 12 nt, Shigella flexneri 2a str. 2457T
ugcacuggcuuc

SEQ ID NO: 1915391 - RNA, 17 nt, Shigella flexneri 2a str. 2457T
ugcacuuaacaggaucu

SEQ ID NO: 1915392 - RNA, 19 nt, Shigella flexneri 2a str. 2457T
ugcacuugcuuaaaauccc

SEQ ID NO: 1915393 - RNA, 19 nt, Shigella flexneri 2a str. 2457T
ugcacucgcauccucuuua

SEQ ID NO: 1915394 - RNA, 19 nt, Shigella flexneri 2a str. 2457T
ugcacuagacgaugaaaaa

SEQ ID NO: 1915395 - RNA, 20 nt, Shigella flexneri 2a str. 2457T
ugcacuagacgaugaaaaag

SEQ ID NO: 1915396 - RNA, 16 nt, Shigella flexneri 2a str. 2457T
ugcacuagguuuucgu

SEQ ID NO: 1915397 - RNA, 16 nt, Shigella flexneri 2a str. 2457T
ugcagcguuuccagcc

SEQ ID NO: 1915398 - RNA, 18 nt, Shigella flexneri 2a str. 2457T
ugcagcguaaaccccuua

SEQ ID NO: 1915399 - RNA, 15 nt, Shigella flexneri 2a str. 2457T
ugcagcgucaucaac

SEQ ID NO: 1915400 - RNA, 14 nt, Shigella flexneri 2a str. 2457T
ugcagccuucauuc

SEQ ID NO: 1915401 - RNA, 15 nt, Shigella flexneri 2a str. 2457T
ugcagccggagcuuc

SEQ ID NO: 1915402 - RNA, 14 nt, Shigella flexneri 2a str. 2457T
ugcagcaagccauc

SEQ ID NO: 1915403 - RNA, 16 nt, Shigella flexneri 2a str. 2457T
ugcagcaacucuuuuu

SEQ ID NO: 1915404 - RNA, 23 nt, Shigella flexneri 2a str. 2457T
ugcagcacacauuauaggccuga

SEQ ID NO: 1915405 - RNA, 20 nt, Shigella flexneri 2a str. 2457T
ugcagcacggagagacguug

SEQ ID NO: 1915406 - RNA, 14 nt, Shigella flexneri 2a str. 2457T
ugcaaccuuuucca

SEQ ID NO: 1915407 - RNA, 22 nt, Shigella flexneri 2a str. 2457T
ugcaacccgccagguuucauag

SEQ ID NO: 1915408 - RNA, 17 nt, Shigella flexneri 2a str. 2457T
ugcaacauguugaaucu

SEQ ID NO: 1915409 - RNA, 13 nt, Shigella flexneri 2a str. 2457T
ugcaacagcacca

SEQ ID NO: 1915410 - RNA, 15 nt, Shigella flexneri 2a str. 2457T
ugcaaauucaauaua

SEQ ID NO: 1915411 - RNA, 17 nt, Shigella flexneri 2a str. 2457T
ugcaaaucggcaaucuc

SEQ ID NO: 1915412 - RNA, 20 nt, Shigella flexneri 2a str. 2457T
ugcaaaugccagauaagaca

SEQ ID NO: 1915413 - RNA, 22 nt, Shigella flexneri 2a str. 2457T
ugcaacaagaggcaauaguucu

SEQ ID NO: 1915414 - RNA, 15 nt, Shigella flexneri 2a str. 2457T
ugcaacucgacugga

SEQ ID NO: 1915415 - RNA, 22 nt, Shigella flexneri 2a str. 2457T
ugcaacugaguucucaugguuc

SEQ ID NO: 1915416 - RNA, 17 nt, Shigella flexneri 2a str. 2457T
ugcaaccuuuuccauug

SEQ ID NO: 1915417 - RNA, 17 nt, Shigella flexneri 2a str. 2457T
ugcaagccuguaguaca

SEQ ID NO: 1915418 - RNA, 18 nt, Shigella flexneri 2a str. 2457T
ugcaaggugaaagcaauu

SEQ ID NO: 1915419 - RNA, 14 nt, Shigella flexneri 2a str. 2457T
ugcaagaaaugaca

SEQ ID NO: 1915420 - RNA, 23 nt, Shigella flexneri 2a str. 2457T
ugcaagaucgcgcaucagcuccg

SEQ ID NO: 1915421 - RNA, 16 nt, Shigella flexneri 2a str. 2457T
ugcaauuauuaaccug

SEQ ID NO: 1915422 - RNA, 17 nt, Shigella flexneri 2a str. 2457T
ugcacaaagguuucgua

SEQ ID NO: 1915423 - RNA, 22 nt, Shigella flexneri 2a str. 2457T
ugcaauuaaggucggcuuugaa

SEQ ID NO: 1915424 - RNA, 15 nt, Shigella flexneri 2a str. 2457T
ugcaaugucaucagc

SEQ ID NO: 1915425 - RNA, 22 nt, Shigella flexneri 2a str. 2457T
ugcaaugucaucagcauucuca

SEQ ID NO: 1915426 - RNA, 19 nt, Shigella flexneri 2a str. 2457T
ugcaaugccguuugcugca

SEQ ID NO: 1915427 - RNA, 23 nt, Shigella flexneri 2a str. 2457T
ugcaaugccguuugcugcaugau

SEQ ID NO: 1915428 - RNA, 15 nt, Shigella flexneri 2a str. 2457T
ugcaaugauucaggc

SEQ ID NO: 1915429 - RNA, 24 nt, Shigella flexneri 2a str. 2457T
ugcaaucuacaaaagauuauugcu

SEQ ID NO: 1915430 - RNA, 15 nt, Shigella flexneri 2a str. 2457T
ugcaaucuacaaaag

SEQ ID NO: 1915431 - RNA, 13 nt, Shigella flexneri 2a str. 2457T
ugcaaucaguuca

SEQ ID NO: 1915432 - RNA, 20 nt, Shigella flexneri 2a str. 2457T
ugcaaucaguucaaauucau

SEQ ID NO: 1915433 - RNA, 18 nt, Shigella flexneri 2a str. 2457T
ugcaagugagucggcuuu

SEQ ID NO: 1915434 - RNA, 22 nt, Shigella flexneri 2a str. 2457T
ugcaagguggucagacggaaca

SEQ ID NO: 1915435 - RNA, 18 nt, Shigella flexneri 2a str. 2457T
ugcaauaauggaaccuaa

SEQ ID NO: 1915436 - RNA, 22 nt, Shigella flexneri 2a str. 2457T
ugcaauaauggaaccuaacgcu

SEQ ID NO: 1915437 - RNA, 18 nt, Shigella flexneri 2a str. 2457T
ugcaauacuuccgcuucc

SEQ ID NO: 1915438 - RNA, 16 nt, Shigella flexneri 2a str. 2457T
ugcaauauauugaauu

SEQ ID NO: 1915439 - RNA, 23 nt, Shigella flexneri 2a str. 2457T
ugcaaucaaaaauggcuuuauuc

SEQ ID NO: 1915440 - RNA, 21 nt, Shigella flexneri 2a str. 2457T
ugcaaucaacaccacugccag

SEQ ID NO: 1915441 - RNA, 16 nt, Shigella flexneri 2a str. 2457T
ugcaaucagauaaaau

SEQ ID NO: 1915442 - RNA, 18 nt, Shigella flexneri 2a str. 2457T
ugauuuugcauuuuaaau

SEQ ID NO: 1915443 - RNA, 20 nt, Shigella flexneri 2a str. 2457T
ugauuuugccugugcaaccu

SEQ ID NO: 1915444 - RNA, 17 nt, Shigella flexneri 2a str. 2457T
ugauuuuucguuuuaau

SEQ ID NO: 1915445 - RNA, 23 nt, Shigella flexneri 2a str. 2457T
ugauuuuucguuuuaaugcgauc

SEQ ID NO: 1915446 - RNA, 18 nt, Shigella flexneri 2a str. 2457T
ugauuuuucguuuuaaug

SEQ ID NO: 1915447 - RNA, 19 nt, Shigella flexneri 2a str. 2457T
ugauuuuucguuuuaaugc

SEQ ID NO: 1915448 - RNA, 12 nt, Shigella flexneri 2a str. 2457T
ugcaaaaaaacu

SEQ ID NO: 1915449 - RNA, 20 nt, Shigella flexneri 2a str. 2457T
ugcaaaaaauacguaaaauc

SEQ ID NO: 1915450 - RNA, 22 nt, Shigella flexneri 2a str. 2457T
ugcaaaaaauugcgucaguauu

SEQ ID NO: 1915451 - RNA, 14 nt, Shigella flexneri 2a str. 2457T
ugcaaaucaccaca

SEQ ID NO: 1915452 - RNA, 13 nt, Shigella flexneri 2a str. 2457T
ugcaaauauuaau

SEQ ID NO: 1915453 - RNA, 12 nt, Shigella flexneri 2a str. 2457T
ugcaaauauaca

SEQ ID NO: 1915454 - RNA, 18 nt, Shigella flexneri 2a str. 2457T
ugcaaauacccaaaaaau

SEQ ID NO: 1915455 - RNA, 13 nt, Shigella flexneri 2a str. 2457T
ugcaaaaauucaa

SEQ ID NO: 1915456 - RNA, 13 nt, Shigella flexneri 2a str. 2457T
ugcaaaaccuggu

SEQ ID NO: 1915457 - RNA, 16 nt, Shigella flexneri 2a str. 2457T
ugauugaagaaaucag

SEQ ID NO: 1915458 - RNA, 20 nt, Shigella flexneri 2a str. 2457T
ugauugacgcguucgcuaaa

SEQ ID NO: 1915459 - RNA, 18 nt, Shigella flexneri 2a str. 2457T
ugauugagcugcccggcu

SEQ ID NO: 1915460 - RNA, 22 nt, Shigella flexneri 2a str. 2457T
ugauuuaaccaacaauaaaauu

SEQ ID NO: 1915461 - RNA, 20 nt, Shigella flexneri 2a str. 2457T
ugauuuaaaaccacuaccca

SEQ ID NO: 1915462 - RNA, 22 nt, Shigella flexneri 2a str. 2457T
ugauuuaccggaaggauuaucc

SEQ ID NO: 1915463 - RNA, 15 nt, Shigella flexneri 2a str. 2457T
ugaugaguugaaaac

SEQ ID NO: 1915464 - RNA, 17 nt, Shigella flexneri 2a str. 2457T
ugaugaggcauaagcga

SEQ ID NO: 1915465 - RNA, 14 nt, Shigella flexneri 2a str. 2457T
ugaugauacugaca

SEQ ID NO: 1915466 - RNA, 18 nt, Shigella flexneri 2a str. 2457T
ugaugauugguaugccug

SEQ ID NO: 1915467 - RNA, 14 nt, Shigella flexneri 2a str. 2457T
ugaugaugccuaca

SEQ ID NO: 1915468 - RNA, 20 nt, Shigella flexneri 2a str. 2457T
ugauuccagcauaaugacuc

SEQ ID NO: 1915469 - RNA, 22 nt, Shigella flexneri 2a str. 2457T
ugauuccgccaguucuuccagu

SEQ ID NO: 1915470 - RNA, 18 nt, Shigella flexneri 2a str. 2457T
ugauuccggcaaauaaca

SEQ ID NO: 1915471 - RNA, 23 nt, Shigella flexneri 2a str. 2457T
ugauuccgggaauucgaagcugu

SEQ ID NO: 1915472 - RNA, 22 nt, Shigella flexneri 2a str. 2457T
ugauucgaucaaacaauuuuca

SEQ ID NO: 1915473 - RNA, 18 nt, Shigella flexneri 2a str. 2457T
ucaguuugcaaacccuga

SEQ ID NO: 1915474 - RNA, 12 nt, Shigella flexneri 2a str. 2457T
ucauuaaaaaua

SEQ ID NO: 1915475 - RNA, 18 nt, Shigella flexneri 2a str. 2457T
ucauuaaaaauaugaccu

SEQ ID NO: 1915476 - RNA, 15 nt, Shigella flexneri 2a str. 2457T
ucaguucuaccauca

SEQ ID NO: 1915477 - RNA, 16 nt, Shigella flexneri 2a str. 2457T
ucaguucuagaacuaa

SEQ ID NO: 1915478 - RNA, 17 nt, Shigella flexneri 2a str. 2457T
ucaguugcaccugaucc

SEQ ID NO: 1915479 - RNA, 13 nt, Shigella flexneri 2a str. 2457T
ucagugucuuauc

SEQ ID NO: 1915480 - RNA, 15 nt, Shigella flexneri 2a str. 2457T
ucagugucuuaucug

SEQ ID NO: 1915481 - RNA, 16 nt, Shigella flexneri 2a str. 2457T
ucaguuggggaaaagu

SEQ ID NO: 1915482 - RNA, 18 nt, Shigella flexneri 2a str. 2457T
ucaguuuauagaacggca

SEQ ID NO: 1915483 - RNA, 21 nt, Shigella flexneri 2a str. 2457T
ucaguuguucagaaugcccac

SEQ ID NO: 1915484 - RNA, 14 nt, Shigella flexneri 2a str. 2457T
ucauugaaggcggc

SEQ ID NO: 1915485 - RNA, 17 nt, Shigella flexneri 2a str. 2457T
ucauugaaggcggcgca

SEQ ID NO: 1915486 - RNA, 14 nt, Shigella flexneri 2a str. 2457T
ucauucgacaacug

SEQ ID NO: 1915487 - RNA, 13 nt, Shigella flexneri 2a str. 2457T
ucauuccuggagc

SEQ ID NO: 1915488 - RNA, 18 nt, Shigella flexneri 2a str. 2457T
ucauuccaccgaaacuuu

SEQ ID NO: 1915489 - RNA, 18 nt, Shigella flexneri 2a str. 2457T
ucauuagucacaaaucuc

SEQ ID NO: 1915490 - RNA, 11 nt, Shigella flexneri 2a str. 2457T
ucauuuugguu

SEQ ID NO: 1915491 - RNA, 21 nt, Shigella flexneri 2a str. 2457T
ucauuuucuucagcaguucag

SEQ ID NO: 1915492 - RNA, 20 nt, Shigella flexneri 2a str. 2457T
ucauuuucggcagugaaaac

SEQ ID NO: 1915493 - RNA, 13 nt, Shigella flexneri 2a str. 2457T
uccaacaccaggc

SEQ ID NO: 1915494 - RNA, 17 nt, Shigella flexneri 2a str. 2457T
ucauuugaauaguuaau

SEQ ID NO: 1915495 - RNA, 14 nt, Shigella flexneri 2a str. 2457T
ucauuucuggaagc

SEQ ID NO: 1915496 - RNA, 22 nt, Shigella flexneri 2a str. 2457T
ucauuguguacauccuaaaggc

SEQ ID NO: 1915497 - RNA, 22 nt, Shigella flexneri 2a str. 2457T
ucauuuaaaaagaaaaaacuaa

SEQ ID NO: 1915498 - RNA, 20 nt, Shigella flexneri 2a str. 2457T
uccacgcgauacuuuuucaa

SEQ ID NO: 1915499 - RNA, 23 nt, Shigella flexneri 2a str. 2457T
uccacgcggguuuacuacggcuu

SEQ ID NO: 1915500 - RNA, 19 nt, Shigella flexneri 2a str. 2457T
uccacgcuauacagcagcc

SEQ ID NO: 1915501 - RNA, 20 nt, Shigella flexneri 2a str. 2457T
uccacgcuauacagcagcca

SEQ ID NO: 1915502 - RNA, 22 nt, Shigella flexneri 2a str. 2457T
uccacgccguuuuuacccagca

SEQ ID NO: 1915503 - RNA, 17 nt, Shigella flexneri 2a str. 2457T
uccacgccuuuuuucac

SEQ ID NO: 1915504 - RNA, 21 nt, Shigella flexneri 2a str. 2457T
uccacgccgcugucuaccagc

SEQ ID NO: 1915505 - RNA, 18 nt, Shigella flexneri 2a str. 2457T
uccacgacguguuccuga

SEQ ID NO: 1915506 - RNA, 15 nt, Shigella flexneri 2a str. 2457T
uccacgauacgcugc

SEQ ID NO: 1915507 - RNA, 14 nt, Shigella flexneri 2a str. 2457T
uccacuaacuguuu

SEQ ID NO: 1915508 - RNA, 18 nt, Shigella flexneri 2a str. 2457T
uccacgguucuccacucu

SEQ ID NO: 1915509 - RNA, 21 nt, Shigella flexneri 2a str. 2457T
uccacuucacggcugcuaaua

SEQ ID NO: 1915510 - RNA, 13 nt, Shigella flexneri 2a str. 2457T
uccacuucaucaa

SEQ ID NO: 1915511 - RNA, 21 nt, Shigella flexneri 2a str. 2457T
uccacuuccaccacuuccugc

SEQ ID NO: 1915512 - RNA, 15 nt, Shigella flexneri 2a str. 2457T
uccacaccacuuccg

SEQ ID NO: 1915513 - RNA, 18 nt, Shigella flexneri 2a str. 2457T
uccacaagcuccggcuuu

SEQ ID NO: 1915514 - RNA, 17 nt, Shigella flexneri 2a str. 2457T
uccacccgcagcaagcg

SEQ ID NO: 1915515 - RNA, 14 nt, Shigella flexneri 2a str. 2457T
uccaccagcggcug

SEQ ID NO: 1915516 - RNA, 19 nt, Shigella flexneri 2a str. 2457T
uccaagcgcggcaggcauc

SEQ ID NO: 1915517 - RNA, 13 nt, Shigella flexneri 2a str. 2457T
uccaguucugcuu

SEQ ID NO: 1915518 - RNA, 21 nt, Shigella flexneri 2a str. 2457T
uccaguuccuucaacccauca

SEQ ID NO: 1915519 - RNA, 20 nt, Shigella flexneri 2a str. 2457T
uccaguuaucaagccauagc

SEQ ID NO: 1915520 - RNA, 20 nt, Shigella flexneri 2a str. 2457T
uccaguucaagugcuaccca

SEQ ID NO: 1915521 - RNA, 11 nt, Shigella flexneri 2a str. 2457T
uccaguuucac

SEQ ID NO: 1915522 - RNA, 19 nt, Shigella flexneri 2a str. 2457T
uccaucaaagguuuuucag

SEQ ID NO: 1915523 - RNA, 21 nt, Shigella flexneri 2a str. 2457T
uccaucaacauugguguguua

SEQ ID NO: 1915524 - RNA, 17 nt, Shigella flexneri 2a str. 2457T
uccauauggcugcauuc

SEQ ID NO: 1915525 - RNA, 20 nt, Shigella flexneri 2a str. 2457T
uccauagucacuaccuguuu

SEQ ID NO: 1915526 - RNA, 23 nt, Shigella flexneri 2a str. 2457T
uccauaguguguuccucugcucc

SEQ ID NO: 1915527 - RNA, 16 nt, Shigella flexneri 2a str. 2457T
uccauagcgauguauu

SEQ ID NO: 1915528 - RNA, 23 nt, Shigella flexneri 2a str. 2457T
uccagguccuccuguaccuucac

SEQ ID NO: 1915529 - RNA, 20 nt, Shigella flexneri 2a str. 2457T
uccagugccggaugauucac

SEQ ID NO: 1915530 - RNA, 21 nt, Shigella flexneri 2a str. 2457T
uccagugcguacccagcgugu

SEQ ID NO: 1915531 - RNA, 21 nt, Shigella flexneri 2a str. 2457T
uccagugcguccgguuuacuu

SEQ ID NO: 1915532 - RNA, 21 nt, Shigella flexneri 2a str. 2457T
uccagugcgcuuuauucagau

SEQ ID NO: 1915533 - RNA, 15 nt, Shigella flexneri 2a str. 2457T
uccagucgcugcuga

SEQ ID NO: 1915534 - RNA, 19 nt, Shigella flexneri 2a str. 2457T
uccagucguuaugcacgcu

SEQ ID NO: 1915535 - RNA, 14 nt, Shigella flexneri 2a str. 2457T
uccagcggcaggcc

SEQ ID NO: 1915536 - RNA, 20 nt, Shigella flexneri 2a str. 2457T
uccaggcagauuuuuuaacu

SEQ ID NO: 1915537 - RNA, 16 nt, Shigella flexneri 2a str. 2457T
uccagcgucacgucac

SEQ ID NO: 1915538 - RNA, 13 nt, Shigella flexneri 2a str. 2457T
uccaggagcucca

SEQ ID NO: 1915539 - RNA, 19 nt, Shigella flexneri 2a str. 2457T
uccaggagcguauucagca

SEQ ID NO: 1915540 - RNA, 18 nt, Shigella flexneri 2a str. 2457T
uccagcgccaguaauucu

SEQ ID NO: 1915541 - RNA, 13 nt, Shigella flexneri 2a str. 2457T
uccagcgccgcca

SEQ ID NO: 1915542 - RNA, 18 nt, Shigella flexneri 2a str. 2457T
uccagcgcguaaauaccu

SEQ ID NO: 1915543 - RNA, 17 nt, Shigella flexneri 2a str. 2457T
uccagcaucgaccagga

SEQ ID NO: 1915544 - RNA, 16 nt, Shigella flexneri 2a str. 2457T
uccagcauaaugugcg

SEQ ID NO: 1915545 - RNA, 15 nt, Shigella flexneri 2a str. 2457T
uccagcauaaugacu

SEQ ID NO: 1915546 - RNA, 17 nt, Shigella flexneri 2a str. 2457T
uccagcauaaugacucu

SEQ ID NO: 1915547 - RNA, 16 nt, Shigella flexneri 2a str. 2457T
uccagcgcaucgaucu

SEQ ID NO: 1915548 - RNA, 16 nt, Shigella flexneri 2a str. 2457T
uccagcaucuguucuu

SEQ ID NO: 1915549 - RNA, 15 nt, Shigella flexneri 2a str. 2457T
uccacuuucgcggcu

SEQ ID NO: 1915550 - RNA, 16 nt, Shigella flexneri 2a str. 2457T
uccacuuucgcggcuu

SEQ ID NO: 1915551 - RNA, 17 nt, Shigella flexneri 2a str. 2457T
uccacuuucgcggcuuu

SEQ ID NO: 1915552 - RNA, 13 nt, Shigella flexneri 2a str. 2457T
uccacuugaaaau

SEQ ID NO: 1915553 - RNA, 19 nt, Shigella flexneri 2a str. 2457T
ucccacgaccgcagcauug

SEQ ID NO: 1915554 - RNA, 17 nt, Shigella flexneri 2a str. 2457T
ucccaacaacagcgcgc

SEQ ID NO: 1915555 - RNA, 17 nt, Shigella flexneri 2a str. 2457T
ucccaaagaucuccuca

SEQ ID NO: 1915556 - RNA, 20 nt, Shigella flexneri 2a str. 2457T
uccauugccgcuuuccaggc

SEQ ID NO: 1915557 - RNA, 14 nt, Shigella flexneri 2a str. 2457T
uccauucgaugaga

SEQ ID NO: 1915558 - RNA, 18 nt, Shigella flexneri 2a str. 2457T
uccauucaucgccuuuca

SEQ ID NO: 1915559 - RNA, 16 nt, Shigella flexneri 2a str. 2457T
uccauugcucuggcaa

SEQ ID NO: 1915560 - RNA, 15 nt, Shigella flexneri 2a str. 2457T
uccauuucauugagu

SEQ ID NO: 1915561 - RNA, 20 nt, Shigella flexneri 2a str. 2457T
uccaugcgcauuaagccaug

SEQ ID NO: 1915562 - RNA, 14 nt, Shigella flexneri 2a str. 2457T
uccaugccaucugc

SEQ ID NO: 1915563 - RNA, 22 nt, Shigella flexneri 2a str. 2457T
uccauggacgaugagacccgcc

SEQ ID NO: 1915564 - RNA, 17 nt, Shigella flexneri 2a str. 2457T
uccauguugcuggaaga

SEQ ID NO: 1915565 - RNA, 16 nt, Shigella flexneri 2a str. 2457T
uccauucaaacgugaa

SEQ ID NO: 1915566 - RNA, 14 nt, Shigella flexneri 2a str. 2457T
uccaugugggcugc

SEQ ID NO: 1915567 - RNA, 16 nt, Shigella flexneri 2a str. 2457T
uccaucagauucagca

SEQ ID NO: 1915568 - RNA, 19 nt, Shigella flexneri 2a str. 2457T
uccaucagauucagcagcg

SEQ ID NO: 1915569 - RNA, 18 nt, Shigella flexneri 2a str. 2457T
uccaucacgcugaauuua

SEQ ID NO: 1915570 - RNA, 18 nt, Shigella flexneri 2a str. 2457T
uccauccauacgggcaug

SEQ ID NO: 1915571 - RNA, 18 nt, Shigella flexneri 2a str. 2457T
uccaucccgcucuguaag

SEQ ID NO: 1915572 - RNA, 22 nt, Shigella flexneri 2a str. 2457T
uccauccggcuggucagcaacu

SEQ ID NO: 1915573 - RNA, 19 nt, Shigella flexneri 2a str. 2457T
uccaucuuuaugaaauauc

SEQ ID NO: 1915574 - RNA, 18 nt, Shigella flexneri 2a str. 2457T
uccaucuuuaugaaauau

SEQ ID NO: 1915575 - RNA, 14 nt, Shigella flexneri 2a str. 2457T
uccaucgggcuauu

SEQ ID NO: 1915576 - RNA, 23 nt, Shigella flexneri 2a str. 2457T
uccaucucgccauccuuacgcag

SEQ ID NO: 1915577 - RNA, 17 nt, Shigella flexneri 2a str. 2457T
uccgccagugccaaagc

SEQ ID NO: 1915578 - RNA, 17 nt, Shigella flexneri 2a str. 2457T
uccgccaguucuuccag

SEQ ID NO: 1915579 - RNA, 18 nt, Shigella flexneri 2a str. 2457T
uccgccaguucuuccagu

SEQ ID NO: 1915580 - RNA, 22 nt, Shigella flexneri 2a str. 2457T
uccgccaguucuuccaguuccg

SEQ ID NO: 1915581 - RNA, 11 nt, Shigella flexneri 2a str. 2457T
uccgccagcga

SEQ ID NO: 1915582 - RNA, 15 nt, Shigella flexneri 2a str. 2457T
uccgccagaccaauc

SEQ ID NO: 1915583 - RNA, 16 nt, Shigella flexneri 2a str. 2457T
uccgcagacacuuucc

SEQ ID NO: 1915584 - RNA, 18 nt, Shigella flexneri 2a str. 2457T
uccgcacguuagaaacaa

SEQ ID NO: 1915585 - RNA, 14 nt, Shigella flexneri 2a str. 2457T
uccgccaauuucau

SEQ ID NO: 1915586 - RNA, 23 nt, Shigella flexneri 2a str. 2457T
uccgcaaucaaaugacugguuuu

SEQ ID NO: 1915587 - RNA, 20 nt, Shigella flexneri 2a str. 2457T
uccgcaccugaguaauuaau

SEQ ID NO: 1915588 - RNA, 18 nt, Shigella flexneri 2a str. 2457T
uccgcaccaacuccacuu

SEQ ID NO: 1915589 - RNA, 15 nt, Shigella flexneri 2a str. 2457T
uccgagguuaauauu

SEQ ID NO: 1915590 - RNA, 13 nt, Shigella flexneri 2a str. 2457T
uccgauccucacu

SEQ ID NO: 1915591 - RNA, 18 nt, Shigella flexneri 2a str. 2457T
uccgaucgcgcaucagca

SEQ ID NO: 1915592 - RNA, 13 nt, Shigella flexneri 2a str. 2457T
uccgaucccugcg

SEQ ID NO: 1915593 - RNA, 17 nt, Shigella flexneri 2a str. 2457T
uccgcuaucaguucaga

SEQ ID NO: 1915594 - RNA, 21 nt, Shigella flexneri 2a str. 2457T
uccgcuaucaguucagaagcu

SEQ ID NO: 1915595 - RNA, 17 nt, Shigella flexneri 2a str. 2457T
uccgcgugacgcuggca

SEQ ID NO: 1915596 - RNA, 20 nt, Shigella flexneri 2a str. 2457T
uccgcuaguguacccuucgu

SEQ ID NO: 1915597 - RNA, 18 nt, Shigella flexneri 2a str. 2457T
uccgcggcuuugucauaa

SEQ ID NO: 1915598 - RNA, 17 nt, Shigella flexneri 2a str. 2457T
uccgcgucuuaucaggc

SEQ ID NO: 1915599 - RNA, 23 nt, Shigella flexneri 2a str. 2457T
uccgcgugacgcuggcagaaagu

SEQ ID NO: 1915600 - RNA, 19 nt, Shigella flexneri 2a str. 2457T
uccgcgucauugacgcugg

SEQ ID NO: 1915601 - RNA, 15 nt, Shigella flexneri 2a str. 2457T
uccgcgccgcgguac

SEQ ID NO: 1915602 - RNA, 15 nt, Shigella flexneri 2a str. 2457T
uccgcgacuggcaug

SEQ ID NO: 1915603 - RNA, 15 nt, Shigella flexneri 2a str. 2457T
uccgccauuuuaauc

SEQ ID NO: 1915604 - RNA, 16 nt, Shigella flexneri 2a str. 2457T
uccgccccauuuuuaa

SEQ ID NO: 1915605 - RNA, 21 nt, Shigella flexneri 2a str. 2457T
uccgccgccauugacguuccu

SEQ ID NO: 1915606 - RNA, 16 nt, Shigella flexneri 2a str. 2457T
uccgccgccagcagac

SEQ ID NO: 1915607 - RNA, 17 nt, Shigella flexneri 2a str. 2457T
uccgcgaacagcagcgg

SEQ ID NO: 1915608 - RNA, 18 nt, Shigella flexneri 2a str. 2457T
uccgccucuaacagauca

SEQ ID NO: 1915609 - RNA, 19 nt, Shigella flexneri 2a str. 2457T
uccgccgcuguggcaggua

SEQ ID NO: 1915610 - RNA, 18 nt, Shigella flexneri 2a str. 2457T
uccgccgucgggucagcu

SEQ ID NO: 1915611 - RNA, 15 nt, Shigella flexneri 2a str. 2457T
aaaucugaaaucauc

SEQ ID NO: 1915612 - RNA, 18 nt, Shigella flexneri 2a str. 2457T
aaaucugauuaauauuga

SEQ ID NO: 1915613 - RNA, 20 nt, Shigella flexneri 2a str. 2457T
aaaucugcccguuaaccaua

SEQ ID NO: 1915614 - RNA, 18 nt, Shigella flexneri 2a str. 2457T
aaaucugccgauuucaac

SEQ ID NO: 1915615 - RNA, 19 nt, Shigella flexneri 2a str. 2457T
uccgagaauggacaccagc

SEQ ID NO: 1915616 - RNA, 22 nt, Shigella flexneri 2a str. 2457T
ucccuuucagcaaaccacugau

SEQ ID NO: 1915617 - RNA, 13 nt, Shigella flexneri 2a str. 2457T
ucccuuucugcag

SEQ ID NO: 1915618 - RNA, 19 nt, Shigella flexneri 2a str. 2457T
ucccuuuugcaguuaaaau

SEQ ID NO: 1915619 - RNA, 21 nt, Shigella flexneri 2a str. 2457T
uccgaauacggucuuuuuaua

SEQ ID NO: 1915620 - RNA, 18 nt, Shigella flexneri 2a str. 2457T
uccgacaucccgccagcc

SEQ ID NO: 1915621 - RNA, 20 nt, Shigella flexneri 2a str. 2457T
uccgacauuucugcugccua

SEQ ID NO: 1915622 - RNA, 19 nt, Shigella flexneri 2a str. 2457T
ucccuuaacacuuguuaug

SEQ ID NO: 1915623 - RNA, 15 nt, Shigella flexneri 2a str. 2457T
ucccuuacccuuacu

SEQ ID NO: 1915624 - RNA, 17 nt, Shigella flexneri 2a str. 2457T
ucccuucagccaccagg

SEQ ID NO: 1915625 - RNA, 20 nt, Shigella flexneri 2a str. 2457T
ucccuucagccaccagguuc

SEQ ID NO: 1915626 - RNA, 21 nt, Shigella flexneri 2a str. 2457T
ucccuucagccaccagguuca

SEQ ID NO: 1915627 - RNA, 13 nt, Shigella flexneri 2a str. 2457T
ucccuucccagcc

SEQ ID NO: 1915628 - RNA, 19 nt, Shigella flexneri 2a str. 2457T
ucccuuccggugcaaucag

SEQ ID NO: 1915629 - RNA, 21 nt, Shigella flexneri 2a str. 2457T
ucccuggcccaucgccagugc

SEQ ID NO: 1915630 - RNA, 15 nt, Shigella flexneri 2a str. 2457T
ucccugguaaaaaau

SEQ ID NO: 1915631 - RNA, 19 nt, Shigella flexneri 2a str. 2457T
ucccugguaaaaaaugauu

SEQ ID NO: 1915632 - RNA, 11 nt, Shigella flexneri 2a str. 2457T
ucccugcauau

SEQ ID NO: 1915633 - RNA, 15 nt, Shigella flexneri 2a str. 2457T
ucccugcgccagcgg

SEQ ID NO: 1915634 - RNA, 16 nt, Shigella flexneri 2a str. 2457T
ucccugccuccaugaa

SEQ ID NO: 1915635 - RNA, 13 nt, Shigella flexneri 2a str. 2457T
ucccugccagucc

SEQ ID NO: 1915636 - RNA, 14 nt, Shigella flexneri 2a str. 2457T
ucccucuuucuggc

SEQ ID NO: 1915637 - RNA, 13 nt, Shigella flexneri 2a str. 2457T
ucccucauauuua

SEQ ID NO: 1915638 - RNA, 18 nt, Shigella flexneri 2a str. 2457T
ucccucauacugguuucu

SEQ ID NO: 1915639 - RNA, 21 nt, Shigella flexneri 2a str. 2457T
ucccucgccccuucggggaga

SEQ ID NO: 1915640 - RNA, 14 nt, Shigella flexneri 2a str. 2457T
ucccucuacauuca

SEQ ID NO: 1915641 - RNA, 19 nt, Shigella flexneri 2a str. 2457T
ucccuacucucgcaugggg

SEQ ID NO: 1915642 - RNA, 13 nt, Shigella flexneri 2a str. 2457T
ucccuaaaauauu

SEQ ID NO: 1915643 - RNA, 15 nt, Shigella flexneri 2a str. 2457T
ucccuauuuuuucgu

SEQ ID NO: 1915644 - RNA, 21 nt, Shigella flexneri 2a str. 2457T
ucccgcgaacgagaauuucuc

SEQ ID NO: 1915645 - RNA, 22 nt, Shigella flexneri 2a str. 2457T
ucccgcagccacgucaccugcc

SEQ ID NO: 1915646 - RNA, 16 nt, Shigella flexneri 2a str. 2457T
ucccgcagcuccagcc

SEQ ID NO: 1915647 - RNA, 19 nt, Shigella flexneri 2a str. 2457T
ucccgcagccacgucaccu

SEQ ID NO: 1915648 - RNA, 15 nt, Shigella flexneri 2a str. 2457T
ucccgccagcaccag

SEQ ID NO: 1915649 - RNA, 23 nt, Shigella flexneri 2a str. 2457T
ucccgcgccgcagccggaaaacc

SEQ ID NO: 1915650 - RNA, 17 nt, Shigella flexneri 2a str. 2457T
ucccgcuucguuuucag

SEQ ID NO: 1915651 - RNA, 22 nt, Shigella flexneri 2a str. 2457T
ucccggaccgucaucuuccacc

SEQ ID NO: 1915652 - RNA, 15 nt, Shigella flexneri 2a str. 2457T
ucccgcuuacaucaa

SEQ ID NO: 1915653 - RNA, 21 nt, Shigella flexneri 2a str. 2457T
ucccgggucgcgacugccagc

SEQ ID NO: 1915654 - RNA, 13 nt, Shigella flexneri 2a str. 2457T
ucccggcucaucc

SEQ ID NO: 1915655 - RNA, 21 nt, Shigella flexneri 2a str. 2457T
ucccggcaagauuccagugcc

SEQ ID NO: 1915656 - RNA, 14 nt, Shigella flexneri 2a str. 2457T
ucccggcagagaaa

SEQ ID NO: 1915657 - RNA, 20 nt, Shigella flexneri 2a str. 2457T
ucccggauaaaucuccauuu

SEQ ID NO: 1915658 - RNA, 19 nt, Shigella flexneri 2a str. 2457T
ucccggauaaaucuccauu

SEQ ID NO: 1915659 - RNA, 17 nt, Shigella flexneri 2a str. 2457T
ucccggauaucccagcu

SEQ ID NO: 1915660 - RNA, 16 nt, Shigella flexneri 2a str. 2457T
ucccggaugcaccauc

SEQ ID NO: 1915661 - RNA, 14 nt, Shigella flexneri 2a str. 2457T
ucccgguuauuaaa

SEQ ID NO: 1915662 - RNA, 17 nt, Shigella flexneri 2a str. 2457T
ucccggucaguagaaua

SEQ ID NO: 1915663 - RNA, 15 nt, Shigella flexneri 2a str. 2457T
ucccguuucccuguc

SEQ ID NO: 1915664 - RNA, 17 nt, Shigella flexneri 2a str. 2457T
ucccguauuacugagau

SEQ ID NO: 1915665 - RNA, 14 nt, Shigella flexneri 2a str. 2457T
ucccgugccagagc

SEQ ID NO: 1915666 - RNA, 16 nt, Shigella flexneri 2a str. 2457T
uccccuggggagugac

SEQ ID NO: 1915667 - RNA, 14 nt, Shigella flexneri 2a str. 2457T
uccccugcgcggcg

SEQ ID NO: 1915668 - RNA, 13 nt, Shigella flexneri 2a str. 2457T
uccccucgcuccu

SEQ ID NO: 1915669 - RNA, 18 nt, Shigella flexneri 2a str. 2457T
ucccgauggucagcuuca

SEQ ID NO: 1915670 - RNA, 16 nt, Shigella flexneri 2a str. 2457T
ucccgauaaccgcaaa

SEQ ID NO: 1915671 - RNA, 19 nt, Shigella flexneri 2a str. 2457T
ucccgauaaccuucuucau

SEQ ID NO: 1915672 - RNA, 16 nt, Shigella flexneri 2a str. 2457T
uccccgcuugggcaga

SEQ ID NO: 1915673 - RNA, 13 nt, Shigella flexneri 2a str. 2457T
uccccgcucuccc

SEQ ID NO: 1915674 - RNA, 15 nt, Shigella flexneri 2a str. 2457T
uccccuaacucuuuc

SEQ ID NO: 1915675 - RNA, 17 nt, Shigella flexneri 2a str. 2457T
uccccggcagugcuuuc

SEQ ID NO: 1915676 - RNA, 14 nt, Shigella flexneri 2a str. 2457T
uccccggaaucaga

SEQ ID NO: 1915677 - RNA, 16 nt, Shigella flexneri 2a str. 2457T
uccccggaaucagagg

SEQ ID NO: 1915678 - RNA, 17 nt, Shigella flexneri 2a str. 2457T
uccccggcaaccacacc

SEQ ID NO: 1915679 - RNA, 17 nt, Shigella flexneri 2a str. 2457T
uccccggauucaugcua

SEQ ID NO: 1915680 - RNA, 16 nt, Shigella flexneri 2a str. 2457T
uccccggucagcagca

SEQ ID NO: 1915681 - RNA, 16 nt, Shigella flexneri 2a str. 2457T
uccccacaaccggcgg

SEQ ID NO: 1915682 - RNA, 15 nt, Shigella flexneri 2a str. 2457T
uccccaccucaucag

SEQ ID NO: 1915683 - RNA, 16 nt, Shigella flexneri 2a str. 2457T
uccccacagaaacaau

SEQ ID NO: 1915684 - RNA, 11 nt, Shigella flexneri 2a str. 2457T
uccccaauacg

SEQ ID NO: 1915685 - RNA, 23 nt, Shigella flexneri 2a str. 2457T
uccccacucgccccgagaaaaau

SEQ ID NO: 1915686 - RNA, 17 nt, Shigella flexneri 2a str. 2457T
uccccagaauccaggaa

SEQ ID NO: 1915687 - RNA, 23 nt, Shigella flexneri 2a str. 2457T
uccccaaaaaaucaacgacaaaa

SEQ ID NO: 1915688 - RNA, 14 nt, Shigella flexneri 2a str. 2457T
ucccauuuuugaau

SEQ ID NO: 1915689 - RNA, 22 nt, Shigella flexneri 2a str. 2457T
ucccauuuuugaauggaucucc

SEQ ID NO: 1915690 - RNA, 16 nt, Shigella flexneri 2a str. 2457T
ucccauuuauuuuucc

SEQ ID NO: 1915691 - RNA, 20 nt, Shigella flexneri 2a str. 2457T
ucccccacagcucugcuguc

SEQ ID NO: 1915692 - RNA, 14 nt, Shigella flexneri 2a str. 2457T
ucccccacagcucu

SEQ ID NO: 1915693 - RNA, 15 nt, Shigella flexneri 2a str. 2457T
ucccccaccaccauc

SEQ ID NO: 1915694 - RNA, 23 nt, Shigella flexneri 2a str. 2457T
ucccccacuuuuaaaucgccaag

SEQ ID NO: 1915695 - RNA, 19 nt, Shigella flexneri 2a str. 2457T
uccccccggcaucgcauuc

SEQ ID NO: 1915696 - RNA, 16 nt, Shigella flexneri 2a str. 2457T
ucccccugccagacca

SEQ ID NO: 1915697 - RNA, 17 nt, Shigella flexneri 2a str. 2457T
ucccccgcgagaagcgg

SEQ ID NO: 1915698 - RNA, 17 nt, Shigella flexneri 2a str. 2457T
uccccagcggaaaauau

SEQ ID NO: 1915699 - RNA, 22 nt, Shigella flexneri 2a str. 2457T
uccccauggacgcgucagucgc

SEQ ID NO: 1915700 - RNA, 23 nt, Shigella flexneri 2a str. 2457T
ucccaucugauucggguacugau

SEQ ID NO: 1915701 - RNA, 15 nt, Shigella flexneri 2a str. 2457T
ucccaucuuuuuaag

SEQ ID NO: 1915702 - RNA, 20 nt, Shigella flexneri 2a str. 2457T
ucccaguaagccuaaaugua

SEQ ID NO: 1915703 - RNA, 14 nt, Shigella flexneri 2a str. 2457T
ucccagucuuucca

SEQ ID NO: 1915704 - RNA, 15 nt, Shigella flexneri 2a str. 2457T
ucccagugccugcau

SEQ ID NO: 1915705 - RNA, 19 nt, Shigella flexneri 2a str. 2457T
ucccagcgcggugauaacc

SEQ ID NO: 1915706 - RNA, 19 nt, Shigella flexneri 2a str. 2457T
ucccagcguggagagcagc

SEQ ID NO: 1915707 - RNA, 15 nt, Shigella flexneri 2a str. 2457T
ucccagcgcaggcag

SEQ ID NO: 1915708 - RNA, 16 nt, Shigella flexneri 2a str. 2457T
ucccaggcaaauccca

SEQ ID NO: 1915709 - RNA, 11 nt, Shigella flexneri 2a str. 2457T
ucccaggcacc

SEQ ID NO: 1915710 - RNA, 15 nt, Shigella flexneri 2a str. 2457T
ucccaggccaaaucc

SEQ ID NO: 1915711 - RNA, 22 nt, Shigella flexneri 2a str. 2457T
ucccaggccgccugcaacgcuu

SEQ ID NO: 1915712 - RNA, 19 nt, Shigella flexneri 2a str. 2457T
ucccagaauguuaacgcca

SEQ ID NO: 1915713 - RNA, 17 nt, Shigella flexneri 2a str. 2457T
ucccagagcgggcagac

SEQ ID NO: 1915714 - RNA, 13 nt, Shigella flexneri 2a str. 2457T
ucccagcagagau

SEQ ID NO: 1915715 - RNA, 19 nt, Shigella flexneri 2a str. 2457T
ucccagcagagaucuuuca

SEQ ID NO: 1915716 - RNA, 17 nt, Shigella flexneri 2a str. 2457T
ucccagauagcaacagc

SEQ ID NO: 1915717 - RNA, 20 nt, Shigella flexneri 2a str. 2457T
ucccagcagagaucuuucac

SEQ ID NO: 1915718 - RNA, 13 nt, Shigella flexneri 2a str. 2457T
ucccagcccagcg

SEQ ID NO: 1915719 - RNA, 16 nt, Shigella flexneri 2a str. 2457T
ucccagcccagcgcuu

SEQ ID NO: 1915720 - RNA, 20 nt, Shigella flexneri 2a str. 2457T
ucccagcccccuguguugau

SEQ ID NO: 1915721 - RNA, 14 nt, Shigella flexneri 2a str. 2457T
ucccagccuugcca

SEQ ID NO: 1915722 - RNA, 22 nt, Shigella flexneri 2a str. 2457T
ucccacugcgccacgguguugu

SEQ ID NO: 1915723 - RNA, 13 nt, Shigella flexneri 2a str. 2457T
ucccacgccgaau

SEQ ID NO: 1915724 - RNA, 20 nt, Shigella flexneri 2a str. 2457T
uccuguugucuuuccagacu

SEQ ID NO: 1915725 - RNA, 18 nt, Shigella flexneri 2a str. 2457T
uccuguugaaaaaccaga

SEQ ID NO: 1915726 - RNA, 15 nt, Shigella flexneri 2a str. 2457T
uccuguucauccucu

SEQ ID NO: 1915727 - RNA, 23 nt, Shigella flexneri 2a str. 2457T
uccuguucugugcgccaugcuuc

SEQ ID NO: 1915728 - RNA, 22 nt, Shigella flexneri 2a str. 2457T
uccuguucaaacauuagcgcau

SEQ ID NO: 1915729 - RNA, 17 nt, Shigella flexneri 2a str. 2457T
uccuguuccauggugua

SEQ ID NO: 1915730 - RNA, 20 nt, Shigella flexneri 2a str. 2457T
uccuguaucgucacugguuc

SEQ ID NO: 1915731 - RNA, 16 nt, Shigella flexneri 2a str. 2457T
uccuggcuuggcuggc

SEQ ID NO: 1915732 - RNA, 23 nt, Shigella flexneri 2a str. 2457T
uccuggcuuggcuggcgugagcc

SEQ ID NO: 1915733 - RNA, 22 nt, Shigella flexneri 2a str. 2457T
uccuggggguucaucaccacug

SEQ ID NO: 1915734 - RNA, 18 nt, Shigella flexneri 2a str. 2457T
uccuguaaugagaauaau

SEQ ID NO: 1915735 - RNA, 18 nt, Shigella flexneri 2a str. 2457T
uccuggucggcaaacugc

SEQ ID NO: 1915736 - RNA, 17 nt, Shigella flexneri 2a str. 2457T
uccugguuucuggucau

SEQ ID NO: 1915737 - RNA, 20 nt, Shigella flexneri 2a str. 2457T
uccuggucugaugaaugguu

SEQ ID NO: 1915738 - RNA, 18 nt, Shigella flexneri 2a str. 2457T
uccuguuuuuaagugaug

SEQ ID NO: 1915739 - RNA, 13 nt, Shigella flexneri 2a str. 2457T
uccuguuucacuu

SEQ ID NO: 1915740 - RNA, 23 nt, Shigella flexneri 2a str. 2457T
uccuuagcaacaggccaguucga

SEQ ID NO: 1915741 - RNA, 16 nt, Shigella flexneri 2a str. 2457T
uccuucacacugccuc

SEQ ID NO: 1915742 - RNA, 19 nt, Shigella flexneri 2a str. 2457T
uccuucacuuuugccagac

SEQ ID NO: 1915743 - RNA, 23 nt, Shigella flexneri 2a str. 2457T
uccuucacuuuugccagacgaau

SEQ ID NO: 1915744 - RNA, 20 nt, Shigella flexneri 2a str. 2457T
uccuucaucuucaacugcca

SEQ ID NO: 1915745 - RNA, 12 nt, Shigella flexneri 2a str. 2457T
uccuucagcaac

SEQ ID NO: 1915746 - RNA, 22 nt, Shigella flexneri 2a str. 2457T
uccuggcaacggacgaccgauu

SEQ ID NO: 1915747 - RNA, 21 nt, Shigella flexneri 2a str. 2457T
uccuggccgcaguacugggcc

SEQ ID NO: 1915748 - RNA, 16 nt, Shigella flexneri 2a str. 2457T
uccuggcgaaaacgcc

SEQ ID NO: 1915749 - RNA, 21 nt, Shigella flexneri 2a str. 2457T
uccuggcgggaauaaaagcca

SEQ ID NO: 1915750 - RNA, 19 nt, Shigella flexneri 2a str. 2457T
uccuggcggggauuauugc

SEQ ID NO: 1915751 - RNA, 17 nt, Shigella flexneri 2a str. 2457T
uccuggaacagaccgac

SEQ ID NO: 1915752 - RNA, 22 nt, Shigella flexneri 2a str. 2457T
uccugcucaaugucugucauau

SEQ ID NO: 1915753 - RNA, 19 nt, Shigella flexneri 2a str. 2457T
uccugcgugacuaaaaccc

SEQ ID NO: 1915754 - RNA, 17 nt, Shigella flexneri 2a str. 2457T
uccugcugaacgugauu

SEQ ID NO: 1915755 - RNA, 16 nt, Shigella flexneri 2a str. 2457T
uccugccaguuuuucc

SEQ ID NO: 1915756 - RNA, 16 nt, Shigella flexneri 2a str. 2457T
uccugccgcaguuucu

SEQ ID NO: 1915757 - RNA, 13 nt, Shigella flexneri 2a str. 2457T
uccugcgcuucca

SEQ ID NO: 1915758 - RNA, 18 nt, Shigella flexneri 2a str. 2457T
uccugcggagcaaccugc

SEQ ID NO: 1915759 - RNA, 17 nt, Shigella flexneri 2a str. 2457T
uccugcgcugcguagcc

SEQ ID NO: 1915760 - RNA, 21 nt, Shigella flexneri 2a str. 2457T
uccugcggcagacgcucgcca

SEQ ID NO: 1915761 - RNA, 23 nt, Shigella flexneri 2a str. 2457T
uccugcggcagacgcucgccauu

SEQ ID NO: 1915762 - RNA, 18 nt, Shigella flexneri 2a str. 2457T
uccugcagcuucacggaa

SEQ ID NO: 1915763 - RNA, 22 nt, Shigella flexneri 2a str. 2457T
uccugcacggcuucccacguca

SEQ ID NO: 1915764 - RNA, 17 nt, Shigella flexneri 2a str. 2457T
uccuccguauccuguca

SEQ ID NO: 1915765 - RNA, 19 nt, Shigella flexneri 2a str. 2457T
uccuccggcuccacuucgu

SEQ ID NO: 1915766 - RNA, 16 nt, Shigella flexneri 2a str. 2457T
uccuccugucuucccu

SEQ ID NO: 1915767 - RNA, 21 nt, Shigella flexneri 2a str. 2457T
uccucguuucgcccugccuuu

SEQ ID NO: 1915768 - RNA, 14 nt, Shigella flexneri 2a str. 2457T
uccugaaaccauag

SEQ ID NO: 1915769 - RNA, 21 nt, Shigella flexneri 2a str. 2457T
uccugaaacgcggcguaaccg

SEQ ID NO: 1915770 - RNA, 21 nt, Shigella flexneri 2a str. 2457T
uccugaagcgcuggggaaaau

SEQ ID NO: 1915771 - RNA, 15 nt, Shigella flexneri 2a str. 2457T
uccugaagaugcugc

SEQ ID NO: 1915772 - RNA, 16 nt, Shigella flexneri 2a str. 2457T
uccugaagaugcugca

SEQ ID NO: 1915773 - RNA, 20 nt, Shigella flexneri 2a str. 2457T
uccugaagacgccucgcauu

SEQ ID NO: 1915774 - RNA, 15 nt, Shigella flexneri 2a str. 2457T
uccucuauauuucac

SEQ ID NO: 1915775 - RNA, 16 nt, Shigella flexneri 2a str. 2457T
uccucugacuggacuc

SEQ ID NO: 1915776 - RNA, 17 nt, Shigella flexneri 2a str. 2457T
uccucuuucaucucccg

SEQ ID NO: 1915777 - RNA, 22 nt, Shigella flexneri 2a str. 2457T
uccugacggugauacagcaaaa

SEQ ID NO: 1915778 - RNA, 18 nt, Shigella flexneri 2a str. 2457T
uccugacccucucggcau

SEQ ID NO: 1915779 - RNA, 20 nt, Shigella flexneri 2a str. 2457T
uccugacuuugccccagcgg

SEQ ID NO: 1915780 - RNA, 20 nt, Shigella flexneri 2a str. 2457T
uccugacuccuguaucguca

SEQ ID NO: 1915781 - RNA, 22 nt, Shigella flexneri 2a str. 2457T
uccugacguaacgaccaccacc

SEQ ID NO: 1915782 - RNA, 19 nt, Shigella flexneri 2a str. 2457T
uccugauaaccuuccagcu

SEQ ID NO: 1915783 - RNA, 17 nt, Shigella flexneri 2a str. 2457T
uccugauuuaacaucuc

SEQ ID NO: 1915784 - RNA, 21 nt, Shigella flexneri 2a str. 2457T
uccugcaacuucucuuucggc

SEQ ID NO: 1915785 - RNA, 14 nt, Shigella flexneri 2a str. 2457T
uccuacacauacuu

SEQ ID NO: 1915786 - RNA, 15 nt, Shigella flexneri 2a str. 2457T
uccuaacaaccaucc

SEQ ID NO: 1915787 - RNA, 19 nt, Shigella flexneri 2a str. 2457T
uccuaaaggcaaaaugcca

SEQ ID NO: 1915788 - RNA, 13 nt, Shigella flexneri 2a str. 2457T
uccuaaaguuguu

SEQ ID NO: 1915789 - RNA, 22 nt, Shigella flexneri 2a str. 2457T
uccuauuguugauaaggaaauu

SEQ ID NO: 1915790 - RNA, 19 nt, Shigella flexneri 2a str. 2457T
uccuaugcaacaacugaaa

SEQ ID NO: 1915791 - RNA, 15 nt, Shigella flexneri 2a str. 2457T
uccuaucgugguucc

SEQ ID NO: 1915792 - RNA, 13 nt, Shigella flexneri 2a str. 2457T
uccucaagaauau

SEQ ID NO: 1915793 - RNA, 21 nt, Shigella flexneri 2a str. 2457T
uccucaagaauaugcuuugcc

SEQ ID NO: 1915794 - RNA, 22 nt, Shigella flexneri 2a str. 2457T
uccucaagaauaugcuuugccu

SEQ ID NO: 1915795 - RNA, 22 nt, Shigella flexneri 2a str. 2457T
uccucacuguuuucuaacucau

SEQ ID NO: 1915796 - RNA, 14 nt, Shigella flexneri 2a str. 2457T
uccguaccagccuu

SEQ ID NO: 1915797 - RNA, 14 nt, Shigella flexneri 2a str. 2457T
uccguaauuuuuac

SEQ ID NO: 1915798 - RNA, 15 nt, Shigella flexneri 2a str. 2457T
uccgucccagccuug

SEQ ID NO: 1915799 - RNA, 20 nt, Shigella flexneri 2a str. 2457T
uccgucccagccuugccaga

SEQ ID NO: 1915800 - RNA, 16 nt, Shigella flexneri 2a str. 2457T
uccgucauccauacca

SEQ ID NO: 1915801 - RNA, 19 nt, Shigella flexneri 2a str. 2457T
uccgucaccggaauaauga

SEQ ID NO: 1915802 - RNA, 14 nt, Shigella flexneri 2a str. 2457T
uccguagugaaaaa

SEQ ID NO: 1915803 - RNA, 14 nt, Shigella flexneri 2a str. 2457T
uccguuuuccagcc

SEQ ID NO: 1915804 - RNA, 20 nt, Shigella flexneri 2a str. 2457T
uccuaaaaaagcaugaauuu

SEQ ID NO: 1915805 - RNA, 15 nt, Shigella flexneri 2a str. 2457T
uccuaaaaacaguac

SEQ ID NO: 1915806 - RNA, 16 nt, Shigella flexneri 2a str. 2457T
uccguugaaaaugcug

SEQ ID NO: 1915807 - RNA, 16 nt, Shigella flexneri 2a str. 2457T
uccguucucaccagcu

SEQ ID NO: 1915808 - RNA, 13 nt, Shigella flexneri 2a str. 2457T
uccguucagaucg

SEQ ID NO: 1915809 - RNA, 19 nt, Shigella flexneri 2a str. 2457T
uccguuaugucucccgccc

SEQ ID NO: 1915810 - RNA, 21 nt, Shigella flexneri 2a str. 2457T
uccguuaaccgugggaaacag

SEQ ID NO: 1915811 - RNA, 22 nt, Shigella flexneri 2a str. 2457T
uccggcagaagcaaucauccca

SEQ ID NO: 1915812 - RNA, 13 nt, Shigella flexneri 2a str. 2457T
uccggcagcgaac

SEQ ID NO: 1915813 - RNA, 20 nt, Shigella flexneri 2a str. 2457T
uccggcaccuuuucaucagg

SEQ ID NO: 1915814 - RNA, 14 nt, Shigella flexneri 2a str. 2457T
uccggcagaagcaa

SEQ ID NO: 1915815 - RNA, 23 nt, Shigella flexneri 2a str. 2457T
uccggcaaaaacaacgagccaau

SEQ ID NO: 1915816 - RNA, 15 nt, Shigella flexneri 2a str. 2457T
uccggcaauggcugc

SEQ ID NO: 1915817 - RNA, 21 nt, Shigella flexneri 2a str. 2457T
uccggcaaucggugcaaaugc

SEQ ID NO: 1915818 - RNA, 23 nt, Shigella flexneri 2a str. 2457T
uccggcaaucggugcaaaugcca

SEQ ID NO: 1915819 - RNA, 22 nt, Shigella flexneri 2a str. 2457T
uccggcaauugugauggucaga

SEQ ID NO: 1915820 - RNA, 17 nt, Shigella flexneri 2a str. 2457T
uccggcauacaguaacu

SEQ ID NO: 1915821 - RNA, 23 nt, Shigella flexneri 2a str. 2457T
uccggcaucaacaaagugcacgu

SEQ ID NO: 1915822 - RNA, 21 nt, Shigella flexneri 2a str. 2457T
uccggcauuugagcaggaugc

SEQ ID NO: 1915823 - RNA, 15 nt, Shigella flexneri 2a str. 2457T
uccggcaugaacaaa

SEQ ID NO: 1915824 - RNA, 14 nt, Shigella flexneri 2a str. 2457T
uccggcaguuucau

SEQ ID NO: 1915825 - RNA, 22 nt, Shigella flexneri 2a str. 2457T
uccggcauaaacaaagugcacu

SEQ ID NO: 1915826 - RNA, 19 nt, Shigella flexneri 2a str. 2457T
uccggacuccgcaccgccg

SEQ ID NO: 1915827 - RNA, 15 nt, Shigella flexneri 2a str. 2457T
uccggacguucagcc

SEQ ID NO: 1915828 - RNA, 14 nt, Shigella flexneri 2a str. 2457T
uccggcaaaaaagc

SEQ ID NO: 1915829 - RNA, 14 nt, Shigella flexneri 2a str. 2457T
uccggcaaaaacaa

SEQ ID NO: 1915830 - RNA, 19 nt, Shigella flexneri 2a str. 2457T
uccgcuuucgguuuuucua

SEQ ID NO: 1915831 - RNA, 13 nt, Shigella flexneri 2a str. 2457T
uccgcuucugcuu

SEQ ID NO: 1915832 - RNA, 13 nt, Shigella flexneri 2a str. 2457T
uccgcuucaaucu

SEQ ID NO: 1915833 - RNA, 16 nt, Shigella flexneri 2a str. 2457T
uccgcugacagcgcgu

SEQ ID NO: 1915834 - RNA, 18 nt, Shigella flexneri 2a str. 2457T
uccgcucgccgcagagau

SEQ ID NO: 1915835 - RNA, 16 nt, Shigella flexneri 2a str. 2457T
uccgcuggcgucuggg

SEQ ID NO: 1915836 - RNA, 14 nt, Shigella flexneri 2a str. 2457T
uccggggaagcgca

SEQ ID NO: 1915837 - RNA, 23 nt, Shigella flexneri 2a str. 2457T
uccgggcugguuuucagcgaaac

SEQ ID NO: 1915838 - RNA, 17 nt, Shigella flexneri 2a str. 2457T
uccgggccgcaaaccag

SEQ ID NO: 1915839 - RNA, 20 nt, Shigella flexneri 2a str. 2457T
uccgggcuauauacccuucu

SEQ ID NO: 1915840 - RNA, 16 nt, Shigella flexneri 2a str. 2457T
uccgggauggucagcg

SEQ ID NO: 1915841 - RNA, 16 nt, Shigella flexneri 2a str. 2457T
uccgggaucaccagac

SEQ ID NO: 1915842 - RNA, 16 nt, Shigella flexneri 2a str. 2457T
uccggcuguuccagca

SEQ ID NO: 1915843 - RNA, 20 nt, Shigella flexneri 2a str. 2457T
uccgggaaauccucaaccgg

SEQ ID NO: 1915844 - RNA, 12 nt, Shigella flexneri 2a str. 2457T
uccgguaauuuu

SEQ ID NO: 1915845 - RNA, 23 nt, Shigella flexneri 2a str. 2457T
uccgguauacgucccggugaagc

SEQ ID NO: 1915846 - RNA, 16 nt, Shigella flexneri 2a str. 2457T
uccgggguucgaaucc

SEQ ID NO: 1915847 - RNA, 17 nt, Shigella flexneri 2a str. 2457T
uccgggucauccaggaa

SEQ ID NO: 1915848 - RNA, 21 nt, Shigella flexneri 2a str. 2457T
uccggcgcaauucccggaccg

SEQ ID NO: 1915849 - RNA, 14 nt, Shigella flexneri 2a str. 2457T
uccggcgcguugau

SEQ ID NO: 1915850 - RNA, 18 nt, Shigella flexneri 2a str. 2457T
uccggcgggucgcugccg

SEQ ID NO: 1915851 - RNA, 17 nt, Shigella flexneri 2a str. 2457T
uccggcugccagccagg

SEQ ID NO: 1915852 - RNA, 23 nt, Shigella flexneri 2a str. 2457T
uccggcugggcgugaaucugccu

SEQ ID NO: 1915853 - RNA, 17 nt, Shigella flexneri 2a str. 2457T
uccggcuugaaccagcc

SEQ ID NO: 1915854 - RNA, 20 nt, Shigella flexneri 2a str. 2457T
uccggcugaggcguuucaac

SEQ ID NO: 1915855 - RNA, 22 nt, Shigella flexneri 2a str. 2457T
uccggcucgccuuucggcugca

SEQ ID NO: 1915856 - RNA, 14 nt, Shigella flexneri 2a str. 2457T
ucgcagcugccugc

SEQ ID NO: 1915857 - RNA, 22 nt, Shigella flexneri 2a str. 2457T
ucgcagggaucauccacccgca

SEQ ID NO: 1915858 - RNA, 20 nt, Shigella flexneri 2a str. 2457T
ucgcaggcgguggaagcacc

SEQ ID NO: 1915859 - RNA, 18 nt, Shigella flexneri 2a str. 2457T
ucgcaggcugagaaaugc

SEQ ID NO: 1915860 - RNA, 20 nt, Shigella flexneri 2a str. 2457T
ucgcaggcugagaaaugcca

SEQ ID NO: 1915861 - RNA, 22 nt, Shigella flexneri 2a str. 2457T
ucgcauacaaaaacacauucaa

SEQ ID NO: 1915862 - RNA, 15 nt, Shigella flexneri 2a str. 2457T
ucgcauaucuucaac

SEQ ID NO: 1915863 - RNA, 16 nt, Shigella flexneri 2a str. 2457T
ucgcauaucuucaacg

SEQ ID NO: 1915864 - RNA, 18 nt, Shigella flexneri 2a str. 2457T
ucgcacuaaguucugccc

SEQ ID NO: 1915865 - RNA, 15 nt, Shigella flexneri 2a str. 2457T
ucgcagccagcgcgc

SEQ ID NO: 1915866 - RNA, 13 nt, Shigella flexneri 2a str. 2457T
ucgcagaugaauu

SEQ ID NO: 1915867 - RNA, 20 nt, Shigella flexneri 2a str. 2457T
ucgcaagacgaaaaaugaau

SEQ ID NO: 1915868 - RNA, 18 nt, Shigella flexneri 2a str. 2457T
ucgcaauacccugaccca

SEQ ID NO: 1915869 - RNA, 16 nt, Shigella flexneri 2a str. 2457T
ucgcaaugauuuugau

SEQ ID NO: 1915870 - RNA, 22 nt, Shigella flexneri 2a str. 2457T
ucgcaaaccacgguuucagugg

SEQ ID NO: 1915871 - RNA, 15 nt, Shigella flexneri 2a str. 2457T
ucgcaccaaacgggc

SEQ ID NO: 1915872 - RNA, 14 nt, Shigella flexneri 2a str. 2457T
ucgcaccuuucaac

SEQ ID NO: 1915873 - RNA, 17 nt, Shigella flexneri 2a str. 2457T
ucgcacaaaaucaugag

SEQ ID NO: 1915874 - RNA, 10 nt, Shigella flexneri 2a str. 2457T
ucgcaauuac

SEQ ID NO: 1915875 - RNA, 16 nt, Shigella flexneri 2a str. 2457T
ucgcacaaaaucauga

SEQ ID NO: 1915876 - RNA, 14 nt, Shigella flexneri 2a str. 2457T
ucgcacaaaaucau

SEQ ID NO: 1915877 - RNA, 16 nt, Shigella flexneri 2a str. 2457T
ucgauucacauuuaaa

SEQ ID NO: 1915878 - RNA, 19 nt, Shigella flexneri 2a str. 2457T
ucgauugcacaaagguuuc

SEQ ID NO: 1915879 - RNA, 18 nt, Shigella flexneri 2a str. 2457T
ucgauuuugcaauaaugg

SEQ ID NO: 1915880 - RNA, 18 nt, Shigella flexneri 2a str. 2457T
ucgaucucuucgccugcc

SEQ ID NO: 1915881 - RNA, 14 nt, Shigella flexneri 2a str. 2457T
ucgaugaucaaccg

SEQ ID NO: 1915882 - RNA, 18 nt, Shigella flexneri 2a str. 2457T
ucgaugcgcuggcggcug

SEQ ID NO: 1915883 - RNA, 20 nt, Shigella flexneri 2a str. 2457T
ucgaugccugaugacaugca

SEQ ID NO: 1915884 - RNA, 19 nt, Shigella flexneri 2a str. 2457T
ucgauaucguacuugccaa

SEQ ID NO: 1915885 - RNA, 20 nt, Shigella flexneri 2a str. 2457T
ucgaucagugaaggcgccuc

SEQ ID NO: 1915886 - RNA, 16 nt, Shigella flexneri 2a str. 2457T
ucgaucacuuucugcg

SEQ ID NO: 1915887 - RNA, 23 nt, Shigella flexneri 2a str. 2457T
ucgaucaaacaauuuucauugaa

SEQ ID NO: 1915888 - RNA, 21 nt, Shigella flexneri 2a str. 2457T
ucgauaaccaucuucuucacu

SEQ ID NO: 1915889 - RNA, 22 nt, Shigella flexneri 2a str. 2457T
ucgauaaacaguuucgccaggg

SEQ ID NO: 1915890 - RNA, 22 nt, Shigella flexneri 2a str. 2457T
ucgaggccgcggcucaggcgca

SEQ ID NO: 1915891 - RNA, 15 nt, Shigella flexneri 2a str. 2457T
ucgagcauauuuagg

SEQ ID NO: 1915892 - RNA, 20 nt, Shigella flexneri 2a str. 2457T
ucgagcaucacaucaaaucc

SEQ ID NO: 1915893 - RNA, 13 nt, Shigella flexneri 2a str. 2457T
ucgaggagcugga

SEQ ID NO: 1915894 - RNA, 18 nt, Shigella flexneri 2a str. 2457T
ucgagauaccuaacauuu

SEQ ID NO: 1915895 - RNA, 22 nt, Shigella flexneri 2a str. 2457T
ucgagagaauggggucagcagg

SEQ ID NO: 1915896 - RNA, 16 nt, Shigella flexneri 2a str. 2457T
ucgagaaggcgcugac

SEQ ID NO: 1915897 - RNA, 23 nt, Shigella flexneri 2a str. 2457T
ucgacuuuuuucggguuauuggu

SEQ ID NO: 1915898 - RNA, 21 nt, Shigella flexneri 2a str. 2457T
ucgacuuuagucgcuugcagg

SEQ ID NO: 1915899 - RNA, 20 nt, Shigella flexneri 2a str. 2457T
ucgacuucuucauucauccg

SEQ ID NO: 1915900 - RNA, 18 nt, Shigella flexneri 2a str. 2457T
ucgacggugacacuuugc

SEQ ID NO: 1915901 - RNA, 21 nt, Shigella flexneri 2a str. 2457T
ucgacggcuggacaaaauacu

SEQ ID NO: 1915902 - RNA, 17 nt, Shigella flexneri 2a str. 2457T
ucgacgagaauuuccuu

SEQ ID NO: 1915903 - RNA, 18 nt, Shigella flexneri 2a str. 2457T
ucgacgagaauuuccuuc

SEQ ID NO: 1915904 - RNA, 18 nt, Shigella flexneri 2a str. 2457T
ucgacaguuucaccugcu

SEQ ID NO: 1915905 - RNA, 15 nt, Shigella flexneri 2a str. 2457T
ucgacagacgccagc

SEQ ID NO: 1915906 - RNA, 21 nt, Shigella flexneri 2a str. 2457T
ucgacagacgccagcgcuuuu

SEQ ID NO: 1915907 - RNA, 18 nt, Shigella flexneri 2a str. 2457T
ucgacagcgccuuuucuu

SEQ ID NO: 1915908 - RNA, 19 nt, Shigella flexneri 2a str. 2457T
ucgacagcgccuuuucuuu

SEQ ID NO: 1915909 - RNA, 16 nt, Shigella flexneri 2a str. 2457T
ucgaccaggauuugau

SEQ ID NO: 1915910 - RNA, 19 nt, Shigella flexneri 2a str. 2457T
ucgaauuacacagccacag

SEQ ID NO: 1915911 - RNA, 14 nt, Shigella flexneri 2a str. 2457T
ucgaauuacacagc

SEQ ID NO: 1915912 - RNA, 15 nt, Shigella flexneri 2a str. 2457T
ucgaaugccgcagca

SEQ ID NO: 1915913 - RNA, 14 nt, Shigella flexneri 2a str. 2457T
ucgaauccucccgg

SEQ ID NO: 1915914 - RNA, 14 nt, Shigella flexneri 2a str. 2457T
ucgaaguuuuccuc

SEQ ID NO: 1915915 - RNA, 18 nt, Shigella flexneri 2a str. 2457T
ucgacaaaaucggaaaca

SEQ ID NO: 1915916 - RNA, 15 nt, Shigella flexneri 2a str. 2457T
ucgacaaaaacccug

SEQ ID NO: 1915917 - RNA, 12 nt, Shigella flexneri 2a str. 2457T
ucgacaccaucu

SEQ ID NO: 1915918 - RNA, 13 nt, Shigella flexneri 2a str. 2457T
ucgacaacugcug

SEQ ID NO: 1915919 - RNA, 16 nt, Shigella flexneri 2a str. 2457T
ucgaagagggcaacuu

SEQ ID NO: 1915920 - RNA, 17 nt, Shigella flexneri 2a str. 2457T
ucgaagaacugcuggaa

SEQ ID NO: 1915921 - RNA, 19 nt, Shigella flexneri 2a str. 2457T
ucgaagaacugcuggaagc

SEQ ID NO: 1915922 - RNA, 18 nt, Shigella flexneri 2a str. 2457T
ucgaacucauacaccagc

SEQ ID NO: 1915923 - RNA, 15 nt, Shigella flexneri 2a str. 2457T
ucgaaagccccagcc

SEQ ID NO: 1915924 - RNA, 14 nt, Shigella flexneri 2a str. 2457T
ucgaaaaucucaua

SEQ ID NO: 1915925 - RNA, 16 nt, Shigella flexneri 2a str. 2457T
ucgaacauacacaagc

SEQ ID NO: 1915926 - RNA, 14 nt, Shigella flexneri 2a str. 2457T
ucgaacaucugcgu

SEQ ID NO: 1915927 - RNA, 21 nt, Shigella flexneri 2a str. 2457T
ucgaacauccccacagaaaca

SEQ ID NO: 1915928 - RNA, 15 nt, Shigella flexneri 2a str. 2457T
ucgaacaugcggguc

SEQ ID NO: 1915929 - RNA, 19 nt, Shigella flexneri 2a str. 2457T
ucgaaccaaacagcgccag

SEQ ID NO: 1915930 - RNA, 20 nt, Shigella flexneri 2a str. 2457T
ucgaaccaucggcuuuggca

SEQ ID NO: 1915931 - RNA, 15 nt, Shigella flexneri 2a str. 2457T
ucgaacaaaaaaagc

SEQ ID NO: 1915932 - RNA, 12 nt, Shigella flexneri 2a str. 2457T
uccuuuguacca

SEQ ID NO: 1915933 - RNA, 21 nt, Shigella flexneri 2a str. 2457T
uccuuuguacaggauauauuu

SEQ ID NO: 1915934 - RNA, 16 nt, Shigella flexneri 2a str. 2457T
uccuuuuauuuaaccg

SEQ ID NO: 1915935 - RNA, 16 nt, Shigella flexneri 2a str. 2457T
ucgaaaaccacuccug

SEQ ID NO: 1915936 - RNA, 17 nt, Shigella flexneri 2a str. 2457T
uccuuggauauuuuaau

SEQ ID NO: 1915937 - RNA, 19 nt, Shigella flexneri 2a str. 2457T
uccuuggauauuuuaauca

SEQ ID NO: 1915938 - RNA, 21 nt, Shigella flexneri 2a str. 2457T
uccuugcgcuuucuuaaauua

SEQ ID NO: 1915939 - RNA, 16 nt, Shigella flexneri 2a str. 2457T
uccuuuaccucgaaaa

SEQ ID NO: 1915940 - RNA, 23 nt, Shigella flexneri 2a str. 2457T
uccuucuuguucgaagaguucca

SEQ ID NO: 1915941 - RNA, 22 nt, Shigella flexneri 2a str. 2457T
uccuuccuuggauauuuuaauc

SEQ ID NO: 1915942 - RNA, 15 nt, Shigella flexneri 2a str. 2457T
uccuucgauaaaagc

SEQ ID NO: 1915943 - RNA, 16 nt, Shigella flexneri 2a str. 2457T
uccuucgauaaaagcc

SEQ ID NO: 1915944 - RNA, 13 nt, Shigella flexneri 2a str. 2457T
uccuuccagguca

SEQ ID NO: 1915945 - RNA, 12 nt, Shigella flexneri 2a str. 2457T
uccuuccagcuc

SEQ ID NO: 1915946 - RNA, 14 nt, Shigella flexneri 2a str. 2457T
uagucgcuuucauu

SEQ ID NO: 1915947 - RNA, 14 nt, Shigella flexneri 2a str. 2457T
uagugaucaaacac

SEQ ID NO: 1915948 - RNA, 16 nt, Shigella flexneri 2a str. 2457T
uaguggcaaauucuug

SEQ ID NO: 1915949 - RNA, 16 nt, Shigella flexneri 2a str. 2457T
uagugcuuucagcgaa

SEQ ID NO: 1915950 - RNA, 17 nt, Shigella flexneri 2a str. 2457T
uaguuagccggagaaau

SEQ ID NO: 1915951 - RNA, 18 nt, Shigella flexneri 2a str. 2457T
uacuuuauuuauaucagu

SEQ ID NO: 1915952 - RNA, 17 nt, Shigella flexneri 2a str. 2457T
uacuuucacaaaaauaa

SEQ ID NO: 1915953 - RNA, 12 nt, Shigella flexneri 2a str. 2457T
uacuuucaucaa

SEQ ID NO: 1915954 - RNA, 20 nt, Shigella flexneri 2a str. 2457T
uagguggcaaagaaauccac

SEQ ID NO: 1915955 - RNA, 20 nt, Shigella flexneri 2a str. 2457T
uagguucucucagucuuucc

SEQ ID NO: 1915956 - RNA, 12 nt, Shigella flexneri 2a str. 2457T
uagucaucauca

SEQ ID NO: 1915957 - RNA, 15 nt, Shigella flexneri 2a str. 2457T
uagucaugaugacgc

SEQ ID NO: 1915958 - RNA, 13 nt, Shigella flexneri 2a str. 2457T
uagucacaaaucu

SEQ ID NO: 1915959 - RNA, 22 nt, Shigella flexneri 2a str. 2457T
uaguacgggcaauuucacguuc

SEQ ID NO: 1915960 - RNA, 21 nt, Shigella flexneri 2a str. 2457T
uauaaaauuuaacauuuggau

SEQ ID NO: 1915961 - RNA, 14 nt, Shigella flexneri 2a str. 2457T
uauaaauaaaaauu

SEQ ID NO: 1915962 - RNA, 21 nt, Shigella flexneri 2a str. 2457T
uauaaauaaaaauugaaucac

SEQ ID NO: 1915963 - RNA, 13 nt, Shigella flexneri 2a str. 2457T
uauaaauaaaaag

SEQ ID NO: 1915964 - RNA, 11 nt, Shigella flexneri 2a str. 2457T
uauaaauaaaa

SEQ ID NO: 1915965 - RNA, 19 nt, Shigella flexneri 2a str. 2457T
uaguugcugucgacaaagc

SEQ ID NO: 1915966 - RNA, 19 nt, Shigella flexneri 2a str. 2457T
uaguugcauuccaguccac

SEQ ID NO: 1915967 - RNA, 18 nt, Shigella flexneri 2a str. 2457T
uauaaccugaauauuagu

SEQ ID NO: 1915968 - RNA, 16 nt, Shigella flexneri 2a str. 2457T
uauaaccgccauagaa

SEQ ID NO: 1915969 - RNA, 20 nt, Shigella flexneri 2a str. 2457T
uauaaccggcaacagaacgc

SEQ ID NO: 1915970 - RNA, 16 nt, Shigella flexneri 2a str. 2457T
uauaagccaguaagac

SEQ ID NO: 1915971 - RNA, 11 nt, Shigella flexneri 2a str. 2457T
uauaaauauuu

SEQ ID NO: 1915972 - RNA, 12 nt, Shigella flexneri 2a str. 2457T
uauaauuaaaaa

SEQ ID NO: 1915973 - RNA, 14 nt, Shigella flexneri 2a str. 2457T
uauaauuaaaaaua

SEQ ID NO: 1915974 - RNA, 17 nt, Shigella flexneri 2a str. 2457T
uauaaucacucaaaaua

SEQ ID NO: 1915975 - RNA, 21 nt, Shigella flexneri 2a str. 2457T
uauaauccccggccuuugauu

SEQ ID NO: 1915976 - RNA, 18 nt, Shigella flexneri 2a str. 2457T
uauaauugcuuuuuucca

SEQ ID NO: 1915977 - RNA, 12 nt, Shigella flexneri 2a str. 2457T
uauaauuauugc

SEQ ID NO: 1915978 - RNA, 17 nt, Shigella flexneri 2a str. 2457T
uauaauaucuuuucuua

SEQ ID NO: 1915979 - RNA, 20 nt, Shigella flexneri 2a str. 2457T
uauaauaucuuuucuuaaca

SEQ ID NO: 1915980 - RNA, 23 nt, Shigella flexneri 2a str. 2457T
uauaauaucuuuucuuaacaaaa

SEQ ID NO: 1915981 - RNA, 12 nt, Shigella flexneri 2a str. 2457T
uauaauacgcuu

SEQ ID NO: 1915982 - RNA, 15 nt, Shigella flexneri 2a str. 2457T
uauaaguguaaaauu

SEQ ID NO: 1915983 - RNA, 14 nt, Shigella flexneri 2a str. 2457T
uauagcuuauucuu

SEQ ID NO: 1915984 - RNA, 22 nt, Shigella flexneri 2a str. 2457T
uauacacgaggcauauaggucu

SEQ ID NO: 1915985 - RNA, 19 nt, Shigella flexneri 2a str. 2457T
uauauaaaaaaacaaugcg

SEQ ID NO: 1915986 - RNA, 17 nt, Shigella flexneri 2a str. 2457T
uauaugacgcucgcgca

SEQ ID NO: 1915987 - RNA, 19 nt, Shigella flexneri 2a str. 2457T
uauauuacaacguauuaua

SEQ ID NO: 1915988 - RNA, 14 nt, Shigella flexneri 2a str. 2457T
uaucaccaaucaca

SEQ ID NO: 1915989 - RNA, 15 nt, Shigella flexneri 2a str. 2457T
uaucaccaaugauaa

SEQ ID NO: 1915990 - RNA, 23 nt, Shigella flexneri 2a str. 2457T
uaucaccaaugauaaguuucacu

SEQ ID NO: 1915991 - RNA, 17 nt, Shigella flexneri 2a str. 2457T
uaucagauuggcuucau

SEQ ID NO: 1915992 - RNA, 15 nt, Shigella flexneri 2a str. 2457T
uaucagcaacuggca

SEQ ID NO: 1915993 - RNA, 13 nt, Shigella flexneri 2a str. 2457T
uaucaacaugaug

SEQ ID NO: 1915994 - RNA, 20 nt, Shigella flexneri 2a str. 2457T
uaucaagaucaucaaacuuu

SEQ ID NO: 1915995 - RNA, 14 nt, Shigella flexneri 2a str. 2457T
uaucggccauaugu

SEQ ID NO: 1915996 - RNA, 17 nt, Shigella flexneri 2a str. 2457T
uaucggccaucuguucu

SEQ ID NO: 1915997 - RNA, 13 nt, Shigella flexneri 2a str. 2457T
uaucggagaacag

SEQ ID NO: 1915998 - RNA, 23 nt, Shigella flexneri 2a str. 2457T
uaucggcgcugcuuuccugcugc

SEQ ID NO: 1915999 - RNA, 19 nt, Shigella flexneri 2a str. 2457T
uaucgccaggccagccugg

SEQ ID NO: 1916000 - RNA, 15 nt, Shigella flexneri 2a str. 2457T
uaucgcauuaucaaa

SEQ ID NO: 1916001 - RNA, 14 nt, Shigella flexneri 2a str. 2457T
uaucgccguacaua

SEQ ID NO: 1916002 - RNA, 18 nt, Shigella flexneri 2a str. 2457T
uaucgccguacauagcgu

SEQ ID NO: 1916003 - RNA, 14 nt, Shigella flexneri 2a str. 2457T
uaucgcgcagaaau

SEQ ID NO: 1916004 - RNA, 19 nt, Shigella flexneri 2a str. 2457T
uaucgcucaauauccugac

SEQ ID NO: 1916005 - RNA, 16 nt, Shigella flexneri 2a str. 2457T
uaucgcucuugcucuc

SEQ ID NO: 1916006 - RNA, 18 nt, Shigella flexneri 2a str. 2457T
uaucgcugauauacccuu

SEQ ID NO: 1916007 - RNA, 23 nt, Shigella flexneri 2a str. 2457T
uaucgauuucuacacccagcccc

SEQ ID NO: 1916008 - RNA, 16 nt, Shigella flexneri 2a str. 2457T
uaucgauuuucaaaau

SEQ ID NO: 1916009 - RNA, 16 nt, Shigella flexneri 2a str. 2457T
uaucgacgaaccauuu

SEQ ID NO: 1916010 - RNA, 19 nt, Shigella flexneri 2a str. 2457T
uaucgacggcguauugcau

SEQ ID NO: 1916011 - RNA, 21 nt, Shigella flexneri 2a str. 2457T
uaucgagagaauggggucagc

SEQ ID NO: 1916012 - RNA, 17 nt, Shigella flexneri 2a str. 2457T
uaucgauaaauggcgca

SEQ ID NO: 1916013 - RNA, 15 nt, Shigella flexneri 2a str. 2457T
uauccugauaaaaac

SEQ ID NO: 1916014 - RNA, 21 nt, Shigella flexneri 2a str. 2457T
uauccugcccacuccagcuau

SEQ ID NO: 1916015 - RNA, 21 nt, Shigella flexneri 2a str. 2457T
uauccuguggauaaagcaguu

SEQ ID NO: 1916016 - RNA, 15 nt, Shigella flexneri 2a str. 2457T
uaucgaacaaaaaaa

SEQ ID NO: 1916017 - RNA, 12 nt, Shigella flexneri 2a str. 2457T
uaucgaacaugc

SEQ ID NO: 1916018 - RNA, 14 nt, Shigella flexneri 2a str. 2457T
uaucgaaccagcgg

SEQ ID NO: 1916019 - RNA, 15 nt, Shigella flexneri 2a str. 2457T
uauccccugcgaugg

SEQ ID NO: 1916020 - RNA, 19 nt, Shigella flexneri 2a str. 2457T
uaucccgccagcaccagca

SEQ ID NO: 1916021 - RNA, 19 nt, Shigella flexneri 2a str. 2457T
uaucccgcgcguuuuucuu

SEQ ID NO: 1916022 - RNA, 21 nt, Shigella flexneri 2a str. 2457T
uauccaguccgcgcuugccgc

SEQ ID NO: 1916023 - RNA, 15 nt, Shigella flexneri 2a str. 2457T
uauccggccuacaca

SEQ ID NO: 1916024 - RNA, 13 nt, Shigella flexneri 2a str. 2457T
uauccgguucacu

SEQ ID NO: 1916025 - RNA, 14 nt, Shigella flexneri 2a str. 2457T
uauccggcuaacaa

SEQ ID NO: 1916026 - RNA, 19 nt, Shigella flexneri 2a str. 2457T
uauccggcccacaucaacu

SEQ ID NO: 1916027 - RNA, 17 nt, Shigella flexneri 2a str. 2457T
uauccggccuacaaaac

SEQ ID NO: 1916028 - RNA, 22 nt, Shigella flexneri 2a str. 2457T
uauccggcacuuacuuuccuua

SEQ ID NO: 1916029 - RNA, 16 nt, Shigella flexneri 2a str. 2457T
uauccagcggcagcca

SEQ ID NO: 1916030 - RNA, 22 nt, Shigella flexneri 2a str. 2457T
uauccagcgcggcgaaggugcc

SEQ ID NO: 1916031 - RNA, 12 nt, Shigella flexneri 2a str. 2457T
uauccagcgcau

SEQ ID NO: 1916032 - RNA, 13 nt, Shigella flexneri 2a str. 2457T
uaucaucauuauu

SEQ ID NO: 1916033 - RNA, 16 nt, Shigella flexneri 2a str. 2457T
uaucaggcaaaaaaau

SEQ ID NO: 1916034 - RNA, 22 nt, Shigella flexneri 2a str. 2457T
uaucaggcaaaaaaaugcacau

SEQ ID NO: 1916035 - RNA, 16 nt, Shigella flexneri 2a str. 2457T
uaugcgccuuucgcuu

SEQ ID NO: 1916036 - RNA, 21 nt, Shigella flexneri 2a str. 2457T
uaugcggugccauuaaaccaa

SEQ ID NO: 1916037 - RNA, 14 nt, Shigella flexneri 2a str. 2457T
uaugccucuuucag

SEQ ID NO: 1916038 - RNA, 19 nt, Shigella flexneri 2a str. 2457T
uaugcgaccauaugaauau

SEQ ID NO: 1916039 - RNA, 17 nt, Shigella flexneri 2a str. 2457T
uaugccuguccucuuca

SEQ ID NO: 1916040 - RNA, 21 nt, Shigella flexneri 2a str. 2457T
uaugccacgugagcuuuucug

SEQ ID NO: 1916041 - RNA, 16 nt, Shigella flexneri 2a str. 2457T
uaugccgaucaucauc

SEQ ID NO: 1916042 - RNA, 16 nt, Shigella flexneri 2a str. 2457T
uauggucggucaggag

SEQ ID NO: 1916043 - RNA, 21 nt, Shigella flexneri 2a str. 2457T
uauggucggucaggagcaacu

SEQ ID NO: 1916044 - RNA, 18 nt, Shigella flexneri 2a str. 2457T
uauggugaaaguaaaaaa

SEQ ID NO: 1916045 - RNA, 17 nt, Shigella flexneri 2a str. 2457T
uauggcgaacuggucug

SEQ ID NO: 1916046 - RNA, 14 nt, Shigella flexneri 2a str. 2457T
uauggcauugucug

SEQ ID NO: 1916047 - RNA, 13 nt, Shigella flexneri 2a str. 2457T
uauggcucgccau

SEQ ID NO: 1916048 - RNA, 13 nt, Shigella flexneri 2a str. 2457T
uaugcuuaauguu

SEQ ID NO: 1916049 - RNA, 19 nt, Shigella flexneri 2a str. 2457T
uauggaaaaguugcuuugg

SEQ ID NO: 1916050 - RNA, 14 nt, Shigella flexneri 2a str. 2457T
uauggcaccuguug

SEQ ID NO: 1916051 - RNA, 21 nt, Shigella flexneri 2a str. 2457T
uauggcaaucuuccucgccag

SEQ ID NO: 1916052 - RNA, 19 nt, Shigella flexneri 2a str. 2457T
uauggcaaucguggucugg

SEQ ID NO: 1916053 - RNA, 15 nt, Shigella flexneri 2a str. 2457T
uauggagcaggaaua

SEQ ID NO: 1916054 - RNA, 22 nt, Shigella flexneri 2a str. 2457T
uauggaucagaguugaaaaaca

SEQ ID NO: 1916055 - RNA, 15 nt, Shigella flexneri 2a str. 2457T
uaugauauuuuuuua

SEQ ID NO: 1916056 - RNA, 20 nt, Shigella flexneri 2a str. 2457T
uaugaucaaaaucauauaau

SEQ ID NO: 1916057 - RNA, 23 nt, Shigella flexneri 2a str. 2457T
uaugaugaaggcuaaugcugucg

SEQ ID NO: 1916058 - RNA, 15 nt, Shigella flexneri 2a str. 2457T
uaugauuuaaaaaau

SEQ ID NO: 1916059 - RNA, 15 nt, Shigella flexneri 2a str. 2457T
uaugcagugcaucca

SEQ ID NO: 1916060 - RNA, 20 nt, Shigella flexneri 2a str. 2457T
uaugcauaauuugcggaauu

SEQ ID NO: 1916061 - RNA, 14 nt, Shigella flexneri 2a str. 2457T
uaugccacgugagc

SEQ ID NO: 1916062 - RNA, 23 nt, Shigella flexneri 2a str. 2457T
uaugcaacaacugaaaaaaaauu

SEQ ID NO: 1916063 - RNA, 22 nt, Shigella flexneri 2a str. 2457T
uaugaauauauccgaaaaagga

SEQ ID NO: 1916064 - RNA, 19 nt, Shigella flexneri 2a str. 2457T
uaugaaucuuuucaucgca

SEQ ID NO: 1916065 - RNA, 21 nt, Shigella flexneri 2a str. 2457T
uaugaauuacuucucuuuccc

SEQ ID NO: 1916066 - RNA, 18 nt, Shigella flexneri 2a str. 2457T
uaugaggcacuaaggcga

SEQ ID NO: 1916067 - RNA, 22 nt, Shigella flexneri 2a str. 2457T
uaugagaaaauuucauuaauau

SEQ ID NO: 1916068 - RNA, 14 nt, Shigella flexneri 2a str. 2457T
uaucuauuucaggu

SEQ ID NO: 1916069 - RNA, 20 nt, Shigella flexneri 2a str. 2457T
uaucuauucacgaaucuauu

SEQ ID NO: 1916070 - RNA, 21 nt, Shigella flexneri 2a str. 2457T
uaucgugcuggauuuguguca

SEQ ID NO: 1916071 - RNA, 19 nt, Shigella flexneri 2a str. 2457T
uaucuacagcauuuccuua

SEQ ID NO: 1916072 - RNA, 15 nt, Shigella flexneri 2a str. 2457T
uaucugggcugccug

SEQ ID NO: 1916073 - RNA, 17 nt, Shigella flexneri 2a str. 2457T
uaucuggcaagcaggac

SEQ ID NO: 1916074 - RNA, 19 nt, Shigella flexneri 2a str. 2457T
uaucugcugugguuugccc

SEQ ID NO: 1916075 - RNA, 17 nt, Shigella flexneri 2a str. 2457T
uaucugccguucagcua

SEQ ID NO: 1916076 - RNA, 13 nt, Shigella flexneri 2a str. 2457T
uaucugacagcaa

SEQ ID NO: 1916077 - RNA, 18 nt, Shigella flexneri 2a str. 2457T
uaucugcagauuaugccu

SEQ ID NO: 1916078 - RNA, 19 nt, Shigella flexneri 2a str. 2457T
uaucucugaugguuuuuug

SEQ ID NO: 1916079 - RNA, 12 nt, Shigella flexneri 2a str. 2457T
uaucucaacaca

SEQ ID NO: 1916080 - RNA, 12 nt, Shigella flexneri 2a str. 2457T
uaucuccagcua

SEQ ID NO: 1916081 - RNA, 12 nt, Shigella flexneri 2a str. 2457T
uaucuccauccg

SEQ ID NO: 1916082 - RNA, 14 nt, Shigella flexneri 2a str. 2457T
uaucuucaaucaga

SEQ ID NO: 1916083 - RNA, 18 nt, Shigella flexneri 2a str. 2457T
uaucuucaaucagaugug

SEQ ID NO: 1916084 - RNA, 19 nt, Shigella flexneri 2a str. 2457T
uaucuuauagacuaaauuu

SEQ ID NO: 1916085 - RNA, 17 nt, Shigella flexneri 2a str. 2457T
uaucuuacccuuccuua

SEQ ID NO: 1916086 - RNA, 13 nt, Shigella flexneri 2a str. 2457T
uaucuguguaaug

SEQ ID NO: 1916087 - RNA, 18 nt, Shigella flexneri 2a str. 2457T
uaucuuuacugauaauuu

SEQ ID NO: 1916088 - RNA, 13 nt, Shigella flexneri 2a str. 2457T
uaucuuccacuuc

SEQ ID NO: 1916089 - RNA, 13 nt, Shigella flexneri 2a str. 2457T
uaucuucccagcc

SEQ ID NO: 1916090 - RNA, 19 nt, Shigella flexneri 2a str. 2457T
uaucuucccagccaaugca

SEQ ID NO: 1916091 - RNA, 14 nt, Shigella flexneri 2a str. 2457T
uaucuucgauaaac

SEQ ID NO: 1916092 - RNA, 19 nt, Shigella flexneri 2a str. 2457T
uaucuucgauaaacucaau

SEQ ID NO: 1916093 - RNA, 18 nt, Shigella flexneri 2a str. 2457T
uaugaauagcggaaaucu

SEQ ID NO: 1916094 - RNA, 20 nt, Shigella flexneri 2a str. 2457T
uaugaauagcggaaaucucc

SEQ ID NO: 1916095 - RNA, 18 nt, Shigella flexneri 2a str. 2457T
uaugaacacgaucucacg

SEQ ID NO: 1916096 - RNA, 14 nt, Shigella flexneri 2a str. 2457T
uaugaaaauaggaa

SEQ ID NO: 1916097 - RNA, 20 nt, Shigella flexneri 2a str. 2457T
uaucuuugauugaagaaauc

SEQ ID NO: 1916098 - RNA, 13 nt, Shigella flexneri 2a str. 2457T
uauucaaaggcuc

SEQ ID NO: 1916099 - RNA, 15 nt, Shigella flexneri 2a str. 2457T
uauucaaaggcucca

SEQ ID NO: 1916100 - RNA, 20 nt, Shigella flexneri 2a str. 2457T
uauuaugcgaccauaugaau

SEQ ID NO: 1916101 - RNA, 21 nt, Shigella flexneri 2a str. 2457T
uauuaugcgaccauaugaaua

SEQ ID NO: 1916102 - RNA, 19 nt, Shigella flexneri 2a str. 2457T
uauuaucuucaucgauacu

SEQ ID NO: 1916103 - RNA, 17 nt, Shigella flexneri 2a str. 2457T
uauuccucguaguucuu

SEQ ID NO: 1916104 - RNA, 14 nt, Shigella flexneri 2a str. 2457T
uauucccuugcucu

SEQ ID NO: 1916105 - RNA, 20 nt, Shigella flexneri 2a str. 2457T
uauucccguauuacugagau

SEQ ID NO: 1916106 - RNA, 12 nt, Shigella flexneri 2a str. 2457T
uauuccccagac

SEQ ID NO: 1916107 - RNA, 16 nt, Shigella flexneri 2a str. 2457T
uauucaacgucacugg

SEQ ID NO: 1916108 - RNA, 14 nt, Shigella flexneri 2a str. 2457T
uauucgugcggcac

SEQ ID NO: 1916109 - RNA, 21 nt, Shigella flexneri 2a str. 2457T
uauucgugcggcacaagaaaa

SEQ ID NO: 1916110 - RNA, 19 nt, Shigella flexneri 2a str. 2457T
uauuccgcgugaaaugcca

SEQ ID NO: 1916111 - RNA, 12 nt, Shigella flexneri 2a str. 2457T
uauucuuauaaa

SEQ ID NO: 1916112 - RNA, 22 nt, Shigella flexneri 2a str. 2457T
aaauccugucuggcgaauaaua

SEQ ID NO: 1916113 - RNA, 17 nt, Shigella flexneri 2a str. 2457T
uauugauuuucuuguca

SEQ ID NO: 1916114 - RNA, 21 nt, Shigella flexneri 2a str. 2457T
uauugauucaucucuucuucc

SEQ ID NO: 1916115 - RNA, 17 nt, Shigella flexneri 2a str. 2457T
uauugcacaguauagca

SEQ ID NO: 1916116 - RNA, 14 nt, Shigella flexneri 2a str. 2457T
uauugcaaucaucu

SEQ ID NO: 1916117 - RNA, 16 nt, Shigella flexneri 2a str. 2457T
uauugaagauuuugcu

SEQ ID NO: 1916118 - RNA, 15 nt, Shigella flexneri 2a str. 2457T
uauugaaaucacuaa

SEQ ID NO: 1916119 - RNA, 15 nt, Shigella flexneri 2a str. 2457T
uauuguuuugaugaa

SEQ ID NO: 1916120 - RNA, 21 nt, Shigella flexneri 2a str. 2457T
uauuguugauaaggaaauuca

SEQ ID NO: 1916121 - RNA, 14 nt, Shigella flexneri 2a str. 2457T
uauugggugacugg

SEQ ID NO: 1916122 - RNA, 18 nt, Shigella flexneri 2a str. 2457T
uauugguaaacucaaagu

SEQ ID NO: 1916123 - RNA, 19 nt, Shigella flexneri 2a str. 2457T
uauggugagcgauauuuau

SEQ ID NO: 1916124 - RNA, 15 nt, Shigella flexneri 2a str. 2457T
uaugguucacuugcu

SEQ ID NO: 1916125 - RNA, 17 nt, Shigella flexneri 2a str. 2457T
uaugguuagagaacaac

SEQ ID NO: 1916126 - RNA, 14 nt, Shigella flexneri 2a str. 2457T
uaugugaaauuuau

SEQ ID NO: 1916127 - RNA, 18 nt, Shigella flexneri 2a str. 2457T
uaugucuggcgagcucca

SEQ ID NO: 1916128 - RNA, 23 nt, Shigella flexneri 2a str. 2457T
uauuaaaagcguugcggcuauau

SEQ ID NO: 1916129 - RNA, 13 nt, Shigella flexneri 2a str. 2457T
uauguuuaucagg

SEQ ID NO: 1916130 - RNA, 15 nt, Shigella flexneri 2a str. 2457T
uauguuuauuagccc

SEQ ID NO: 1916131 - RNA, 22 nt, Shigella flexneri 2a str. 2457T
uauguucagauaaugcccgaug

SEQ ID NO: 1916132 - RNA, 23 nt, Shigella flexneri 2a str. 2457T
uauguucagccgucauccaggaa

SEQ ID NO: 1916133 - RNA, 13 nt, Shigella flexneri 2a str. 2457T
uauguuccccuca

SEQ ID NO: 1916134 - RNA, 15 nt, Shigella flexneri 2a str. 2457T
uauguucagauaaug

SEQ ID NO: 1916135 - RNA, 13 nt, Shigella flexneri 2a str. 2457T
uauguugaaaagc

SEQ ID NO: 1916136 - RNA, 14 nt, Shigella flexneri 2a str. 2457T
uauuaguacucauu

SEQ ID NO: 1916137 - RNA, 20 nt, Shigella flexneri 2a str. 2457T
uauuaucugaucaauauaga

SEQ ID NO: 1916138 - RNA, 16 nt, Shigella flexneri 2a str. 2457T
uauuaucuaucgcguu

SEQ ID NO: 1916139 - RNA, 23 nt, Shigella flexneri 2a str. 2457T
uauuaccgaugugaacccugauu

SEQ ID NO: 1916140 - RNA, 14 nt, Shigella flexneri 2a str. 2457T
uauuaauuaugaug

SEQ ID NO: 1916141 - RNA, 15 nt, Shigella flexneri 2a str. 2457T
uauuaauucuaaaac

SEQ ID NO: 1916142 - RNA, 14 nt, Shigella flexneri 2a str. 2457T
uauuaagaauuuua

SEQ ID NO: 1916143 - RNA, 18 nt, Shigella flexneri 2a str. 2457T
uauuaaggguaaaaggau

SEQ ID NO: 1916144 - RNA, 13 nt, Shigella flexneri 2a str. 2457T
uauuaaaccaccc

SEQ ID NO: 1916145 - RNA, 14 nt, Shigella flexneri 2a str. 2457T
uauuaaauuuuuuc

SEQ ID NO: 1916146 - RNA, 15 nt, Shigella flexneri 2a str. 2457T
uauuaaauuugcuuu

SEQ ID NO: 1916147 - RNA, 17 nt, Shigella flexneri 2a str. 2457T
uauuaacuuaauaaaca

SEQ ID NO: 1916148 - RNA, 14 nt, Shigella flexneri 2a str. 2457T
uauuaacggcucug

SEQ ID NO: 1916149 - RNA, 19 nt, Shigella flexneri 2a str. 2457T
ucaauaccgcguaauacau

SEQ ID NO: 1916150 - RNA, 18 nt, Shigella flexneri 2a str. 2457T
ucaauacuuucacaaaaa

SEQ ID NO: 1916151 - RNA, 20 nt, Shigella flexneri 2a str. 2457T
ucaauacuuucacaaaaaua

SEQ ID NO: 1916152 - RNA, 13 nt, Shigella flexneri 2a str. 2457T
ucaauauauugca

SEQ ID NO: 1916153 - RNA, 18 nt, Shigella flexneri 2a str. 2457T
ucaauauauugcaaucuc

SEQ ID NO: 1916154 - RNA, 23 nt, Shigella flexneri 2a str. 2457T
ucaauaucauuacgccagucacg

SEQ ID NO: 1916155 - RNA, 14 nt, Shigella flexneri 2a str. 2457T
ucaauaugaauuaa

SEQ ID NO: 1916156 - RNA, 16 nt, Shigella flexneri 2a str. 2457T
ucaauaugauaaaccu

SEQ ID NO: 1916157 - RNA, 17 nt, Shigella flexneri 2a str. 2457T
ucaauaaaaggaaacag

SEQ ID NO: 1916158 - RNA, 14 nt, Shigella flexneri 2a str. 2457T
ucaauaaacaauga

SEQ ID NO: 1916159 - RNA, 21 nt, Shigella flexneri 2a str. 2457T
ucaauaaaaauacauacgcaa

SEQ ID NO: 1916160 - RNA, 20 nt, Shigella flexneri 2a str. 2457T
ucaauaaucugauuugucgg

SEQ ID NO: 1916161 - RNA, 10 nt, Shigella flexneri 2a str. 2457T
ucaauaauca

SEQ ID NO: 1916162 - RNA, 20 nt, Shigella flexneri 2a str. 2457T
ucaauugcguuaaaaucagc

SEQ ID NO: 1916163 - RNA, 21 nt, Shigella flexneri 2a str. 2457T
ucaauuuauugaauuuacaca

SEQ ID NO: 1916164 - RNA, 15 nt, Shigella flexneri 2a str. 2457T
ucaauguaucucuga

SEQ ID NO: 1916165 - RNA, 14 nt, Shigella flexneri 2a str. 2457T
ucaaugucugucau

SEQ ID NO: 1916166 - RNA, 14 nt, Shigella flexneri 2a str. 2457T
ucaauuccuauuuu

SEQ ID NO: 1916167 - RNA, 18 nt, Shigella flexneri 2a str. 2457T
ucaauuccuucugggcgc

SEQ ID NO: 1916168 - RNA, 13 nt, Shigella flexneri 2a str. 2457T
ucaauuccuucug

SEQ ID NO: 1916169 - RNA, 17 nt, Shigella flexneri 2a str. 2457T
ucaauucggaaauaauc

SEQ ID NO: 1916170 - RNA, 15 nt, Shigella flexneri 2a str. 2457T
ucaaucauccauauu

SEQ ID NO: 1916171 - RNA, 20 nt, Shigella flexneri 2a str. 2457T
ucaaucauccauauuuucag

SEQ ID NO: 1916172 - RNA, 16 nt, Shigella flexneri 2a str. 2457T
ucaauauggaaguuuu

SEQ ID NO: 1916173 - RNA, 12 nt, Shigella flexneri 2a str. 2457T
ucaaucaccgca

SEQ ID NO: 1916174 - RNA, 14 nt, Shigella flexneri 2a str. 2457T
ucaaucaggcuauc

SEQ ID NO: 1916175 - RNA, 14 nt, Shigella flexneri 2a str. 2457T
ucaaucaguucauu

SEQ ID NO: 1916176 - RNA, 22 nt, Shigella flexneri 2a str. 2457T
ucaauggcugcaaagcauuuuu

SEQ ID NO: 1916177 - RNA, 16 nt, Shigella flexneri 2a str. 2457T
ucaaugguguuuucca

SEQ ID NO: 1916178 - RNA, 16 nt, Shigella flexneri 2a str. 2457T
ucaauggucagcgcca

SEQ ID NO: 1916179 - RNA, 14 nt, Shigella flexneri 2a str. 2457T
ucaaugauaagccu

SEQ ID NO: 1916180 - RNA, 20 nt, Shigella flexneri 2a str. 2457T
ucacaucaucaucgccaggc

SEQ ID NO: 1916181 - RNA, 14 nt, Shigella flexneri 2a str. 2457T
ucacaucaccaaca

SEQ ID NO: 1916182 - RNA, 13 nt, Shigella flexneri 2a str. 2457T
ucacaucaccaua

SEQ ID NO: 1916183 - RNA, 19 nt, Shigella flexneri 2a str. 2457T
ucacaucaccauaaaucag

SEQ ID NO: 1916184 - RNA, 15 nt, Shigella flexneri 2a str. 2457T
ucacaucaccauagc

SEQ ID NO: 1916185 - RNA, 13 nt, Shigella flexneri 2a str. 2457T
ucacaucccagca

SEQ ID NO: 1916186 - RNA, 18 nt, Shigella flexneri 2a str. 2457T
ucacauccaguacgccuu

SEQ ID NO: 1916187 - RNA, 15 nt, Shigella flexneri 2a str. 2457T
ucaccaccagcaccg

SEQ ID NO: 1916188 - RNA, 20 nt, Shigella flexneri 2a str. 2457T
ucaccacccagcgguaaaau

SEQ ID NO: 1916189 - RNA, 22 nt, Shigella flexneri 2a str. 2457T
ucaccaccagcggaauaucaga

SEQ ID NO: 1916190 - RNA, 16 nt, Shigella flexneri 2a str. 2457T
ucaccaggucaccaga

SEQ ID NO: 1916191 - RNA, 19 nt, Shigella flexneri 2a str. 2457T
ucaccacgcugagagaagc

SEQ ID NO: 1916192 - RNA, 15 nt, Shigella flexneri 2a str. 2457T
ucaccaccuggguga

SEQ ID NO: 1916193 - RNA, 15 nt, Shigella flexneri 2a str. 2457T
ucaccacgaaaacag

SEQ ID NO: 1916194 - RNA, 23 nt, Shigella flexneri 2a str. 2457T
ucaccacgaaaacagcggccacu

SEQ ID NO: 1916195 - RNA, 19 nt, Shigella flexneri 2a str. 2457T
ucaccaucuugagaaaaac

SEQ ID NO: 1916196 - RNA, 17 nt, Shigella flexneri 2a str. 2457T
ucaccaugagcggcgcu

SEQ ID NO: 1916197 - RNA, 15 nt, Shigella flexneri 2a str. 2457T
ucaccaucagcagca

SEQ ID NO: 1916198 - RNA, 21 nt, Shigella flexneri 2a str. 2457T
ucaccauaaaacgcgcuacug

SEQ ID NO: 1916199 - RNA, 22 nt, Shigella flexneri 2a str. 2457T
ucaccaguuacaucggugccuu

SEQ ID NO: 1916200 - RNA, 20 nt, Shigella flexneri 2a str. 2457T
ucaccaguaaggcaucuucu

SEQ ID NO: 1916201 - RNA, 18 nt, Shigella flexneri 2a str. 2457T
ucaccauauucagcagca

SEQ ID NO: 1916202 - RNA, 18 nt, Shigella flexneri 2a str. 2457T
ucacauaaucgaaaacau

SEQ ID NO: 1916203 - RNA, 19 nt, Shigella flexneri 2a str. 2457T
ucacauaaucgaaaacauc

SEQ ID NO: 1916204 - RNA, 21 nt, Shigella flexneri 2a str. 2457T
aaaucgcugaauaucuuucuc

SEQ ID NO: 1916205 - RNA, 11 nt, Shigella flexneri 2a str. 2457T
aaaucgcccgg

SEQ ID NO: 1916206 - RNA, 14 nt, Shigella flexneri 2a str. 2457T
aaaucgccaagauu

SEQ ID NO: 1916207 - RNA, 20 nt, Shigella flexneri 2a str. 2457T
aaaucgccaacaaucucuuc

SEQ ID NO: 1916208 - RNA, 23 nt, Shigella flexneri 2a str. 2457T
aaaucgccaacaaucucuuccag

SEQ ID NO: 1916209 - RNA, 20 nt, Shigella flexneri 2a str. 2457T
ucacaggguggcccaaaugg

SEQ ID NO: 1916210 - RNA, 10 nt, Shigella flexneri 2a str. 2457T
ucacagugaa

SEQ ID NO: 1916211 - RNA, 14 nt, Shigella flexneri 2a str. 2457T
ucacauaacugccu

SEQ ID NO: 1916212 - RNA, 22 nt, Shigella flexneri 2a str. 2457T
ucacaguaaugauuuaaaacca

SEQ ID NO: 1916213 - RNA, 18 nt, Shigella flexneri 2a str. 2457T
aaaucgauaaaacuuccc

SEQ ID NO: 1916214 - RNA, 19 nt, Shigella flexneri 2a str. 2457T
ucacagaggucuuuucucg

SEQ ID NO: 1916215 - RNA, 18 nt, Shigella flexneri 2a str. 2457T
ucacaaaacgaauaauug

SEQ ID NO: 1916216 - RNA, 12 nt, Shigella flexneri 2a str. 2457T
ucacaaacauca

SEQ ID NO: 1916217 - RNA, 17 nt, Shigella flexneri 2a str. 2457T
ucacaaaacgaauaauu

SEQ ID NO: 1916218 - RNA, 22 nt, Shigella flexneri 2a str. 2457T
ucacaaaaauaauuuucguagu

SEQ ID NO: 1916219 - RNA, 14 nt, Shigella flexneri 2a str. 2457T
ucacaaaacgaaua

SEQ ID NO: 1916220 - RNA, 19 nt, Shigella flexneri 2a str. 2457T
ucacagaguauuuccagcu

SEQ ID NO: 1916221 - RNA, 17 nt, Shigella flexneri 2a str. 2457T
ucacagaguauuuccag

SEQ ID NO: 1916222 - RNA, 21 nt, Shigella flexneri 2a str. 2457T
ucacagggcucuuaagcaccg

SEQ ID NO: 1916223 - RNA, 20 nt, Shigella flexneri 2a str. 2457T
ucacagcuaaucaucaucag

SEQ ID NO: 1916224 - RNA, 16 nt, Shigella flexneri 2a str. 2457T
ucaacaauugaagaau

SEQ ID NO: 1916225 - RNA, 19 nt, Shigella flexneri 2a str. 2457T
ucaacaaaguugcacacuu

SEQ ID NO: 1916226 - RNA, 21 nt, Shigella flexneri 2a str. 2457T
ucaacaaauucuggcaccacc

SEQ ID NO: 1916227 - RNA, 19 nt, Shigella flexneri 2a str. 2457T
ucaacaccgggugcagaca

SEQ ID NO: 1916228 - RNA, 21 nt, Shigella flexneri 2a str. 2457T
ucaacacagugaugaaaacga

SEQ ID NO: 1916229 - RNA, 16 nt, Shigella flexneri 2a str. 2457T
ucaacacauccagugg

SEQ ID NO: 1916230 - RNA, 12 nt, Shigella flexneri 2a str. 2457T
ucaacaccacug

SEQ ID NO: 1916231 - RNA, 22 nt, Shigella flexneri 2a str. 2457T
ucaaccacuacgugaucgucuu

SEQ ID NO: 1916232 - RNA, 12 nt, Shigella flexneri 2a str. 2457T
ucaaccacucac

SEQ ID NO: 1916233 - RNA, 14 nt, Shigella flexneri 2a str. 2457T
ucaaccauugaaac

SEQ ID NO: 1916234 - RNA, 18 nt, Shigella flexneri 2a str. 2457T
ucaaccagcacaaagugg

SEQ ID NO: 1916235 - RNA, 17 nt, Shigella flexneri 2a str. 2457T
ucaaccagcacuucgcc

SEQ ID NO: 1916236 - RNA, 20 nt, Shigella flexneri 2a str. 2457T
ucaaccacuuuaucgagaau

SEQ ID NO: 1916237 - RNA, 20 nt, Shigella flexneri 2a str. 2457T
ucaaccagaucggacuucau

SEQ ID NO: 1916238 - RNA, 18 nt, Shigella flexneri 2a str. 2457T
ucaacauuucccccuucc

SEQ ID NO: 1916239 - RNA, 15 nt, Shigella flexneri 2a str. 2457T
ucaacaugaaaauaa

SEQ ID NO: 1916240 - RNA, 12 nt, Shigella flexneri 2a str. 2457T
ucaacauacgca

SEQ ID NO: 1916241 - RNA, 12 nt, Shigella flexneri 2a str. 2457T
ucaacaucaucu

SEQ ID NO: 1916242 - RNA, 14 nt, Shigella flexneri 2a str. 2457T
ucaacauauuaaaa

SEQ ID NO: 1916243 - RNA, 21 nt, Shigella flexneri 2a str. 2457T
ucaacauacaaauagccaauu

SEQ ID NO: 1916244 - RNA, 19 nt, Shigella flexneri 2a str. 2457T
ucaacaggcuaccagcaaa

SEQ ID NO: 1916245 - RNA, 20 nt, Shigella flexneri 2a str. 2457T
ucaacauaacgcaucccguu

SEQ ID NO: 1916246 - RNA, 23 nt, Shigella flexneri 2a str. 2457T
ucaacgcucaggccgauuucaug

SEQ ID NO: 1916247 - RNA, 15 nt, Shigella flexneri 2a str. 2457T
ucaacguugaauuuc

SEQ ID NO: 1916248 - RNA, 18 nt, Shigella flexneri 2a str. 2457T
ucaacguugaauuucagg

SEQ ID NO: 1916249 - RNA, 22 nt, Shigella flexneri 2a str. 2457T
ucaacguuuacccaauccccca

SEQ ID NO: 1916250 - RNA, 16 nt, Shigella flexneri 2a str. 2457T
ucaacuuuaccuucau

SEQ ID NO: 1916251 - RNA, 15 nt, Shigella flexneri 2a str. 2457T
ucaacuuucgaucag

SEQ ID NO: 1916252 - RNA, 22 nt, Shigella flexneri 2a str. 2457T
ucaacuuuguuagcgaauaaag

SEQ ID NO: 1916253 - RNA, 18 nt, Shigella flexneri 2a str. 2457T
ucaacuccgccagcaacu

SEQ ID NO: 1916254 - RNA, 22 nt, Shigella flexneri 2a str. 2457T
ucaacgcaccgacaaauuucau

SEQ ID NO: 1916255 - RNA, 17 nt, Shigella flexneri 2a str. 2457T
ucaacgauucaagaaac

SEQ ID NO: 1916256 - RNA, 13 nt, Shigella flexneri 2a str. 2457T
ucaacgacagccu

SEQ ID NO: 1916257 - RNA, 22 nt, Shigella flexneri 2a str. 2457T
ucaaccgucgcgcccuccugca

SEQ ID NO: 1916258 - RNA, 19 nt, Shigella flexneri 2a str. 2457T
ucaaccugugcgccaggau

SEQ ID NO: 1916259 - RNA, 20 nt, Shigella flexneri 2a str. 2457T
ucaaccugaucgugccagga

SEQ ID NO: 1916260 - RNA, 23 nt, Shigella flexneri 2a str. 2457T
ucaaccgagagggcuuuuucaau

SEQ ID NO: 1916261 - RNA, 13 nt, Shigella flexneri 2a str. 2457T
ucaacccgcccag

SEQ ID NO: 1916262 - RNA, 17 nt, Shigella flexneri 2a str. 2457T
ucaacccgcacagucac

SEQ ID NO: 1916263 - RNA, 17 nt, Shigella flexneri 2a str. 2457T
ucaaaaucaucauugcu

SEQ ID NO: 1916264 - RNA, 14 nt, Shigella flexneri 2a str. 2457T
ucaaacacaaaguc

SEQ ID NO: 1916265 - RNA, 16 nt, Shigella flexneri 2a str. 2457T
ucaaacaguucuggaa

SEQ ID NO: 1916266 - RNA, 22 nt, Shigella flexneri 2a str. 2457T
ucaaacauuagcgcaugaccag

SEQ ID NO: 1916267 - RNA, 19 nt, Shigella flexneri 2a str. 2457T
ucaaaccacuuaauuauua

SEQ ID NO: 1916268 - RNA, 13 nt, Shigella flexneri 2a str. 2457T
ucaaaccaauggc

SEQ ID NO: 1916269 - RNA, 22 nt, Shigella flexneri 2a str. 2457T
ucaaaccaauggcauuggcaga

SEQ ID NO: 1916270 - RNA, 22 nt, Shigella flexneri 2a str. 2457T
ucaaaccauucccugcuuugca

SEQ ID NO: 1916271 - RNA, 22 nt, Shigella flexneri 2a str. 2457T
ucaaaccauuuugcaaggcuuc

SEQ ID NO: 1916272 - RNA, 17 nt, Shigella flexneri 2a str. 2457T
ucaaacucggcuucgcu

SEQ ID NO: 1916273 - RNA, 14 nt, Shigella flexneri 2a str. 2457T
ucaaacucaauuac

SEQ ID NO: 1916274 - RNA, 22 nt, Shigella flexneri 2a str. 2457T
ucaaauuugucgccaacuucau

SEQ ID NO: 1916275 - RNA, 13 nt, Shigella flexneri 2a str. 2457T
ucaacaaaccaaa

SEQ ID NO: 1916276 - RNA, 21 nt, Shigella flexneri 2a str. 2457T
ucaaauguugcguucaucagu

SEQ ID NO: 1916277 - RNA, 17 nt, Shigella flexneri 2a str. 2457T
ucaaauggcgcuuuaua

SEQ ID NO: 1916278 - RNA, 23 nt, Shigella flexneri 2a str. 2457T
ucaaauggcauccuugcuaacca

SEQ ID NO: 1916279 - RNA, 13 nt, Shigella flexneri 2a str. 2457T
ucaaauucauugu

SEQ ID NO: 1916280 - RNA, 18 nt, Shigella flexneri 2a str. 2457T
ucaaauaucuauuucagg

SEQ ID NO: 1916281 - RNA, 16 nt, Shigella flexneri 2a str. 2457T
ucaaauauucugccca

SEQ ID NO: 1916282 - RNA, 16 nt, Shigella flexneri 2a str. 2457T
ucaaaucacuaaaccc

SEQ ID NO: 1916283 - RNA, 18 nt, Shigella flexneri 2a str. 2457T
ucaaacuuuuaaauugaa

SEQ ID NO: 1916284 - RNA, 20 nt, Shigella flexneri 2a str. 2457T
ucaaacugaccuuuagcgcg

SEQ ID NO: 1916285 - RNA, 17 nt, Shigella flexneri 2a str. 2457T
ucaaagcgaucauguac

SEQ ID NO: 1916286 - RNA, 15 nt, Shigella flexneri 2a str. 2457T
ucaaagccaggcaga

SEQ ID NO: 1916287 - RNA, 16 nt, Shigella flexneri 2a str. 2457T
ucaaagccgaagcugu

SEQ ID NO: 1916288 - RNA, 22 nt, Shigella flexneri 2a str. 2457T
ucaaagauuguuggcaaaaaaa

SEQ ID NO: 1916289 - RNA, 16 nt, Shigella flexneri 2a str. 2457T
ucacguugacgcauac

SEQ ID NO: 1916290 - RNA, 14 nt, Shigella flexneri 2a str. 2457T
ucacguugauggua

SEQ ID NO: 1916291 - RNA, 16 nt, Shigella flexneri 2a str. 2457T
ucacuauacuccugau

SEQ ID NO: 1916292 - RNA, 15 nt, Shigella flexneri 2a str. 2457T
ucacggcaccagcca

SEQ ID NO: 1916293 - RNA, 19 nt, Shigella flexneri 2a str. 2457T
ucacggcccauuccucaug

SEQ ID NO: 1916294 - RNA, 19 nt, Shigella flexneri 2a str. 2457T
ucacggcgacggcuggcaa

SEQ ID NO: 1916295 - RNA, 13 nt, Shigella flexneri 2a str. 2457T
ucacguuccaggc

SEQ ID NO: 1916296 - RNA, 21 nt, Shigella flexneri 2a str. 2457T
ucacguucacccaucacuacc

SEQ ID NO: 1916297 - RNA, 18 nt, Shigella flexneri 2a str. 2457T
ucacggcuguagccagcu

SEQ ID NO: 1916298 - RNA, 22 nt, Shigella flexneri 2a str. 2457T
ucacccgccgguggcguuucca

SEQ ID NO: 1916299 - RNA, 23 nt, Shigella flexneri 2a str. 2457T
ucacccgugagaacugcugcauc

SEQ ID NO: 1916300 - RNA, 19 nt, Shigella flexneri 2a str. 2457T
ucacgccgcauccggcauu

SEQ ID NO: 1916301 - RNA, 22 nt, Shigella flexneri 2a str. 2457T
ucacgccgggaaauuuuuccgu

SEQ ID NO: 1916302 - RNA, 19 nt, Shigella flexneri 2a str. 2457T
ucacggaaucccguaaucc

SEQ ID NO: 1916303 - RNA, 22 nt, Shigella flexneri 2a str. 2457T
ucacgcuuaucgcccuggauuu

SEQ ID NO: 1916304 - RNA, 13 nt, Shigella flexneri 2a str. 2457T
ucacggcaccagc

SEQ ID NO: 1916305 - RNA, 16 nt, Shigella flexneri 2a str. 2457T
ucacgccgaccagacc

SEQ ID NO: 1916306 - RNA, 21 nt, Shigella flexneri 2a str. 2457T
ucacgccgcauccggcauaaa

SEQ ID NO: 1916307 - RNA, 12 nt, Shigella flexneri 2a str. 2457T
ucacgccaauac

SEQ ID NO: 1916308 - RNA, 13 nt, Shigella flexneri 2a str. 2457T
ucacgcccagucc

SEQ ID NO: 1916309 - RNA, 11 nt, Shigella flexneri 2a str. 2457T
ucacuggagac

SEQ ID NO: 1916310 - RNA, 14 nt, Shigella flexneri 2a str. 2457T
ucacugguucaaag

SEQ ID NO: 1916311 - RNA, 22 nt, Shigella flexneri 2a str. 2457T
ucacugggcgauuaauaaaauu

SEQ ID NO: 1916312 - RNA, 21 nt, Shigella flexneri 2a str. 2457T
ucacugccagaauagccgcag

SEQ ID NO: 1916313 - RNA, 22 nt, Shigella flexneri 2a str. 2457T
ucacugcgaaagcgucagcuuu

SEQ ID NO: 1916314 - RNA, 13 nt, Shigella flexneri 2a str. 2457T
ucacugcaaauac

SEQ ID NO: 1916315 - RNA, 21 nt, Shigella flexneri 2a str. 2457T
ucacuaugagguagccugagu

SEQ ID NO: 1916316 - RNA, 16 nt, Shigella flexneri 2a str. 2457T
ucacuuccggcaaggc

SEQ ID NO: 1916317 - RNA, 13 nt, Shigella flexneri 2a str. 2457T
ucacuucugaguu

SEQ ID NO: 1916318 - RNA, 12 nt, Shigella flexneri 2a str. 2457T
ucacuuccucaa

SEQ ID NO: 1916319 - RNA, 18 nt, Shigella flexneri 2a str. 2457T
ucacuucgauccagugau

SEQ ID NO: 1916320 - RNA, 22 nt, Shigella flexneri 2a str. 2457T
ucacuucgauccagugauucca

SEQ ID NO: 1916321 - RNA, 13 nt, Shigella flexneri 2a str. 2457T
ucacuuuuuuccg

SEQ ID NO: 1916322 - RNA, 15 nt, Shigella flexneri 2a str. 2457T
ucacuuucuggcagc

SEQ ID NO: 1916323 - RNA, 20 nt, Shigella flexneri 2a str. 2457T
ucagaaauuuggcuccucug

SEQ ID NO: 1916324 - RNA, 23 nt, Shigella flexneri 2a str. 2457T
ucagaaauuuggcuccucugacu

SEQ ID NO: 1916325 - RNA, 16 nt, Shigella flexneri 2a str. 2457T
ucagaaagugccacgc

SEQ ID NO: 1916326 - RNA, 18 nt, Shigella flexneri 2a str. 2457T
ucagaaagcgccagcaag

SEQ ID NO: 1916327 - RNA, 21 nt, Shigella flexneri 2a str. 2457T
ucagaaaguaauuacacccuu

SEQ ID NO: 1916328 - RNA, 21 nt, Shigella flexneri 2a str. 2457T
ucagaaaguauauaaaaaaca

SEQ ID NO: 1916329 - RNA, 19 nt, Shigella flexneri 2a str. 2457T
ucagaaaaaucaauauuuu

SEQ ID NO: 1916330 - RNA, 20 nt, Shigella flexneri 2a str. 2457T
ucagaaagccgccgacaugu

SEQ ID NO: 1916331 - RNA, 16 nt, Shigella flexneri 2a str. 2457T
ucagaagacgcuccag

SEQ ID NO: 1916332 - RNA, 13 nt, Shigella flexneri 2a str. 2457T
ucagaaggcagac

SEQ ID NO: 1916333 - RNA, 11 nt, Shigella flexneri 2a str. 2457T
ucagaaucagg

SEQ ID NO: 1916334 - RNA, 15 nt, Shigella flexneri 2a str. 2457T
ucagaaguugcaccc

SEQ ID NO: 1916335 - RNA, 13 nt, Shigella flexneri 2a str. 2457T
ucagacaccaguc

SEQ ID NO: 1916336 - RNA, 23 nt, Shigella flexneri 2a str. 2457T
ucagaccgcuucugcguucugau

SEQ ID NO: 1916337 - RNA, 18 nt, Shigella flexneri 2a str. 2457T
ucagaccggcaaccagca

SEQ ID NO: 1916338 - RNA, 16 nt, Shigella flexneri 2a str. 2457T
ucagaaucgcgcccca

SEQ ID NO: 1916339 - RNA, 18 nt, Shigella flexneri 2a str. 2457T
ucagaaugcgcucuuccg

SEQ ID NO: 1916340 - RNA, 14 nt, Shigella flexneri 2a str. 2457T
ucagagaagcaccg

SEQ ID NO: 1916341 - RNA, 13 nt, Shigella flexneri 2a str. 2457T
ucagagagccagc

SEQ ID NO: 1916342 - RNA, 20 nt, Shigella flexneri 2a str. 2457T
ucagagugccgaagaacaua

SEQ ID NO: 1916343 - RNA, 12 nt, Shigella flexneri 2a str. 2457T
ucagauaaaaag

SEQ ID NO: 1916344 - RNA, 20 nt, Shigella flexneri 2a str. 2457T
ucagacacaauaauuuuauu

SEQ ID NO: 1916345 - RNA, 20 nt, Shigella flexneri 2a str. 2457T
ucagacguugcauuucgucu

SEQ ID NO: 1916346 - RNA, 19 nt, Shigella flexneri 2a str. 2457T
ucagacuauucagcucuuc

SEQ ID NO: 1916347 - RNA, 17 nt, Shigella flexneri 2a str. 2457T
ucagacuuugcgccauc

SEQ ID NO: 1916348 - RNA, 13 nt, Shigella flexneri 2a str. 2457T
ucagauugagcau

SEQ ID NO: 1916349 - RNA, 20 nt, Shigella flexneri 2a str. 2457T
ucagauuggcuucauugauu

SEQ ID NO: 1916350 - RNA, 15 nt, Shigella flexneri 2a str. 2457T
ucagaugugcggugg

SEQ ID NO: 1916351 - RNA, 22 nt, Shigella flexneri 2a str. 2457T
ucagauuauagugauccugcau

SEQ ID NO: 1916352 - RNA, 22 nt, Shigella flexneri 2a str. 2457T
ucagaugaacgagucaacgcuu

SEQ ID NO: 1916353 - RNA, 21 nt, Shigella flexneri 2a str. 2457T
ucagaucuaauguugguguga

SEQ ID NO: 1916354 - RNA, 16 nt, Shigella flexneri 2a str. 2457T
ucagauggcggcuggc

SEQ ID NO: 1916355 - RNA, 21 nt, Shigella flexneri 2a str. 2457T
ucagaugcggcuucgcuucau

SEQ ID NO: 1916356 - RNA, 14 nt, Shigella flexneri 2a str. 2457T
ucagaugccugaug

SEQ ID NO: 1916357 - RNA, 17 nt, Shigella flexneri 2a str. 2457T
ucagaugaugauacuga

SEQ ID NO: 1916358 - RNA, 18 nt, Shigella flexneri 2a str. 2457T
ucagaugaugauacugac

SEQ ID NO: 1916359 - RNA, 18 nt, Shigella flexneri 2a str. 2457T
ucagauaauagguaaaca

SEQ ID NO: 1916360 - RNA, 13 nt, Shigella flexneri 2a str. 2457T
ucagauaaaugca

SEQ ID NO: 1916361 - RNA, 16 nt, Shigella flexneri 2a str. 2457T
ucagauaaaaaguuuu

SEQ ID NO: 1916362 - RNA, 21 nt, Shigella flexneri 2a str. 2457T
ucagauaaugcccgaugaccu

SEQ ID NO: 1916363 - RNA, 20 nt, Shigella flexneri 2a str. 2457T
ucagaucccaauucauuccu

SEQ ID NO: 1916364 - RNA, 20 nt, Shigella flexneri 2a str. 2457T
ucagaucagccacuuccugc

SEQ ID NO: 1916365 - RNA, 17 nt, Shigella flexneri 2a str. 2457T
ucagaucagccacuucc

SEQ ID NO: 1916366 - RNA, 18 nt, Shigella flexneri 2a str. 2457T
aaaucggugggcugacau

SEQ ID NO: 1916367 - RNA, 19 nt, Shigella flexneri 2a str. 2457T
aaaucguauccggcauuau

SEQ ID NO: 1916368 - RNA, 16 nt, Shigella flexneri 2a str. 2457T
aaaucgucaaaauuag

SEQ ID NO: 1916369 - RNA, 14 nt, Shigella flexneri 2a str. 2457T
aaaucguaagcagg

SEQ ID NO: 1916370 - RNA, 20 nt, Shigella flexneri 2a str. 2457T
ucagcaacuggcaaaaacca

SEQ ID NO: 1916371 - RNA, 21 nt, Shigella flexneri 2a str. 2457T
ucagugaccgaaccuguuuuc

SEQ ID NO: 1916372 - RNA, 17 nt, Shigella flexneri 2a str. 2457T
ucagugcaaaugccaga

SEQ ID NO: 1916373 - RNA, 15 nt, Shigella flexneri 2a str. 2457T
ucagugcaaaugcca

SEQ ID NO: 1916374 - RNA, 17 nt, Shigella flexneri 2a str. 2457T
ucaguggcuauuuacca

SEQ ID NO: 1916375 - RNA, 15 nt, Shigella flexneri 2a str. 2457T
ucagugggcgcugcu

SEQ ID NO: 1916376 - RNA, 21 nt, Shigella flexneri 2a str. 2457T
ucaguggguuaugaaacucca

SEQ ID NO: 1916377 - RNA, 18 nt, Shigella flexneri 2a str. 2457T
ucaguggguuaugaaacu

SEQ ID NO: 1916378 - RNA, 10 nt, Shigella flexneri 2a str. 2457T
ucagugucuu

SEQ ID NO: 1916379 - RNA, 19 nt, Shigella flexneri 2a str. 2457T
ucaguagcgcaaucaccac

SEQ ID NO: 1916380 - RNA, 13 nt, Shigella flexneri 2a str. 2457T
ucaguauaacuac

SEQ ID NO: 1916381 - RNA, 17 nt, Shigella flexneri 2a str. 2457T
ucaguauaacuacugau

SEQ ID NO: 1916382 - RNA, 13 nt, Shigella flexneri 2a str. 2457T
ucaguauuuccac

SEQ ID NO: 1916383 - RNA, 15 nt, Shigella flexneri 2a str. 2457T
ucagucgugauuguc

SEQ ID NO: 1916384 - RNA, 15 nt, Shigella flexneri 2a str. 2457T
ucaguauuuccacaa

SEQ ID NO: 1916385 - RNA, 21 nt, Shigella flexneri 2a str. 2457T
ucagucucaagggaggaguca

SEQ ID NO: 1916386 - RNA, 12 nt, Shigella flexneri 2a str. 2457T
ucagugaaaccg

SEQ ID NO: 1916387 - RNA, 18 nt, Shigella flexneri 2a str. 2457T
ucagguagcgcauaagcc

SEQ ID NO: 1916388 - RNA, 20 nt, Shigella flexneri 2a str. 2457T
ucagguauucguuaaaacca

SEQ ID NO: 1916389 - RNA, 16 nt, Shigella flexneri 2a str. 2457T
ucagguauuuugucag

SEQ ID NO: 1916390 - RNA, 22 nt, Shigella flexneri 2a str. 2457T
ucaggucaaaagauugaauuau

SEQ ID NO: 1916391 - RNA, 16 nt, Shigella flexneri 2a str. 2457T
ucaggcucucauuuuu

SEQ ID NO: 1916392 - RNA, 15 nt, Shigella flexneri 2a str. 2457T
ucaggcgcugaaaga

SEQ ID NO: 1916393 - RNA, 16 nt, Shigella flexneri 2a str. 2457T
ucaggcggcucaccug

SEQ ID NO: 1916394 - RNA, 22 nt, Shigella flexneri 2a str. 2457T
ucaggcguuuguaacccaccau

SEQ ID NO: 1916395 - RNA, 16 nt, Shigella flexneri 2a str. 2457T
ucaggcuacuuuucca

SEQ ID NO: 1916396 - RNA, 14 nt, Shigella flexneri 2a str. 2457T
ucaggcguugaaaa

SEQ ID NO: 1916397 - RNA, 16 nt, Shigella flexneri 2a str. 2457T
ucaggcguugaaaaau

SEQ ID NO: 1916398 - RNA, 16 nt, Shigella flexneri 2a str. 2457T
ucagcucuuccuucag

SEQ ID NO: 1916399 - RNA, 18 nt, Shigella flexneri 2a str. 2457T
ucaggcacuucuucugca

SEQ ID NO: 1916400 - RNA, 18 nt, Shigella flexneri 2a str. 2457T
ucaggcagauacaaccaa

SEQ ID NO: 1916401 - RNA, 22 nt, Shigella flexneri 2a str. 2457T
ucaggcagauacaaccaaucgc

SEQ ID NO: 1916402 - RNA, 18 nt, Shigella flexneri 2a str. 2457T
ucaggauaaacuccugca

SEQ ID NO: 1916403 - RNA, 16 nt, Shigella flexneri 2a str. 2457T
ucaggcaucugagcau

SEQ ID NO: 1916404 - RNA, 18 nt, Shigella flexneri 2a str. 2457T
ucaggcauucuuuuucau

SEQ ID NO: 1916405 - RNA, 11 nt, Shigella flexneri 2a str. 2457T
ucaggccagga

SEQ ID NO: 1916406 - RNA, 12 nt, Shigella flexneri 2a str. 2457T
aaaucuccagau

SEQ ID NO: 1916407 - RNA, 13 nt, Shigella flexneri 2a str. 2457T
aaaucuccauuuc

SEQ ID NO: 1916408 - RNA, 14 nt, Shigella flexneri 2a str. 2457T
aaaucuccauuuca

SEQ ID NO: 1916409 - RNA, 15 nt, Shigella flexneri 2a str. 2457T
aaaucuauugcaaca

SEQ ID NO: 1916410 - RNA, 23 nt, Shigella flexneri 2a str. 2457T
ucaggcgagucgagaucccuucc

SEQ ID NO: 1916411 - RNA, 18 nt, Shigella flexneri 2a str. 2457T
ucaggccuacaaaaucua

SEQ ID NO: 1916412 - RNA, 18 nt, Shigella flexneri 2a str. 2457T
ucaggccgaggcacagca

SEQ ID NO: 1916413 - RNA, 17 nt, Shigella flexneri 2a str. 2457T
ucagcauaaucaccagu

SEQ ID NO: 1916414 - RNA, 16 nt, Shigella flexneri 2a str. 2457T
ucagcaguucacgcag

SEQ ID NO: 1916415 - RNA, 20 nt, Shigella flexneri 2a str. 2457T
ucagcaguucagucagcagu

SEQ ID NO: 1916416 - RNA, 17 nt, Shigella flexneri 2a str. 2457T
ucagcaucaaugaccug

SEQ ID NO: 1916417 - RNA, 12 nt, Shigella flexneri 2a str. 2457T
ucagcaugacaa

SEQ ID NO: 1916418 - RNA, 13 nt, Shigella flexneri 2a str. 2457T
ucagcaucuggaa

SEQ ID NO: 1916419 - RNA, 19 nt, Shigella flexneri 2a str. 2457T
ucagcauauaggaggccuc

SEQ ID NO: 1916420 - RNA, 18 nt, Shigella flexneri 2a str. 2457T
ucagcauauaggaggccu

SEQ ID NO: 1916421 - RNA, 23 nt, Shigella flexneri 2a str. 2457T
ucagcaugcauuuaagaaaaaag

SEQ ID NO: 1916422 - RNA, 16 nt, Shigella flexneri 2a str. 2457T
ucagcaugacaaaaaa

SEQ ID NO: 1916423 - RNA, 17 nt, Shigella flexneri 2a str. 2457T
ucagcaugacaaaaaag

SEQ ID NO: 1916424 - RNA, 19 nt, Shigella flexneri 2a str. 2457T
ucagcacgucuuccauugc

SEQ ID NO: 1916425 - RNA, 22 nt, Shigella flexneri 2a str. 2457T
ucagcacuuaucucuuccgcau

SEQ ID NO: 1916426 - RNA, 21 nt, Shigella flexneri 2a str. 2457T
ucagcagacggccaaaaucuc

SEQ ID NO: 1916427 - RNA, 19 nt, Shigella flexneri 2a str. 2457T
ucagcacgacauaagcgca

SEQ ID NO: 1916428 - RNA, 15 nt, Shigella flexneri 2a str. 2457T
ucagcaauuucuccg

SEQ ID NO: 1916429 - RNA, 19 nt, Shigella flexneri 2a str. 2457T
ucagcaauucucucuucag

SEQ ID NO: 1916430 - RNA, 14 nt, Shigella flexneri 2a str. 2457T
ucagcaauacgcuu

SEQ ID NO: 1916431 - RNA, 19 nt, Shigella flexneri 2a str. 2457T
ucagcaaucugaagccgca

SEQ ID NO: 1916432 - RNA, 13 nt, Shigella flexneri 2a str. 2457T
ucagcaaucugau

SEQ ID NO: 1916433 - RNA, 17 nt, Shigella flexneri 2a str. 2457T
ucagcaagugaauaaau

SEQ ID NO: 1916434 - RNA, 22 nt, Shigella flexneri 2a str. 2457T
ucagcaagugaauaaauuuuau

SEQ ID NO: 1916435 - RNA, 20 nt, Shigella flexneri 2a str. 2457T
ucagcggcguaucuuccagg

SEQ ID NO: 1916436 - RNA, 17 nt, Shigella flexneri 2a str. 2457T
ucagcgggcagggcauc

SEQ ID NO: 1916437 - RNA, 12 nt, Shigella flexneri 2a str. 2457T
ucagcggugcgg

SEQ ID NO: 1916438 - RNA, 16 nt, Shigella flexneri 2a str. 2457T
ucagcguaucaauuaa

SEQ ID NO: 1916439 - RNA, 21 nt, Shigella flexneri 2a str. 2457T
ucagcuccucuuucauuucac

SEQ ID NO: 1916440 - RNA, 13 nt, Shigella flexneri 2a str. 2457T
ucagcgccaaccc

SEQ ID NO: 1916441 - RNA, 15 nt, Shigella flexneri 2a str. 2457T
ucagcgccagcgcga

SEQ ID NO: 1916442 - RNA, 18 nt, Shigella flexneri 2a str. 2457T
ucagcgccagcgcggaag

SEQ ID NO: 1916443 - RNA, 17 nt, Shigella flexneri 2a str. 2457T
ucagcgcaaagagugaa

SEQ ID NO: 1916444 - RNA, 20 nt, Shigella flexneri 2a str. 2457T
ucagcgcaacuugcagaucc

SEQ ID NO: 1916445 - RNA, 13 nt, Shigella flexneri 2a str. 2457T
ucagcgcaugauu

SEQ ID NO: 1916446 - RNA, 16 nt, Shigella flexneri 2a str. 2457T
ucagcccuucuuuaug

SEQ ID NO: 1916447 - RNA, 14 nt, Shigella flexneri 2a str. 2457T
ucagccccuccaca

SEQ ID NO: 1916448 - RNA, 14 nt, Shigella flexneri 2a str. 2457T
ucagcccgaugaua

SEQ ID NO: 1916449 - RNA, 15 nt, Shigella flexneri 2a str. 2457T
guggcguuuccagca

SEQ ID NO: 1916450 - RNA, 18 nt, Shigella flexneri 2a str. 2457T
guggcgguaacauccaga

SEQ ID NO: 1916451 - RNA, 18 nt, Shigella flexneri 2a str. 2457T
guggcgggaucaccugca

SEQ ID NO: 1916452 - RNA, 19 nt, Shigella flexneri 2a str. 2457T
guggcgaugggacgcgcga

SEQ ID NO: 1916453 - RNA, 19 nt, Shigella flexneri 2a str. 2457T
guggcgauaaucagcgcca

SEQ ID NO: 1916454 - RNA, 21 nt, Shigella flexneri 2a str. 2457T
guggcgauaaucagcgccagc

SEQ ID NO: 1916455 - RNA, 17 nt, Shigella flexneri 2a str. 2457T
guggcgcagccgucauu

SEQ ID NO: 1916456 - RNA, 13 nt, Shigella flexneri 2a str. 2457T
guggcgcagccgu

SEQ ID NO: 1916457 - RNA, 16 nt, Shigella flexneri 2a str. 2457T
gugggauuccagcgcc

SEQ ID NO: 1916458 - RNA, 23 nt, Shigella flexneri 2a str. 2457T
gugggaucacaucuucaauccac

SEQ ID NO: 1916459 - RNA, 23 nt, Shigella flexneri 2a str. 2457T
gugggauucaccaaucggcagaa

SEQ ID NO: 1916460 - RNA, 16 nt, Shigella flexneri 2a str. 2457T
gugggcaggaaaauca

SEQ ID NO: 1916461 - RNA, 20 nt, Shigella flexneri 2a str. 2457T
guggcguuugccaccugugc

SEQ ID NO: 1916462 - RNA, 20 nt, Shigella flexneri 2a str. 2457T
guggcauugguugcuggaaa

SEQ ID NO: 1916463 - RNA, 15 nt, Shigella flexneri 2a str. 2457T
guggcagucuggccu

SEQ ID NO: 1916464 - RNA, 15 nt, Shigella flexneri 2a str. 2457T
guggcagggcagcga

SEQ ID NO: 1916465 - RNA, 13 nt, Shigella flexneri 2a str. 2457T
guggcagggcagc

SEQ ID NO: 1916466 - RNA, 16 nt, Shigella flexneri 2a str. 2457T
guggauagacgcaggu

SEQ ID NO: 1916467 - RNA, 19 nt, Shigella flexneri 2a str. 2457T
guggaucacaucgccggug

SEQ ID NO: 1916468 - RNA, 16 nt, Shigella flexneri 2a str. 2457T
guggaucgauuucaau

SEQ ID NO: 1916469 - RNA, 15 nt, Shigella flexneri 2a str. 2457T
guggauuaucuucac

SEQ ID NO: 1916470 - RNA, 20 nt, Shigella flexneri 2a str. 2457T
guggcaaucauauucaccac

SEQ ID NO: 1916471 - RNA, 19 nt, Shigella flexneri 2a str. 2457T
guggcaaucguagcccagc

SEQ ID NO: 1916472 - RNA, 21 nt, Shigella flexneri 2a str. 2457T
guggcaauggcgacuucugcu

SEQ ID NO: 1916473 - RNA, 23 nt, Shigella flexneri 2a str. 2457T
guggaauaugcgccacaccacug

SEQ ID NO: 1916474 - RNA, 15 nt, Shigella flexneri 2a str. 2457T
guggaacggugaaaa

SEQ ID NO: 1916475 - RNA, 21 nt, Shigella flexneri 2a str. 2457T
gugcugggaaaccuggauauu

SEQ ID NO: 1916476 - RNA, 14 nt, Shigella flexneri 2a str. 2457T
gugcuguacagcag

SEQ ID NO: 1916477 - RNA, 16 nt, Shigella flexneri 2a str. 2457T
guggaaaagaaaacag

SEQ ID NO: 1916478 - RNA, 14 nt, Shigella flexneri 2a str. 2457T
guguggccaguucc

SEQ ID NO: 1916479 - RNA, 17 nt, Shigella flexneri 2a str. 2457T
guguguauggcauuguc

SEQ ID NO: 1916480 - RNA, 12 nt, Shigella flexneri 2a str. 2457T
guguguccaucc

SEQ ID NO: 1916481 - RNA, 11 nt, Shigella flexneri 2a str. 2457T
gugugugcuga

SEQ ID NO: 1916482 - RNA, 17 nt, Shigella flexneri 2a str. 2457T
guguguuccucugcucc

SEQ ID NO: 1916483 - RNA, 21 nt, Shigella flexneri 2a str. 2457T
aaauauccguagugaaaaagc

SEQ ID NO: 1916484 - RNA, 20 nt, Shigella flexneri 2a str. 2457T
aaauaucaucaaaauuaaca

SEQ ID NO: 1916485 - RNA, 23 nt, Shigella flexneri 2a str. 2457T
aaauaucacucggggcuuuucuc

SEQ ID NO: 1916486 - RNA, 12 nt, Shigella flexneri 2a str. 2457T
aaauauauccua

SEQ ID NO: 1916487 - RNA, 23 nt, Shigella flexneri 2a str. 2457T
gugugcucaaucugauagugauc

SEQ ID NO: 1916488 - RNA, 19 nt, Shigella flexneri 2a str. 2457T
gugguugucgcaggcggug

SEQ ID NO: 1916489 - RNA, 17 nt, Shigella flexneri 2a str. 2457T
guguacagcggcaggga

SEQ ID NO: 1916490 - RNA, 18 nt, Shigella flexneri 2a str. 2457T
guguacuuaucuuuuaca

SEQ ID NO: 1916491 - RNA, 16 nt, Shigella flexneri 2a str. 2457T
guggguaaugcuguga

SEQ ID NO: 1916492 - RNA, 19 nt, Shigella flexneri 2a str. 2457T
guggggucucugcaaaaaa

SEQ ID NO: 1916493 - RNA, 16 nt, Shigella flexneri 2a str. 2457T
guggggaaugauauuu

SEQ ID NO: 1916494 - RNA, 20 nt, Shigella flexneri 2a str. 2457T
gugucuaacgaugccagcac

SEQ ID NO: 1916495 - RNA, 17 nt, Shigella flexneri 2a str. 2457T
gugucguuacgccgcag

SEQ ID NO: 1916496 - RNA, 15 nt, Shigella flexneri 2a str. 2457T
gugugaaaucagcac

SEQ ID NO: 1916497 - RNA, 22 nt, Shigella flexneri 2a str. 2457T
gugucuuaucuggcauuugcac

SEQ ID NO: 1916498 - RNA, 19 nt, Shigella flexneri 2a str. 2457T
guguagcucgccuucaggu

SEQ ID NO: 1916499 - RNA, 16 nt, Shigella flexneri 2a str. 2457T
guguccagccagucca

SEQ ID NO: 1916500 - RNA, 19 nt, Shigella flexneri 2a str. 2457T
guguccagcggcauaaaac

SEQ ID NO: 1916501 - RNA, 13 nt, Shigella flexneri 2a str. 2457T
guguccacuuccg

SEQ ID NO: 1916502 - RNA, 14 nt, Shigella flexneri 2a str. 2457T
guucaucucaaaca

SEQ ID NO: 1916503 - RNA, 23 nt, Shigella flexneri 2a str. 2457T
guucauccucuucugccugcugg

SEQ ID NO: 1916504 - RNA, 18 nt, Shigella flexneri 2a str. 2457T
guucauccccucuuccau

SEQ ID NO: 1916505 - RNA, 20 nt, Shigella flexneri 2a str. 2457T
guuccacauaaaguagccaa

SEQ ID NO: 1916506 - RNA, 21 nt, Shigella flexneri 2a str. 2457T
guuccacggaauauuucaccg

SEQ ID NO: 1916507 - RNA, 19 nt, Shigella flexneri 2a str. 2457T
guuccaccacguuuuucaa

SEQ ID NO: 1916508 - RNA, 19 nt, Shigella flexneri 2a str. 2457T
guuccacuucugcggguga

SEQ ID NO: 1916509 - RNA, 17 nt, Shigella flexneri 2a str. 2457T
guuccagugcguaccca

SEQ ID NO: 1916510 - RNA, 21 nt, Shigella flexneri 2a str. 2457T
guuccagugcguacccagcgu

SEQ ID NO: 1916511 - RNA, 19 nt, Shigella flexneri 2a str. 2457T
guucacgccgcaucuggca

SEQ ID NO: 1916512 - RNA, 18 nt, Shigella flexneri 2a str. 2457T
guucacgccaucaucggc

SEQ ID NO: 1916513 - RNA, 15 nt, Shigella flexneri 2a str. 2457T
guucacgcagcucac

SEQ ID NO: 1916514 - RNA, 15 nt, Shigella flexneri 2a str. 2457T
guucagcaucuggaa

SEQ ID NO: 1916515 - RNA, 22 nt, Shigella flexneri 2a str. 2457T
guucagcaguucugccaggcug

SEQ ID NO: 1916516 - RNA, 16 nt, Shigella flexneri 2a str. 2457T
guuauuuccaggagau

SEQ ID NO: 1916517 - RNA, 22 nt, Shigella flexneri 2a str. 2457T
guuauugucgggcguuucgcca

SEQ ID NO: 1916518 - RNA, 22 nt, Shigella flexneri 2a str. 2457T
guuauugguauggucgugauca

SEQ ID NO: 1916519 - RNA, 22 nt, Shigella flexneri 2a str. 2457T
guucgcaccaucaaaguuuuua

SEQ ID NO: 1916520 - RNA, 22 nt, Shigella flexneri 2a str. 2457T
guucgcccacgcgcauucccag

SEQ ID NO: 1916521 - RNA, 23 nt, Shigella flexneri 2a str. 2457T
guucgcauacggguuuuccccuu

SEQ ID NO: 1916522 - RNA, 20 nt, Shigella flexneri 2a str. 2457T
guucggggcuguuuuccagc

SEQ ID NO: 1916523 - RNA, 15 nt, Shigella flexneri 2a str. 2457T
guucggcgguuuuuu

SEQ ID NO: 1916524 - RNA, 12 nt, Shigella flexneri 2a str. 2457T
guuccuggggaa

SEQ ID NO: 1916525 - RNA, 17 nt, Shigella flexneri 2a str. 2457T
guuccuggggaaaaugg

SEQ ID NO: 1916526 - RNA, 20 nt, Shigella flexneri 2a str. 2457T
guuccuuaacuucaucagca

SEQ ID NO: 1916527 - RNA, 23 nt, Shigella flexneri 2a str. 2457T
guuccggagaagcguagguguua

SEQ ID NO: 1916528 - RNA, 22 nt, Shigella flexneri 2a str. 2457T
guuccgccauuuuaaucaucug

SEQ ID NO: 1916529 - RNA, 16 nt, Shigella flexneri 2a str. 2457T
guuccauaugaauucc

SEQ ID NO: 1916530 - RNA, 14 nt, Shigella flexneri 2a str. 2457T
guuccauaaucgcc

SEQ ID NO: 1916531 - RNA, 13 nt, Shigella flexneri 2a str. 2457T
guuccaucaccag

SEQ ID NO: 1916532 - RNA, 21 nt, Shigella flexneri 2a str. 2457T
guuccaucuuuaugaaauauc

SEQ ID NO: 1916533 - RNA, 14 nt, Shigella flexneri 2a str. 2457T
guucccaacaacag

SEQ ID NO: 1916534 - RNA, 14 nt, Shigella flexneri 2a str. 2457T
guuccauggcagga

SEQ ID NO: 1916535 - RNA, 17 nt, Shigella flexneri 2a str. 2457T
guuacugucgcgcagca

SEQ ID NO: 1916536 - RNA, 16 nt, Shigella flexneri 2a str. 2457T
guuacugccaucuucc

SEQ ID NO: 1916537 - RNA, 17 nt, Shigella flexneri 2a str. 2457T
guuagaaacaaaaaaac

SEQ ID NO: 1916538 - RNA, 19 nt, Shigella flexneri 2a str. 2457T
guuagcugcguacauugcc

SEQ ID NO: 1916539 - RNA, 21 nt, Shigella flexneri 2a str. 2457T
guuagaauaccugccugucac

SEQ ID NO: 1916540 - RNA, 15 nt, Shigella flexneri 2a str. 2457T
guuaccgcuauuugc

SEQ ID NO: 1916541 - RNA, 15 nt, Shigella flexneri 2a str. 2457T
guuaccgaucgccag

SEQ ID NO: 1916542 - RNA, 16 nt, Shigella flexneri 2a str. 2457T
guuaccgaucgccagc

SEQ ID NO: 1916543 - RNA, 13 nt, Shigella flexneri 2a str. 2457T
guuacccagcacg

SEQ ID NO: 1916544 - RNA, 18 nt, Shigella flexneri 2a str. 2457T
guuaccgacugcggccug

SEQ ID NO: 1916545 - RNA, 18 nt, Shigella flexneri 2a str. 2457T
guuaccuucggccccauc

SEQ ID NO: 1916546 - RNA, 15 nt, Shigella flexneri 2a str. 2457T
guuagugucuuaucu

SEQ ID NO: 1916547 - RNA, 13 nt, Shigella flexneri 2a str. 2457T
guuagucaucauc

SEQ ID NO: 1916548 - RNA, 20 nt, Shigella flexneri 2a str. 2457T
guuauaucccauuuuugaau

SEQ ID NO: 1916549 - RNA, 17 nt, Shigella flexneri 2a str. 2457T
guuauagcuggauuuuc

SEQ ID NO: 1916550 - RNA, 22 nt, Shigella flexneri 2a str. 2457T
guuaugcaccgacaauccggua

SEQ ID NO: 1916551 - RNA, 13 nt, Shigella flexneri 2a str. 2457T
guuaugcucggca

SEQ ID NO: 1916552 - RNA, 13 nt, Shigella flexneri 2a str. 2457T
guuaugaaacucc

SEQ ID NO: 1916553 - RNA, 16 nt, Shigella flexneri 2a str. 2457T
guuaucagcaacuggc

SEQ ID NO: 1916554 - RNA, 18 nt, Shigella flexneri 2a str. 2457T
guuaucaagugcuuucau

SEQ ID NO: 1916555 - RNA, 16 nt, Shigella flexneri 2a str. 2457T
guuaaaaacagccagc

SEQ ID NO: 1916556 - RNA, 17 nt, Shigella flexneri 2a str. 2457T
guuaaaaacagccagca

SEQ ID NO: 1916557 - RNA, 22 nt, Shigella flexneri 2a str. 2457T
guguugccgccaccuuucuguu

SEQ ID NO: 1916558 - RNA, 19 nt, Shigella flexneri 2a str. 2457T
guguugcguaaugguggug

SEQ ID NO: 1916559 - RNA, 20 nt, Shigella flexneri 2a str. 2457T
guuaaaacuaaaaacagcau

SEQ ID NO: 1916560 - RNA, 17 nt, Shigella flexneri 2a str. 2457T
guuaaaacgcacgcugu

SEQ ID NO: 1916561 - RNA, 12 nt, Shigella flexneri 2a str. 2457T
guuaaccagcac

SEQ ID NO: 1916562 - RNA, 21 nt, Shigella flexneri 2a str. 2457T
guuaacugaauauuccaguua

SEQ ID NO: 1916563 - RNA, 19 nt, Shigella flexneri 2a str. 2457T
guuaacugaauauuccagu

SEQ ID NO: 1916564 - RNA, 18 nt, Shigella flexneri 2a str. 2457T
guuaacgugucauaacug

SEQ ID NO: 1916565 - RNA, 23 nt, Shigella flexneri 2a str. 2457T
guuaaccggaggauaugcaucau

SEQ ID NO: 1916566 - RNA, 11 nt, Shigella flexneri 2a str. 2457T
guuaaugguug

SEQ ID NO: 1916567 - RNA, 20 nt, Shigella flexneri 2a str. 2457T
guuaaucuuuucugagucaa

SEQ ID NO: 1916568 - RNA, 12 nt, Shigella flexneri 2a str. 2457T
guuaagcauucg

SEQ ID NO: 1916569 - RNA, 11 nt, Shigella flexneri 2a str. 2457T
guugaggaagc

SEQ ID NO: 1916570 - RNA, 17 nt, Shigella flexneri 2a str. 2457T
guugagggcgcaauuuc

SEQ ID NO: 1916571 - RNA, 14 nt, Shigella flexneri 2a str. 2457T
guugaggcacaucu

SEQ ID NO: 1916572 - RNA, 21 nt, Shigella flexneri 2a str. 2457T
guucucccauaggaugagguu

SEQ ID NO: 1916573 - RNA, 20 nt, Shigella flexneri 2a str. 2457T
guucucccauaggaugaggu

SEQ ID NO: 1916574 - RNA, 22 nt, Shigella flexneri 2a str. 2457T
guucuacgugcgcuauguguua

SEQ ID NO: 1916575 - RNA, 14 nt, Shigella flexneri 2a str. 2457T
guucuacauaaaac

SEQ ID NO: 1916576 - RNA, 14 nt, Shigella flexneri 2a str. 2457T
guucucaauuacug

SEQ ID NO: 1916577 - RNA, 13 nt, Shigella flexneri 2a str. 2457T
guucucaugguuc

SEQ ID NO: 1916578 - RNA, 21 nt, Shigella flexneri 2a str. 2457T
guugauacaggaacagccacu

SEQ ID NO: 1916579 - RNA, 21 nt, Shigella flexneri 2a str. 2457T
guugccuuuuuuguacuccag

SEQ ID NO: 1916580 - RNA, 13 nt, Shigella flexneri 2a str. 2457T
guugcgaaaaaau

SEQ ID NO: 1916581 - RNA, 23 nt, Shigella flexneri 2a str. 2457T
guugcgaaaaaaucauccauccg

SEQ ID NO: 1916582 - RNA, 12 nt, Shigella flexneri 2a str. 2457T
guugccugcugu

SEQ ID NO: 1916583 - RNA, 16 nt, Shigella flexneri 2a str. 2457T
guugccgcuuuuucca

SEQ ID NO: 1916584 - RNA, 16 nt, Shigella flexneri 2a str. 2457T
guugcaguucugccau

SEQ ID NO: 1916585 - RNA, 19 nt, Shigella flexneri 2a str. 2457T
guuggcggugccaucgaua

SEQ ID NO: 1916586 - RNA, 17 nt, Shigella flexneri 2a str. 2457T
guuggcguguuucagcu

SEQ ID NO: 1916587 - RNA, 22 nt, Shigella flexneri 2a str. 2457T
guuggcgcauaacucaccauca

SEQ ID NO: 1916588 - RNA, 14 nt, Shigella flexneri 2a str. 2457T
guuggcgaaaaucu

SEQ ID NO: 1916589 - RNA, 22 nt, Shigella flexneri 2a str. 2457T
guugguucagugggcgcugcug

SEQ ID NO: 1916590 - RNA, 14 nt, Shigella flexneri 2a str. 2457T
guuggugcgaucug

SEQ ID NO: 1916591 - RNA, 15 nt, Shigella flexneri 2a str. 2457T
guugcgguuucaacu

SEQ ID NO: 1916592 - RNA, 20 nt, Shigella flexneri 2a str. 2457T
guugcgcuucccgaaucaug

SEQ ID NO: 1916593 - RNA, 14 nt, Shigella flexneri 2a str. 2457T
guugcgcccaucau

SEQ ID NO: 1916594 - RNA, 16 nt, Shigella flexneri 2a str. 2457T
guugcgcaugaccuuu

SEQ ID NO: 1916595 - RNA, 23 nt, Shigella flexneri 2a str. 2457T
guugcugccgacaaaugcaguuu

SEQ ID NO: 1916596 - RNA, 13 nt, Shigella flexneri 2a str. 2457T
guugcugacugua

SEQ ID NO: 1916597 - RNA, 17 nt, Shigella flexneri 2a str. 2457T
guugcuauggggaaaaa

SEQ ID NO: 1916598 - RNA, 23 nt, Shigella flexneri 2a str. 2457T
guuuacuucgcuuuacccugguu

SEQ ID NO: 1916599 - RNA, 14 nt, Shigella flexneri 2a str. 2457T
guuuacgccaggca

SEQ ID NO: 1916600 - RNA, 14 nt, Shigella flexneri 2a str. 2457T
guuuaagacgccgc

SEQ ID NO: 1916601 - RNA, 17 nt, Shigella flexneri 2a str. 2457T
guugucauuacaacaag

SEQ ID NO: 1916602 - RNA, 23 nt, Shigella flexneri 2a str. 2457T
guuguccuuaccacagacaaaau

SEQ ID NO: 1916603 - RNA, 15 nt, Shigella flexneri 2a str. 2457T
guugucagcaacugu

SEQ ID NO: 1916604 - RNA, 18 nt, Shigella flexneri 2a str. 2457T
guugucaguucuuuuauu

SEQ ID NO: 1916605 - RNA, 18 nt, Shigella flexneri 2a str. 2457T
guuuaucuacagcauuuc

SEQ ID NO: 1916606 - RNA, 21 nt, Shigella flexneri 2a str. 2457T
guuuauccauccccagagcac

SEQ ID NO: 1916607 - RNA, 18 nt, Shigella flexneri 2a str. 2457T
guuuaucccaauuaucug

SEQ ID NO: 1916608 - RNA, 19 nt, Shigella flexneri 2a str. 2457T
guuuacugucugcuucugc

SEQ ID NO: 1916609 - RNA, 21 nt, Shigella flexneri 2a str. 2457T
guuucaacgacccagccagac

SEQ ID NO: 1916610 - RNA, 15 nt, Shigella flexneri 2a str. 2457T
guuucaacacaggau

SEQ ID NO: 1916611 - RNA, 20 nt, Shigella flexneri 2a str. 2457T
guuucaacaucaucucccac

SEQ ID NO: 1916612 - RNA, 17 nt, Shigella flexneri 2a str. 2457T
aaauaucuucaauagca

SEQ ID NO: 1916613 - RNA, 11 nt, Shigella flexneri 2a str. 2457T
aaauaucugua

SEQ ID NO: 1916614 - RNA, 14 nt, Shigella flexneri 2a str. 2457T
guuucaguaauccu

SEQ ID NO: 1916615 - RNA, 17 nt, Shigella flexneri 2a str. 2457T
aaauaucgcccauauga

SEQ ID NO: 1916616 - RNA, 18 nt, Shigella flexneri 2a str. 2457T
aaauaucgcccauaugaa

SEQ ID NO: 1916617 - RNA, 15 nt, Shigella flexneri 2a str. 2457T
guuucagcagcggca

SEQ ID NO: 1916618 - RNA, 17 nt, Shigella flexneri 2a str. 2457T
guuucagccucugccgc

SEQ ID NO: 1916619 - RNA, 16 nt, Shigella flexneri 2a str. 2457T
guuucacuuucugcaa

SEQ ID NO: 1916620 - RNA, 18 nt, Shigella flexneri 2a str. 2457T
guuucagaccaauaaucc

SEQ ID NO: 1916621 - RNA, 13 nt, Shigella flexneri 2a str. 2457T
guuucaucuucag

SEQ ID NO: 1916622 - RNA, 17 nt, Shigella flexneri 2a str. 2457T
aaauauuauuggcaucg

SEQ ID NO: 1916623 - RNA, 13 nt, Shigella flexneri 2a str. 2457T
aaauauuaauaau

SEQ ID NO: 1916624 - RNA, 14 nt, Shigella flexneri 2a str. 2457T
aaauauuaauaaua

SEQ ID NO: 1916625 - RNA, 22 nt, Shigella flexneri 2a str. 2457T
aaauauggugaaaguaaaaaag

SEQ ID NO: 1916626 - RNA, 16 nt, Shigella flexneri 2a str. 2457T
aaauauggcgcaccga

SEQ ID NO: 1916627 - RNA, 17 nt, Shigella flexneri 2a str. 2457T
aaauauggugaaaguaa

SEQ ID NO: 1916628 - RNA, 20 nt, Shigella flexneri 2a str. 2457T
aaauauggugaaaguaaaaa

SEQ ID NO: 1916629 - RNA, 13 nt, Shigella flexneri 2a str. 2457T
guuuuaguaacaa

SEQ ID NO: 1916630 - RNA, 17 nt, Shigella flexneri 2a str. 2457T
guuuuaguguuuguauu

SEQ ID NO: 1916631 - RNA, 20 nt, Shigella flexneri 2a str. 2457T
guuuuauagcgggaaauacu

SEQ ID NO: 1916632 - RNA, 22 nt, Shigella flexneri 2a str. 2457T
guuuuauaaucgcaucaaucuu

SEQ ID NO: 1916633 - RNA, 17 nt, Shigella flexneri 2a str. 2457T
aaaucauauaauuguuc

SEQ ID NO: 1916634 - RNA, 20 nt, Shigella flexneri 2a str. 2457T
aaauccaaccucuucuuuua

SEQ ID NO: 1916635 - RNA, 20 nt, Shigella flexneri 2a str. 2457T
guuuucagcuucgguuucac

SEQ ID NO: 1916636 - RNA, 16 nt, Shigella flexneri 2a str. 2457T
guuuucagcaccagau

SEQ ID NO: 1916637 - RNA, 17 nt, Shigella flexneri 2a str. 2457T
guuuucagaagcaugaa

SEQ ID NO: 1916638 - RNA, 13 nt, Shigella flexneri 2a str. 2457T
guuuucuuugcca

SEQ ID NO: 1916639 - RNA, 14 nt, Shigella flexneri 2a str. 2457T
guuuucaccggcac

SEQ ID NO: 1916640 - RNA, 15 nt, Shigella flexneri 2a str. 2457T
guuuucaacggcggc

SEQ ID NO: 1916641 - RNA, 13 nt, Shigella flexneri 2a str. 2457T
guuuugaugaauc

SEQ ID NO: 1916642 - RNA, 17 nt, Shigella flexneri 2a str. 2457T
guuuugcaucaacugcg

SEQ ID NO: 1916643 - RNA, 18 nt, Shigella flexneri 2a str. 2457T
guuuugcauggcaacuaa

SEQ ID NO: 1916644 - RNA, 17 nt, Shigella flexneri 2a str. 2457T
guuuugccagucagcuc

SEQ ID NO: 1916645 - RNA, 18 nt, Shigella flexneri 2a str. 2457T
guuucucuguucagccug

SEQ ID NO: 1916646 - RNA, 20 nt, Shigella flexneri 2a str. 2457T
guuucucuuaaaugcacaau

SEQ ID NO: 1916647 - RNA, 18 nt, Shigella flexneri 2a str. 2457T
guuucugcauuauccagc

SEQ ID NO: 1916648 - RNA, 13 nt, Shigella flexneri 2a str. 2457T
guuucugcagcuc

SEQ ID NO: 1916649 - RNA, 16 nt, Shigella flexneri 2a str. 2457T
guuucugcagcuccag

SEQ ID NO: 1916650 - RNA, 16 nt, Shigella flexneri 2a str. 2457T
guuucuggucauugcc

SEQ ID NO: 1916651 - RNA, 18 nt, Shigella flexneri 2a str. 2457T
guuucuggcuuaaacgca

SEQ ID NO: 1916652 - RNA, 18 nt, Shigella flexneri 2a str. 2457T
guuugaucacuuccagca

SEQ ID NO: 1916653 - RNA, 21 nt, Shigella flexneri 2a str. 2457T
guuugacuuauaagucucaga

SEQ ID NO: 1916654 - RNA, 19 nt, Shigella flexneri 2a str. 2457T
guuugacauaaauuccgcu

SEQ ID NO: 1916655 - RNA, 18 nt, Shigella flexneri 2a str. 2457T
guuuuacuuuuuaacuuu

SEQ ID NO: 1916656 - RNA, 16 nt, Shigella flexneri 2a str. 2457T
guuuuaccuucauccc

SEQ ID NO: 1916657 - RNA, 17 nt, Shigella flexneri 2a str. 2457T
guuugugggaauaacca

SEQ ID NO: 1916658 - RNA, 16 nt, Shigella flexneri 2a str. 2457T
guuuguucaagcgcaa

SEQ ID NO: 1916659 - RNA, 17 nt, Shigella flexneri 2a str. 2457T
guuuguuacgauagaau

SEQ ID NO: 1916660 - RNA, 13 nt, Shigella flexneri 2a str. 2457T
guuuguuauccac

SEQ ID NO: 1916661 - RNA, 12 nt, Shigella flexneri 2a str. 2457T
guuuguucagcu

SEQ ID NO: 1916662 - RNA, 13 nt, Shigella flexneri 2a str. 2457T
guuugcugccuuc

SEQ ID NO: 1916663 - RNA, 13 nt, Shigella flexneri 2a str. 2457T
guuugucauaaau

SEQ ID NO: 1916664 - RNA, 15 nt, Shigella flexneri 2a str. 2457T
guuugcgucauggua

SEQ ID NO: 1916665 - RNA, 22 nt, Shigella flexneri 2a str. 2457T
guuugccuuucggcgcagucac

SEQ ID NO: 1916666 - RNA, 15 nt, Shigella flexneri 2a str. 2457T
guuugcgcccaguua

SEQ ID NO: 1916667 - RNA, 19 nt, Shigella flexneri 2a str. 2457T
guuugccguugaucucucc

SEQ ID NO: 1916668 - RNA, 18 nt, Shigella flexneri 2a str. 2457T
guuucgugcaucauggaa

SEQ ID NO: 1916669 - RNA, 16 nt, Shigella flexneri 2a str. 2457T
guuucgcuucuucagc

SEQ ID NO: 1916670 - RNA, 18 nt, Shigella flexneri 2a str. 2457T
guuucggucauuuugacc

SEQ ID NO: 1916671 - RNA, 19 nt, Shigella flexneri 2a str. 2457T
guuucgcagucgccagcaa

SEQ ID NO: 1916672 - RNA, 14 nt, Shigella flexneri 2a str. 2457T
guuucgccugccag

SEQ ID NO: 1916673 - RNA, 12 nt, Shigella flexneri 2a str. 2457T
aaaucaacuuuc

SEQ ID NO: 1916674 - RNA, 22 nt, Shigella flexneri 2a str. 2457T
aaaucaacuugacgauuaacgc

SEQ ID NO: 1916675 - RNA, 13 nt, Shigella flexneri 2a str. 2457T
aaaucaaugccuu

SEQ ID NO: 1916676 - RNA, 23 nt, Shigella flexneri 2a str. 2457T
aaaucaauccaguguaaaacagc

SEQ ID NO: 1916677 - RNA, 16 nt, Shigella flexneri 2a str. 2457T
aaaucacuaaacccga

SEQ ID NO: 1916678 - RNA, 22 nt, Shigella flexneri 2a str. 2457T
aaaucacuaaacccgaccacuu

SEQ ID NO: 1916679 - RNA, 20 nt, Shigella flexneri 2a str. 2457T
aaaucacuauuaaagaaagu

SEQ ID NO: 1916680 - RNA, 18 nt, Shigella flexneri 2a str. 2457T
aaaucacuauuaaagaaa

SEQ ID NO: 1916681 - RNA, 16 nt, Shigella flexneri 2a str. 2457T
guuucucgccacuaaa

SEQ ID NO: 1916682 - RNA, 18 nt, Shigella flexneri 2a str. 2457T
guuucucugacgcucucu

SEQ ID NO: 1916683 - RNA, 14 nt, Shigella flexneri 2a str. 2457T
guuucucuguucag

SEQ ID NO: 1916684 - RNA, 23 nt, Shigella flexneri 2a str. 2457T
aaaucaccauauucagcagcaga

SEQ ID NO: 1916685 - RNA, 13 nt, Shigella flexneri 2a str. 2457T
aaaucacgcaucg

SEQ ID NO: 1916686 - RNA, 20 nt, Shigella flexneri 2a str. 2457T
aaaucacgcugcugauuaaa

SEQ ID NO: 1916687 - RNA, 13 nt, Shigella flexneri 2a str. 2457T
aaaucacgcauca

SEQ ID NO: 1916688 - RNA, 13 nt, Shigella flexneri 2a str. 2457T
aaaucacgcgccu

SEQ ID NO: 1916689 - RNA, 16 nt, Shigella flexneri 2a str. 2457T
aaaucacauaaauucu

SEQ ID NO: 1916690 - RNA, 17 nt, Shigella flexneri 2a str. 2457T
aaaucaccaccagcacc

SEQ ID NO: 1916691 - RNA, 21 nt, Shigella flexneri 2a str. 2457T
aaaucaccauauucagcagca

SEQ ID NO: 1916692 - RNA, 14 nt, Shigella flexneri 2a str. 2457T
aaaucaccaccagc

SEQ ID NO: 1916693 - RNA, 13 nt, Shigella flexneri 2a str. 2457T
aaaucaacauguu

SEQ ID NO: 1916694 - RNA, 15 nt, Shigella flexneri 2a str. 2457T
aaaucaacaugaaaa

SEQ ID NO: 1916695 - RNA, 12 nt, Shigella flexneri 2a str. 2457T
aaaucaaaccaa

SEQ ID NO: 1916696 - RNA, 15 nt, Shigella flexneri 2a str. 2457T
guuuccgcuucucaa

SEQ ID NO: 1916697 - RNA, 16 nt, Shigella flexneri 2a str. 2457T
guuuccgcuucugcuu

SEQ ID NO: 1916698 - RNA, 13 nt, Shigella flexneri 2a str. 2457T
guuucccuguuca

SEQ ID NO: 1916699 - RNA, 15 nt, Shigella flexneri 2a str. 2457T
aaauauugagcagaa

SEQ ID NO: 1916700 - RNA, 18 nt, Shigella flexneri 2a str. 2457T
guuuccagauuuugcuua

SEQ ID NO: 1916701 - RNA, 11 nt, Shigella flexneri 2a str. 2457T
guuuccagcag

SEQ ID NO: 1916702 - RNA, 22 nt, Shigella flexneri 2a str. 2457T
guuuccacggauaacaaaauaa

SEQ ID NO: 1916703 - RNA, 14 nt, Shigella flexneri 2a str. 2457T
gugaacgccuuauc

SEQ ID NO: 1916704 - RNA, 19 nt, Shigella flexneri 2a str. 2457T
gugaacguguaggccugau

SEQ ID NO: 1916705 - RNA, 18 nt, Shigella flexneri 2a str. 2457T
gugaagcacguaaaucuu

SEQ ID NO: 1916706 - RNA, 23 nt, Shigella flexneri 2a str. 2457T
aaauagccgagcgcguuaaagaa

SEQ ID NO: 1916707 - RNA, 21 nt, Shigella flexneri 2a str. 2457T
aaauagcccgauggauuuauc

SEQ ID NO: 1916708 - RNA, 17 nt, Shigella flexneri 2a str. 2457T
gugaauaaauuuuauuc

SEQ ID NO: 1916709 - RNA, 22 nt, Shigella flexneri 2a str. 2457T
gugaauaaauuuuauucauauu

SEQ ID NO: 1916710 - RNA, 21 nt, Shigella flexneri 2a str. 2457T
gugaaguugccggauguguug

SEQ ID NO: 1916711 - RNA, 23 nt, Shigella flexneri 2a str. 2457T
gugaagugagaauuuuucacucc

SEQ ID NO: 1916712 - RNA, 13 nt, Shigella flexneri 2a str. 2457T
gugaagagaugga

SEQ ID NO: 1916713 - RNA, 21 nt, Shigella flexneri 2a str. 2457T
gugaauauuccuuaugguuca

SEQ ID NO: 1916714 - RNA, 23 nt, Shigella flexneri 2a str. 2457T
gugaauauuuaaccugagcuuga

SEQ ID NO: 1916715 - RNA, 17 nt, Shigella flexneri 2a str. 2457T
gugacaaucaccagguc

SEQ ID NO: 1916716 - RNA, 15 nt, Shigella flexneri 2a str. 2457T
gugaauuguuuuaua

SEQ ID NO: 1916717 - RNA, 22 nt, Shigella flexneri 2a str. 2457T
gugaccaucagcaugacaaaaa

SEQ ID NO: 1916718 - RNA, 16 nt, Shigella flexneri 2a str. 2457T
gugacccgcagccagc

SEQ ID NO: 1916719 - RNA, 22 nt, Shigella flexneri 2a str. 2457T
gugaccgaaccuguuuucaccg

SEQ ID NO: 1916720 - RNA, 14 nt, Shigella flexneri 2a str. 2457T
gugaccgaaggcga

SEQ ID NO: 1916721 - RNA, 17 nt, Shigella flexneri 2a str. 2457T
gugacgcugucuuauca

SEQ ID NO: 1916722 - RNA, 14 nt, Shigella flexneri 2a str. 2457T
gugacgcauuuuac

SEQ ID NO: 1916723 - RNA, 22 nt, Shigella flexneri 2a str. 2457T
gugacgaaagucugggccgaua

SEQ ID NO: 1916724 - RNA, 15 nt, Shigella flexneri 2a str. 2457T
gugacgacaccaucu

SEQ ID NO: 1916725 - RNA, 16 nt, Shigella flexneri 2a str. 2457T
gugacgcaaccgcaaa

SEQ ID NO: 1916726 - RNA, 11 nt, Shigella flexneri 2a str. 2457T
gugacauucug

SEQ ID NO: 1916727 - RNA, 13 nt, Shigella flexneri 2a str. 2457T
gugaccagcagca

SEQ ID NO: 1916728 - RNA, 20 nt, Shigella flexneri 2a str. 2457T
gugacaguguuauucccaac

SEQ ID NO: 1916729 - RNA, 18 nt, Shigella flexneri 2a str. 2457T
gugacagguuuaaacaga

SEQ ID NO: 1916730 - RNA, 12 nt, Shigella flexneri 2a str. 2457T
gugacagcagcg

SEQ ID NO: 1916731 - RNA, 18 nt, Shigella flexneri 2a str. 2457T
gugacacgcgcgcauggu

SEQ ID NO: 1916732 - RNA, 23 nt, Shigella flexneri 2a str. 2457T
aaauagugccuggcugcgugagg

SEQ ID NO: 1916733 - RNA, 23 nt, Shigella flexneri 2a str. 2457T
gugauaaaacgcagucuucccag

SEQ ID NO: 1916734 - RNA, 17 nt, Shigella flexneri 2a str. 2457T
gugauaaucaguuugau

SEQ ID NO: 1916735 - RNA, 18 nt, Shigella flexneri 2a str. 2457T
gugauaaucaguuugaug

SEQ ID NO: 1916736 - RNA, 21 nt, Shigella flexneri 2a str. 2457T
gugauaaaacgcagucuuccc

SEQ ID NO: 1916737 - RNA, 22 nt, Shigella flexneri 2a str. 2457T
gugauaaaacgcagucuuccca

SEQ ID NO: 1916738 - RNA, 23 nt, Shigella flexneri 2a str. 2457T
gugauaaacccaacggcaaacau

SEQ ID NO: 1916739 - RNA, 17 nt, Shigella flexneri 2a str. 2457T
gugaguugguuauucaa

SEQ ID NO: 1916740 - RNA, 12 nt, Shigella flexneri 2a str. 2457T
gugagguaacaa

SEQ ID NO: 1916741 - RNA, 14 nt, Shigella flexneri 2a str. 2457T
gugaggaucaccag

SEQ ID NO: 1916742 - RNA, 20 nt, Shigella flexneri 2a str. 2457T
gugagcguuuucucaaaaaa

SEQ ID NO: 1916743 - RNA, 15 nt, Shigella flexneri 2a str. 2457T
gugagggggcguuca

SEQ ID NO: 1916744 - RNA, 21 nt, Shigella flexneri 2a str. 2457T
gugaggcgaugccugcuuccg

SEQ ID NO: 1916745 - RNA, 14 nt, Shigella flexneri 2a str. 2457T
gugagauugcugcg

SEQ ID NO: 1916746 - RNA, 23 nt, Shigella flexneri 2a str. 2457T
gugagaucauuauuaaacagaca

SEQ ID NO: 1916747 - RNA, 14 nt, Shigella flexneri 2a str. 2457T
gugagcacaucugg

SEQ ID NO: 1916748 - RNA, 18 nt, Shigella flexneri 2a str. 2457T
gugagcgggcgaaccagg

SEQ ID NO: 1916749 - RNA, 22 nt, Shigella flexneri 2a str. 2457T
gugagcgguguugccgaagcag

SEQ ID NO: 1916750 - RNA, 22 nt, Shigella flexneri 2a str. 2457T
gugacucccacuuuuauuucac

SEQ ID NO: 1916751 - RNA, 19 nt, Shigella flexneri 2a str. 2457T
gugacuucgccgugaaagu

SEQ ID NO: 1916752 - RNA, 18 nt, Shigella flexneri 2a str. 2457T
gugacuucugccagcugc

SEQ ID NO: 1916753 - RNA, 12 nt, Shigella flexneri 2a str. 2457T
gugagaacacca

SEQ ID NO: 1916754 - RNA, 21 nt, Shigella flexneri 2a str. 2457T
gugagaucauuauuaaacaga

SEQ ID NO: 1916755 - RNA, 11 nt, Shigella flexneri 2a str. 2457T
gugacugcugg

SEQ ID NO: 1916756 - RNA, 21 nt, Shigella flexneri 2a str. 2457T
gugauuucaggcuuuuuucca

SEQ ID NO: 1916757 - RNA, 18 nt, Shigella flexneri 2a str. 2457T
gugcaagaaaugacagag

SEQ ID NO: 1916758 - RNA, 23 nt, Shigella flexneri 2a str. 2457T
gugcaagcauuagcauacugaaa

SEQ ID NO: 1916759 - RNA, 14 nt, Shigella flexneri 2a str. 2457T
gugauuucuucauu

SEQ ID NO: 1916760 - RNA, 23 nt, Shigella flexneri 2a str. 2457T
gugauuuccccuaacucuuucaa

SEQ ID NO: 1916761 - RNA, 16 nt, Shigella flexneri 2a str. 2457T
gugcaauaccauggcu

SEQ ID NO: 1916762 - RNA, 16 nt, Shigella flexneri 2a str. 2457T
gugcaaucaaacucaa

SEQ ID NO: 1916763 - RNA, 14 nt, Shigella flexneri 2a str. 2457T
gugauuaucggcau

SEQ ID NO: 1916764 - RNA, 21 nt, Shigella flexneri 2a str. 2457T
gugauucauaguaagcagauu

SEQ ID NO: 1916765 - RNA, 17 nt, Shigella flexneri 2a str. 2457T
gugaucguggccaugac

SEQ ID NO: 1916766 - RNA, 20 nt, Shigella flexneri 2a str. 2457T
gugaucguggccaugaccgc

SEQ ID NO: 1916767 - RNA, 19 nt, Shigella flexneri 2a str. 2457T
gugcaaucaacaccacugc

SEQ ID NO: 1916768 - RNA, 14 nt, Shigella flexneri 2a str. 2457T
gugcacaauauuuu

SEQ ID NO: 1916769 - RNA, 14 nt, Shigella flexneri 2a str. 2457T
gugcagagcccguu

SEQ ID NO: 1916770 - RNA, 17 nt, Shigella flexneri 2a str. 2457T
aaauagcauaauauaac

SEQ ID NO: 1916771 - RNA, 21 nt, Shigella flexneri 2a str. 2457T
aaauagccaaucauucccauu

SEQ ID NO: 1916772 - RNA, 17 nt, Shigella flexneri 2a str. 2457T
aaauagccaaucauucc

SEQ ID NO: 1916773 - RNA, 16 nt, Shigella flexneri 2a str. 2457T
gugaaauuaaacuguc

SEQ ID NO: 1916774 - RNA, 17 nt, Shigella flexneri 2a str. 2457T
gugaaaucugaaaucau

SEQ ID NO: 1916775 - RNA, 17 nt, Shigella flexneri 2a str. 2457T
gugaaagagccgucauu

SEQ ID NO: 1916776 - RNA, 19 nt, Shigella flexneri 2a str. 2457T
gugaaacaaaucacuauua

SEQ ID NO: 1916777 - RNA, 16 nt, Shigella flexneri 2a str. 2457T
gugaaaagcugcauac

SEQ ID NO: 1916778 - RNA, 13 nt, Shigella flexneri 2a str. 2457T
gucuuuugaucaa

SEQ ID NO: 1916779 - RNA, 16 nt, Shigella flexneri 2a str. 2457T
gucuuuuuucaacuuu

SEQ ID NO: 1916780 - RNA, 12 nt, Shigella flexneri 2a str. 2457T
gucuuuuuucac

SEQ ID NO: 1916781 - RNA, 22 nt, Shigella flexneri 2a str. 2457T
gucuuuuuucacuggcaaugac

SEQ ID NO: 1916782 - RNA, 17 nt, Shigella flexneri 2a str. 2457T
gucuuuuuuccagcaca

SEQ ID NO: 1916783 - RNA, 11 nt, Shigella flexneri 2a str. 2457T
gugaaaaaaag

SEQ ID NO: 1916784 - RNA, 14 nt, Shigella flexneri 2a str. 2457T
gugaaaaaaacugc

SEQ ID NO: 1916785 - RNA, 13 nt, Shigella flexneri 2a str. 2457T
gugaaaaauaaaa

SEQ ID NO: 1916786 - RNA, 22 nt, Shigella flexneri 2a str. 2457T
gucuuucuuaccccugauuuug

SEQ ID NO: 1916787 - RNA, 13 nt, Shigella flexneri 2a str. 2457T
gucuguuccccuc

SEQ ID NO: 1916788 - RNA, 20 nt, Shigella flexneri 2a str. 2457T
gucuuaaaccggacaauaaa

SEQ ID NO: 1916789 - RNA, 21 nt, Shigella flexneri 2a str. 2457T
gucuuaaaggggugaaaaaaa

SEQ ID NO: 1916790 - RNA, 16 nt, Shigella flexneri 2a str. 2457T
gucuuaucaggccagg

SEQ ID NO: 1916791 - RNA, 13 nt, Shigella flexneri 2a str. 2457T
gucuuaucuggca

SEQ ID NO: 1916792 - RNA, 14 nt, Shigella flexneri 2a str. 2457T
gucuuccagcaaau

SEQ ID NO: 1916793 - RNA, 20 nt, Shigella flexneri 2a str. 2457T
gucuucugugauuccgccag

SEQ ID NO: 1916794 - RNA, 21 nt, Shigella flexneri 2a str. 2457T
gucuucugugauuccgccagu

SEQ ID NO: 1916795 - RNA, 13 nt, Shigella flexneri 2a str. 2457T
gucuucugguugc

SEQ ID NO: 1916796 - RNA, 21 nt, Shigella flexneri 2a str. 2457T
gucuucugguugcgaaaaaau

SEQ ID NO: 1916797 - RNA, 20 nt, Shigella flexneri 2a str. 2457T
gucuucgauagcaaauugcu

SEQ ID NO: 1916798 - RNA, 14 nt, Shigella flexneri 2a str. 2457T
gucuucccgcagcc

SEQ ID NO: 1916799 - RNA, 10 nt, Shigella flexneri 2a str. 2457T
gucuuccugc

SEQ ID NO: 1916800 - RNA, 10 nt, Shigella flexneri 2a str. 2457T
gucuucccug

SEQ ID NO: 1916801 - RNA, 14 nt, Shigella flexneri 2a str. 2457T
gucguucaggcgcu

SEQ ID NO: 1916802 - RNA, 12 nt, Shigella flexneri 2a str. 2457T
gucucaucuuua

SEQ ID NO: 1916803 - RNA, 18 nt, Shigella flexneri 2a str. 2457T
gucucccgaugccagcac

SEQ ID NO: 1916804 - RNA, 17 nt, Shigella flexneri 2a str. 2457T
gucucaggugucuggca

SEQ ID NO: 1916805 - RNA, 20 nt, Shigella flexneri 2a str. 2457T
gucguugcuaacaauggagc

SEQ ID NO: 1916806 - RNA, 15 nt, Shigella flexneri 2a str. 2457T
gucuccgguccaguc

SEQ ID NO: 1916807 - RNA, 17 nt, Shigella flexneri 2a str. 2457T
gucucccgucaggagcu

SEQ ID NO: 1916808 - RNA, 23 nt, Shigella flexneri 2a str. 2457T
gucuccgcugagacgcgcuugca

SEQ ID NO: 1916809 - RNA, 19 nt, Shigella flexneri 2a str. 2457T
gucucggcauggauuaugu

SEQ ID NO: 1916810 - RNA, 19 nt, Shigella flexneri 2a str. 2457T
gucucuugccgguuuugca

SEQ ID NO: 1916811 - RNA, 21 nt, Shigella flexneri 2a str. 2457T
gucucugccggguucgcacua

SEQ ID NO: 1916812 - RNA, 23 nt, Shigella flexneri 2a str. 2457T
gucucucagcacaccauaaaaca

SEQ ID NO: 1916813 - RNA, 21 nt, Shigella flexneri 2a str. 2457T
gucugaucggcaaucacgccc

SEQ ID NO: 1916814 - RNA, 22 nt, Shigella flexneri 2a str. 2457T
gucugauuccgauauucaauug

SEQ ID NO: 1916815 - RNA, 21 nt, Shigella flexneri 2a str. 2457T
gucugaauaucaucccccugc

SEQ ID NO: 1916816 - RNA, 15 nt, Shigella flexneri 2a str. 2457T
gucugagccgaaaaa

SEQ ID NO: 1916817 - RNA, 18 nt, Shigella flexneri 2a str. 2457T
gucugagccgaaaaagag

SEQ ID NO: 1916818 - RNA, 18 nt, Shigella flexneri 2a str. 2457T
gucuggguuucgccaggc

SEQ ID NO: 1916819 - RNA, 20 nt, Shigella flexneri 2a str. 2457T
gucuggguuucgccaggcac

SEQ ID NO: 1916820 - RNA, 18 nt, Shigella flexneri 2a str. 2457T
gucuguacggcagugaac

SEQ ID NO: 1916821 - RNA, 17 nt, Shigella flexneri 2a str. 2457T
gucugggcguugcaaua

SEQ ID NO: 1916822 - RNA, 14 nt, Shigella flexneri 2a str. 2457T
gucugggcaaaauc

SEQ ID NO: 1916823 - RNA, 16 nt, Shigella flexneri 2a str. 2457T
gucugcugaccaccug

SEQ ID NO: 1916824 - RNA, 17 nt, Shigella flexneri 2a str. 2457T
gucugcuggaacaaacu

SEQ ID NO: 1916825 - RNA, 13 nt, Shigella flexneri 2a str. 2457T
gucuggaagccag

SEQ ID NO: 1916826 - RNA, 14 nt, Shigella flexneri 2a str. 2457T
gucggcuuucucau

SEQ ID NO: 1916827 - RNA, 22 nt, Shigella flexneri 2a str. 2457T
gucgcuucgcgaaucgccacaa

SEQ ID NO: 1916828 - RNA, 16 nt, Shigella flexneri 2a str. 2457T
gucgcugucuuccugg

SEQ ID NO: 1916829 - RNA, 11 nt, Shigella flexneri 2a str. 2457T
gucgcuuugac

SEQ ID NO: 1916830 - RNA, 21 nt, Shigella flexneri 2a str. 2457T
gucgcugguugcaugaugacu

SEQ ID NO: 1916831 - RNA, 18 nt, Shigella flexneri 2a str. 2457T
gucggaaccacaacucaa

SEQ ID NO: 1916832 - RNA, 15 nt, Shigella flexneri 2a str. 2457T
gucggcagagaguug

SEQ ID NO: 1916833 - RNA, 17 nt, Shigella flexneri 2a str. 2457T
gucgggaucaucgccca

SEQ ID NO: 1916834 - RNA, 15 nt, Shigella flexneri 2a str. 2457T
gucgggaccagcauu

SEQ ID NO: 1916835 - RNA, 14 nt, Shigella flexneri 2a str. 2457T
gucguaaacaacug

SEQ ID NO: 1916836 - RNA, 19 nt, Shigella flexneri 2a str. 2457T
gucgguuuguacucuuccg

SEQ ID NO: 1916837 - RNA, 15 nt, Shigella flexneri 2a str. 2457T
gucgguuuauggaaa

SEQ ID NO: 1916838 - RNA, 15 nt, Shigella flexneri 2a str. 2457T
gucgccgggaugcug

SEQ ID NO: 1916839 - RNA, 14 nt, Shigella flexneri 2a str. 2457T
gucgccguaccggg

SEQ ID NO: 1916840 - RNA, 20 nt, Shigella flexneri 2a str. 2457T
gucgccgcgacgcccccugc

SEQ ID NO: 1916841 - RNA, 20 nt, Shigella flexneri 2a str. 2457T
gucgccgcgauaaggucaga

SEQ ID NO: 1916842 - RNA, 17 nt, Shigella flexneri 2a str. 2457T
gucgccgcgcaaaucca

SEQ ID NO: 1916843 - RNA, 15 nt, Shigella flexneri 2a str. 2457T
gucgccgcugguggu

SEQ ID NO: 1916844 - RNA, 22 nt, Shigella flexneri 2a str. 2457T
gucgccccggaacgggagaaac

SEQ ID NO: 1916845 - RNA, 23 nt, Shigella flexneri 2a str. 2457T
gucgcccgaccaucgccagcuca

SEQ ID NO: 1916846 - RNA, 15 nt, Shigella flexneri 2a str. 2457T
gucgcagccagcgcg

SEQ ID NO: 1916847 - RNA, 17 nt, Shigella flexneri 2a str. 2457T
gucgcaagacgaaaaau

SEQ ID NO: 1916848 - RNA, 16 nt, Shigella flexneri 2a str. 2457T
gucgcaaauccgcugu

SEQ ID NO: 1916849 - RNA, 20 nt, Shigella flexneri 2a str. 2457T
gucgcaauacccugacccag

SEQ ID NO: 1916850 - RNA, 15 nt, Shigella flexneri 2a str. 2457T
guccugcguuucuuc

SEQ ID NO: 1916851 - RNA, 12 nt, Shigella flexneri 2a str. 2457T
guccuuccaggu

SEQ ID NO: 1916852 - RNA, 15 nt, Shigella flexneri 2a str. 2457T
guccuuuuauuacgu

SEQ ID NO: 1916853 - RNA, 19 nt, Shigella flexneri 2a str. 2457T
gucgauaucgcugucgcca

SEQ ID NO: 1916854 - RNA, 14 nt, Shigella flexneri 2a str. 2457T
gucgauauaauuga

SEQ ID NO: 1916855 - RNA, 17 nt, Shigella flexneri 2a str. 2457T
gucgauaucgauaauca

SEQ ID NO: 1916856 - RNA, 20 nt, Shigella flexneri 2a str. 2457T
guccuaacaaccauccccaa

SEQ ID NO: 1916857 - RNA, 15 nt, Shigella flexneri 2a str. 2457T
guccgggcaucagca

SEQ ID NO: 1916858 - RNA, 14 nt, Shigella flexneri 2a str. 2457T
guccggcgcugcaa

SEQ ID NO: 1916859 - RNA, 18 nt, Shigella flexneri 2a str. 2457T
guccugagcacuuuucug

SEQ ID NO: 1916860 - RNA, 22 nt, Shigella flexneri 2a str. 2457T
guccucccuuauugcuaaugau

SEQ ID NO: 1916861 - RNA, 15 nt, Shigella flexneri 2a str. 2457T
guccgcguccagcuu

SEQ ID NO: 1916862 - RNA, 16 nt, Shigella flexneri 2a str. 2457T
gucacgccaauaaucg

SEQ ID NO: 1916863 - RNA, 15 nt, Shigella flexneri 2a str. 2457T
gucaaugauuucugc

SEQ ID NO: 1916864 - RNA, 12 nt, Shigella flexneri 2a str. 2457T
gucaaucugcuc

SEQ ID NO: 1916865 - RNA, 18 nt, Shigella flexneri 2a str. 2457T
ggugaacaucgcagggaa

SEQ ID NO: 1916866 - RNA, 19 nt, Shigella flexneri 2a str. 2457T
ggugaaaguaaaaaagaag

SEQ ID NO: 1916867 - RNA, 22 nt, Shigella flexneri 2a str. 2457T
ggugaaaguaacaaagccugca

SEQ ID NO: 1916868 - RNA, 20 nt, Shigella flexneri 2a str. 2457T
ggugaacucacacagcgagu

SEQ ID NO: 1916869 - RNA, 21 nt, Shigella flexneri 2a str. 2457T
gucaacugcgccacucgauac

SEQ ID NO: 1916870 - RNA, 13 nt, Shigella flexneri 2a str. 2457T
gucaacuccaguu

SEQ ID NO: 1916871 - RNA, 15 nt, Shigella flexneri 2a str. 2457T
gucaaucauccauau

SEQ ID NO: 1916872 - RNA, 12 nt, Shigella flexneri 2a str. 2457T
gucagcaucaua

SEQ ID NO: 1916873 - RNA, 19 nt, Shigella flexneri 2a str. 2457T
gucagcaucauaccuccgc

SEQ ID NO: 1916874 - RNA, 17 nt, Shigella flexneri 2a str. 2457T
gucagccacuucuucca

SEQ ID NO: 1916875 - RNA, 15 nt, Shigella flexneri 2a str. 2457T
gucagccagaaagaa

SEQ ID NO: 1916876 - RNA, 13 nt, Shigella flexneri 2a str. 2457T
gucagccagcggc

SEQ ID NO: 1916877 - RNA, 15 nt, Shigella flexneri 2a str. 2457T
gucacgucauccccc

SEQ ID NO: 1916878 - RNA, 21 nt, Shigella flexneri 2a str. 2457T
gucacguagcggcggcagauu

SEQ ID NO: 1916879 - RNA, 18 nt, Shigella flexneri 2a str. 2457T
gucacugauagugcugcc

SEQ ID NO: 1916880 - RNA, 13 nt, Shigella flexneri 2a str. 2457T
gucacugauagug

SEQ ID NO: 1916881 - RNA, 22 nt, Shigella flexneri 2a str. 2457T
gucacucucgacccgacagaug

SEQ ID NO: 1916882 - RNA, 21 nt, Shigella flexneri 2a str. 2457T
gucaggcaaccgcugagcgau

SEQ ID NO: 1916883 - RNA, 16 nt, Shigella flexneri 2a str. 2457T
gucagcgccuggcugc

SEQ ID NO: 1916884 - RNA, 16 nt, Shigella flexneri 2a str. 2457T
gucagcgaucagcauu

SEQ ID NO: 1916885 - RNA, 18 nt, Shigella flexneri 2a str. 2457T
gucagccucgcuggucag

SEQ ID NO: 1916886 - RNA, 20 nt, Shigella flexneri 2a str. 2457T
gucagccucgcuggucagcg

SEQ ID NO: 1916887 - RNA, 20 nt, Shigella flexneri 2a str. 2457T
gucagcccgugauuuuccug

SEQ ID NO: 1916888 - RNA, 18 nt, Shigella flexneri 2a str. 2457T
gucaucgcauacaaaaac

SEQ ID NO: 1916889 - RNA, 18 nt, Shigella flexneri 2a str. 2457T
gucauccaggaacuccag

SEQ ID NO: 1916890 - RNA, 23 nt, Shigella flexneri 2a str. 2457T
gucauccaaaucgcccagcaaau

SEQ ID NO: 1916891 - RNA, 13 nt, Shigella flexneri 2a str. 2457T
gucauccauacca

SEQ ID NO: 1916892 - RNA, 15 nt, Shigella flexneri 2a str. 2457T
gucagguuuuaccuc

SEQ ID NO: 1916893 - RNA, 22 nt, Shigella flexneri 2a str. 2457T
gucaucaaacggcauaugccau

SEQ ID NO: 1916894 - RNA, 19 nt, Shigella flexneri 2a str. 2457T
gucaucagucugagccugc

SEQ ID NO: 1916895 - RNA, 14 nt, Shigella flexneri 2a str. 2457T
gucaucaguuucaa

SEQ ID NO: 1916896 - RNA, 20 nt, Shigella flexneri 2a str. 2457T
gucaucagcgccaacccgcu

SEQ ID NO: 1916897 - RNA, 21 nt, Shigella flexneri 2a str. 2457T
gucauuuugcguguuucagaa

SEQ ID NO: 1916898 - RNA, 14 nt, Shigella flexneri 2a str. 2457T
gucauuacaacaag

SEQ ID NO: 1916899 - RNA, 13 nt, Shigella flexneri 2a str. 2457T
gucauuaccagcg

SEQ ID NO: 1916900 - RNA, 14 nt, Shigella flexneri 2a str. 2457T
guccaaaagguccu

SEQ ID NO: 1916901 - RNA, 18 nt, Shigella flexneri 2a str. 2457T
guccaaaagguccuucag

SEQ ID NO: 1916902 - RNA, 22 nt, Shigella flexneri 2a str. 2457T
guccaaaagguccuucaggccc

SEQ ID NO: 1916903 - RNA, 14 nt, Shigella flexneri 2a str. 2457T
gucaugucaugagu

SEQ ID NO: 1916904 - RNA, 18 nt, Shigella flexneri 2a str. 2457T
gucaucggcguugcccau

SEQ ID NO: 1916905 - RNA, 14 nt, Shigella flexneri 2a str. 2457T
gucaucugcacggu

SEQ ID NO: 1916906 - RNA, 14 nt, Shigella flexneri 2a str. 2457T
gucauggcugacac

SEQ ID NO: 1916907 - RNA, 22 nt, Shigella flexneri 2a str. 2457T
gucauggcauuaauaugcucaa

SEQ ID NO: 1916908 - RNA, 14 nt, Shigella flexneri 2a str. 2457T
guccagccgccagg

SEQ ID NO: 1916909 - RNA, 16 nt, Shigella flexneri 2a str. 2457T
guccaccgugauucac

SEQ ID NO: 1916910 - RNA, 18 nt, Shigella flexneri 2a str. 2457T
guccaccgcgaugcugcc

SEQ ID NO: 1916911 - RNA, 18 nt, Shigella flexneri 2a str. 2457T
guccaccaauagcccaug

SEQ ID NO: 1916912 - RNA, 21 nt, Shigella flexneri 2a str. 2457T
guccaucacaaucauccuacc

SEQ ID NO: 1916913 - RNA, 21 nt, Shigella flexneri 2a str. 2457T
guccauagcgauguauuucau

SEQ ID NO: 1916914 - RNA, 18 nt, Shigella flexneri 2a str. 2457T
guccagcuccguccagcc

SEQ ID NO: 1916915 - RNA, 15 nt, Shigella flexneri 2a str. 2457T
guccauggugucuga

SEQ ID NO: 1916916 - RNA, 19 nt, Shigella flexneri 2a str. 2457T
gucccacuggucgcccugg

SEQ ID NO: 1916917 - RNA, 17 nt, Shigella flexneri 2a str. 2457T
guccauccauacgggca

SEQ ID NO: 1916918 - RNA, 21 nt, Shigella flexneri 2a str. 2457T
guccaugcugucggcugccag

SEQ ID NO: 1916919 - RNA, 14 nt, Shigella flexneri 2a str. 2457T
uacgcccacgccag

SEQ ID NO: 1916920 - RNA, 15 nt, Shigella flexneri 2a str. 2457T
uacgccaucccaacu

SEQ ID NO: 1916921 - RNA, 18 nt, Shigella flexneri 2a str. 2457T
uacgccaucgccagcagc

SEQ ID NO: 1916922 - RNA, 16 nt, Shigella flexneri 2a str. 2457T
uacgccucacagggcu

SEQ ID NO: 1916923 - RNA, 20 nt, Shigella flexneri 2a str. 2457T
uacgccugccagcucuuucg

SEQ ID NO: 1916924 - RNA, 16 nt, Shigella flexneri 2a str. 2457T
uacgccgcauccaaca

SEQ ID NO: 1916925 - RNA, 21 nt, Shigella flexneri 2a str. 2457T
uacgcaccgcuccaucgccuu

SEQ ID NO: 1916926 - RNA, 16 nt, Shigella flexneri 2a str. 2457T
uacgcauugcucacuu

SEQ ID NO: 1916927 - RNA, 13 nt, Shigella flexneri 2a str. 2457T
uacgcaaaaaaca

SEQ ID NO: 1916928 - RNA, 23 nt, Shigella flexneri 2a str. 2457T
uaccgucgccagacgcagcaagg

SEQ ID NO: 1916929 - RNA, 20 nt, Shigella flexneri 2a str. 2457T
uaccgugguacguuaaaguu

SEQ ID NO: 1916930 - RNA, 15 nt, Shigella flexneri 2a str. 2457T
uaccguaucuaccac

SEQ ID NO: 1916931 - RNA, 17 nt, Shigella flexneri 2a str. 2457T
uaccguaaccauaacca

SEQ ID NO: 1916932 - RNA, 14 nt, Shigella flexneri 2a str. 2457T
uacgcgaucguccg

SEQ ID NO: 1916933 - RNA, 17 nt, Shigella flexneri 2a str. 2457T
uacgcgcccgcgcagcu

SEQ ID NO: 1916934 - RNA, 22 nt, Shigella flexneri 2a str. 2457T
uacgcguaaaacagccagcgcu

SEQ ID NO: 1916935 - RNA, 13 nt, Shigella flexneri 2a str. 2457T
uacgucacuucau

SEQ ID NO: 1916936 - RNA, 14 nt, Shigella flexneri 2a str. 2457T
uacguaaugcucau

SEQ ID NO: 1916937 - RNA, 20 nt, Shigella flexneri 2a str. 2457T
uacggcguuucacuucugag

SEQ ID NO: 1916938 - RNA, 14 nt, Shigella flexneri 2a str. 2457T
uacggcggucuggc

SEQ ID NO: 1916939 - RNA, 20 nt, Shigella flexneri 2a str. 2457T
uacggcuccgcaagcgaaug

SEQ ID NO: 1916940 - RNA, 17 nt, Shigella flexneri 2a str. 2457T
uacgggaggucaucagc

SEQ ID NO: 1916941 - RNA, 16 nt, Shigella flexneri 2a str. 2457T
uacggcuggaagguga

SEQ ID NO: 1916942 - RNA, 15 nt, Shigella flexneri 2a str. 2457T
uacgugaggcaucag

SEQ ID NO: 1916943 - RNA, 22 nt, Shigella flexneri 2a str. 2457T
uacgucacuucaucgucauaau

SEQ ID NO: 1916944 - RNA, 16 nt, Shigella flexneri 2a str. 2457T
uacuacguaauuucaa

SEQ ID NO: 1916945 - RNA, 21 nt, Shigella flexneri 2a str. 2457T
uacuaaucucacccauagaua

SEQ ID NO: 1916946 - RNA, 21 nt, Shigella flexneri 2a str. 2457T
uacucuuugacaacaucaucu

SEQ ID NO: 1916947 - RNA, 23 nt, Shigella flexneri 2a str. 2457T
uacucuuucccggcaaucaccgc

SEQ ID NO: 1916948 - RNA, 19 nt, Shigella flexneri 2a str. 2457T
uacugaaaguggaaaaaua

SEQ ID NO: 1916949 - RNA, 18 nt, Shigella flexneri 2a str. 2457T
uacugaacaacuuaacuu

SEQ ID NO: 1916950 - RNA, 13 nt, Shigella flexneri 2a str. 2457T
uacugacauuaac

SEQ ID NO: 1916951 - RNA, 13 nt, Shigella flexneri 2a str. 2457T
uacugaaucccug

SEQ ID NO: 1916952 - RNA, 16 nt, Shigella flexneri 2a str. 2457T
uacugacaaacugcgc

SEQ ID NO: 1916953 - RNA, 23 nt, Shigella flexneri 2a str. 2457T
uacugacuagaugugcaguuccu

SEQ ID NO: 1916954 - RNA, 13 nt, Shigella flexneri 2a str. 2457T
uacugauuuuauu

SEQ ID NO: 1916955 - RNA, 14 nt, Shigella flexneri 2a str. 2457T
uacugcccgcuugc

SEQ ID NO: 1916956 - RNA, 18 nt, Shigella flexneri 2a str. 2457T
uacugauggcuacguucu

SEQ ID NO: 1916957 - RNA, 16 nt, Shigella flexneri 2a str. 2457T
uacugauguuugucac

SEQ ID NO: 1916958 - RNA, 22 nt, Shigella flexneri 2a str. 2457T
uacugauaguguuuuauguuca

SEQ ID NO: 1916959 - RNA, 13 nt, Shigella flexneri 2a str. 2457T
uacugaucaucau

SEQ ID NO: 1916960 - RNA, 21 nt, Shigella flexneri 2a str. 2457T
uacucugucugaugauaauca

SEQ ID NO: 1916961 - RNA, 21 nt, Shigella flexneri 2a str. 2457T
uacucuuucccggcaaucacc

SEQ ID NO: 1916962 - RNA, 23 nt, Shigella flexneri 2a str. 2457T
uacucuccugcggcgacaaaugu

SEQ ID NO: 1916963 - RNA, 16 nt, Shigella flexneri 2a str. 2457T
uacucuccuccagguu

SEQ ID NO: 1916964 - RNA, 20 nt, Shigella flexneri 2a str. 2457T
uacucguuuauuaugccaca

SEQ ID NO: 1916965 - RNA, 14 nt, Shigella flexneri 2a str. 2457T
uacuuaucuuuuac

SEQ ID NO: 1916966 - RNA, 13 nt, Shigella flexneri 2a str. 2457T
uacuucaccaguu

SEQ ID NO: 1916967 - RNA, 15 nt, Shigella flexneri 2a str. 2457T
uacuucaacacauaa

SEQ ID NO: 1916968 - RNA, 14 nt, Shigella flexneri 2a str. 2457T
uacuucaccuucuu

SEQ ID NO: 1916969 - RNA, 21 nt, Shigella flexneri 2a str. 2457T
uacuucaccuucuuuacugcc

SEQ ID NO: 1916970 - RNA, 21 nt, Shigella flexneri 2a str. 2457T
uacuucagcaagcgauaauuu

SEQ ID NO: 1916971 - RNA, 23 nt, Shigella flexneri 2a str. 2457T
uacuucauaacguuuuuucguca

SEQ ID NO: 1916972 - RNA, 23 nt, Shigella flexneri 2a str. 2457T
uacuucuucaugccaaaagggag

SEQ ID NO: 1916973 - RNA, 19 nt, Shigella flexneri 2a str. 2457T
uacuucucgauaaaccauc

SEQ ID NO: 1916974 - RNA, 14 nt, Shigella flexneri 2a str. 2457T
uacugcuggcaaca

SEQ ID NO: 1916975 - RNA, 15 nt, Shigella flexneri 2a str. 2457T
uacuggaauuucauu

SEQ ID NO: 1916976 - RNA, 17 nt, Shigella flexneri 2a str. 2457T
uacuggaguuauucauu

SEQ ID NO: 1916977 - RNA, 17 nt, Shigella flexneri 2a str. 2457T
uacugccccggagaaau

SEQ ID NO: 1916978 - RNA, 15 nt, Shigella flexneri 2a str. 2457T
uacugccuugaugaa

SEQ ID NO: 1916979 - RNA, 22 nt, Shigella flexneri 2a str. 2457T
uacugcugaaugaggcuuuaau

SEQ ID NO: 1916980 - RNA, 17 nt, Shigella flexneri 2a str. 2457T
uacuggcgauugucauu

SEQ ID NO: 1916981 - RNA, 16 nt, Shigella flexneri 2a str. 2457T
uacuggcgguuuucuu

SEQ ID NO: 1916982 - RNA, 23 nt, Shigella flexneri 2a str. 2457T
uacuggauagauauucuccagcu

SEQ ID NO: 1916983 - RNA, 20 nt, Shigella flexneri 2a str. 2457T
uacuguuuaucuucccagcg

SEQ ID NO: 1916984 - RNA, 21 nt, Shigella flexneri 2a str. 2457T
uaccggaacacucuuccaguc

SEQ ID NO: 1916985 - RNA, 15 nt, Shigella flexneri 2a str. 2457T
uaccggacacacuuc

SEQ ID NO: 1916986 - RNA, 18 nt, Shigella flexneri 2a str. 2457T
uaccggacacacuucauu

SEQ ID NO: 1916987 - RNA, 18 nt, Shigella flexneri 2a str. 2457T
uaccggauuuuuuuuccg

SEQ ID NO: 1916988 - RNA, 12 nt, Shigella flexneri 2a str. 2457T
uaccgccagacc

SEQ ID NO: 1916989 - RNA, 12 nt, Shigella flexneri 2a str. 2457T
uaccgccacagc

SEQ ID NO: 1916990 - RNA, 13 nt, Shigella flexneri 2a str. 2457T
uaccgcaccacca

SEQ ID NO: 1916991 - RNA, 17 nt, Shigella flexneri 2a str. 2457T
uaccgcaccaccagcag

SEQ ID NO: 1916992 - RNA, 19 nt, Shigella flexneri 2a str. 2457T
uaccgcaccuuccggaaua

SEQ ID NO: 1916993 - RNA, 13 nt, Shigella flexneri 2a str. 2457T
uaccgauucccag

SEQ ID NO: 1916994 - RNA, 24 nt, Shigella flexneri 2a str. 2457T
uaccgaauccaguaagcugugcga

SEQ ID NO: 1916995 - RNA, 18 nt, Shigella flexneri 2a str. 2457T
uaccgaagaguaaccaaa

SEQ ID NO: 1916996 - RNA, 17 nt, Shigella flexneri 2a str. 2457T
uacccugacccagaccg

SEQ ID NO: 1916997 - RNA, 19 nt, Shigella flexneri 2a str. 2457T
uaccccuucauccacauuc

SEQ ID NO: 1916998 - RNA, 19 nt, Shigella flexneri 2a str. 2457T
uaccccucuauccagcuca

SEQ ID NO: 1916999 - RNA, 20 nt, Shigella flexneri 2a str. 2457T
uaccccucuauccagcucau

SEQ ID NO: 1917000 - RNA, 18 nt, Shigella flexneri 2a str. 2457T
uacccgcuaacugguggc

SEQ ID NO: 1917001 - RNA, 15 nt, Shigella flexneri 2a str. 2457T
uacccgguuugugaa

SEQ ID NO: 1917002 - RNA, 14 nt, Shigella flexneri 2a str. 2457T
uaccagcugccaca

SEQ ID NO: 1917003 - RNA, 20 nt, Shigella flexneri 2a str. 2457T
uaccaggcgaccguuuucac

SEQ ID NO: 1917004 - RNA, 16 nt, Shigella flexneri 2a str. 2457T
uaccaguacgcccacg

SEQ ID NO: 1917005 - RNA, 16 nt, Shigella flexneri 2a str. 2457T
uaccaguccuacacac

SEQ ID NO: 1917006 - RNA, 17 nt, Shigella flexneri 2a str. 2457T
uaccaucggcagcgcca

SEQ ID NO: 1917007 - RNA, 12 nt, Shigella flexneri 2a str. 2457T
uaccaucaccaa

SEQ ID NO: 1917008 - RNA, 22 nt, Shigella flexneri 2a str. 2457T
uaccauuaaucgauaaaccagc

SEQ ID NO: 1917009 - RNA, 17 nt, Shigella flexneri 2a str. 2457T
uaccaugcgcaucaucg

SEQ ID NO: 1917010 - RNA, 15 nt, Shigella flexneri 2a str. 2457T
uaccaugcaccaacc

SEQ ID NO: 1917011 - RNA, 17 nt, Shigella flexneri 2a str. 2457T
uaccauggaagaaaaau

SEQ ID NO: 1917012 - RNA, 22 nt, Shigella flexneri 2a str. 2457T
uacccagcguguugaggaagcg

SEQ ID NO: 1917013 - RNA, 22 nt, Shigella flexneri 2a str. 2457T
uacccagcgaauccagcaugcu

SEQ ID NO: 1917014 - RNA, 19 nt, Shigella flexneri 2a str. 2457T
uaccccgucaccacuucac

SEQ ID NO: 1917015 - RNA, 19 nt, Shigella flexneri 2a str. 2457T
uacccagcguguugaggaa

SEQ ID NO: 1917016 - RNA, 12 nt, Shigella flexneri 2a str. 2457T
uacccagcagca

SEQ ID NO: 1917017 - RNA, 14 nt, Shigella flexneri 2a str. 2457T
uacccaaaaaauag

SEQ ID NO: 1917018 - RNA, 18 nt, Shigella flexneri 2a str. 2457T
uaccagcgaggucaaaau

SEQ ID NO: 1917019 - RNA, 20 nt, Shigella flexneri 2a str. 2457T
uaccagccuucuucauccag

SEQ ID NO: 1917020 - RNA, 23 nt, Shigella flexneri 2a str. 2457T
uaccaggauaggcuucuauacca

SEQ ID NO: 1917021 - RNA, 20 nt, Shigella flexneri 2a str. 2457T
uaccagcacccauagcuuca

SEQ ID NO: 1917022 - RNA, 19 nt, Shigella flexneri 2a str. 2457T
uaccagcaccugcuugaac

SEQ ID NO: 1917023 - RNA, 16 nt, Shigella flexneri 2a str. 2457T
uaccagauuaauuauu

SEQ ID NO: 1917024 - RNA, 20 nt, Shigella flexneri 2a str. 2457T
uaccagcaacugauggccca

SEQ ID NO: 1917025 - RNA, 18 nt, Shigella flexneri 2a str. 2457T
uaccagauuaauuauuga

SEQ ID NO: 1917026 - RNA, 21 nt, Shigella flexneri 2a str. 2457T
uaccagauaaucaccugccuu

SEQ ID NO: 1917027 - RNA, 23 nt, Shigella flexneri 2a str. 2457T
uaccaccaaugucgaaagcccca

SEQ ID NO: 1917028 - RNA, 17 nt, Shigella flexneri 2a str. 2457T
uaccagaccgcacaccg

SEQ ID NO: 1917029 - RNA, 18 nt, Shigella flexneri 2a str. 2457T
uaccagaccgcacaccga

SEQ ID NO: 1917030 - RNA, 17 nt, Shigella flexneri 2a str. 2457T
uaccagaccauacagug

SEQ ID NO: 1917031 - RNA, 16 nt, Shigella flexneri 2a str. 2457T
uaccagauaaacaucg

SEQ ID NO: 1917032 - RNA, 15 nt, Shigella flexneri 2a str. 2457T
uaccagaaucaccuu

SEQ ID NO: 1917033 - RNA, 19 nt, Shigella flexneri 2a str. 2457T
uacauuaucgcgucuaaau

SEQ ID NO: 1917034 - RNA, 14 nt, Shigella flexneri 2a str. 2457T
uacaucuuaaucuu

SEQ ID NO: 1917035 - RNA, 22 nt, Shigella flexneri 2a str. 2457T
uacaucuuaaucuuagguaaug

SEQ ID NO: 1917036 - RNA, 18 nt, Shigella flexneri 2a str. 2457T
uaccaaauuccagaaaag

SEQ ID NO: 1917037 - RNA, 13 nt, Shigella flexneri 2a str. 2457T
uacauacuuaaau

SEQ ID NO: 1917038 - RNA, 14 nt, Shigella flexneri 2a str. 2457T
uacauauuuuucau

SEQ ID NO: 1917039 - RNA, 14 nt, Shigella flexneri 2a str. 2457T
uacauaacgcagcg

SEQ ID NO: 1917040 - RNA, 12 nt, Shigella flexneri 2a str. 2457T
uacauacgcaaa

SEQ ID NO: 1917041 - RNA, 15 nt, Shigella flexneri 2a str. 2457T
uacauacgcaaaaaa

SEQ ID NO: 1917042 - RNA, 17 nt, Shigella flexneri 2a str. 2457T
uacauacgcaaaaaaca

SEQ ID NO: 1917043 - RNA, 20 nt, Shigella flexneri 2a str. 2457T
uacauacgcaaaaaacauug

SEQ ID NO: 1917044 - RNA, 14 nt, Shigella flexneri 2a str. 2457T
uacaucauuucaau

SEQ ID NO: 1917045 - RNA, 18 nt, Shigella flexneri 2a str. 2457T
uacaucaccguucagcuu

SEQ ID NO: 1917046 - RNA, 13 nt, Shigella flexneri 2a str. 2457T
uacaggugcucgc

SEQ ID NO: 1917047 - RNA, 21 nt, Shigella flexneri 2a str. 2457T
uaauuucacaaguugucccau

SEQ ID NO: 1917048 - RNA, 19 nt, Shigella flexneri 2a str. 2457T
uaauuucacaccaucaaca

SEQ ID NO: 1917049 - RNA, 22 nt, Shigella flexneri 2a str. 2457T
uaauuucaucugccuuauugaa

SEQ ID NO: 1917050 - RNA, 23 nt, Shigella flexneri 2a str. 2457T
uaauugccagcuugcuuuccagc

SEQ ID NO: 1917051 - RNA, 10 nt, Shigella flexneri 2a str. 2457T
uaauugcucc

SEQ ID NO: 1917052 - RNA, 20 nt, Shigella flexneri 2a str. 2457T
uaauugccggaugcgacgca

SEQ ID NO: 1917053 - RNA, 17 nt, Shigella flexneri 2a str. 2457T
uaauuuuuguuguuuaa

SEQ ID NO: 1917054 - RNA, 18 nt, Shigella flexneri 2a str. 2457T
uaauuuuucaauauccaa

SEQ ID NO: 1917055 - RNA, 22 nt, Shigella flexneri 2a str. 2457T
uacaaaaaaggccgcaggcugu

SEQ ID NO: 1917056 - RNA, 21 nt, Shigella flexneri 2a str. 2457T
uaauuuugugcagcaugcacc

SEQ ID NO: 1917057 - RNA, 18 nt, Shigella flexneri 2a str. 2457T
uacaaaauuuaacaccau

SEQ ID NO: 1917058 - RNA, 23 nt, Shigella flexneri 2a str. 2457T
uacaaaaucuugcaaauucaaua

SEQ ID NO: 1917059 - RNA, 16 nt, Shigella flexneri 2a str. 2457T
uacaaaagcaauaauu

SEQ ID NO: 1917060 - RNA, 13 nt, Shigella flexneri 2a str. 2457T
uacaaacccagcc

SEQ ID NO: 1917061 - RNA, 19 nt, Shigella flexneri 2a str. 2457T
uacaaagccaacagcagcc

SEQ ID NO: 1917062 - RNA, 16 nt, Shigella flexneri 2a str. 2457T
uacaaaguguuguucu

SEQ ID NO: 1917063 - RNA, 20 nt, Shigella flexneri 2a str. 2457T
uacaacucgcuuaagccauc

SEQ ID NO: 1917064 - RNA, 17 nt, Shigella flexneri 2a str. 2457T
uacaagaaucaugccaa

SEQ ID NO: 1917065 - RNA, 13 nt, Shigella flexneri 2a str. 2457T
uacaagcagagag

SEQ ID NO: 1917066 - RNA, 21 nt, Shigella flexneri 2a str. 2457T
uacaagaaccaaagaaaucag

SEQ ID NO: 1917067 - RNA, 21 nt, Shigella flexneri 2a str. 2457T
uacaacugccgcgccugaauc

SEQ ID NO: 1917068 - RNA, 20 nt, Shigella flexneri 2a str. 2457T
uacaacugcuuuuugcucuc

SEQ ID NO: 1917069 - RNA, 17 nt, Shigella flexneri 2a str. 2457T
uaauuccggugaaaggc

SEQ ID NO: 1917070 - RNA, 23 nt, Shigella flexneri 2a str. 2457T
uaauuacugccuuaaucaagaaa

SEQ ID NO: 1917071 - RNA, 19 nt, Shigella flexneri 2a str. 2457T
uaauuaugccgaucaucau

SEQ ID NO: 1917072 - RNA, 11 nt, Shigella flexneri 2a str. 2457T
uaauuauuaac

SEQ ID NO: 1917073 - RNA, 15 nt, Shigella flexneri 2a str. 2457T
uaauuauuaacaaaa

SEQ ID NO: 1917074 - RNA, 20 nt, Shigella flexneri 2a str. 2457T
uaauuauuuauuuuucuuga

SEQ ID NO: 1917075 - RNA, 20 nt, Shigella flexneri 2a str. 2457T
uaauuacaccaaucauucaa

SEQ ID NO: 1917076 - RNA, 14 nt, Shigella flexneri 2a str. 2457T
uaauguguucaacu

SEQ ID NO: 1917077 - RNA, 14 nt, Shigella flexneri 2a str. 2457T
uaauguuuaucuac

SEQ ID NO: 1917078 - RNA, 23 nt, Shigella flexneri 2a str. 2457T
uaauguugauccagucagugguu

SEQ ID NO: 1917079 - RNA, 15 nt, Shigella flexneri 2a str. 2457T
uaaugcugacaaaac

SEQ ID NO: 1917080 - RNA, 16 nt, Shigella flexneri 2a str. 2457T
uaaugcaaucaaaaau

SEQ ID NO: 1917081 - RNA, 18 nt, Shigella flexneri 2a str. 2457T
uaaugcaaucaaaaaugg

SEQ ID NO: 1917082 - RNA, 16 nt, Shigella flexneri 2a str. 2457T
uaaugccguuuggcaa

SEQ ID NO: 1917083 - RNA, 22 nt, Shigella flexneri 2a str. 2457T
uaaugccucuccccagcggaaa

SEQ ID NO: 1917084 - RNA, 22 nt, Shigella flexneri 2a str. 2457T
uaaugccugggcgauuuccuuc

SEQ ID NO: 1917085 - RNA, 21 nt, Shigella flexneri 2a str. 2457T
uaaugcguaacguuucuuuca

SEQ ID NO: 1917086 - RNA, 22 nt, Shigella flexneri 2a str. 2457T
uaaugauacuauaaguguaaaa

SEQ ID NO: 1917087 - RNA, 16 nt, Shigella flexneri 2a str. 2457T
uaaugauguaaaaaua

SEQ ID NO: 1917088 - RNA, 18 nt, Shigella flexneri 2a str. 2457T
uaaucgacaguugcugcg

SEQ ID NO: 1917089 - RNA, 13 nt, Shigella flexneri 2a str. 2457T
uaaucgcaauuac

SEQ ID NO: 1917090 - RNA, 21 nt, Shigella flexneri 2a str. 2457T
uaaucgccagcaaaaucacca

SEQ ID NO: 1917091 - RNA, 16 nt, Shigella flexneri 2a str. 2457T
uaaucgcacaaaauca

SEQ ID NO: 1917092 - RNA, 18 nt, Shigella flexneri 2a str. 2457T
uaaucgccagcaaaauca

SEQ ID NO: 1917093 - RNA, 15 nt, Shigella flexneri 2a str. 2457T
uaaugagauauuuaa

SEQ ID NO: 1917094 - RNA, 20 nt, Shigella flexneri 2a str. 2457T
uaaugagcaccgcaccuaaa

SEQ ID NO: 1917095 - RNA, 13 nt, Shigella flexneri 2a str. 2457T
uaauaugcugguu

SEQ ID NO: 1917096 - RNA, 16 nt, Shigella flexneri 2a str. 2457T
uaauaugcaauucaca

SEQ ID NO: 1917097 - RNA, 15 nt, Shigella flexneri 2a str. 2457T
uaauaugcaauucac

SEQ ID NO: 1917098 - RNA, 15 nt, Shigella flexneri 2a str. 2457T
uaauaucuccagcua

SEQ ID NO: 1917099 - RNA, 19 nt, Shigella flexneri 2a str. 2457T
uaauaucgcgcagaaauuc

SEQ ID NO: 1917100 - RNA, 23 nt, Shigella flexneri 2a str. 2457T
uaauauccccagccuaagccauu

SEQ ID NO: 1917101 - RNA, 23 nt, Shigella flexneri 2a str. 2457T
uaauauccugccguuuuuuauuu

SEQ ID NO: 1917102 - RNA, 15 nt, Shigella flexneri 2a str. 2457T
uaauaucaggcauuc

SEQ ID NO: 1917103 - RNA, 22 nt, Shigella flexneri 2a str. 2457T
uaauauccccagccuaagccau

SEQ ID NO: 1917104 - RNA, 19 nt, Shigella flexneri 2a str. 2457T
uaauauucagcaugcauuu

SEQ ID NO: 1917105 - RNA, 15 nt, Shigella flexneri 2a str. 2457T
uaaucaacaaaccaa

SEQ ID NO: 1917106 - RNA, 17 nt, Shigella flexneri 2a str. 2457T
uaaucaugcagcgcuua

SEQ ID NO: 1917107 - RNA, 16 nt, Shigella flexneri 2a str. 2457T
uaaucauuacaaccgc

SEQ ID NO: 1917108 - RNA, 20 nt, Shigella flexneri 2a str. 2457T
uaauccacuuucuuaaagcc

SEQ ID NO: 1917109 - RNA, 12 nt, Shigella flexneri 2a str. 2457T
uaauccacuuuc

SEQ ID NO: 1917110 - RNA, 14 nt, Shigella flexneri 2a str. 2457T
uaauccacuuucuu

SEQ ID NO: 1917111 - RNA, 19 nt, Shigella flexneri 2a str. 2457T
uaauccaggacauaucagg

SEQ ID NO: 1917112 - RNA, 21 nt, Shigella flexneri 2a str. 2457T
uaauccauaguguguuccucu

SEQ ID NO: 1917113 - RNA, 19 nt, Shigella flexneri 2a str. 2457T
uaaucccgcgcaacaaaua

SEQ ID NO: 1917114 - RNA, 15 nt, Shigella flexneri 2a str. 2457T
uaauccccaaugacc

SEQ ID NO: 1917115 - RNA, 14 nt, Shigella flexneri 2a str. 2457T
uaauccgagaaucg

SEQ ID NO: 1917116 - RNA, 19 nt, Shigella flexneri 2a str. 2457T
uaaucacauaauccagaca

SEQ ID NO: 1917117 - RNA, 16 nt, Shigella flexneri 2a str. 2457T
uaaucaccaaucacaa

SEQ ID NO: 1917118 - RNA, 18 nt, Shigella flexneri 2a str. 2457T
uaaucaccaaucacaacu

SEQ ID NO: 1917119 - RNA, 14 nt, Shigella flexneri 2a str. 2457T
uaaucaauuuaucg

SEQ ID NO: 1917120 - RNA, 14 nt, Shigella flexneri 2a str. 2457T
uaaucaauaaaaau

SEQ ID NO: 1917121 - RNA, 21 nt, Shigella flexneri 2a str. 2457T
uaaucacuucuucuuguucau

SEQ ID NO: 1917122 - RNA, 18 nt, Shigella flexneri 2a str. 2457T
uaaucagaucguugaccu

SEQ ID NO: 1917123 - RNA, 17 nt, Shigella flexneri 2a str. 2457T
uaaucagaauuuuucgc

SEQ ID NO: 1917124 - RNA, 13 nt, Shigella flexneri 2a str. 2457T
uaaucaggcuauc

SEQ ID NO: 1917125 - RNA, 15 nt, Shigella flexneri 2a str. 2457T
uaaucagcuuuucca

SEQ ID NO: 1917126 - RNA, 12 nt, Shigella flexneri 2a str. 2457T
uaaucagcacaa

SEQ ID NO: 1917127 - RNA, 19 nt, Shigella flexneri 2a str. 2457T
uaaucagcgaguuaccuua

SEQ ID NO: 1917128 - RNA, 17 nt, Shigella flexneri 2a str. 2457T
uaaucauauuaaauuuu

SEQ ID NO: 1917129 - RNA, 13 nt, Shigella flexneri 2a str. 2457T
uaauaaucaucac

SEQ ID NO: 1917130 - RNA, 14 nt, Shigella flexneri 2a str. 2457T
uaauaaucagcaca

SEQ ID NO: 1917131 - RNA, 22 nt, Shigella flexneri 2a str. 2457T
uaauaaugagcagaaaaaccgu

SEQ ID NO: 1917132 - RNA, 22 nt, Shigella flexneri 2a str. 2457T
uaauaagcgcaaggguaaacgu

SEQ ID NO: 1917133 - RNA, 17 nt, Shigella flexneri 2a str. 2457T
uaauacacuaacagaac

SEQ ID NO: 1917134 - RNA, 20 nt, Shigella flexneri 2a str. 2457T
uaauaccagccuucuucauc

SEQ ID NO: 1917135 - RNA, 14 nt, Shigella flexneri 2a str. 2457T
uaauaccagccuuc

SEQ ID NO: 1917136 - RNA, 23 nt, Shigella flexneri 2a str. 2457T
uaauaccgacuucggccagugcu

SEQ ID NO: 1917137 - RNA, 22 nt, Shigella flexneri 2a str. 2457T
uaauaccgacuccguagaaccu

SEQ ID NO: 1917138 - RNA, 17 nt, Shigella flexneri 2a str. 2457T
uaauaauucaaaaaccu

SEQ ID NO: 1917139 - RNA, 14 nt, Shigella flexneri 2a str. 2457T
uaauaauuucugca

SEQ ID NO: 1917140 - RNA, 23 nt, Shigella flexneri 2a str. 2457T
uaauaguauuaagccaguucuca

SEQ ID NO: 1917141 - RNA, 18 nt, Shigella flexneri 2a str. 2457T
uaauaguauuaagccagu

SEQ ID NO: 1917142 - RNA, 14 nt, Shigella flexneri 2a str. 2457T
uaauagguaaacau

SEQ ID NO: 1917143 - RNA, 12 nt, Shigella flexneri 2a str. 2457T
uaauauaaauuc

SEQ ID NO: 1917144 - RNA, 13 nt, Shigella flexneri 2a str. 2457T
uaauaguuucuga

SEQ ID NO: 1917145 - RNA, 20 nt, Shigella flexneri 2a str. 2457T
uaauagaacuauaauugcuu

SEQ ID NO: 1917146 - RNA, 18 nt, Shigella flexneri 2a str. 2457T
uaauagauccuuuuuccc

SEQ ID NO: 1917147 - RNA, 15 nt, Shigella flexneri 2a str. 2457T
uaauagaacuauaau

SEQ ID NO: 1917148 - RNA, 23 nt, Shigella flexneri 2a str. 2457T
uaacucaauaccugaugagaugc

SEQ ID NO: 1917149 - RNA, 24 nt, Shigella flexneri 2a str. 2457T
uaacucaauaccugaugagaugcu

SEQ ID NO: 1917150 - RNA, 15 nt, Shigella flexneri 2a str. 2457T
uaacucagcauuauu

SEQ ID NO: 1917151 - RNA, 20 nt, Shigella flexneri 2a str. 2457T
uaacucaaaaauaaucaucu

SEQ ID NO: 1917152 - RNA, 23 nt, Shigella flexneri 2a str. 2457T
uaacuauuguuuugaugaaucag

SEQ ID NO: 1917153 - RNA, 23 nt, Shigella flexneri 2a str. 2457T
uaacuccuucuaaagcaacucca

SEQ ID NO: 1917154 - RNA, 22 nt, Shigella flexneri 2a str. 2457T
uaacuccuucuaaagcaacucc

SEQ ID NO: 1917155 - RNA, 19 nt, Shigella flexneri 2a str. 2457T
uaacuccccgagaaauacu

SEQ ID NO: 1917156 - RNA, 15 nt, Shigella flexneri 2a str. 2457T
uaacucauauaacgc

SEQ ID NO: 1917157 - RNA, 19 nt, Shigella flexneri 2a str. 2457T
uaacucuuugaugaaacau

SEQ ID NO: 1917158 - RNA, 20 nt, Shigella flexneri 2a str. 2457T
uaacucucuuuugcuugaca

SEQ ID NO: 1917159 - RNA, 13 nt, Shigella flexneri 2a str. 2457T
uaacguuuuuaaa

SEQ ID NO: 1917160 - RNA, 14 nt, Shigella flexneri 2a str. 2457T
uaacguuuuuaaaa

SEQ ID NO: 1917161 - RNA, 20 nt, Shigella flexneri 2a str. 2457T
uaacguuucuuucaucaggu

SEQ ID NO: 1917162 - RNA, 19 nt, Shigella flexneri 2a str. 2457T
uaacguugaaccgccccac

SEQ ID NO: 1917163 - RNA, 15 nt, Shigella flexneri 2a str. 2457T
uaacuacaaucacga

SEQ ID NO: 1917164 - RNA, 22 nt, Shigella flexneri 2a str. 2457T
uaacuacccaaccgauaaccac

SEQ ID NO: 1917165 - RNA, 23 nt, Shigella flexneri 2a str. 2457T
uaacguggugaaagcauagcucg

SEQ ID NO: 1917166 - RNA, 18 nt, Shigella flexneri 2a str. 2457T
uaacgugucauaacuggu

SEQ ID NO: 1917167 - RNA, 15 nt, Shigella flexneri 2a str. 2457T
uaacgucaccauccc

SEQ ID NO: 1917168 - RNA, 19 nt, Shigella flexneri 2a str. 2457T
uaacgucgguuucaucaca

SEQ ID NO: 1917169 - RNA, 13 nt, Shigella flexneri 2a str. 2457T
uaacugugccaaa

SEQ ID NO: 1917170 - RNA, 16 nt, Shigella flexneri 2a str. 2457T
uaacuguucugaaaac

SEQ ID NO: 1917171 - RNA, 19 nt, Shigella flexneri 2a str. 2457T
uaacuguggcguuauggca

SEQ ID NO: 1917172 - RNA, 12 nt, Shigella flexneri 2a str. 2457T
uaacuucaucag

SEQ ID NO: 1917173 - RNA, 15 nt, Shigella flexneri 2a str. 2457T
uaacuucaucagcaa

SEQ ID NO: 1917174 - RNA, 16 nt, Shigella flexneri 2a str. 2457T
uaacuuaauaaacauc

SEQ ID NO: 1917175 - RNA, 13 nt, Shigella flexneri 2a str. 2457T
uaacuuaauguca

SEQ ID NO: 1917176 - RNA, 19 nt, Shigella flexneri 2a str. 2457T
aaaucccgcuucaacgacc

SEQ ID NO: 1917177 - RNA, 19 nt, Shigella flexneri 2a str. 2457T
uaacugcguuucuggcuua

SEQ ID NO: 1917178 - RNA, 15 nt, Shigella flexneri 2a str. 2457T
uaacugcugcucaau

SEQ ID NO: 1917179 - RNA, 14 nt, Shigella flexneri 2a str. 2457T
aaaucccagugccu

SEQ ID NO: 1917180 - RNA, 22 nt, Shigella flexneri 2a str. 2457T
uaacugacuuucguuugaaaac

SEQ ID NO: 1917181 - RNA, 18 nt, Shigella flexneri 2a str. 2457T
uaagaucaucggccagau

SEQ ID NO: 1917182 - RNA, 15 nt, Shigella flexneri 2a str. 2457T
uaagaugcgccagca

SEQ ID NO: 1917183 - RNA, 23 nt, Shigella flexneri 2a str. 2457T
uaagauaaauuccugcuuauugu

SEQ ID NO: 1917184 - RNA, 16 nt, Shigella flexneri 2a str. 2457T
uaagacgcgccagcgu

SEQ ID NO: 1917185 - RNA, 14 nt, Shigella flexneri 2a str. 2457T
uaagacaauugaug

SEQ ID NO: 1917186 - RNA, 23 nt, Shigella flexneri 2a str. 2457T
uaagacaccccacagcucuugcu

SEQ ID NO: 1917187 - RNA, 15 nt, Shigella flexneri 2a str. 2457T
uaagaguuucaacau

SEQ ID NO: 1917188 - RNA, 22 nt, Shigella flexneri 2a str. 2457T
uaagagcuggcaucagcaaaca

SEQ ID NO: 1917189 - RNA, 20 nt, Shigella flexneri 2a str. 2457T
uaagacuuuuuucaugggua

SEQ ID NO: 1917190 - RNA, 18 nt, Shigella flexneri 2a str. 2457T
uaagacuuaccagcccua

SEQ ID NO: 1917191 - RNA, 23 nt, Shigella flexneri 2a str. 2457T
uaacuucuuuacuggcuuucauu

SEQ ID NO: 1917192 - RNA, 22 nt, Shigella flexneri 2a str. 2457T
uaacuucuuuacuggcuuucau

SEQ ID NO: 1917193 - RNA, 21 nt, Shigella flexneri 2a str. 2457T
uaacuuuaauuuugugcagca

SEQ ID NO: 1917194 - RNA, 16 nt, Shigella flexneri 2a str. 2457T
uaagaagggcuggcca

SEQ ID NO: 1917195 - RNA, 16 nt, Shigella flexneri 2a str. 2457T
uaagaauugauaaaaa

SEQ ID NO: 1917196 - RNA, 22 nt, Shigella flexneri 2a str. 2457T
uaagaauguccauuauuucaau

SEQ ID NO: 1917197 - RNA, 13 nt, Shigella flexneri 2a str. 2457T
uaagaauuuuaua

SEQ ID NO: 1917198 - RNA, 18 nt, Shigella flexneri 2a str. 2457T
uaagaauugauaaaaaaa

SEQ ID NO: 1917199 - RNA, 17 nt, Shigella flexneri 2a str. 2457T
uaagaaugcgaaaacga

SEQ ID NO: 1917200 - RNA, 17 nt, Shigella flexneri 2a str. 2457T
uaagaaaguggcaggcu

SEQ ID NO: 1917201 - RNA, 14 nt, Shigella flexneri 2a str. 2457T
uaagcguagcgcau

SEQ ID NO: 1917202 - RNA, 22 nt, Shigella flexneri 2a str. 2457T
uaagcguaagcgcauccggcac

SEQ ID NO: 1917203 - RNA, 14 nt, Shigella flexneri 2a str. 2457T
uaagcgccaccguc

SEQ ID NO: 1917204 - RNA, 20 nt, Shigella flexneri 2a str. 2457T
uaagcuuuccggcaucacau

SEQ ID NO: 1917205 - RNA, 18 nt, Shigella flexneri 2a str. 2457T
uaagcugucgaaaagaua

SEQ ID NO: 1917206 - RNA, 17 nt, Shigella flexneri 2a str. 2457T
uaagcuggguaaaugca

SEQ ID NO: 1917207 - RNA, 22 nt, Shigella flexneri 2a str. 2457T
uaagcugucacguuuugugaug

SEQ ID NO: 1917208 - RNA, 15 nt, Shigella flexneri 2a str. 2457T
uaaggcuguucccac

SEQ ID NO: 1917209 - RNA, 14 nt, Shigella flexneri 2a str. 2457T
uaaggcgcaauaau

SEQ ID NO: 1917210 - RNA, 17 nt, Shigella flexneri 2a str. 2457T
uaaggcaacgccccuuc

SEQ ID NO: 1917211 - RNA, 14 nt, Shigella flexneri 2a str. 2457T
uaaggcaagaaaau

SEQ ID NO: 1917212 - RNA, 12 nt, Shigella flexneri 2a str. 2457T
uaaggauaaaaa

SEQ ID NO: 1917213 - RNA, 17 nt, Shigella flexneri 2a str. 2457T
uaaggaaacuccagccc

SEQ ID NO: 1917214 - RNA, 20 nt, Shigella flexneri 2a str. 2457T
uaaggaaaauaaucaugcag

SEQ ID NO: 1917215 - RNA, 17 nt, Shigella flexneri 2a str. 2457T
uaagcaucuauuauugu

SEQ ID NO: 1917216 - RNA, 19 nt, Shigella flexneri 2a str. 2457T
uaagcacuacucuauacag

SEQ ID NO: 1917217 - RNA, 20 nt, Shigella flexneri 2a str. 2457T
uaagcacuacucuauacagg

SEQ ID NO: 1917218 - RNA, 18 nt, Shigella flexneri 2a str. 2457T
uaagcaggcuggcuacga

SEQ ID NO: 1917219 - RNA, 16 nt, Shigella flexneri 2a str. 2457T
uaagcagccaucugau

SEQ ID NO: 1917220 - RNA, 21 nt, Shigella flexneri 2a str. 2457T
uaagcaacugacuggcucuuu

SEQ ID NO: 1917221 - RNA, 14 nt, Shigella flexneri 2a str. 2457T
uaagcaaaaaaaca

SEQ ID NO: 1917222 - RNA, 14 nt, Shigella flexneri 2a str. 2457T
uaagcaaaggugcc

SEQ ID NO: 1917223 - RNA, 14 nt, Shigella flexneri 2a str. 2457T
uaagcgcagcgcau

SEQ ID NO: 1917224 - RNA, 14 nt, Shigella flexneri 2a str. 2457T
uaagcgcaaaggcc

SEQ ID NO: 1917225 - RNA, 21 nt, Shigella flexneri 2a str. 2457T
uaagccgccacgaccugcaga

SEQ ID NO: 1917226 - RNA, 14 nt, Shigella flexneri 2a str. 2457T
uaagccgugcauag

SEQ ID NO: 1917227 - RNA, 18 nt, Shigella flexneri 2a str. 2457T
uaagcauuuagcgccggg

SEQ ID NO: 1917228 - RNA, 23 nt, Shigella flexneri 2a str. 2457T
uaagccaagcgccgccucagcca

SEQ ID NO: 1917229 - RNA, 23 nt, Shigella flexneri 2a str. 2457T
uaagccagaccacccguaauccc

SEQ ID NO: 1917230 - RNA, 20 nt, Shigella flexneri 2a str. 2457T
uaagcccagaacaaauaaau

SEQ ID NO: 1917231 - RNA, 19 nt, Shigella flexneri 2a str. 2457T
uaagguaucgcgaaaaaaa

SEQ ID NO: 1917232 - RNA, 21 nt, Shigella flexneri 2a str. 2457T
uaagguaucgcgaaaaaaaga

SEQ ID NO: 1917233 - RNA, 16 nt, Shigella flexneri 2a str. 2457T
uaagguccuccagcuc

SEQ ID NO: 1917234 - RNA, 21 nt, Shigella flexneri 2a str. 2457T
uaaggucagacgaagucaaca

SEQ ID NO: 1917235 - RNA, 16 nt, Shigella flexneri 2a str. 2457T
uaagggcugacaguug

SEQ ID NO: 1917236 - RNA, 17 nt, Shigella flexneri 2a str. 2457T
uaaggguauagaagcca

SEQ ID NO: 1917237 - RNA, 23 nt, Shigella flexneri 2a str. 2457T
uaagggugucuguuaaucgcauu

SEQ ID NO: 1917238 - RNA, 14 nt, Shigella flexneri 2a str. 2457T
uaaggguaaaagga

SEQ ID NO: 1917239 - RNA, 13 nt, Shigella flexneri 2a str. 2457T
uaaguaagcaaca

SEQ ID NO: 1917240 - RNA, 16 nt, Shigella flexneri 2a str. 2457T
uaaguaaugaacuccg

SEQ ID NO: 1917241 - RNA, 20 nt, Shigella flexneri 2a str. 2457T
uaaggugguagcugcccccg

SEQ ID NO: 1917242 - RNA, 21 nt, Shigella flexneri 2a str. 2457T
uaagucuggcacgaccgccuu

SEQ ID NO: 1917243 - RNA, 15 nt, Shigella flexneri 2a str. 2457T
uaaguccgaacuaaa

SEQ ID NO: 1917244 - RNA, 14 nt, Shigella flexneri 2a str. 2457T
uaaguacauuaaaa

SEQ ID NO: 1917245 - RNA, 16 nt, Shigella flexneri 2a str. 2457T
uaaguacauuaaaauu

SEQ ID NO: 1917246 - RNA, 23 nt, Shigella flexneri 2a str. 2457T
uaagugauggcgauuauaugagg

SEQ ID NO: 1917247 - RNA, 17 nt, Shigella flexneri 2a str. 2457T
uaaguggggguuuuauu

SEQ ID NO: 1917248 - RNA, 20 nt, Shigella flexneri 2a str. 2457T
uaaguggggguuuuauuuaa

SEQ ID NO: 1917249 - RNA, 15 nt, Shigella flexneri 2a str. 2457T
uaaguguaaaauucu

SEQ ID NO: 1917250 - RNA, 22 nt, Shigella flexneri 2a str. 2457T
uaaguguccgccaauuucauca

SEQ ID NO: 1917251 - RNA, 22 nt, Shigella flexneri 2a str. 2457T
uaaguguuucacuuucaucacc

SEQ ID NO: 1917252 - RNA, 14 nt, Shigella flexneri 2a str. 2457T
uaaguugaaucggc

SEQ ID NO: 1917253 - RNA, 17 nt, Shigella flexneri 2a str. 2457T
uaaguugccacgcuuca

SEQ ID NO: 1917254 - RNA, 20 nt, Shigella flexneri 2a str. 2457T
uaaguuaauucugagagcau

SEQ ID NO: 1917255 - RNA, 15 nt, Shigella flexneri 2a str. 2457T
uaaguuacacaucau

SEQ ID NO: 1917256 - RNA, 21 nt, Shigella flexneri 2a str. 2457T
uaaguuagucgcuuucauuca

SEQ ID NO: 1917257 - RNA, 13 nt, Shigella flexneri 2a str. 2457T
uaauaacacauau

SEQ ID NO: 1917258 - RNA, 23 nt, Shigella flexneri 2a str. 2457T
uaauaacagggaaugugaugaaa

SEQ ID NO: 1917259 - RNA, 13 nt, Shigella flexneri 2a str. 2457T
uaauaaauuaacu

SEQ ID NO: 1917260 - RNA, 13 nt, Shigella flexneri 2a str. 2457T
uaauaaauauuaa

SEQ ID NO: 1917261 - RNA, 11 nt, Shigella flexneri 2a str. 2457T
uaauaaagcgg

SEQ ID NO: 1917262 - RNA, 13 nt, Shigella flexneri 2a str. 2457T
uaauaaaaauuuu

SEQ ID NO: 1917263 - RNA, 13 nt, Shigella flexneri 2a str. 2457T
uaaauuccacgcg

SEQ ID NO: 1917264 - RNA, 21 nt, Shigella flexneri 2a str. 2457T
uaaauucgcugcggacaaaac

SEQ ID NO: 1917265 - RNA, 15 nt, Shigella flexneri 2a str. 2457T
uaaauuccuaaaguu

SEQ ID NO: 1917266 - RNA, 17 nt, Shigella flexneri 2a str. 2457T
uaaauuccuaaaguugu

SEQ ID NO: 1917267 - RNA, 15 nt, Shigella flexneri 2a str. 2457T
uaaauucuucugaau

SEQ ID NO: 1917268 - RNA, 21 nt, Shigella flexneri 2a str. 2457T
uaaauucccgcagauaaauau

SEQ ID NO: 1917269 - RNA, 20 nt, Shigella flexneri 2a str. 2457T
uaaaucccgccgcuucacca

SEQ ID NO: 1917270 - RNA, 14 nt, Shigella flexneri 2a str. 2457T
uaaaucccagugcc

SEQ ID NO: 1917271 - RNA, 15 nt, Shigella flexneri 2a str. 2457T
uaaauccuuuguaca

SEQ ID NO: 1917272 - RNA, 15 nt, Shigella flexneri 2a str. 2457T
uaaaucgccaugguc

SEQ ID NO: 1917273 - RNA, 18 nt, Shigella flexneri 2a str. 2457T
uaaaugcugcagccaggg

SEQ ID NO: 1917274 - RNA, 18 nt, Shigella flexneri 2a str. 2457T
uaacaauuuaucagacaa

SEQ ID NO: 1917275 - RNA, 13 nt, Shigella flexneri 2a str. 2457T
uaacaauacaucu

SEQ ID NO: 1917276 - RNA, 14 nt, Shigella flexneri 2a str. 2457T
uaacaauuuaucag

SEQ ID NO: 1917277 - RNA, 14 nt, Shigella flexneri 2a str. 2457T
uaacacacaauuac

SEQ ID NO: 1917278 - RNA, 13 nt, Shigella flexneri 2a str. 2457T
uaacaccaucagu

SEQ ID NO: 1917279 - RNA, 15 nt, Shigella flexneri 2a str. 2457T
uaacaccaucauauu

SEQ ID NO: 1917280 - RNA, 15 nt, Shigella flexneri 2a str. 2457T
uaacaccgauuuugu

SEQ ID NO: 1917281 - RNA, 20 nt, Shigella flexneri 2a str. 2457T
uaaauuuucccgucaaagag

SEQ ID NO: 1917282 - RNA, 16 nt, Shigella flexneri 2a str. 2457T
uaacaacguuuuucua

SEQ ID NO: 1917283 - RNA, 19 nt, Shigella flexneri 2a str. 2457T
uaacaacguuuuucuaagc

SEQ ID NO: 1917284 - RNA, 16 nt, Shigella flexneri 2a str. 2457T
uaaccguccaguugug

SEQ ID NO: 1917285 - RNA, 14 nt, Shigella flexneri 2a str. 2457T
uaaccguugaccag

SEQ ID NO: 1917286 - RNA, 13 nt, Shigella flexneri 2a str. 2457T
uaaccguuuugug

SEQ ID NO: 1917287 - RNA, 22 nt, Shigella flexneri 2a str. 2457T
uaaccggaggauaugcaucaug

SEQ ID NO: 1917288 - RNA, 21 nt, Shigella flexneri 2a str. 2457T
uaaccgguacgccgcguuuau

SEQ ID NO: 1917289 - RNA, 14 nt, Shigella flexneri 2a str. 2457T
uaacgcaagugauc

SEQ ID NO: 1917290 - RNA, 17 nt, Shigella flexneri 2a str. 2457T
uaacgcacacauccaca

SEQ ID NO: 1917291 - RNA, 22 nt, Shigella flexneri 2a str. 2457T
uaacgauuuggccgaagaggaa

SEQ ID NO: 1917292 - RNA, 23 nt, Shigella flexneri 2a str. 2457T
uaacgcagaaucuucuucucagc

SEQ ID NO: 1917293 - RNA, 20 nt, Shigella flexneri 2a str. 2457T
uaacgcagaaucuucuucuc

SEQ ID NO: 1917294 - RNA, 21 nt, Shigella flexneri 2a str. 2457T
uaacgccaauucauuccuuga

SEQ ID NO: 1917295 - RNA, 22 nt, Shigella flexneri 2a str. 2457T
uaacgcaucggcuaaaccauca

SEQ ID NO: 1917296 - RNA, 14 nt, Shigella flexneri 2a str. 2457T
uaacgccagacucg

SEQ ID NO: 1917297 - RNA, 19 nt, Shigella flexneri 2a str. 2457T
uaacgccaugagcggacug

SEQ ID NO: 1917298 - RNA, 18 nt, Shigella flexneri 2a str. 2457T
uaacgcuggcagcaagug

SEQ ID NO: 1917299 - RNA, 17 nt, Shigella flexneri 2a str. 2457T
uaacgcuucucccagcc

SEQ ID NO: 1917300 - RNA, 21 nt, Shigella flexneri 2a str. 2457T
uaacgccggagagaaaaaccu

SEQ ID NO: 1917301 - RNA, 17 nt, Shigella flexneri 2a str. 2457T
uaacgccuuuuccagcg

SEQ ID NO: 1917302 - RNA, 21 nt, Shigella flexneri 2a str. 2457T
uaacgccguuauuaaaaagcc

SEQ ID NO: 1917303 - RNA, 14 nt, Shigella flexneri 2a str. 2457T
uaacggccugacca

SEQ ID NO: 1917304 - RNA, 22 nt, Shigella flexneri 2a str. 2457T
uaacggcagaagcugcaggacc

SEQ ID NO: 1917305 - RNA, 23 nt, Shigella flexneri 2a str. 2457T
uaacggaacguugccugauuuua

SEQ ID NO: 1917306 - RNA, 21 nt, Shigella flexneri 2a str. 2457T
uaacgguaaagcccucaccga

SEQ ID NO: 1917307 - RNA, 17 nt, Shigella flexneri 2a str. 2457T
uaacgguaucuuuccag

SEQ ID NO: 1917308 - RNA, 19 nt, Shigella flexneri 2a str. 2457T
uaacggucgguuagaacaa

SEQ ID NO: 1917309 - RNA, 18 nt, Shigella flexneri 2a str. 2457T
uaacgguguaaugccagu

SEQ ID NO: 1917310 - RNA, 12 nt, Shigella flexneri 2a str. 2457T
uaaccaucccuu

SEQ ID NO: 1917311 - RNA, 21 nt, Shigella flexneri 2a str. 2457T
uaacccgcagcuuaaugaacu

SEQ ID NO: 1917312 - RNA, 18 nt, Shigella flexneri 2a str. 2457T
uaacccggcaccaacaaa

SEQ ID NO: 1917313 - RNA, 23 nt, Shigella flexneri 2a str. 2457T
uaacccgugggacaaagacaauu

SEQ ID NO: 1917314 - RNA, 14 nt, Shigella flexneri 2a str. 2457T
uaaccauaaccaau

SEQ ID NO: 1917315 - RNA, 16 nt, Shigella flexneri 2a str. 2457T
uaaccaucuucuucac

SEQ ID NO: 1917316 - RNA, 15 nt, Shigella flexneri 2a str. 2457T
uaaccaucgcacagc

SEQ ID NO: 1917317 - RNA, 15 nt, Shigella flexneri 2a str. 2457T
uaaccaucagcucug

SEQ ID NO: 1917318 - RNA, 16 nt, Shigella flexneri 2a str. 2457T
uaaccacgcucagcaa

SEQ ID NO: 1917319 - RNA, 20 nt, Shigella flexneri 2a str. 2457T
uaaccagaugucgcgcacug

SEQ ID NO: 1917320 - RNA, 12 nt, Shigella flexneri 2a str. 2457T
uaaccagcacca

SEQ ID NO: 1917321 - RNA, 23 nt, Shigella flexneri 2a str. 2457T
uaaccagccuggcggaaagccag

SEQ ID NO: 1917322 - RNA, 20 nt, Shigella flexneri 2a str. 2457T
uaaccagcgcagacaccaga

SEQ ID NO: 1917323 - RNA, 21 nt, Shigella flexneri 2a str. 2457T
uaaccagcguuuccagcacca

SEQ ID NO: 1917324 - RNA, 13 nt, Shigella flexneri 2a str. 2457T
uaacauggcggua

SEQ ID NO: 1917325 - RNA, 18 nt, Shigella flexneri 2a str. 2457T
uaaccaccaguaaauugu

SEQ ID NO: 1917326 - RNA, 10 nt, Shigella flexneri 2a str. 2457T
uaacauccag

SEQ ID NO: 1917327 - RNA, 19 nt, Shigella flexneri 2a str. 2457T
uaacaucgccagaaaucag

SEQ ID NO: 1917328 - RNA, 20 nt, Shigella flexneri 2a str. 2457T
uaacaucgccagaaaucagc

SEQ ID NO: 1917329 - RNA, 23 nt, Shigella flexneri 2a str. 2457T
uaacagaaugcgggcgaaaacau

SEQ ID NO: 1917330 - RNA, 13 nt, Shigella flexneri 2a str. 2457T
uaacacugauaac

SEQ ID NO: 1917331 - RNA, 17 nt, Shigella flexneri 2a str. 2457T
uaacacgcucuggcagg

SEQ ID NO: 1917332 - RNA, 21 nt, Shigella flexneri 2a str. 2457T
uaacacuuguuaugagauaau

SEQ ID NO: 1917333 - RNA, 16 nt, Shigella flexneri 2a str. 2457T
uaaaucaucggguuac

SEQ ID NO: 1917334 - RNA, 18 nt, Shigella flexneri 2a str. 2457T
uaaaucaucggguuacug

SEQ ID NO: 1917335 - RNA, 15 nt, Shigella flexneri 2a str. 2457T
uaaaucacgcuuauc

SEQ ID NO: 1917336 - RNA, 18 nt, Shigella flexneri 2a str. 2457T
uaaauauuaauacaacaa

SEQ ID NO: 1917337 - RNA, 21 nt, Shigella flexneri 2a str. 2457T
uaaauaacuggugcuaacagc

SEQ ID NO: 1917338 - RNA, 16 nt, Shigella flexneri 2a str. 2457T
uaaauaaaaagagauu

SEQ ID NO: 1917339 - RNA, 14 nt, Shigella flexneri 2a str. 2457T
uaaaguuuuauccc

SEQ ID NO: 1917340 - RNA, 12 nt, Shigella flexneri 2a str. 2457T
uaaauaguggca

SEQ ID NO: 1917341 - RNA, 18 nt, Shigella flexneri 2a str. 2457T
uaaauauauaaaaaaaca

SEQ ID NO: 1917342 - RNA, 19 nt, Shigella flexneri 2a str. 2457T
uaaaguugcucucaaagac

SEQ ID NO: 1917343 - RNA, 20 nt, Shigella flexneri 2a str. 2457T
uaaaguuaccuucgaagaac

SEQ ID NO: 1917344 - RNA, 14 nt, Shigella flexneri 2a str. 2457T
uaaaguuagucgcg

SEQ ID NO: 1917345 - RNA, 15 nt, Shigella flexneri 2a str. 2457T
uaaagugcaaaaauu

SEQ ID NO: 1917346 - RNA, 20 nt, Shigella flexneri 2a str. 2457T
uaaaguggcggggaucacuc

SEQ ID NO: 1917347 - RNA, 16 nt, Shigella flexneri 2a str. 2457T
uaaagucuuuguauuu

SEQ ID NO: 1917348 - RNA, 23 nt, Shigella flexneri 2a str. 2457T
uaaaguacguguggucuuuucaa

SEQ ID NO: 1917349 - RNA, 15 nt, Shigella flexneri 2a str. 2457T
uaaaguagaaauuau

SEQ ID NO: 1917350 - RNA, 19 nt, Shigella flexneri 2a str. 2457T
uaaaguagaaauuauuucu

SEQ ID NO: 1917351 - RNA, 21 nt, Shigella flexneri 2a str. 2457T
uaaaguaggccagauaagacg

SEQ ID NO: 1917352 - RNA, 21 nt, Shigella flexneri 2a str. 2457T
uaaagcaucaauugcuaccga

SEQ ID NO: 1917353 - RNA, 19 nt, Shigella flexneri 2a str. 2457T
uaaagcaucugccagccau

SEQ ID NO: 1917354 - RNA, 15 nt, Shigella flexneri 2a str. 2457T
uaaaggaaaguaaau

SEQ ID NO: 1917355 - RNA, 16 nt, Shigella flexneri 2a str. 2457T
uaaaggaaaguaaauu

SEQ ID NO: 1917356 - RNA, 23 nt, Shigella flexneri 2a str. 2457T
uaaagcugcggauccugagcaaa

SEQ ID NO: 1917357 - RNA, 18 nt, Shigella flexneri 2a str. 2457T
uaaagcugccgucaauuu

SEQ ID NO: 1917358 - RNA, 21 nt, Shigella flexneri 2a str. 2457T
guuuuucaucgcuaauaauaa

SEQ ID NO: 1917359 - RNA, 22 nt, Shigella flexneri 2a str. 2457T
guuuuucaucgcuaauaauaag

SEQ ID NO: 1917360 - RNA, 16 nt, Shigella flexneri 2a str. 2457T
guuuuuccaaaacugg

SEQ ID NO: 1917361 - RNA, 22 nt, Shigella flexneri 2a str. 2457T
guuuuucauugcacucuccucc

SEQ ID NO: 1917362 - RNA, 19 nt, Shigella flexneri 2a str. 2457T
guuuuucagcgccagcgcg

SEQ ID NO: 1917363 - RNA, 22 nt, Shigella flexneri 2a str. 2457T
guuuuucaguagacucaagcag

SEQ ID NO: 1917364 - RNA, 15 nt, Shigella flexneri 2a str. 2457T
guuuuuaucuucaca

SEQ ID NO: 1917365 - RNA, 15 nt, Shigella flexneri 2a str. 2457T
guuuuuauuuugccc

SEQ ID NO: 1917366 - RNA, 20 nt, Shigella flexneri 2a str. 2457T
guuuuggccgugaauuacug

SEQ ID NO: 1917367 - RNA, 17 nt, Shigella flexneri 2a str. 2457T
uaaacaagguuugaaaa

SEQ ID NO: 1917368 - RNA, 15 nt, Shigella flexneri 2a str. 2457T
uaaaccacccaccag

SEQ ID NO: 1917369 - RNA, 23 nt, Shigella flexneri 2a str. 2457T
uaaaccacugacacaggcagcaa

SEQ ID NO: 1917370 - RNA, 14 nt, Shigella flexneri 2a str. 2457T
uaaaccacagaccg

SEQ ID NO: 1917371 - RNA, 20 nt, Shigella flexneri 2a str. 2457T
uaaaccacccaccagcgccg

SEQ ID NO: 1917372 - RNA, 17 nt, Shigella flexneri 2a str. 2457T
uaaaccgcucgucacau

SEQ ID NO: 1917373 - RNA, 18 nt, Shigella flexneri 2a str. 2457T
uaaaccuaaaaagaaaau

SEQ ID NO: 1917374 - RNA, 13 nt, Shigella flexneri 2a str. 2457T
uaaaccuccagca

SEQ ID NO: 1917375 - RNA, 17 nt, Shigella flexneri 2a str. 2457T
uaaaccuccagcaucag

SEQ ID NO: 1917376 - RNA, 16 nt, Shigella flexneri 2a str. 2457T
uaaaccgucagcacca

SEQ ID NO: 1917377 - RNA, 21 nt, Shigella flexneri 2a str. 2457T
uaaacgccugcuuaucgcccu

SEQ ID NO: 1917378 - RNA, 17 nt, Shigella flexneri 2a str. 2457T
uaaacgccguucuucag

SEQ ID NO: 1917379 - RNA, 14 nt, Shigella flexneri 2a str. 2457T
uaaacgcuggcagg

SEQ ID NO: 1917380 - RNA, 19 nt, Shigella flexneri 2a str. 2457T
uaaacgccugcuuaucgcc

SEQ ID NO: 1917381 - RNA, 12 nt, Shigella flexneri 2a str. 2457T
uaaacuccuuuc

SEQ ID NO: 1917382 - RNA, 20 nt, Shigella flexneri 2a str. 2457T
uaaacgcuuuuuugagcagc

SEQ ID NO: 1917383 - RNA, 19 nt, Shigella flexneri 2a str. 2457T
uaaacggcugggaaaucac

SEQ ID NO: 1917384 - RNA, 13 nt, Shigella flexneri 2a str. 2457T
uaaacuggcugug

SEQ ID NO: 1917385 - RNA, 14 nt, Shigella flexneri 2a str. 2457T
uaaacugagccaaa

SEQ ID NO: 1917386 - RNA, 20 nt, Shigella flexneri 2a str. 2457T
gcugauauucgacaccaucu

SEQ ID NO: 1917387 - RNA, 11 nt, Shigella flexneri 2a str. 2457T
gcugagauacu

SEQ ID NO: 1917388 - RNA, 14 nt, Shigella flexneri 2a str. 2457T
gcugagcacuaucc

SEQ ID NO: 1917389 - RNA, 15 nt, Shigella flexneri 2a str. 2457T
gcugaugucagcacu

SEQ ID NO: 1917390 - RNA, 21 nt, Shigella flexneri 2a str. 2457T
gcugauuucaccccacaccac

SEQ ID NO: 1917391 - RNA, 14 nt, Shigella flexneri 2a str. 2457T
gcugauuucaccau

SEQ ID NO: 1917392 - RNA, 15 nt, Shigella flexneri 2a str. 2457T
gcugauugcggagaa

SEQ ID NO: 1917393 - RNA, 20 nt, Shigella flexneri 2a str. 2457T
gcugauucucccucaucauu

SEQ ID NO: 1917394 - RNA, 19 nt, Shigella flexneri 2a str. 2457T
gcugauuaugucaucaucg

SEQ ID NO: 1917395 - RNA, 22 nt, Shigella flexneri 2a str. 2457T
gcugccacauugcguccaggcc

SEQ ID NO: 1917396 - RNA, 18 nt, Shigella flexneri 2a str. 2457T
gcugcaaagcauuuuuuc

SEQ ID NO: 1917397 - RNA, 21 nt, Shigella flexneri 2a str. 2457T
gcugcaaagcauuuuuucaca

SEQ ID NO: 1917398 - RNA, 12 nt, Shigella flexneri 2a str. 2457T
gcugauuuuucu

SEQ ID NO: 1917399 - RNA, 18 nt, Shigella flexneri 2a str. 2457T
gcugcaaggugaaagcaa

SEQ ID NO: 1917400 - RNA, 13 nt, Shigella flexneri 2a str. 2457T
gcugcaauaaaau

SEQ ID NO: 1917401 - RNA, 22 nt, Shigella flexneri 2a str. 2457T
gcugcaauaaaauaucuuccac

SEQ ID NO: 1917402 - RNA, 15 nt, Shigella flexneri 2a str. 2457T
gcugacgcaucuucu

SEQ ID NO: 1917403 - RNA, 17 nt, Shigella flexneri 2a str. 2457T
gcugacgcaucuucucc

SEQ ID NO: 1917404 - RNA, 19 nt, Shigella flexneri 2a str. 2457T
gcugacgauuguagaaaau

SEQ ID NO: 1917405 - RNA, 22 nt, Shigella flexneri 2a str. 2457T
gcugacgcaacugguccagccc

SEQ ID NO: 1917406 - RNA, 12 nt, Shigella flexneri 2a str. 2457T
gcugagaaaaag

SEQ ID NO: 1917407 - RNA, 20 nt, Shigella flexneri 2a str. 2457T
gcugaccgucaaagcgccag

SEQ ID NO: 1917408 - RNA, 22 nt, Shigella flexneri 2a str. 2457T
gcugacauaaacaccagcaaua

SEQ ID NO: 1917409 - RNA, 17 nt, Shigella flexneri 2a str. 2457T
gcugacauaaacaccag

SEQ ID NO: 1917410 - RNA, 20 nt, Shigella flexneri 2a str. 2457T
gcugacauaaacaccagcaa

SEQ ID NO: 1917411 - RNA, 22 nt, Shigella flexneri 2a str. 2457T
gcugacacuauucgccagcacg

SEQ ID NO: 1917412 - RNA, 18 nt, Shigella flexneri 2a str. 2457T
gcugacaaaucagaggcu

SEQ ID NO: 1917413 - RNA, 23 nt, Shigella flexneri 2a str. 2457T
gcugaauuuuuuucucgcggcgg

SEQ ID NO: 1917414 - RNA, 15 nt, Shigella flexneri 2a str. 2457T
gcugaauaucuuucu

SEQ ID NO: 1917415 - RNA, 13 nt, Shigella flexneri 2a str. 2457T
gcugaauccccuu

SEQ ID NO: 1917416 - RNA, 17 nt, Shigella flexneri 2a str. 2457T
gcugaaaucacagcggc

SEQ ID NO: 1917417 - RNA, 15 nt, Shigella flexneri 2a str. 2457T
gcucucucgcuggcg

SEQ ID NO: 1917418 - RNA, 13 nt, Shigella flexneri 2a str. 2457T
gcugcuggaucug

SEQ ID NO: 1917419 - RNA, 23 nt, Shigella flexneri 2a str. 2457T
gcuggaaaugaccauaaaaggca

SEQ ID NO: 1917420 - RNA, 21 nt, Shigella flexneri 2a str. 2457T
gcuggaagguaaggauaaaaa

SEQ ID NO: 1917421 - RNA, 14 nt, Shigella flexneri 2a str. 2457T
gcuggaucguggug

SEQ ID NO: 1917422 - RNA, 23 nt, Shigella flexneri 2a str. 2457T
gcuggaucugcggguuagucugc

SEQ ID NO: 1917423 - RNA, 13 nt, Shigella flexneri 2a str. 2457T
gcuggaucccaga

SEQ ID NO: 1917424 - RNA, 23 nt, Shigella flexneri 2a str. 2457T
gcugcgccaguugcuuauccagc

SEQ ID NO: 1917425 - RNA, 13 nt, Shigella flexneri 2a str. 2457T
gcugcgccccaca

SEQ ID NO: 1917426 - RNA, 18 nt, Shigella flexneri 2a str. 2457T
gcugcgccccacaccacc

SEQ ID NO: 1917427 - RNA, 11 nt, Shigella flexneri 2a str. 2457T
gcugcgcccgc

SEQ ID NO: 1917428 - RNA, 23 nt, Shigella flexneri 2a str. 2457T
gcugcguuugcccuaaagcgcga

SEQ ID NO: 1917429 - RNA, 22 nt, Shigella flexneri 2a str. 2457T
gcugcucaggcgaggcggacug

SEQ ID NO: 1917430 - RNA, 14 nt, Shigella flexneri 2a str. 2457T
gcugcgugccuaau

SEQ ID NO: 1917431 - RNA, 16 nt, Shigella flexneri 2a str. 2457T
gcugcguuccggcaug

SEQ ID NO: 1917432 - RNA, 22 nt, Shigella flexneri 2a str. 2457T
gcugccagcgauuuaucggcaa

SEQ ID NO: 1917433 - RNA, 22 nt, Shigella flexneri 2a str. 2457T
gcugccagaaaucggccuucca

SEQ ID NO: 1917434 - RNA, 20 nt, Shigella flexneri 2a str. 2457T
gcugccagaucaucguuucc

SEQ ID NO: 1917435 - RNA, 13 nt, Shigella flexneri 2a str. 2457T
gcugccagcacuu

SEQ ID NO: 1917436 - RNA, 16 nt, Shigella flexneri 2a str. 2457T
gcugccgacaaaugca

SEQ ID NO: 1917437 - RNA, 21 nt, Shigella flexneri 2a str. 2457T
gcugccgccaguucuuccagu

SEQ ID NO: 1917438 - RNA, 22 nt, Shigella flexneri 2a str. 2457T
gcugccggaaggcagccuuucu

SEQ ID NO: 1917439 - RNA, 23 nt, Shigella flexneri 2a str. 2457T
gcugccggaaggcagccuuucuc

SEQ ID NO: 1917440 - RNA, 18 nt, Shigella flexneri 2a str. 2457T
gcugccggaccaucuucc

SEQ ID NO: 1917441 - RNA, 22 nt, Shigella flexneri 2a str. 2457T
gcugcgauaguggaacaaagaa

SEQ ID NO: 1917442 - RNA, 19 nt, Shigella flexneri 2a str. 2457T
gcugcgaucgcaaauccau

SEQ ID NO: 1917443 - RNA, 13 nt, Shigella flexneri 2a str. 2457T
gcugccugagcug

SEQ ID NO: 1917444 - RNA, 15 nt, Shigella flexneri 2a str. 2457T
gcugccugagcuguc

SEQ ID NO: 1917445 - RNA, 17 nt, Shigella flexneri 2a str. 2457T
gcugccucucuucgcug

SEQ ID NO: 1917446 - RNA, 15 nt, Shigella flexneri 2a str. 2457T
gcugccuuucgcucc

SEQ ID NO: 1917447 - RNA, 14 nt, Shigella flexneri 2a str. 2457T
gcugccgucaauuu

SEQ ID NO: 1917448 - RNA, 17 nt, Shigella flexneri 2a str. 2457T
gcugccggggagauauu

SEQ ID NO: 1917449 - RNA, 19 nt, Shigella flexneri 2a str. 2457T
gcugccgggguaaagcgcg

SEQ ID NO: 1917450 - RNA, 17 nt, Shigella flexneri 2a str. 2457T
gcucuacaauauccuca

SEQ ID NO: 1917451 - RNA, 12 nt, Shigella flexneri 2a str. 2457T
gcucgccgccgc

SEQ ID NO: 1917452 - RNA, 15 nt, Shigella flexneri 2a str. 2457T
gcucgccgcagagau

SEQ ID NO: 1917453 - RNA, 19 nt, Shigella flexneri 2a str. 2457T
gcucgccgguugggccacc

SEQ ID NO: 1917454 - RNA, 18 nt, Shigella flexneri 2a str. 2457T
gcucgcgguuagcggcuu

SEQ ID NO: 1917455 - RNA, 19 nt, Shigella flexneri 2a str. 2457T
gcucgcaggcugagaaaug

SEQ ID NO: 1917456 - RNA, 17 nt, Shigella flexneri 2a str. 2457T
gcucgacgauaucggag

SEQ ID NO: 1917457 - RNA, 16 nt, Shigella flexneri 2a str. 2457T
gcucgacaccaaacag

SEQ ID NO: 1917458 - RNA, 17 nt, Shigella flexneri 2a str. 2457T
gcucgaacgccucugca

SEQ ID NO: 1917459 - RNA, 17 nt, Shigella flexneri 2a str. 2457T
gcucgaagcgggcgcgc

SEQ ID NO: 1917460 - RNA, 22 nt, Shigella flexneri 2a str. 2457T
gcuccugcauugacucgccuuc

SEQ ID NO: 1917461 - RNA, 19 nt, Shigella flexneri 2a str. 2457T
gcuccuguaugacccggua

SEQ ID NO: 1917462 - RNA, 20 nt, Shigella flexneri 2a str. 2457T
gcuccuggcgaaucaggacc

SEQ ID NO: 1917463 - RNA, 13 nt, Shigella flexneri 2a str. 2457T
gcuccuguugaug

SEQ ID NO: 1917464 - RNA, 19 nt, Shigella flexneri 2a str. 2457T
gcgguaguuucuccccaug

SEQ ID NO: 1917465 - RNA, 16 nt, Shigella flexneri 2a str. 2457T
gcgguaucaccaccca

SEQ ID NO: 1917466 - RNA, 17 nt, Shigella flexneri 2a str. 2457T
gcgguauccaacccgcg

SEQ ID NO: 1917467 - RNA, 18 nt, Shigella flexneri 2a str. 2457T
gcgguaaucacgcaugga

SEQ ID NO: 1917468 - RNA, 14 nt, Shigella flexneri 2a str. 2457T
gcggucaaugguca

SEQ ID NO: 1917469 - RNA, 16 nt, Shigella flexneri 2a str. 2457T
gcggucaaaagcugca

SEQ ID NO: 1917470 - RNA, 12 nt, Shigella flexneri 2a str. 2457T
gcucaucagcgg

SEQ ID NO: 1917471 - RNA, 16 nt, Shigella flexneri 2a str. 2457T
gcucaucagcccggca

SEQ ID NO: 1917472 - RNA, 14 nt, Shigella flexneri 2a str. 2457T
gcucaucaagcaca

SEQ ID NO: 1917473 - RNA, 21 nt, Shigella flexneri 2a str. 2457T
gcucauaaaaucacgcgccug

SEQ ID NO: 1917474 - RNA, 13 nt, Shigella flexneri 2a str. 2457T
gcucauagccacu

SEQ ID NO: 1917475 - RNA, 16 nt, Shigella flexneri 2a str. 2457T
gcucaucggcauacag

SEQ ID NO: 1917476 - RNA, 16 nt, Shigella flexneri 2a str. 2457T
gcucaucuggauuguu

SEQ ID NO: 1917477 - RNA, 19 nt, Shigella flexneri 2a str. 2457T
gcuccagauuaccagcgac

SEQ ID NO: 1917478 - RNA, 20 nt, Shigella flexneri 2a str. 2457T
gcuccagauuaccagcgaca

SEQ ID NO: 1917479 - RNA, 16 nt, Shigella flexneri 2a str. 2457T
gcuccacaagcuccgg

SEQ ID NO: 1917480 - RNA, 23 nt, Shigella flexneri 2a str. 2457T
gcuccacaagaaugccugccagc

SEQ ID NO: 1917481 - RNA, 13 nt, Shigella flexneri 2a str. 2457T
gcuccagcgggcg

SEQ ID NO: 1917482 - RNA, 18 nt, Shigella flexneri 2a str. 2457T
gcuccagccgcucccuuc

SEQ ID NO: 1917483 - RNA, 18 nt, Shigella flexneri 2a str. 2457T
gcuccacaagcuccggcu

SEQ ID NO: 1917484 - RNA, 21 nt, Shigella flexneri 2a str. 2457T
gcuccggcgggguuuuuugua

SEQ ID NO: 1917485 - RNA, 21 nt, Shigella flexneri 2a str. 2457T
gcuccgggaaaacgcuggcag

SEQ ID NO: 1917486 - RNA, 24 nt, Shigella flexneri 2a str. 2457T
gcuccggcaccucccccugagcag

SEQ ID NO: 1917487 - RNA, 17 nt, Shigella flexneri 2a str. 2457T
gcuccuccuucucaccu

SEQ ID NO: 1917488 - RNA, 22 nt, Shigella flexneri 2a str. 2457T
gcucccugccaguccugcucaa

SEQ ID NO: 1917489 - RNA, 19 nt, Shigella flexneri 2a str. 2457T
gcuccgccaucuucuugca

SEQ ID NO: 1917490 - RNA, 22 nt, Shigella flexneri 2a str. 2457T
gcuccgcaagcgaaugaggcag

SEQ ID NO: 1917491 - RNA, 14 nt, Shigella flexneri 2a str. 2457T
gcuccauccaccag

SEQ ID NO: 1917492 - RNA, 16 nt, Shigella flexneri 2a str. 2457T
gcuccagcguaccugc

SEQ ID NO: 1917493 - RNA, 20 nt, Shigella flexneri 2a str. 2457T
gcuccagcguaccugccgcg

SEQ ID NO: 1917494 - RNA, 22 nt, Shigella flexneri 2a str. 2457T
gcuccaugagaagcugaaauca

SEQ ID NO: 1917495 - RNA, 21 nt, Shigella flexneri 2a str. 2457T
gcuuuaccaccgucaaaaaaa

SEQ ID NO: 1917496 - RNA, 16 nt, Shigella flexneri 2a str. 2457T
gcuuuacccagccaug

SEQ ID NO: 1917497 - RNA, 11 nt, Shigella flexneri 2a str. 2457T
gcuuuaaaaaa

SEQ ID NO: 1917498 - RNA, 16 nt, Shigella flexneri 2a str. 2457T
gcuuguugcuaauuua

SEQ ID NO: 1917499 - RNA, 19 nt, Shigella flexneri 2a str. 2457T
gcuuuccaggcaucagcaa

SEQ ID NO: 1917500 - RNA, 22 nt, Shigella flexneri 2a str. 2457T
gcuuuccaggcaucagcaacac

SEQ ID NO: 1917501 - RNA, 18 nt, Shigella flexneri 2a str. 2457T
gcuuucaggucagcgaau

SEQ ID NO: 1917502 - RNA, 17 nt, Shigella flexneri 2a str. 2457T
gcuuucagcacuuaucu

SEQ ID NO: 1917503 - RNA, 17 nt, Shigella flexneri 2a str. 2457T
gcuuucagcagcggcuc

SEQ ID NO: 1917504 - RNA, 20 nt, Shigella flexneri 2a str. 2457T
gcuuucaguucuagaacuaa

SEQ ID NO: 1917505 - RNA, 17 nt, Shigella flexneri 2a str. 2457T
gcuuucauauuccagcc

SEQ ID NO: 1917506 - RNA, 17 nt, Shigella flexneri 2a str. 2457T
gcuuuccaacuguacca

SEQ ID NO: 1917507 - RNA, 23 nt, Shigella flexneri 2a str. 2457T
gcuuuccaccaucacgccaauaa

SEQ ID NO: 1917508 - RNA, 12 nt, Shigella flexneri 2a str. 2457T
gcuuuauauucu

SEQ ID NO: 1917509 - RNA, 23 nt, Shigella flexneri 2a str. 2457T
gcuuuauccugcccacuccagcu

SEQ ID NO: 1917510 - RNA, 20 nt, Shigella flexneri 2a str. 2457T
gcuuuaucgacuaacuucug

SEQ ID NO: 1917511 - RNA, 22 nt, Shigella flexneri 2a str. 2457T
gcuuuaucgccaccaacccgga

SEQ ID NO: 1917512 - RNA, 15 nt, Shigella flexneri 2a str. 2457T
gcuuucacgccgccg

SEQ ID NO: 1917513 - RNA, 15 nt, Shigella flexneri 2a str. 2457T
gcuuucacucugaaa

SEQ ID NO: 1917514 - RNA, 14 nt, Shigella flexneri 2a str. 2457T
gcuuucaccugcgc

SEQ ID NO: 1917515 - RNA, 18 nt, Shigella flexneri 2a str. 2457T
gcuuucacuauuucuuug

SEQ ID NO: 1917516 - RNA, 21 nt, Shigella flexneri 2a str. 2457T
gcuuucacgccgccguuagcu

SEQ ID NO: 1917517 - RNA, 14 nt, Shigella flexneri 2a str. 2457T
aaaggcgaugcugu

SEQ ID NO: 1917518 - RNA, 19 nt, Shigella flexneri 2a str. 2457T
aaaggcgcgguuucugcuu

SEQ ID NO: 1917519 - RNA, 19 nt, Shigella flexneri 2a str. 2457T
aaaggcggcagaacagaac

SEQ ID NO: 1917520 - RNA, 19 nt, Shigella flexneri 2a str. 2457T
aaaggcgugaacuucgcca

SEQ ID NO: 1917521 - RNA, 16 nt, Shigella flexneri 2a str. 2457T
gcuuguggugaaacua

SEQ ID NO: 1917522 - RNA, 16 nt, Shigella flexneri 2a str. 2457T
gcuugugcaccagcug

SEQ ID NO: 1917523 - RNA, 15 nt, Shigella flexneri 2a str. 2457T
gcuugguuuugccau

SEQ ID NO: 1917524 - RNA, 18 nt, Shigella flexneri 2a str. 2457T
gcuugguuuugccaugca

SEQ ID NO: 1917525 - RNA, 15 nt, Shigella flexneri 2a str. 2457T
gcuugcuuuccagcu

SEQ ID NO: 1917526 - RNA, 16 nt, Shigella flexneri 2a str. 2457T
aaaggcaacaugaaac

SEQ ID NO: 1917527 - RNA, 18 nt, Shigella flexneri 2a str. 2457T
aaaggcaacaugaaacag

SEQ ID NO: 1917528 - RNA, 18 nt, Shigella flexneri 2a str. 2457T
aaaggccagcaaucccca

SEQ ID NO: 1917529 - RNA, 11 nt, Shigella flexneri 2a str. 2457T
gcuugggcaga

SEQ ID NO: 1917530 - RNA, 16 nt, Shigella flexneri 2a str. 2457T
gcuugaaaaauaaagu

SEQ ID NO: 1917531 - RNA, 15 nt, Shigella flexneri 2a str. 2457T
gcuugaagggcuggc

SEQ ID NO: 1917532 - RNA, 18 nt, Shigella flexneri 2a str. 2457T
gcuugacgugucuuauca

SEQ ID NO: 1917533 - RNA, 22 nt, Shigella flexneri 2a str. 2457T
gcuugacgcgucuuaucaggcc

SEQ ID NO: 1917534 - RNA, 13 nt, Shigella flexneri 2a str. 2457T
gcuugcagcgucu

SEQ ID NO: 1917535 - RNA, 13 nt, Shigella flexneri 2a str. 2457T
gcuugcaggauca

SEQ ID NO: 1917536 - RNA, 19 nt, Shigella flexneri 2a str. 2457T
gcuugccagauggcaucca

SEQ ID NO: 1917537 - RNA, 18 nt, Shigella flexneri 2a str. 2457T
gcuugccguugagggcgc

SEQ ID NO: 1917538 - RNA, 20 nt, Shigella flexneri 2a str. 2457T
gcuugccgggccguaauauu

SEQ ID NO: 1917539 - RNA, 17 nt, Shigella flexneri 2a str. 2457T
gcuugccggaaccggau

SEQ ID NO: 1917540 - RNA, 18 nt, Shigella flexneri 2a str. 2457T
gcuugcgauauucuucag

SEQ ID NO: 1917541 - RNA, 17 nt, Shigella flexneri 2a str. 2457T
gcuugcgauccugcaga

SEQ ID NO: 1917542 - RNA, 16 nt, Shigella flexneri 2a str. 2457T
gcuugcgcgcaaucag

SEQ ID NO: 1917543 - RNA, 20 nt, Shigella flexneri 2a str. 2457T
gcuugcgcgcaaucagcacc

SEQ ID NO: 1917544 - RNA, 19 nt, Shigella flexneri 2a str. 2457T
gcuugcgucauccagcacu

SEQ ID NO: 1917545 - RNA, 20 nt, Shigella flexneri 2a str. 2457T
gcuugcgucauccagcacuu

SEQ ID NO: 1917546 - RNA, 18 nt, Shigella flexneri 2a str. 2457T
gcuucucgugaaacucac

SEQ ID NO: 1917547 - RNA, 20 nt, Shigella flexneri 2a str. 2457T
gcuucucaggccuacccggu

SEQ ID NO: 1917548 - RNA, 13 nt, Shigella flexneri 2a str. 2457T
gcuucguuuucag

SEQ ID NO: 1917549 - RNA, 13 nt, Shigella flexneri 2a str. 2457T
gcuucuggcuggc

SEQ ID NO: 1917550 - RNA, 16 nt, Shigella flexneri 2a str. 2457T
gcuucuggcuggcgcu

SEQ ID NO: 1917551 - RNA, 21 nt, Shigella flexneri 2a str. 2457T
gcuucugccuuauccagcaga

SEQ ID NO: 1917552 - RNA, 23 nt, Shigella flexneri 2a str. 2457T
gcuucugcguucugauuuaaucu

SEQ ID NO: 1917553 - RNA, 12 nt, Shigella flexneri 2a str. 2457T
gcuucugcagcu

SEQ ID NO: 1917554 - RNA, 19 nt, Shigella flexneri 2a str. 2457T
gcuucgcggacaucgucca

SEQ ID NO: 1917555 - RNA, 21 nt, Shigella flexneri 2a str. 2457T
gcuucgcggacaucguccagc

SEQ ID NO: 1917556 - RNA, 18 nt, Shigella flexneri 2a str. 2457T
gcuucgcuuaccaugcca

SEQ ID NO: 1917557 - RNA, 17 nt, Shigella flexneri 2a str. 2457T
gcuucgcuuaucaggcc

SEQ ID NO: 1917558 - RNA, 13 nt, Shigella flexneri 2a str. 2457T
gcuucgcuuccca

SEQ ID NO: 1917559 - RNA, 14 nt, Shigella flexneri 2a str. 2457T
gcuucgcuucccaa

SEQ ID NO: 1917560 - RNA, 18 nt, Shigella flexneri 2a str. 2457T
gcuucgguaagcaaagcg

SEQ ID NO: 1917561 - RNA, 16 nt, Shigella flexneri 2a str. 2457T
gcuucaggugcccaac

SEQ ID NO: 1917562 - RNA, 14 nt, Shigella flexneri 2a str. 2457T
gcuucauaaggaaa

SEQ ID NO: 1917563 - RNA, 17 nt, Shigella flexneri 2a str. 2457T
gcuucaggaauaagaca

SEQ ID NO: 1917564 - RNA, 21 nt, Shigella flexneri 2a str. 2457T
gcuucagugacuucugccagc

SEQ ID NO: 1917565 - RNA, 22 nt, Shigella flexneri 2a str. 2457T
gcuucagugacuucugccagcu

SEQ ID NO: 1917566 - RNA, 19 nt, Shigella flexneri 2a str. 2457T
gcuuccaccguuucuuuuu

SEQ ID NO: 1917567 - RNA, 13 nt, Shigella flexneri 2a str. 2457T
gcuucauuuacau

SEQ ID NO: 1917568 - RNA, 19 nt, Shigella flexneri 2a str. 2457T
gcuucauccagcagugacu

SEQ ID NO: 1917569 - RNA, 15 nt, Shigella flexneri 2a str. 2457T
gcuucauccagcagu

SEQ ID NO: 1917570 - RNA, 13 nt, Shigella flexneri 2a str. 2457T
gcuucccaaagau

SEQ ID NO: 1917571 - RNA, 18 nt, Shigella flexneri 2a str. 2457T
gcuucccccgcaucguga

SEQ ID NO: 1917572 - RNA, 19 nt, Shigella flexneri 2a str. 2457T
gcuucccgauaagggagca

SEQ ID NO: 1917573 - RNA, 18 nt, Shigella flexneri 2a str. 2457T
gcuucccgauaagggagc

SEQ ID NO: 1917574 - RNA, 16 nt, Shigella flexneri 2a str. 2457T
gcuuccagcauuucug

SEQ ID NO: 1917575 - RNA, 16 nt, Shigella flexneri 2a str. 2457T
gcuuccagcagaccuu

SEQ ID NO: 1917576 - RNA, 12 nt, Shigella flexneri 2a str. 2457T
gcuuccagcucc

SEQ ID NO: 1917577 - RNA, 16 nt, Shigella flexneri 2a str. 2457T
gcuuccggcaauggcu

SEQ ID NO: 1917578 - RNA, 22 nt, Shigella flexneri 2a str. 2457T
gcuuccuaacauaaugcaacga

SEQ ID NO: 1917579 - RNA, 19 nt, Shigella flexneri 2a str. 2457T
gcuuccgguuguucaacca

SEQ ID NO: 1917580 - RNA, 21 nt, Shigella flexneri 2a str. 2457T
gcuuacucuucguucuucuuc

SEQ ID NO: 1917581 - RNA, 18 nt, Shigella flexneri 2a str. 2457T
gcuuacucuucguucuuc

SEQ ID NO: 1917582 - RNA, 13 nt, Shigella flexneri 2a str. 2457T
gcuuagaaauuca

SEQ ID NO: 1917583 - RNA, 23 nt, Shigella flexneri 2a str. 2457T
gcuuacgaagccguauucugacu

SEQ ID NO: 1917584 - RNA, 14 nt, Shigella flexneri 2a str. 2457T
gcuuacgccugcca

SEQ ID NO: 1917585 - RNA, 16 nt, Shigella flexneri 2a str. 2457T
gcuuacgccugccagc

SEQ ID NO: 1917586 - RNA, 20 nt, Shigella flexneri 2a str. 2457T
gcuuaccguccucuucccag

SEQ ID NO: 1917587 - RNA, 19 nt, Shigella flexneri 2a str. 2457T
gcuuacccuaaauccgcca

SEQ ID NO: 1917588 - RNA, 19 nt, Shigella flexneri 2a str. 2457T
gcuuauccggcaugcaauc

SEQ ID NO: 1917589 - RNA, 19 nt, Shigella flexneri 2a str. 2457T
gcuuaucaggccuacaaaa

SEQ ID NO: 1917590 - RNA, 19 nt, Shigella flexneri 2a str. 2457T
gcuuaucaggccugcaaac

SEQ ID NO: 1917591 - RNA, 17 nt, Shigella flexneri 2a str. 2457T
gcuuaucgccagcgcca

SEQ ID NO: 1917592 - RNA, 13 nt, Shigella flexneri 2a str. 2457T
gcuuaucgcccug

SEQ ID NO: 1917593 - RNA, 19 nt, Shigella flexneri 2a str. 2457T
gcuuaucgcccugcuccag

SEQ ID NO: 1917594 - RNA, 22 nt, Shigella flexneri 2a str. 2457T
gcuuauuucugugacuuccgac

SEQ ID NO: 1917595 - RNA, 22 nt, Shigella flexneri 2a str. 2457T
gcuuaugcgccguuuuuuuucu

SEQ ID NO: 1917596 - RNA, 16 nt, Shigella flexneri 2a str. 2457T
gcuucaacauacccuu

SEQ ID NO: 1917597 - RNA, 14 nt, Shigella flexneri 2a str. 2457T
gcuucaagaugcca

SEQ ID NO: 1917598 - RNA, 17 nt, Shigella flexneri 2a str. 2457T
gcuucaaauuagccgca

SEQ ID NO: 1917599 - RNA, 15 nt, Shigella flexneri 2a str. 2457T
gcuucaaauuagccg

SEQ ID NO: 1917600 - RNA, 13 nt, Shigella flexneri 2a str. 2457T
gcuucaaaguuug

SEQ ID NO: 1917601 - RNA, 17 nt, Shigella flexneri 2a str. 2457T
gcuucacgcgccagcuu

SEQ ID NO: 1917602 - RNA, 19 nt, Shigella flexneri 2a str. 2457T
gcuucaccgacaucuuucu

SEQ ID NO: 1917603 - RNA, 23 nt, Shigella flexneri 2a str. 2457T
gcuucaaucugauauuuagccag

SEQ ID NO: 1917604 - RNA, 12 nt, Shigella flexneri 2a str. 2457T
gcuucaaucuga

SEQ ID NO: 1917605 - RNA, 15 nt, Shigella flexneri 2a str. 2457T
gcuucaauuuuuucu

SEQ ID NO: 1917606 - RNA, 20 nt, Shigella flexneri 2a str. 2457T
gcuucaauuuuuucuggcga

SEQ ID NO: 1917607 - RNA, 18 nt, Shigella flexneri 2a str. 2457T
gcuguucacugugcuggu

SEQ ID NO: 1917608 - RNA, 17 nt, Shigella flexneri 2a str. 2457T
gcuguuccggcuuuguu

SEQ ID NO: 1917609 - RNA, 17 nt, Shigella flexneri 2a str. 2457T
gcuguucgagcaucaca

SEQ ID NO: 1917610 - RNA, 16 nt, Shigella flexneri 2a str. 2457T
gcugucauccagcagc

SEQ ID NO: 1917611 - RNA, 16 nt, Shigella flexneri 2a str. 2457T
gcuuaacgagcgcaag

SEQ ID NO: 1917612 - RNA, 16 nt, Shigella flexneri 2a str. 2457T
gcuuaaggcagaaaca

SEQ ID NO: 1917613 - RNA, 16 nt, Shigella flexneri 2a str. 2457T
gcuuaagccaucauca

SEQ ID NO: 1917614 - RNA, 13 nt, Shigella flexneri 2a str. 2457T
gcuuaauguugag

SEQ ID NO: 1917615 - RNA, 20 nt, Shigella flexneri 2a str. 2457T
gcuuaauguugagcggcagu

SEQ ID NO: 1917616 - RNA, 17 nt, Shigella flexneri 2a str. 2457T
gcuuacaaaaccugcuu

SEQ ID NO: 1917617 - RNA, 19 nt, Shigella flexneri 2a str. 2457T
gcuguuuuuucaggcccuc

SEQ ID NO: 1917618 - RNA, 14 nt, Shigella flexneri 2a str. 2457T
gcuguuuucagcac

SEQ ID NO: 1917619 - RNA, 14 nt, Shigella flexneri 2a str. 2457T
gcuguugugcucgc

SEQ ID NO: 1917620 - RNA, 14 nt, Shigella flexneri 2a str. 2457T
gcuguuguucaaca

SEQ ID NO: 1917621 - RNA, 15 nt, Shigella flexneri 2a str. 2457T
gcuguuguucaacac

SEQ ID NO: 1917622 - RNA, 16 nt, Shigella flexneri 2a str. 2457T
gcuguuguucaacacu

SEQ ID NO: 1917623 - RNA, 23 nt, Shigella flexneri 2a str. 2457T
aaaggacagugggauuaaaaagu

SEQ ID NO: 1917624 - RNA, 18 nt, Shigella flexneri 2a str. 2457T
gcuguauucuucagcgac

SEQ ID NO: 1917625 - RNA, 19 nt, Shigella flexneri 2a str. 2457T
gcugucaacugcgccacuc

SEQ ID NO: 1917626 - RNA, 20 nt, Shigella flexneri 2a str. 2457T
gcuguagcaguuccagcauc

SEQ ID NO: 1917627 - RNA, 16 nt, Shigella flexneri 2a str. 2457T
gcuguagccgaugccg

SEQ ID NO: 1917628 - RNA, 19 nt, Shigella flexneri 2a str. 2457T
gcuggugccaagcuccagc

SEQ ID NO: 1917629 - RNA, 20 nt, Shigella flexneri 2a str. 2457T
gcuggucacugaccacuucg

SEQ ID NO: 1917630 - RNA, 23 nt, Shigella flexneri 2a str. 2457T
gcuggauuuuagggacaaagaau

SEQ ID NO: 1917631 - RNA, 22 nt, Shigella flexneri 2a str. 2457T
gcuggauuaacgcuggggauag

SEQ ID NO: 1917632 - RNA, 22 nt, Shigella flexneri 2a str. 2457T
gcuggcaccgcagaucagacca

SEQ ID NO: 1917633 - RNA, 22 nt, Shigella flexneri 2a str. 2457T
gcuggcaagauggcgaacauaa

SEQ ID NO: 1917634 - RNA, 13 nt, Shigella flexneri 2a str. 2457T
gcuggcaaugacc

SEQ ID NO: 1917635 - RNA, 16 nt, Shigella flexneri 2a str. 2457T
ggccagacauuauaaa

SEQ ID NO: 1917636 - RNA, 15 nt, Shigella flexneri 2a str. 2457T
ggccagacauuauaa

SEQ ID NO: 1917637 - RNA, 11 nt, Shigella flexneri 2a str. 2457T
ggccagagcau

SEQ ID NO: 1917638 - RNA, 22 nt, Shigella flexneri 2a str. 2457T
ggcauuacaagaaucaugccaa

SEQ ID NO: 1917639 - RNA, 13 nt, Shigella flexneri 2a str. 2457T
ggcauuagauauu

SEQ ID NO: 1917640 - RNA, 18 nt, Shigella flexneri 2a str. 2457T
ggcauucagauaauaggu

SEQ ID NO: 1917641 - RNA, 20 nt, Shigella flexneri 2a str. 2457T
ggcauuggcauagugcugag

SEQ ID NO: 1917642 - RNA, 15 nt, Shigella flexneri 2a str. 2457T
ggcaucguguugaug

SEQ ID NO: 1917643 - RNA, 19 nt, Shigella flexneri 2a str. 2457T
ggcaucguguugaugcucc

SEQ ID NO: 1917644 - RNA, 16 nt, Shigella flexneri 2a str. 2457T
ggcaucguccauuucu

SEQ ID NO: 1917645 - RNA, 19 nt, Shigella flexneri 2a str. 2457T
aaaguauuugacuguucua

SEQ ID NO: 1917646 - RNA, 14 nt, Shigella flexneri 2a str. 2457T
aaagucauaucagc

SEQ ID NO: 1917647 - RNA, 12 nt, Shigella flexneri 2a str. 2457T
aaagucaucaau

SEQ ID NO: 1917648 - RNA, 19 nt, Shigella flexneri 2a str. 2457T
aaaguccaggcugcaaagu

SEQ ID NO: 1917649 - RNA, 13 nt, Shigella flexneri 2a str. 2457T
aaagucccuuccc

SEQ ID NO: 1917650 - RNA, 18 nt, Shigella flexneri 2a str. 2457T
ggcaugcuguccagcagg

SEQ ID NO: 1917651 - RNA, 19 nt, Shigella flexneri 2a str. 2457T
aaagucagauaaaaaguuu

SEQ ID NO: 1917652 - RNA, 22 nt, Shigella flexneri 2a str. 2457T
aaagucacgccaauaaucgauu

SEQ ID NO: 1917653 - RNA, 19 nt, Shigella flexneri 2a str. 2457T
ggcaguaaccaaaagcugg

SEQ ID NO: 1917654 - RNA, 13 nt, Shigella flexneri 2a str. 2457T
ggcaucagcaauu

SEQ ID NO: 1917655 - RNA, 14 nt, Shigella flexneri 2a str. 2457T
ggcaucagcagaau

SEQ ID NO: 1917656 - RNA, 15 nt, Shigella flexneri 2a str. 2457T
ggcaguaauaccaga

SEQ ID NO: 1917657 - RNA, 20 nt, Shigella flexneri 2a str. 2457T
ggcauauuccgccaccugcg

SEQ ID NO: 1917658 - RNA, 20 nt, Shigella flexneri 2a str. 2457T
ggcauauaggucugauuccg

SEQ ID NO: 1917659 - RNA, 21 nt, Shigella flexneri 2a str. 2457T
ggcauauaguggguaacaauu

SEQ ID NO: 1917660 - RNA, 18 nt, Shigella flexneri 2a str. 2457T
ggcaucacgaauccgcac

SEQ ID NO: 1917661 - RNA, 22 nt, Shigella flexneri 2a str. 2457T
ggcaucaaugaaaggcuuccca

SEQ ID NO: 1917662 - RNA, 16 nt, Shigella flexneri 2a str. 2457T
ggcaucacaucgcugg

SEQ ID NO: 1917663 - RNA, 15 nt, Shigella flexneri 2a str. 2457T
ggcaggaguggcagc

SEQ ID NO: 1917664 - RNA, 16 nt, Shigella flexneri 2a str. 2457T
ggcaggaguggcagca

SEQ ID NO: 1917665 - RNA, 15 nt, Shigella flexneri 2a str. 2457T
ggcagggccaccagc

SEQ ID NO: 1917666 - RNA, 14 nt, Shigella flexneri 2a str. 2457T
ggcaggaacugcuc

SEQ ID NO: 1917667 - RNA, 17 nt, Shigella flexneri 2a str. 2457T
ggcagcucgaccgcugc

SEQ ID NO: 1917668 - RNA, 18 nt, Shigella flexneri 2a str. 2457T
ggcagcuccagcaaaaag

SEQ ID NO: 1917669 - RNA, 20 nt, Shigella flexneri 2a str. 2457T
aaaguagugucuaauuaccc

SEQ ID NO: 1917670 - RNA, 14 nt, Shigella flexneri 2a str. 2457T
ggcagacgugacca

SEQ ID NO: 1917671 - RNA, 20 nt, Shigella flexneri 2a str. 2457T
ggcagaccugcuuuguucag

SEQ ID NO: 1917672 - RNA, 17 nt, Shigella flexneri 2a str. 2457T
ggcagagaaaccacauc

SEQ ID NO: 1917673 - RNA, 14 nt, Shigella flexneri 2a str. 2457T
ggcagagaucgccg

SEQ ID NO: 1917674 - RNA, 18 nt, Shigella flexneri 2a str. 2457T
ggcagagaaagcaaaaau

SEQ ID NO: 1917675 - RNA, 15 nt, Shigella flexneri 2a str. 2457T
ggcagacaaaacaua

SEQ ID NO: 1917676 - RNA, 12 nt, Shigella flexneri 2a str. 2457T
ggcagaacggug

SEQ ID NO: 1917677 - RNA, 16 nt, Shigella flexneri 2a str. 2457T
ggcaaguaauaauauc

SEQ ID NO: 1917678 - RNA, 20 nt, Shigella flexneri 2a str. 2457T
ggcaagccgcuaacagcagc

SEQ ID NO: 1917679 - RNA, 14 nt, Shigella flexneri 2a str. 2457T
ggcagccaggcgcg

SEQ ID NO: 1917680 - RNA, 16 nt, Shigella flexneri 2a str. 2457T
ggcagccagauggcug

SEQ ID NO: 1917681 - RNA, 21 nt, Shigella flexneri 2a str. 2457T
ggcagauacaaccaaucgcgg

SEQ ID NO: 1917682 - RNA, 13 nt, Shigella flexneri 2a str. 2457T
ggcagaugcgucu

SEQ ID NO: 1917683 - RNA, 18 nt, Shigella flexneri 2a str. 2457T
ggccgaauaccggcgucc

SEQ ID NO: 1917684 - RNA, 19 nt, Shigella flexneri 2a str. 2457T
ggccgaaaaaugcuggauc

SEQ ID NO: 1917685 - RNA, 21 nt, Shigella flexneri 2a str. 2457T
ggcccuuucccuucucgucgg

SEQ ID NO: 1917686 - RNA, 15 nt, Shigella flexneri 2a str. 2457T
aaagugaguuuugca

SEQ ID NO: 1917687 - RNA, 21 nt, Shigella flexneri 2a str. 2457T
aaagucuuuguauuuauuuuc

SEQ ID NO: 1917688 - RNA, 16 nt, Shigella flexneri 2a str. 2457T
ggcccaccuggcugag

SEQ ID NO: 1917689 - RNA, 11 nt, Shigella flexneri 2a str. 2457T
ggcccaggcau

SEQ ID NO: 1917690 - RNA, 14 nt, Shigella flexneri 2a str. 2457T
ggcccaucgccagu

SEQ ID NO: 1917691 - RNA, 19 nt, Shigella flexneri 2a str. 2457T
ggcccagugagucggggcc

SEQ ID NO: 1917692 - RNA, 23 nt, Shigella flexneri 2a str. 2457T
ggcccagugagucggggccagca

SEQ ID NO: 1917693 - RNA, 17 nt, Shigella flexneri 2a str. 2457T
ggcccauuuucucggcu

SEQ ID NO: 1917694 - RNA, 15 nt, Shigella flexneri 2a str. 2457T
ggccagcaaucccca

SEQ ID NO: 1917695 - RNA, 15 nt, Shigella flexneri 2a str. 2457T
ggccaugcggcgagg

SEQ ID NO: 1917696 - RNA, 20 nt, Shigella flexneri 2a str. 2457T
ggccaugcugcuuuguaagu

SEQ ID NO: 1917697 - RNA, 18 nt, Shigella flexneri 2a str. 2457T
ggccauacccgccagugc

SEQ ID NO: 1917698 - RNA, 15 nt, Shigella flexneri 2a str. 2457T
ggccaguuccgccgg

SEQ ID NO: 1917699 - RNA, 12 nt, Shigella flexneri 2a str. 2457T
ggcaagaaaauu

SEQ ID NO: 1917700 - RNA, 22 nt, Shigella flexneri 2a str. 2457T
ggcaagcaggucggcucagccg

SEQ ID NO: 1917701 - RNA, 15 nt, Shigella flexneri 2a str. 2457T
ggcaagcaggacgcc

SEQ ID NO: 1917702 - RNA, 14 nt, Shigella flexneri 2a str. 2457T
ggcaagccagcaua

SEQ ID NO: 1917703 - RNA, 12 nt, Shigella flexneri 2a str. 2457T
ggcaacugcugc

SEQ ID NO: 1917704 - RNA, 13 nt, Shigella flexneri 2a str. 2457T
ggcaaaaauaagg

SEQ ID NO: 1917705 - RNA, 13 nt, Shigella flexneri 2a str. 2457T
ggcaaaaaccaau

SEQ ID NO: 1917706 - RNA, 20 nt, Shigella flexneri 2a str. 2457T
ggcaaaaacccuucuuccau

SEQ ID NO: 1917707 - RNA, 14 nt, Shigella flexneri 2a str. 2457T
ggauuuuuuuauuu

SEQ ID NO: 1917708 - RNA, 12 nt, Shigella flexneri 2a str. 2457T
ggcaaaauaugu

SEQ ID NO: 1917709 - RNA, 14 nt, Shigella flexneri 2a str. 2457T
ggcaaccagcccau

SEQ ID NO: 1917710 - RNA, 15 nt, Shigella flexneri 2a str. 2457T
ggcaacaucaaauua

SEQ ID NO: 1917711 - RNA, 19 nt, Shigella flexneri 2a str. 2457T
ggcaacaugaaacagaaaa

SEQ ID NO: 1917712 - RNA, 15 nt, Shigella flexneri 2a str. 2457T
ggcaaccacaaccgc

SEQ ID NO: 1917713 - RNA, 18 nt, Shigella flexneri 2a str. 2457T
ggauucacguugauggua

SEQ ID NO: 1917714 - RNA, 22 nt, Shigella flexneri 2a str. 2457T
ggauucacguugaugguaggug

SEQ ID NO: 1917715 - RNA, 14 nt, Shigella flexneri 2a str. 2457T
ggauuaaaaaguaa

SEQ ID NO: 1917716 - RNA, 17 nt, Shigella flexneri 2a str. 2457T
ggauuacuccccgcaca

SEQ ID NO: 1917717 - RNA, 13 nt, Shigella flexneri 2a str. 2457T
ggauuugugucag

SEQ ID NO: 1917718 - RNA, 14 nt, Shigella flexneri 2a str. 2457T
ggauuucugauuau

SEQ ID NO: 1917719 - RNA, 16 nt, Shigella flexneri 2a str. 2457T
ggaugcggcguaaaug

SEQ ID NO: 1917720 - RNA, 19 nt, Shigella flexneri 2a str. 2457T
ggaugcucucaucacuaca

SEQ ID NO: 1917721 - RNA, 11 nt, Shigella flexneri 2a str. 2457T
ggauggcggcu

SEQ ID NO: 1917722 - RNA, 19 nt, Shigella flexneri 2a str. 2457T
ggauggcgauacucugcca

SEQ ID NO: 1917723 - RNA, 16 nt, Shigella flexneri 2a str. 2457T
ggaugccgaaaaaagu

SEQ ID NO: 1917724 - RNA, 15 nt, Shigella flexneri 2a str. 2457T
ggaugccgaaaaaag

SEQ ID NO: 1917725 - RNA, 18 nt, Shigella flexneri 2a str. 2457T
aaaguaccaucguccagc

SEQ ID NO: 1917726 - RNA, 12 nt, Shigella flexneri 2a str. 2457T
ggauggcggcuu

SEQ ID NO: 1917727 - RNA, 22 nt, Shigella flexneri 2a str. 2457T
ggauggucgcuuuguggcggca

SEQ ID NO: 1917728 - RNA, 17 nt, Shigella flexneri 2a str. 2457T
ggaugggcguagcuggg

SEQ ID NO: 1917729 - RNA, 21 nt, Shigella flexneri 2a str. 2457T
ggaucguucacaugagagaaa

SEQ ID NO: 1917730 - RNA, 21 nt, Shigella flexneri 2a str. 2457T
ggaucuuugccagaucgccug

SEQ ID NO: 1917731 - RNA, 14 nt, Shigella flexneri 2a str. 2457T
ggaugacacgcagg

SEQ ID NO: 1917732 - RNA, 15 nt, Shigella flexneri 2a str. 2457T
ggaucuuuugucaug

SEQ ID NO: 1917733 - RNA, 13 nt, Shigella flexneri 2a str. 2457T
ggaugaagugaag

SEQ ID NO: 1917734 - RNA, 11 nt, Shigella flexneri 2a str. 2457T
ggaugauucac

SEQ ID NO: 1917735 - RNA, 14 nt, Shigella flexneri 2a str. 2457T
ggaucgugauagua

SEQ ID NO: 1917736 - RNA, 16 nt, Shigella flexneri 2a str. 2457T
ggaucgguagaccgga

SEQ ID NO: 1917737 - RNA, 21 nt, Shigella flexneri 2a str. 2457T
ggaucggugcagacacgcaau

SEQ ID NO: 1917738 - RNA, 22 nt, Shigella flexneri 2a str. 2457T
ggaucauccacccgcagcaagc

SEQ ID NO: 1917739 - RNA, 12 nt, Shigella flexneri 2a str. 2457T
ggaucggaggca

SEQ ID NO: 1917740 - RNA, 14 nt, Shigella flexneri 2a str. 2457T
ggagccaguuggcg

SEQ ID NO: 1917741 - RNA, 15 nt, Shigella flexneri 2a str. 2457T
ggauaaagcaguuua

SEQ ID NO: 1917742 - RNA, 13 nt, Shigella flexneri 2a str. 2457T
ggauaaagccccc

SEQ ID NO: 1917743 - RNA, 18 nt, Shigella flexneri 2a str. 2457T
ggauaaacuuggcuauaa

SEQ ID NO: 1917744 - RNA, 18 nt, Shigella flexneri 2a str. 2457T
ggauaaacacucgcugug

SEQ ID NO: 1917745 - RNA, 17 nt, Shigella flexneri 2a str. 2457T
aaagguaggccugauaa

SEQ ID NO: 1917746 - RNA, 17 nt, Shigella flexneri 2a str. 2457T
aaagguccuguaaugag

SEQ ID NO: 1917747 - RNA, 17 nt, Shigella flexneri 2a str. 2457T
aaagguguguauccguu

SEQ ID NO: 1917748 - RNA, 21 nt, Shigella flexneri 2a str. 2457T
aaaguaagaauugauaaaaaa

SEQ ID NO: 1917749 - RNA, 18 nt, Shigella flexneri 2a str. 2457T
ggacugaaaguacuucac

SEQ ID NO: 1917750 - RNA, 14 nt, Shigella flexneri 2a str. 2457T
ggagcaggccgggu

SEQ ID NO: 1917751 - RNA, 19 nt, Shigella flexneri 2a str. 2457T
ggagauuaacugggcguca

SEQ ID NO: 1917752 - RNA, 15 nt, Shigella flexneri 2a str. 2457T
ggagagggccggggu

SEQ ID NO: 1917753 - RNA, 15 nt, Shigella flexneri 2a str. 2457T
ggagacuaaggcagc

SEQ ID NO: 1917754 - RNA, 24 nt, Shigella flexneri 2a str. 2457T
ggagaaacccggccacagcgccag

SEQ ID NO: 1917755 - RNA, 17 nt, Shigella flexneri 2a str. 2457T
ggacuucaugcgcagca

SEQ ID NO: 1917756 - RNA, 17 nt, Shigella flexneri 2a str. 2457T
aaaggggugaaaaaaac

SEQ ID NO: 1917757 - RNA, 16 nt, Shigella flexneri 2a str. 2457T
ggacgcugagcacguu

SEQ ID NO: 1917758 - RNA, 17 nt, Shigella flexneri 2a str. 2457T
aaaggcuuugacuaaca

SEQ ID NO: 1917759 - RNA, 16 nt, Shigella flexneri 2a str. 2457T
ggaccuuauggaucug

SEQ ID NO: 1917760 - RNA, 19 nt, Shigella flexneri 2a str. 2457T
ggacccuuaaagggucagg

SEQ ID NO: 1917761 - RNA, 17 nt, Shigella flexneri 2a str. 2457T
ggaccgucaucuuccac

SEQ ID NO: 1917762 - RNA, 16 nt, Shigella flexneri 2a str. 2457T
aaaggcugacaaauca

SEQ ID NO: 1917763 - RNA, 20 nt, Shigella flexneri 2a str. 2457T
ggacagaccugcgucaccac

SEQ ID NO: 1917764 - RNA, 13 nt, Shigella flexneri 2a str. 2457T
ggacaggcggccc

SEQ ID NO: 1917765 - RNA, 17 nt, Shigella flexneri 2a str. 2457T
ggacagcguugccagcu

SEQ ID NO: 1917766 - RNA, 18 nt, Shigella flexneri 2a str. 2457T
ggaaugugaugaaaaaag

SEQ ID NO: 1917767 - RNA, 19 nt, Shigella flexneri 2a str. 2457T
ggaauuacgcaauuacaug

SEQ ID NO: 1917768 - RNA, 15 nt, Shigella flexneri 2a str. 2457T
ggaauaaaagccagg

SEQ ID NO: 1917769 - RNA, 18 nt, Shigella flexneri 2a str. 2457T
ggaauaagacuggcaaau

SEQ ID NO: 1917770 - RNA, 20 nt, Shigella flexneri 2a str. 2457T
ggacacugcuuacaggcugg

SEQ ID NO: 1917771 - RNA, 13 nt, Shigella flexneri 2a str. 2457T
ggacaccucacca

SEQ ID NO: 1917772 - RNA, 16 nt, Shigella flexneri 2a str. 2457T
ggacacauuucuuuug

SEQ ID NO: 1917773 - RNA, 13 nt, Shigella flexneri 2a str. 2457T
ggacacacuucau

SEQ ID NO: 1917774 - RNA, 19 nt, Shigella flexneri 2a str. 2457T
ggacaauagcuaacgaaaa

SEQ ID NO: 1917775 - RNA, 23 nt, Shigella flexneri 2a str. 2457T
ggacaaaagccccaggcgauauu

SEQ ID NO: 1917776 - RNA, 12 nt, Shigella flexneri 2a str. 2457T
ggaauucucaaa

SEQ ID NO: 1917777 - RNA, 13 nt, Shigella flexneri 2a str. 2457T
ggaauuuuacagc

SEQ ID NO: 1917778 - RNA, 14 nt, Shigella flexneri 2a str. 2457T
ggaagcuccaccag

SEQ ID NO: 1917779 - RNA, 14 nt, Shigella flexneri 2a str. 2457T
ggaaguauuucaau

SEQ ID NO: 1917780 - RNA, 21 nt, Shigella flexneri 2a str. 2457T
ggaagcuggauuaacgcuggg

SEQ ID NO: 1917781 - RNA, 17 nt, Shigella flexneri 2a str. 2457T
ggaacggggguuuuacu

SEQ ID NO: 1917782 - RNA, 18 nt, Shigella flexneri 2a str. 2457T
ggaagccggaauuuuccu

SEQ ID NO: 1917783 - RNA, 20 nt, Shigella flexneri 2a str. 2457T
ggaagccggaauuuuccuuc

SEQ ID NO: 1917784 - RNA, 19 nt, Shigella flexneri 2a str. 2457T
ggaacauaucaaaaagcug

SEQ ID NO: 1917785 - RNA, 14 nt, Shigella flexneri 2a str. 2457T
ggaaccacagcgcc

SEQ ID NO: 1917786 - RNA, 19 nt, Shigella flexneri 2a str. 2457T
ggaacauucgccgcuguga

SEQ ID NO: 1917787 - RNA, 13 nt, Shigella flexneri 2a str. 2457T
ggaaccaggcgcg

SEQ ID NO: 1917788 - RNA, 16 nt, Shigella flexneri 2a str. 2457T
ggaacaggcagggcca

SEQ ID NO: 1917789 - RNA, 20 nt, Shigella flexneri 2a str. 2457T
ggaacaaacugccgcgccgc

SEQ ID NO: 1917790 - RNA, 20 nt, Shigella flexneri 2a str. 2457T
ggaacaaaauuuucagcgug

SEQ ID NO: 1917791 - RNA, 21 nt, Shigella flexneri 2a str. 2457T
gcuuucgagcacgacuuucuc

SEQ ID NO: 1917792 - RNA, 12 nt, Shigella flexneri 2a str. 2457T
gguccuucaggc

SEQ ID NO: 1917793 - RNA, 12 nt, Shigella flexneri 2a str. 2457T
gguccuucaucu

SEQ ID NO: 1917794 - RNA, 22 nt, Shigella flexneri 2a str. 2457T
ggucgccccggaacgggagaaa

SEQ ID NO: 1917795 - RNA, 17 nt, Shigella flexneri 2a str. 2457T
ggucggcaaacugcuga

SEQ ID NO: 1917796 - RNA, 18 nt, Shigella flexneri 2a str. 2457T
ggucuggcaaaaauaagg

SEQ ID NO: 1917797 - RNA, 16 nt, Shigella flexneri 2a str. 2457T
ggucuggcgcaguggg

SEQ ID NO: 1917798 - RNA, 14 nt, Shigella flexneri 2a str. 2457T
ggugaaaaaauuaa

SEQ ID NO: 1917799 - RNA, 12 nt, Shigella flexneri 2a str. 2457T
ggugaaaaaaac

SEQ ID NO: 1917800 - RNA, 13 nt, Shigella flexneri 2a str. 2457T
ggucugcaaaaug

SEQ ID NO: 1917801 - RNA, 18 nt, Shigella flexneri 2a str. 2457T
ggucugcaugacggcuga

SEQ ID NO: 1917802 - RNA, 14 nt, Shigella flexneri 2a str. 2457T
ggucugccaacuuu

SEQ ID NO: 1917803 - RNA, 21 nt, Shigella flexneri 2a str. 2457T
ggucgugcgguuucagcucac

SEQ ID NO: 1917804 - RNA, 17 nt, Shigella flexneri 2a str. 2457T
ggucggcuucccugcgg

SEQ ID NO: 1917805 - RNA, 16 nt, Shigella flexneri 2a str. 2457T
ggucauaggccgcuga

SEQ ID NO: 1917806 - RNA, 15 nt, Shigella flexneri 2a str. 2457T
ggucaguuggcuggg

SEQ ID NO: 1917807 - RNA, 12 nt, Shigella flexneri 2a str. 2457T
ggucauccaaau

SEQ ID NO: 1917808 - RNA, 18 nt, Shigella flexneri 2a str. 2457T
ggucauuaugaccguuca

SEQ ID NO: 1917809 - RNA, 14 nt, Shigella flexneri 2a str. 2457T
ggucauuuucuuca

SEQ ID NO: 1917810 - RNA, 22 nt, Shigella flexneri 2a str. 2457T
ggucauuuucuucagcaguuca

SEQ ID NO: 1917811 - RNA, 18 nt, Shigella flexneri 2a str. 2457T
ggucauuuugaccacacg

SEQ ID NO: 1917812 - RNA, 17 nt, Shigella flexneri 2a str. 2457T
gguccagccgccagggc

SEQ ID NO: 1917813 - RNA, 18 nt, Shigella flexneri 2a str. 2457T
gguccccucgcuccucug

SEQ ID NO: 1917814 - RNA, 14 nt, Shigella flexneri 2a str. 2457T
ggucccuucaaucu

SEQ ID NO: 1917815 - RNA, 19 nt, Shigella flexneri 2a str. 2457T
ggucccucaacaacagucu

SEQ ID NO: 1917816 - RNA, 20 nt, Shigella flexneri 2a str. 2457T
ggucccugaugcaucaguca

SEQ ID NO: 1917817 - RNA, 21 nt, Shigella flexneri 2a str. 2457T
ggucagcuucaccuuccagua

SEQ ID NO: 1917818 - RNA, 20 nt, Shigella flexneri 2a str. 2457T
ggucagccacaguugaucag

SEQ ID NO: 1917819 - RNA, 14 nt, Shigella flexneri 2a str. 2457T
ggucagccagcggc

SEQ ID NO: 1917820 - RNA, 23 nt, Shigella flexneri 2a str. 2457T
ggucagccacaguugaucagcca

SEQ ID NO: 1917821 - RNA, 18 nt, Shigella flexneri 2a str. 2457T
ggucagcgccuggcugca

SEQ ID NO: 1917822 - RNA, 17 nt, Shigella flexneri 2a str. 2457T
ggucagcgccagcgugu

SEQ ID NO: 1917823 - RNA, 21 nt, Shigella flexneri 2a str. 2457T
ggucagcaggagcagccccug

SEQ ID NO: 1917824 - RNA, 16 nt, Shigella flexneri 2a str. 2457T
ggucagauuucaaucu

SEQ ID NO: 1917825 - RNA, 15 nt, Shigella flexneri 2a str. 2457T
ggucacaucgcugac

SEQ ID NO: 1917826 - RNA, 22 nt, Shigella flexneri 2a str. 2457T
ggucacggcuguagccagcucg

SEQ ID NO: 1917827 - RNA, 14 nt, Shigella flexneri 2a str. 2457T
ggucagagaaucga

SEQ ID NO: 1917828 - RNA, 11 nt, Shigella flexneri 2a str. 2457T
ggucagacaac

SEQ ID NO: 1917829 - RNA, 16 nt, Shigella flexneri 2a str. 2457T
ggucagacaacuuccc

SEQ ID NO: 1917830 - RNA, 22 nt, Shigella flexneri 2a str. 2457T
ggucagagagccagccccacag

SEQ ID NO: 1917831 - RNA, 10 nt, Shigella flexneri 2a str. 2457T
ggucagagaa

SEQ ID NO: 1917832 - RNA, 21 nt, Shigella flexneri 2a str. 2457T
ggucagaacgaccaguucaca

SEQ ID NO: 1917833 - RNA, 20 nt, Shigella flexneri 2a str. 2457T
gguaugcuuccuaacauaau

SEQ ID NO: 1917834 - RNA, 19 nt, Shigella flexneri 2a str. 2457T
gguauucaaccguuuccag

SEQ ID NO: 1917835 - RNA, 16 nt, Shigella flexneri 2a str. 2457T
gguauuaaucugccag

SEQ ID NO: 1917836 - RNA, 15 nt, Shigella flexneri 2a str. 2457T
gguauuaguggcaac

SEQ ID NO: 1917837 - RNA, 22 nt, Shigella flexneri 2a str. 2457T
gguaucguaaccuugauccugc

SEQ ID NO: 1917838 - RNA, 21 nt, Shigella flexneri 2a str. 2457T
gguaucuucccagccaaugca

SEQ ID NO: 1917839 - RNA, 15 nt, Shigella flexneri 2a str. 2457T
ggucaaaaaaugaaa

SEQ ID NO: 1917840 - RNA, 16 nt, Shigella flexneri 2a str. 2457T
gguauuuucugaaacg

SEQ ID NO: 1917841 - RNA, 22 nt, Shigella flexneri 2a str. 2457T
ggucaaaugaccgggcuuuccg

SEQ ID NO: 1917842 - RNA, 13 nt, Shigella flexneri 2a str. 2457T
gguauuggugaaa

SEQ ID NO: 1917843 - RNA, 15 nt, Shigella flexneri 2a str. 2457T
gguauugcuucucag

SEQ ID NO: 1917844 - RNA, 19 nt, Shigella flexneri 2a str. 2457T
gguagugaugcgcauuaug

SEQ ID NO: 1917845 - RNA, 18 nt, Shigella flexneri 2a str. 2457T
gguagugccgucagcagg

SEQ ID NO: 1917846 - RNA, 15 nt, Shigella flexneri 2a str. 2457T
gguaguccaugacca

SEQ ID NO: 1917847 - RNA, 17 nt, Shigella flexneri 2a str. 2457T
gguauacgucccgguga

SEQ ID NO: 1917848 - RNA, 18 nt, Shigella flexneri 2a str. 2457T
gguaucgcgccagccagu

SEQ ID NO: 1917849 - RNA, 16 nt, Shigella flexneri 2a str. 2457T
gguaccagaaucaccu

SEQ ID NO: 1917850 - RNA, 17 nt, Shigella flexneri 2a str. 2457T
gguacaaacaucaucca

SEQ ID NO: 1917851 - RNA, 12 nt, Shigella flexneri 2a str. 2457T
gguacaaccgca

SEQ ID NO: 1917852 - RNA, 17 nt, Shigella flexneri 2a str. 2457T
gguacgacuuccuggcu

SEQ ID NO: 1917853 - RNA, 23 nt, Shigella flexneri 2a str. 2457T
gguacgaauacggauauguuuac

SEQ ID NO: 1917854 - RNA, 19 nt, Shigella flexneri 2a str. 2457T
gguaccuuugaacugcuga

SEQ ID NO: 1917855 - RNA, 18 nt, Shigella flexneri 2a str. 2457T
gguacgaaaagggcugga

SEQ ID NO: 1917856 - RNA, 15 nt, Shigella flexneri 2a str. 2457T
gguagaacccuacca

SEQ ID NO: 1917857 - RNA, 22 nt, Shigella flexneri 2a str. 2457T
gguagacaccaaggaacugugc

SEQ ID NO: 1917858 - RNA, 13 nt, Shigella flexneri 2a str. 2457T
gguagagaaguuu

SEQ ID NO: 1917859 - RNA, 20 nt, Shigella flexneri 2a str. 2457T
gguagauuauuucgcugcgg

SEQ ID NO: 1917860 - RNA, 19 nt, Shigella flexneri 2a str. 2457T
gguagcgaugacagucugg

SEQ ID NO: 1917861 - RNA, 20 nt, Shigella flexneri 2a str. 2457T
gguagcgaugacagucugga

SEQ ID NO: 1917862 - RNA, 16 nt, Shigella flexneri 2a str. 2457T
gguagcgcauaagcca

SEQ ID NO: 1917863 - RNA, 16 nt, Shigella flexneri 2a str. 2457T
gggugauuaaagaaaa

SEQ ID NO: 1917864 - RNA, 19 nt, Shigella flexneri 2a str. 2457T
gggugagggcguagagaga

SEQ ID NO: 1917865 - RNA, 15 nt, Shigella flexneri 2a str. 2457T
gggugcaaucaacac

SEQ ID NO: 1917866 - RNA, 17 nt, Shigella flexneri 2a str. 2457T
ggguucgacgcgguuga

SEQ ID NO: 1917867 - RNA, 15 nt, Shigella flexneri 2a str. 2457T
ggguuagucugcauu

SEQ ID NO: 1917868 - RNA, 12 nt, Shigella flexneri 2a str. 2457T
gguaauggucag

SEQ ID NO: 1917869 - RNA, 17 nt, Shigella flexneri 2a str. 2457T
gguaauuaagauucagc

SEQ ID NO: 1917870 - RNA, 11 nt, Shigella flexneri 2a str. 2457T
gguaauucccu

SEQ ID NO: 1917871 - RNA, 17 nt, Shigella flexneri 2a str. 2457T
gguaauuugaucaaaua

SEQ ID NO: 1917872 - RNA, 22 nt, Shigella flexneri 2a str. 2457T
gguaauacuaaucucacccaua

SEQ ID NO: 1917873 - RNA, 14 nt, Shigella flexneri 2a str. 2457T
gguaaggugauuag

SEQ ID NO: 1917874 - RNA, 18 nt, Shigella flexneri 2a str. 2457T
ggguuuuucgcgcgggca

SEQ ID NO: 1917875 - RNA, 21 nt, Shigella flexneri 2a str. 2457T
gguaaaauggucagccagcgg

SEQ ID NO: 1917876 - RNA, 12 nt, Shigella flexneri 2a str. 2457T
gguaaacaacau

SEQ ID NO: 1917877 - RNA, 20 nt, Shigella flexneri 2a str. 2457T
gguaaacaccuucauccagc

SEQ ID NO: 1917878 - RNA, 21 nt, Shigella flexneri 2a str. 2457T
gguaaaaccugacaacaaaac

SEQ ID NO: 1917879 - RNA, 16 nt, Shigella flexneri 2a str. 2457T
gguaaaaccaugccau

SEQ ID NO: 1917880 - RNA, 11 nt, Shigella flexneri 2a str. 2457T
gguaaauuguu

SEQ ID NO: 1917881 - RNA, 12 nt, Shigella flexneri 2a str. 2457T
gguaaagaagag

SEQ ID NO: 1917882 - RNA, 15 nt, Shigella flexneri 2a str. 2457T
gguaaagcccucacc

SEQ ID NO: 1917883 - RNA, 15 nt, Shigella flexneri 2a str. 2457T
gguaaagccgugcug

SEQ ID NO: 1917884 - RNA, 12 nt, Shigella flexneri 2a str. 2457T
gguaacauccag

SEQ ID NO: 1917885 - RNA, 15 nt, Shigella flexneri 2a str. 2457T
gguaaccgccaguaa

SEQ ID NO: 1917886 - RNA, 20 nt, Shigella flexneri 2a str. 2457T
gggcucgggcaaauccacug

SEQ ID NO: 1917887 - RNA, 21 nt, Shigella flexneri 2a str. 2457T
gggcugacguuaagaaaacgg

SEQ ID NO: 1917888 - RNA, 21 nt, Shigella flexneri 2a str. 2457T
gggcugacauuaucagacacc

SEQ ID NO: 1917889 - RNA, 17 nt, Shigella flexneri 2a str. 2457T
gggcguuacagcuggag

SEQ ID NO: 1917890 - RNA, 11 nt, Shigella flexneri 2a str. 2457T
gggcgcgggcg

SEQ ID NO: 1917891 - RNA, 23 nt, Shigella flexneri 2a str. 2457T
gggcggagaugcggaaauaucgg

SEQ ID NO: 1917892 - RNA, 20 nt, Shigella flexneri 2a str. 2457T
gggcggaacuucgcgaguga

SEQ ID NO: 1917893 - RNA, 14 nt, Shigella flexneri 2a str. 2457T
gggcgauuuugcuu

SEQ ID NO: 1917894 - RNA, 13 nt, Shigella flexneri 2a str. 2457T
gggcgaguaugga

SEQ ID NO: 1917895 - RNA, 21 nt, Shigella flexneri 2a str. 2457T
gggcgaauuaucggcagcggc

SEQ ID NO: 1917896 - RNA, 14 nt, Shigella flexneri 2a str. 2457T
gggccgucuggcug

SEQ ID NO: 1917897 - RNA, 23 nt, Shigella flexneri 2a str. 2457T
gggccguuuucguuacuccgcca

SEQ ID NO: 1917898 - RNA, 12 nt, Shigella flexneri 2a str. 2457T
gggccugaagga

SEQ ID NO: 1917899 - RNA, 20 nt, Shigella flexneri 2a str. 2457T
gggccgaacaucagauaauc

SEQ ID NO: 1917900 - RNA, 21 nt, Shigella flexneri 2a str. 2457T
gggcauuuccauuuuugacua

SEQ ID NO: 1917901 - RNA, 16 nt, Shigella flexneri 2a str. 2457T
gggccaacuggcaaaa

SEQ ID NO: 1917902 - RNA, 14 nt, Shigella flexneri 2a str. 2457T
gggcaugaguaaaa

SEQ ID NO: 1917903 - RNA, 18 nt, Shigella flexneri 2a str. 2457T
gggcauguguuagcccug

SEQ ID NO: 1917904 - RNA, 19 nt, Shigella flexneri 2a str. 2457T
gggucuuccagcaaaucca

SEQ ID NO: 1917905 - RNA, 13 nt, Shigella flexneri 2a str. 2457T
gggucaguaugga

SEQ ID NO: 1917906 - RNA, 21 nt, Shigella flexneri 2a str. 2457T
gggucauccaggaacuccaga

SEQ ID NO: 1917907 - RNA, 21 nt, Shigella flexneri 2a str. 2457T
ggguauggaucccucuuucug

SEQ ID NO: 1917908 - RNA, 14 nt, Shigella flexneri 2a str. 2457T
gggguaaagcgcgg

SEQ ID NO: 1917909 - RNA, 20 nt, Shigella flexneri 2a str. 2457T
gggggcuaaucuugaaacca

SEQ ID NO: 1917910 - RNA, 15 nt, Shigella flexneri 2a str. 2457T
ggguacgacuuccug

SEQ ID NO: 1917911 - RNA, 21 nt, Shigella flexneri 2a str. 2457T
ggguaaaaccccgcguacuga

SEQ ID NO: 1917912 - RNA, 12 nt, Shigella flexneri 2a str. 2457T
gggcuucaaagu

SEQ ID NO: 1917913 - RNA, 21 nt, Shigella flexneri 2a str. 2457T
gggcuggaaacgcgaucgcca

SEQ ID NO: 1917914 - RNA, 20 nt, Shigella flexneri 2a str. 2457T
gggcuggcguacccaucaac

SEQ ID NO: 1917915 - RNA, 21 nt, Shigella flexneri 2a str. 2457T
gggcuuuuuuuauuauuccgu

SEQ ID NO: 1917916 - RNA, 18 nt, Shigella flexneri 2a str. 2457T
gggcuuuauucaccagua

SEQ ID NO: 1917917 - RNA, 21 nt, Shigella flexneri 2a str. 2457T
ggggauguguuauucagcugg

SEQ ID NO: 1917918 - RNA, 16 nt, Shigella flexneri 2a str. 2457T
ggggauguuggcgaau

SEQ ID NO: 1917919 - RNA, 12 nt, Shigella flexneri 2a str. 2457T
ggggccagcauu

SEQ ID NO: 1917920 - RNA, 14 nt, Shigella flexneri 2a str. 2457T
ggggcuucuuccgg

SEQ ID NO: 1917921 - RNA, 15 nt, Shigella flexneri 2a str. 2457T
ggggcggcaaucgcu

SEQ ID NO: 1917922 - RNA, 16 nt, Shigella flexneri 2a str. 2457T
gggagcagacuguaaa

SEQ ID NO: 1917923 - RNA, 23 nt, Shigella flexneri 2a str. 2457T
gggagcagauacggcgcaucugu

SEQ ID NO: 1917924 - RNA, 14 nt, Shigella flexneri 2a str. 2457T
gggagcaggccggg

SEQ ID NO: 1917925 - RNA, 17 nt, Shigella flexneri 2a str. 2457T
gggagcaggcuaguaaa

SEQ ID NO: 1917926 - RNA, 14 nt, Shigella flexneri 2a str. 2457T
gggagagggccggg

SEQ ID NO: 1917927 - RNA, 15 nt, Shigella flexneri 2a str. 2457T
gggagagggccgggg

SEQ ID NO: 1917928 - RNA, 16 nt, Shigella flexneri 2a str. 2457T
gggaaugugaugaaaa

SEQ ID NO: 1917929 - RNA, 19 nt, Shigella flexneri 2a str. 2457T
gggaaugugaugaaaaaag

SEQ ID NO: 1917930 - RNA, 14 nt, Shigella flexneri 2a str. 2457T
gggaauccagcaau

SEQ ID NO: 1917931 - RNA, 18 nt, Shigella flexneri 2a str. 2457T
ggcuuuuuaugacgcugg

SEQ ID NO: 1917932 - RNA, 18 nt, Shigella flexneri 2a str. 2457T
gggaaaacagcgcaccag

SEQ ID NO: 1917933 - RNA, 23 nt, Shigella flexneri 2a str. 2457T
gggaaaacagcgcaccagaaaca

SEQ ID NO: 1917934 - RNA, 13 nt, Shigella flexneri 2a str. 2457T
gggaaaacucagu

SEQ ID NO: 1917935 - RNA, 16 nt, Shigella flexneri 2a str. 2457T
gggaaaacgcuggcag

SEQ ID NO: 1917936 - RNA, 14 nt, Shigella flexneri 2a str. 2457T
ggcuuuuuuuugcc

SEQ ID NO: 1917937 - RNA, 18 nt, Shigella flexneri 2a str. 2457T
ggcuuuuuuacaucauca

SEQ ID NO: 1917938 - RNA, 23 nt, Shigella flexneri 2a str. 2457T
ggcuuuuuuaccucuuuuuucaa

SEQ ID NO: 1917939 - RNA, 22 nt, Shigella flexneri 2a str. 2457T
ggcuuucaucacuugauccaua

SEQ ID NO: 1917940 - RNA, 15 nt, Shigella flexneri 2a str. 2457T
ggcuuuaucacugag

SEQ ID NO: 1917941 - RNA, 23 nt, Shigella flexneri 2a str. 2457T
ggcuuuaccaccgucaaaaaaac

SEQ ID NO: 1917942 - RNA, 13 nt, Shigella flexneri 2a str. 2457T
ggcuuuaaucacc

SEQ ID NO: 1917943 - RNA, 23 nt, Shigella flexneri 2a str. 2457T
ggcuuucuucuggguugccugau

SEQ ID NO: 1917944 - RNA, 21 nt, Shigella flexneri 2a str. 2457T
ggcuuuguuacccccauccac

SEQ ID NO: 1917945 - RNA, 17 nt, Shigella flexneri 2a str. 2457T
ggcuuugcuguuuccag

SEQ ID NO: 1917946 - RNA, 14 nt, Shigella flexneri 2a str. 2457T
ggcuuuggcaaacu

SEQ ID NO: 1917947 - RNA, 19 nt, Shigella flexneri 2a str. 2457T
ggcuuugcuacagccuggu

SEQ ID NO: 1917948 - RNA, 22 nt, Shigella flexneri 2a str. 2457T
gggaaggcccuuucccuucucg

SEQ ID NO: 1917949 - RNA, 13 nt, Shigella flexneri 2a str. 2457T
gggaacaucaggc

SEQ ID NO: 1917950 - RNA, 13 nt, Shigella flexneri 2a str. 2457T
gggaacagaccag

SEQ ID NO: 1917951 - RNA, 14 nt, Shigella flexneri 2a str. 2457T
gggaaaguggcguu

SEQ ID NO: 1917952 - RNA, 23 nt, Shigella flexneri 2a str. 2457T
gggaggcacaccagauuccucuc

SEQ ID NO: 1917953 - RNA, 13 nt, Shigella flexneri 2a str. 2457T
gggauagcucaau

SEQ ID NO: 1917954 - RNA, 19 nt, Shigella flexneri 2a str. 2457T
gggauagaaacagucugga

SEQ ID NO: 1917955 - RNA, 15 nt, Shigella flexneri 2a str. 2457T
gggaucagcuuuuua

SEQ ID NO: 1917956 - RNA, 20 nt, Shigella flexneri 2a str. 2457T
gggaucauccacccgcagca

SEQ ID NO: 1917957 - RNA, 19 nt, Shigella flexneri 2a str. 2457T
gggaucucuuccagugccu

SEQ ID NO: 1917958 - RNA, 13 nt, Shigella flexneri 2a str. 2457T
gggaugcagaaug

SEQ ID NO: 1917959 - RNA, 17 nt, Shigella flexneri 2a str. 2457T
gggauuauugccgcagc

SEQ ID NO: 1917960 - RNA, 21 nt, Shigella flexneri 2a str. 2457T
gggcaaauucuucacggaaaa

SEQ ID NO: 1917961 - RNA, 21 nt, Shigella flexneri 2a str. 2457T
gggauucacguugaugguagg

SEQ ID NO: 1917962 - RNA, 14 nt, Shigella flexneri 2a str. 2457T
gggcaauauuucgc

SEQ ID NO: 1917963 - RNA, 18 nt, Shigella flexneri 2a str. 2457T
gggcagcaucgccaggau

SEQ ID NO: 1917964 - RNA, 16 nt, Shigella flexneri 2a str. 2457T
gggcaggaaaaucagc

SEQ ID NO: 1917965 - RNA, 16 nt, Shigella flexneri 2a str. 2457T
ggcuggcacaaaaaau

SEQ ID NO: 1917966 - RNA, 20 nt, Shigella flexneri 2a str. 2457T
ggcuggccccgucagcaaaa

SEQ ID NO: 1917967 - RNA, 21 nt, Shigella flexneri 2a str. 2457T
ggcuggcauuuuuuauggugg

SEQ ID NO: 1917968 - RNA, 20 nt, Shigella flexneri 2a str. 2457T
ggcuggcggcaaucgccaga

SEQ ID NO: 1917969 - RNA, 20 nt, Shigella flexneri 2a str. 2457T
ggcugugggucaccguacug

SEQ ID NO: 1917970 - RNA, 19 nt, Shigella flexneri 2a str. 2457T
ggcugugcccguaaaaaau

SEQ ID NO: 1917971 - RNA, 16 nt, Shigella flexneri 2a str. 2457T
ggcugucauccagcag

SEQ ID NO: 1917972 - RNA, 20 nt, Shigella flexneri 2a str. 2457T
ggcuggcucguugcgccggg

SEQ ID NO: 1917973 - RNA, 15 nt, Shigella flexneri 2a str. 2457T
ggcuuauccggcaug

SEQ ID NO: 1917974 - RNA, 19 nt, Shigella flexneri 2a str. 2457T
ggcuguucacugugcuggu

SEQ ID NO: 1917975 - RNA, 17 nt, Shigella flexneri 2a str. 2457T
ggcuguuuucagcacca

SEQ ID NO: 1917976 - RNA, 22 nt, Shigella flexneri 2a str. 2457T
ggcuucgccaaaucgcugcugc

SEQ ID NO: 1917977 - RNA, 22 nt, Shigella flexneri 2a str. 2457T
ggcuucaaucaauaacagcgca

SEQ ID NO: 1917978 - RNA, 16 nt, Shigella flexneri 2a str. 2457T
ggcuucugccuuaucc

SEQ ID NO: 1917979 - RNA, 21 nt, Shigella flexneri 2a str. 2457T
ggcuucugccuuauccagcag

SEQ ID NO: 1917980 - RNA, 12 nt, Shigella flexneri 2a str. 2457T
ggcuugccgggc

SEQ ID NO: 1917981 - RNA, 12 nt, Shigella flexneri 2a str. 2457T
ggcuuggcuggc

SEQ ID NO: 1917982 - RNA, 20 nt, Shigella flexneri 2a str. 2457T
ggcuugcugaugcacgcaga

SEQ ID NO: 1917983 - RNA, 16 nt, Shigella flexneri 2a str. 2457T
ggcuugugcgcccggc

SEQ ID NO: 1917984 - RNA, 18 nt, Shigella flexneri 2a str. 2457T
ggcucgccauccagugaa

SEQ ID NO: 1917985 - RNA, 14 nt, Shigella flexneri 2a str. 2457T
ggcucgaucuggug

SEQ ID NO: 1917986 - RNA, 19 nt, Shigella flexneri 2a str. 2457T
ggcucugauugccuuccac

SEQ ID NO: 1917987 - RNA, 22 nt, Shigella flexneri 2a str. 2457T
ggcucuuaagcaccgacguuga

SEQ ID NO: 1917988 - RNA, 18 nt, Shigella flexneri 2a str. 2457T
ggcucuucgcuccaguca

SEQ ID NO: 1917989 - RNA, 15 nt, Shigella flexneri 2a str. 2457T
ggcuccacuucguuc

SEQ ID NO: 1917990 - RNA, 16 nt, Shigella flexneri 2a str. 2457T
ggcuccucugacugga

SEQ ID NO: 1917991 - RNA, 23 nt, Shigella flexneri 2a str. 2457T
ggcgucaacaacacucucugaag

SEQ ID NO: 1917992 - RNA, 18 nt, Shigella flexneri 2a str. 2457T
ggcguagugcccgcagua

SEQ ID NO: 1917993 - RNA, 18 nt, Shigella flexneri 2a str. 2457T
ggcucuuuuucggggcug

SEQ ID NO: 1917994 - RNA, 22 nt, Shigella flexneri 2a str. 2457T
ggcugacugcuuugcacaggca

SEQ ID NO: 1917995 - RNA, 13 nt, Shigella flexneri 2a str. 2457T
ggcugccagcucu

SEQ ID NO: 1917996 - RNA, 14 nt, Shigella flexneri 2a str. 2457T
ggcugccagcucuc

SEQ ID NO: 1917997 - RNA, 13 nt, Shigella flexneri 2a str. 2457T
ggcugccaugguu

SEQ ID NO: 1917998 - RNA, 10 nt, Shigella flexneri 2a str. 2457T
ggcugccgcc

SEQ ID NO: 1917999 - RNA, 15 nt, Shigella flexneri 2a str. 2457T
ggcugccugagcugu

SEQ ID NO: 1918000 - RNA, 21 nt, Shigella flexneri 2a str. 2457T
aaauaacgccggagagaaaaa

SEQ ID NO: 1918001 - RNA, 18 nt, Shigella flexneri 2a str. 2457T
ggcgagaauagucggccc

SEQ ID NO: 1918002 - RNA, 16 nt, Shigella flexneri 2a str. 2457T
ggcgagcgccagcaug

SEQ ID NO: 1918003 - RNA, 16 nt, Shigella flexneri 2a str. 2457T
ggccgacagcaggcuc

SEQ ID NO: 1918004 - RNA, 14 nt, Shigella flexneri 2a str. 2457T
ggccgagaggcuga

SEQ ID NO: 1918005 - RNA, 13 nt, Shigella flexneri 2a str. 2457T
ggcgaaaggcugg

SEQ ID NO: 1918006 - RNA, 14 nt, Shigella flexneri 2a str. 2457T
ggcgaaaggcuggc

SEQ ID NO: 1918007 - RNA, 18 nt, Shigella flexneri 2a str. 2457T
ggcgaaaagcuucuuccu

SEQ ID NO: 1918008 - RNA, 19 nt, Shigella flexneri 2a str. 2457T
ggcgacacaucuaaugcuu

SEQ ID NO: 1918009 - RNA, 12 nt, Shigella flexneri 2a str. 2457T
aaauaauauccc

SEQ ID NO: 1918010 - RNA, 14 nt, Shigella flexneri 2a str. 2457T
aaauaauccgcugu

SEQ ID NO: 1918011 - RNA, 23 nt, Shigella flexneri 2a str. 2457T
aaauaaucccgcgcaacaaauaa

SEQ ID NO: 1918012 - RNA, 21 nt, Shigella flexneri 2a str. 2457T
aaauaaucgcaauuacccagu

SEQ ID NO: 1918013 - RNA, 19 nt, Shigella flexneri 2a str. 2457T
aaauaaucgggaauacaga

SEQ ID NO: 1918014 - RNA, 21 nt, Shigella flexneri 2a str. 2457T
aaauaauuuucguaguauaga

SEQ ID NO: 1918015 - RNA, 12 nt, Shigella flexneri 2a str. 2457T
aaauaauuuuaa

SEQ ID NO: 1918016 - RNA, 13 nt, Shigella flexneri 2a str. 2457T
ggcgauaccagua

SEQ ID NO: 1918017 - RNA, 15 nt, Shigella flexneri 2a str. 2457T
ggcgauaucuggauc

SEQ ID NO: 1918018 - RNA, 20 nt, Shigella flexneri 2a str. 2457T
ggcgauauuauccccugcga

SEQ ID NO: 1918019 - RNA, 13 nt, Shigella flexneri 2a str. 2457T
ggcgauuccacuc

SEQ ID NO: 1918020 - RNA, 19 nt, Shigella flexneri 2a str. 2457T
ggcgaugcacaugcuucag

SEQ ID NO: 1918021 - RNA, 18 nt, Shigella flexneri 2a str. 2457T
ggcgcaccugaaucguca

SEQ ID NO: 1918022 - RNA, 12 nt, Shigella flexneri 2a str. 2457T
ggcgcagcgcgc

SEQ ID NO: 1918023 - RNA, 21 nt, Shigella flexneri 2a str. 2457T
aaauacauacgcaaaaaacau

SEQ ID NO: 1918024 - RNA, 15 nt, Shigella flexneri 2a str. 2457T
aaauacccaaaaaau

SEQ ID NO: 1918025 - RNA, 17 nt, Shigella flexneri 2a str. 2457T
aaauacccaaaaaauag

SEQ ID NO: 1918026 - RNA, 18 nt, Shigella flexneri 2a str. 2457T
aaauacauuaguaauuuc

SEQ ID NO: 1918027 - RNA, 18 nt, Shigella flexneri 2a str. 2457T
ggcgggcaagcggcggca

SEQ ID NO: 1918028 - RNA, 13 nt, Shigella flexneri 2a str. 2457T
ggcggcgcggcga

SEQ ID NO: 1918029 - RNA, 17 nt, Shigella flexneri 2a str. 2457T
ggcggauggaguggggc

SEQ ID NO: 1918030 - RNA, 16 nt, Shigella flexneri 2a str. 2457T
ggcggcaaucgcugcu

SEQ ID NO: 1918031 - RNA, 21 nt, Shigella flexneri 2a str. 2457T
ggcggcaaugaaagcgagcga

SEQ ID NO: 1918032 - RNA, 20 nt, Shigella flexneri 2a str. 2457T
ggcggcaguauagcggcaug

SEQ ID NO: 1918033 - RNA, 15 nt, Shigella flexneri 2a str. 2457T
ggcggaagagcacac

SEQ ID NO: 1918034 - RNA, 15 nt, Shigella flexneri 2a str. 2457T
ggcgcgucagauuga

SEQ ID NO: 1918035 - RNA, 13 nt, Shigella flexneri 2a str. 2457T
ggcgcugaucuua

SEQ ID NO: 1918036 - RNA, 15 nt, Shigella flexneri 2a str. 2457T
aaauagaaagugacu

SEQ ID NO: 1918037 - RNA, 16 nt, Shigella flexneri 2a str. 2457T
ggcgcggacgcacaua

SEQ ID NO: 1918038 - RNA, 14 nt, Shigella flexneri 2a str. 2457T
ggcgcggcccuggg

SEQ ID NO: 1918039 - RNA, 23 nt, Shigella flexneri 2a str. 2457T
aaauacgcuuuuucccugguaaa

SEQ ID NO: 1918040 - RNA, 14 nt, Shigella flexneri 2a str. 2457T
ggcgcgaaacauca

SEQ ID NO: 1918041 - RNA, 17 nt, Shigella flexneri 2a str. 2457T
ggcgcgaaccaucaccu

SEQ ID NO: 1918042 - RNA, 20 nt, Shigella flexneri 2a str. 2457T
ggcgcgcauucuggagcugg

SEQ ID NO: 1918043 - RNA, 20 nt, Shigella flexneri 2a str. 2457T
gccuucacgguuauuguagc

SEQ ID NO: 1918044 - RNA, 12 nt, Shigella flexneri 2a str. 2457T
gccuucaggaau

SEQ ID NO: 1918045 - RNA, 15 nt, Shigella flexneri 2a str. 2457T
gccuucgccuuucag

SEQ ID NO: 1918046 - RNA, 23 nt, Shigella flexneri 2a str. 2457T
gccuuucacgccgggaaauuuuu

SEQ ID NO: 1918047 - RNA, 21 nt, Shigella flexneri 2a str. 2457T
gccuuuccuccugucuucccu

SEQ ID NO: 1918048 - RNA, 23 nt, Shigella flexneri 2a str. 2457T
gccuuuccuccugucuucccugc

SEQ ID NO: 1918049 - RNA, 14 nt, Shigella flexneri 2a str. 2457T
gccuuucucagaga

SEQ ID NO: 1918050 - RNA, 22 nt, Shigella flexneri 2a str. 2457T
gccuuugaaaauaacaucgcca

SEQ ID NO: 1918051 - RNA, 22 nt, Shigella flexneri 2a str. 2457T
gccuuucuuaauauuuuccgug

SEQ ID NO: 1918052 - RNA, 21 nt, Shigella flexneri 2a str. 2457T
gccuuuucaguuggcugacaa

SEQ ID NO: 1918053 - RNA, 17 nt, Shigella flexneri 2a str. 2457T
gccuuuauuaaugacau

SEQ ID NO: 1918054 - RNA, 22 nt, Shigella flexneri 2a str. 2457T
gcgaagauacccgcgaggcgca

SEQ ID NO: 1918055 - RNA, 17 nt, Shigella flexneri 2a str. 2457T
gcgaagaaagcggguga

SEQ ID NO: 1918056 - RNA, 15 nt, Shigella flexneri 2a str. 2457T
gcgaagagaaagaac

SEQ ID NO: 1918057 - RNA, 13 nt, Shigella flexneri 2a str. 2457T
gccuuuuccagcg

SEQ ID NO: 1918058 - RNA, 12 nt, Shigella flexneri 2a str. 2457T
gcgaaagaaaag

SEQ ID NO: 1918059 - RNA, 17 nt, Shigella flexneri 2a str. 2457T
gcgaaacgguguaaaaa

SEQ ID NO: 1918060 - RNA, 18 nt, Shigella flexneri 2a str. 2457T
gcgaacaacagaucaaca

SEQ ID NO: 1918061 - RNA, 21 nt, Shigella flexneri 2a str. 2457T
gcgaacauaaggaugcgggcg

SEQ ID NO: 1918062 - RNA, 20 nt, Shigella flexneri 2a str. 2457T
gccuggguuuucacagaagu

SEQ ID NO: 1918063 - RNA, 18 nt, Shigella flexneri 2a str. 2457T
gccugguaccagcaccgu

SEQ ID NO: 1918064 - RNA, 15 nt, Shigella flexneri 2a str. 2457T
gccuggguuuucaca

SEQ ID NO: 1918065 - RNA, 17 nt, Shigella flexneri 2a str. 2457T
gccuggguuuucacaga

SEQ ID NO: 1918066 - RNA, 18 nt, Shigella flexneri 2a str. 2457T
gccugggcgauuuccuuc

SEQ ID NO: 1918067 - RNA, 13 nt, Shigella flexneri 2a str. 2457T
gccugggcgaggu

SEQ ID NO: 1918068 - RNA, 17 nt, Shigella flexneri 2a str. 2457T
gccuggcugcauggcaa

SEQ ID NO: 1918069 - RNA, 16 nt, Shigella flexneri 2a str. 2457T
gccuggcguccggaaa

SEQ ID NO: 1918070 - RNA, 23 nt, Shigella flexneri 2a str. 2457T
gccuuauugccugugacuuucug

SEQ ID NO: 1918071 - RNA, 18 nt, Shigella flexneri 2a str. 2457T
gccuucacaggccgccag

SEQ ID NO: 1918072 - RNA, 19 nt, Shigella flexneri 2a str. 2457T
gccuucacaggccgccagg

SEQ ID NO: 1918073 - RNA, 19 nt, Shigella flexneri 2a str. 2457T
gccugcugggcgcaccugc

SEQ ID NO: 1918074 - RNA, 22 nt, Shigella flexneri 2a str. 2457T
gccugcugauaagacgcaucca

SEQ ID NO: 1918075 - RNA, 16 nt, Shigella flexneri 2a str. 2457T
gccugccgcauccggu

SEQ ID NO: 1918076 - RNA, 13 nt, Shigella flexneri 2a str. 2457T
gccugccugcagc

SEQ ID NO: 1918077 - RNA, 19 nt, Shigella flexneri 2a str. 2457T
gccucucaaaccccgccac

SEQ ID NO: 1918078 - RNA, 15 nt, Shigella flexneri 2a str. 2457T
gccucucuggccgcu

SEQ ID NO: 1918079 - RNA, 21 nt, Shigella flexneri 2a str. 2457T
gccucucuggccgcuuccagc

SEQ ID NO: 1918080 - RNA, 20 nt, Shigella flexneri 2a str. 2457T
gccucucggaucgguggcgc

SEQ ID NO: 1918081 - RNA, 22 nt, Shigella flexneri 2a str. 2457T
gccucuccuuuaccacucucgg

SEQ ID NO: 1918082 - RNA, 15 nt, Shigella flexneri 2a str. 2457T
gccucucuucgcugc

SEQ ID NO: 1918083 - RNA, 19 nt, Shigella flexneri 2a str. 2457T
gccucgcuggucagcgcca

SEQ ID NO: 1918084 - RNA, 15 nt, Shigella flexneri 2a str. 2457T
gccucguucuucccu

SEQ ID NO: 1918085 - RNA, 18 nt, Shigella flexneri 2a str. 2457T
gccucgguaagcaaagcg

SEQ ID NO: 1918086 - RNA, 18 nt, Shigella flexneri 2a str. 2457T
gccucgggcuuugcuaca

SEQ ID NO: 1918087 - RNA, 16 nt, Shigella flexneri 2a str. 2457T
gccucgcuacgccagc

SEQ ID NO: 1918088 - RNA, 16 nt, Shigella flexneri 2a str. 2457T
gccucgccgaaacgcu

SEQ ID NO: 1918089 - RNA, 17 nt, Shigella flexneri 2a str. 2457T
gccucgccgaaacgcuu

SEQ ID NO: 1918090 - RNA, 17 nt, Shigella flexneri 2a str. 2457T
gccucagguaccagcau

SEQ ID NO: 1918091 - RNA, 14 nt, Shigella flexneri 2a str. 2457T
gccucccugccucc

SEQ ID NO: 1918092 - RNA, 15 nt, Shigella flexneri 2a str. 2457T
gccucccuucgcugc

SEQ ID NO: 1918093 - RNA, 18 nt, Shigella flexneri 2a str. 2457T
gccgugcugccagcgauu

SEQ ID NO: 1918094 - RNA, 18 nt, Shigella flexneri 2a str. 2457T
gccgugaacguggccaug

SEQ ID NO: 1918095 - RNA, 21 nt, Shigella flexneri 2a str. 2457T
gccguuauccugaucaagcac

SEQ ID NO: 1918096 - RNA, 13 nt, Shigella flexneri 2a str. 2457T
gccguuagcuuca

SEQ ID NO: 1918097 - RNA, 20 nt, Shigella flexneri 2a str. 2457T
gccuacaacuccguugaaau

SEQ ID NO: 1918098 - RNA, 21 nt, Shigella flexneri 2a str. 2457T
gccuaauccagccuacaaauu

SEQ ID NO: 1918099 - RNA, 14 nt, Shigella flexneri 2a str. 2457T
gccguuuucaaagg

SEQ ID NO: 1918100 - RNA, 16 nt, Shigella flexneri 2a str. 2457T
gccguuugcugcauga

SEQ ID NO: 1918101 - RNA, 16 nt, Shigella flexneri 2a str. 2457T
gccguuuaccgccauc

SEQ ID NO: 1918102 - RNA, 22 nt, Shigella flexneri 2a str. 2457T
gccgucaccgccugcgauggug

SEQ ID NO: 1918103 - RNA, 20 nt, Shigella flexneri 2a str. 2457T
gccguccugcguuucuucua

SEQ ID NO: 1918104 - RNA, 14 nt, Shigella flexneri 2a str. 2457T
gccguccggcgcug

SEQ ID NO: 1918105 - RNA, 17 nt, Shigella flexneri 2a str. 2457T
gccgucugccccgccgc

SEQ ID NO: 1918106 - RNA, 13 nt, Shigella flexneri 2a str. 2457T
gccgcuuccagca

SEQ ID NO: 1918107 - RNA, 20 nt, Shigella flexneri 2a str. 2457T
gccgcuuuuucugcgcacac

SEQ ID NO: 1918108 - RNA, 22 nt, Shigella flexneri 2a str. 2457T
gccggaaacauaaauaguggca

SEQ ID NO: 1918109 - RNA, 22 nt, Shigella flexneri 2a str. 2457T
gccgcuuuaugugcuucuacca

SEQ ID NO: 1918110 - RNA, 18 nt, Shigella flexneri 2a str. 2457T
gccggaaauuugcagugc

SEQ ID NO: 1918111 - RNA, 18 nt, Shigella flexneri 2a str. 2457T
gccguaguuccacauaaa

SEQ ID NO: 1918112 - RNA, 18 nt, Shigella flexneri 2a str. 2457T
gccguauaauaucuuuuc

SEQ ID NO: 1918113 - RNA, 20 nt, Shigella flexneri 2a str. 2457T
gccggaacguuaagagcugg

SEQ ID NO: 1918114 - RNA, 19 nt, Shigella flexneri 2a str. 2457T
gccguauggcgagcaggag

SEQ ID NO: 1918115 - RNA, 12 nt, Shigella flexneri 2a str. 2457T
gcgcauccggca

SEQ ID NO: 1918116 - RNA, 20 nt, Shigella flexneri 2a str. 2457T
gcgcaguuuaaucguugaug

SEQ ID NO: 1918117 - RNA, 15 nt, Shigella flexneri 2a str. 2457T
gcgcaucaugccacc

SEQ ID NO: 1918118 - RNA, 16 nt, Shigella flexneri 2a str. 2457T
gcgcaucagcuccggu

SEQ ID NO: 1918119 - RNA, 13 nt, Shigella flexneri 2a str. 2457T
gcgcaucaaagcc

SEQ ID NO: 1918120 - RNA, 14 nt, Shigella flexneri 2a str. 2457T
gcgcaucagcuccg

SEQ ID NO: 1918121 - RNA, 19 nt, Shigella flexneri 2a str. 2457T
gcgcauuacgcucacugca

SEQ ID NO: 1918122 - RNA, 16 nt, Shigella flexneri 2a str. 2457T
gcgcauuaagccauga

SEQ ID NO: 1918123 - RNA, 12 nt, Shigella flexneri 2a str. 2457T
gcgcauugacga

SEQ ID NO: 1918124 - RNA, 22 nt, Shigella flexneri 2a str. 2457T
gcgcauuucccagcaagaacca

SEQ ID NO: 1918125 - RNA, 17 nt, Shigella flexneri 2a str. 2457T
gcgcauuucccagcaag

SEQ ID NO: 1918126 - RNA, 15 nt, Shigella flexneri 2a str. 2457T
gcgccaaaugucagc

SEQ ID NO: 1918127 - RNA, 16 nt, Shigella flexneri 2a str. 2457T
gcgccaagcagcgcgc

SEQ ID NO: 1918128 - RNA, 17 nt, Shigella flexneri 2a str. 2457T
gcgccaagauagaacca

SEQ ID NO: 1918129 - RNA, 21 nt, Shigella flexneri 2a str. 2457T
gcgccaaucagcgcagcaccc

SEQ ID NO: 1918130 - RNA, 21 nt, Shigella flexneri 2a str. 2457T
gcgccagccaguuuacccagc

SEQ ID NO: 1918131 - RNA, 17 nt, Shigella flexneri 2a str. 2457T
gcgccagccaccacaau

SEQ ID NO: 1918132 - RNA, 22 nt, Shigella flexneri 2a str. 2457T
gcgccagcaucgcauccggcaa

SEQ ID NO: 1918133 - RNA, 11 nt, Shigella flexneri 2a str. 2457T
gcgccagcaag

SEQ ID NO: 1918134 - RNA, 13 nt, Shigella flexneri 2a str. 2457T
gcgccagauggca

SEQ ID NO: 1918135 - RNA, 22 nt, Shigella flexneri 2a str. 2457T
gcgccagcaagagcaaauaaaa

SEQ ID NO: 1918136 - RNA, 19 nt, Shigella flexneri 2a str. 2457T
gcgccagcaagagcaaaua

SEQ ID NO: 1918137 - RNA, 20 nt, Shigella flexneri 2a str. 2457T
gcgccagcgaagccagcucc

SEQ ID NO: 1918138 - RNA, 13 nt, Shigella flexneri 2a str. 2457T
gcgccagcgcgga

SEQ ID NO: 1918139 - RNA, 13 nt, Shigella flexneri 2a str. 2457T
gcgccagcggcag

SEQ ID NO: 1918140 - RNA, 17 nt, Shigella flexneri 2a str. 2457T
gcgccagcggccagcgc

SEQ ID NO: 1918141 - RNA, 20 nt, Shigella flexneri 2a str. 2457T
gcgccaccgcggacagacuu

SEQ ID NO: 1918142 - RNA, 19 nt, Shigella flexneri 2a str. 2457T
gcgccaccucuuucaccaa

SEQ ID NO: 1918143 - RNA, 15 nt, Shigella flexneri 2a str. 2457T
gcgccacaucagacu

SEQ ID NO: 1918144 - RNA, 20 nt, Shigella flexneri 2a str. 2457T
gcgccaaucggcaauucagu

SEQ ID NO: 1918145 - RNA, 15 nt, Shigella flexneri 2a str. 2457T
gcgccaccaccagca

SEQ ID NO: 1918146 - RNA, 16 nt, Shigella flexneri 2a str. 2457T
gcgccagacaaaccac

SEQ ID NO: 1918147 - RNA, 24 nt, Shigella flexneri 2a str. 2457T
gcgccagacccagacgcucagggu

SEQ ID NO: 1918148 - RNA, 17 nt, Shigella flexneri 2a str. 2457T
gcgcacugucgccgcgg

SEQ ID NO: 1918149 - RNA, 18 nt, Shigella flexneri 2a str. 2457T
gcgcagcauaaucggcug

SEQ ID NO: 1918150 - RNA, 17 nt, Shigella flexneri 2a str. 2457T
gcgcaggccaacagucu

SEQ ID NO: 1918151 - RNA, 15 nt, Shigella flexneri 2a str. 2457T
gcgcagcgaguaaaa

SEQ ID NO: 1918152 - RNA, 17 nt, Shigella flexneri 2a str. 2457T
gcgcagucaccagcauc

SEQ ID NO: 1918153 - RNA, 19 nt, Shigella flexneri 2a str. 2457T
gcgcagugccuucugguga

SEQ ID NO: 1918154 - RNA, 16 nt, Shigella flexneri 2a str. 2457T
gcgcaguucgcacacc

SEQ ID NO: 1918155 - RNA, 22 nt, Shigella flexneri 2a str. 2457T
gcgcaguugcaacucgacugga

SEQ ID NO: 1918156 - RNA, 17 nt, Shigella flexneri 2a str. 2457T
gcgcaauuuccauugcu

SEQ ID NO: 1918157 - RNA, 20 nt, Shigella flexneri 2a str. 2457T
gcgcaauguugcgggggcuu

SEQ ID NO: 1918158 - RNA, 13 nt, Shigella flexneri 2a str. 2457T
gcgcacaucagga

SEQ ID NO: 1918159 - RNA, 18 nt, Shigella flexneri 2a str. 2457T
gcgcacauccgcgucggc

SEQ ID NO: 1918160 - RNA, 17 nt, Shigella flexneri 2a str. 2457T
gcgcaaaggccagcaau

SEQ ID NO: 1918161 - RNA, 15 nt, Shigella flexneri 2a str. 2457T
gcgcaaauugcuggu

SEQ ID NO: 1918162 - RNA, 22 nt, Shigella flexneri 2a str. 2457T
gcgcaacaaauaaaagcaaaaa

SEQ ID NO: 1918163 - RNA, 16 nt, Shigella flexneri 2a str. 2457T
gcgcaacuugcagauc

SEQ ID NO: 1918164 - RNA, 20 nt, Shigella flexneri 2a str. 2457T
gcgcaauaugcggugccauu

SEQ ID NO: 1918165 - RNA, 22 nt, Shigella flexneri 2a str. 2457T
gcgcaauaccgauaucgccauu

SEQ ID NO: 1918166 - RNA, 16 nt, Shigella flexneri 2a str. 2457T
gcgcaaucgcccagcg

SEQ ID NO: 1918167 - RNA, 19 nt, Shigella flexneri 2a str. 2457T
gcgcaaugccauccagcuu

SEQ ID NO: 1918168 - RNA, 16 nt, Shigella flexneri 2a str. 2457T
gcgcaagggccgcagc

SEQ ID NO: 1918169 - RNA, 17 nt, Shigella flexneri 2a str. 2457T
gcgcaacuugugcucgu

SEQ ID NO: 1918170 - RNA, 21 nt, Shigella flexneri 2a str. 2457T
gcgauuauuuauucccgccag

SEQ ID NO: 1918171 - RNA, 17 nt, Shigella flexneri 2a str. 2457T
gcgauuaugaaacaaga

SEQ ID NO: 1918172 - RNA, 18 nt, Shigella flexneri 2a str. 2457T
gcgauucauaugcgccag

SEQ ID NO: 1918173 - RNA, 21 nt, Shigella flexneri 2a str. 2457T
gcgauucauaugcgccagcug

SEQ ID NO: 1918174 - RNA, 22 nt, Shigella flexneri 2a str. 2457T
gcgauucauaugcgccagcugc

SEQ ID NO: 1918175 - RNA, 14 nt, Shigella flexneri 2a str. 2457T
gcgauuaagaaugc

SEQ ID NO: 1918176 - RNA, 13 nt, Shigella flexneri 2a str. 2457T
gcgauuaauaaaa

SEQ ID NO: 1918177 - RNA, 21 nt, Shigella flexneri 2a str. 2457T
gcgauuaauaaaauuauccag

SEQ ID NO: 1918178 - RNA, 19 nt, Shigella flexneri 2a str. 2457T
gcgauguucaauaaaagca

SEQ ID NO: 1918179 - RNA, 13 nt, Shigella flexneri 2a str. 2457T
gcgcaaaggccag

SEQ ID NO: 1918180 - RNA, 20 nt, Shigella flexneri 2a str. 2457T
gcgauugugacacgcgcgca

SEQ ID NO: 1918181 - RNA, 23 nt, Shigella flexneri 2a str. 2457T
gcgauuucacaagacuguaaaua

SEQ ID NO: 1918182 - RNA, 12 nt, Shigella flexneri 2a str. 2457T
gcgauugccgca

SEQ ID NO: 1918183 - RNA, 21 nt, Shigella flexneri 2a str. 2457T
gcgaugcugacgcaucuucuc

SEQ ID NO: 1918184 - RNA, 14 nt, Shigella flexneri 2a str. 2457T
gcgauggcccgcuu

SEQ ID NO: 1918185 - RNA, 12 nt, Shigella flexneri 2a str. 2457T
gcgaugguggug

SEQ ID NO: 1918186 - RNA, 13 nt, Shigella flexneri 2a str. 2457T
gcgaugguggugg

SEQ ID NO: 1918187 - RNA, 20 nt, Shigella flexneri 2a str. 2457T
gcgaugaugccaagccgaua

SEQ ID NO: 1918188 - RNA, 20 nt, Shigella flexneri 2a str. 2457T
gcgaugauuuucggcugcgc

SEQ ID NO: 1918189 - RNA, 15 nt, Shigella flexneri 2a str. 2457T
gcgaugccuggcaau

SEQ ID NO: 1918190 - RNA, 17 nt, Shigella flexneri 2a str. 2457T
gcgaugcccagugacca

SEQ ID NO: 1918191 - RNA, 16 nt, Shigella flexneri 2a str. 2457T
gcgaugaccaaaaaca

SEQ ID NO: 1918192 - RNA, 20 nt, Shigella flexneri 2a str. 2457T
gcgaucuuccacgccugcau

SEQ ID NO: 1918193 - RNA, 12 nt, Shigella flexneri 2a str. 2457T
gcgaucuucccg

SEQ ID NO: 1918194 - RNA, 20 nt, Shigella flexneri 2a str. 2457T
gcgaucgucgcuccaugaga

SEQ ID NO: 1918195 - RNA, 17 nt, Shigella flexneri 2a str. 2457T
gcgagcuuucgaccagc

SEQ ID NO: 1918196 - RNA, 23 nt, Shigella flexneri 2a str. 2457T
gcgagcuuccuguauaacgcaaa

SEQ ID NO: 1918197 - RNA, 22 nt, Shigella flexneri 2a str. 2457T
gcgauaaccuucaccgugaaug

SEQ ID NO: 1918198 - RNA, 17 nt, Shigella flexneri 2a str. 2457T
gcgauaaccgcaccuuc

SEQ ID NO: 1918199 - RNA, 13 nt, Shigella flexneri 2a str. 2457T
gcgauaaaucuca

SEQ ID NO: 1918200 - RNA, 13 nt, Shigella flexneri 2a str. 2457T
gcgauaaccgcac

SEQ ID NO: 1918201 - RNA, 18 nt, Shigella flexneri 2a str. 2457T
gcgauauaauaaaccugc

SEQ ID NO: 1918202 - RNA, 18 nt, Shigella flexneri 2a str. 2457T
gcgaguuuuucaguccac

SEQ ID NO: 1918203 - RNA, 16 nt, Shigella flexneri 2a str. 2457T
gcgaguuuuaccuuca

SEQ ID NO: 1918204 - RNA, 22 nt, Shigella flexneri 2a str. 2457T
gcgacggcgaaucaaccgcgcc

SEQ ID NO: 1918205 - RNA, 15 nt, Shigella flexneri 2a str. 2457T
gcgaagcuggcggcg

SEQ ID NO: 1918206 - RNA, 15 nt, Shigella flexneri 2a str. 2457T
gcgaagcuggucagc

SEQ ID NO: 1918207 - RNA, 22 nt, Shigella flexneri 2a str. 2457T
gcgaagucguucagaucuuuca

SEQ ID NO: 1918208 - RNA, 14 nt, Shigella flexneri 2a str. 2457T
gcgaauaaaaaaag

SEQ ID NO: 1918209 - RNA, 16 nt, Shigella flexneri 2a str. 2457T
gcgaauaaaaagccua

SEQ ID NO: 1918210 - RNA, 18 nt, Shigella flexneri 2a str. 2457T
gcgaaguagacagcguuu

SEQ ID NO: 1918211 - RNA, 13 nt, Shigella flexneri 2a str. 2457T
gcgaagggcuguc

SEQ ID NO: 1918212 - RNA, 20 nt, Shigella flexneri 2a str. 2457T
gcgagccauaaacugagcca

SEQ ID NO: 1918213 - RNA, 22 nt, Shigella flexneri 2a str. 2457T
gcgagaaacuucacaucaccau

SEQ ID NO: 1918214 - RNA, 21 nt, Shigella flexneri 2a str. 2457T
gcgcccgucugggcgcggcuc

SEQ ID NO: 1918215 - RNA, 13 nt, Shigella flexneri 2a str. 2457T
gcgcccaucggcg

SEQ ID NO: 1918216 - RNA, 19 nt, Shigella flexneri 2a str. 2457T
gcgcccaguggaugcgcca

SEQ ID NO: 1918217 - RNA, 23 nt, Shigella flexneri 2a str. 2457T
gcgccccuggucauaggccgcug

SEQ ID NO: 1918218 - RNA, 16 nt, Shigella flexneri 2a str. 2457T
gcgccccacaccacca

SEQ ID NO: 1918219 - RNA, 22 nt, Shigella flexneri 2a str. 2457T
gcgccaguugcuuauccagcac

SEQ ID NO: 1918220 - RNA, 14 nt, Shigella flexneri 2a str. 2457T
gcgccauuuuucac

SEQ ID NO: 1918221 - RNA, 17 nt, Shigella flexneri 2a str. 2457T
gcgcccaacacuucccc

SEQ ID NO: 1918222 - RNA, 22 nt, Shigella flexneri 2a str. 2457T
gcgccaugcguuuuaccgccuc

SEQ ID NO: 1918223 - RNA, 18 nt, Shigella flexneri 2a str. 2457T
gcgccauaccaugcacca

SEQ ID NO: 1918224 - RNA, 14 nt, Shigella flexneri 2a str. 2457T
gcgccauccauaau

SEQ ID NO: 1918225 - RNA, 14 nt, Shigella flexneri 2a str. 2457T
gcgccgacagcagc

SEQ ID NO: 1918226 - RNA, 23 nt, Shigella flexneri 2a str. 2457T
gcgccgagcaauaaaaacuccgc

SEQ ID NO: 1918227 - RNA, 19 nt, Shigella flexneri 2a str. 2457T
gcgccgacugcgccaauac

SEQ ID NO: 1918228 - RNA, 16 nt, Shigella flexneri 2a str. 2457T
gcgccgaguaaaaaaa

SEQ ID NO: 1918229 - RNA, 20 nt, Shigella flexneri 2a str. 2457T
gcgccgcaacuaccagcagu

SEQ ID NO: 1918230 - RNA, 13 nt, Shigella flexneri 2a str. 2457T
gcgccgccaaccc

SEQ ID NO: 1918231 - RNA, 22 nt, Shigella flexneri 2a str. 2457T
gcgccgcaucgggggaagcuga

SEQ ID NO: 1918232 - RNA, 14 nt, Shigella flexneri 2a str. 2457T
gcgccgcuuucucu

SEQ ID NO: 1918233 - RNA, 22 nt, Shigella flexneri 2a str. 2457T
gcgccgcuuuuugugcggaagu

SEQ ID NO: 1918234 - RNA, 17 nt, Shigella flexneri 2a str. 2457T
gcgccgcucaguacgag

SEQ ID NO: 1918235 - RNA, 20 nt, Shigella flexneri 2a str. 2457T
gcgccgccuccucagaaaag

SEQ ID NO: 1918236 - RNA, 16 nt, Shigella flexneri 2a str. 2457T
gcgccgccucagccag

SEQ ID NO: 1918237 - RNA, 21 nt, Shigella flexneri 2a str. 2457T
gcgccgccucccuucgcugcu

SEQ ID NO: 1918238 - RNA, 17 nt, Shigella flexneri 2a str. 2457T
gcgccguccacaaaccg

SEQ ID NO: 1918239 - RNA, 22 nt, Shigella flexneri 2a str. 2457T
gcgccucaacgccuaaugccag

SEQ ID NO: 1918240 - RNA, 21 nt, Shigella flexneri 2a str. 2457T
gcgccucaacgccuaaugcca

SEQ ID NO: 1918241 - RNA, 18 nt, Shigella flexneri 2a str. 2457T
gcgccugcaggaucagca

SEQ ID NO: 1918242 - RNA, 22 nt, Shigella flexneri 2a str. 2457T
gcgccugcggccagcagcugua

SEQ ID NO: 1918243 - RNA, 16 nt, Shigella flexneri 2a str. 2457T
gcgcggcacccgcagg

SEQ ID NO: 1918244 - RNA, 21 nt, Shigella flexneri 2a str. 2457T
gcgcggcaauuagcggcuggc

SEQ ID NO: 1918245 - RNA, 22 nt, Shigella flexneri 2a str. 2457T
gcgcggcaauuagcggcuggcu

SEQ ID NO: 1918246 - RNA, 15 nt, Shigella flexneri 2a str. 2457T
gcgcgcuucgcccuu

SEQ ID NO: 1918247 - RNA, 16 nt, Shigella flexneri 2a str. 2457T
gcgcgcugccagaacc

SEQ ID NO: 1918248 - RNA, 15 nt, Shigella flexneri 2a str. 2457T
gcgcgcggcaggaag

SEQ ID NO: 1918249 - RNA, 13 nt, Shigella flexneri 2a str. 2457T
gcgcgccaggaga

SEQ ID NO: 1918250 - RNA, 12 nt, Shigella flexneri 2a str. 2457T
gcgcgccaggcg

SEQ ID NO: 1918251 - RNA, 19 nt, Shigella flexneri 2a str. 2457T
gcgccuucgugcggcugca

SEQ ID NO: 1918252 - RNA, 18 nt, Shigella flexneri 2a str. 2457T
gcgccuucuacagcuuca

SEQ ID NO: 1918253 - RNA, 17 nt, Shigella flexneri 2a str. 2457T
gcgccuuauccugccug

SEQ ID NO: 1918254 - RNA, 21 nt, Shigella flexneri 2a str. 2457T
gcgccuucauucaggccaaag

SEQ ID NO: 1918255 - RNA, 13 nt, Shigella flexneri 2a str. 2457T
gcgcgaacagcac

SEQ ID NO: 1918256 - RNA, 19 nt, Shigella flexneri 2a str. 2457T
gcgcgaccaaugucagggc

SEQ ID NO: 1918257 - RNA, 23 nt, Shigella flexneri 2a str. 2457T
gcgccuuuuguuuguucuucucg

SEQ ID NO: 1918258 - RNA, 20 nt, Shigella flexneri 2a str. 2457T
gcgccuuuuuucgccgcagc

SEQ ID NO: 1918259 - RNA, 21 nt, Shigella flexneri 2a str. 2457T
gcgccuuuuuucgccgcagca

SEQ ID NO: 1918260 - RNA, 22 nt, Shigella flexneri 2a str. 2457T
gcgccuuuaauauuaacgccag

SEQ ID NO: 1918261 - RNA, 15 nt, Shigella flexneri 2a str. 2457T
gcgccuuguuaccug

SEQ ID NO: 1918262 - RNA, 23 nt, Shigella flexneri 2a str. 2457T
gcgcgcagugccgguggaagggc

SEQ ID NO: 1918263 - RNA, 21 nt, Shigella flexneri 2a str. 2457T
gcgcgcauucuggagcuggac

SEQ ID NO: 1918264 - RNA, 15 nt, Shigella flexneri 2a str. 2457T
gcgcgaugccgccgu

SEQ ID NO: 1918265 - RNA, 22 nt, Shigella flexneri 2a str. 2457T
gcgcgaucggcuucgcucggcu

SEQ ID NO: 1918266 - RNA, 22 nt, Shigella flexneri 2a str. 2457T
gcgcgaucgggaaccggcuggc

SEQ ID NO: 1918267 - RNA, 17 nt, Shigella flexneri 2a str. 2457T
gcggcggcgggcgcagu

SEQ ID NO: 1918268 - RNA, 14 nt, Shigella flexneri 2a str. 2457T
gcggcuaucccaaa

SEQ ID NO: 1918269 - RNA, 22 nt, Shigella flexneri 2a str. 2457T
gcggcucauugccauucgccag

SEQ ID NO: 1918270 - RNA, 21 nt, Shigella flexneri 2a str. 2457T
gcggcguaucgacaaucacca

SEQ ID NO: 1918271 - RNA, 15 nt, Shigella flexneri 2a str. 2457T
gcggcgcgcgcugcu

SEQ ID NO: 1918272 - RNA, 14 nt, Shigella flexneri 2a str. 2457T
gcggcgcaggcgcu

SEQ ID NO: 1918273 - RNA, 20 nt, Shigella flexneri 2a str. 2457T
gcggcggauauguucucggu

SEQ ID NO: 1918274 - RNA, 11 nt, Shigella flexneri 2a str. 2457T
gcggcggcaga

SEQ ID NO: 1918275 - RNA, 15 nt, Shigella flexneri 2a str. 2457T
gcgggucaggccagg

SEQ ID NO: 1918276 - RNA, 20 nt, Shigella flexneri 2a str. 2457T
gcgguaaauuuuuugaucaa

SEQ ID NO: 1918277 - RNA, 16 nt, Shigella flexneri 2a str. 2457T
gcgguaaacugcauga

SEQ ID NO: 1918278 - RNA, 20 nt, Shigella flexneri 2a str. 2457T
gcgguaaagcgcggcaguga

SEQ ID NO: 1918279 - RNA, 18 nt, Shigella flexneri 2a str. 2457T
gcgguaaaguuuggcugu

SEQ ID NO: 1918280 - RNA, 13 nt, Shigella flexneri 2a str. 2457T
gcgguaaauuuuu

SEQ ID NO: 1918281 - RNA, 18 nt, Shigella flexneri 2a str. 2457T
gcggguuucaacauuucc

SEQ ID NO: 1918282 - RNA, 20 nt, Shigella flexneri 2a str. 2457T
gcgggcguagugcccgcagu

SEQ ID NO: 1918283 - RNA, 18 nt, Shigella flexneri 2a str. 2457T
gcgggcgcgcaggcgcug

SEQ ID NO: 1918284 - RNA, 22 nt, Shigella flexneri 2a str. 2457T
gcgggcgaaucaacuccagaau

SEQ ID NO: 1918285 - RNA, 12 nt, Shigella flexneri 2a str. 2457T
gcggcugccagc

SEQ ID NO: 1918286 - RNA, 12 nt, Shigella flexneri 2a str. 2457T
gcggcucuccug

SEQ ID NO: 1918287 - RNA, 21 nt, Shigella flexneri 2a str. 2457T
gcggcugcccaucaucgucgu

SEQ ID NO: 1918288 - RNA, 13 nt, Shigella flexneri 2a str. 2457T
gcggcuccagaau

SEQ ID NO: 1918289 - RNA, 15 nt, Shigella flexneri 2a str. 2457T
gcgggaacagcgacc

SEQ ID NO: 1918290 - RNA, 23 nt, Shigella flexneri 2a str. 2457T
gcggcuucgguuuuguugccgcc

SEQ ID NO: 1918291 - RNA, 16 nt, Shigella flexneri 2a str. 2457T
gcggcccaggcggcgu

SEQ ID NO: 1918292 - RNA, 14 nt, Shigella flexneri 2a str. 2457T
gcggcaucuucucc

SEQ ID NO: 1918293 - RNA, 16 nt, Shigella flexneri 2a str. 2457T
gcggcaucuucuccac

SEQ ID NO: 1918294 - RNA, 15 nt, Shigella flexneri 2a str. 2457T
gcggccaaagggagc

SEQ ID NO: 1918295 - RNA, 18 nt, Shigella flexneri 2a str. 2457T
gcggcauuucgccgagca

SEQ ID NO: 1918296 - RNA, 14 nt, Shigella flexneri 2a str. 2457T
gcggacgguucccu

SEQ ID NO: 1918297 - RNA, 13 nt, Shigella flexneri 2a str. 2457T
gcggaucugcucc

SEQ ID NO: 1918298 - RNA, 12 nt, Shigella flexneri 2a str. 2457T
gcggaauaacgc

SEQ ID NO: 1918299 - RNA, 16 nt, Shigella flexneri 2a str. 2457T
gcggacgagagaguga

SEQ ID NO: 1918300 - RNA, 15 nt, Shigella flexneri 2a str. 2457T
gcggcaggccgugga

SEQ ID NO: 1918301 - RNA, 14 nt, Shigella flexneri 2a str. 2457T
gcggcagcuccagc

SEQ ID NO: 1918302 - RNA, 11 nt, Shigella flexneri 2a str. 2457T
gcggauuucac

SEQ ID NO: 1918303 - RNA, 12 nt, Shigella flexneri 2a str. 2457T
gcgcuggugguc

SEQ ID NO: 1918304 - RNA, 16 nt, Shigella flexneri 2a str. 2457T
gcgcugugagcaggcg

SEQ ID NO: 1918305 - RNA, 12 nt, Shigella flexneri 2a str. 2457T
gcggaacccagc

SEQ ID NO: 1918306 - RNA, 23 nt, Shigella flexneri 2a str. 2457T
gcggaaauaucggcgucguugua

SEQ ID NO: 1918307 - RNA, 20 nt, Shigella flexneri 2a str. 2457T
gcggaaaucacgauugcugc

SEQ ID NO: 1918308 - RNA, 19 nt, Shigella flexneri 2a str. 2457T
gcggaaacgacuauuaaac

SEQ ID NO: 1918309 - RNA, 15 nt, Shigella flexneri 2a str. 2457T
gcggaacugaagcug

SEQ ID NO: 1918310 - RNA, 21 nt, Shigella flexneri 2a str. 2457T
gcggaacgcacuauacaacca

SEQ ID NO: 1918311 - RNA, 16 nt, Shigella flexneri 2a str. 2457T
gcgcucugcccaugcu

SEQ ID NO: 1918312 - RNA, 13 nt, Shigella flexneri 2a str. 2457T
gcgcugcggcgcg

SEQ ID NO: 1918313 - RNA, 18 nt, Shigella flexneri 2a str. 2457T
gcgcugcgcuuaucaggc

SEQ ID NO: 1918314 - RNA, 23 nt, Shigella flexneri 2a str. 2457T
gcgcugcuguagcaguuccagca

SEQ ID NO: 1918315 - RNA, 15 nt, Shigella flexneri 2a str. 2457T
gcgcugcugcacaua

SEQ ID NO: 1918316 - RNA, 14 nt, Shigella flexneri 2a str. 2457T
gcagugacugcccc

SEQ ID NO: 1918317 - RNA, 18 nt, Shigella flexneri 2a str. 2457T
gcagugcacgaaccagag

SEQ ID NO: 1918318 - RNA, 19 nt, Shigella flexneri 2a str. 2457T
gcagucauagguucuuuua

SEQ ID NO: 1918319 - RNA, 17 nt, Shigella flexneri 2a str. 2457T
gcagucagguucagcgu

SEQ ID NO: 1918320 - RNA, 16 nt, Shigella flexneri 2a str. 2457T
gcagucauaaaaucaa

SEQ ID NO: 1918321 - RNA, 19 nt, Shigella flexneri 2a str. 2457T
gcagucaccugcggugcag

SEQ ID NO: 1918322 - RNA, 15 nt, Shigella flexneri 2a str. 2457T
gcagucauaaccagu

SEQ ID NO: 1918323 - RNA, 13 nt, Shigella flexneri 2a str. 2457T
gcaggggcgggga

SEQ ID NO: 1918324 - RNA, 15 nt, Shigella flexneri 2a str. 2457T
gcaggggaauuucaa

SEQ ID NO: 1918325 - RNA, 15 nt, Shigella flexneri 2a str. 2457T
gcagguuuaaccauc

SEQ ID NO: 1918326 - RNA, 22 nt, Shigella flexneri 2a str. 2457T
gcagguuuuugcagugaaaagg

SEQ ID NO: 1918327 - RNA, 14 nt, Shigella flexneri 2a str. 2457T
gcaguaaaccaccc

SEQ ID NO: 1918328 - RNA, 13 nt, Shigella flexneri 2a str. 2457T
gcaguaaaccacc

SEQ ID NO: 1918329 - RNA, 15 nt, Shigella flexneri 2a str. 2457T
gcaguaaaccaccca

SEQ ID NO: 1918330 - RNA, 19 nt, Shigella flexneri 2a str. 2457T
gcaguaaaccacccaccag

SEQ ID NO: 1918331 - RNA, 12 nt, Shigella flexneri 2a str. 2457T
gcaguaaaucgu

SEQ ID NO: 1918332 - RNA, 20 nt, Shigella flexneri 2a str. 2457T
gcaguaaccaaaagcuggga

SEQ ID NO: 1918333 - RNA, 16 nt, Shigella flexneri 2a str. 2457T
gcaguaagcgccaggg

SEQ ID NO: 1918334 - RNA, 16 nt, Shigella flexneri 2a str. 2457T
gcagucaaaucuuaua

SEQ ID NO: 1918335 - RNA, 15 nt, Shigella flexneri 2a str. 2457T
gcagucaccagcauc

SEQ ID NO: 1918336 - RNA, 17 nt, Shigella flexneri 2a str. 2457T
gcagucaccugcccucc

SEQ ID NO: 1918337 - RNA, 21 nt, Shigella flexneri 2a str. 2457T
gcaguaaucggcgaaaccgcg

SEQ ID NO: 1918338 - RNA, 20 nt, Shigella flexneri 2a str. 2457T
gcaguaaggucaucaaucau

SEQ ID NO: 1918339 - RNA, 21 nt, Shigella flexneri 2a str. 2457T
gcaguucugccaggcuggcag

SEQ ID NO: 1918340 - RNA, 18 nt, Shigella flexneri 2a str. 2457T
gcaguucuggcaccggac

SEQ ID NO: 1918341 - RNA, 16 nt, Shigella flexneri 2a str. 2457T
gcaguugcuucaucuc

SEQ ID NO: 1918342 - RNA, 12 nt, Shigella flexneri 2a str. 2457T
gcaguuuauaaa

SEQ ID NO: 1918343 - RNA, 15 nt, Shigella flexneri 2a str. 2457T
gcaguuucgcgaccu

SEQ ID NO: 1918344 - RNA, 21 nt, Shigella flexneri 2a str. 2457T
gcaguuugcgguguguggcug

SEQ ID NO: 1918345 - RNA, 23 nt, Shigella flexneri 2a str. 2457T
gcauaaccagagagcuuauccag

SEQ ID NO: 1918346 - RNA, 18 nt, Shigella flexneri 2a str. 2457T
gcauaaccggaucgccaa

SEQ ID NO: 1918347 - RNA, 23 nt, Shigella flexneri 2a str. 2457T
gcaguguuuguuaaaacuuucca

SEQ ID NO: 1918348 - RNA, 19 nt, Shigella flexneri 2a str. 2457T
gcaguuccccggcgcggug

SEQ ID NO: 1918349 - RNA, 12 nt, Shigella flexneri 2a str. 2457T
gcaguuccugca

SEQ ID NO: 1918350 - RNA, 21 nt, Shigella flexneri 2a str. 2457T
gcaguucgucgcguuugcccg

SEQ ID NO: 1918351 - RNA, 22 nt, Shigella flexneri 2a str. 2457T
gcaguggcuaagcaggcuggcu

SEQ ID NO: 1918352 - RNA, 14 nt, Shigella flexneri 2a str. 2457T
gcaguggugcggcu

SEQ ID NO: 1918353 - RNA, 22 nt, Shigella flexneri 2a str. 2457T
gcagugggcguuggucagcgga

SEQ ID NO: 1918354 - RNA, 23 nt, Shigella flexneri 2a str. 2457T
gcaguggguaagccagaccaccc

SEQ ID NO: 1918355 - RNA, 21 nt, Shigella flexneri 2a str. 2457T
gcaguggauaauacacuaaca

SEQ ID NO: 1918356 - RNA, 13 nt, Shigella flexneri 2a str. 2457T
gcagggcaucaag

SEQ ID NO: 1918357 - RNA, 15 nt, Shigella flexneri 2a str. 2457T
gcaggcuggugguga

SEQ ID NO: 1918358 - RNA, 22 nt, Shigella flexneri 2a str. 2457T
gcagggccguuuucguuacucc

SEQ ID NO: 1918359 - RNA, 16 nt, Shigella flexneri 2a str. 2457T
gcaggcgauuuacugg

SEQ ID NO: 1918360 - RNA, 17 nt, Shigella flexneri 2a str. 2457T
gcaggcgcaauggcgca

SEQ ID NO: 1918361 - RNA, 18 nt, Shigella flexneri 2a str. 2457T
gcaggcucagaagacgcu

SEQ ID NO: 1918362 - RNA, 16 nt, Shigella flexneri 2a str. 2457T
gcaggcgucgggaaga

SEQ ID NO: 1918363 - RNA, 20 nt, Shigella flexneri 2a str. 2457T
gcaggccggguuuucucccu

SEQ ID NO: 1918364 - RNA, 15 nt, Shigella flexneri 2a str. 2457T
gcaggccguggauca

SEQ ID NO: 1918365 - RNA, 21 nt, Shigella flexneri 2a str. 2457T
gcaggagcgauuaugaaacaa

SEQ ID NO: 1918366 - RNA, 14 nt, Shigella flexneri 2a str. 2457T
gcaggagcagcccc

SEQ ID NO: 1918367 - RNA, 20 nt, Shigella flexneri 2a str. 2457T
gcaggagcagccccugcgcc

SEQ ID NO: 1918368 - RNA, 18 nt, Shigella flexneri 2a str. 2457T
gcaggaaaaucagcauca

SEQ ID NO: 1918369 - RNA, 15 nt, Shigella flexneri 2a str. 2457T
gcagcuuucagcagc

SEQ ID NO: 1918370 - RNA, 16 nt, Shigella flexneri 2a str. 2457T
gcagcuuucagcagcg

SEQ ID NO: 1918371 - RNA, 23 nt, Shigella flexneri 2a str. 2457T
gcagcuuugcccgaucaucaaaa

SEQ ID NO: 1918372 - RNA, 23 nt, Shigella flexneri 2a str. 2457T
gcagcuugcuguuucgcugacga

SEQ ID NO: 1918373 - RNA, 17 nt, Shigella flexneri 2a str. 2457T
gcaggaauaaucagcaa

SEQ ID NO: 1918374 - RNA, 12 nt, Shigella flexneri 2a str. 2457T
gcagcuucacgg

SEQ ID NO: 1918375 - RNA, 22 nt, Shigella flexneri 2a str. 2457T
gcagcuucucgugaaacucacg

SEQ ID NO: 1918376 - RNA, 18 nt, Shigella flexneri 2a str. 2457T
gcagcuucacaaaggcuu

SEQ ID NO: 1918377 - RNA, 13 nt, Shigella flexneri 2a str. 2457T
gcagcuucacaaa

SEQ ID NO: 1918378 - RNA, 18 nt, Shigella flexneri 2a str. 2457T
gcagcuuaucuuuuucgg

SEQ ID NO: 1918379 - RNA, 14 nt, Shigella flexneri 2a str. 2457T
gcagcuuagaaauu

SEQ ID NO: 1918380 - RNA, 18 nt, Shigella flexneri 2a str. 2457T
gcagcuuaaucauaaugu

SEQ ID NO: 1918381 - RNA, 17 nt, Shigella flexneri 2a str. 2457T
gcagcgucacucgcugc

SEQ ID NO: 1918382 - RNA, 14 nt, Shigella flexneri 2a str. 2457T
gcagcgucagcacc

SEQ ID NO: 1918383 - RNA, 15 nt, Shigella flexneri 2a str. 2457T
gcagcguuuccagcc

SEQ ID NO: 1918384 - RNA, 23 nt, Shigella flexneri 2a str. 2457T
gcagcuccaguuucuuuugcgcc

SEQ ID NO: 1918385 - RNA, 21 nt, Shigella flexneri 2a str. 2457T
gcagcuccaccgauuuugaga

SEQ ID NO: 1918386 - RNA, 15 nt, Shigella flexneri 2a str. 2457T
gcagcucacgcacga

SEQ ID NO: 1918387 - RNA, 20 nt, Shigella flexneri 2a str. 2457T
gcagcguuucgcgcgcgccu

SEQ ID NO: 1918388 - RNA, 21 nt, Shigella flexneri 2a str. 2457T
gcauccagcguauucgugaca

SEQ ID NO: 1918389 - RNA, 18 nt, Shigella flexneri 2a str. 2457T
gcaucaugaauauauaau

SEQ ID NO: 1918390 - RNA, 16 nt, Shigella flexneri 2a str. 2457T
gcaucauggcauuuca

SEQ ID NO: 1918391 - RNA, 16 nt, Shigella flexneri 2a str. 2457T
gcaucaucgcaaugau

SEQ ID NO: 1918392 - RNA, 23 nt, Shigella flexneri 2a str. 2457T
gcaucgacagcgccuuuucuuua

SEQ ID NO: 1918393 - RNA, 17 nt, Shigella flexneri 2a str. 2457T
gcaucuacgcucucuuc

SEQ ID NO: 1918394 - RNA, 19 nt, Shigella flexneri 2a str. 2457T
gcaucuacgcucucuucaa

SEQ ID NO: 1918395 - RNA, 14 nt, Shigella flexneri 2a str. 2457T
gcaucuccugcaac

SEQ ID NO: 1918396 - RNA, 14 nt, Shigella flexneri 2a str. 2457T
gcaucugauaagcc

SEQ ID NO: 1918397 - RNA, 16 nt, Shigella flexneri 2a str. 2457T
gcaucucuacagcgcc

SEQ ID NO: 1918398 - RNA, 12 nt, Shigella flexneri 2a str. 2457T
gcaucugaaacu

SEQ ID NO: 1918399 - RNA, 20 nt, Shigella flexneri 2a str. 2457T
gcaucgcaacaugcuggccu

SEQ ID NO: 1918400 - RNA, 20 nt, Shigella flexneri 2a str. 2457T
gcaucgcaaaccagacgcgc

SEQ ID NO: 1918401 - RNA, 16 nt, Shigella flexneri 2a str. 2457T
gcaucgccaaacaggc

SEQ ID NO: 1918402 - RNA, 15 nt, Shigella flexneri 2a str. 2457T
gcaucgccauaauaa

SEQ ID NO: 1918403 - RNA, 20 nt, Shigella flexneri 2a str. 2457T
gcaucgccauaauaagcgcc

SEQ ID NO: 1918404 - RNA, 19 nt, Shigella flexneri 2a str. 2457T
gcaucaaccaacaccuguu

SEQ ID NO: 1918405 - RNA, 18 nt, Shigella flexneri 2a str. 2457T
gcaucaggcaacccagaa

SEQ ID NO: 1918406 - RNA, 23 nt, Shigella flexneri 2a str. 2457T
gcaucaggcguucgcggcggcac

SEQ ID NO: 1918407 - RNA, 20 nt, Shigella flexneri 2a str. 2457T
gcaucagucucaaaccggcu

SEQ ID NO: 1918408 - RNA, 22 nt, Shigella flexneri 2a str. 2457T
gcaucaguucggaaacagugcu

SEQ ID NO: 1918409 - RNA, 21 nt, Shigella flexneri 2a str. 2457T
gcaucagucacgacaaagaca

SEQ ID NO: 1918410 - RNA, 14 nt, Shigella flexneri 2a str. 2457T
gcaucaggcaaucu

SEQ ID NO: 1918411 - RNA, 19 nt, Shigella flexneri 2a str. 2457T
gcaucaggcuaaucgccag

SEQ ID NO: 1918412 - RNA, 21 nt, Shigella flexneri 2a str. 2457T
gcaucaggcuaaucgccaggc

SEQ ID NO: 1918413 - RNA, 19 nt, Shigella flexneri 2a str. 2457T
gcauaucuucaacgcaccc

SEQ ID NO: 1918414 - RNA, 14 nt, Shigella flexneri 2a str. 2457T
gcauaugcggugcg

SEQ ID NO: 1918415 - RNA, 16 nt, Shigella flexneri 2a str. 2457T
gcauaugcuuugccgu

SEQ ID NO: 1918416 - RNA, 19 nt, Shigella flexneri 2a str. 2457T
gcaucaaacgguugauaaa

SEQ ID NO: 1918417 - RNA, 15 nt, Shigella flexneri 2a str. 2457T
gcaucaaagccaggc

SEQ ID NO: 1918418 - RNA, 18 nt, Shigella flexneri 2a str. 2457T
gcauaucguagccccagu

SEQ ID NO: 1918419 - RNA, 13 nt, Shigella flexneri 2a str. 2457T
gcauauccggugc

SEQ ID NO: 1918420 - RNA, 17 nt, Shigella flexneri 2a str. 2457T
gcauaaugcagccaucc

SEQ ID NO: 1918421 - RNA, 21 nt, Shigella flexneri 2a str. 2457T
gcauaaugugcgcacauugcc

SEQ ID NO: 1918422 - RNA, 13 nt, Shigella flexneri 2a str. 2457T
gcauaagccaccu

SEQ ID NO: 1918423 - RNA, 14 nt, Shigella flexneri 2a str. 2457T
gcauaaugcagcca

SEQ ID NO: 1918424 - RNA, 13 nt, Shigella flexneri 2a str. 2457T
gcauaaucaccag

SEQ ID NO: 1918425 - RNA, 21 nt, Shigella flexneri 2a str. 2457T
gcauaaucaccaucagcagca

SEQ ID NO: 1918426 - RNA, 15 nt, Shigella flexneri 2a str. 2457T
gcauaacucaccauc

SEQ ID NO: 1918427 - RNA, 20 nt, Shigella flexneri 2a str. 2457T
gcauggacacugccggaaga

SEQ ID NO: 1918428 - RNA, 16 nt, Shigella flexneri 2a str. 2457T
gcauggaucgccgcgg

SEQ ID NO: 1918429 - RNA, 15 nt, Shigella flexneri 2a str. 2457T
gcauggcauuuugca

SEQ ID NO: 1918430 - RNA, 21 nt, Shigella flexneri 2a str. 2457T
gcaugguguucagauggccaa

SEQ ID NO: 1918431 - RNA, 21 nt, Shigella flexneri 2a str. 2457T
gcaugucgguuguacaaaaaa

SEQ ID NO: 1918432 - RNA, 19 nt, Shigella flexneri 2a str. 2457T
gcauuaagggugaucagcc

SEQ ID NO: 1918433 - RNA, 20 nt, Shigella flexneri 2a str. 2457T
gcauuaaggcaagaaaauua

SEQ ID NO: 1918434 - RNA, 18 nt, Shigella flexneri 2a str. 2457T
gcauuaaugcgcccagcg

SEQ ID NO: 1918435 - RNA, 14 nt, Shigella flexneri 2a str. 2457T
gcauuaaucugcuc

SEQ ID NO: 1918436 - RNA, 19 nt, Shigella flexneri 2a str. 2457T
gcaucuucuucuaugccag

SEQ ID NO: 1918437 - RNA, 13 nt, Shigella flexneri 2a str. 2457T
gcaucuucuucau

SEQ ID NO: 1918438 - RNA, 20 nt, Shigella flexneri 2a str. 2457T
gcaucuucgcgccaauccag

SEQ ID NO: 1918439 - RNA, 22 nt, Shigella flexneri 2a str. 2457T
gcaucuguuucgaucagcaauu

SEQ ID NO: 1918440 - RNA, 20 nt, Shigella flexneri 2a str. 2457T
gcaucuggcauaaacaaagc

SEQ ID NO: 1918441 - RNA, 16 nt, Shigella flexneri 2a str. 2457T
gcaucuggaaagucug

SEQ ID NO: 1918442 - RNA, 20 nt, Shigella flexneri 2a str. 2457T
gcaugauguaagaugaaaua

SEQ ID NO: 1918443 - RNA, 14 nt, Shigella flexneri 2a str. 2457T
gcaugcacccucaa

SEQ ID NO: 1918444 - RNA, 17 nt, Shigella flexneri 2a str. 2457T
gcauuggagacugauga

SEQ ID NO: 1918445 - RNA, 14 nt, Shigella flexneri 2a str. 2457T
gcauugcgccugca

SEQ ID NO: 1918446 - RNA, 16 nt, Shigella flexneri 2a str. 2457T
gcauugcgccugcagg

SEQ ID NO: 1918447 - RNA, 15 nt, Shigella flexneri 2a str. 2457T
gcauugcuaaugcug

SEQ ID NO: 1918448 - RNA, 17 nt, Shigella flexneri 2a str. 2457T
gcauucccgccagcggc

SEQ ID NO: 1918449 - RNA, 21 nt, Shigella flexneri 2a str. 2457T
gcauuacgcucacugcaaaac

SEQ ID NO: 1918450 - RNA, 13 nt, Shigella flexneri 2a str. 2457T
gcauuacaagaau

SEQ ID NO: 1918451 - RNA, 13 nt, Shigella flexneri 2a str. 2457T
gcauuacuacggu

SEQ ID NO: 1918452 - RNA, 21 nt, Shigella flexneri 2a str. 2457T
gcauuacuacgguaauacaac

SEQ ID NO: 1918453 - RNA, 21 nt, Shigella flexneri 2a str. 2457T
gcauuucuccgcguucaauac

SEQ ID NO: 1918454 - RNA, 23 nt, Shigella flexneri 2a str. 2457T
gcauuucgguauaaauaaacccu

SEQ ID NO: 1918455 - RNA, 17 nt, Shigella flexneri 2a str. 2457T
gcauuucgucuucauca

SEQ ID NO: 1918456 - RNA, 17 nt, Shigella flexneri 2a str. 2457T
gcauuucccagcaagaa

SEQ ID NO: 1918457 - RNA, 22 nt, Shigella flexneri 2a str. 2457T
gcauuuaugccauguucaucaa

SEQ ID NO: 1918458 - RNA, 20 nt, Shigella flexneri 2a str. 2457T
gcauuuauggugcuaguuau

SEQ ID NO: 1918459 - RNA, 15 nt, Shigella flexneri 2a str. 2457T
gccaaacgcucccug

SEQ ID NO: 1918460 - RNA, 17 nt, Shigella flexneri 2a str. 2457T
gccaaagaccaggaaac

SEQ ID NO: 1918461 - RNA, 12 nt, Shigella flexneri 2a str. 2457T
gcauuuucucgc

SEQ ID NO: 1918462 - RNA, 15 nt, Shigella flexneri 2a str. 2457T
gcauuuucugcgcau

SEQ ID NO: 1918463 - RNA, 18 nt, Shigella flexneri 2a str. 2457T
gccagcgcgaugcaggcc

SEQ ID NO: 1918464 - RNA, 17 nt, Shigella flexneri 2a str. 2457T
gccagcggcagcucgcg

SEQ ID NO: 1918465 - RNA, 13 nt, Shigella flexneri 2a str. 2457T
gccagcggcagcu

SEQ ID NO: 1918466 - RNA, 18 nt, Shigella flexneri 2a str. 2457T
gccagcuccgggcugguu

SEQ ID NO: 1918467 - RNA, 22 nt, Shigella flexneri 2a str. 2457T
gccagcguaccaugauccugca

SEQ ID NO: 1918468 - RNA, 15 nt, Shigella flexneri 2a str. 2457T
gccagcguaaauccu

SEQ ID NO: 1918469 - RNA, 17 nt, Shigella flexneri 2a str. 2457T
gccagcgucaucauaga

SEQ ID NO: 1918470 - RNA, 14 nt, Shigella flexneri 2a str. 2457T
gccagcgucugagc

SEQ ID NO: 1918471 - RNA, 20 nt, Shigella flexneri 2a str. 2457T
gccagcgucugagcaggcgg

SEQ ID NO: 1918472 - RNA, 22 nt, Shigella flexneri 2a str. 2457T
gccaggagccaacacuuucacu

SEQ ID NO: 1918473 - RNA, 16 nt, Shigella flexneri 2a str. 2457T
gccaggcacgccgcgc

SEQ ID NO: 1918474 - RNA, 11 nt, Shigella flexneri 2a str. 2457T
gccagcuuagu

SEQ ID NO: 1918475 - RNA, 18 nt, Shigella flexneri 2a str. 2457T
gccaggaaccugugacag

SEQ ID NO: 1918476 - RNA, 21 nt, Shigella flexneri 2a str. 2457T
gccaggaaucgcaaaccacgg

SEQ ID NO: 1918477 - RNA, 11 nt, Shigella flexneri 2a str. 2457T
gccagcaggaa

SEQ ID NO: 1918478 - RNA, 22 nt, Shigella flexneri 2a str. 2457T
gccagcagagggauaucuuccc

SEQ ID NO: 1918479 - RNA, 18 nt, Shigella flexneri 2a str. 2457T
gccagcagcgaaucagcc

SEQ ID NO: 1918480 - RNA, 14 nt, Shigella flexneri 2a str. 2457T
gccagcagccauuc

SEQ ID NO: 1918481 - RNA, 14 nt, Shigella flexneri 2a str. 2457T
gccagcagcagcgu

SEQ ID NO: 1918482 - RNA, 15 nt, Shigella flexneri 2a str. 2457T
gccagccaagcaugu

SEQ ID NO: 1918483 - RNA, 16 nt, Shigella flexneri 2a str. 2457T
gccagccacaggcuuu

SEQ ID NO: 1918484 - RNA, 11 nt, Shigella flexneri 2a str. 2457T
gccagccagaa

SEQ ID NO: 1918485 - RNA, 19 nt, Shigella flexneri 2a str. 2457T
gccagccauccgucaucca

SEQ ID NO: 1918486 - RNA, 14 nt, Shigella flexneri 2a str. 2457T
gccagcauccggca

SEQ ID NO: 1918487 - RNA, 21 nt, Shigella flexneri 2a str. 2457T
gccagcauaaucaccaucagc

SEQ ID NO: 1918488 - RNA, 17 nt, Shigella flexneri 2a str. 2457T
gccagcaguuucuucug

SEQ ID NO: 1918489 - RNA, 23 nt, Shigella flexneri 2a str. 2457T
gccagcauaaucaccaucagcag

SEQ ID NO: 1918490 - RNA, 17 nt, Shigella flexneri 2a str. 2457T
gccagcaugaccaccgg

SEQ ID NO: 1918491 - RNA, 16 nt, Shigella flexneri 2a str. 2457T
gccagcgaagccagcu

SEQ ID NO: 1918492 - RNA, 15 nt, Shigella flexneri 2a str. 2457T
gccagcgaagccagc

SEQ ID NO: 1918493 - RNA, 19 nt, Shigella flexneri 2a str. 2457T
gccagcgccgacagcagcc

SEQ ID NO: 1918494 - RNA, 14 nt, Shigella flexneri 2a str. 2457T
gccagccucaucca

SEQ ID NO: 1918495 - RNA, 15 nt, Shigella flexneri 2a str. 2457T
gccagccucccagcc

SEQ ID NO: 1918496 - RNA, 11 nt, Shigella flexneri 2a str. 2457T
gccagccuccc

SEQ ID NO: 1918497 - RNA, 15 nt, Shigella flexneri 2a str. 2457T
gccagccucauccau

SEQ ID NO: 1918498 - RNA, 13 nt, Shigella flexneri 2a str. 2457T
gccagccccagcg

SEQ ID NO: 1918499 - RNA, 18 nt, Shigella flexneri 2a str. 2457T
gccacauaugaucggaag

SEQ ID NO: 1918500 - RNA, 19 nt, Shigella flexneri 2a str. 2457T
gccacaguugaucagccag

SEQ ID NO: 1918501 - RNA, 19 nt, Shigella flexneri 2a str. 2457T
gccacaggucagcaggagc

SEQ ID NO: 1918502 - RNA, 22 nt, Shigella flexneri 2a str. 2457T
gccacaguucgaggaucgcggg

SEQ ID NO: 1918503 - RNA, 13 nt, Shigella flexneri 2a str. 2457T
gccacauccggca

SEQ ID NO: 1918504 - RNA, 17 nt, Shigella flexneri 2a str. 2457T
gccacauuccucuguca

SEQ ID NO: 1918505 - RNA, 15 nt, Shigella flexneri 2a str. 2457T
gccaccacuugcagc

SEQ ID NO: 1918506 - RNA, 15 nt, Shigella flexneri 2a str. 2457T
gccaccaccagcaca

SEQ ID NO: 1918507 - RNA, 13 nt, Shigella flexneri 2a str. 2457T
gccaccaccagcg

SEQ ID NO: 1918508 - RNA, 17 nt, Shigella flexneri 2a str. 2457T
gccaccacgccaagaaa

SEQ ID NO: 1918509 - RNA, 16 nt, Shigella flexneri 2a str. 2457T
gccacaccacugcgca

SEQ ID NO: 1918510 - RNA, 17 nt, Shigella flexneri 2a str. 2457T
gccacaggucagcagga

SEQ ID NO: 1918511 - RNA, 17 nt, Shigella flexneri 2a str. 2457T
gccacaggcuuuccuga

SEQ ID NO: 1918512 - RNA, 19 nt, Shigella flexneri 2a str. 2457T
gccacagggugaucaccag

SEQ ID NO: 1918513 - RNA, 15 nt, Shigella flexneri 2a str. 2457T
gccacaauaaacgcg

SEQ ID NO: 1918514 - RNA, 19 nt, Shigella flexneri 2a str. 2457T
gccacaauacugaucauca

SEQ ID NO: 1918515 - RNA, 22 nt, Shigella flexneri 2a str. 2457T
gccacacacgauccugcacggu

SEQ ID NO: 1918516 - RNA, 13 nt, Shigella flexneri 2a str. 2457T
gccacaacuucaa

SEQ ID NO: 1918517 - RNA, 19 nt, Shigella flexneri 2a str. 2457T
gccaaaugucaccagccga

SEQ ID NO: 1918518 - RNA, 18 nt, Shigella flexneri 2a str. 2457T
gccaaaugucagcugcca

SEQ ID NO: 1918519 - RNA, 22 nt, Shigella flexneri 2a str. 2457T
gccacaaucgcagcgcaagcug

SEQ ID NO: 1918520 - RNA, 17 nt, Shigella flexneri 2a str. 2457T
gccacaacuucaacguu

SEQ ID NO: 1918521 - RNA, 20 nt, Shigella flexneri 2a str. 2457T
gccacaauaaagcgauaaau

SEQ ID NO: 1918522 - RNA, 23 nt, Shigella flexneri 2a str. 2457T
gccaaauccuuccagcuccagcc

SEQ ID NO: 1918523 - RNA, 14 nt, Shigella flexneri 2a str. 2457T
gccaaaucauccag

SEQ ID NO: 1918524 - RNA, 19 nt, Shigella flexneri 2a str. 2457T
gccaaaucauccagaccgc

SEQ ID NO: 1918525 - RNA, 15 nt, Shigella flexneri 2a str. 2457T
gccaaauccagcgcc

SEQ ID NO: 1918526 - RNA, 21 nt, Shigella flexneri 2a str. 2457T
gccaaauauuucuuuaucacc

SEQ ID NO: 1918527 - RNA, 12 nt, Shigella flexneri 2a str. 2457T
gccaaagggagc

SEQ ID NO: 1918528 - RNA, 20 nt, Shigella flexneri 2a str. 2457T
gccaaaguacggacgcggca

SEQ ID NO: 1918529 - RNA, 23 nt, Shigella flexneri 2a str. 2457T
gccaaagugacacaaucaaaucc

SEQ ID NO: 1918530 - RNA, 17 nt, Shigella flexneri 2a str. 2457T
gccaaagccgccgagca

SEQ ID NO: 1918531 - RNA, 13 nt, Shigella flexneri 2a str. 2457T
gccaaagccgccg

SEQ ID NO: 1918532 - RNA, 16 nt, Shigella flexneri 2a str. 2457T
gccaaagccgccgagc

SEQ ID NO: 1918533 - RNA, 20 nt, Shigella flexneri 2a str. 2457T
gccacgccuguaccagcggc

SEQ ID NO: 1918534 - RNA, 15 nt, Shigella flexneri 2a str. 2457T
gccacgccacgcugc

SEQ ID NO: 1918535 - RNA, 12 nt, Shigella flexneri 2a str. 2457T
gccaccugugca

SEQ ID NO: 1918536 - RNA, 13 nt, Shigella flexneri 2a str. 2457T
gccaccugaucca

SEQ ID NO: 1918537 - RNA, 12 nt, Shigella flexneri 2a str. 2457T
gccaccgcgcca

SEQ ID NO: 1918538 - RNA, 16 nt, Shigella flexneri 2a str. 2457T
gccaccgcgccgggca

SEQ ID NO: 1918539 - RNA, 18 nt, Shigella flexneri 2a str. 2457T
gccaccagcgccgcgcca

SEQ ID NO: 1918540 - RNA, 18 nt, Shigella flexneri 2a str. 2457T
gccaccagugcaggcacc

SEQ ID NO: 1918541 - RNA, 16 nt, Shigella flexneri 2a str. 2457T
gccaccagggauaaag

SEQ ID NO: 1918542 - RNA, 21 nt, Shigella flexneri 2a str. 2457T
gccagaucgccugccgccagu

SEQ ID NO: 1918543 - RNA, 16 nt, Shigella flexneri 2a str. 2457T
gccagauaauggcugu

SEQ ID NO: 1918544 - RNA, 18 nt, Shigella flexneri 2a str. 2457T
gccagauacaucagcgac

SEQ ID NO: 1918545 - RNA, 23 nt, Shigella flexneri 2a str. 2457T
gccagauauugauucaucucuuc

SEQ ID NO: 1918546 - RNA, 22 nt, Shigella flexneri 2a str. 2457T
gccagaguggauuaucuucacc

SEQ ID NO: 1918547 - RNA, 15 nt, Shigella flexneri 2a str. 2457T
gccagauaagacgcg

SEQ ID NO: 1918548 - RNA, 15 nt, Shigella flexneri 2a str. 2457T
gccagaggagccauc

SEQ ID NO: 1918549 - RNA, 20 nt, Shigella flexneri 2a str. 2457T
gccagaggagccaucaccau

SEQ ID NO: 1918550 - RNA, 23 nt, Shigella flexneri 2a str. 2457T
gccagcaaaaugcauaaccgcag

SEQ ID NO: 1918551 - RNA, 15 nt, Shigella flexneri 2a str. 2457T
gccagauuugcugac

SEQ ID NO: 1918552 - RNA, 16 nt, Shigella flexneri 2a str. 2457T
gccagauucuccaaca

SEQ ID NO: 1918553 - RNA, 12 nt, Shigella flexneri 2a str. 2457T
gccagaugggau

SEQ ID NO: 1918554 - RNA, 18 nt, Shigella flexneri 2a str. 2457T
gccagauggcuuugcccu

SEQ ID NO: 1918555 - RNA, 22 nt, Shigella flexneri 2a str. 2457T
gccagcaagagcaaauaaaaca

SEQ ID NO: 1918556 - RNA, 18 nt, Shigella flexneri 2a str. 2457T
gccagcaauccccagaca

SEQ ID NO: 1918557 - RNA, 15 nt, Shigella flexneri 2a str. 2457T
gccagcaauccccag

SEQ ID NO: 1918558 - RNA, 18 nt, Shigella flexneri 2a str. 2457T
gccagcaaggcgcuaaaa

SEQ ID NO: 1918559 - RNA, 17 nt, Shigella flexneri 2a str. 2457T
gccagcaacugacugac

SEQ ID NO: 1918560 - RNA, 18 nt, Shigella flexneri 2a str. 2457T
gccacgcuucaaucugau

SEQ ID NO: 1918561 - RNA, 12 nt, Shigella flexneri 2a str. 2457T
gccagaaaucag

SEQ ID NO: 1918562 - RNA, 14 nt, Shigella flexneri 2a str. 2457T
gccagaaaucagcu

SEQ ID NO: 1918563 - RNA, 21 nt, Shigella flexneri 2a str. 2457T
gccagaaauggcccaaaaggc

SEQ ID NO: 1918564 - RNA, 21 nt, Shigella flexneri 2a str. 2457T
gccagaaauccaggcccgcau

SEQ ID NO: 1918565 - RNA, 20 nt, Shigella flexneri 2a str. 2457T
gccagaacacuguuaccgcu

SEQ ID NO: 1918566 - RNA, 20 nt, Shigella flexneri 2a str. 2457T
gccacuuugcaguuccugcc

SEQ ID NO: 1918567 - RNA, 22 nt, Shigella flexneri 2a str. 2457T
gccacuuucucacucaccgcag

SEQ ID NO: 1918568 - RNA, 14 nt, Shigella flexneri 2a str. 2457T
gccagaaaaccugg

SEQ ID NO: 1918569 - RNA, 18 nt, Shigella flexneri 2a str. 2457T
gccagaaaaccuggcgca

SEQ ID NO: 1918570 - RNA, 16 nt, Shigella flexneri 2a str. 2457T
gccagacauuauaaau

SEQ ID NO: 1918571 - RNA, 18 nt, Shigella flexneri 2a str. 2457T
gccagacacuggaaacag

SEQ ID NO: 1918572 - RNA, 22 nt, Shigella flexneri 2a str. 2457T
gccagacaccccuucauucagg

SEQ ID NO: 1918573 - RNA, 12 nt, Shigella flexneri 2a str. 2457T
gccagaccacug

SEQ ID NO: 1918574 - RNA, 15 nt, Shigella flexneri 2a str. 2457T
gccagacaaaccacg

SEQ ID NO: 1918575 - RNA, 23 nt, Shigella flexneri 2a str. 2457T
gccagaaucaccucuuuuuccac

SEQ ID NO: 1918576 - RNA, 17 nt, Shigella flexneri 2a str. 2457T
gccagaauagccgcagc

SEQ ID NO: 1918577 - RNA, 21 nt, Shigella flexneri 2a str. 2457T
gccagaauaacgugaucgaac

SEQ ID NO: 1918578 - RNA, 13 nt, Shigella flexneri 2a str. 2457T
gccagacugcgcu

SEQ ID NO: 1918579 - RNA, 20 nt, Shigella flexneri 2a str. 2457T
gccagacugcgcuaccagga

SEQ ID NO: 1918580 - RNA, 16 nt, Shigella flexneri 2a str. 2457T
gccagagcagcaacaa

SEQ ID NO: 1918581 - RNA, 19 nt, Shigella flexneri 2a str. 2457T
gccagagcagcaacaagcc

SEQ ID NO: 1918582 - RNA, 16 nt, Shigella flexneri 2a str. 2457T
gccagacgguaacccc

SEQ ID NO: 1918583 - RNA, 13 nt, Shigella flexneri 2a str. 2457T
gccagacucgcca

SEQ ID NO: 1918584 - RNA, 22 nt, Shigella flexneri 2a str. 2457T
gccagacgaauaaaacagaaac

SEQ ID NO: 1918585 - RNA, 20 nt, Shigella flexneri 2a str. 2457T
gccgccuaacgacaaaucau

SEQ ID NO: 1918586 - RNA, 18 nt, Shigella flexneri 2a str. 2457T
gccgcgauagcaagcgcu

SEQ ID NO: 1918587 - RNA, 13 nt, Shigella flexneri 2a str. 2457T
aaagcucuucaug

SEQ ID NO: 1918588 - RNA, 22 nt, Shigella flexneri 2a str. 2457T
aaagcucuuuugacgcccccaa

SEQ ID NO: 1918589 - RNA, 13 nt, Shigella flexneri 2a str. 2457T
aaagcucccuaaa

SEQ ID NO: 1918590 - RNA, 15 nt, Shigella flexneri 2a str. 2457T
aaagcugcaagguga

SEQ ID NO: 1918591 - RNA, 19 nt, Shigella flexneri 2a str. 2457T
aaagcugcaaggugaaagc

SEQ ID NO: 1918592 - RNA, 20 nt, Shigella flexneri 2a str. 2457T
aaagcugcaaggugaaagca

SEQ ID NO: 1918593 - RNA, 19 nt, Shigella flexneri 2a str. 2457T
aaagcugcugaccaccagc

SEQ ID NO: 1918594 - RNA, 23 nt, Shigella flexneri 2a str. 2457T
aaagcugccgucaauuuuaagca

SEQ ID NO: 1918595 - RNA, 21 nt, Shigella flexneri 2a str. 2457T
gccgcguggacggucaacuga

SEQ ID NO: 1918596 - RNA, 19 nt, Shigella flexneri 2a str. 2457T
gccgcguguuuccgggccg

SEQ ID NO: 1918597 - RNA, 18 nt, Shigella flexneri 2a str. 2457T
gccgcguuggcaaugucg

SEQ ID NO: 1918598 - RNA, 16 nt, Shigella flexneri 2a str. 2457T
gccgcguuugcgcagc

SEQ ID NO: 1918599 - RNA, 20 nt, Shigella flexneri 2a str. 2457T
gccgcuaauggugcgcgcac

SEQ ID NO: 1918600 - RNA, 14 nt, Shigella flexneri 2a str. 2457T
gccgcuaccgcccu

SEQ ID NO: 1918601 - RNA, 15 nt, Shigella flexneri 2a str. 2457T
gccgcuaccgcccug

SEQ ID NO: 1918602 - RNA, 14 nt, Shigella flexneri 2a str. 2457T
gccgcuaacagcag

SEQ ID NO: 1918603 - RNA, 24 nt, Shigella flexneri 2a str. 2457T
gccgcuaacgucuaguaaagcaga

SEQ ID NO: 1918604 - RNA, 15 nt, Shigella flexneri 2a str. 2457T
gccgcguagagaaaa

SEQ ID NO: 1918605 - RNA, 21 nt, Shigella flexneri 2a str. 2457T
gccgcuacggaagaugaaaaa

SEQ ID NO: 1918606 - RNA, 14 nt, Shigella flexneri 2a str. 2457T
gccgcuccagaauc

SEQ ID NO: 1918607 - RNA, 17 nt, Shigella flexneri 2a str. 2457T
gccgcucagucggcgcu

SEQ ID NO: 1918608 - RNA, 13 nt, Shigella flexneri 2a str. 2457T
gccgcuuaaauuu

SEQ ID NO: 1918609 - RNA, 18 nt, Shigella flexneri 2a str. 2457T
gccgcuggccauuucugc

SEQ ID NO: 1918610 - RNA, 18 nt, Shigella flexneri 2a str. 2457T
gccgaaccagugcuccac

SEQ ID NO: 1918611 - RNA, 12 nt, Shigella flexneri 2a str. 2457T
gccgacaaagau

SEQ ID NO: 1918612 - RNA, 13 nt, Shigella flexneri 2a str. 2457T
gccgacggucagg

SEQ ID NO: 1918613 - RNA, 16 nt, Shigella flexneri 2a str. 2457T
gccgacuggcgcgagc

SEQ ID NO: 1918614 - RNA, 17 nt, Shigella flexneri 2a str. 2457T
gcccugcuccagcaacu

SEQ ID NO: 1918615 - RNA, 13 nt, Shigella flexneri 2a str. 2457T
gcccugcuccagc

SEQ ID NO: 1918616 - RNA, 19 nt, Shigella flexneri 2a str. 2457T
gcccugcugguuagcggcc

SEQ ID NO: 1918617 - RNA, 19 nt, Shigella flexneri 2a str. 2457T
gcccuggguaccgagaaaa

SEQ ID NO: 1918618 - RNA, 22 nt, Shigella flexneri 2a str. 2457T
gcccuggacaacauuccugcug

SEQ ID NO: 1918619 - RNA, 17 nt, Shigella flexneri 2a str. 2457T
gcccuggacaacauucc

SEQ ID NO: 1918620 - RNA, 18 nt, Shigella flexneri 2a str. 2457T
gcccuggacaacauuccu

SEQ ID NO: 1918621 - RNA, 17 nt, Shigella flexneri 2a str. 2457T
gcccugcccguugccag

SEQ ID NO: 1918622 - RNA, 19 nt, Shigella flexneri 2a str. 2457T
gcccuugccaacgcaaacg

SEQ ID NO: 1918623 - RNA, 14 nt, Shigella flexneri 2a str. 2457T
gccgcagccccaga

SEQ ID NO: 1918624 - RNA, 19 nt, Shigella flexneri 2a str. 2457T
gccgcauccggcaauggug

SEQ ID NO: 1918625 - RNA, 16 nt, Shigella flexneri 2a str. 2457T
gccgccacugccacca

SEQ ID NO: 1918626 - RNA, 18 nt, Shigella flexneri 2a str. 2457T
gccgccagacugcgagaa

SEQ ID NO: 1918627 - RNA, 22 nt, Shigella flexneri 2a str. 2457T
gccgccagaccacugcgccgcu

SEQ ID NO: 1918628 - RNA, 15 nt, Shigella flexneri 2a str. 2457T
gccgcauccugcacc

SEQ ID NO: 1918629 - RNA, 20 nt, Shigella flexneri 2a str. 2457T
gccgcaucgggggaagcuga

SEQ ID NO: 1918630 - RNA, 20 nt, Shigella flexneri 2a str. 2457T
gccgauuuugccuucauacu

SEQ ID NO: 1918631 - RNA, 18 nt, Shigella flexneri 2a str. 2457T
gccgaugaacggcggcgg

SEQ ID NO: 1918632 - RNA, 20 nt, Shigella flexneri 2a str. 2457T
gccgcaaaucguauccggca

SEQ ID NO: 1918633 - RNA, 21 nt, Shigella flexneri 2a str. 2457T
gccgauaaauacagcguuaaa

SEQ ID NO: 1918634 - RNA, 23 nt, Shigella flexneri 2a str. 2457T
gccgauaacaccgauuuuguaaa

SEQ ID NO: 1918635 - RNA, 20 nt, Shigella flexneri 2a str. 2457T
gccgaggcacagcaggccaa

SEQ ID NO: 1918636 - RNA, 21 nt, Shigella flexneri 2a str. 2457T
gccgauaaucaacgcgccgcc

SEQ ID NO: 1918637 - RNA, 14 nt, Shigella flexneri 2a str. 2457T
gccgaucgucuggg

SEQ ID NO: 1918638 - RNA, 14 nt, Shigella flexneri 2a str. 2457T
gccgauccgcguca

SEQ ID NO: 1918639 - RNA, 19 nt, Shigella flexneri 2a str. 2457T
gccgagaauaaaacaggca

SEQ ID NO: 1918640 - RNA, 15 nt, Shigella flexneri 2a str. 2457T
gccgagcgccagcca

SEQ ID NO: 1918641 - RNA, 11 nt, Shigella flexneri 2a str. 2457T
gccgagcgcgu

SEQ ID NO: 1918642 - RNA, 20 nt, Shigella flexneri 2a str. 2457T
gccgagcgggaucgccgcgu

SEQ ID NO: 1918643 - RNA, 21 nt, Shigella flexneri 2a str. 2457T
gccaucgcauagcgcaauaac

SEQ ID NO: 1918644 - RNA, 22 nt, Shigella flexneri 2a str. 2457T
gccaucgccaggaacaacgaca

SEQ ID NO: 1918645 - RNA, 14 nt, Shigella flexneri 2a str. 2457T
gccaucugccugau

SEQ ID NO: 1918646 - RNA, 23 nt, Shigella flexneri 2a str. 2457T
gccaucucugcaacgucuucccg

SEQ ID NO: 1918647 - RNA, 14 nt, Shigella flexneri 2a str. 2457T
gccaucucuuccag

SEQ ID NO: 1918648 - RNA, 15 nt, Shigella flexneri 2a str. 2457T
gccaucugccagacc

SEQ ID NO: 1918649 - RNA, 17 nt, Shigella flexneri 2a str. 2457T
gccaucugccagcaagc

SEQ ID NO: 1918650 - RNA, 12 nt, Shigella flexneri 2a str. 2457T
gccaucagcagc

SEQ ID NO: 1918651 - RNA, 13 nt, Shigella flexneri 2a str. 2457T
gccaucagcagcg

SEQ ID NO: 1918652 - RNA, 16 nt, Shigella flexneri 2a str. 2457T
gccauccgucauccau

SEQ ID NO: 1918653 - RNA, 18 nt, Shigella flexneri 2a str. 2457T
gccaucaucccuacaggu

SEQ ID NO: 1918654 - RNA, 16 nt, Shigella flexneri 2a str. 2457T
gccaucaucaccagaa

SEQ ID NO: 1918655 - RNA, 17 nt, Shigella flexneri 2a str. 2457T
gccaucaucaccagaau

SEQ ID NO: 1918656 - RNA, 19 nt, Shigella flexneri 2a str. 2457T
gccauauguguuugugcug

SEQ ID NO: 1918657 - RNA, 19 nt, Shigella flexneri 2a str. 2457T
gccaggcgcugauugggaa

SEQ ID NO: 1918658 - RNA, 22 nt, Shigella flexneri 2a str. 2457T
gccaggcguaccgugggcggca

SEQ ID NO: 1918659 - RNA, 12 nt, Shigella flexneri 2a str. 2457T
gcccaaaccacc

SEQ ID NO: 1918660 - RNA, 20 nt, Shigella flexneri 2a str. 2457T
gcccaaaccacccagcagcg

SEQ ID NO: 1918661 - RNA, 12 nt, Shigella flexneri 2a str. 2457T
gccauuggcuuu

SEQ ID NO: 1918662 - RNA, 20 nt, Shigella flexneri 2a str. 2457T
gccauugccggugauugcaa

SEQ ID NO: 1918663 - RNA, 16 nt, Shigella flexneri 2a str. 2457T
gcccacaccagucagc

SEQ ID NO: 1918664 - RNA, 20 nt, Shigella flexneri 2a str. 2457T
gcccacaccagucagcgaac

SEQ ID NO: 1918665 - RNA, 22 nt, Shigella flexneri 2a str. 2457T
gcccaacauacuguaacugcgu

SEQ ID NO: 1918666 - RNA, 23 nt, Shigella flexneri 2a str. 2457T
gcccaaccacggaguugaccagc

SEQ ID NO: 1918667 - RNA, 15 nt, Shigella flexneri 2a str. 2457T
gccaugcgaaugcca

SEQ ID NO: 1918668 - RNA, 17 nt, Shigella flexneri 2a str. 2457T
gccaugcccgugcugac

SEQ ID NO: 1918669 - RNA, 13 nt, Shigella flexneri 2a str. 2457T
gccauuaaacgca

SEQ ID NO: 1918670 - RNA, 12 nt, Shigella flexneri 2a str. 2457T
gccauuaaacaa

SEQ ID NO: 1918671 - RNA, 17 nt, Shigella flexneri 2a str. 2457T
gcccauaaauacgucuu

SEQ ID NO: 1918672 - RNA, 21 nt, Shigella flexneri 2a str. 2457T
gcccaucacaauggcacaaau

SEQ ID NO: 1918673 - RNA, 17 nt, Shigella flexneri 2a str. 2457T
gcccaucgccagugccg

SEQ ID NO: 1918674 - RNA, 21 nt, Shigella flexneri 2a str. 2457T
gcccaucgccacgccuguacc

SEQ ID NO: 1918675 - RNA, 16 nt, Shigella flexneri 2a str. 2457T
gcccaucgccagugcc

SEQ ID NO: 1918676 - RNA, 14 nt, Shigella flexneri 2a str. 2457T
gcccaucaugcgcc

SEQ ID NO: 1918677 - RNA, 22 nt, Shigella flexneri 2a str. 2457T
gcccagcgucagcauaaaaaua

SEQ ID NO: 1918678 - RNA, 16 nt, Shigella flexneri 2a str. 2457T
gcccagacaaaugaac

SEQ ID NO: 1918679 - RNA, 14 nt, Shigella flexneri 2a str. 2457T
gcccagaccagaau

SEQ ID NO: 1918680 - RNA, 22 nt, Shigella flexneri 2a str. 2457T
gcccagcucauucagccggguu

SEQ ID NO: 1918681 - RNA, 23 nt, Shigella flexneri 2a str. 2457T
gcccaccgacgcagucaugcgag

SEQ ID NO: 1918682 - RNA, 21 nt, Shigella flexneri 2a str. 2457T
gcccacaucaacucugcaaug

SEQ ID NO: 1918683 - RNA, 13 nt, Shigella flexneri 2a str. 2457T
gcccaccaccagc

SEQ ID NO: 1918684 - RNA, 21 nt, Shigella flexneri 2a str. 2457T
gcccacuuucaggccagcggc

SEQ ID NO: 1918685 - RNA, 15 nt, Shigella flexneri 2a str. 2457T
gcccagaacaaauaa

SEQ ID NO: 1918686 - RNA, 14 nt, Shigella flexneri 2a str. 2457T
gcccagaacaaaua

SEQ ID NO: 1918687 - RNA, 20 nt, Shigella flexneri 2a str. 2457T
gcccacggcguggcaucaau

SEQ ID NO: 1918688 - RNA, 17 nt, Shigella flexneri 2a str. 2457T
gcccaccuacaccggca

SEQ ID NO: 1918689 - RNA, 18 nt, Shigella flexneri 2a str. 2457T
gcccacgccaucauaccc

SEQ ID NO: 1918690 - RNA, 12 nt, Shigella flexneri 2a str. 2457T
gcccaccuggcu

SEQ ID NO: 1918691 - RNA, 13 nt, Shigella flexneri 2a str. 2457T
gcccacgccgccc

SEQ ID NO: 1918692 - RNA, 14 nt, Shigella flexneri 2a str. 2457T
gcccacgccgccca

SEQ ID NO: 1918693 - RNA, 20 nt, Shigella flexneri 2a str. 2457T
gccccauugcugaugcaccu

SEQ ID NO: 1918694 - RNA, 21 nt, Shigella flexneri 2a str. 2457T
gccccauggacauacgcaccu

SEQ ID NO: 1918695 - RNA, 16 nt, Shigella flexneri 2a str. 2457T
gcccauuccaguaauu

SEQ ID NO: 1918696 - RNA, 18 nt, Shigella flexneri 2a str. 2457T
gcccaucgcgcccgccgc

SEQ ID NO: 1918697 - RNA, 20 nt, Shigella flexneri 2a str. 2457T
gccccaucgaaccaucggcu

SEQ ID NO: 1918698 - RNA, 20 nt, Shigella flexneri 2a str. 2457T
gccccggcgaucccagagcg

SEQ ID NO: 1918699 - RNA, 23 nt, Shigella flexneri 2a str. 2457T
gccccgcgaacggggcugccagc

SEQ ID NO: 1918700 - RNA, 16 nt, Shigella flexneri 2a str. 2457T
gccccuucggggagag

SEQ ID NO: 1918701 - RNA, 14 nt, Shigella flexneri 2a str. 2457T
gcccgacgaggcgc

SEQ ID NO: 1918702 - RNA, 17 nt, Shigella flexneri 2a str. 2457T
gccccggguuuccugga

SEQ ID NO: 1918703 - RNA, 16 nt, Shigella flexneri 2a str. 2457T
gccccgguuucucuuc

SEQ ID NO: 1918704 - RNA, 15 nt, Shigella flexneri 2a str. 2457T
gccccgugaugaacu

SEQ ID NO: 1918705 - RNA, 20 nt, Shigella flexneri 2a str. 2457T
gcccgauagaaaccaugucc

SEQ ID NO: 1918706 - RNA, 14 nt, Shigella flexneri 2a str. 2457T
gcccgaugaccuug

SEQ ID NO: 1918707 - RNA, 13 nt, Shigella flexneri 2a str. 2457T
gcccgccgccauu

SEQ ID NO: 1918708 - RNA, 15 nt, Shigella flexneri 2a str. 2457T
gcccgcccccgggcc

SEQ ID NO: 1918709 - RNA, 21 nt, Shigella flexneri 2a str. 2457T
gcccggauauccacccgcagc

SEQ ID NO: 1918710 - RNA, 20 nt, Shigella flexneri 2a str. 2457T
gcccggaucguucacaugag

SEQ ID NO: 1918711 - RNA, 16 nt, Shigella flexneri 2a str. 2457T
gcccggcauucaccuc

SEQ ID NO: 1918712 - RNA, 22 nt, Shigella flexneri 2a str. 2457T
gcccgcgcgagcuuuccggcgg

SEQ ID NO: 1918713 - RNA, 16 nt, Shigella flexneri 2a str. 2457T
gcccgcugaaaagcgg

SEQ ID NO: 1918714 - RNA, 15 nt, Shigella flexneri 2a str. 2457T
gcccggagcagcagu

SEQ ID NO: 1918715 - RNA, 21 nt, Shigella flexneri 2a str. 2457T
gcccggaacuugccgggcgca

SEQ ID NO: 1918716 - RNA, 23 nt, Shigella flexneri 2a str. 2457T
gcccggaacuugccgggcgcagu

SEQ ID NO: 1918717 - RNA, 14 nt, Shigella flexneri 2a str. 2457T
gcccgcuuccagcg

SEQ ID NO: 1918718 - RNA, 19 nt, Shigella flexneri 2a str. 2457T
gcaacaauggcauuuaucu

SEQ ID NO: 1918719 - RNA, 20 nt, Shigella flexneri 2a str. 2457T
gcaacaaugccacgccacag

SEQ ID NO: 1918720 - RNA, 12 nt, Shigella flexneri 2a str. 2457T
gcaacaacugaa

SEQ ID NO: 1918721 - RNA, 12 nt, Shigella flexneri 2a str. 2457T
gcaacaaauaaa

SEQ ID NO: 1918722 - RNA, 14 nt, Shigella flexneri 2a str. 2457T
gcaacaacagcgcg

SEQ ID NO: 1918723 - RNA, 20 nt, Shigella flexneri 2a str. 2457T
gcaacagaaacgccauccag

SEQ ID NO: 1918724 - RNA, 15 nt, Shigella flexneri 2a str. 2457T
gcaacacgccagcgu

SEQ ID NO: 1918725 - RNA, 15 nt, Shigella flexneri 2a str. 2457T
gcaacagguugcgcu

SEQ ID NO: 1918726 - RNA, 16 nt, Shigella flexneri 2a str. 2457T
gcaacaguaauaaugc

SEQ ID NO: 1918727 - RNA, 12 nt, Shigella flexneri 2a str. 2457T
gcaacaggcugu

SEQ ID NO: 1918728 - RNA, 13 nt, Shigella flexneri 2a str. 2457T
gcaacccccacac

SEQ ID NO: 1918729 - RNA, 15 nt, Shigella flexneri 2a str. 2457T
gcaaccagcaggcug

SEQ ID NO: 1918730 - RNA, 17 nt, Shigella flexneri 2a str. 2457T
gcaaccagcaggcuggu

SEQ ID NO: 1918731 - RNA, 23 nt, Shigella flexneri 2a str. 2457T
gcaaccagcccaugaaucagcaa

SEQ ID NO: 1918732 - RNA, 14 nt, Shigella flexneri 2a str. 2457T
gcaaccacacccac

SEQ ID NO: 1918733 - RNA, 18 nt, Shigella flexneri 2a str. 2457T
gcaaccagcggcugcuga

SEQ ID NO: 1918734 - RNA, 19 nt, Shigella flexneri 2a str. 2457T
gcaaccaacgccagcagca

SEQ ID NO: 1918735 - RNA, 16 nt, Shigella flexneri 2a str. 2457T
gcaaccacaaccgccg

SEQ ID NO: 1918736 - RNA, 19 nt, Shigella flexneri 2a str. 2457T
gcaacaugucagcaaucac

SEQ ID NO: 1918737 - RNA, 20 nt, Shigella flexneri 2a str. 2457T
gcaacaugguuagcggaggc

SEQ ID NO: 1918738 - RNA, 14 nt, Shigella flexneri 2a str. 2457T
gcaacauguugaau

SEQ ID NO: 1918739 - RNA, 15 nt, Shigella flexneri 2a str. 2457T
gcaacauguugaauc

SEQ ID NO: 1918740 - RNA, 22 nt, Shigella flexneri 2a str. 2457T
gcaacauuaaauacagcuuaau

SEQ ID NO: 1918741 - RNA, 23 nt, Shigella flexneri 2a str. 2457T
gcaacaucaaauuacagcaccuu

SEQ ID NO: 1918742 - RNA, 15 nt, Shigella flexneri 2a str. 2457T
gcaacauaggcugcu

SEQ ID NO: 1918743 - RNA, 21 nt, Shigella flexneri 2a str. 2457T
gcaacaaaauccgccguaaau

SEQ ID NO: 1918744 - RNA, 23 nt, Shigella flexneri 2a str. 2457T
gcaaauuauuugcguagucugac

SEQ ID NO: 1918745 - RNA, 13 nt, Shigella flexneri 2a str. 2457T
gcaaaugcggaga

SEQ ID NO: 1918746 - RNA, 11 nt, Shigella flexneri 2a str. 2457T
gcaaaugccag

SEQ ID NO: 1918747 - RNA, 18 nt, Shigella flexneri 2a str. 2457T
gcaaaugcagcauugccu

SEQ ID NO: 1918748 - RNA, 23 nt, Shigella flexneri 2a str. 2457T
gcaaaugcggagacucaaacccc

SEQ ID NO: 1918749 - RNA, 22 nt, Shigella flexneri 2a str. 2457T
gcaaaucgacgccacaaucuga

SEQ ID NO: 1918750 - RNA, 15 nt, Shigella flexneri 2a str. 2457T
gcaaauccgcacuca

SEQ ID NO: 1918751 - RNA, 23 nt, Shigella flexneri 2a str. 2457T
gcaaaucgacgccacaaucugau

SEQ ID NO: 1918752 - RNA, 17 nt, Shigella flexneri 2a str. 2457T
gcaaaguagagcgaaac

SEQ ID NO: 1918753 - RNA, 14 nt, Shigella flexneri 2a str. 2457T
gcaaagguuuuacc

SEQ ID NO: 1918754 - RNA, 21 nt, Shigella flexneri 2a str. 2457T
gcaaaggguuuuugagucaca

SEQ ID NO: 1918755 - RNA, 23 nt, Shigella flexneri 2a str. 2457T
gcaaaggguuuuugagucacauu

SEQ ID NO: 1918756 - RNA, 15 nt, Shigella flexneri 2a str. 2457T
gcaaaguaauaauga

SEQ ID NO: 1918757 - RNA, 15 nt, Shigella flexneri 2a str. 2457T
gcaaaguagagcgaa

SEQ ID NO: 1918758 - RNA, 13 nt, Shigella flexneri 2a str. 2457T
gcaaauaaaacau

SEQ ID NO: 1918759 - RNA, 20 nt, Shigella flexneri 2a str. 2457T
gcaaagugaauacagaacag

SEQ ID NO: 1918760 - RNA, 19 nt, Shigella flexneri 2a str. 2457T
gcaaauacccaaaaaauag

SEQ ID NO: 1918761 - RNA, 17 nt, Shigella flexneri 2a str. 2457T
gcaaauacaguugcgcc

SEQ ID NO: 1918762 - RNA, 15 nt, Shigella flexneri 2a str. 2457T
gcaaauauugcauug

SEQ ID NO: 1918763 - RNA, 16 nt, Shigella flexneri 2a str. 2457T
gcaaauauuaauaaua

SEQ ID NO: 1918764 - RNA, 21 nt, Shigella flexneri 2a str. 2457T
gcaaaucaauagugaacugac

SEQ ID NO: 1918765 - RNA, 17 nt, Shigella flexneri 2a str. 2457T
gcaaaucacgcugcuga

SEQ ID NO: 1918766 - RNA, 19 nt, Shigella flexneri 2a str. 2457T
gcaaaucacgcugcugauu

SEQ ID NO: 1918767 - RNA, 12 nt, Shigella flexneri 2a str. 2457T
gcaaaucaccac

SEQ ID NO: 1918768 - RNA, 14 nt, Shigella flexneri 2a str. 2457T
gcaaacaccagcga

SEQ ID NO: 1918769 - RNA, 14 nt, Shigella flexneri 2a str. 2457T
gcaaacaggaacac

SEQ ID NO: 1918770 - RNA, 22 nt, Shigella flexneri 2a str. 2457T
gcaaacaguuucugcagcucca

SEQ ID NO: 1918771 - RNA, 17 nt, Shigella flexneri 2a str. 2457T
gcaaacaucggcuuauu

SEQ ID NO: 1918772 - RNA, 19 nt, Shigella flexneri 2a str. 2457T
gcaaacugccguugcugcc

SEQ ID NO: 1918773 - RNA, 19 nt, Shigella flexneri 2a str. 2457T
gcaaacucugagagaucuu

SEQ ID NO: 1918774 - RNA, 11 nt, Shigella flexneri 2a str. 2457T
gcaaacugagu

SEQ ID NO: 1918775 - RNA, 15 nt, Shigella flexneri 2a str. 2457T
gcaaacuaucccagc

SEQ ID NO: 1918776 - RNA, 19 nt, Shigella flexneri 2a str. 2457T
gcaaacuacaaauccaaca

SEQ ID NO: 1918777 - RNA, 16 nt, Shigella flexneri 2a str. 2457T
gcaaaccugcaaugau

SEQ ID NO: 1918778 - RNA, 21 nt, Shigella flexneri 2a str. 2457T
gcaaaccuggcauguggcggc

SEQ ID NO: 1918779 - RNA, 15 nt, Shigella flexneri 2a str. 2457T
gcaaaccucaggaau

SEQ ID NO: 1918780 - RNA, 15 nt, Shigella flexneri 2a str. 2457T
gcaaacgccaccugu

SEQ ID NO: 1918781 - RNA, 19 nt, Shigella flexneri 2a str. 2457T
gcaaagcauuuuuucacau

SEQ ID NO: 1918782 - RNA, 11 nt, Shigella flexneri 2a str. 2457T
gcaaagcccac

SEQ ID NO: 1918783 - RNA, 16 nt, Shigella flexneri 2a str. 2457T
gcaaaggccagcaauc

SEQ ID NO: 1918784 - RNA, 14 nt, Shigella flexneri 2a str. 2457T
gcaaaggccagcca

SEQ ID NO: 1918785 - RNA, 21 nt, Shigella flexneri 2a str. 2457T
gcaaagcgugcaaauauacau

SEQ ID NO: 1918786 - RNA, 16 nt, Shigella flexneri 2a str. 2457T
gcaaagcggucuucug

SEQ ID NO: 1918787 - RNA, 20 nt, Shigella flexneri 2a str. 2457T
gcaaacugucuaauggugaa

SEQ ID NO: 1918788 - RNA, 13 nt, Shigella flexneri 2a str. 2457T
gcaaaaauuugcg

SEQ ID NO: 1918789 - RNA, 19 nt, Shigella flexneri 2a str. 2457T
gcaaaaaucgacagcagga

SEQ ID NO: 1918790 - RNA, 20 nt, Shigella flexneri 2a str. 2457T
gcaaaaaucgacagcaggau

SEQ ID NO: 1918791 - RNA, 21 nt, Shigella flexneri 2a str. 2457T
gcaaaaauucaauugcuagua

SEQ ID NO: 1918792 - RNA, 20 nt, Shigella flexneri 2a str. 2457T
gcaaaaccucuuccagcaga

SEQ ID NO: 1918793 - RNA, 19 nt, Shigella flexneri 2a str. 2457T
gcaaaauagucaucucuuc

SEQ ID NO: 1918794 - RNA, 12 nt, Shigella flexneri 2a str. 2457T
gcaaaauaggua

SEQ ID NO: 1918795 - RNA, 19 nt, Shigella flexneri 2a str. 2457T
gcaaaaucaucacucccuu

SEQ ID NO: 1918796 - RNA, 20 nt, Shigella flexneri 2a str. 2457T
gcaaaauuuucauugccgca

SEQ ID NO: 1918797 - RNA, 14 nt, Shigella flexneri 2a str. 2457T
gcaaaauuagcucg

SEQ ID NO: 1918798 - RNA, 24 nt, Shigella flexneri 2a str. 2457T
gcaaaaucucacacucaugauccu

SEQ ID NO: 1918799 - RNA, 19 nt, Shigella flexneri 2a str. 2457T
gcaaaaucguaagcaggag

SEQ ID NO: 1918800 - RNA, 16 nt, Shigella flexneri 2a str. 2457T
gcaaaaauaaggcgga

SEQ ID NO: 1918801 - RNA, 16 nt, Shigella flexneri 2a str. 2457T
gauuuuuuuauuuuuu

SEQ ID NO: 1918802 - RNA, 19 nt, Shigella flexneri 2a str. 2457T
gauuuuuuccaacaggcga

SEQ ID NO: 1918803 - RNA, 22 nt, Shigella flexneri 2a str. 2457T
gcaaaaaaaacgggcauggugu

SEQ ID NO: 1918804 - RNA, 16 nt, Shigella flexneri 2a str. 2457T
gcaaaaaaccaucccu

SEQ ID NO: 1918805 - RNA, 18 nt, Shigella flexneri 2a str. 2457T
gauuuuuuauaguacuuc

SEQ ID NO: 1918806 - RNA, 16 nt, Shigella flexneri 2a str. 2457T
gauuuugcaauaaugg

SEQ ID NO: 1918807 - RNA, 14 nt, Shigella flexneri 2a str. 2457T
gauuuugccagcau

SEQ ID NO: 1918808 - RNA, 12 nt, Shigella flexneri 2a str. 2457T
gauuuucugcuc

SEQ ID NO: 1918809 - RNA, 13 nt, Shigella flexneri 2a str. 2457T
gauuuugcaauaa

SEQ ID NO: 1918810 - RNA, 14 nt, Shigella flexneri 2a str. 2457T
gauuuugcaauaau

SEQ ID NO: 1918811 - RNA, 19 nt, Shigella flexneri 2a str. 2457T
gauuuucuacuucuuucac

SEQ ID NO: 1918812 - RNA, 15 nt, Shigella flexneri 2a str. 2457T
gauuuucaucuucuu

SEQ ID NO: 1918813 - RNA, 20 nt, Shigella flexneri 2a str. 2457T
gauuugugcacgugccagau

SEQ ID NO: 1918814 - RNA, 19 nt, Shigella flexneri 2a str. 2457T
gauuugucgccugcaucac

SEQ ID NO: 1918815 - RNA, 13 nt, Shigella flexneri 2a str. 2457T
gauuuccuucagc

SEQ ID NO: 1918816 - RNA, 20 nt, Shigella flexneri 2a str. 2457T
gauuucguugugucgccagc

SEQ ID NO: 1918817 - RNA, 17 nt, Shigella flexneri 2a str. 2457T
gauuucuucaccagccu

SEQ ID NO: 1918818 - RNA, 22 nt, Shigella flexneri 2a str. 2457T
gauuucuucauuaaauuuccgc

SEQ ID NO: 1918819 - RNA, 13 nt, Shigella flexneri 2a str. 2457T
gauuuggcugccg

SEQ ID NO: 1918820 - RNA, 17 nt, Shigella flexneri 2a str. 2457T
gauuugauggucucgcc

SEQ ID NO: 1918821 - RNA, 16 nt, Shigella flexneri 2a str. 2457T
gauuuaugauauuuuu

SEQ ID NO: 1918822 - RNA, 22 nt, Shigella flexneri 2a str. 2457T
gauuuccaagcgcggcaggcau

SEQ ID NO: 1918823 - RNA, 19 nt, Shigella flexneri 2a str. 2457T
gauuucaucgcccaggcaa

SEQ ID NO: 1918824 - RNA, 12 nt, Shigella flexneri 2a str. 2457T
gauuucaucgcc

SEQ ID NO: 1918825 - RNA, 22 nt, Shigella flexneri 2a str. 2457T
gauuuccguuaaccuaaagccu

SEQ ID NO: 1918826 - RNA, 13 nt, Shigella flexneri 2a str. 2457T
gauuucccggcac

SEQ ID NO: 1918827 - RNA, 17 nt, Shigella flexneri 2a str. 2457T
gauuuccaucuccagcu

SEQ ID NO: 1918828 - RNA, 19 nt, Shigella flexneri 2a str. 2457T
gauuuaaucuguaucaggc

SEQ ID NO: 1918829 - RNA, 13 nt, Shigella flexneri 2a str. 2457T
gauuuaaugccaa

SEQ ID NO: 1918830 - RNA, 20 nt, Shigella flexneri 2a str. 2457T
gauuuacuacguaauuucaa

SEQ ID NO: 1918831 - RNA, 22 nt, Shigella flexneri 2a str. 2457T
gauuuaccguuaagcuggaaau

SEQ ID NO: 1918832 - RNA, 14 nt, Shigella flexneri 2a str. 2457T
gauuuaacaucucc

SEQ ID NO: 1918833 - RNA, 18 nt, Shigella flexneri 2a str. 2457T
gauuguuggcaaaaaaau

SEQ ID NO: 1918834 - RNA, 18 nt, Shigella flexneri 2a str. 2457T
gauugugugauacuucuu

SEQ ID NO: 1918835 - RNA, 11 nt, Shigella flexneri 2a str. 2457T
gauuguauuua

SEQ ID NO: 1918836 - RNA, 19 nt, Shigella flexneri 2a str. 2457T
gauucaagauuagccugaa

SEQ ID NO: 1918837 - RNA, 17 nt, Shigella flexneri 2a str. 2457T
gauucacuuucugaagg

SEQ ID NO: 1918838 - RNA, 17 nt, Shigella flexneri 2a str. 2457T
gauucagauaaucccca

SEQ ID NO: 1918839 - RNA, 22 nt, Shigella flexneri 2a str. 2457T
gauucagcccgagguuauuuug

SEQ ID NO: 1918840 - RNA, 15 nt, Shigella flexneri 2a str. 2457T
gauucccccggugcc

SEQ ID NO: 1918841 - RNA, 22 nt, Shigella flexneri 2a str. 2457T
gauucauccguuucccuguuca

SEQ ID NO: 1918842 - RNA, 19 nt, Shigella flexneri 2a str. 2457T
gauucaugcugcggcuguc

SEQ ID NO: 1918843 - RNA, 22 nt, Shigella flexneri 2a str. 2457T
gauucguuuuucuucagcagcc

SEQ ID NO: 1918844 - RNA, 17 nt, Shigella flexneri 2a str. 2457T
gauucguuuuucuucag

SEQ ID NO: 1918845 - RNA, 21 nt, Shigella flexneri 2a str. 2457T
gauucgccugaacaugcccuu

SEQ ID NO: 1918846 - RNA, 15 nt, Shigella flexneri 2a str. 2457T
gauucgcccgcagcc

SEQ ID NO: 1918847 - RNA, 21 nt, Shigella flexneri 2a str. 2457T
gauucggguucauguucagau

SEQ ID NO: 1918848 - RNA, 13 nt, Shigella flexneri 2a str. 2457T
gauucgcccgcag

SEQ ID NO: 1918849 - RNA, 15 nt, Shigella flexneri 2a str. 2457T
gauuccgccgccauu

SEQ ID NO: 1918850 - RNA, 13 nt, Shigella flexneri 2a str. 2457T
gauucccgggcac

SEQ ID NO: 1918851 - RNA, 17 nt, Shigella flexneri 2a str. 2457T
gauuccgguuggccugc

SEQ ID NO: 1918852 - RNA, 13 nt, Shigella flexneri 2a str. 2457T
gauugauuuauca

SEQ ID NO: 1918853 - RNA, 18 nt, Shigella flexneri 2a str. 2457T
gauugcacuugcuuaaaa

SEQ ID NO: 1918854 - RNA, 19 nt, Shigella flexneri 2a str. 2457T
gauugcacuugcuuaaaau

SEQ ID NO: 1918855 - RNA, 21 nt, Shigella flexneri 2a str. 2457T
gauugcauaaugguggagugg

SEQ ID NO: 1918856 - RNA, 19 nt, Shigella flexneri 2a str. 2457T
gauugccggaauggugcuu

SEQ ID NO: 1918857 - RNA, 23 nt, Shigella flexneri 2a str. 2457T
gauugccggggauuuuacugcuu

SEQ ID NO: 1918858 - RNA, 19 nt, Shigella flexneri 2a str. 2457T
gauugccgauauaaaccau

SEQ ID NO: 1918859 - RNA, 16 nt, Shigella flexneri 2a str. 2457T
gauugauuuaucaggu

SEQ ID NO: 1918860 - RNA, 19 nt, Shigella flexneri 2a str. 2457T
gauugcgaauauguacuuu

SEQ ID NO: 1918861 - RNA, 13 nt, Shigella flexneri 2a str. 2457T
gauugcggagaag

SEQ ID NO: 1918862 - RNA, 12 nt, Shigella flexneri 2a str. 2457T
gauugcuucugc

SEQ ID NO: 1918863 - RNA, 13 nt, Shigella flexneri 2a str. 2457T
gauugcuucugcu

SEQ ID NO: 1918864 - RNA, 10 nt, Shigella flexneri 2a str. 2457T
gauugcuucu

SEQ ID NO: 1918865 - RNA, 16 nt, Shigella flexneri 2a str. 2457T
gauucuucgaugaugc

SEQ ID NO: 1918866 - RNA, 17 nt, Shigella flexneri 2a str. 2457T
gauucuggugauugucu

SEQ ID NO: 1918867 - RNA, 18 nt, Shigella flexneri 2a str. 2457T
gauuaaacuucaccagca

SEQ ID NO: 1918868 - RNA, 15 nt, Shigella flexneri 2a str. 2457T
gauuaaaaucagaau

SEQ ID NO: 1918869 - RNA, 21 nt, Shigella flexneri 2a str. 2457T
gauuaaacaagguuugaaaaa

SEQ ID NO: 1918870 - RNA, 20 nt, Shigella flexneri 2a str. 2457T
gauuaaaggaaggucaucca

SEQ ID NO: 1918871 - RNA, 22 nt, Shigella flexneri 2a str. 2457T
gauuaauaaaauuauccagcuu

SEQ ID NO: 1918872 - RNA, 18 nt, Shigella flexneri 2a str. 2457T
gauuaauaaaauuaucca

SEQ ID NO: 1918873 - RNA, 18 nt, Shigella flexneri 2a str. 2457T
gauuaaaaacccugcaga

SEQ ID NO: 1918874 - RNA, 18 nt, Shigella flexneri 2a str. 2457T
gauguuuucugccucugc

SEQ ID NO: 1918875 - RNA, 21 nt, Shigella flexneri 2a str. 2457T
gauguugguaaccaaaucucc

SEQ ID NO: 1918876 - RNA, 14 nt, Shigella flexneri 2a str. 2457T
gauguucaauaaaa

SEQ ID NO: 1918877 - RNA, 20 nt, Shigella flexneri 2a str. 2457T
gaugugcgguggcuucgccu

SEQ ID NO: 1918878 - RNA, 16 nt, Shigella flexneri 2a str. 2457T
gaugugauggccgcgc

SEQ ID NO: 1918879 - RNA, 17 nt, Shigella flexneri 2a str. 2457T
gaugugauggccgcgca

SEQ ID NO: 1918880 - RNA, 17 nt, Shigella flexneri 2a str. 2457T
gaugugcaguuccugca

SEQ ID NO: 1918881 - RNA, 16 nt, Shigella flexneri 2a str. 2457T
gaugugccggauagcg

SEQ ID NO: 1918882 - RNA, 19 nt, Shigella flexneri 2a str. 2457T
gauguggugcaaggaaaua

SEQ ID NO: 1918883 - RNA, 16 nt, Shigella flexneri 2a str. 2457T
gaugucgcuuccauug

SEQ ID NO: 1918884 - RNA, 18 nt, Shigella flexneri 2a str. 2457T
gauucaaaagaugagaaa

SEQ ID NO: 1918885 - RNA, 22 nt, Shigella flexneri 2a str. 2457T
gauuauugcuugaucaggaaau

SEQ ID NO: 1918886 - RNA, 16 nt, Shigella flexneri 2a str. 2457T
gauuaugucaucaucg

SEQ ID NO: 1918887 - RNA, 20 nt, Shigella flexneri 2a str. 2457T
gauuaugucgcucaaugugc

SEQ ID NO: 1918888 - RNA, 13 nt, Shigella flexneri 2a str. 2457T
gauuauucacaau

SEQ ID NO: 1918889 - RNA, 23 nt, Shigella flexneri 2a str. 2457T
gauuaucgacugcgcccugaacc

SEQ ID NO: 1918890 - RNA, 17 nt, Shigella flexneri 2a str. 2457T
gauuauauggaaaaaua

SEQ ID NO: 1918891 - RNA, 17 nt, Shigella flexneri 2a str. 2457T
gauuauauaauaugcau

SEQ ID NO: 1918892 - RNA, 16 nt, Shigella flexneri 2a str. 2457T
gauuacgccgguguca

SEQ ID NO: 1918893 - RNA, 22 nt, Shigella flexneri 2a str. 2457T
gauuacucgccuuucacacgcu

SEQ ID NO: 1918894 - RNA, 23 nt, Shigella flexneri 2a str. 2457T
gauuagccuucaugcgacgacgg

SEQ ID NO: 1918895 - RNA, 22 nt, Shigella flexneri 2a str. 2457T
gauuacuguacagauccgccau

SEQ ID NO: 1918896 - RNA, 21 nt, Shigella flexneri 2a str. 2457T
gauuacugcaaacucaucgcc

SEQ ID NO: 1918897 - RNA, 19 nt, Shigella flexneri 2a str. 2457T
gauuacuguacagauccgc

SEQ ID NO: 1918898 - RNA, 13 nt, Shigella flexneri 2a str. 2457T
gauuacuuuauuu

SEQ ID NO: 1918899 - RNA, 13 nt, Shigella flexneri 2a str. 2457T
gauuaauuacaca

SEQ ID NO: 1918900 - RNA, 18 nt, Shigella flexneri 2a str. 2457T
gauuaauuucccaccacu

SEQ ID NO: 1918901 - RNA, 14 nt, Shigella flexneri 2a str. 2457T
gauuaccauuucac

SEQ ID NO: 1918902 - RNA, 13 nt, Shigella flexneri 2a str. 2457T
gauuacaaauaaa

SEQ ID NO: 1918903 - RNA, 21 nt, Shigella flexneri 2a str. 2457T
gauuacauggacgaaaucuac

SEQ ID NO: 1918904 - RNA, 15 nt, Shigella flexneri 2a str. 2457T
gaugguuuuauagcg

SEQ ID NO: 1918905 - RNA, 19 nt, Shigella flexneri 2a str. 2457T
gaugguugcccugcuggug

SEQ ID NO: 1918906 - RNA, 11 nt, Shigella flexneri 2a str. 2457T
gauguaaugag

SEQ ID NO: 1918907 - RNA, 13 nt, Shigella flexneri 2a str. 2457T
gauguaaugagaa

SEQ ID NO: 1918908 - RNA, 22 nt, Shigella flexneri 2a str. 2457T
gauguacgcugccgcuucuucu

SEQ ID NO: 1918909 - RNA, 19 nt, Shigella flexneri 2a str. 2457T
gauggucgcuuuguggcgg

SEQ ID NO: 1918910 - RNA, 14 nt, Shigella flexneri 2a str. 2457T
gauggucgucaauc

SEQ ID NO: 1918911 - RNA, 18 nt, Shigella flexneri 2a str. 2457T
gaugguacuucaaucgcc

SEQ ID NO: 1918912 - RNA, 19 nt, Shigella flexneri 2a str. 2457T
gaugguacgcguggacugg

SEQ ID NO: 1918913 - RNA, 20 nt, Shigella flexneri 2a str. 2457T
gaugguacuucaaucgccac

SEQ ID NO: 1918914 - RNA, 23 nt, Shigella flexneri 2a str. 2457T
gaugguacuucaaucgccaccac

SEQ ID NO: 1918915 - RNA, 18 nt, Shigella flexneri 2a str. 2457T
gauggucagcuucaccuu

SEQ ID NO: 1918916 - RNA, 21 nt, Shigella flexneri 2a str. 2457T
gaugggcgccauuuuucacug

SEQ ID NO: 1918917 - RNA, 16 nt, Shigella flexneri 2a str. 2457T
gauggcuacguucugc

SEQ ID NO: 1918918 - RNA, 19 nt, Shigella flexneri 2a str. 2457T
gauggcuugcgucauccag

SEQ ID NO: 1918919 - RNA, 14 nt, Shigella flexneri 2a str. 2457T
gauggacauucucc

SEQ ID NO: 1918920 - RNA, 13 nt, Shigella flexneri 2a str. 2457T
gauggauugcuga

SEQ ID NO: 1918921 - RNA, 18 nt, Shigella flexneri 2a str. 2457T
gauggcaaaagugauauu

SEQ ID NO: 1918922 - RNA, 13 nt, Shigella flexneri 2a str. 2457T
gaugcuuucccac

SEQ ID NO: 1918923 - RNA, 19 nt, Shigella flexneri 2a str. 2457T
gauggaaaaagagcagcug

SEQ ID NO: 1918924 - RNA, 17 nt, Shigella flexneri 2a str. 2457T
gaugcuuugaccucccg

SEQ ID NO: 1918925 - RNA, 21 nt, Shigella flexneri 2a str. 2457T
gaugcuggcggcgcgauaaaa

SEQ ID NO: 1918926 - RNA, 22 nt, Shigella flexneri 2a str. 2457T
gaugcugcggcggcggaaaaag

SEQ ID NO: 1918927 - RNA, 22 nt, Shigella flexneri 2a str. 2457T
gauggccgguuuguuauccacc

SEQ ID NO: 1918928 - RNA, 12 nt, Shigella flexneri 2a str. 2457T
gauggcccggcg

SEQ ID NO: 1918929 - RNA, 17 nt, Shigella flexneri 2a str. 2457T
gauggcaauuuucacug

SEQ ID NO: 1918930 - RNA, 22 nt, Shigella flexneri 2a str. 2457T
gauggcagaaacaguguauuuc

SEQ ID NO: 1918931 - RNA, 19 nt, Shigella flexneri 2a str. 2457T
gauggcauaccauccggca

SEQ ID NO: 1918932 - RNA, 20 nt, Shigella flexneri 2a str. 2457T
gauggcaucaccaucgggcc

SEQ ID NO: 1918933 - RNA, 21 nt, Shigella flexneri 2a str. 2457T
gauggcgcgcggcaggaagug

SEQ ID NO: 1918934 - RNA, 21 nt, Shigella flexneri 2a str. 2457T
gauggcgcaaugccauccagc

SEQ ID NO: 1918935 - RNA, 19 nt, Shigella flexneri 2a str. 2457T
gauggcgcgcagaaagagg

SEQ ID NO: 1918936 - RNA, 18 nt, Shigella flexneri 2a str. 2457T
gauggcgcaaugccaucc

SEQ ID NO: 1918937 - RNA, 13 nt, Shigella flexneri 2a str. 2457T
aaagcgaagcggc

SEQ ID NO: 1918938 - RNA, 13 nt, Shigella flexneri 2a str. 2457T
aaagcgaagcgaa

SEQ ID NO: 1918939 - RNA, 16 nt, Shigella flexneri 2a str. 2457T
aaagccuuucacuucg

SEQ ID NO: 1918940 - RNA, 16 nt, Shigella flexneri 2a str. 2457T
aaagccuuuugccagu

SEQ ID NO: 1918941 - RNA, 15 nt, Shigella flexneri 2a str. 2457T
aaagcgacuuugccu

SEQ ID NO: 1918942 - RNA, 22 nt, Shigella flexneri 2a str. 2457T
gaugaugugaauggccagacac

SEQ ID NO: 1918943 - RNA, 14 nt, Shigella flexneri 2a str. 2457T
gaugauuaaagcau

SEQ ID NO: 1918944 - RNA, 16 nt, Shigella flexneri 2a str. 2457T
gaugcagcguaaaccc

SEQ ID NO: 1918945 - RNA, 14 nt, Shigella flexneri 2a str. 2457T
gaugcaacuguuuu

SEQ ID NO: 1918946 - RNA, 13 nt, Shigella flexneri 2a str. 2457T
gaugcccccagca

SEQ ID NO: 1918947 - RNA, 13 nt, Shigella flexneri 2a str. 2457T
gaugcccagcuca

SEQ ID NO: 1918948 - RNA, 21 nt, Shigella flexneri 2a str. 2457T
gaugccggaaucaaccauggu

SEQ ID NO: 1918949 - RNA, 18 nt, Shigella flexneri 2a str. 2457T
gaugccggaugcggcgug

SEQ ID NO: 1918950 - RNA, 15 nt, Shigella flexneri 2a str. 2457T
gaugccgugcagcac

SEQ ID NO: 1918951 - RNA, 18 nt, Shigella flexneri 2a str. 2457T
gaugccgguuaauacgcc

SEQ ID NO: 1918952 - RNA, 17 nt, Shigella flexneri 2a str. 2457T
gaugccuugugggccug

SEQ ID NO: 1918953 - RNA, 19 nt, Shigella flexneri 2a str. 2457T
gaugcgacggcaccacauu

SEQ ID NO: 1918954 - RNA, 22 nt, Shigella flexneri 2a str. 2457T
gaugcgaucgcgaauaugcugg

SEQ ID NO: 1918955 - RNA, 14 nt, Shigella flexneri 2a str. 2457T
gaugcgauguaauc

SEQ ID NO: 1918956 - RNA, 12 nt, Shigella flexneri 2a str. 2457T
gaugcgcuggcg

SEQ ID NO: 1918957 - RNA, 15 nt, Shigella flexneri 2a str. 2457T
gaugcgcuggcggcu

SEQ ID NO: 1918958 - RNA, 14 nt, Shigella flexneri 2a str. 2457T
gaugcggcggacgu

SEQ ID NO: 1918959 - RNA, 21 nt, Shigella flexneri 2a str. 2457T
gaugcggcguaaacgccuuau

SEQ ID NO: 1918960 - RNA, 13 nt, Shigella flexneri 2a str. 2457T
gaugcguucaccu

SEQ ID NO: 1918961 - RNA, 15 nt, Shigella flexneri 2a str. 2457T
gaugcucgccaggcg

SEQ ID NO: 1918962 - RNA, 21 nt, Shigella flexneri 2a str. 2457T
gaugaaauagacauuacgcau

SEQ ID NO: 1918963 - RNA, 15 nt, Shigella flexneri 2a str. 2457T
gaugaacaacccuaa

SEQ ID NO: 1918964 - RNA, 22 nt, Shigella flexneri 2a str. 2457T
gaugacaaacuugauagaacaa

SEQ ID NO: 1918965 - RNA, 18 nt, Shigella flexneri 2a str. 2457T
gaugaaucaguaggugca

SEQ ID NO: 1918966 - RNA, 19 nt, Shigella flexneri 2a str. 2457T
gaugaaguccacgcgguag

SEQ ID NO: 1918967 - RNA, 16 nt, Shigella flexneri 2a str. 2457T
gaucuguugcuggcuu

SEQ ID NO: 1918968 - RNA, 22 nt, Shigella flexneri 2a str. 2457T
gaugaaaaaaccagaaagggaa

SEQ ID NO: 1918969 - RNA, 20 nt, Shigella flexneri 2a str. 2457T
gaucuuuaucaaucaccgcu

SEQ ID NO: 1918970 - RNA, 17 nt, Shigella flexneri 2a str. 2457T
gaugaccuugucaugca

SEQ ID NO: 1918971 - RNA, 14 nt, Shigella flexneri 2a str. 2457T
gaugacaugcaaug

SEQ ID NO: 1918972 - RNA, 20 nt, Shigella flexneri 2a str. 2457T
gaugaggcguuaacagcgca

SEQ ID NO: 1918973 - RNA, 19 nt, Shigella flexneri 2a str. 2457T
gaugagaacggaguugagg

SEQ ID NO: 1918974 - RNA, 21 nt, Shigella flexneri 2a str. 2457T
gaugacuggccggaagauaug

SEQ ID NO: 1918975 - RNA, 18 nt, Shigella flexneri 2a str. 2457T
aaagccgguuuugguuaa

SEQ ID NO: 1918976 - RNA, 21 nt, Shigella flexneri 2a str. 2457T
aaagccucucgcgaggagagg

SEQ ID NO: 1918977 - RNA, 14 nt, Shigella flexneri 2a str. 2457T
aaagccugcuggca

SEQ ID NO: 1918978 - RNA, 19 nt, Shigella flexneri 2a str. 2457T
gaugaucaacagcaucauc

SEQ ID NO: 1918979 - RNA, 15 nt, Shigella flexneri 2a str. 2457T
gaugauauguagacg

SEQ ID NO: 1918980 - RNA, 13 nt, Shigella flexneri 2a str. 2457T
gaugauaaaucca

SEQ ID NO: 1918981 - RNA, 17 nt, Shigella flexneri 2a str. 2457T
gaugaguugaaaaccuc

SEQ ID NO: 1918982 - RNA, 16 nt, Shigella flexneri 2a str. 2457T
gaugaguuaagaagau

SEQ ID NO: 1918983 - RNA, 18 nt, Shigella flexneri 2a str. 2457T
gagauuuuuccccaccuc

SEQ ID NO: 1918984 - RNA, 21 nt, Shigella flexneri 2a str. 2457T
gagauuacuuuauuuauauca

SEQ ID NO: 1918985 - RNA, 22 nt, Shigella flexneri 2a str. 2457T
gacucagucgcccaguaucuga

SEQ ID NO: 1918986 - RNA, 19 nt, Shigella flexneri 2a str. 2457T
gagaguacugccgggaaga

SEQ ID NO: 1918987 - RNA, 17 nt, Shigella flexneri 2a str. 2457T
gagcagcagucaggcgc

SEQ ID NO: 1918988 - RNA, 18 nt, Shigella flexneri 2a str. 2457T
gagcagccaccacuugca

SEQ ID NO: 1918989 - RNA, 19 nt, Shigella flexneri 2a str. 2457T
gagcagcauuccggcauuu

SEQ ID NO: 1918990 - RNA, 17 nt, Shigella flexneri 2a str. 2457T
gagcagcauuaccugcc

SEQ ID NO: 1918991 - RNA, 13 nt, Shigella flexneri 2a str. 2457T
gagcagcacaaug

SEQ ID NO: 1918992 - RNA, 17 nt, Shigella flexneri 2a str. 2457T
gagcagauacugaugaa

SEQ ID NO: 1918993 - RNA, 10 nt, Shigella flexneri 2a str. 2457T
gagcaaugau

SEQ ID NO: 1918994 - RNA, 22 nt, Shigella flexneri 2a str. 2457T
gagcaaugcgcaucaaagccag

SEQ ID NO: 1918995 - RNA, 21 nt, Shigella flexneri 2a str. 2457T
gagcaauagacaguucuuccu

SEQ ID NO: 1918996 - RNA, 17 nt, Shigella flexneri 2a str. 2457T
gagcaaaccacaggccg

SEQ ID NO: 1918997 - RNA, 12 nt, Shigella flexneri 2a str. 2457T
gagcaaauaaaa

SEQ ID NO: 1918998 - RNA, 21 nt, Shigella flexneri 2a str. 2457T
aaagcagacggcugucaucca

SEQ ID NO: 1918999 - RNA, 20 nt, Shigella flexneri 2a str. 2457T
aaagcagacuuuuugcggca

SEQ ID NO: 1919000 - RNA, 19 nt, Shigella flexneri 2a str. 2457T
aaagcacagaaucuaagau

SEQ ID NO: 1919001 - RNA, 14 nt, Shigella flexneri 2a str. 2457T
aaagcaccacuccu

SEQ ID NO: 1919002 - RNA, 12 nt, Shigella flexneri 2a str. 2457T
aaagcacaaaau

SEQ ID NO: 1919003 - RNA, 23 nt, Shigella flexneri 2a str. 2457T
gagcgucauauagccgccuuguu

SEQ ID NO: 1919004 - RNA, 19 nt, Shigella flexneri 2a str. 2457T
gagcguauccagcauaccu

SEQ ID NO: 1919005 - RNA, 18 nt, Shigella flexneri 2a str. 2457T
gagcguuuuuugauaguu

SEQ ID NO: 1919006 - RNA, 16 nt, Shigella flexneri 2a str. 2457T
gagcuacaaagauuug

SEQ ID NO: 1919007 - RNA, 20 nt, Shigella flexneri 2a str. 2457T
gagcgcuggugacaucgcca

SEQ ID NO: 1919008 - RNA, 22 nt, Shigella flexneri 2a str. 2457T
gagcgcuggugacaucgccaga

SEQ ID NO: 1919009 - RNA, 19 nt, Shigella flexneri 2a str. 2457T
gagcgggacaacaaacgca

SEQ ID NO: 1919010 - RNA, 16 nt, Shigella flexneri 2a str. 2457T
gagcgccagcauggca

SEQ ID NO: 1919011 - RNA, 22 nt, Shigella flexneri 2a str. 2457T
gagcgccauuucuucuccggca

SEQ ID NO: 1919012 - RNA, 15 nt, Shigella flexneri 2a str. 2457T
gagcgccccagaccu

SEQ ID NO: 1919013 - RNA, 15 nt, Shigella flexneri 2a str. 2457T
gagcgagggagaaaa

SEQ ID NO: 1919014 - RNA, 16 nt, Shigella flexneri 2a str. 2457T
gagcgcaaauugcugg

SEQ ID NO: 1919015 - RNA, 19 nt, Shigella flexneri 2a str. 2457T
gagccugccaauggcaggc

SEQ ID NO: 1919016 - RNA, 15 nt, Shigella flexneri 2a str. 2457T
gagccgauauccgga

SEQ ID NO: 1919017 - RNA, 22 nt, Shigella flexneri 2a str. 2457T
gagccgaaauauggcgcugcgg

SEQ ID NO: 1919018 - RNA, 23 nt, Shigella flexneri 2a str. 2457T
gagccgaaauauggcgcugcggc

SEQ ID NO: 1919019 - RNA, 20 nt, Shigella flexneri 2a str. 2457T
gagccaccuuaugagucaga

SEQ ID NO: 1919020 - RNA, 21 nt, Shigella flexneri 2a str. 2457T
gagucaagggugucggcacac

SEQ ID NO: 1919021 - RNA, 18 nt, Shigella flexneri 2a str. 2457T
gagucacucgacagcacc

SEQ ID NO: 1919022 - RNA, 15 nt, Shigella flexneri 2a str. 2457T
gaguccuuccagguc

SEQ ID NO: 1919023 - RNA, 14 nt, Shigella flexneri 2a str. 2457T
gagucggggccagc

SEQ ID NO: 1919024 - RNA, 16 nt, Shigella flexneri 2a str. 2457T
gagucggggccagcau

SEQ ID NO: 1919025 - RNA, 20 nt, Shigella flexneri 2a str. 2457T
gagucggggccagcauucca

SEQ ID NO: 1919026 - RNA, 19 nt, Shigella flexneri 2a str. 2457T
gaguauguuaccugugaau

SEQ ID NO: 1919027 - RNA, 17 nt, Shigella flexneri 2a str. 2457T
gaguauucuugcugaua

SEQ ID NO: 1919028 - RNA, 12 nt, Shigella flexneri 2a str. 2457T
gaguaucugcug

SEQ ID NO: 1919029 - RNA, 20 nt, Shigella flexneri 2a str. 2457T
gaguggugaaaaaaaggcga

SEQ ID NO: 1919030 - RNA, 18 nt, Shigella flexneri 2a str. 2457T
gagugguuagagcacaga

SEQ ID NO: 1919031 - RNA, 14 nt, Shigella flexneri 2a str. 2457T
gaguguggcguggc

SEQ ID NO: 1919032 - RNA, 14 nt, Shigella flexneri 2a str. 2457T
gagucgggaccagc

SEQ ID NO: 1919033 - RNA, 19 nt, Shigella flexneri 2a str. 2457T
gagugacaguucaaucucc

SEQ ID NO: 1919034 - RNA, 18 nt, Shigella flexneri 2a str. 2457T
gaguggauuaucuucacc

SEQ ID NO: 1919035 - RNA, 17 nt, Shigella flexneri 2a str. 2457T
gagugcagcaugcaccc

SEQ ID NO: 1919036 - RNA, 22 nt, Shigella flexneri 2a str. 2457T
gauaacgccuagaaaucauuca

SEQ ID NO: 1919037 - RNA, 23 nt, Shigella flexneri 2a str. 2457T
gauaacgccuagaaaucauucaa

SEQ ID NO: 1919038 - RNA, 13 nt, Shigella flexneri 2a str. 2457T
gauaaccuuccag

SEQ ID NO: 1919039 - RNA, 13 nt, Shigella flexneri 2a str. 2457T
gauaaccuucuuc

SEQ ID NO: 1919040 - RNA, 16 nt, Shigella flexneri 2a str. 2457T
gauaacgcggcagcag

SEQ ID NO: 1919041 - RNA, 22 nt, Shigella flexneri 2a str. 2457T
gauaacguacugggcggcaaaa

SEQ ID NO: 1919042 - RNA, 22 nt, Shigella flexneri 2a str. 2457T
gauaacuauggucggucaggag

SEQ ID NO: 1919043 - RNA, 16 nt, Shigella flexneri 2a str. 2457T
gauaacguuauauccc

SEQ ID NO: 1919044 - RNA, 14 nt, Shigella flexneri 2a str. 2457T
gauaaacuccugca

SEQ ID NO: 1919045 - RNA, 15 nt, Shigella flexneri 2a str. 2457T
gauaaacaguuucgc

SEQ ID NO: 1919046 - RNA, 19 nt, Shigella flexneri 2a str. 2457T
gauaaacaguuucgccagg

SEQ ID NO: 1919047 - RNA, 20 nt, Shigella flexneri 2a str. 2457T
gauaaacaucgggacaugau

SEQ ID NO: 1919048 - RNA, 19 nt, Shigella flexneri 2a str. 2457T
gauaaaccuccagcaucag

SEQ ID NO: 1919049 - RNA, 21 nt, Shigella flexneri 2a str. 2457T
gaguucgucaacacgguugga

SEQ ID NO: 1919050 - RNA, 23 nt, Shigella flexneri 2a str. 2457T
gaguuccuggaugacccggaacu

SEQ ID NO: 1919051 - RNA, 21 nt, Shigella flexneri 2a str. 2457T
gauaaaacgcagucuucccag

SEQ ID NO: 1919052 - RNA, 15 nt, Shigella flexneri 2a str. 2457T
gaguuuggugccacg

SEQ ID NO: 1919053 - RNA, 18 nt, Shigella flexneri 2a str. 2457T
gauaaaauacacuuuaau

SEQ ID NO: 1919054 - RNA, 19 nt, Shigella flexneri 2a str. 2457T
gauaaaagccaucccugua

SEQ ID NO: 1919055 - RNA, 21 nt, Shigella flexneri 2a str. 2457T
gauaaaacucucaucuuugaa

SEQ ID NO: 1919056 - RNA, 20 nt, Shigella flexneri 2a str. 2457T
gaggccuucgccugaugaua

SEQ ID NO: 1919057 - RNA, 20 nt, Shigella flexneri 2a str. 2457T
gaggcggggccaauugcugu

SEQ ID NO: 1919058 - RNA, 19 nt, Shigella flexneri 2a str. 2457T
gaggguaaacaacaugcua

SEQ ID NO: 1919059 - RNA, 14 nt, Shigella flexneri 2a str. 2457T
gagguaaaaccuga

SEQ ID NO: 1919060 - RNA, 19 nt, Shigella flexneri 2a str. 2457T
gaguaaaauaacagcggca

SEQ ID NO: 1919061 - RNA, 16 nt, Shigella flexneri 2a str. 2457T
gaguaaauugcaaacc

SEQ ID NO: 1919062 - RNA, 20 nt, Shigella flexneri 2a str. 2457T
gaguaacgggcacguaaauc

SEQ ID NO: 1919063 - RNA, 15 nt, Shigella flexneri 2a str. 2457T
gaguaaugccaguca

SEQ ID NO: 1919064 - RNA, 12 nt, Shigella flexneri 2a str. 2457T
gaguaaucacau

SEQ ID NO: 1919065 - RNA, 14 nt, Shigella flexneri 2a str. 2457T
gagcugauuuccgg

SEQ ID NO: 1919066 - RNA, 16 nt, Shigella flexneri 2a str. 2457T
gaggaacccagugaua

SEQ ID NO: 1919067 - RNA, 14 nt, Shigella flexneri 2a str. 2457T
gaggaagacaacca

SEQ ID NO: 1919068 - RNA, 21 nt, Shigella flexneri 2a str. 2457T
gaggaagcgcagcagcgcgcc

SEQ ID NO: 1919069 - RNA, 15 nt, Shigella flexneri 2a str. 2457T
gaggccaaucagcaa

SEQ ID NO: 1919070 - RNA, 13 nt, Shigella flexneri 2a str. 2457T
gaggccaaaacca

SEQ ID NO: 1919071 - RNA, 17 nt, Shigella flexneri 2a str. 2457T
gaggauaauauuuuugc

SEQ ID NO: 1919072 - RNA, 18 nt, Shigella flexneri 2a str. 2457T
gaggagcuggaggaccuu

SEQ ID NO: 1919073 - RNA, 22 nt, Shigella flexneri 2a str. 2457T
gaggagcugcacgaugacugaa

SEQ ID NO: 1919074 - RNA, 14 nt, Shigella flexneri 2a str. 2457T
gaucccucuuucug

SEQ ID NO: 1919075 - RNA, 16 nt, Shigella flexneri 2a str. 2457T
gaucccagagcgggca

SEQ ID NO: 1919076 - RNA, 19 nt, Shigella flexneri 2a str. 2457T
gauccccgcuuccugcagc

SEQ ID NO: 1919077 - RNA, 22 nt, Shigella flexneri 2a str. 2457T
gauccgcgauaagucuuugacu

SEQ ID NO: 1919078 - RNA, 16 nt, Shigella flexneri 2a str. 2457T
gauccaggaacagaag

SEQ ID NO: 1919079 - RNA, 14 nt, Shigella flexneri 2a str. 2457T
gauccagugcguau

SEQ ID NO: 1919080 - RNA, 20 nt, Shigella flexneri 2a str. 2457T
gauccauaagguccuccagc

SEQ ID NO: 1919081 - RNA, 15 nt, Shigella flexneri 2a str. 2457T
gauccaccaccgcaa

SEQ ID NO: 1919082 - RNA, 15 nt, Shigella flexneri 2a str. 2457T
gauccaccacgcugu

SEQ ID NO: 1919083 - RNA, 14 nt, Shigella flexneri 2a str. 2457T
gauccuguucaucc

SEQ ID NO: 1919084 - RNA, 15 nt, Shigella flexneri 2a str. 2457T
gauccuuuuucccaa

SEQ ID NO: 1919085 - RNA, 21 nt, Shigella flexneri 2a str. 2457T
aaagccgccaucucuuccagc

SEQ ID NO: 1919086 - RNA, 15 nt, Shigella flexneri 2a str. 2457T
gaucgccaauaucaa

SEQ ID NO: 1919087 - RNA, 15 nt, Shigella flexneri 2a str. 2457T
gauccugcacuuuca

SEQ ID NO: 1919088 - RNA, 16 nt, Shigella flexneri 2a str. 2457T
gauccugcacuuucag

SEQ ID NO: 1919089 - RNA, 15 nt, Shigella flexneri 2a str. 2457T
gauccugcaacagca

SEQ ID NO: 1919090 - RNA, 17 nt, Shigella flexneri 2a str. 2457T
gauccugagccaguuuu

SEQ ID NO: 1919091 - RNA, 15 nt, Shigella flexneri 2a str. 2457T
gauccugauccugca

SEQ ID NO: 1919092 - RNA, 22 nt, Shigella flexneri 2a str. 2457T
gauccugauuuaacaucuccac

SEQ ID NO: 1919093 - RNA, 17 nt, Shigella flexneri 2a str. 2457T
aaagcccauaccacagc

SEQ ID NO: 1919094 - RNA, 14 nt, Shigella flexneri 2a str. 2457T
aaagccccaccagc

SEQ ID NO: 1919095 - RNA, 16 nt, Shigella flexneri 2a str. 2457T
aaagccccaccagcaa

SEQ ID NO: 1919096 - RNA, 15 nt, Shigella flexneri 2a str. 2457T
aaagcccucaccgaa

SEQ ID NO: 1919097 - RNA, 14 nt, Shigella flexneri 2a str. 2457T
aaagcccaucaucc

SEQ ID NO: 1919098 - RNA, 18 nt, Shigella flexneri 2a str. 2457T
aaagcccccgcaacauug

SEQ ID NO: 1919099 - RNA, 23 nt, Shigella flexneri 2a str. 2457T
aaagcccccgcaacauugcgccu

SEQ ID NO: 1919100 - RNA, 14 nt, Shigella flexneri 2a str. 2457T
gaucgccacugcug

SEQ ID NO: 1919101 - RNA, 13 nt, Shigella flexneri 2a str. 2457T
gaucgccagcagg

SEQ ID NO: 1919102 - RNA, 13 nt, Shigella flexneri 2a str. 2457T
gaucgccauauuu

SEQ ID NO: 1919103 - RNA, 14 nt, Shigella flexneri 2a str. 2457T
gaucgccauauuuc

SEQ ID NO: 1919104 - RNA, 20 nt, Shigella flexneri 2a str. 2457T
gaucgccugguaccagcacc

SEQ ID NO: 1919105 - RNA, 21 nt, Shigella flexneri 2a str. 2457T
gaucgccugcagggcuuucac

SEQ ID NO: 1919106 - RNA, 13 nt, Shigella flexneri 2a str. 2457T
gaucggcaaugag

SEQ ID NO: 1919107 - RNA, 20 nt, Shigella flexneri 2a str. 2457T
gaucgcugaacgcaccuucc

SEQ ID NO: 1919108 - RNA, 19 nt, Shigella flexneri 2a str. 2457T
gaucgcugcccugcugguu

SEQ ID NO: 1919109 - RNA, 14 nt, Shigella flexneri 2a str. 2457T
gaucgcuucggucu

SEQ ID NO: 1919110 - RNA, 21 nt, Shigella flexneri 2a str. 2457T
gaucgcuaaggguauagaagc

SEQ ID NO: 1919111 - RNA, 18 nt, Shigella flexneri 2a str. 2457T
gaucggcguacuggcaau

SEQ ID NO: 1919112 - RNA, 22 nt, Shigella flexneri 2a str. 2457T
gaucguaagaauaaucaucggc

SEQ ID NO: 1919113 - RNA, 15 nt, Shigella flexneri 2a str. 2457T
gaucgugugccacca

SEQ ID NO: 1919114 - RNA, 22 nt, Shigella flexneri 2a str. 2457T
gaucguguggauaauccauccc

SEQ ID NO: 1919115 - RNA, 15 nt, Shigella flexneri 2a str. 2457T
gaucugcgccugcac

SEQ ID NO: 1919116 - RNA, 12 nt, Shigella flexneri 2a str. 2457T
gaucugcggguu

SEQ ID NO: 1919117 - RNA, 23 nt, Shigella flexneri 2a str. 2457T
gaucugccuguccggcauacuau

SEQ ID NO: 1919118 - RNA, 18 nt, Shigella flexneri 2a str. 2457T
gaucuggaauggaaacag

SEQ ID NO: 1919119 - RNA, 18 nt, Shigella flexneri 2a str. 2457T
gaucugcgucgcuuucca

SEQ ID NO: 1919120 - RNA, 17 nt, Shigella flexneri 2a str. 2457T
gaucugacugauaacgc

SEQ ID NO: 1919121 - RNA, 15 nt, Shigella flexneri 2a str. 2457T
gaucugauggaaaau

SEQ ID NO: 1919122 - RNA, 15 nt, Shigella flexneri 2a str. 2457T
gaucucuucgccugc

SEQ ID NO: 1919123 - RNA, 13 nt, Shigella flexneri 2a str. 2457T
gaucucaaacggu

SEQ ID NO: 1919124 - RNA, 19 nt, Shigella flexneri 2a str. 2457T
gaucaugccgcaauugucu

SEQ ID NO: 1919125 - RNA, 15 nt, Shigella flexneri 2a str. 2457T
gaucauucaccagcc

SEQ ID NO: 1919126 - RNA, 18 nt, Shigella flexneri 2a str. 2457T
gaucauuauuaaacagac

SEQ ID NO: 1919127 - RNA, 15 nt, Shigella flexneri 2a str. 2457T
gaucauuagcccaau

SEQ ID NO: 1919128 - RNA, 13 nt, Shigella flexneri 2a str. 2457T
gaucauccgcaca

SEQ ID NO: 1919129 - RNA, 22 nt, Shigella flexneri 2a str. 2457T
gaucauagagcacggcauccca

SEQ ID NO: 1919130 - RNA, 20 nt, Shigella flexneri 2a str. 2457T
gaucaucaaggcuuccuucg

SEQ ID NO: 1919131 - RNA, 21 nt, Shigella flexneri 2a str. 2457T
gaucagcgaagcgugauuguu

SEQ ID NO: 1919132 - RNA, 13 nt, Shigella flexneri 2a str. 2457T
gaucagcgguuuu

SEQ ID NO: 1919133 - RNA, 11 nt, Shigella flexneri 2a str. 2457T
gaucaguaaac

SEQ ID NO: 1919134 - RNA, 16 nt, Shigella flexneri 2a str. 2457T
gaucaguuccagcagc

SEQ ID NO: 1919135 - RNA, 15 nt, Shigella flexneri 2a str. 2457T
gaucaggguuagccg

SEQ ID NO: 1919136 - RNA, 21 nt, Shigella flexneri 2a str. 2457T
gaucacauccaguacgccuuc

SEQ ID NO: 1919137 - RNA, 19 nt, Shigella flexneri 2a str. 2457T
gaucaccaguccaucggca

SEQ ID NO: 1919138 - RNA, 17 nt, Shigella flexneri 2a str. 2457T
gaucaccgcagaagcga

SEQ ID NO: 1919139 - RNA, 23 nt, Shigella flexneri 2a str. 2457T
gaucaaccgcuacauacuuaaau

SEQ ID NO: 1919140 - RNA, 22 nt, Shigella flexneri 2a str. 2457T
gaucaaccgcuacauacuuaaa

SEQ ID NO: 1919141 - RNA, 18 nt, Shigella flexneri 2a str. 2457T
gaucaacagcaucaucgc

SEQ ID NO: 1919142 - RNA, 15 nt, Shigella flexneri 2a str. 2457T
gaucaccugcacaug

SEQ ID NO: 1919143 - RNA, 20 nt, Shigella flexneri 2a str. 2457T
gaucacuucgcgcaaccagu

SEQ ID NO: 1919144 - RNA, 13 nt, Shigella flexneri 2a str. 2457T
gaucacugcaacu

SEQ ID NO: 1919145 - RNA, 19 nt, Shigella flexneri 2a str. 2457T
gaucagcaaauccaucgcc

SEQ ID NO: 1919146 - RNA, 20 nt, Shigella flexneri 2a str. 2457T
gaucagaagcguaaccgagc

SEQ ID NO: 1919147 - RNA, 13 nt, Shigella flexneri 2a str. 2457T
gaucagacacaau

SEQ ID NO: 1919148 - RNA, 16 nt, Shigella flexneri 2a str. 2457T
gaucagacacaauaau

SEQ ID NO: 1919149 - RNA, 12 nt, Shigella flexneri 2a str. 2457T
gaucagcauuuc

SEQ ID NO: 1919150 - RNA, 20 nt, Shigella flexneri 2a str. 2457T
gauacugcauucccaucgca

SEQ ID NO: 1919151 - RNA, 20 nt, Shigella flexneri 2a str. 2457T
gauacugaugaacgcgcagg

SEQ ID NO: 1919152 - RNA, 15 nt, Shigella flexneri 2a str. 2457T
gauagaauauuucua

SEQ ID NO: 1919153 - RNA, 19 nt, Shigella flexneri 2a str. 2457T
gauacgcugcacaauugcc

SEQ ID NO: 1919154 - RNA, 15 nt, Shigella flexneri 2a str. 2457T
gauacgcccuggaua

SEQ ID NO: 1919155 - RNA, 19 nt, Shigella flexneri 2a str. 2457T
gauacgaccguuccauuca

SEQ ID NO: 1919156 - RNA, 20 nt, Shigella flexneri 2a str. 2457T
gauacgaccguuccauucaa

SEQ ID NO: 1919157 - RNA, 23 nt, Shigella flexneri 2a str. 2457T
gauaagcguagcgcaucaggcaa

SEQ ID NO: 1919158 - RNA, 15 nt, Shigella flexneri 2a str. 2457T
gauaagccccaguuc

SEQ ID NO: 1919159 - RNA, 21 nt, Shigella flexneri 2a str. 2457T
gauaacucaaaaauaaucauc

SEQ ID NO: 1919160 - RNA, 19 nt, Shigella flexneri 2a str. 2457T
gauaagacgcgccagcguc

SEQ ID NO: 1919161 - RNA, 12 nt, Shigella flexneri 2a str. 2457T
gauagcugguga

SEQ ID NO: 1919162 - RNA, 17 nt, Shigella flexneri 2a str. 2457T
gauaggaauuaaaaccc

SEQ ID NO: 1919163 - RNA, 16 nt, Shigella flexneri 2a str. 2457T
gauagauauucuccag

SEQ ID NO: 1919164 - RNA, 19 nt, Shigella flexneri 2a str. 2457T
gauaguaagauuauauaau

SEQ ID NO: 1919165 - RNA, 21 nt, Shigella flexneri 2a str. 2457T
gauaguguuuuauguucagau

SEQ ID NO: 1919166 - RNA, 15 nt, Shigella flexneri 2a str. 2457T
gauaguuaaaauuca

SEQ ID NO: 1919167 - RNA, 13 nt, Shigella flexneri 2a str. 2457T
gauauacccgcca

SEQ ID NO: 1919168 - RNA, 15 nt, Shigella flexneri 2a str. 2457T
gauaucugcccgcac

SEQ ID NO: 1919169 - RNA, 16 nt, Shigella flexneri 2a str. 2457T
gauaugcgagcaccug

SEQ ID NO: 1919170 - RNA, 13 nt, Shigella flexneri 2a str. 2457T
gauaugcaucaug

SEQ ID NO: 1919171 - RNA, 18 nt, Shigella flexneri 2a str. 2457T
gauaugcaguaaggaaau

SEQ ID NO: 1919172 - RNA, 17 nt, Shigella flexneri 2a str. 2457T
gauaugcaucaugaaaa

SEQ ID NO: 1919173 - RNA, 18 nt, Shigella flexneri 2a str. 2457T
gauaugcaucaugaaaac

SEQ ID NO: 1919174 - RNA, 20 nt, Shigella flexneri 2a str. 2457T
cuuucauuucaauaaauucc

SEQ ID NO: 1919175 - RNA, 16 nt, Shigella flexneri 2a str. 2457T
cuuucccggcaaucac

SEQ ID NO: 1919176 - RNA, 17 nt, Shigella flexneri 2a str. 2457T
cuuucccggcaaucacc

SEQ ID NO: 1919177 - RNA, 16 nt, Shigella flexneri 2a str. 2457T
cuuuccaucuuuccuc

SEQ ID NO: 1919178 - RNA, 19 nt, Shigella flexneri 2a str. 2457T
cuuuccgcuggcgucuggg

SEQ ID NO: 1919179 - RNA, 14 nt, Shigella flexneri 2a str. 2457T
cuuucgugaagcug

SEQ ID NO: 1919180 - RNA, 17 nt, Shigella flexneri 2a str. 2457T
cuuuccggcaucacauc

SEQ ID NO: 1919181 - RNA, 18 nt, Shigella flexneri 2a str. 2457T
cuuucccuucacucugcu

SEQ ID NO: 1919182 - RNA, 19 nt, Shigella flexneri 2a str. 2457T
cuuucguuugaaaacuggc

SEQ ID NO: 1919183 - RNA, 18 nt, Shigella flexneri 2a str. 2457T
cuuucguuaaauucuucu

SEQ ID NO: 1919184 - RNA, 21 nt, Shigella flexneri 2a str. 2457T
cuuucguggugagggcaaaca

SEQ ID NO: 1919185 - RNA, 16 nt, Shigella flexneri 2a str. 2457T
cuuucguuaaauucuu

SEQ ID NO: 1919186 - RNA, 16 nt, Shigella flexneri 2a str. 2457T
cuuucugagcaucaca

SEQ ID NO: 1919187 - RNA, 20 nt, Shigella flexneri 2a str. 2457T
cuuucugagcggccuuuucc

SEQ ID NO: 1919188 - RNA, 23 nt, Shigella flexneri 2a str. 2457T
cuuucugagauucaauuauagua

SEQ ID NO: 1919189 - RNA, 23 nt, Shigella flexneri 2a str. 2457T
cuuucuuuuuguugcgcugaaac

SEQ ID NO: 1919190 - RNA, 19 nt, Shigella flexneri 2a str. 2457T
cuuucugaaggauuagccg

SEQ ID NO: 1919191 - RNA, 21 nt, Shigella flexneri 2a str. 2457T
cuuucuauaagauacuggaua

SEQ ID NO: 1919192 - RNA, 19 nt, Shigella flexneri 2a str. 2457T
cuuuguuacccccauccac

SEQ ID NO: 1919193 - RNA, 13 nt, Shigella flexneri 2a str. 2457T
cuuugucuucaau

SEQ ID NO: 1919194 - RNA, 19 nt, Shigella flexneri 2a str. 2457T
cuuuguuaaacagugccca

SEQ ID NO: 1919195 - RNA, 13 nt, Shigella flexneri 2a str. 2457T
cuuuguagaugau

SEQ ID NO: 1919196 - RNA, 13 nt, Shigella flexneri 2a str. 2457T
cuuugcuggcaug

SEQ ID NO: 1919197 - RNA, 16 nt, Shigella flexneri 2a str. 2457T
cuuugauuauuuuuuu

SEQ ID NO: 1919198 - RNA, 22 nt, Shigella flexneri 2a str. 2457T
cuuugaucgguugcugaacagc

SEQ ID NO: 1919199 - RNA, 21 nt, Shigella flexneri 2a str. 2457T
cuuugaucucaaacgguucuu

SEQ ID NO: 1919200 - RNA, 19 nt, Shigella flexneri 2a str. 2457T
cuuugcuacagccugguga

SEQ ID NO: 1919201 - RNA, 13 nt, Shigella flexneri 2a str. 2457T
cuuugcaggcugg

SEQ ID NO: 1919202 - RNA, 17 nt, Shigella flexneri 2a str. 2457T
cuuugcagguucugcuc

SEQ ID NO: 1919203 - RNA, 17 nt, Shigella flexneri 2a str. 2457T
cuuuaucggcgcugcuu

SEQ ID NO: 1919204 - RNA, 23 nt, Shigella flexneri 2a str. 2457T
cuuuauucugacgccaccauuca

SEQ ID NO: 1919205 - RNA, 15 nt, Shigella flexneri 2a str. 2457T
cuuuauucauucgcu

SEQ ID NO: 1919206 - RNA, 14 nt, Shigella flexneri 2a str. 2457T
cuuuauccugacuc

SEQ ID NO: 1919207 - RNA, 14 nt, Shigella flexneri 2a str. 2457T
cuuuauccugccca

SEQ ID NO: 1919208 - RNA, 19 nt, Shigella flexneri 2a str. 2457T
cuuuaucgccgcuggaaau

SEQ ID NO: 1919209 - RNA, 19 nt, Shigella flexneri 2a str. 2457T
cuuuaucgcgcaaaaaauc

SEQ ID NO: 1919210 - RNA, 19 nt, Shigella flexneri 2a str. 2457T
cuuuauagugugcaaucac

SEQ ID NO: 1919211 - RNA, 21 nt, Shigella flexneri 2a str. 2457T
cuuucagcaguucagucagca

SEQ ID NO: 1919212 - RNA, 15 nt, Shigella flexneri 2a str. 2457T
cuuucagcaccagcc

SEQ ID NO: 1919213 - RNA, 20 nt, Shigella flexneri 2a str. 2457T
cuuucagcgaaaaagucccu

SEQ ID NO: 1919214 - RNA, 23 nt, Shigella flexneri 2a str. 2457T
cuuucagcgaaaaagucccuucc

SEQ ID NO: 1919215 - RNA, 16 nt, Shigella flexneri 2a str. 2457T
cuuucaggccgcgcag

SEQ ID NO: 1919216 - RNA, 14 nt, Shigella flexneri 2a str. 2457T
cuuucauacugccg

SEQ ID NO: 1919217 - RNA, 17 nt, Shigella flexneri 2a str. 2457T
cuuucaucaaaaaauga

SEQ ID NO: 1919218 - RNA, 22 nt, Shigella flexneri 2a str. 2457T
cuuucacccggaucaauuaauc

SEQ ID NO: 1919219 - RNA, 12 nt, Shigella flexneri 2a str. 2457T
cuuucacaaggc

SEQ ID NO: 1919220 - RNA, 21 nt, Shigella flexneri 2a str. 2457T
cuuuauuggcauggcgcuggc

SEQ ID NO: 1919221 - RNA, 21 nt, Shigella flexneri 2a str. 2457T
cuuucaaugcuuuuugcauuu

SEQ ID NO: 1919222 - RNA, 18 nt, Shigella flexneri 2a str. 2457T
cuucgcucccuagaagga

SEQ ID NO: 1919223 - RNA, 16 nt, Shigella flexneri 2a str. 2457T
cuucgcugcagcucug

SEQ ID NO: 1919224 - RNA, 17 nt, Shigella flexneri 2a str. 2457T
cuucgcugcagcucugc

SEQ ID NO: 1919225 - RNA, 21 nt, Shigella flexneri 2a str. 2457T
cuucgcuguacgccuucaugu

SEQ ID NO: 1919226 - RNA, 20 nt, Shigella flexneri 2a str. 2457T
cuuuaaaugcugcuuuauau

SEQ ID NO: 1919227 - RNA, 18 nt, Shigella flexneri 2a str. 2457T
aaagaccaggaaacccaa

SEQ ID NO: 1919228 - RNA, 21 nt, Shigella flexneri 2a str. 2457T
cuuuaauccguuacggaugaa

SEQ ID NO: 1919229 - RNA, 23 nt, Shigella flexneri 2a str. 2457T
cuuuaaugccacauuagauaaaa

SEQ ID NO: 1919230 - RNA, 17 nt, Shigella flexneri 2a str. 2457T
cuuuaaauugcguaaag

SEQ ID NO: 1919231 - RNA, 23 nt, Shigella flexneri 2a str. 2457T
cuuuaaguucagccaguugaucu

SEQ ID NO: 1919232 - RNA, 16 nt, Shigella flexneri 2a str. 2457T
cuuuacgccaggcauc

SEQ ID NO: 1919233 - RNA, 23 nt, Shigella flexneri 2a str. 2457T
cuuuaccucgaaaaccacuccug

SEQ ID NO: 1919234 - RNA, 11 nt, Shigella flexneri 2a str. 2457T
cuuuaccuuca

SEQ ID NO: 1919235 - RNA, 14 nt, Shigella flexneri 2a str. 2457T
cuuuaccuucaucc

SEQ ID NO: 1919236 - RNA, 16 nt, Shigella flexneri 2a str. 2457T
cuuuacgaagaaagca

SEQ ID NO: 1919237 - RNA, 13 nt, Shigella flexneri 2a str. 2457T
cuuuacgcaaaau

SEQ ID NO: 1919238 - RNA, 17 nt, Shigella flexneri 2a str. 2457T
cuuuaccgccuuacgcu

SEQ ID NO: 1919239 - RNA, 23 nt, Shigella flexneri 2a str. 2457T
cuuuaccgccuuacgcugcauuu

SEQ ID NO: 1919240 - RNA, 20 nt, Shigella flexneri 2a str. 2457T
cuuuaccgcgcauacggaau

SEQ ID NO: 1919241 - RNA, 20 nt, Shigella flexneri 2a str. 2457T
gaaaacaauuacgccgagcg

SEQ ID NO: 1919242 - RNA, 23 nt, Shigella flexneri 2a str. 2457T
gaaaacagcgcaccagaaacaau

SEQ ID NO: 1919243 - RNA, 17 nt, Shigella flexneri 2a str. 2457T
gaaaacagcgcaccaga

SEQ ID NO: 1919244 - RNA, 18 nt, Shigella flexneri 2a str. 2457T
gaaaacagcgcaccagaa

SEQ ID NO: 1919245 - RNA, 22 nt, Shigella flexneri 2a str. 2457T
gaaaacagcgcaccagaaacaa

SEQ ID NO: 1919246 - RNA, 20 nt, Shigella flexneri 2a str. 2457T
gaaaacccucgaccaucucc

SEQ ID NO: 1919247 - RNA, 14 nt, Shigella flexneri 2a str. 2457T
gaaaaccacuccug

SEQ ID NO: 1919248 - RNA, 11 nt, Shigella flexneri 2a str. 2457T
gaaaaccgcac

SEQ ID NO: 1919249 - RNA, 22 nt, Shigella flexneri 2a str. 2457T
gaaaaccgguacagaaucugaa

SEQ ID NO: 1919250 - RNA, 14 nt, Shigella flexneri 2a str. 2457T
gaaaacgaauugca

SEQ ID NO: 1919251 - RNA, 15 nt, Shigella flexneri 2a str. 2457T
gaaaacgaaagcgcc

SEQ ID NO: 1919252 - RNA, 19 nt, Shigella flexneri 2a str. 2457T
gaaaacgcauaccagucua

SEQ ID NO: 1919253 - RNA, 14 nt, Shigella flexneri 2a str. 2457T
gaaaacgcccggca

SEQ ID NO: 1919254 - RNA, 13 nt, Shigella flexneri 2a str. 2457T
gaaaaucaccauu

SEQ ID NO: 1919255 - RNA, 16 nt, Shigella flexneri 2a str. 2457T
gaaaaucaccucauca

SEQ ID NO: 1919256 - RNA, 16 nt, Shigella flexneri 2a str. 2457T
gaaaauaaucaugcag

SEQ ID NO: 1919257 - RNA, 13 nt, Shigella flexneri 2a str. 2457T
gaaaauacagcaa

SEQ ID NO: 1919258 - RNA, 19 nt, Shigella flexneri 2a str. 2457T
gaaaacguuucaaccugca

SEQ ID NO: 1919259 - RNA, 20 nt, Shigella flexneri 2a str. 2457T
gaaaacguuucaaacaggcu

SEQ ID NO: 1919260 - RNA, 17 nt, Shigella flexneri 2a str. 2457T
cuuuuucgaucacuuuu

SEQ ID NO: 1919261 - RNA, 15 nt, Shigella flexneri 2a str. 2457T
cuuuuguuucccgau

SEQ ID NO: 1919262 - RNA, 19 nt, Shigella flexneri 2a str. 2457T
cuuuuguuuguucuucucg

SEQ ID NO: 1919263 - RNA, 14 nt, Shigella flexneri 2a str. 2457T
cuuuuuuaaacauu

SEQ ID NO: 1919264 - RNA, 18 nt, Shigella flexneri 2a str. 2457T
cuuuuuuaagauccaguu

SEQ ID NO: 1919265 - RNA, 20 nt, Shigella flexneri 2a str. 2457T
cuuuuugaacggugaugcuc

SEQ ID NO: 1919266 - RNA, 15 nt, Shigella flexneri 2a str. 2457T
gaaaaaacagcaggg

SEQ ID NO: 1919267 - RNA, 12 nt, Shigella flexneri 2a str. 2457T
gaaaaaaacugc

SEQ ID NO: 1919268 - RNA, 15 nt, Shigella flexneri 2a str. 2457T
cuuuuuuauuuuuua

SEQ ID NO: 1919269 - RNA, 20 nt, Shigella flexneri 2a str. 2457T
cuuuuuucaauucucuaauc

SEQ ID NO: 1919270 - RNA, 16 nt, Shigella flexneri 2a str. 2457T
cuuuuuuugccccaga

SEQ ID NO: 1919271 - RNA, 22 nt, Shigella flexneri 2a str. 2457T
cuuuuuuuugccaaauaucuua

SEQ ID NO: 1919272 - RNA, 14 nt, Shigella flexneri 2a str. 2457T
cuuuuacauuaucc

SEQ ID NO: 1919273 - RNA, 12 nt, Shigella flexneri 2a str. 2457T
cuuuuauuguua

SEQ ID NO: 1919274 - RNA, 15 nt, Shigella flexneri 2a str. 2457T
cuuuuccagcauaau

SEQ ID NO: 1919275 - RNA, 17 nt, Shigella flexneri 2a str. 2457T
cuuuuccagcauaaugu

SEQ ID NO: 1919276 - RNA, 23 nt, Shigella flexneri 2a str. 2457T
cuuuuccagcauaaugugcgcac

SEQ ID NO: 1919277 - RNA, 14 nt, Shigella flexneri 2a str. 2457T
cuuuucccuccacu

SEQ ID NO: 1919278 - RNA, 22 nt, Shigella flexneri 2a str. 2457T
cuuuucaccaugggcaauccac

SEQ ID NO: 1919279 - RNA, 16 nt, Shigella flexneri 2a str. 2457T
cuuuucaaccauccua

SEQ ID NO: 1919280 - RNA, 21 nt, Shigella flexneri 2a str. 2457T
cuuuucaucagguuggaucaa

SEQ ID NO: 1919281 - RNA, 13 nt, Shigella flexneri 2a str. 2457T
cuuuucauuaucg

SEQ ID NO: 1919282 - RNA, 20 nt, Shigella flexneri 2a str. 2457T
cuuuucaguuggcugacaaa

SEQ ID NO: 1919283 - RNA, 16 nt, Shigella flexneri 2a str. 2457T
cuuuucauauuauuug

SEQ ID NO: 1919284 - RNA, 23 nt, Shigella flexneri 2a str. 2457T
aaagacgacuuuaugcgucuggg

SEQ ID NO: 1919285 - RNA, 21 nt, Shigella flexneri 2a str. 2457T
cuuuucuggucaguuggcugg

SEQ ID NO: 1919286 - RNA, 21 nt, Shigella flexneri 2a str. 2457T
cuuuucugaaguacacauaaa

SEQ ID NO: 1919287 - RNA, 21 nt, Shigella flexneri 2a str. 2457T
cuuuucguuuugguccugguc

SEQ ID NO: 1919288 - RNA, 17 nt, Shigella flexneri 2a str. 2457T
cuuuucguucaggccua

SEQ ID NO: 1919289 - RNA, 21 nt, Shigella flexneri 2a str. 2457T
cuuuucuaccaccaaaaccac

SEQ ID NO: 1919290 - RNA, 21 nt, Shigella flexneri 2a str. 2457T
cuuuugcgccacuaacgcauu

SEQ ID NO: 1919291 - RNA, 17 nt, Shigella flexneri 2a str. 2457T
cuuuugccagaauagcg

SEQ ID NO: 1919292 - RNA, 16 nt, Shigella flexneri 2a str. 2457T
gaaccuguucaacaau

SEQ ID NO: 1919293 - RNA, 15 nt, Shigella flexneri 2a str. 2457T
gaaccuguuuucacc

SEQ ID NO: 1919294 - RNA, 18 nt, Shigella flexneri 2a str. 2457T
gaaccugugacagcagcg

SEQ ID NO: 1919295 - RNA, 18 nt, Shigella flexneri 2a str. 2457T
gaaccuuuaucacuguga

SEQ ID NO: 1919296 - RNA, 13 nt, Shigella flexneri 2a str. 2457T
gaacgagaaaagc

SEQ ID NO: 1919297 - RNA, 22 nt, Shigella flexneri 2a str. 2457T
gaacgagaaaagccaaccugcg

SEQ ID NO: 1919298 - RNA, 19 nt, Shigella flexneri 2a str. 2457T
gaaccuccauguccagcuu

SEQ ID NO: 1919299 - RNA, 23 nt, Shigella flexneri 2a str. 2457T
gaaccugaacucgccgcacaggc

SEQ ID NO: 1919300 - RNA, 15 nt, Shigella flexneri 2a str. 2457T
gaaccguaaacagau

SEQ ID NO: 1919301 - RNA, 15 nt, Shigella flexneri 2a str. 2457T
gaaccgccccacccc

SEQ ID NO: 1919302 - RNA, 23 nt, Shigella flexneri 2a str. 2457T
gaaccgcuguugucugaaugaua

SEQ ID NO: 1919303 - RNA, 14 nt, Shigella flexneri 2a str. 2457T
gaaccggaaaucca

SEQ ID NO: 1919304 - RNA, 15 nt, Shigella flexneri 2a str. 2457T
gaaccgccuggcgcu

SEQ ID NO: 1919305 - RNA, 17 nt, Shigella flexneri 2a str. 2457T
gaacccguuggcacagg

SEQ ID NO: 1919306 - RNA, 17 nt, Shigella flexneri 2a str. 2457T
gaacccuaccagcugcc

SEQ ID NO: 1919307 - RNA, 21 nt, Shigella flexneri 2a str. 2457T
gaaccagggaaaaaagccccg

SEQ ID NO: 1919308 - RNA, 16 nt, Shigella flexneri 2a str. 2457T
gaaccauaaaaucaca

SEQ ID NO: 1919309 - RNA, 16 nt, Shigella flexneri 2a str. 2457T
gaaccagagaaucugc

SEQ ID NO: 1919310 - RNA, 22 nt, Shigella flexneri 2a str. 2457T
gaacccaaccgugaggccaccg

SEQ ID NO: 1919311 - RNA, 13 nt, Shigella flexneri 2a str. 2457T
gaacccagcaggu

SEQ ID NO: 1919312 - RNA, 18 nt, Shigella flexneri 2a str. 2457T
gaaccaaacagcgccaga

SEQ ID NO: 1919313 - RNA, 17 nt, Shigella flexneri 2a str. 2457T
gaaccaaagaaaucagu

SEQ ID NO: 1919314 - RNA, 16 nt, Shigella flexneri 2a str. 2457T
gaaccacagauccgga

SEQ ID NO: 1919315 - RNA, 21 nt, Shigella flexneri 2a str. 2457T
gaaccacggaaaggcaguuca

SEQ ID NO: 1919316 - RNA, 15 nt, Shigella flexneri 2a str. 2457T
gaacauuacuuuccg

SEQ ID NO: 1919317 - RNA, 16 nt, Shigella flexneri 2a str. 2457T
gaacauuacuuuccgu

SEQ ID NO: 1919318 - RNA, 13 nt, Shigella flexneri 2a str. 2457T
gaacauuggauua

SEQ ID NO: 1919319 - RNA, 14 nt, Shigella flexneri 2a str. 2457T
gaacaucauucccg

SEQ ID NO: 1919320 - RNA, 17 nt, Shigella flexneri 2a str. 2457T
gaacaucaauccaaaca

SEQ ID NO: 1919321 - RNA, 11 nt, Shigella flexneri 2a str. 2457T
gaacugacagc

SEQ ID NO: 1919322 - RNA, 14 nt, Shigella flexneri 2a str. 2457T
gaacugacagccaa

SEQ ID NO: 1919323 - RNA, 17 nt, Shigella flexneri 2a str. 2457T
gaacucuucuuccggca

SEQ ID NO: 1919324 - RNA, 14 nt, Shigella flexneri 2a str. 2457T
gaacucuuccggca

SEQ ID NO: 1919325 - RNA, 22 nt, Shigella flexneri 2a str. 2457T
gaacucguucagcgcauuccag

SEQ ID NO: 1919326 - RNA, 23 nt, Shigella flexneri 2a str. 2457T
gaacucguucagcgcauuccagu

SEQ ID NO: 1919327 - RNA, 15 nt, Shigella flexneri 2a str. 2457T
gaacugcaacucacc

SEQ ID NO: 1919328 - RNA, 18 nt, Shigella flexneri 2a str. 2457T
gaacugggccugcauauc

SEQ ID NO: 1919329 - RNA, 20 nt, Shigella flexneri 2a str. 2457T
gaacugggaaggaaugacga

SEQ ID NO: 1919330 - RNA, 15 nt, Shigella flexneri 2a str. 2457T
gaacuggcaggaaac

SEQ ID NO: 1919331 - RNA, 19 nt, Shigella flexneri 2a str. 2457T
gaacuggcaacaauggcau

SEQ ID NO: 1919332 - RNA, 15 nt, Shigella flexneri 2a str. 2457T
gaacucaggcugcca

SEQ ID NO: 1919333 - RNA, 15 nt, Shigella flexneri 2a str. 2457T
gaacucacagggcug

SEQ ID NO: 1919334 - RNA, 12 nt, Shigella flexneri 2a str. 2457T
gaacuauauccc

SEQ ID NO: 1919335 - RNA, 18 nt, Shigella flexneri 2a str. 2457T
gaacucaacgccuucuuc

SEQ ID NO: 1919336 - RNA, 15 nt, Shigella flexneri 2a str. 2457T
gaacuacguuccaug

SEQ ID NO: 1919337 - RNA, 16 nt, Shigella flexneri 2a str. 2457T
gaacgccauaaaaguc

SEQ ID NO: 1919338 - RNA, 22 nt, Shigella flexneri 2a str. 2457T
gaacgcccacggcguggcauca

SEQ ID NO: 1919339 - RNA, 18 nt, Shigella flexneri 2a str. 2457T
gaacgcguucacugccgu

SEQ ID NO: 1919340 - RNA, 16 nt, Shigella flexneri 2a str. 2457T
gaacgcuggcggcagg

SEQ ID NO: 1919341 - RNA, 20 nt, Shigella flexneri 2a str. 2457T
gaacgcggcccaggcggcgu

SEQ ID NO: 1919342 - RNA, 16 nt, Shigella flexneri 2a str. 2457T
gaacgccuuauccggc

SEQ ID NO: 1919343 - RNA, 17 nt, Shigella flexneri 2a str. 2457T
gaacgccuuauccggcc

SEQ ID NO: 1919344 - RNA, 16 nt, Shigella flexneri 2a str. 2457T
gaacgccuuaucuggc

SEQ ID NO: 1919345 - RNA, 15 nt, Shigella flexneri 2a str. 2457T
gaacgccuaauccag

SEQ ID NO: 1919346 - RNA, 20 nt, Shigella flexneri 2a str. 2457T
gaacguuacaaucugcgcug

SEQ ID NO: 1919347 - RNA, 22 nt, Shigella flexneri 2a str. 2457T
gaacguuacaaucugcgcugga

SEQ ID NO: 1919348 - RNA, 19 nt, Shigella flexneri 2a str. 2457T
gaacgugccaggguggcuc

SEQ ID NO: 1919349 - RNA, 19 nt, Shigella flexneri 2a str. 2457T
gaacguaacaguacaauau

SEQ ID NO: 1919350 - RNA, 20 nt, Shigella flexneri 2a str. 2457T
gaacggcuucgccuccuguu

SEQ ID NO: 1919351 - RNA, 22 nt, Shigella flexneri 2a str. 2457T
gaacgggucacgacucaggaac

SEQ ID NO: 1919352 - RNA, 20 nt, Shigella flexneri 2a str. 2457T
gaacgggugauuaaagaaaa

SEQ ID NO: 1919353 - RNA, 21 nt, Shigella flexneri 2a str. 2457T
gaacgggugauuaaagaaaau

SEQ ID NO: 1919354 - RNA, 15 nt, Shigella flexneri 2a str. 2457T
gaacggcagagaaac

SEQ ID NO: 1919355 - RNA, 13 nt, Shigella flexneri 2a str. 2457T
gaacggcggcggc

SEQ ID NO: 1919356 - RNA, 15 nt, Shigella flexneri 2a str. 2457T
gaacacgaucucacg

SEQ ID NO: 1919357 - RNA, 15 nt, Shigella flexneri 2a str. 2457T
gaacaauuaacccgc

SEQ ID NO: 1919358 - RNA, 16 nt, Shigella flexneri 2a str. 2457T
gaacaagugccacgca

SEQ ID NO: 1919359 - RNA, 16 nt, Shigella flexneri 2a str. 2457T
gaacaaucacccccac

SEQ ID NO: 1919360 - RNA, 19 nt, Shigella flexneri 2a str. 2457T
gaacaaaauguuuaugccu

SEQ ID NO: 1919361 - RNA, 13 nt, Shigella flexneri 2a str. 2457T
gaacaaaaaagag

SEQ ID NO: 1919362 - RNA, 12 nt, Shigella flexneri 2a str. 2457T
gaacaaaacagc

SEQ ID NO: 1919363 - RNA, 15 nt, Shigella flexneri 2a str. 2457T
gaacacucuuccagu

SEQ ID NO: 1919364 - RNA, 15 nt, Shigella flexneri 2a str. 2457T
gaacauacacaagcc

SEQ ID NO: 1919365 - RNA, 18 nt, Shigella flexneri 2a str. 2457T
gaacagcuuuuuccugcg

SEQ ID NO: 1919366 - RNA, 17 nt, Shigella flexneri 2a str. 2457T
gaaaugaaaaucaccau

SEQ ID NO: 1919367 - RNA, 21 nt, Shigella flexneri 2a str. 2457T
gaaauccugccgcaguuucug

SEQ ID NO: 1919368 - RNA, 13 nt, Shigella flexneri 2a str. 2457T
aaagagaacucuu

SEQ ID NO: 1919369 - RNA, 17 nt, Shigella flexneri 2a str. 2457T
aaagagaacucuuuuuu

SEQ ID NO: 1919370 - RNA, 15 nt, Shigella flexneri 2a str. 2457T
gaaaugaaaaaauag

SEQ ID NO: 1919371 - RNA, 19 nt, Shigella flexneri 2a str. 2457T
gaaaugcagcguuuccagc

SEQ ID NO: 1919372 - RNA, 18 nt, Shigella flexneri 2a str. 2457T
gaaaugccaaauauuucu

SEQ ID NO: 1919373 - RNA, 15 nt, Shigella flexneri 2a str. 2457T
gaaaugccaguaacu

SEQ ID NO: 1919374 - RNA, 16 nt, Shigella flexneri 2a str. 2457T
gaaauuaacgucacca

SEQ ID NO: 1919375 - RNA, 18 nt, Shigella flexneri 2a str. 2457T
gaaauuaccgcaccacca

SEQ ID NO: 1919376 - RNA, 18 nt, Shigella flexneri 2a str. 2457T
gaaauugaaaaaccagac

SEQ ID NO: 1919377 - RNA, 12 nt, Shigella flexneri 2a str. 2457T
gaaauugcacug

SEQ ID NO: 1919378 - RNA, 23 nt, Shigella flexneri 2a str. 2457T
gaaauugccacgccaauguguuu

SEQ ID NO: 1919379 - RNA, 20 nt, Shigella flexneri 2a str. 2457T
gaaauuuugcugauauuuau

SEQ ID NO: 1919380 - RNA, 12 nt, Shigella flexneri 2a str. 2457T
gaaauuauuucu

SEQ ID NO: 1919381 - RNA, 19 nt, Shigella flexneri 2a str. 2457T
gaaauuauuucuuuuacau

SEQ ID NO: 1919382 - RNA, 19 nt, Shigella flexneri 2a str. 2457T
aaagagcagcugauugaaa

SEQ ID NO: 1919383 - RNA, 13 nt, Shigella flexneri 2a str. 2457T
gaaauucacuguc

SEQ ID NO: 1919384 - RNA, 19 nt, Shigella flexneri 2a str. 2457T
gaaauucagcaguuuuugc

SEQ ID NO: 1919385 - RNA, 15 nt, Shigella flexneri 2a str. 2457T
gaaauucgccagaca

SEQ ID NO: 1919386 - RNA, 18 nt, Shigella flexneri 2a str. 2457T
gaaauuccagcggcagga

SEQ ID NO: 1919387 - RNA, 21 nt, Shigella flexneri 2a str. 2457T
gaaauucgcuucaucgcacga

SEQ ID NO: 1919388 - RNA, 21 nt, Shigella flexneri 2a str. 2457T
gaaagcgccaucaaugugcug

SEQ ID NO: 1919389 - RNA, 18 nt, Shigella flexneri 2a str. 2457T
gaaagcagcauguagaug

SEQ ID NO: 1919390 - RNA, 20 nt, Shigella flexneri 2a str. 2457T
gaaagcaccugcgcaggcau

SEQ ID NO: 1919391 - RNA, 16 nt, Shigella flexneri 2a str. 2457T
gaaagcaccugcgcag

SEQ ID NO: 1919392 - RNA, 12 nt, Shigella flexneri 2a str. 2457T
gaaacuuguaac

SEQ ID NO: 1919393 - RNA, 18 nt, Shigella flexneri 2a str. 2457T
gaaacugacuguuucacc

SEQ ID NO: 1919394 - RNA, 15 nt, Shigella flexneri 2a str. 2457T
gaaacucauaugcag

SEQ ID NO: 1919395 - RNA, 21 nt, Shigella flexneri 2a str. 2457T
gaaacucgcguaaauccagcg

SEQ ID NO: 1919396 - RNA, 16 nt, Shigella flexneri 2a str. 2457T
gaaacucgcugccagc

SEQ ID NO: 1919397 - RNA, 12 nt, Shigella flexneri 2a str. 2457T
gaaacuuauuca

SEQ ID NO: 1919398 - RNA, 17 nt, Shigella flexneri 2a str. 2457T
gaaaaugccucagagcu

SEQ ID NO: 1919399 - RNA, 17 nt, Shigella flexneri 2a str. 2457T
gaaaaugccgcacauca

SEQ ID NO: 1919400 - RNA, 15 nt, Shigella flexneri 2a str. 2457T
gaaaauggccagcca

SEQ ID NO: 1919401 - RNA, 18 nt, Shigella flexneri 2a str. 2457T
gaaaauggccagccagca

SEQ ID NO: 1919402 - RNA, 23 nt, Shigella flexneri 2a str. 2457T
gaaacucacgcagggugugcucc

SEQ ID NO: 1919403 - RNA, 15 nt, Shigella flexneri 2a str. 2457T
gaaacucacgccagc

SEQ ID NO: 1919404 - RNA, 17 nt, Shigella flexneri 2a str. 2457T
gaaacucacgccagcag

SEQ ID NO: 1919405 - RNA, 20 nt, Shigella flexneri 2a str. 2457T
gaaaaucugaauuguuuuuc

SEQ ID NO: 1919406 - RNA, 14 nt, Shigella flexneri 2a str. 2457T
gaaaaucugcggga

SEQ ID NO: 1919407 - RNA, 16 nt, Shigella flexneri 2a str. 2457T
gaaaaucgacaauaug

SEQ ID NO: 1919408 - RNA, 12 nt, Shigella flexneri 2a str. 2457T
gaaaaucaucuu

SEQ ID NO: 1919409 - RNA, 18 nt, Shigella flexneri 2a str. 2457T
gaaauagaacaguuacgc

SEQ ID NO: 1919410 - RNA, 14 nt, Shigella flexneri 2a str. 2457T
gaaauaccagguug

SEQ ID NO: 1919411 - RNA, 18 nt, Shigella flexneri 2a str. 2457T
gaaauacagguccccgcu

SEQ ID NO: 1919412 - RNA, 12 nt, Shigella flexneri 2a str. 2457T
gaaaucaaguua

SEQ ID NO: 1919413 - RNA, 21 nt, Shigella flexneri 2a str. 2457T
gaaaucagaaggguuggugaa

SEQ ID NO: 1919414 - RNA, 22 nt, Shigella flexneri 2a str. 2457T
gaaauccggcaccugucagacu

SEQ ID NO: 1919415 - RNA, 17 nt, Shigella flexneri 2a str. 2457T
gaaauccucaaccggug

SEQ ID NO: 1919416 - RNA, 17 nt, Shigella flexneri 2a str. 2457T
gaaaguauuugacuguu

SEQ ID NO: 1919417 - RNA, 17 nt, Shigella flexneri 2a str. 2457T
gaaaguaauuacacccu

SEQ ID NO: 1919418 - RNA, 22 nt, Shigella flexneri 2a str. 2457T
gaaaguacuucacaaucagcgc

SEQ ID NO: 1919419 - RNA, 21 nt, Shigella flexneri 2a str. 2457T
gaaauaaucgggaauacagaa

SEQ ID NO: 1919420 - RNA, 22 nt, Shigella flexneri 2a str. 2457T
gaaauaacugcuauucaccagc

SEQ ID NO: 1919421 - RNA, 20 nt, Shigella flexneri 2a str. 2457T
gaaaguaaaaaagaaggaaa

SEQ ID NO: 1919422 - RNA, 14 nt, Shigella flexneri 2a str. 2457T
gaaaguaaaaaaga

SEQ ID NO: 1919423 - RNA, 15 nt, Shigella flexneri 2a str. 2457T
gaaaguaacaccauc

SEQ ID NO: 1919424 - RNA, 15 nt, Shigella flexneri 2a str. 2457T
gaaaguaaaccacca

SEQ ID NO: 1919425 - RNA, 20 nt, Shigella flexneri 2a str. 2457T
gaaagcguauccaucacuaa

SEQ ID NO: 1919426 - RNA, 20 nt, Shigella flexneri 2a str. 2457T
gaaagcggaucaguuccagc

SEQ ID NO: 1919427 - RNA, 20 nt, Shigella flexneri 2a str. 2457T
gaaagcgucagcuuucagag

SEQ ID NO: 1919428 - RNA, 21 nt, Shigella flexneri 2a str. 2457T
gacaguaugguuacugucguu

SEQ ID NO: 1919429 - RNA, 19 nt, Shigella flexneri 2a str. 2457T
gacaguagccuuuaucugu

SEQ ID NO: 1919430 - RNA, 15 nt, Shigella flexneri 2a str. 2457T
gacaguauaacgaaa

SEQ ID NO: 1919431 - RNA, 20 nt, Shigella flexneri 2a str. 2457T
gacaguauaacgaaacgggu

SEQ ID NO: 1919432 - RNA, 20 nt, Shigella flexneri 2a str. 2457T
gacaguaaucuaccccagug

SEQ ID NO: 1919433 - RNA, 19 nt, Shigella flexneri 2a str. 2457T
gacagggaucucuuccagu

SEQ ID NO: 1919434 - RNA, 14 nt, Shigella flexneri 2a str. 2457T
gacaggugaugcau

SEQ ID NO: 1919435 - RNA, 20 nt, Shigella flexneri 2a str. 2457T
gacagcccggcauguuucaa

SEQ ID NO: 1919436 - RNA, 18 nt, Shigella flexneri 2a str. 2457T
gacaccgauauucgccgc

SEQ ID NO: 1919437 - RNA, 16 nt, Shigella flexneri 2a str. 2457T
gacaccgcccaacaga

SEQ ID NO: 1919438 - RNA, 18 nt, Shigella flexneri 2a str. 2457T
gacaccgcccaacagacg

SEQ ID NO: 1919439 - RNA, 15 nt, Shigella flexneri 2a str. 2457T
gacagauuuugccag

SEQ ID NO: 1919440 - RNA, 21 nt, Shigella flexneri 2a str. 2457T
gacagccauaaagaaaucacc

SEQ ID NO: 1919441 - RNA, 21 nt, Shigella flexneri 2a str. 2457T
gacagacuugacgccuuuacc

SEQ ID NO: 1919442 - RNA, 15 nt, Shigella flexneri 2a str. 2457T
gacagagaaagcaaa

SEQ ID NO: 1919443 - RNA, 20 nt, Shigella flexneri 2a str. 2457T
gacagagauucgguaaccau

SEQ ID NO: 1919444 - RNA, 15 nt, Shigella flexneri 2a str. 2457T
gacagaugcucgcca

SEQ ID NO: 1919445 - RNA, 21 nt, Shigella flexneri 2a str. 2457T
gacauugugugaaaucagcac

SEQ ID NO: 1919446 - RNA, 16 nt, Shigella flexneri 2a str. 2457T
gacauuguuuccauau

SEQ ID NO: 1919447 - RNA, 14 nt, Shigella flexneri 2a str. 2457T
gacauguggauuaa

SEQ ID NO: 1919448 - RNA, 16 nt, Shigella flexneri 2a str. 2457T
gaccaaagaaugacac

SEQ ID NO: 1919449 - RNA, 21 nt, Shigella flexneri 2a str. 2457T
gaccaaaacgugcagcugccu

SEQ ID NO: 1919450 - RNA, 13 nt, Shigella flexneri 2a str. 2457T
gacauuuucucua

SEQ ID NO: 1919451 - RNA, 22 nt, Shigella flexneri 2a str. 2457T
gaccacacggucuaucaucagc

SEQ ID NO: 1919452 - RNA, 23 nt, Shigella flexneri 2a str. 2457T
gaccacacggucuaucaucagca

SEQ ID NO: 1919453 - RNA, 18 nt, Shigella flexneri 2a str. 2457T
gaccaauaaacgccaggu

SEQ ID NO: 1919454 - RNA, 15 nt, Shigella flexneri 2a str. 2457T
gaccaauccgccagc

SEQ ID NO: 1919455 - RNA, 17 nt, Shigella flexneri 2a str. 2457T
gacauccgugcagaacu

SEQ ID NO: 1919456 - RNA, 15 nt, Shigella flexneri 2a str. 2457T
gacauccugcguuaa

SEQ ID NO: 1919457 - RNA, 13 nt, Shigella flexneri 2a str. 2457T
gacaugcaucacg

SEQ ID NO: 1919458 - RNA, 20 nt, Shigella flexneri 2a str. 2457T
gacauggugcgauuaagaua

SEQ ID NO: 1919459 - RNA, 15 nt, Shigella flexneri 2a str. 2457T
gacaucccagugcaa

SEQ ID NO: 1919460 - RNA, 17 nt, Shigella flexneri 2a str. 2457T
gacaucccgccagccgc

SEQ ID NO: 1919461 - RNA, 14 nt, Shigella flexneri 2a str. 2457T
gacauccaugcacu

SEQ ID NO: 1919462 - RNA, 16 nt, Shigella flexneri 2a str. 2457T
gacaguucaaucuccg

SEQ ID NO: 1919463 - RNA, 16 nt, Shigella flexneri 2a str. 2457T
gacaguuauuaucuga

SEQ ID NO: 1919464 - RNA, 17 nt, Shigella flexneri 2a str. 2457T
gacaguguuauucccaa

SEQ ID NO: 1919465 - RNA, 18 nt, Shigella flexneri 2a str. 2457T
gaccagcuccagcagacc

SEQ ID NO: 1919466 - RNA, 19 nt, Shigella flexneri 2a str. 2457T
gaccagcggguugcugaga

SEQ ID NO: 1919467 - RNA, 17 nt, Shigella flexneri 2a str. 2457T
gaccaccgaaugcgccu

SEQ ID NO: 1919468 - RNA, 16 nt, Shigella flexneri 2a str. 2457T
gacccauaaucagacg

SEQ ID NO: 1919469 - RNA, 19 nt, Shigella flexneri 2a str. 2457T
gaccauaaauauggugaaa

SEQ ID NO: 1919470 - RNA, 18 nt, Shigella flexneri 2a str. 2457T
gaccauacagcagcaacg

SEQ ID NO: 1919471 - RNA, 19 nt, Shigella flexneri 2a str. 2457T
gaccauacagcagcaacga

SEQ ID NO: 1919472 - RNA, 21 nt, Shigella flexneri 2a str. 2457T
gaccaucaacuaaauauccac

SEQ ID NO: 1919473 - RNA, 17 nt, Shigella flexneri 2a str. 2457T
gaccaucagcaugacaa

SEQ ID NO: 1919474 - RNA, 14 nt, Shigella flexneri 2a str. 2457T
gaccgccagcgcca

SEQ ID NO: 1919475 - RNA, 16 nt, Shigella flexneri 2a str. 2457T
gaccgcccgcuaugag

SEQ ID NO: 1919476 - RNA, 20 nt, Shigella flexneri 2a str. 2457T
gacccgacagaugcucgcca

SEQ ID NO: 1919477 - RNA, 14 nt, Shigella flexneri 2a str. 2457T
gacccaucugccag

SEQ ID NO: 1919478 - RNA, 16 nt, Shigella flexneri 2a str. 2457T
gacgccauucacuggc

SEQ ID NO: 1919479 - RNA, 22 nt, Shigella flexneri 2a str. 2457T
gacgcauccgaucgcgcaucag

SEQ ID NO: 1919480 - RNA, 16 nt, Shigella flexneri 2a str. 2457T
gacgccacaaucugau

SEQ ID NO: 1919481 - RNA, 20 nt, Shigella flexneri 2a str. 2457T
gacgccacaaucugauaauc

SEQ ID NO: 1919482 - RNA, 21 nt, Shigella flexneri 2a str. 2457T
gacgccgccggugucgcaccu

SEQ ID NO: 1919483 - RNA, 19 nt, Shigella flexneri 2a str. 2457T
gacgccgcgguucuuccaa

SEQ ID NO: 1919484 - RNA, 19 nt, Shigella flexneri 2a str. 2457T
gacgcccugcgcuggugaa

SEQ ID NO: 1919485 - RNA, 21 nt, Shigella flexneri 2a str. 2457T
gacgcccguuaaccgcucugc

SEQ ID NO: 1919486 - RNA, 11 nt, Shigella flexneri 2a str. 2457T
gacgacgcuga

SEQ ID NO: 1919487 - RNA, 22 nt, Shigella flexneri 2a str. 2457T
gacgacgccccggccuugccug

SEQ ID NO: 1919488 - RNA, 15 nt, Shigella flexneri 2a str. 2457T
gacgacgguuuccac

SEQ ID NO: 1919489 - RNA, 15 nt, Shigella flexneri 2a str. 2457T
gacgacuuuuuccau

SEQ ID NO: 1919490 - RNA, 16 nt, Shigella flexneri 2a str. 2457T
gacgaucgcagaugaa

SEQ ID NO: 1919491 - RNA, 23 nt, Shigella flexneri 2a str. 2457T
gacgauagauagagaaguaaccg

SEQ ID NO: 1919492 - RNA, 22 nt, Shigella flexneri 2a str. 2457T
gacgcaggaugcaauuguugag

SEQ ID NO: 1919493 - RNA, 19 nt, Shigella flexneri 2a str. 2457T
gacgcagucaugcgagaag

SEQ ID NO: 1919494 - RNA, 21 nt, Shigella flexneri 2a str. 2457T
gacgcaggcgcgcuguggugu

SEQ ID NO: 1919495 - RNA, 16 nt, Shigella flexneri 2a str. 2457T
gacgaaauccccccgg

SEQ ID NO: 1919496 - RNA, 15 nt, Shigella flexneri 2a str. 2457T
gacgaaagucugggc

SEQ ID NO: 1919497 - RNA, 13 nt, Shigella flexneri 2a str. 2457T
gaccuuuuuucag

SEQ ID NO: 1919498 - RNA, 17 nt, Shigella flexneri 2a str. 2457T
gacgaaaaaucaauaaa

SEQ ID NO: 1919499 - RNA, 19 nt, Shigella flexneri 2a str. 2457T
gaccuuucaguuugccgcu

SEQ ID NO: 1919500 - RNA, 13 nt, Shigella flexneri 2a str. 2457T
gaccugugccagc

SEQ ID NO: 1919501 - RNA, 23 nt, Shigella flexneri 2a str. 2457T
gaccugucggggccagcgcaucc

SEQ ID NO: 1919502 - RNA, 14 nt, Shigella flexneri 2a str. 2457T
gaccugguugcugg

SEQ ID NO: 1919503 - RNA, 21 nt, Shigella flexneri 2a str. 2457T
gaccugucggggccagcgcau

SEQ ID NO: 1919504 - RNA, 17 nt, Shigella flexneri 2a str. 2457T
gaccuguaaaguacaau

SEQ ID NO: 1919505 - RNA, 16 nt, Shigella flexneri 2a str. 2457T
gaccugacuguuccag

SEQ ID NO: 1919506 - RNA, 18 nt, Shigella flexneri 2a str. 2457T
gaccugacuguuccagca

SEQ ID NO: 1919507 - RNA, 15 nt, Shigella flexneri 2a str. 2457T
gaccugauacauagc

SEQ ID NO: 1919508 - RNA, 19 nt, Shigella flexneri 2a str. 2457T
gaccugcaaauucaauaaa

SEQ ID NO: 1919509 - RNA, 20 nt, Shigella flexneri 2a str. 2457T
gaccugcgucaccacaucca

SEQ ID NO: 1919510 - RNA, 15 nt, Shigella flexneri 2a str. 2457T
gaccugcgccugcac

SEQ ID NO: 1919511 - RNA, 16 nt, Shigella flexneri 2a str. 2457T
gaccuggaaggacucg

SEQ ID NO: 1919512 - RNA, 15 nt, Shigella flexneri 2a str. 2457T
gaccugggaaaucca

SEQ ID NO: 1919513 - RNA, 18 nt, Shigella flexneri 2a str. 2457T
gaccugggaaauccaaca

SEQ ID NO: 1919514 - RNA, 20 nt, Shigella flexneri 2a str. 2457T
gacggccagucauugagcuu

SEQ ID NO: 1919515 - RNA, 21 nt, Shigella flexneri 2a str. 2457T
gacggccucugcggaggccgu

SEQ ID NO: 1919516 - RNA, 23 nt, Shigella flexneri 2a str. 2457T
gacggcgcucuugcggcauuucg

SEQ ID NO: 1919517 - RNA, 22 nt, Shigella flexneri 2a str. 2457T
gacggugacacuuugcgccauc

SEQ ID NO: 1919518 - RNA, 23 nt, Shigella flexneri 2a str. 2457T
gacuaacggaauugccaacggca

SEQ ID NO: 1919519 - RNA, 21 nt, Shigella flexneri 2a str. 2457T
gacuaaaguuucuuuaggauu

SEQ ID NO: 1919520 - RNA, 17 nt, Shigella flexneri 2a str. 2457T
gacguuaauaaaauuua

SEQ ID NO: 1919521 - RNA, 14 nt, Shigella flexneri 2a str. 2457T
gacguucaguuccg

SEQ ID NO: 1919522 - RNA, 18 nt, Shigella flexneri 2a str. 2457T
gacguagugaaaucgcca

SEQ ID NO: 1919523 - RNA, 18 nt, Shigella flexneri 2a str. 2457T
gacguauaaccggaugac

SEQ ID NO: 1919524 - RNA, 17 nt, Shigella flexneri 2a str. 2457T
gacgugucuuaucaggc

SEQ ID NO: 1919525 - RNA, 13 nt, Shigella flexneri 2a str. 2457T
gacuaucaucgcc

SEQ ID NO: 1919526 - RNA, 20 nt, Shigella flexneri 2a str. 2457T
gacuaucgcgacgaauaggu

SEQ ID NO: 1919527 - RNA, 16 nt, Shigella flexneri 2a str. 2457T
gacuauuaaacaggau

SEQ ID NO: 1919528 - RNA, 15 nt, Shigella flexneri 2a str. 2457T
gacuauucagcucuu

SEQ ID NO: 1919529 - RNA, 14 nt, Shigella flexneri 2a str. 2457T
gacuauuacucaac

SEQ ID NO: 1919530 - RNA, 16 nt, Shigella flexneri 2a str. 2457T
gacuagugauaaccac

SEQ ID NO: 1919531 - RNA, 18 nt, Shigella flexneri 2a str. 2457T
gacuacgccaacagaagu

SEQ ID NO: 1919532 - RNA, 12 nt, Shigella flexneri 2a str. 2457T
gacaccaaacag

SEQ ID NO: 1919533 - RNA, 21 nt, Shigella flexneri 2a str. 2457T
gacaccauaacagaggccacc

SEQ ID NO: 1919534 - RNA, 16 nt, Shigella flexneri 2a str. 2457T
gacaccccuucauuca

SEQ ID NO: 1919535 - RNA, 23 nt, Shigella flexneri 2a str. 2457T
gacaauaauacccagcaccgcag

SEQ ID NO: 1919536 - RNA, 22 nt, Shigella flexneri 2a str. 2457T
gacaauaauaucuuuuuugcgu

SEQ ID NO: 1919537 - RNA, 18 nt, Shigella flexneri 2a str. 2457T
gacaacgccauauaaauu

SEQ ID NO: 1919538 - RNA, 23 nt, Shigella flexneri 2a str. 2457T
gacaaggcguugauuggcgcagg

SEQ ID NO: 1919539 - RNA, 14 nt, Shigella flexneri 2a str. 2457T
gacaaggcaucaga

SEQ ID NO: 1919540 - RNA, 14 nt, Shigella flexneri 2a str. 2457T
gacaaacacaaaac

SEQ ID NO: 1919541 - RNA, 21 nt, Shigella flexneri 2a str. 2457T
gacaaacagcucgacaccaaa

SEQ ID NO: 1919542 - RNA, 20 nt, Shigella flexneri 2a str. 2457T
gacaaacaggaaguuucagc

SEQ ID NO: 1919543 - RNA, 17 nt, Shigella flexneri 2a str. 2457T
gacaaacauugcugcca

SEQ ID NO: 1919544 - RNA, 22 nt, Shigella flexneri 2a str. 2457T
gacaaacgcuguaauuaccagc

SEQ ID NO: 1919545 - RNA, 13 nt, Shigella flexneri 2a str. 2457T
gacaacaucaucu

SEQ ID NO: 1919546 - RNA, 20 nt, Shigella flexneri 2a str. 2457T
gacaaacuugauagaacaaa

SEQ ID NO: 1919547 - RNA, 11 nt, Shigella flexneri 2a str. 2457T
gacaacaucau

SEQ ID NO: 1919548 - RNA, 15 nt, Shigella flexneri 2a str. 2457T
gaauuucagaaaacg

SEQ ID NO: 1919549 - RNA, 22 nt, Shigella flexneri 2a str. 2457T
gaauuuuuuauagaccuuaauu

SEQ ID NO: 1919550 - RNA, 15 nt, Shigella flexneri 2a str. 2457T
gacaaaaauaccacc

SEQ ID NO: 1919551 - RNA, 20 nt, Shigella flexneri 2a str. 2457T
gaauugcugcgcccgcagcg

SEQ ID NO: 1919552 - RNA, 14 nt, Shigella flexneri 2a str. 2457T
gaauugugaugguu

SEQ ID NO: 1919553 - RNA, 21 nt, Shigella flexneri 2a str. 2457T
gaauuaugcagccuucauuca

SEQ ID NO: 1919554 - RNA, 18 nt, Shigella flexneri 2a str. 2457T
gaauugcagauaccacau

SEQ ID NO: 1919555 - RNA, 13 nt, Shigella flexneri 2a str. 2457T
gaauuaugcagcc

SEQ ID NO: 1919556 - RNA, 16 nt, Shigella flexneri 2a str. 2457T
gaauuaugcagccuuc

SEQ ID NO: 1919557 - RNA, 14 nt, Shigella flexneri 2a str. 2457T
gaauuaugauaguc

SEQ ID NO: 1919558 - RNA, 16 nt, Shigella flexneri 2a str. 2457T
gaauuacacagccaca

SEQ ID NO: 1919559 - RNA, 14 nt, Shigella flexneri 2a str. 2457T
gaaugagcaucuac

SEQ ID NO: 1919560 - RNA, 15 nt, Shigella flexneri 2a str. 2457T
gaaugagcaucuacu

SEQ ID NO: 1919561 - RNA, 15 nt, Shigella flexneri 2a str. 2457T
gaaugaggcagcaag

SEQ ID NO: 1919562 - RNA, 16 nt, Shigella flexneri 2a str. 2457T
gaaugcgaaaauccuc

SEQ ID NO: 1919563 - RNA, 15 nt, Shigella flexneri 2a str. 2457T
gaaugcgauggcaaa

SEQ ID NO: 1919564 - RNA, 17 nt, Shigella flexneri 2a str. 2457T
gaaugcgauggcaaaag

SEQ ID NO: 1919565 - RNA, 17 nt, Shigella flexneri 2a str. 2457T
gaaugcgcuuuauugua

SEQ ID NO: 1919566 - RNA, 19 nt, Shigella flexneri 2a str. 2457T
gaaugcgguuaaaccgaaa

SEQ ID NO: 1919567 - RNA, 14 nt, Shigella flexneri 2a str. 2457T
gaauguuccauacc

SEQ ID NO: 1919568 - RNA, 20 nt, Shigella flexneri 2a str. 2457T
gaauguuccaucaccagauu

SEQ ID NO: 1919569 - RNA, 15 nt, Shigella flexneri 2a str. 2457T
gaaugugaugaaaaa

SEQ ID NO: 1919570 - RNA, 15 nt, Shigella flexneri 2a str. 2457T
gaauguggcaaugag

SEQ ID NO: 1919571 - RNA, 18 nt, Shigella flexneri 2a str. 2457T
gaaucgccagcaucggca

SEQ ID NO: 1919572 - RNA, 23 nt, Shigella flexneri 2a str. 2457T
gaaucgccagcaucggcagcgcc

SEQ ID NO: 1919573 - RNA, 22 nt, Shigella flexneri 2a str. 2457T
gaaucuguuuuuugguguuacu

SEQ ID NO: 1919574 - RNA, 13 nt, Shigella flexneri 2a str. 2457T
gaaucgccagcau

SEQ ID NO: 1919575 - RNA, 23 nt, Shigella flexneri 2a str. 2457T
gaaucgcaaagccgauaccuucc

SEQ ID NO: 1919576 - RNA, 18 nt, Shigella flexneri 2a str. 2457T
gaauccuucccccaccac

SEQ ID NO: 1919577 - RNA, 15 nt, Shigella flexneri 2a str. 2457T
gaaucuuuucaucgc

SEQ ID NO: 1919578 - RNA, 14 nt, Shigella flexneri 2a str. 2457T
gaaucagcaguuca

SEQ ID NO: 1919579 - RNA, 19 nt, Shigella flexneri 2a str. 2457T
gaaucaucguucauauauu

SEQ ID NO: 1919580 - RNA, 21 nt, Shigella flexneri 2a str. 2457T
gaaucaucguucauauauucc

SEQ ID NO: 1919581 - RNA, 21 nt, Shigella flexneri 2a str. 2457T
gaaucaguaaugauucgggcu

SEQ ID NO: 1919582 - RNA, 19 nt, Shigella flexneri 2a str. 2457T
gaaucaguaggugcaagca

SEQ ID NO: 1919583 - RNA, 22 nt, Shigella flexneri 2a str. 2457T
gaaucaugguuuauuucccaga

SEQ ID NO: 1919584 - RNA, 21 nt, Shigella flexneri 2a str. 2457T
gaaucauaaauacaaggccaa

SEQ ID NO: 1919585 - RNA, 23 nt, Shigella flexneri 2a str. 2457T
gaaucaugccgaucgucugggca

SEQ ID NO: 1919586 - RNA, 20 nt, Shigella flexneri 2a str. 2457T
aaagauucaucgcccuuuuu

SEQ ID NO: 1919587 - RNA, 19 nt, Shigella flexneri 2a str. 2457T
gaaucaaauaaaaauaccc

SEQ ID NO: 1919588 - RNA, 15 nt, Shigella flexneri 2a str. 2457T
gaauagcggaaaucu

SEQ ID NO: 1919589 - RNA, 20 nt, Shigella flexneri 2a str. 2457T
gaauagccuuuagcgagcga

SEQ ID NO: 1919590 - RNA, 13 nt, Shigella flexneri 2a str. 2457T
aaagauuaaaaaa

SEQ ID NO: 1919591 - RNA, 21 nt, Shigella flexneri 2a str. 2457T
gaauagaaccuaagaaccaga

SEQ ID NO: 1919592 - RNA, 15 nt, Shigella flexneri 2a str. 2457T
gaauaccuucuuccu

SEQ ID NO: 1919593 - RNA, 16 nt, Shigella flexneri 2a str. 2457T
gaauaaaacaggcagc

SEQ ID NO: 1919594 - RNA, 15 nt, Shigella flexneri 2a str. 2457T
gaauaaaacagaaac

SEQ ID NO: 1919595 - RNA, 15 nt, Shigella flexneri 2a str. 2457T
gaauaagcugcguga

SEQ ID NO: 1919596 - RNA, 18 nt, Shigella flexneri 2a str. 2457T
gaauaccguauucaacga

SEQ ID NO: 1919597 - RNA, 21 nt, Shigella flexneri 2a str. 2457T
gaauaccccauggagaaaaug

SEQ ID NO: 1919598 - RNA, 13 nt, Shigella flexneri 2a str. 2457T
gaauaaucagaug

SEQ ID NO: 1919599 - RNA, 13 nt, Shigella flexneri 2a str. 2457T
gaauaaucagcaa

SEQ ID NO: 1919600 - RNA, 19 nt, Shigella flexneri 2a str. 2457T
gaauaaucaccuuuaaccu

SEQ ID NO: 1919601 - RNA, 18 nt, Shigella flexneri 2a str. 2457T
gaagucguucagaucuuu

SEQ ID NO: 1919602 - RNA, 17 nt, Shigella flexneri 2a str. 2457T
gaagucgaacuucucuu

SEQ ID NO: 1919603 - RNA, 15 nt, Shigella flexneri 2a str. 2457T
gaaguuuuccucagu

SEQ ID NO: 1919604 - RNA, 17 nt, Shigella flexneri 2a str. 2457T
gaaggaauauucaggcu

SEQ ID NO: 1919605 - RNA, 21 nt, Shigella flexneri 2a str. 2457T
gaagcuuucuugcagcucuug

SEQ ID NO: 1919606 - RNA, 13 nt, Shigella flexneri 2a str. 2457T
gaaggauuacuca

SEQ ID NO: 1919607 - RNA, 20 nt, Shigella flexneri 2a str. 2457T
gaaggcgcacugauucauga

SEQ ID NO: 1919608 - RNA, 16 nt, Shigella flexneri 2a str. 2457T
gaaggcgcauugcugg

SEQ ID NO: 1919609 - RNA, 21 nt, Shigella flexneri 2a str. 2457T
gaaggguauugccgaugaacg

SEQ ID NO: 1919610 - RNA, 19 nt, Shigella flexneri 2a str. 2457T
gaaguagccaguaccaccc

SEQ ID NO: 1919611 - RNA, 18 nt, Shigella flexneri 2a str. 2457T
gaaguaccauugaagcaa

SEQ ID NO: 1919612 - RNA, 20 nt, Shigella flexneri 2a str. 2457T
gaaguacuccugcucgccga

SEQ ID NO: 1919613 - RNA, 15 nt, Shigella flexneri 2a str. 2457T
gaaguacuccugcuc

SEQ ID NO: 1919614 - RNA, 17 nt, Shigella flexneri 2a str. 2457T
gaaguaauaaucaacgc

SEQ ID NO: 1919615 - RNA, 20 nt, Shigella flexneri 2a str. 2457T
gaagcccaucaguacaccac

SEQ ID NO: 1919616 - RNA, 20 nt, Shigella flexneri 2a str. 2457T
gaagcgggggagucgcuggu

SEQ ID NO: 1919617 - RNA, 19 nt, Shigella flexneri 2a str. 2457T
gaagcguaauauccaggcc

SEQ ID NO: 1919618 - RNA, 20 nt, Shigella flexneri 2a str. 2457T
gaagcggccgucagaucgcc

SEQ ID NO: 1919619 - RNA, 23 nt, Shigella flexneri 2a str. 2457T
gaagcacguucaucccacucuga

SEQ ID NO: 1919620 - RNA, 17 nt, Shigella flexneri 2a str. 2457T
gaagcacacgacauccg

SEQ ID NO: 1919621 - RNA, 18 nt, Shigella flexneri 2a str. 2457T
gaagccauuaaacaccag

SEQ ID NO: 1919622 - RNA, 15 nt, Shigella flexneri 2a str. 2457T
gaagccagucacauc

SEQ ID NO: 1919623 - RNA, 21 nt, Shigella flexneri 2a str. 2457T
aaagagugugaauauucagaa

SEQ ID NO: 1919624 - RNA, 19 nt, Shigella flexneri 2a str. 2457T
gaagaggaucugcucuucu

SEQ ID NO: 1919625 - RNA, 16 nt, Shigella flexneri 2a str. 2457T
aaagagggcauggcgc

SEQ ID NO: 1919626 - RNA, 17 nt, Shigella flexneri 2a str. 2457T
gaagaacugcuggaagc

SEQ ID NO: 1919627 - RNA, 13 nt, Shigella flexneri 2a str. 2457T
gaagaaccacaga

SEQ ID NO: 1919628 - RNA, 17 nt, Shigella flexneri 2a str. 2457T
gaagacuguagcaggau

SEQ ID NO: 1919629 - RNA, 19 nt, Shigella flexneri 2a str. 2457T
gaacuucauaugcgccaga

SEQ ID NO: 1919630 - RNA, 20 nt, Shigella flexneri 2a str. 2457T
gaacuucauaugcgccagac

SEQ ID NO: 1919631 - RNA, 14 nt, Shigella flexneri 2a str. 2457T
gaagaaaccgauga

SEQ ID NO: 1919632 - RNA, 17 nt, Shigella flexneri 2a str. 2457T
cuguagugaucaaacac

SEQ ID NO: 1919633 - RNA, 16 nt, Shigella flexneri 2a str. 2457T
cuguaguacaaauuuu

SEQ ID NO: 1919634 - RNA, 18 nt, Shigella flexneri 2a str. 2457T
cuguaguacaaauuuuag

SEQ ID NO: 1919635 - RNA, 18 nt, Shigella flexneri 2a str. 2457T
cuguaguuguuaauguga

SEQ ID NO: 1919636 - RNA, 18 nt, Shigella flexneri 2a str. 2457T
cuguaggccagauaagac

SEQ ID NO: 1919637 - RNA, 19 nt, Shigella flexneri 2a str. 2457T
cuguaggccagauaagacg

SEQ ID NO: 1919638 - RNA, 14 nt, Shigella flexneri 2a str. 2457T
cuguagccagcucg

SEQ ID NO: 1919639 - RNA, 19 nt, Shigella flexneri 2a str. 2457T
cuguagauaaaacacucuu

SEQ ID NO: 1919640 - RNA, 23 nt, Shigella flexneri 2a str. 2457T
cuguagauaaaacacucuuuuug

SEQ ID NO: 1919641 - RNA, 15 nt, Shigella flexneri 2a str. 2457T
cuguacggcagugaa

SEQ ID NO: 1919642 - RNA, 16 nt, Shigella flexneri 2a str. 2457T
cuguacuuucaacagg

SEQ ID NO: 1919643 - RNA, 17 nt, Shigella flexneri 2a str. 2457T
cuguauaaacuauccug

SEQ ID NO: 1919644 - RNA, 14 nt, Shigella flexneri 2a str. 2457T
cuguaucaggcuga

SEQ ID NO: 1919645 - RNA, 20 nt, Shigella flexneri 2a str. 2457T
cuguaucaugcaguaccaga

SEQ ID NO: 1919646 - RNA, 18 nt, Shigella flexneri 2a str. 2457T
cuguauggccuggaagcu

SEQ ID NO: 1919647 - RNA, 15 nt, Shigella flexneri 2a str. 2457T
cuguauguuccccuc

SEQ ID NO: 1919648 - RNA, 13 nt, Shigella flexneri 2a str. 2457T
cuguaucccagcc

SEQ ID NO: 1919649 - RNA, 16 nt, Shigella flexneri 2a str. 2457T
cuguaucgucacuggu

SEQ ID NO: 1919650 - RNA, 11 nt, Shigella flexneri 2a str. 2457T
cugucaacugc

SEQ ID NO: 1919651 - RNA, 14 nt, Shigella flexneri 2a str. 2457T
cuguauuugucuca

SEQ ID NO: 1919652 - RNA, 17 nt, Shigella flexneri 2a str. 2457T
aaacucucaucuuugaa

SEQ ID NO: 1919653 - RNA, 20 nt, Shigella flexneri 2a str. 2457T
cugucaauaaacgccugcuu

SEQ ID NO: 1919654 - RNA, 22 nt, Shigella flexneri 2a str. 2457T
cugucaauaaacgccugcuuau

SEQ ID NO: 1919655 - RNA, 20 nt, Shigella flexneri 2a str. 2457T
cugucagaacgguucuugaa

SEQ ID NO: 1919656 - RNA, 17 nt, Shigella flexneri 2a str. 2457T
cugucagguaacaagcc

SEQ ID NO: 1919657 - RNA, 15 nt, Shigella flexneri 2a str. 2457T
cugucaguuggcugu

SEQ ID NO: 1919658 - RNA, 20 nt, Shigella flexneri 2a str. 2457T
cugucaguggacgauaagca

SEQ ID NO: 1919659 - RNA, 14 nt, Shigella flexneri 2a str. 2457T
cugucauauuaucu

SEQ ID NO: 1919660 - RNA, 21 nt, Shigella flexneri 2a str. 2457T
cugucauacgcguaaaacagc

SEQ ID NO: 1919661 - RNA, 19 nt, Shigella flexneri 2a str. 2457T
cuguccgcuucaccaccgc

SEQ ID NO: 1919662 - RNA, 16 nt, Shigella flexneri 2a str. 2457T
cuguccggcgcacugg

SEQ ID NO: 1919663 - RNA, 19 nt, Shigella flexneri 2a str. 2457T
cuguccaaauccuucagca

SEQ ID NO: 1919664 - RNA, 22 nt, Shigella flexneri 2a str. 2457T
cuguccaaauccuucagcaacu

SEQ ID NO: 1919665 - RNA, 15 nt, Shigella flexneri 2a str. 2457T
cuguccaccacgcug

SEQ ID NO: 1919666 - RNA, 20 nt, Shigella flexneri 2a str. 2457T
cuguccauaccggacuccag

SEQ ID NO: 1919667 - RNA, 15 nt, Shigella flexneri 2a str. 2457T
cuguccagcacgccg

SEQ ID NO: 1919668 - RNA, 14 nt, Shigella flexneri 2a str. 2457T
cugucguccggcag

SEQ ID NO: 1919669 - RNA, 17 nt, Shigella flexneri 2a str. 2457T
cugucgggugcuuuuuu

SEQ ID NO: 1919670 - RNA, 21 nt, Shigella flexneri 2a str. 2457T
cugucgggugcuuuuuucaau

SEQ ID NO: 1919671 - RNA, 20 nt, Shigella flexneri 2a str. 2457T
cugucgguuuguacucuucc

SEQ ID NO: 1919672 - RNA, 15 nt, Shigella flexneri 2a str. 2457T
cugucguaacugcgc

SEQ ID NO: 1919673 - RNA, 20 nt, Shigella flexneri 2a str. 2457T
cugucguuaaugcgccaagc

SEQ ID NO: 1919674 - RNA, 12 nt, Shigella flexneri 2a str. 2457T
cugucuaccagc

SEQ ID NO: 1919675 - RNA, 16 nt, Shigella flexneri 2a str. 2457T
cugucuaauggugaac

SEQ ID NO: 1919676 - RNA, 14 nt, Shigella flexneri 2a str. 2457T
cugucuaccagcac

SEQ ID NO: 1919677 - RNA, 17 nt, Shigella flexneri 2a str. 2457T
cugucugaugauaauca

SEQ ID NO: 1919678 - RNA, 21 nt, Shigella flexneri 2a str. 2457T
cugucuuaacgcaccaugcac

SEQ ID NO: 1919679 - RNA, 12 nt, Shigella flexneri 2a str. 2457T
cugucugcuucu

SEQ ID NO: 1919680 - RNA, 19 nt, Shigella flexneri 2a str. 2457T
cugucuggcgucuccugcc

SEQ ID NO: 1919681 - RNA, 16 nt, Shigella flexneri 2a str. 2457T
cugucugcuucugccu

SEQ ID NO: 1919682 - RNA, 18 nt, Shigella flexneri 2a str. 2457T
cugucgaacgcuaugacg

SEQ ID NO: 1919683 - RNA, 16 nt, Shigella flexneri 2a str. 2457T
cugucgauaaacucau

SEQ ID NO: 1919684 - RNA, 15 nt, Shigella flexneri 2a str. 2457T
cugucgacuaaccug

SEQ ID NO: 1919685 - RNA, 16 nt, Shigella flexneri 2a str. 2457T
cugucgacuaaccuga

SEQ ID NO: 1919686 - RNA, 20 nt, Shigella flexneri 2a str. 2457T
cugucggcacugaccaccac

SEQ ID NO: 1919687 - RNA, 23 nt, Shigella flexneri 2a str. 2457T
cugucggcaagauacugcauaau

SEQ ID NO: 1919688 - RNA, 17 nt, Shigella flexneri 2a str. 2457T
cugucggacgcugucac

SEQ ID NO: 1919689 - RNA, 19 nt, Shigella flexneri 2a str. 2457T
cugucggguaagcgccaca

SEQ ID NO: 1919690 - RNA, 19 nt, Shigella flexneri 2a str. 2457T
cugucgccgcgacgccccc

SEQ ID NO: 1919691 - RNA, 17 nt, Shigella flexneri 2a str. 2457T
cugugcccguaaaaaau

SEQ ID NO: 1919692 - RNA, 18 nt, Shigella flexneri 2a str. 2457T
cugugccacggcuuugca

SEQ ID NO: 1919693 - RNA, 14 nt, Shigella flexneri 2a str. 2457T
cugugccagugcca

SEQ ID NO: 1919694 - RNA, 19 nt, Shigella flexneri 2a str. 2457T
cugugccagcucgugcaga

SEQ ID NO: 1919695 - RNA, 16 nt, Shigella flexneri 2a str. 2457T
cugugcaaucgccgcu

SEQ ID NO: 1919696 - RNA, 13 nt, Shigella flexneri 2a str. 2457T
cugugacagauuu

SEQ ID NO: 1919697 - RNA, 16 nt, Shigella flexneri 2a str. 2457T
cugugacgacuuuuuc

SEQ ID NO: 1919698 - RNA, 19 nt, Shigella flexneri 2a str. 2457T
cugugauuccgccaguucu

SEQ ID NO: 1919699 - RNA, 15 nt, Shigella flexneri 2a str. 2457T
cuguggauucagcac

SEQ ID NO: 1919700 - RNA, 16 nt, Shigella flexneri 2a str. 2457T
cuguggauguuuuacu

SEQ ID NO: 1919701 - RNA, 17 nt, Shigella flexneri 2a str. 2457T
cugugggguauuuccag

SEQ ID NO: 1919702 - RNA, 11 nt, Shigella flexneri 2a str. 2457T
cugugcugccg

SEQ ID NO: 1919703 - RNA, 14 nt, Shigella flexneri 2a str. 2457T
cugugccggaaggg

SEQ ID NO: 1919704 - RNA, 22 nt, Shigella flexneri 2a str. 2457T
cugugccguaaaucccagugcc

SEQ ID NO: 1919705 - RNA, 19 nt, Shigella flexneri 2a str. 2457T
cugugccugagccggaguu

SEQ ID NO: 1919706 - RNA, 20 nt, Shigella flexneri 2a str. 2457T
cuggucauaggccgcugaug

SEQ ID NO: 1919707 - RNA, 13 nt, Shigella flexneri 2a str. 2457T
cuggucgagaucg

SEQ ID NO: 1919708 - RNA, 20 nt, Shigella flexneri 2a str. 2457T
cugguagacguucaguuccg

SEQ ID NO: 1919709 - RNA, 17 nt, Shigella flexneri 2a str. 2457T
cugguacuggugcaaaa

SEQ ID NO: 1919710 - RNA, 16 nt, Shigella flexneri 2a str. 2457T
cugguaaucaccaccc

SEQ ID NO: 1919711 - RNA, 14 nt, Shigella flexneri 2a str. 2457T
cugguaccagcacc

SEQ ID NO: 1919712 - RNA, 18 nt, Shigella flexneri 2a str. 2457T
cugguauuuccaguccag

SEQ ID NO: 1919713 - RNA, 21 nt, Shigella flexneri 2a str. 2457T
cugguaguuguacaacugcuu

SEQ ID NO: 1919714 - RNA, 14 nt, Shigella flexneri 2a str. 2457T
cugguaguccagga

SEQ ID NO: 1919715 - RNA, 15 nt, Shigella flexneri 2a str. 2457T
cugggcgaugcuggc

SEQ ID NO: 1919716 - RNA, 19 nt, Shigella flexneri 2a str. 2457T
cugggcgaugcuggcagaa

SEQ ID NO: 1919717 - RNA, 18 nt, Shigella flexneri 2a str. 2457T
cuggggcuugccagagca

SEQ ID NO: 1919718 - RNA, 19 nt, Shigella flexneri 2a str. 2457T
cuggggcuugccagagcag

SEQ ID NO: 1919719 - RNA, 22 nt, Shigella flexneri 2a str. 2457T
cuggggauagaaacagucugga

SEQ ID NO: 1919720 - RNA, 19 nt, Shigella flexneri 2a str. 2457T
cugggcuaacacccgucgu

SEQ ID NO: 1919721 - RNA, 23 nt, Shigella flexneri 2a str. 2457T
cugggcuucauccagcagugacu

SEQ ID NO: 1919722 - RNA, 21 nt, Shigella flexneri 2a str. 2457T
cugggugguugucgcacugcu

SEQ ID NO: 1919723 - RNA, 14 nt, Shigella flexneri 2a str. 2457T
cuggguuuucacag

SEQ ID NO: 1919724 - RNA, 15 nt, Shigella flexneri 2a str. 2457T
cuggguaguccauga

SEQ ID NO: 1919725 - RNA, 19 nt, Shigella flexneri 2a str. 2457T
cuggguagaguuugaacuc

SEQ ID NO: 1919726 - RNA, 12 nt, Shigella flexneri 2a str. 2457T
cuggguaacacc

SEQ ID NO: 1919727 - RNA, 20 nt, Shigella flexneri 2a str. 2457T
cuggguaaaaauagggugcg

SEQ ID NO: 1919728 - RNA, 18 nt, Shigella flexneri 2a str. 2457T
cuguacagauccgccauu

SEQ ID NO: 1919729 - RNA, 14 nt, Shigella flexneri 2a str. 2457T
cuguaccacaaccu

SEQ ID NO: 1919730 - RNA, 19 nt, Shigella flexneri 2a str. 2457T
cuguaauuucacaccauca

SEQ ID NO: 1919731 - RNA, 19 nt, Shigella flexneri 2a str. 2457T
cuguaauuaccagcgccgg

SEQ ID NO: 1919732 - RNA, 17 nt, Shigella flexneri 2a str. 2457T
cuguacgacaaaagaau

SEQ ID NO: 1919733 - RNA, 12 nt, Shigella flexneri 2a str. 2457T
cuguaccugguu

SEQ ID NO: 1919734 - RNA, 23 nt, Shigella flexneri 2a str. 2457T
cuguaccuucacgcgcuccagga

SEQ ID NO: 1919735 - RNA, 19 nt, Shigella flexneri 2a str. 2457T
cuguaccuucagcggcagc

SEQ ID NO: 1919736 - RNA, 15 nt, Shigella flexneri 2a str. 2457T
cuguaccacaaccug

SEQ ID NO: 1919737 - RNA, 22 nt, Shigella flexneri 2a str. 2457T
cuguaccaccagaaucgccagc

SEQ ID NO: 1919738 - RNA, 14 nt, Shigella flexneri 2a str. 2457T
cuguaccaccagaa

SEQ ID NO: 1919739 - RNA, 12 nt, Shigella flexneri 2a str. 2457T
cuguaccaccag

SEQ ID NO: 1919740 - RNA, 22 nt, Shigella flexneri 2a str. 2457T
cuguaaaacgcgcccucagccc

SEQ ID NO: 1919741 - RNA, 22 nt, Shigella flexneri 2a str. 2457T
cuguaaauucucaauaucauca

SEQ ID NO: 1919742 - RNA, 22 nt, Shigella flexneri 2a str. 2457T
cuguaaagagugugaauauuca

SEQ ID NO: 1919743 - RNA, 21 nt, Shigella flexneri 2a str. 2457T
cuguaacguugcugcgccgag

SEQ ID NO: 1919744 - RNA, 23 nt, Shigella flexneri 2a str. 2457T
cuguaaauugaugugaaaacucu

SEQ ID NO: 1919745 - RNA, 17 nt, Shigella flexneri 2a str. 2457T
cuguaaccagcgcagac

SEQ ID NO: 1919746 - RNA, 16 nt, Shigella flexneri 2a str. 2457T
cuguaacgccuuuucc

SEQ ID NO: 1919747 - RNA, 21 nt, Shigella flexneri 2a str. 2457T
cuguaacggagguacaaccgc

SEQ ID NO: 1919748 - RNA, 17 nt, Shigella flexneri 2a str. 2457T
cugguucccaacaacag

SEQ ID NO: 1919749 - RNA, 23 nt, Shigella flexneri 2a str. 2457T
cugguucugcggguuagucugca

SEQ ID NO: 1919750 - RNA, 15 nt, Shigella flexneri 2a str. 2457T
cugguuauauuuccc

SEQ ID NO: 1919751 - RNA, 21 nt, Shigella flexneri 2a str. 2457T
cugguuaucuuccaccaccac

SEQ ID NO: 1919752 - RNA, 15 nt, Shigella flexneri 2a str. 2457T
cugguuuugaacagc

SEQ ID NO: 1919753 - RNA, 15 nt, Shigella flexneri 2a str. 2457T
cugguuuuucgauuu

SEQ ID NO: 1919754 - RNA, 21 nt, Shigella flexneri 2a str. 2457T
cugguuuuucgauuuaaauga

SEQ ID NO: 1919755 - RNA, 23 nt, Shigella flexneri 2a str. 2457T
cuggugcuaacagcaaucccaaa

SEQ ID NO: 1919756 - RNA, 17 nt, Shigella flexneri 2a str. 2457T
cuggugcuaacagcaau

SEQ ID NO: 1919757 - RNA, 21 nt, Shigella flexneri 2a str. 2457T
cuggugccaagcuccagcauc

SEQ ID NO: 1919758 - RNA, 20 nt, Shigella flexneri 2a str. 2457T
cuggugauugccggaauggu

SEQ ID NO: 1919759 - RNA, 16 nt, Shigella flexneri 2a str. 2457T
cuggugauugucuuuu

SEQ ID NO: 1919760 - RNA, 22 nt, Shigella flexneri 2a str. 2457T
cugguguaagucggucacaguc

SEQ ID NO: 1919761 - RNA, 21 nt, Shigella flexneri 2a str. 2457T
cuggugggugcuuuaaaaaag

SEQ ID NO: 1919762 - RNA, 19 nt, Shigella flexneri 2a str. 2457T
cuucgcaaaaaaccauccc

SEQ ID NO: 1919763 - RNA, 12 nt, Shigella flexneri 2a str. 2457T
cuucgcaaaaaa

SEQ ID NO: 1919764 - RNA, 14 nt, Shigella flexneri 2a str. 2457T
cuucgauuuaaccc

SEQ ID NO: 1919765 - RNA, 17 nt, Shigella flexneri 2a str. 2457T
cuucgcacacacugcuu

SEQ ID NO: 1919766 - RNA, 14 nt, Shigella flexneri 2a str. 2457T
cuucgccaaaucgc

SEQ ID NO: 1919767 - RNA, 14 nt, Shigella flexneri 2a str. 2457T
cuucgccaaugacc

SEQ ID NO: 1919768 - RNA, 22 nt, Shigella flexneri 2a str. 2457T
cuucgcccuucgggucguugcc

SEQ ID NO: 1919769 - RNA, 21 nt, Shigella flexneri 2a str. 2457T
cuuccgcaauacagccagcca

SEQ ID NO: 1919770 - RNA, 18 nt, Shigella flexneri 2a str. 2457T
cuuccgcgccaaacauuu

SEQ ID NO: 1919771 - RNA, 22 nt, Shigella flexneri 2a str. 2457T
cuuccuccagcgguuuaucaau

SEQ ID NO: 1919772 - RNA, 18 nt, Shigella flexneri 2a str. 2457T
cuuccuugcuaagcccuc

SEQ ID NO: 1919773 - RNA, 15 nt, Shigella flexneri 2a str. 2457T
cuuccucgucccaaa

SEQ ID NO: 1919774 - RNA, 12 nt, Shigella flexneri 2a str. 2457T
cuuccugcaacg

SEQ ID NO: 1919775 - RNA, 20 nt, Shigella flexneri 2a str. 2457T
cuuccugcaacgagugcauc

SEQ ID NO: 1919776 - RNA, 12 nt, Shigella flexneri 2a str. 2457T
cuuccugaguga

SEQ ID NO: 1919777 - RNA, 21 nt, Shigella flexneri 2a str. 2457T
cuuccugagugaauauuuaac

SEQ ID NO: 1919778 - RNA, 22 nt, Shigella flexneri 2a str. 2457T
cuuccugauaaccuuccagcuu

SEQ ID NO: 1919779 - RNA, 17 nt, Shigella flexneri 2a str. 2457T
cuuccccgcuucagccc

SEQ ID NO: 1919780 - RNA, 22 nt, Shigella flexneri 2a str. 2457T
cuucccaaagaucuccucacca

SEQ ID NO: 1919781 - RNA, 22 nt, Shigella flexneri 2a str. 2457T
cuucccaauugcacauauuuuu

SEQ ID NO: 1919782 - RNA, 13 nt, Shigella flexneri 2a str. 2457T
cuucccagcgcag

SEQ ID NO: 1919783 - RNA, 18 nt, Shigella flexneri 2a str. 2457T
cuuccagcgcaucugccg

SEQ ID NO: 1919784 - RNA, 19 nt, Shigella flexneri 2a str. 2457T
cuuccauguguuuaucuau

SEQ ID NO: 1919785 - RNA, 20 nt, Shigella flexneri 2a str. 2457T
cuuccauugccgcuuuccag

SEQ ID NO: 1919786 - RNA, 22 nt, Shigella flexneri 2a str. 2457T
cuuccauugagaaagcccuggc

SEQ ID NO: 1919787 - RNA, 14 nt, Shigella flexneri 2a str. 2457T
cuuccauugccgcu

SEQ ID NO: 1919788 - RNA, 17 nt, Shigella flexneri 2a str. 2457T
cuuccauugagaaagcc

SEQ ID NO: 1919789 - RNA, 20 nt, Shigella flexneri 2a str. 2457T
cuuccauugagaaagcccug

SEQ ID NO: 1919790 - RNA, 15 nt, Shigella flexneri 2a str. 2457T
cuuccagcaaaucca

SEQ ID NO: 1919791 - RNA, 15 nt, Shigella flexneri 2a str. 2457T
cuuccagauucaguu

SEQ ID NO: 1919792 - RNA, 22 nt, Shigella flexneri 2a str. 2457T
cuuccagcagaccagcaauaac

SEQ ID NO: 1919793 - RNA, 18 nt, Shigella flexneri 2a str. 2457T
cuuccagcaguucgcccg

SEQ ID NO: 1919794 - RNA, 18 nt, Shigella flexneri 2a str. 2457T
cuuccacaccacuuccga

SEQ ID NO: 1919795 - RNA, 20 nt, Shigella flexneri 2a str. 2457T
cuucaccuucuuuacugccc

SEQ ID NO: 1919796 - RNA, 18 nt, Shigella flexneri 2a str. 2457T
cuucaccuuucagaacgg

SEQ ID NO: 1919797 - RNA, 17 nt, Shigella flexneri 2a str. 2457T
cuucacgcccgccccag

SEQ ID NO: 1919798 - RNA, 14 nt, Shigella flexneri 2a str. 2457T
cuucacgcgcucca

SEQ ID NO: 1919799 - RNA, 18 nt, Shigella flexneri 2a str. 2457T
cuucacgcgcuccaggag

SEQ ID NO: 1919800 - RNA, 18 nt, Shigella flexneri 2a str. 2457T
cuucacgcggguugccac

SEQ ID NO: 1919801 - RNA, 17 nt, Shigella flexneri 2a str. 2457T
cuucacugacauugccu

SEQ ID NO: 1919802 - RNA, 18 nt, Shigella flexneri 2a str. 2457T
cuucacagaaggccagga

SEQ ID NO: 1919803 - RNA, 12 nt, Shigella flexneri 2a str. 2457T
cuucacaggccg

SEQ ID NO: 1919804 - RNA, 12 nt, Shigella flexneri 2a str. 2457T
cuucacacugau

SEQ ID NO: 1919805 - RNA, 22 nt, Shigella flexneri 2a str. 2457T
cuucacacacuuuuauuaacuc

SEQ ID NO: 1919806 - RNA, 16 nt, Shigella flexneri 2a str. 2457T
cuucacaaaggcuugc

SEQ ID NO: 1919807 - RNA, 16 nt, Shigella flexneri 2a str. 2457T
cuucacaaucagcgcg

SEQ ID NO: 1919808 - RNA, 19 nt, Shigella flexneri 2a str. 2457T
cuuauucuucaacaauuga

SEQ ID NO: 1919809 - RNA, 17 nt, Shigella flexneri 2a str. 2457T
cuucaaacguuuugcaa

SEQ ID NO: 1919810 - RNA, 19 nt, Shigella flexneri 2a str. 2457T
cuucaaacguuuugcaauu

SEQ ID NO: 1919811 - RNA, 13 nt, Shigella flexneri 2a str. 2457T
cuucaaacgcuga

SEQ ID NO: 1919812 - RNA, 21 nt, Shigella flexneri 2a str. 2457T
cuucaaaucgacgcgugaaaa

SEQ ID NO: 1919813 - RNA, 21 nt, Shigella flexneri 2a str. 2457T
cuucaacacggcgcauugcca

SEQ ID NO: 1919814 - RNA, 20 nt, Shigella flexneri 2a str. 2457T
cuucaaguguggccgccagu

SEQ ID NO: 1919815 - RNA, 18 nt, Shigella flexneri 2a str. 2457T
cuucauccggauacagcc

SEQ ID NO: 1919816 - RNA, 17 nt, Shigella flexneri 2a str. 2457T
cuucaucgauacugcuc

SEQ ID NO: 1919817 - RNA, 14 nt, Shigella flexneri 2a str. 2457T
cuucaucccugaaa

SEQ ID NO: 1919818 - RNA, 24 nt, Shigella flexneri 2a str. 2457T
cuucauauuccugacccagcacca

SEQ ID NO: 1919819 - RNA, 18 nt, Shigella flexneri 2a str. 2457T
cuucaucgugcucgcuuu

SEQ ID NO: 1919820 - RNA, 17 nt, Shigella flexneri 2a str. 2457T
cuucaucgugcucgcuu

SEQ ID NO: 1919821 - RNA, 18 nt, Shigella flexneri 2a str. 2457T
cuucaugcgcagcauaau

SEQ ID NO: 1919822 - RNA, 20 nt, Shigella flexneri 2a str. 2457T
cuucaugcagcauggucagg

SEQ ID NO: 1919823 - RNA, 16 nt, Shigella flexneri 2a str. 2457T
cuucauuaaccacgau

SEQ ID NO: 1919824 - RNA, 13 nt, Shigella flexneri 2a str. 2457T
cuucauuaccuuc

SEQ ID NO: 1919825 - RNA, 22 nt, Shigella flexneri 2a str. 2457T
cuucagcgcuaccgccgaucuc

SEQ ID NO: 1919826 - RNA, 16 nt, Shigella flexneri 2a str. 2457T
cuucagcguaucccag

SEQ ID NO: 1919827 - RNA, 19 nt, Shigella flexneri 2a str. 2457T
cuucagcguccauccacag

SEQ ID NO: 1919828 - RNA, 15 nt, Shigella flexneri 2a str. 2457T
cuucauagguaaaca

SEQ ID NO: 1919829 - RNA, 15 nt, Shigella flexneri 2a str. 2457T
cuucauacaccacua

SEQ ID NO: 1919830 - RNA, 23 nt, Shigella flexneri 2a str. 2457T
cuucagaauauucgaaaucuguu

SEQ ID NO: 1919831 - RNA, 16 nt, Shigella flexneri 2a str. 2457T
cuucacuucuucuuca

SEQ ID NO: 1919832 - RNA, 16 nt, Shigella flexneri 2a str. 2457T
cuucagccccuccaca

SEQ ID NO: 1919833 - RNA, 23 nt, Shigella flexneri 2a str. 2457T
cuucagccaguuuuucagcgcca

SEQ ID NO: 1919834 - RNA, 19 nt, Shigella flexneri 2a str. 2457T
cuuaauugcccgaagccaa

SEQ ID NO: 1919835 - RNA, 14 nt, Shigella flexneri 2a str. 2457T
cuuaauaaaaauuu

SEQ ID NO: 1919836 - RNA, 18 nt, Shigella flexneri 2a str. 2457T
cuuaagaaauuauucaug

SEQ ID NO: 1919837 - RNA, 20 nt, Shigella flexneri 2a str. 2457T
cuuaacuucgcagcuuauuu

SEQ ID NO: 1919838 - RNA, 21 nt, Shigella flexneri 2a str. 2457T
cuuaacuugcuuaaaaaauca

SEQ ID NO: 1919839 - RNA, 22 nt, Shigella flexneri 2a str. 2457T
cuuaacuugcuuaaaaaaucac

SEQ ID NO: 1919840 - RNA, 13 nt, Shigella flexneri 2a str. 2457T
cuuacuucaacac

SEQ ID NO: 1919841 - RNA, 16 nt, Shigella flexneri 2a str. 2457T
cuuacgccugccagcu

SEQ ID NO: 1919842 - RNA, 13 nt, Shigella flexneri 2a str. 2457T
cuuacggauaauu

SEQ ID NO: 1919843 - RNA, 18 nt, Shigella flexneri 2a str. 2457T
cuuacgcguucauacuuu

SEQ ID NO: 1919844 - RNA, 17 nt, Shigella flexneri 2a str. 2457T
cuuacgccgacuaauuu

SEQ ID NO: 1919845 - RNA, 24 nt, Shigella flexneri 2a str. 2457T
cuuacagaaaugguaaagaaggca

SEQ ID NO: 1919846 - RNA, 11 nt, Shigella flexneri 2a str. 2457T
cuuaucuggca

SEQ ID NO: 1919847 - RNA, 17 nt, Shigella flexneri 2a str. 2457T
cuuauccagccuacaaa

SEQ ID NO: 1919848 - RNA, 23 nt, Shigella flexneri 2a str. 2457T
cuuauccagccuacaaaaacuca

SEQ ID NO: 1919849 - RNA, 19 nt, Shigella flexneri 2a str. 2457T
cuuaucaggccuacaaguc

SEQ ID NO: 1919850 - RNA, 22 nt, Shigella flexneri 2a str. 2457T
cuuaucaggccuacaguuuuac

SEQ ID NO: 1919851 - RNA, 17 nt, Shigella flexneri 2a str. 2457T
cuuaucaggccuacaaa

SEQ ID NO: 1919852 - RNA, 18 nt, Shigella flexneri 2a str. 2457T
cuuaucaggccuacaaaa

SEQ ID NO: 1919853 - RNA, 18 nt, Shigella flexneri 2a str. 2457T
cuuaucaggccuacaagu

SEQ ID NO: 1919854 - RNA, 13 nt, Shigella flexneri 2a str. 2457T
cuuaucaggccua

SEQ ID NO: 1919855 - RNA, 22 nt, Shigella flexneri 2a str. 2457T
cuuaucaggccaauugaacucu

SEQ ID NO: 1919856 - RNA, 17 nt, Shigella flexneri 2a str. 2457T
cuuauaaagaaaaucug

SEQ ID NO: 1919857 - RNA, 18 nt, Shigella flexneri 2a str. 2457T
cuuauaaagaaaaucuga

SEQ ID NO: 1919858 - RNA, 13 nt, Shigella flexneri 2a str. 2457T
cuuauaagucuca

SEQ ID NO: 1919859 - RNA, 16 nt, Shigella flexneri 2a str. 2457T
cuuagacagcgccgcu

SEQ ID NO: 1919860 - RNA, 18 nt, Shigella flexneri 2a str. 2457T
cuuacuuuuaaugcuuua

SEQ ID NO: 1919861 - RNA, 17 nt, Shigella flexneri 2a str. 2457T
cuuaaacaguacgagag

SEQ ID NO: 1919862 - RNA, 20 nt, Shigella flexneri 2a str. 2457T
cuuaacggcgaaaaauauuu

SEQ ID NO: 1919863 - RNA, 18 nt, Shigella flexneri 2a str. 2457T
aaacuggugguaagaaua

SEQ ID NO: 1919864 - RNA, 23 nt, Shigella flexneri 2a str. 2457T
aaacugguagcuguagguaaaac

SEQ ID NO: 1919865 - RNA, 22 nt, Shigella flexneri 2a str. 2457T
cuguuugccucguucuucccuc

SEQ ID NO: 1919866 - RNA, 15 nt, Shigella flexneri 2a str. 2457T
cuguugguucagugg

SEQ ID NO: 1919867 - RNA, 16 nt, Shigella flexneri 2a str. 2457T
cuguuuucagcaccag

SEQ ID NO: 1919868 - RNA, 22 nt, Shigella flexneri 2a str. 2457T
cuguuugucgaucaucaggccc

SEQ ID NO: 1919869 - RNA, 19 nt, Shigella flexneri 2a str. 2457T
cuguuuuaccugcgccggu

SEQ ID NO: 1919870 - RNA, 21 nt, Shigella flexneri 2a str. 2457T
cuguugcaagacgaugacauu

SEQ ID NO: 1919871 - RNA, 15 nt, Shigella flexneri 2a str. 2457T
cuguugcugaagaaa

SEQ ID NO: 1919872 - RNA, 16 nt, Shigella flexneri 2a str. 2457T
cuguggugucuuucuc

SEQ ID NO: 1919873 - RNA, 21 nt, Shigella flexneri 2a str. 2457T
cuguguaaugaauggaguugu

SEQ ID NO: 1919874 - RNA, 20 nt, Shigella flexneri 2a str. 2457T
cuguguaaacccagccgcgu

SEQ ID NO: 1919875 - RNA, 13 nt, Shigella flexneri 2a str. 2457T
cuguuaaccggag

SEQ ID NO: 1919876 - RNA, 21 nt, Shigella flexneri 2a str. 2457T
cuguuaagaagggcuggccaa

SEQ ID NO: 1919877 - RNA, 17 nt, Shigella flexneri 2a str. 2457T
cuguuaaggaaauccug

SEQ ID NO: 1919878 - RNA, 20 nt, Shigella flexneri 2a str. 2457T
cuguucugccguccagccgg

SEQ ID NO: 1919879 - RNA, 21 nt, Shigella flexneri 2a str. 2457T
cuguucuuuuaacgcaugcac

SEQ ID NO: 1919880 - RNA, 19 nt, Shigella flexneri 2a str. 2457T
cuguucaguacgaaauaac

SEQ ID NO: 1919881 - RNA, 15 nt, Shigella flexneri 2a str. 2457T
cuguucauuaaagcc

SEQ ID NO: 1919882 - RNA, 16 nt, Shigella flexneri 2a str. 2457T
cuguuccagcaaaucc

SEQ ID NO: 1919883 - RNA, 19 nt, Shigella flexneri 2a str. 2457T
cuggcgcauuaacggcaag

SEQ ID NO: 1919884 - RNA, 15 nt, Shigella flexneri 2a str. 2457T
cuggcgcagugggcg

SEQ ID NO: 1919885 - RNA, 22 nt, Shigella flexneri 2a str. 2457T
cuggcgcgaacagcacaucagc

SEQ ID NO: 1919886 - RNA, 21 nt, Shigella flexneri 2a str. 2457T
cuggcgcgaauagcuucuuca

SEQ ID NO: 1919887 - RNA, 16 nt, Shigella flexneri 2a str. 2457T
cuggcgcgaacagcac

SEQ ID NO: 1919888 - RNA, 11 nt, Shigella flexneri 2a str. 2457T
cuggcgcgcuc

SEQ ID NO: 1919889 - RNA, 12 nt, Shigella flexneri 2a str. 2457T
cuggcgcagcaa

SEQ ID NO: 1919890 - RNA, 13 nt, Shigella flexneri 2a str. 2457T
aaacucacgcagg

SEQ ID NO: 1919891 - RNA, 14 nt, Shigella flexneri 2a str. 2457T
cuggcggcaauaac

SEQ ID NO: 1919892 - RNA, 15 nt, Shigella flexneri 2a str. 2457T
cuggcggaugugcug

SEQ ID NO: 1919893 - RNA, 12 nt, Shigella flexneri 2a str. 2457T
cuggcggcagca

SEQ ID NO: 1919894 - RNA, 21 nt, Shigella flexneri 2a str. 2457T
cuggcggagcucccaggcucc

SEQ ID NO: 1919895 - RNA, 21 nt, Shigella flexneri 2a str. 2457T
cuggcagagaaagaaacgcca

SEQ ID NO: 1919896 - RNA, 19 nt, Shigella flexneri 2a str. 2457T
cuggcagauaaauuacugc

SEQ ID NO: 1919897 - RNA, 17 nt, Shigella flexneri 2a str. 2457T
cuggcagcaagugcggc

SEQ ID NO: 1919898 - RNA, 20 nt, Shigella flexneri 2a str. 2457T
cuggcaucagcaaacaugcc

SEQ ID NO: 1919899 - RNA, 16 nt, Shigella flexneri 2a str. 2457T
cuggccguacccagcu

SEQ ID NO: 1919900 - RNA, 21 nt, Shigella flexneri 2a str. 2457T
cuggccuauuaugacuccagc

SEQ ID NO: 1919901 - RNA, 15 nt, Shigella flexneri 2a str. 2457T
cuggccgugcagacc

SEQ ID NO: 1919902 - RNA, 18 nt, Shigella flexneri 2a str. 2457T
cuggccucucuggccgcu

SEQ ID NO: 1919903 - RNA, 17 nt, Shigella flexneri 2a str. 2457T
cuggcgaaccaggaaga

SEQ ID NO: 1919904 - RNA, 17 nt, Shigella flexneri 2a str. 2457T
cuggcgaacgugcagga

SEQ ID NO: 1919905 - RNA, 17 nt, Shigella flexneri 2a str. 2457T
cuggcgaaucaggaccg

SEQ ID NO: 1919906 - RNA, 18 nt, Shigella flexneri 2a str. 2457T
cugggccgccauccggca

SEQ ID NO: 1919907 - RNA, 19 nt, Shigella flexneri 2a str. 2457T
cugggccgccauccggcaa

SEQ ID NO: 1919908 - RNA, 18 nt, Shigella flexneri 2a str. 2457T
cugggcauugaaggcagc

SEQ ID NO: 1919909 - RNA, 16 nt, Shigella flexneri 2a str. 2457T
cuggcuucccggcaau

SEQ ID NO: 1919910 - RNA, 20 nt, Shigella flexneri 2a str. 2457T
cuggcuguuucgcuucuuca

SEQ ID NO: 1919911 - RNA, 19 nt, Shigella flexneri 2a str. 2457T
cuggcugucgaucuccggc

SEQ ID NO: 1919912 - RNA, 19 nt, Shigella flexneri 2a str. 2457T
cuggcuggcgguuuuucuu

SEQ ID NO: 1919913 - RNA, 22 nt, Shigella flexneri 2a str. 2457T
cugggaaaucaccaccagcacc

SEQ ID NO: 1919914 - RNA, 19 nt, Shigella flexneri 2a str. 2457T
cugggaagaauggaaaaaa

SEQ ID NO: 1919915 - RNA, 16 nt, Shigella flexneri 2a str. 2457T
cugggacgcagacugg

SEQ ID NO: 1919916 - RNA, 22 nt, Shigella flexneri 2a str. 2457T
cuggcguguuucauuagcccgg

SEQ ID NO: 1919917 - RNA, 14 nt, Shigella flexneri 2a str. 2457T
cuggcguguuucau

SEQ ID NO: 1919918 - RNA, 23 nt, Shigella flexneri 2a str. 2457T
cuggcugacauaaacaccagcaa

SEQ ID NO: 1919919 - RNA, 23 nt, Shigella flexneri 2a str. 2457T
cuggcugagcaaacaguucugca

SEQ ID NO: 1919920 - RNA, 14 nt, Shigella flexneri 2a str. 2457T
cuggcucuuuuucg

SEQ ID NO: 1919921 - RNA, 14 nt, Shigella flexneri 2a str. 2457T
cuggcucugcacua

SEQ ID NO: 1919922 - RNA, 22 nt, Shigella flexneri 2a str. 2457T
aaacuccgccgcaucuucccag

SEQ ID NO: 1919923 - RNA, 21 nt, Shigella flexneri 2a str. 2457T
aaacuccgccgcaucuuccca

SEQ ID NO: 1919924 - RNA, 15 nt, Shigella flexneri 2a str. 2457T
cuggcgucaaagcug

SEQ ID NO: 1919925 - RNA, 21 nt, Shigella flexneri 2a str. 2457T
cuggcgucuggcccaugccag

SEQ ID NO: 1919926 - RNA, 15 nt, Shigella flexneri 2a str. 2457T
cuggcgucugggcgu

SEQ ID NO: 1919927 - RNA, 20 nt, Shigella flexneri 2a str. 2457T
cuggcgggaauaaaagccag

SEQ ID NO: 1919928 - RNA, 18 nt, Shigella flexneri 2a str. 2457T
cuggcgggcagaggcaau

SEQ ID NO: 1919929 - RNA, 15 nt, Shigella flexneri 2a str. 2457T
cuggagcaaaaagcg

SEQ ID NO: 1919930 - RNA, 15 nt, Shigella flexneri 2a str. 2457T
cuggagucgucacca

SEQ ID NO: 1919931 - RNA, 16 nt, Shigella flexneri 2a str. 2457T
cuggaguggugaaaca

SEQ ID NO: 1919932 - RNA, 16 nt, Shigella flexneri 2a str. 2457T
cuggaauggaaacagc

SEQ ID NO: 1919933 - RNA, 23 nt, Shigella flexneri 2a str. 2457T
cuggaauggaaacagcaccaucc

SEQ ID NO: 1919934 - RNA, 21 nt, Shigella flexneri 2a str. 2457T
cuggaagaguuuguugagaug

SEQ ID NO: 1919935 - RNA, 17 nt, Shigella flexneri 2a str. 2457T
cuggaagccagucacau

SEQ ID NO: 1919936 - RNA, 17 nt, Shigella flexneri 2a str. 2457T
cuggaaggguugaaaua

SEQ ID NO: 1919937 - RNA, 23 nt, Shigella flexneri 2a str. 2457T
cuggaagcuggauuaacgcuggg

SEQ ID NO: 1919938 - RNA, 13 nt, Shigella flexneri 2a str. 2457T
cuggaagcuggca

SEQ ID NO: 1919939 - RNA, 19 nt, Shigella flexneri 2a str. 2457T
cuggaaggacucgaggagc

SEQ ID NO: 1919940 - RNA, 14 nt, Shigella flexneri 2a str. 2457T
cuggaaggugaaau

SEQ ID NO: 1919941 - RNA, 22 nt, Shigella flexneri 2a str. 2457T
cuggaagguaaggauaaaaaag

SEQ ID NO: 1919942 - RNA, 16 nt, Shigella flexneri 2a str. 2457T
cuggauuuauauaaau

SEQ ID NO: 1919943 - RNA, 15 nt, Shigella flexneri 2a str. 2457T
cuggauuucaauaac

SEQ ID NO: 1919944 - RNA, 22 nt, Shigella flexneri 2a str. 2457T
cuggauuucaauaacuccaucu

SEQ ID NO: 1919945 - RNA, 16 nt, Shigella flexneri 2a str. 2457T
cuggauuacaaauaaa

SEQ ID NO: 1919946 - RNA, 15 nt, Shigella flexneri 2a str. 2457T
cuggaugucuggcag

SEQ ID NO: 1919947 - RNA, 16 nt, Shigella flexneri 2a str. 2457T
cuggcacaugcauaaa

SEQ ID NO: 1919948 - RNA, 19 nt, Shigella flexneri 2a str. 2457T
cuggcacaacucggcggcu

SEQ ID NO: 1919949 - RNA, 17 nt, Shigella flexneri 2a str. 2457T
cuggcaaugacgggcuu

SEQ ID NO: 1919950 - RNA, 14 nt, Shigella flexneri 2a str. 2457T
cuggcacaacucgg

SEQ ID NO: 1919951 - RNA, 15 nt, Shigella flexneri 2a str. 2457T
cuggcaauccagcuc

SEQ ID NO: 1919952 - RNA, 13 nt, Shigella flexneri 2a str. 2457T
cuggcaaucgcca

SEQ ID NO: 1919953 - RNA, 17 nt, Shigella flexneri 2a str. 2457T
cuggcaaucgccagcgg

SEQ ID NO: 1919954 - RNA, 13 nt, Shigella flexneri 2a str. 2457T
cuggcaaugaccc

SEQ ID NO: 1919955 - RNA, 13 nt, Shigella flexneri 2a str. 2457T
cuggaugccagcg

SEQ ID NO: 1919956 - RNA, 16 nt, Shigella flexneri 2a str. 2457T
cuggaguuccuggaug

SEQ ID NO: 1919957 - RNA, 17 nt, Shigella flexneri 2a str. 2457T
cuggaguuccuggauga

SEQ ID NO: 1919958 - RNA, 16 nt, Shigella flexneri 2a str. 2457T
cuggauagagcucauu

SEQ ID NO: 1919959 - RNA, 15 nt, Shigella flexneri 2a str. 2457T
cuggauaaugaaguc

SEQ ID NO: 1919960 - RNA, 18 nt, Shigella flexneri 2a str. 2457T
cuggaacuggcugccagc

SEQ ID NO: 1919961 - RNA, 15 nt, Shigella flexneri 2a str. 2457T
cuggaacugguggau

SEQ ID NO: 1919962 - RNA, 17 nt, Shigella flexneri 2a str. 2457T
cuggaaccacagcgccg

SEQ ID NO: 1919963 - RNA, 20 nt, Shigella flexneri 2a str. 2457T
cuggaagagcgacaaucccu

SEQ ID NO: 1919964 - RNA, 18 nt, Shigella flexneri 2a str. 2457T
cugcuugaacgcaccgcc

SEQ ID NO: 1919965 - RNA, 15 nt, Shigella flexneri 2a str. 2457T
cugcuucggucagca

SEQ ID NO: 1919966 - RNA, 18 nt, Shigella flexneri 2a str. 2457T
cugcugauuaacccgacc

SEQ ID NO: 1919967 - RNA, 23 nt, Shigella flexneri 2a str. 2457T
cugcugaugcgccgcuaacgucu

SEQ ID NO: 1919968 - RNA, 18 nt, Shigella flexneri 2a str. 2457T
cugcugauccagcuucca

SEQ ID NO: 1919969 - RNA, 16 nt, Shigella flexneri 2a str. 2457T
cugcugauccagcuuc

SEQ ID NO: 1919970 - RNA, 18 nt, Shigella flexneri 2a str. 2457T
cugcugguuagcggccug

SEQ ID NO: 1919971 - RNA, 18 nt, Shigella flexneri 2a str. 2457T
cugcuguacuuuuuccuu

SEQ ID NO: 1919972 - RNA, 20 nt, Shigella flexneri 2a str. 2457T
cugcugugccguaaauccca

SEQ ID NO: 1919973 - RNA, 13 nt, Shigella flexneri 2a str. 2457T
cugcucuucagua

SEQ ID NO: 1919974 - RNA, 16 nt, Shigella flexneri 2a str. 2457T
cugcucgcuggaagug

SEQ ID NO: 1919975 - RNA, 13 nt, Shigella flexneri 2a str. 2457T
aaacuauccugug

SEQ ID NO: 1919976 - RNA, 23 nt, Shigella flexneri 2a str. 2457T
aaacuaucccagccuauaacgaa

SEQ ID NO: 1919977 - RNA, 20 nt, Shigella flexneri 2a str. 2457T
aaacuaucaggcaaaaaaau

SEQ ID NO: 1919978 - RNA, 19 nt, Shigella flexneri 2a str. 2457T
cugcugacgcagauccuga

SEQ ID NO: 1919979 - RNA, 19 nt, Shigella flexneri 2a str. 2457T
cugcugacggcacuaccau

SEQ ID NO: 1919980 - RNA, 23 nt, Shigella flexneri 2a str. 2457T
cugcugacgcagauccugauuua

SEQ ID NO: 1919981 - RNA, 14 nt, Shigella flexneri 2a str. 2457T
cugcugaacgugau

SEQ ID NO: 1919982 - RNA, 15 nt, Shigella flexneri 2a str. 2457T
cugcugaacgugauu

SEQ ID NO: 1919983 - RNA, 20 nt, Shigella flexneri 2a str. 2457T
cugcugacuuugauccagcc

SEQ ID NO: 1919984 - RNA, 17 nt, Shigella flexneri 2a str. 2457T
cugcgugacuaaaaccc

SEQ ID NO: 1919985 - RNA, 22 nt, Shigella flexneri 2a str. 2457T
cugcuagggcgcguccggcguc

SEQ ID NO: 1919986 - RNA, 14 nt, Shigella flexneri 2a str. 2457T
cugcucaucuggcg

SEQ ID NO: 1919987 - RNA, 21 nt, Shigella flexneri 2a str. 2457T
cugcucauugguccaucuuuu

SEQ ID NO: 1919988 - RNA, 13 nt, Shigella flexneri 2a str. 2457T
cugcucgcaggcu

SEQ ID NO: 1919989 - RNA, 15 nt, Shigella flexneri 2a str. 2457T
cugcuccagugcauc

SEQ ID NO: 1919990 - RNA, 16 nt, Shigella flexneri 2a str. 2457T
cugcuccagaaaauaa

SEQ ID NO: 1919991 - RNA, 22 nt, Shigella flexneri 2a str. 2457T
cugcgguacggauagccgcccc

SEQ ID NO: 1919992 - RNA, 14 nt, Shigella flexneri 2a str. 2457T
cugcggguuggcuu

SEQ ID NO: 1919993 - RNA, 17 nt, Shigella flexneri 2a str. 2457T
cugcggguuagucugca

SEQ ID NO: 1919994 - RNA, 14 nt, Shigella flexneri 2a str. 2457T
cugcggguuagucu

SEQ ID NO: 1919995 - RNA, 20 nt, Shigella flexneri 2a str. 2457T
cugcgacagggaucucuucc

SEQ ID NO: 1919996 - RNA, 21 nt, Shigella flexneri 2a str. 2457T
cugcgaccggcguaacggcca

SEQ ID NO: 1919997 - RNA, 18 nt, Shigella flexneri 2a str. 2457T
cugcgaaucgcuucauuu

SEQ ID NO: 1919998 - RNA, 15 nt, Shigella flexneri 2a str. 2457T
cugcgacauauuccc

SEQ ID NO: 1919999 - RNA, 17 nt, Shigella flexneri 2a str. 2457T
cugcggacaaaacguga

SEQ ID NO: 1920000 - RNA, 13 nt, Shigella flexneri 2a str. 2457T
cugcgaguccugu

SEQ ID NO: 1920001 - RNA, 14 nt, Shigella flexneri 2a str. 2457T
cugccacuucugcu

SEQ ID NO: 1920002 - RNA, 21 nt, Shigella flexneri 2a str. 2457T
cugccagaaaucggccuucca

SEQ ID NO: 1920003 - RNA, 13 nt, Shigella flexneri 2a str. 2457T
cugccacgccacg

SEQ ID NO: 1920004 - RNA, 15 nt, Shigella flexneri 2a str. 2457T
cugcaucaccaucuu

SEQ ID NO: 1920005 - RNA, 19 nt, Shigella flexneri 2a str. 2457T
cugcaucagcgccuuacca

SEQ ID NO: 1920006 - RNA, 13 nt, Shigella flexneri 2a str. 2457T
cugcaucaccauc

SEQ ID NO: 1920007 - RNA, 12 nt, Shigella flexneri 2a str. 2457T
cugccagcucuc

SEQ ID NO: 1920008 - RNA, 13 nt, Shigella flexneri 2a str. 2457T
cugccagcgccga

SEQ ID NO: 1920009 - RNA, 17 nt, Shigella flexneri 2a str. 2457T
cugccagcgugagggaa

SEQ ID NO: 1920010 - RNA, 13 nt, Shigella flexneri 2a str. 2457T
cugccagaaccgc

SEQ ID NO: 1920011 - RNA, 23 nt, Shigella flexneri 2a str. 2457T
cugccacuuucucacucaccgca

SEQ ID NO: 1920012 - RNA, 20 nt, Shigella flexneri 2a str. 2457T
cugccaggucgugccagaaa

SEQ ID NO: 1920013 - RNA, 15 nt, Shigella flexneri 2a str. 2457T
cugcccaagcgggga

SEQ ID NO: 1920014 - RNA, 17 nt, Shigella flexneri 2a str. 2457T
cugcccccgcucuucca

SEQ ID NO: 1920015 - RNA, 15 nt, Shigella flexneri 2a str. 2457T
cugccauuguuguug

SEQ ID NO: 1920016 - RNA, 20 nt, Shigella flexneri 2a str. 2457T
cugccauuguuguuggaucc

SEQ ID NO: 1920017 - RNA, 21 nt, Shigella flexneri 2a str. 2457T
cugccauuggcaggcucuggu

SEQ ID NO: 1920018 - RNA, 18 nt, Shigella flexneri 2a str. 2457T
cugcccgugggcaggccu

SEQ ID NO: 1920019 - RNA, 14 nt, Shigella flexneri 2a str. 2457T
cugccgacaaaugc

SEQ ID NO: 1920020 - RNA, 18 nt, Shigella flexneri 2a str. 2457T
cugcccuugccaacgcaa

SEQ ID NO: 1920021 - RNA, 13 nt, Shigella flexneri 2a str. 2457T
cugccgcgccuga

SEQ ID NO: 1920022 - RNA, 15 nt, Shigella flexneri 2a str. 2457T
cugccgaucaacugc

SEQ ID NO: 1920023 - RNA, 21 nt, Shigella flexneri 2a str. 2457T
cugccuugaguuuuucauccc

SEQ ID NO: 1920024 - RNA, 21 nt, Shigella flexneri 2a str. 2457T
cugccguccccaucaggaaac

SEQ ID NO: 1920025 - RNA, 15 nt, Shigella flexneri 2a str. 2457T
cugccgucaauuuua

SEQ ID NO: 1920026 - RNA, 13 nt, Shigella flexneri 2a str. 2457T
cugccggaagaga

SEQ ID NO: 1920027 - RNA, 20 nt, Shigella flexneri 2a str. 2457T
cugccggacguucgcccacu

SEQ ID NO: 1920028 - RNA, 21 nt, Shigella flexneri 2a str. 2457T
cugccggaggaguaucugcug

SEQ ID NO: 1920029 - RNA, 19 nt, Shigella flexneri 2a str. 2457T
cugccggagggauguggcc

SEQ ID NO: 1920030 - RNA, 17 nt, Shigella flexneri 2a str. 2457T
cugccggaccaucuucc

SEQ ID NO: 1920031 - RNA, 17 nt, Shigella flexneri 2a str. 2457T
cugccggaaccagccag

SEQ ID NO: 1920032 - RNA, 23 nt, Shigella flexneri 2a str. 2457T
cugccguaauagauccuuuuucc

SEQ ID NO: 1920033 - RNA, 23 nt, Shigella flexneri 2a str. 2457T
cugccguacaggcagcuuagaaa

SEQ ID NO: 1920034 - RNA, 16 nt, Shigella flexneri 2a str. 2457T
cugccguacaggcagc

SEQ ID NO: 1920035 - RNA, 19 nt, Shigella flexneri 2a str. 2457T
cugccguacaggcagcuua

SEQ ID NO: 1920036 - RNA, 20 nt, Shigella flexneri 2a str. 2457T
cugccguacaggcagcuuag

SEQ ID NO: 1920037 - RNA, 18 nt, Shigella flexneri 2a str. 2457T
cugcauaaucgcaacgcc

SEQ ID NO: 1920038 - RNA, 18 nt, Shigella flexneri 2a str. 2457T
cugcaggaacggcaauac

SEQ ID NO: 1920039 - RNA, 16 nt, Shigella flexneri 2a str. 2457T
cugcaggaccauacug

SEQ ID NO: 1920040 - RNA, 17 nt, Shigella flexneri 2a str. 2457T
cugcagcgucacucgcu

SEQ ID NO: 1920041 - RNA, 23 nt, Shigella flexneri 2a str. 2457T
cugcagcucaucuaaugcagggg

SEQ ID NO: 1920042 - RNA, 21 nt, Shigella flexneri 2a str. 2457T
cugcacuuugugucagcgcca

SEQ ID NO: 1920043 - RNA, 15 nt, Shigella flexneri 2a str. 2457T
cugcacuggcuucca

SEQ ID NO: 1920044 - RNA, 19 nt, Shigella flexneri 2a str. 2457T
cugcagcagccugcgcuuc

SEQ ID NO: 1920045 - RNA, 14 nt, Shigella flexneri 2a str. 2457T
cugcagcaucaccg

SEQ ID NO: 1920046 - RNA, 15 nt, Shigella flexneri 2a str. 2457T
cugcagcaucaccgg

SEQ ID NO: 1920047 - RNA, 14 nt, Shigella flexneri 2a str. 2457T
cugcaccaggcggg

SEQ ID NO: 1920048 - RNA, 14 nt, Shigella flexneri 2a str. 2457T
cugcaaauucaucg

SEQ ID NO: 1920049 - RNA, 14 nt, Shigella flexneri 2a str. 2457T
cugcaaauucaaua

SEQ ID NO: 1920050 - RNA, 20 nt, Shigella flexneri 2a str. 2457T
cugcaaaucgaucucaauga

SEQ ID NO: 1920051 - RNA, 16 nt, Shigella flexneri 2a str. 2457T
cugcaaauauuaauaa

SEQ ID NO: 1920052 - RNA, 17 nt, Shigella flexneri 2a str. 2457T
cugcaaauauuaauaau

SEQ ID NO: 1920053 - RNA, 13 nt, Shigella flexneri 2a str. 2457T
cugcaccauugcu

SEQ ID NO: 1920054 - RNA, 17 nt, Shigella flexneri 2a str. 2457T
cugcaccauugcugccg

SEQ ID NO: 1920055 - RNA, 19 nt, Shigella flexneri 2a str. 2457T
cugcaccauugcugccgcc

SEQ ID NO: 1920056 - RNA, 13 nt, Shigella flexneri 2a str. 2457T
cugcacgaaacca

SEQ ID NO: 1920057 - RNA, 20 nt, Shigella flexneri 2a str. 2457T
cugcacgucauacugcucag

SEQ ID NO: 1920058 - RNA, 19 nt, Shigella flexneri 2a str. 2457T
cugcacguuggcgcauaac

SEQ ID NO: 1920059 - RNA, 19 nt, Shigella flexneri 2a str. 2457T
cugcacgguuuuuccagcu

SEQ ID NO: 1920060 - RNA, 23 nt, Shigella flexneri 2a str. 2457T
cugcacggagauauccagcgccg

SEQ ID NO: 1920061 - RNA, 15 nt, Shigella flexneri 2a str. 2457T
cugauaggauuucug

SEQ ID NO: 1920062 - RNA, 17 nt, Shigella flexneri 2a str. 2457T
cugauaaaccuucaucg

SEQ ID NO: 1920063 - RNA, 17 nt, Shigella flexneri 2a str. 2457T
cugauaacgcggcagca

SEQ ID NO: 1920064 - RNA, 13 nt, Shigella flexneri 2a str. 2457T
cugauaaaucccg

SEQ ID NO: 1920065 - RNA, 22 nt, Shigella flexneri 2a str. 2457T
cugauaaacaagcguacaaaau

SEQ ID NO: 1920066 - RNA, 22 nt, Shigella flexneri 2a str. 2457T
cugaguaauaacuuccugagug

SEQ ID NO: 1920067 - RNA, 17 nt, Shigella flexneri 2a str. 2457T
cugaguaauccuucccc

SEQ ID NO: 1920068 - RNA, 14 nt, Shigella flexneri 2a str. 2457T
cugauaaaaaaccc

SEQ ID NO: 1920069 - RNA, 23 nt, Shigella flexneri 2a str. 2457T
cugagguuuauaacggugcugca

SEQ ID NO: 1920070 - RNA, 19 nt, Shigella flexneri 2a str. 2457T
cugagcggcgggcuuuaau

SEQ ID NO: 1920071 - RNA, 22 nt, Shigella flexneri 2a str. 2457T
cugagcuauaccaugccguucu

SEQ ID NO: 1920072 - RNA, 12 nt, Shigella flexneri 2a str. 2457T
cugagcuggcag

SEQ ID NO: 1920073 - RNA, 13 nt, Shigella flexneri 2a str. 2457T
cugagcuucuuca

SEQ ID NO: 1920074 - RNA, 22 nt, Shigella flexneri 2a str. 2457T
cugagcuugauccuacacauac

SEQ ID NO: 1920075 - RNA, 23 nt, Shigella flexneri 2a str. 2457T
cugaggccggaugucgcugcuag

SEQ ID NO: 1920076 - RNA, 17 nt, Shigella flexneri 2a str. 2457T
cugaggcugaugacaaa

SEQ ID NO: 1920077 - RNA, 20 nt, Shigella flexneri 2a str. 2457T
cugagcgugccccugaauaa

SEQ ID NO: 1920078 - RNA, 19 nt, Shigella flexneri 2a str. 2457T
cugagcggccuuuuccuuu

SEQ ID NO: 1920079 - RNA, 17 nt, Shigella flexneri 2a str. 2457T
cugagcggcgggcuuua

SEQ ID NO: 1920080 - RNA, 15 nt, Shigella flexneri 2a str. 2457T
cugagaaaaagcgaa

SEQ ID NO: 1920081 - RNA, 20 nt, Shigella flexneri 2a str. 2457T
cugacuuugccccagcggga

SEQ ID NO: 1920082 - RNA, 13 nt, Shigella flexneri 2a str. 2457T
cugagccugccau

SEQ ID NO: 1920083 - RNA, 15 nt, Shigella flexneri 2a str. 2457T
cugauauacccuuca

SEQ ID NO: 1920084 - RNA, 22 nt, Shigella flexneri 2a str. 2457T
cugauagugauccaucagguag

SEQ ID NO: 1920085 - RNA, 16 nt, Shigella flexneri 2a str. 2457T
cugauagugcugccau

SEQ ID NO: 1920086 - RNA, 17 nt, Shigella flexneri 2a str. 2457T
cugaugaagacagaccu

SEQ ID NO: 1920087 - RNA, 20 nt, Shigella flexneri 2a str. 2457T
cugaugaacgcgcaggucau

SEQ ID NO: 1920088 - RNA, 13 nt, Shigella flexneri 2a str. 2457T
cugaugacaaagu

SEQ ID NO: 1920089 - RNA, 15 nt, Shigella flexneri 2a str. 2457T
cugaugaaugguugu

SEQ ID NO: 1920090 - RNA, 18 nt, Shigella flexneri 2a str. 2457T
cugaugacaaacacaaaa

SEQ ID NO: 1920091 - RNA, 18 nt, Shigella flexneri 2a str. 2457T
cugaugacgcgcuagugc

SEQ ID NO: 1920092 - RNA, 21 nt, Shigella flexneri 2a str. 2457T
cugaugacuaaagucuaaaaa

SEQ ID NO: 1920093 - RNA, 12 nt, Shigella flexneri 2a str. 2457T
cugaugagcaaa

SEQ ID NO: 1920094 - RNA, 18 nt, Shigella flexneri 2a str. 2457T
cugaugagcaaaucgcgg

SEQ ID NO: 1920095 - RNA, 21 nt, Shigella flexneri 2a str. 2457T
cugauggcggcugguuaaaua

SEQ ID NO: 1920096 - RNA, 19 nt, Shigella flexneri 2a str. 2457T
cugauggcccaucgucaca

SEQ ID NO: 1920097 - RNA, 23 nt, Shigella flexneri 2a str. 2457T
cugauggcuguuuucagcaccag

SEQ ID NO: 1920098 - RNA, 20 nt, Shigella flexneri 2a str. 2457T
cugaugauaaguuaacccca

SEQ ID NO: 1920099 - RNA, 15 nt, Shigella flexneri 2a str. 2457T
cugaugauauuuuuc

SEQ ID NO: 1920100 - RNA, 16 nt, Shigella flexneri 2a str. 2457T
cugaugauauuuuucc

SEQ ID NO: 1920101 - RNA, 23 nt, Shigella flexneri 2a str. 2457T
cugaugcugugaauauucauuuc

SEQ ID NO: 1920102 - RNA, 19 nt, Shigella flexneri 2a str. 2457T
cugauggaagacauagcac

SEQ ID NO: 1920103 - RNA, 16 nt, Shigella flexneri 2a str. 2457T
cugauggacauucucc

SEQ ID NO: 1920104 - RNA, 19 nt, Shigella flexneri 2a str. 2457T
cugaugugacgcugucuua

SEQ ID NO: 1920105 - RNA, 14 nt, Shigella flexneri 2a str. 2457T
cugaugugaugccc

SEQ ID NO: 1920106 - RNA, 23 nt, Shigella flexneri 2a str. 2457T
cugauguuguuucucuuucuuca

SEQ ID NO: 1920107 - RNA, 17 nt, Shigella flexneri 2a str. 2457T
cugauguuguuucucuu

SEQ ID NO: 1920108 - RNA, 20 nt, Shigella flexneri 2a str. 2457T
cugauuacgcaccgggcagg

SEQ ID NO: 1920109 - RNA, 20 nt, Shigella flexneri 2a str. 2457T
cugauuaauuuucgcccguu

SEQ ID NO: 1920110 - RNA, 14 nt, Shigella flexneri 2a str. 2457T
cugauuacuuccuu

SEQ ID NO: 1920111 - RNA, 20 nt, Shigella flexneri 2a str. 2457T
cugauuauccgcaucacucc

SEQ ID NO: 1920112 - RNA, 22 nt, Shigella flexneri 2a str. 2457T
cugauuauccgcaucacuccac

SEQ ID NO: 1920113 - RNA, 19 nt, Shigella flexneri 2a str. 2457T
cugauucaugaacuguaca

SEQ ID NO: 1920114 - RNA, 17 nt, Shigella flexneri 2a str. 2457T
cugauuaugucaucauc

SEQ ID NO: 1920115 - RNA, 19 nt, Shigella flexneri 2a str. 2457T
cugauucaaaaccgguucu

SEQ ID NO: 1920116 - RNA, 20 nt, Shigella flexneri 2a str. 2457T
cugauucaaaaccgguucug

SEQ ID NO: 1920117 - RNA, 13 nt, Shigella flexneri 2a str. 2457T
cugauuuuauugc

SEQ ID NO: 1920118 - RNA, 18 nt, Shigella flexneri 2a str. 2457T
cugauuuucaucuucuuc

SEQ ID NO: 1920119 - RNA, 13 nt, Shigella flexneri 2a str. 2457T
cugauuucaccau

SEQ ID NO: 1920120 - RNA, 15 nt, Shigella flexneri 2a str. 2457T
cugauuugcuucaau

SEQ ID NO: 1920121 - RNA, 14 nt, Shigella flexneri 2a str. 2457T
cugaauacgcuggc

SEQ ID NO: 1920122 - RNA, 23 nt, Shigella flexneri 2a str. 2457T
cugaauacgcaccgcuccaucgc

SEQ ID NO: 1920123 - RNA, 12 nt, Shigella flexneri 2a str. 2457T
cugaauacgcug

SEQ ID NO: 1920124 - RNA, 20 nt, Shigella flexneri 2a str. 2457T
cugaauaacaccagccagaa

SEQ ID NO: 1920125 - RNA, 11 nt, Shigella flexneri 2a str. 2457T
cugaauaaucg

SEQ ID NO: 1920126 - RNA, 18 nt, Shigella flexneri 2a str. 2457T
cugaauaacaccagccag

SEQ ID NO: 1920127 - RNA, 19 nt, Shigella flexneri 2a str. 2457T
cugaauaacaccagccaga

SEQ ID NO: 1920128 - RNA, 15 nt, Shigella flexneri 2a str. 2457T
cugaaguuauaagcg

SEQ ID NO: 1920129 - RNA, 13 nt, Shigella flexneri 2a str. 2457T
cucuacaccaacg

SEQ ID NO: 1920130 - RNA, 13 nt, Shigella flexneri 2a str. 2457T
cucuacagcgccc

SEQ ID NO: 1920131 - RNA, 16 nt, Shigella flexneri 2a str. 2457T
cucuacagcgcccgcc

SEQ ID NO: 1920132 - RNA, 16 nt, Shigella flexneri 2a str. 2457T
cugaauauguaagauc

SEQ ID NO: 1920133 - RNA, 23 nt, Shigella flexneri 2a str. 2457T
cugaauaugagucguaaacaacu

SEQ ID NO: 1920134 - RNA, 14 nt, Shigella flexneri 2a str. 2457T
cugaauuaauuuau

SEQ ID NO: 1920135 - RNA, 15 nt, Shigella flexneri 2a str. 2457T
cugaauugugauggu

SEQ ID NO: 1920136 - RNA, 23 nt, Shigella flexneri 2a str. 2457T
cugaauggcgauuucacaagacu

SEQ ID NO: 1920137 - RNA, 16 nt, Shigella flexneri 2a str. 2457T
cugaaugcucugaggc

SEQ ID NO: 1920138 - RNA, 17 nt, Shigella flexneri 2a str. 2457T
cugaaugauaacuucua

SEQ ID NO: 1920139 - RNA, 14 nt, Shigella flexneri 2a str. 2457T
cugacggucuggug

SEQ ID NO: 1920140 - RNA, 19 nt, Shigella flexneri 2a str. 2457T
cugacggugauaaucaucc

SEQ ID NO: 1920141 - RNA, 13 nt, Shigella flexneri 2a str. 2457T
cugacgcaucuuc

SEQ ID NO: 1920142 - RNA, 20 nt, Shigella flexneri 2a str. 2457T
cugacgccaccauucaccaa

SEQ ID NO: 1920143 - RNA, 21 nt, Shigella flexneri 2a str. 2457T
cugacgccaccauucaccaag

SEQ ID NO: 1920144 - RNA, 15 nt, Shigella flexneri 2a str. 2457T
cugacugcgggcgaa

SEQ ID NO: 1920145 - RNA, 16 nt, Shigella flexneri 2a str. 2457T
cugacuguuccagcac

SEQ ID NO: 1920146 - RNA, 15 nt, Shigella flexneri 2a str. 2457T
cugacgucuggccuc

SEQ ID NO: 1920147 - RNA, 17 nt, Shigella flexneri 2a str. 2457T
cugacgucuggccucuc

SEQ ID NO: 1920148 - RNA, 19 nt, Shigella flexneri 2a str. 2457T
cugacggugauacagcaaa

SEQ ID NO: 1920149 - RNA, 13 nt, Shigella flexneri 2a str. 2457T
cugacguagcagc

SEQ ID NO: 1920150 - RNA, 13 nt, Shigella flexneri 2a str. 2457T
cugaccgucgccu

SEQ ID NO: 1920151 - RNA, 15 nt, Shigella flexneri 2a str. 2457T
cugacccuugaugug

SEQ ID NO: 1920152 - RNA, 16 nt, Shigella flexneri 2a str. 2457T
cugaauuucagcgccu

SEQ ID NO: 1920153 - RNA, 17 nt, Shigella flexneri 2a str. 2457T
cugaauugugaugguuu

SEQ ID NO: 1920154 - RNA, 17 nt, Shigella flexneri 2a str. 2457T
cugacauaaccacucac

SEQ ID NO: 1920155 - RNA, 21 nt, Shigella flexneri 2a str. 2457T
cugacauaaacaccagcaaua

SEQ ID NO: 1920156 - RNA, 23 nt, Shigella flexneri 2a str. 2457T
cugacaguugucagcccuuuuuc

SEQ ID NO: 1920157 - RNA, 16 nt, Shigella flexneri 2a str. 2457T
cguugaucucuccggu

SEQ ID NO: 1920158 - RNA, 21 nt, Shigella flexneri 2a str. 2457T
cguugaggaacucaaaccauu

SEQ ID NO: 1920159 - RNA, 11 nt, Shigella flexneri 2a str. 2457T
cguuccuggcu

SEQ ID NO: 1920160 - RNA, 19 nt, Shigella flexneri 2a str. 2457T
cguuccuucaggacccuua

SEQ ID NO: 1920161 - RNA, 21 nt, Shigella flexneri 2a str. 2457T
cguuccuuuacggugaacuca

SEQ ID NO: 1920162 - RNA, 12 nt, Shigella flexneri 2a str. 2457T
cguuccuuucuu

SEQ ID NO: 1920163 - RNA, 21 nt, Shigella flexneri 2a str. 2457T
cguuccuuucuugcgcaaacc

SEQ ID NO: 1920164 - RNA, 15 nt, Shigella flexneri 2a str. 2457T
cguuccuaacaugcc

SEQ ID NO: 1920165 - RNA, 22 nt, Shigella flexneri 2a str. 2457T
cguucauaaauacagagcacgc

SEQ ID NO: 1920166 - RNA, 17 nt, Shigella flexneri 2a str. 2457T
cguucaguucaaaguua

SEQ ID NO: 1920167 - RNA, 17 nt, Shigella flexneri 2a str. 2457T
cguucagccauacguug

SEQ ID NO: 1920168 - RNA, 11 nt, Shigella flexneri 2a str. 2457T
cguucauccca

SEQ ID NO: 1920169 - RNA, 15 nt, Shigella flexneri 2a str. 2457T
cguucauccaacaau

SEQ ID NO: 1920170 - RNA, 24 nt, Shigella flexneri 2a str. 2457T
cguucaucgggcauugcaaccaca

SEQ ID NO: 1920171 - RNA, 19 nt, Shigella flexneri 2a str. 2457T
cguucacgcagcucacgca

SEQ ID NO: 1920172 - RNA, 11 nt, Shigella flexneri 2a str. 2457T
cguucacgccg

SEQ ID NO: 1920173 - RNA, 15 nt, Shigella flexneri 2a str. 2457T
cguucaaccacuuca

SEQ ID NO: 1920174 - RNA, 21 nt, Shigella flexneri 2a str. 2457T
cguucaccgaagacgugcgcc

SEQ ID NO: 1920175 - RNA, 20 nt, Shigella flexneri 2a str. 2457T
cguucaauaccgucugcgcc

SEQ ID NO: 1920176 - RNA, 15 nt, Shigella flexneri 2a str. 2457T
cguucaaaacggcug

SEQ ID NO: 1920177 - RNA, 21 nt, Shigella flexneri 2a str. 2457T
cguucaaaacggcuggugauu

SEQ ID NO: 1920178 - RNA, 17 nt, Shigella flexneri 2a str. 2457T
cguuaucgcuguuaaug

SEQ ID NO: 1920179 - RNA, 23 nt, Shigella flexneri 2a str. 2457T
cguuagugucuuaucuggcauuu

SEQ ID NO: 1920180 - RNA, 13 nt, Shigella flexneri 2a str. 2457T
cguuaguguggcc

SEQ ID NO: 1920181 - RNA, 12 nt, Shigella flexneri 2a str. 2457T
cguuagugucuu

SEQ ID NO: 1920182 - RNA, 18 nt, Shigella flexneri 2a str. 2457T
cguuagugucuuaucugg

SEQ ID NO: 1920183 - RNA, 19 nt, Shigella flexneri 2a str. 2457T
cguuauaucccauuuuuga

SEQ ID NO: 1920184 - RNA, 22 nt, Shigella flexneri 2a str. 2457T
cguuauacaucgcuuuccaggu

SEQ ID NO: 1920185 - RNA, 22 nt, Shigella flexneri 2a str. 2457T
cguuagaaaacgccugcuccuc

SEQ ID NO: 1920186 - RNA, 16 nt, Shigella flexneri 2a str. 2457T
cguuaccggguguucu

SEQ ID NO: 1920187 - RNA, 21 nt, Shigella flexneri 2a str. 2457T
cguuacgacgcaaucaaaaaa

SEQ ID NO: 1920188 - RNA, 21 nt, Shigella flexneri 2a str. 2457T
cguuacgccccgguuucucuu

SEQ ID NO: 1920189 - RNA, 18 nt, Shigella flexneri 2a str. 2457T
cguggcaugacgcagguc

SEQ ID NO: 1920190 - RNA, 22 nt, Shigella flexneri 2a str. 2457T
cgugcugguggucagcagcuuu

SEQ ID NO: 1920191 - RNA, 20 nt, Shigella flexneri 2a str. 2457T
cguggauuuaaugccaaucu

SEQ ID NO: 1920192 - RNA, 23 nt, Shigella flexneri 2a str. 2457T
cguggaugcgauguucccccagc

SEQ ID NO: 1920193 - RNA, 15 nt, Shigella flexneri 2a str. 2457T
cguuacccagcacgg

SEQ ID NO: 1920194 - RNA, 22 nt, Shigella flexneri 2a str. 2457T
cuaaaagcacgccagacaucac

SEQ ID NO: 1920195 - RNA, 24 nt, Shigella flexneri 2a str. 2457T
cuaaaagcauagccccagcgcaga

SEQ ID NO: 1920196 - RNA, 20 nt, Shigella flexneri 2a str. 2457T
cuaaaagcgauuauuuauuc

SEQ ID NO: 1920197 - RNA, 20 nt, Shigella flexneri 2a str. 2457T
cuaaaaacagcaucaauaau

SEQ ID NO: 1920198 - RNA, 16 nt, Shigella flexneri 2a str. 2457T
cguuuugccgccauca

SEQ ID NO: 1920199 - RNA, 14 nt, Shigella flexneri 2a str. 2457T
cguuuuacagcaac

SEQ ID NO: 1920200 - RNA, 11 nt, Shigella flexneri 2a str. 2457T
cguuuuuaaaa

SEQ ID NO: 1920201 - RNA, 17 nt, Shigella flexneri 2a str. 2457T
cguuuuuacccagcagc

SEQ ID NO: 1920202 - RNA, 21 nt, Shigella flexneri 2a str. 2457T
cguuuuuaucuucacacacau

SEQ ID NO: 1920203 - RNA, 16 nt, Shigella flexneri 2a str. 2457T
cguuuuuugaaacagg

SEQ ID NO: 1920204 - RNA, 21 nt, Shigella flexneri 2a str. 2457T
cguuucgcagguuccgcauac

SEQ ID NO: 1920205 - RNA, 22 nt, Shigella flexneri 2a str. 2457T
cguuuuaaugcgauccugagcc

SEQ ID NO: 1920206 - RNA, 13 nt, Shigella flexneri 2a str. 2457T
cguuugucaucag

SEQ ID NO: 1920207 - RNA, 23 nt, Shigella flexneri 2a str. 2457T
cguuuggugguuuggcggcggcu

SEQ ID NO: 1920208 - RNA, 19 nt, Shigella flexneri 2a str. 2457T
cguugauucacuuucugaa

SEQ ID NO: 1920209 - RNA, 20 nt, Shigella flexneri 2a str. 2457T
cguugcaauacuuccgcuuc

SEQ ID NO: 1920210 - RNA, 17 nt, Shigella flexneri 2a str. 2457T
cguugugcgauccacgc

SEQ ID NO: 1920211 - RNA, 17 nt, Shigella flexneri 2a str. 2457T
cguugugcgcgacauac

SEQ ID NO: 1920212 - RNA, 20 nt, Shigella flexneri 2a str. 2457T
cguugucagcaaccugcuua

SEQ ID NO: 1920213 - RNA, 15 nt, Shigella flexneri 2a str. 2457T
cuaaucgcacaaaau

SEQ ID NO: 1920214 - RNA, 17 nt, Shigella flexneri 2a str. 2457T
cuaaucucuucaccaua

SEQ ID NO: 1920215 - RNA, 18 nt, Shigella flexneri 2a str. 2457T
cuaaugagucaggacagu

SEQ ID NO: 1920216 - RNA, 21 nt, Shigella flexneri 2a str. 2457T
cuaaugagucaggacaguaaa

SEQ ID NO: 1920217 - RNA, 23 nt, Shigella flexneri 2a str. 2457T
cuaaucaucuguugugccacauc

SEQ ID NO: 1920218 - RNA, 14 nt, Shigella flexneri 2a str. 2457T
cuaaucaucaucag

SEQ ID NO: 1920219 - RNA, 15 nt, Shigella flexneri 2a str. 2457T
cuaauaaaucuaaaa

SEQ ID NO: 1920220 - RNA, 13 nt, Shigella flexneri 2a str. 2457T
cuaauaauaagcc

SEQ ID NO: 1920221 - RNA, 17 nt, Shigella flexneri 2a str. 2457T
cuaauaaugagcagaaa

SEQ ID NO: 1920222 - RNA, 18 nt, Shigella flexneri 2a str. 2457T
cuaauaauuauccugugg

SEQ ID NO: 1920223 - RNA, 17 nt, Shigella flexneri 2a str. 2457T
cuaauaauugccccuug

SEQ ID NO: 1920224 - RNA, 14 nt, Shigella flexneri 2a str. 2457T
cuacaagcagagag

SEQ ID NO: 1920225 - RNA, 15 nt, Shigella flexneri 2a str. 2457T
cuacaaauuugugca

SEQ ID NO: 1920226 - RNA, 23 nt, Shigella flexneri 2a str. 2457T
cuacaaaaucuugcaaauucaau

SEQ ID NO: 1920227 - RNA, 23 nt, Shigella flexneri 2a str. 2457T
cuacaaaauuguguaaauucaau

SEQ ID NO: 1920228 - RNA, 18 nt, Shigella flexneri 2a str. 2457T
cuacaaacguugcugacu

SEQ ID NO: 1920229 - RNA, 23 nt, Shigella flexneri 2a str. 2457T
cuacaaaaccaauuaaauucaau

SEQ ID NO: 1920230 - RNA, 14 nt, Shigella flexneri 2a str. 2457T
cuacaaaaccugca

SEQ ID NO: 1920231 - RNA, 15 nt, Shigella flexneri 2a str. 2457T
cuacaaaaacucaua

SEQ ID NO: 1920232 - RNA, 15 nt, Shigella flexneri 2a str. 2457T
cuaauuuuuguuguu

SEQ ID NO: 1920233 - RNA, 15 nt, Shigella flexneri 2a str. 2457T
cuaauuuuucccgac

SEQ ID NO: 1920234 - RNA, 15 nt, Shigella flexneri 2a str. 2457T
cuaauggugaacuga

SEQ ID NO: 1920235 - RNA, 20 nt, Shigella flexneri 2a str. 2457T
cuaagaauguccauuauuuc

SEQ ID NO: 1920236 - RNA, 16 nt, Shigella flexneri 2a str. 2457T
cuaagccgugcauaac

SEQ ID NO: 1920237 - RNA, 24 nt, Shigella flexneri 2a str. 2457T
cuaagcgcacuuugucaucagucu

SEQ ID NO: 1920238 - RNA, 21 nt, Shigella flexneri 2a str. 2457T
cuaaggguaaaacgacuggcc

SEQ ID NO: 1920239 - RNA, 14 nt, Shigella flexneri 2a str. 2457T
cuaaggcagccaga

SEQ ID NO: 1920240 - RNA, 23 nt, Shigella flexneri 2a str. 2457T
cuaaaccaucaggaugacaaacu

SEQ ID NO: 1920241 - RNA, 19 nt, Shigella flexneri 2a str. 2457T
cuaaacccgaccacuucca

SEQ ID NO: 1920242 - RNA, 23 nt, Shigella flexneri 2a str. 2457T
cuaaccauuauuaaauuuaauaa

SEQ ID NO: 1920243 - RNA, 20 nt, Shigella flexneri 2a str. 2457T
cuaacacugcguacagcgcg

SEQ ID NO: 1920244 - RNA, 14 nt, Shigella flexneri 2a str. 2457T
cuaacagcaauccc

SEQ ID NO: 1920245 - RNA, 17 nt, Shigella flexneri 2a str. 2457T
cuaacccucuccccaag

SEQ ID NO: 1920246 - RNA, 12 nt, Shigella flexneri 2a str. 2457T
cuaacccucucc

SEQ ID NO: 1920247 - RNA, 15 nt, Shigella flexneri 2a str. 2457T
cuaacccucuccccg

SEQ ID NO: 1920248 - RNA, 15 nt, Shigella flexneri 2a str. 2457T
cuaacagaacaauaa

SEQ ID NO: 1920249 - RNA, 20 nt, Shigella flexneri 2a str. 2457T
cuaacagaacaauaauaacu

SEQ ID NO: 1920250 - RNA, 19 nt, Shigella flexneri 2a str. 2457T
cuaacaaucucaaccgcuu

SEQ ID NO: 1920251 - RNA, 14 nt, Shigella flexneri 2a str. 2457T
cuaacugacuuccg

SEQ ID NO: 1920252 - RNA, 15 nt, Shigella flexneri 2a str. 2457T
cuaacuucuuuuucg

SEQ ID NO: 1920253 - RNA, 14 nt, Shigella flexneri 2a str. 2457T
cuaacuucuuuuuc

SEQ ID NO: 1920254 - RNA, 20 nt, Shigella flexneri 2a str. 2457T
cuaacucauuuuuuaauaug

SEQ ID NO: 1920255 - RNA, 15 nt, Shigella flexneri 2a str. 2457T
cuaacguuuuuaaaa

SEQ ID NO: 1920256 - RNA, 18 nt, Shigella flexneri 2a str. 2457T
cuaacgucuaguaaagca

SEQ ID NO: 1920257 - RNA, 21 nt, Shigella flexneri 2a str. 2457T
cuaacgcgucuuaucuggccu

SEQ ID NO: 1920258 - RNA, 20 nt, Shigella flexneri 2a str. 2457T
cuaacgauaccguguuauuc

SEQ ID NO: 1920259 - RNA, 18 nt, Shigella flexneri 2a str. 2457T
cuaacgaugccagcaccg

SEQ ID NO: 1920260 - RNA, 13 nt, Shigella flexneri 2a str. 2457T
cuaaccucgaugc

SEQ ID NO: 1920261 - RNA, 22 nt, Shigella flexneri 2a str. 2457T
cuaaccugagagugauuaacug

SEQ ID NO: 1920262 - RNA, 22 nt, Shigella flexneri 2a str. 2457T
cuaaccgaauucaaauccuuca

SEQ ID NO: 1920263 - RNA, 23 nt, Shigella flexneri 2a str. 2457T
cgucgcgguugcugucggcggcg

SEQ ID NO: 1920264 - RNA, 21 nt, Shigella flexneri 2a str. 2457T
cgucggcaucgggcagcaucg

SEQ ID NO: 1920265 - RNA, 16 nt, Shigella flexneri 2a str. 2457T
cgucgcaucaggcauu

SEQ ID NO: 1920266 - RNA, 16 nt, Shigella flexneri 2a str. 2457T
cgucgccagcgcgcag

SEQ ID NO: 1920267 - RNA, 14 nt, Shigella flexneri 2a str. 2457T
cgucgcccgaugca

SEQ ID NO: 1920268 - RNA, 20 nt, Shigella flexneri 2a str. 2457T
cgucguuacugucgcgcagc

SEQ ID NO: 1920269 - RNA, 19 nt, Shigella flexneri 2a str. 2457T
cgucguuacugucgcgcag

SEQ ID NO: 1920270 - RNA, 15 nt, Shigella flexneri 2a str. 2457T
cgucgucccuuccgc

SEQ ID NO: 1920271 - RNA, 20 nt, Shigella flexneri 2a str. 2457T
cgucgucagcaguucacgca

SEQ ID NO: 1920272 - RNA, 17 nt, Shigella flexneri 2a str. 2457T
cgucgguguccacuucc

SEQ ID NO: 1920273 - RNA, 17 nt, Shigella flexneri 2a str. 2457T
cgucggcgucagcgcca

SEQ ID NO: 1920274 - RNA, 19 nt, Shigella flexneri 2a str. 2457T
cgucggcgucaucgacauc

SEQ ID NO: 1920275 - RNA, 14 nt, Shigella flexneri 2a str. 2457T
cgucuggccucucu

SEQ ID NO: 1920276 - RNA, 19 nt, Shigella flexneri 2a str. 2457T
cgucugggcaaaaucauca

SEQ ID NO: 1920277 - RNA, 18 nt, Shigella flexneri 2a str. 2457T
cgucugggcaaaaucauc

SEQ ID NO: 1920278 - RNA, 15 nt, Shigella flexneri 2a str. 2457T
cgucucggcauggau

SEQ ID NO: 1920279 - RNA, 14 nt, Shigella flexneri 2a str. 2457T
cgucucccgaugcc

SEQ ID NO: 1920280 - RNA, 22 nt, Shigella flexneri 2a str. 2457T
cgucucaaucaccaccagcgga

SEQ ID NO: 1920281 - RNA, 15 nt, Shigella flexneri 2a str. 2457T
cgucucaaucaccac

SEQ ID NO: 1920282 - RNA, 14 nt, Shigella flexneri 2a str. 2457T
cgugacuaaaaccc

SEQ ID NO: 1920283 - RNA, 15 nt, Shigella flexneri 2a str. 2457T
cgugacuaaaacccu

SEQ ID NO: 1920284 - RNA, 16 nt, Shigella flexneri 2a str. 2457T
cgugaauuacugcugc

SEQ ID NO: 1920285 - RNA, 23 nt, Shigella flexneri 2a str. 2457T
cgugaagagauggaucaacuugg

SEQ ID NO: 1920286 - RNA, 13 nt, Shigella flexneri 2a str. 2457T
cgugaagcuggca

SEQ ID NO: 1920287 - RNA, 13 nt, Shigella flexneri 2a str. 2457T
cgucuucguccca

SEQ ID NO: 1920288 - RNA, 22 nt, Shigella flexneri 2a str. 2457T
cgucuucugguugcgaaaaaau

SEQ ID NO: 1920289 - RNA, 19 nt, Shigella flexneri 2a str. 2457T
cgugcauagcagcacacca

SEQ ID NO: 1920290 - RNA, 16 nt, Shigella flexneri 2a str. 2457T
cgugcaucauggaagc

SEQ ID NO: 1920291 - RNA, 17 nt, Shigella flexneri 2a str. 2457T
cgugcagcgcaaucgcc

SEQ ID NO: 1920292 - RNA, 17 nt, Shigella flexneri 2a str. 2457T
cgugcagcuuucccuuc

SEQ ID NO: 1920293 - RNA, 14 nt, Shigella flexneri 2a str. 2457T
cgugauugguuuca

SEQ ID NO: 1920294 - RNA, 15 nt, Shigella flexneri 2a str. 2457T
cgugaugcuugaugu

SEQ ID NO: 1920295 - RNA, 19 nt, Shigella flexneri 2a str. 2457T
cgugagcggcaggacgcgc

SEQ ID NO: 1920296 - RNA, 11 nt, Shigella flexneri 2a str. 2457T
cgugagcuggg

SEQ ID NO: 1920297 - RNA, 22 nt, Shigella flexneri 2a str. 2457T
cgugaucgucuucaaccgcagu

SEQ ID NO: 1920298 - RNA, 17 nt, Shigella flexneri 2a str. 2457T
cgugaucguggccauga

SEQ ID NO: 1920299 - RNA, 16 nt, Shigella flexneri 2a str. 2457T
cgugcugccagcgauu

SEQ ID NO: 1920300 - RNA, 16 nt, Shigella flexneri 2a str. 2457T
cgugcucgcuuuccau

SEQ ID NO: 1920301 - RNA, 11 nt, Shigella flexneri 2a str. 2457T
cgugcccugcg

SEQ ID NO: 1920302 - RNA, 13 nt, Shigella flexneri 2a str. 2457T
cgugccgcauuuc

SEQ ID NO: 1920303 - RNA, 14 nt, Shigella flexneri 2a str. 2457T
cgugccgcagcuuc

SEQ ID NO: 1920304 - RNA, 20 nt, Shigella flexneri 2a str. 2457T
cgucacuggugugucaucug

SEQ ID NO: 1920305 - RNA, 21 nt, Shigella flexneri 2a str. 2457T
cgucacuggugugucaucugc

SEQ ID NO: 1920306 - RNA, 15 nt, Shigella flexneri 2a str. 2457T
cguauuucagcccca

SEQ ID NO: 1920307 - RNA, 23 nt, Shigella flexneri 2a str. 2457T
cguauuuuuugcucauaaaauca

SEQ ID NO: 1920308 - RNA, 14 nt, Shigella flexneri 2a str. 2457T
cguauugcgccggu

SEQ ID NO: 1920309 - RNA, 22 nt, Shigella flexneri 2a str. 2457T
cguauucggcaagcguaacgug

SEQ ID NO: 1920310 - RNA, 19 nt, Shigella flexneri 2a str. 2457T
cgucauccuaaacgcuggc

SEQ ID NO: 1920311 - RNA, 18 nt, Shigella flexneri 2a str. 2457T
cgucauccggaaagcaca

SEQ ID NO: 1920312 - RNA, 15 nt, Shigella flexneri 2a str. 2457T
cgucaucccagucuu

SEQ ID NO: 1920313 - RNA, 19 nt, Shigella flexneri 2a str. 2457T
cgucaucccagucuucauc

SEQ ID NO: 1920314 - RNA, 14 nt, Shigella flexneri 2a str. 2457T
cgucaucccagucu

SEQ ID NO: 1920315 - RNA, 18 nt, Shigella flexneri 2a str. 2457T
cgucauccagcacuugca

SEQ ID NO: 1920316 - RNA, 22 nt, Shigella flexneri 2a str. 2457T
cgucaucucgcucaaaaaucca

SEQ ID NO: 1920317 - RNA, 16 nt, Shigella flexneri 2a str. 2457T
cgucacugguucaaag

SEQ ID NO: 1920318 - RNA, 13 nt, Shigella flexneri 2a str. 2457T
cgucagaaacagu

SEQ ID NO: 1920319 - RNA, 23 nt, Shigella flexneri 2a str. 2457T
cgucagaccggcaaccagcaccg

SEQ ID NO: 1920320 - RNA, 20 nt, Shigella flexneri 2a str. 2457T
cgucagcgucgcaucuggca

SEQ ID NO: 1920321 - RNA, 16 nt, Shigella flexneri 2a str. 2457T
cgucagcucgcugcca

SEQ ID NO: 1920322 - RNA, 22 nt, Shigella flexneri 2a str. 2457T
cgucagcucgcugccaucaacu

SEQ ID NO: 1920323 - RNA, 14 nt, Shigella flexneri 2a str. 2457T
cgucaggccgccac

SEQ ID NO: 1920324 - RNA, 19 nt, Shigella flexneri 2a str. 2457T
cguccacagccaacacauu

SEQ ID NO: 1920325 - RNA, 22 nt, Shigella flexneri 2a str. 2457T
cguccacggugcgacacugcgu

SEQ ID NO: 1920326 - RNA, 20 nt, Shigella flexneri 2a str. 2457T
cgucauuagcgauaaauguc

SEQ ID NO: 1920327 - RNA, 13 nt, Shigella flexneri 2a str. 2457T
cgucauggcuguc

SEQ ID NO: 1920328 - RNA, 21 nt, Shigella flexneri 2a str. 2457T
cgucauuuucaucgcuuucuu

SEQ ID NO: 1920329 - RNA, 23 nt, Shigella flexneri 2a str. 2457T
cgucauuguuaacgccgcgccgu

SEQ ID NO: 1920330 - RNA, 20 nt, Shigella flexneri 2a str. 2457T
cguccagaugcgagaugucc

SEQ ID NO: 1920331 - RNA, 15 nt, Shigella flexneri 2a str. 2457T
cguccagcagcaaug

SEQ ID NO: 1920332 - RNA, 19 nt, Shigella flexneri 2a str. 2457T
cguagcccgguacaagagu

SEQ ID NO: 1920333 - RNA, 17 nt, Shigella flexneri 2a str. 2457T
cguagcaguucaccgcc

SEQ ID NO: 1920334 - RNA, 19 nt, Shigella flexneri 2a str. 2457T
cguagaagccauuaaacac

SEQ ID NO: 1920335 - RNA, 13 nt, Shigella flexneri 2a str. 2457T
cguauccggcauu

SEQ ID NO: 1920336 - RNA, 19 nt, Shigella flexneri 2a str. 2457T
cguaucgaccagaauaagu

SEQ ID NO: 1920337 - RNA, 20 nt, Shigella flexneri 2a str. 2457T
cguauccagcauaccuucca

SEQ ID NO: 1920338 - RNA, 23 nt, Shigella flexneri 2a str. 2457T
cguaauuaguggcuaaccgucug

SEQ ID NO: 1920339 - RNA, 20 nt, Shigella flexneri 2a str. 2457T
cguaaugcuucuaccgucug

SEQ ID NO: 1920340 - RNA, 20 nt, Shigella flexneri 2a str. 2457T
cguaauggcagcauucaggu

SEQ ID NO: 1920341 - RNA, 22 nt, Shigella flexneri 2a str. 2457T
cguacagggugagggcaauaau

SEQ ID NO: 1920342 - RNA, 15 nt, Shigella flexneri 2a str. 2457T
cguacaccaacauca

SEQ ID NO: 1920343 - RNA, 20 nt, Shigella flexneri 2a str. 2457T
cguacaccaacaucacgcaa

SEQ ID NO: 1920344 - RNA, 15 nt, Shigella flexneri 2a str. 2457T
cguacaugcagggca

SEQ ID NO: 1920345 - RNA, 22 nt, Shigella flexneri 2a str. 2457T
cguacaugcagggcaaacucug

SEQ ID NO: 1920346 - RNA, 20 nt, Shigella flexneri 2a str. 2457T
cguaccaucauuggagaguu

SEQ ID NO: 1920347 - RNA, 16 nt, Shigella flexneri 2a str. 2457T
cguaccacggcauuuc

SEQ ID NO: 1920348 - RNA, 16 nt, Shigella flexneri 2a str. 2457T
cguaccagccuugcca

SEQ ID NO: 1920349 - RNA, 15 nt, Shigella flexneri 2a str. 2457T
cguacugcugaauga

SEQ ID NO: 1920350 - RNA, 12 nt, Shigella flexneri 2a str. 2457T
cguacugcugaa

SEQ ID NO: 1920351 - RNA, 16 nt, Shigella flexneri 2a str. 2457T
cguacuggcaaucgcc

SEQ ID NO: 1920352 - RNA, 22 nt, Shigella flexneri 2a str. 2457T
cguacuggcaaucgccagcggc

SEQ ID NO: 1920353 - RNA, 15 nt, Shigella flexneri 2a str. 2457T
cguacucaauuuuca

SEQ ID NO: 1920354 - RNA, 16 nt, Shigella flexneri 2a str. 2457T
cguacucaccgcucac

SEQ ID NO: 1920355 - RNA, 21 nt, Shigella flexneri 2a str. 2457T
cguacgggcaaagcgacgcgc

SEQ ID NO: 1920356 - RNA, 19 nt, Shigella flexneri 2a str. 2457T
cguacgggucgggcugugu

SEQ ID NO: 1920357 - RNA, 16 nt, Shigella flexneri 2a str. 2457T
cguacguuaacagccu

SEQ ID NO: 1920358 - RNA, 13 nt, Shigella flexneri 2a str. 2457T
cguaccuucaggc

SEQ ID NO: 1920359 - RNA, 16 nt, Shigella flexneri 2a str. 2457T
cguaccggccuugcca

SEQ ID NO: 1920360 - RNA, 13 nt, Shigella flexneri 2a str. 2457T
cguaccgcagcaa

SEQ ID NO: 1920361 - RNA, 20 nt, Shigella flexneri 2a str. 2457T
cguaccauuaucaccaaacu

SEQ ID NO: 1920362 - RNA, 17 nt, Shigella flexneri 2a str. 2457T
cguaccauuaucaccaa

SEQ ID NO: 1920363 - RNA, 17 nt, Shigella flexneri 2a str. 2457T
cuaccacgccgauaauc

SEQ ID NO: 1920364 - RNA, 17 nt, Shigella flexneri 2a str. 2457T
cuaccacugccugaguu

SEQ ID NO: 1920365 - RNA, 12 nt, Shigella flexneri 2a str. 2457T
cuaccacaugau

SEQ ID NO: 1920366 - RNA, 20 nt, Shigella flexneri 2a str. 2457T
cuaccagguuucgcaauaac

SEQ ID NO: 1920367 - RNA, 14 nt, Shigella flexneri 2a str. 2457T
cuaccagcgcggca

SEQ ID NO: 1920368 - RNA, 12 nt, Shigella flexneri 2a str. 2457T
cuaccagcucau

SEQ ID NO: 1920369 - RNA, 15 nt, Shigella flexneri 2a str. 2457T
cuacccauauuuaau

SEQ ID NO: 1920370 - RNA, 14 nt, Shigella flexneri 2a str. 2457T
cuacccuaaguggc

SEQ ID NO: 1920371 - RNA, 12 nt, Shigella flexneri 2a str. 2457T
cuacccggcaag

SEQ ID NO: 1920372 - RNA, 17 nt, Shigella flexneri 2a str. 2457T
cuaccuaaggaauccag

SEQ ID NO: 1920373 - RNA, 19 nt, Shigella flexneri 2a str. 2457T
cuaccgucuguaaccagau

SEQ ID NO: 1920374 - RNA, 22 nt, Shigella flexneri 2a str. 2457T
cuaccuuaacgguaucuuucca

SEQ ID NO: 1920375 - RNA, 20 nt, Shigella flexneri 2a str. 2457T
cuaccuuaacgguaucuuuc

SEQ ID NO: 1920376 - RNA, 20 nt, Shigella flexneri 2a str. 2457T
cuaccugagucaucaacuca

SEQ ID NO: 1920377 - RNA, 15 nt, Shigella flexneri 2a str. 2457T
cuacaucguuccugc

SEQ ID NO: 1920378 - RNA, 14 nt, Shigella flexneri 2a str. 2457T
cuacaugauuucug

SEQ ID NO: 1920379 - RNA, 18 nt, Shigella flexneri 2a str. 2457T
cuacagcgcccgccagca

SEQ ID NO: 1920380 - RNA, 14 nt, Shigella flexneri 2a str. 2457T
cuacagcauauaau

SEQ ID NO: 1920381 - RNA, 23 nt, Shigella flexneri 2a str. 2457T
cuacacagacgguuuuucaaguc

SEQ ID NO: 1920382 - RNA, 16 nt, Shigella flexneri 2a str. 2457T
cuacaauguuucugca

SEQ ID NO: 1920383 - RNA, 21 nt, Shigella flexneri 2a str. 2457T
cuacagaggaaucgcuguuga

SEQ ID NO: 1920384 - RNA, 22 nt, Shigella flexneri 2a str. 2457T
cuacagaggaaucgcuguugag

SEQ ID NO: 1920385 - RNA, 20 nt, Shigella flexneri 2a str. 2457T
cuacacgcuaccaaaaaauc

SEQ ID NO: 1920386 - RNA, 22 nt, Shigella flexneri 2a str. 2457T
cuacacgcuaccaaaaaaucaa

SEQ ID NO: 1920387 - RNA, 14 nt, Shigella flexneri 2a str. 2457T
cuacacccagcccc

SEQ ID NO: 1920388 - RNA, 24 nt, Shigella flexneri 2a str. 2457T
cuagagcaucaugaauauauaauu

SEQ ID NO: 1920389 - RNA, 16 nt, Shigella flexneri 2a str. 2457T
cuagaaaucauucaau

SEQ ID NO: 1920390 - RNA, 19 nt, Shigella flexneri 2a str. 2457T
cuagaaaucauucaauacu

SEQ ID NO: 1920391 - RNA, 23 nt, Shigella flexneri 2a str. 2457T
cuagacagcgacucucugagcca

SEQ ID NO: 1920392 - RNA, 14 nt, Shigella flexneri 2a str. 2457T
cuagacgaugaaaa

SEQ ID NO: 1920393 - RNA, 23 nt, Shigella flexneri 2a str. 2457T
cuacguggaucgaucaauuuauu

SEQ ID NO: 1920394 - RNA, 22 nt, Shigella flexneri 2a str. 2457T
cuacguaggacagcguugccag

SEQ ID NO: 1920395 - RNA, 23 nt, Shigella flexneri 2a str. 2457T
cuacguaggacagcguugccagc

SEQ ID NO: 1920396 - RNA, 16 nt, Shigella flexneri 2a str. 2457T
cuacgguguaaccugc

SEQ ID NO: 1920397 - RNA, 16 nt, Shigella flexneri 2a str. 2457T
cuacgcgcccgcgcag

SEQ ID NO: 1920398 - RNA, 14 nt, Shigella flexneri 2a str. 2457T
cuauaaccguaaua

SEQ ID NO: 1920399 - RNA, 21 nt, Shigella flexneri 2a str. 2457T
cuauaacguugccggauauac

SEQ ID NO: 1920400 - RNA, 18 nt, Shigella flexneri 2a str. 2457T
cuauaacaaaacugagag

SEQ ID NO: 1920401 - RNA, 14 nt, Shigella flexneri 2a str. 2457T
cuaguguacccuuc

SEQ ID NO: 1920402 - RNA, 17 nt, Shigella flexneri 2a str. 2457T
cucagaagacgcuccag

SEQ ID NO: 1920403 - RNA, 14 nt, Shigella flexneri 2a str. 2457T
cucagaaaggggga

SEQ ID NO: 1920404 - RNA, 15 nt, Shigella flexneri 2a str. 2457T
cucagcagacugaua

SEQ ID NO: 1920405 - RNA, 16 nt, Shigella flexneri 2a str. 2457T
cucacuguugaguaag

SEQ ID NO: 1920406 - RNA, 21 nt, Shigella flexneri 2a str. 2457T
cucacuguucacuuuugcugc

SEQ ID NO: 1920407 - RNA, 15 nt, Shigella flexneri 2a str. 2457T
cucacuguucacuuu

SEQ ID NO: 1920408 - RNA, 19 nt, Shigella flexneri 2a str. 2457T
cucacgccguuaacuucac

SEQ ID NO: 1920409 - RNA, 19 nt, Shigella flexneri 2a str. 2457T
cucacgcgcugccucucuu

SEQ ID NO: 1920410 - RNA, 20 nt, Shigella flexneri 2a str. 2457T
cucagcgucagccugcucag

SEQ ID NO: 1920411 - RNA, 24 nt, Shigella flexneri 2a str. 2457T
cucagcgccgcuuuccaggcugug

SEQ ID NO: 1920412 - RNA, 23 nt, Shigella flexneri 2a str. 2457T
cucaggaauagcggcaagcccag

SEQ ID NO: 1920413 - RNA, 13 nt, Shigella flexneri 2a str. 2457T
cucaggaauagcg

SEQ ID NO: 1920414 - RNA, 16 nt, Shigella flexneri 2a str. 2457T
cucagcucauuaaaaa

SEQ ID NO: 1920415 - RNA, 18 nt, Shigella flexneri 2a str. 2457T
cucagcucauuaaaaaua

SEQ ID NO: 1920416 - RNA, 13 nt, Shigella flexneri 2a str. 2457T
cucagcuccucuu

SEQ ID NO: 1920417 - RNA, 16 nt, Shigella flexneri 2a str. 2457T
cucagcuccucuuuca

SEQ ID NO: 1920418 - RNA, 14 nt, Shigella flexneri 2a str. 2457T
cucagcgccacauc

SEQ ID NO: 1920419 - RNA, 15 nt, Shigella flexneri 2a str. 2457T
cucagcgccugcugc

SEQ ID NO: 1920420 - RNA, 14 nt, Shigella flexneri 2a str. 2457T
cucagccagcuggc

SEQ ID NO: 1920421 - RNA, 17 nt, Shigella flexneri 2a str. 2457T
cucagccagcuggcaga

SEQ ID NO: 1920422 - RNA, 22 nt, Shigella flexneri 2a str. 2457T
cucagcauggaaauguuccggc

SEQ ID NO: 1920423 - RNA, 15 nt, Shigella flexneri 2a str. 2457T
cucagcccacaucca

SEQ ID NO: 1920424 - RNA, 21 nt, Shigella flexneri 2a str. 2457T
cucaccagacaucccagugca

SEQ ID NO: 1920425 - RNA, 13 nt, Shigella flexneri 2a str. 2457T
cucaccaucaagu

SEQ ID NO: 1920426 - RNA, 21 nt, Shigella flexneri 2a str. 2457T
cucacgcagggugugcuccag

SEQ ID NO: 1920427 - RNA, 14 nt, Shigella flexneri 2a str. 2457T
cucacgcauccucu

SEQ ID NO: 1920428 - RNA, 16 nt, Shigella flexneri 2a str. 2457T
cucacgcgcugccucu

SEQ ID NO: 1920429 - RNA, 19 nt, Shigella flexneri 2a str. 2457T
cucacaaucaucgcaucca

SEQ ID NO: 1920430 - RNA, 22 nt, Shigella flexneri 2a str. 2457T
cucaauugacaguuuauuuucu

SEQ ID NO: 1920431 - RNA, 14 nt, Shigella flexneri 2a str. 2457T
cucaauggcauccg

SEQ ID NO: 1920432 - RNA, 19 nt, Shigella flexneri 2a str. 2457T
cucaaugguguuuuccacc

SEQ ID NO: 1920433 - RNA, 20 nt, Shigella flexneri 2a str. 2457T
cucaauuaccacaaguaaaa

SEQ ID NO: 1920434 - RNA, 14 nt, Shigella flexneri 2a str. 2457T
cucaaucgccacca

SEQ ID NO: 1920435 - RNA, 18 nt, Shigella flexneri 2a str. 2457T
cucaaucucuuuuuccac

SEQ ID NO: 1920436 - RNA, 19 nt, Shigella flexneri 2a str. 2457T
cucaaugagccggaccucu

SEQ ID NO: 1920437 - RNA, 21 nt, Shigella flexneri 2a str. 2457T
cucaaugagccggaccucuuu

SEQ ID NO: 1920438 - RNA, 23 nt, Shigella flexneri 2a str. 2457T
cucaaugcggcggcgcaccggcc

SEQ ID NO: 1920439 - RNA, 20 nt, Shigella flexneri 2a str. 2457T
cucaauccgccaaaacaucu

SEQ ID NO: 1920440 - RNA, 14 nt, Shigella flexneri 2a str. 2457T
cucaaucccuuucu

SEQ ID NO: 1920441 - RNA, 16 nt, Shigella flexneri 2a str. 2457T
cucaaaguaaucaagc

SEQ ID NO: 1920442 - RNA, 19 nt, Shigella flexneri 2a str. 2457T
cucaaaguaaucaagcccu

SEQ ID NO: 1920443 - RNA, 16 nt, Shigella flexneri 2a str. 2457T
cucaaaggccgacagc

SEQ ID NO: 1920444 - RNA, 23 nt, Shigella flexneri 2a str. 2457T
cucaaaauuucuccuucacucua

SEQ ID NO: 1920445 - RNA, 15 nt, Shigella flexneri 2a str. 2457T
cucaaagccgaauuu

SEQ ID NO: 1920446 - RNA, 22 nt, Shigella flexneri 2a str. 2457T
cucaaagacgcgguaaaagccc

SEQ ID NO: 1920447 - RNA, 15 nt, Shigella flexneri 2a str. 2457T
cucaaaccauuuugc

SEQ ID NO: 1920448 - RNA, 22 nt, Shigella flexneri 2a str. 2457T
cucaaacacgccgauaucgcug

SEQ ID NO: 1920449 - RNA, 17 nt, Shigella flexneri 2a str. 2457T
cucaaaccggcuccaga

SEQ ID NO: 1920450 - RNA, 22 nt, Shigella flexneri 2a str. 2457T
cuauucaccgcaucaauauuaa

SEQ ID NO: 1920451 - RNA, 16 nt, Shigella flexneri 2a str. 2457T
cuauucacgaaucuau

SEQ ID NO: 1920452 - RNA, 23 nt, Shigella flexneri 2a str. 2457T
cuauucacgaaucuauucauuua

SEQ ID NO: 1920453 - RNA, 17 nt, Shigella flexneri 2a str. 2457T
cuauuauuauuuuugug

SEQ ID NO: 1920454 - RNA, 12 nt, Shigella flexneri 2a str. 2457T
cuauuccacgca

SEQ ID NO: 1920455 - RNA, 17 nt, Shigella flexneri 2a str. 2457T
cuauucagcucuuccuu

SEQ ID NO: 1920456 - RNA, 14 nt, Shigella flexneri 2a str. 2457T
cuauggggaaaaau

SEQ ID NO: 1920457 - RNA, 17 nt, Shigella flexneri 2a str. 2457T
cuaugggauauuuuuuu

SEQ ID NO: 1920458 - RNA, 16 nt, Shigella flexneri 2a str. 2457T
cuaugaagaacuggaa

SEQ ID NO: 1920459 - RNA, 21 nt, Shigella flexneri 2a str. 2457T
cuaucuuucagaccuuuuacu

SEQ ID NO: 1920460 - RNA, 15 nt, Shigella flexneri 2a str. 2457T
cuaucuuucaacagu

SEQ ID NO: 1920461 - RNA, 17 nt, Shigella flexneri 2a str. 2457T
cuaugaaagaaaaucaa

SEQ ID NO: 1920462 - RNA, 18 nt, Shigella flexneri 2a str. 2457T
cuaucugcugcuugcggu

SEQ ID NO: 1920463 - RNA, 16 nt, Shigella flexneri 2a str. 2457T
cuauagauuauuugcg

SEQ ID NO: 1920464 - RNA, 16 nt, Shigella flexneri 2a str. 2457T
cuauugauuuaacagc

SEQ ID NO: 1920465 - RNA, 17 nt, Shigella flexneri 2a str. 2457T
cuauucuuauaaagaaa

SEQ ID NO: 1920466 - RNA, 17 nt, Shigella flexneri 2a str. 2457T
cuauuguugauaaggaa

SEQ ID NO: 1920467 - RNA, 19 nt, Shigella flexneri 2a str. 2457T
cuauuucgucgcuaacggu

SEQ ID NO: 1920468 - RNA, 14 nt, Shigella flexneri 2a str. 2457T
cuauuuuagaaaaa

SEQ ID NO: 1920469 - RNA, 20 nt, Shigella flexneri 2a str. 2457T
cuauuuuccuauugcugcug

SEQ ID NO: 1920470 - RNA, 18 nt, Shigella flexneri 2a str. 2457T
cucgguugauucgcucug

SEQ ID NO: 1920471 - RNA, 22 nt, Shigella flexneri 2a str. 2457T
cucggugucguuacgccgcaga

SEQ ID NO: 1920472 - RNA, 21 nt, Shigella flexneri 2a str. 2457T
cucgucgguaauuucacaagu

SEQ ID NO: 1920473 - RNA, 23 nt, Shigella flexneri 2a str. 2457T
cucgucggcgguuuucaucaucc

SEQ ID NO: 1920474 - RNA, 23 nt, Shigella flexneri 2a str. 2457T
cucguucacauauugcagcuucu

SEQ ID NO: 1920475 - RNA, 17 nt, Shigella flexneri 2a str. 2457T
cucgugccaccagugca

SEQ ID NO: 1920476 - RNA, 20 nt, Shigella flexneri 2a str. 2457T
cucuaacccuuccagauuca

SEQ ID NO: 1920477 - RNA, 18 nt, Shigella flexneri 2a str. 2457T
cucuaacccuuccagauu

SEQ ID NO: 1920478 - RNA, 13 nt, Shigella flexneri 2a str. 2457T
cucuaaucaggaa

SEQ ID NO: 1920479 - RNA, 21 nt, Shigella flexneri 2a str. 2457T
cucuaacccguauaaauacug

SEQ ID NO: 1920480 - RNA, 22 nt, Shigella flexneri 2a str. 2457T
cucguugccugcgaagcucuuu

SEQ ID NO: 1920481 - RNA, 16 nt, Shigella flexneri 2a str. 2457T
cucguuggucaucacu

SEQ ID NO: 1920482 - RNA, 18 nt, Shigella flexneri 2a str. 2457T
cucguuucgcccugccuu

SEQ ID NO: 1920483 - RNA, 14 nt, Shigella flexneri 2a str. 2457T
cucuaaaaucauca

SEQ ID NO: 1920484 - RNA, 13 nt, Shigella flexneri 2a str. 2457T
cucgcugccagca

SEQ ID NO: 1920485 - RNA, 19 nt, Shigella flexneri 2a str. 2457T
cucgcuuaagccaucauca

SEQ ID NO: 1920486 - RNA, 14 nt, Shigella flexneri 2a str. 2457T
cucggggccacagg

SEQ ID NO: 1920487 - RNA, 19 nt, Shigella flexneri 2a str. 2457T
cucggucacugacaccagc

SEQ ID NO: 1920488 - RNA, 21 nt, Shigella flexneri 2a str. 2457T
cuccucaguuucgacgccuuc

SEQ ID NO: 1920489 - RNA, 15 nt, Shigella flexneri 2a str. 2457T
cucgaacauccccac

SEQ ID NO: 1920490 - RNA, 24 nt, Shigella flexneri 2a str. 2457T
cucgcaagccgaauaacggcucaa

SEQ ID NO: 1920491 - RNA, 23 nt, Shigella flexneri 2a str. 2457T
cucgcaggcugagaaaugccaga

SEQ ID NO: 1920492 - RNA, 18 nt, Shigella flexneri 2a str. 2457T
cucgccagagagcggagc

SEQ ID NO: 1920493 - RNA, 23 nt, Shigella flexneri 2a str. 2457T
cucgcccauuuuucaugaucuuu

SEQ ID NO: 1920494 - RNA, 18 nt, Shigella flexneri 2a str. 2457T
cucgcccccgaagagggg

SEQ ID NO: 1920495 - RNA, 21 nt, Shigella flexneri 2a str. 2457T
cucgccccgagaaaaauagca

SEQ ID NO: 1920496 - RNA, 13 nt, Shigella flexneri 2a str. 2457T
cucgcccccuugg

SEQ ID NO: 1920497 - RNA, 14 nt, Shigella flexneri 2a str. 2457T
cucgccgcagagau

SEQ ID NO: 1920498 - RNA, 18 nt, Shigella flexneri 2a str. 2457T
cucgccccugcccuuuca

SEQ ID NO: 1920499 - RNA, 13 nt, Shigella flexneri 2a str. 2457T
cucgcgcucuucu

SEQ ID NO: 1920500 - RNA, 21 nt, Shigella flexneri 2a str. 2457T
cucgcgacccaugaacaaaau

SEQ ID NO: 1920501 - RNA, 15 nt, Shigella flexneri 2a str. 2457T
cucgccuuucacacg

SEQ ID NO: 1920502 - RNA, 17 nt, Shigella flexneri 2a str. 2457T
cucgcgaaccgccuggc

SEQ ID NO: 1920503 - RNA, 20 nt, Shigella flexneri 2a str. 2457T
cucgcgaaucuccacgccuu

SEQ ID NO: 1920504 - RNA, 15 nt, Shigella flexneri 2a str. 2457T
cucgcgaaccgccug

SEQ ID NO: 1920505 - RNA, 17 nt, Shigella flexneri 2a str. 2457T
cucgccuaccauccaua

SEQ ID NO: 1920506 - RNA, 13 nt, Shigella flexneri 2a str. 2457T
cuccgaccagaag

SEQ ID NO: 1920507 - RNA, 21 nt, Shigella flexneri 2a str. 2457T
cuccgcguucaauacgcaguu

SEQ ID NO: 1920508 - RNA, 21 nt, Shigella flexneri 2a str. 2457T
cuccggcuuuuuacuucucag

SEQ ID NO: 1920509 - RNA, 23 nt, Shigella flexneri 2a str. 2457T
cuccggaaauuuggggccguccc

SEQ ID NO: 1920510 - RNA, 21 nt, Shigella flexneri 2a str. 2457T
cuccgcuucgguaagcaaagc

SEQ ID NO: 1920511 - RNA, 20 nt, Shigella flexneri 2a str. 2457T
cuccuauuaucggcaccauu

SEQ ID NO: 1920512 - RNA, 14 nt, Shigella flexneri 2a str. 2457T
cuccguaaaccccg

SEQ ID NO: 1920513 - RNA, 14 nt, Shigella flexneri 2a str. 2457T
cuccccagaaucca

SEQ ID NO: 1920514 - RNA, 23 nt, Shigella flexneri 2a str. 2457T
cuccccgcauuuacucucaucaa

SEQ ID NO: 1920515 - RNA, 14 nt, Shigella flexneri 2a str. 2457T
cucccgguagguga

SEQ ID NO: 1920516 - RNA, 15 nt, Shigella flexneri 2a str. 2457T
cucccgugccagagc

SEQ ID NO: 1920517 - RNA, 19 nt, Shigella flexneri 2a str. 2457T
cucccggcgguaaaucgcc

SEQ ID NO: 1920518 - RNA, 14 nt, Shigella flexneri 2a str. 2457T
cuccccugcaaucc

SEQ ID NO: 1920519 - RNA, 17 nt, Shigella flexneri 2a str. 2457T
cucccggauaucccagc

SEQ ID NO: 1920520 - RNA, 15 nt, Shigella flexneri 2a str. 2457T
cuccagcagugccgc

SEQ ID NO: 1920521 - RNA, 13 nt, Shigella flexneri 2a str. 2457T
cuccagccagagc

SEQ ID NO: 1920522 - RNA, 15 nt, Shigella flexneri 2a str. 2457T
cuccauuaccuggau

SEQ ID NO: 1920523 - RNA, 18 nt, Shigella flexneri 2a str. 2457T
cuccauguccagcuugau

SEQ ID NO: 1920524 - RNA, 15 nt, Shigella flexneri 2a str. 2457T
cuccauugaauuuua

SEQ ID NO: 1920525 - RNA, 16 nt, Shigella flexneri 2a str. 2457T
cuccauuccaucgccu

SEQ ID NO: 1920526 - RNA, 24 nt, Shigella flexneri 2a str. 2457T
cuccauuuuuuugcauuacugcua

SEQ ID NO: 1920527 - RNA, 13 nt, Shigella flexneri 2a str. 2457T
cucauuauuugcc

SEQ ID NO: 1920528 - RNA, 14 nt, Shigella flexneri 2a str. 2457T
cucauucaccaguu

SEQ ID NO: 1920529 - RNA, 15 nt, Shigella flexneri 2a str. 2457T
cucaggcacuucuuc

SEQ ID NO: 1920530 - RNA, 16 nt, Shigella flexneri 2a str. 2457T
cucaggccuacaaaau

SEQ ID NO: 1920531 - RNA, 15 nt, Shigella flexneri 2a str. 2457T
cucaggcgcacgccg

SEQ ID NO: 1920532 - RNA, 14 nt, Shigella flexneri 2a str. 2457T
cucauuaaaaauau

SEQ ID NO: 1920533 - RNA, 12 nt, Shigella flexneri 2a str. 2457T
cucauugccagu

SEQ ID NO: 1920534 - RNA, 23 nt, Shigella flexneri 2a str. 2457T
cucauugcuauuuccaccucccc

SEQ ID NO: 1920535 - RNA, 17 nt, Shigella flexneri 2a str. 2457T
cucauuucugccauucc

SEQ ID NO: 1920536 - RNA, 14 nt, Shigella flexneri 2a str. 2457T
cucauuuacagaaa

SEQ ID NO: 1920537 - RNA, 23 nt, Shigella flexneri 2a str. 2457T
cucauuuuucagcguuccccaga

SEQ ID NO: 1920538 - RNA, 22 nt, Shigella flexneri 2a str. 2457T
cuccagauccauaagguccucc

SEQ ID NO: 1920539 - RNA, 23 nt, Shigella flexneri 2a str. 2457T
cuccagauccauaagguccucca

SEQ ID NO: 1920540 - RNA, 17 nt, Shigella flexneri 2a str. 2457T
cuccagcaauaacauua

SEQ ID NO: 1920541 - RNA, 19 nt, Shigella flexneri 2a str. 2457T
cuccagacaccgcugcuuc

SEQ ID NO: 1920542 - RNA, 17 nt, Shigella flexneri 2a str. 2457T
cuccacuuccugccagu

SEQ ID NO: 1920543 - RNA, 13 nt, Shigella flexneri 2a str. 2457T
cuccacuuuuaca

SEQ ID NO: 1920544 - RNA, 13 nt, Shigella flexneri 2a str. 2457T
cuccacugcucac

SEQ ID NO: 1920545 - RNA, 21 nt, Shigella flexneri 2a str. 2457T
cuccacgcuuaacaacccguu

SEQ ID NO: 1920546 - RNA, 18 nt, Shigella flexneri 2a str. 2457T
cuccacgcuuaacaaccc

SEQ ID NO: 1920547 - RNA, 17 nt, Shigella flexneri 2a str. 2457T
cuccacgcccagcgcag

SEQ ID NO: 1920548 - RNA, 20 nt, Shigella flexneri 2a str. 2457T
cuccacgcccagcgcaggaa

SEQ ID NO: 1920549 - RNA, 17 nt, Shigella flexneri 2a str. 2457T
cuccacgcugcaucgcc

SEQ ID NO: 1920550 - RNA, 18 nt, Shigella flexneri 2a str. 2457T
cuccacgauguucugagc

SEQ ID NO: 1920551 - RNA, 22 nt, Shigella flexneri 2a str. 2457T
cuccacgauguucugagcgaag

SEQ ID NO: 1920552 - RNA, 20 nt, Shigella flexneri 2a str. 2457T
cuccacgauguucugagcga

SEQ ID NO: 1920553 - RNA, 14 nt, Shigella flexneri 2a str. 2457T
cuccaccgggcgca

SEQ ID NO: 1920554 - RNA, 14 nt, Shigella flexneri 2a str. 2457T
cuccacaagcuccg

SEQ ID NO: 1920555 - RNA, 14 nt, Shigella flexneri 2a str. 2457T
cuccaccagcacca

SEQ ID NO: 1920556 - RNA, 20 nt, Shigella flexneri 2a str. 2457T
aaaaaauuacaaaaagugcu

SEQ ID NO: 1920557 - RNA, 22 nt, Shigella flexneri 2a str. 2457T
aaaaacaagccgaaacggaaau

SEQ ID NO: 1920558 - RNA, 20 nt, Shigella flexneri 2a str. 2457T
aaaaaauggccagacauuau

SEQ ID NO: 1920559 - RNA, 13 nt, Shigella flexneri 2a str. 2457T
aaaaaagaauuca

SEQ ID NO: 1920560 - RNA, 13 nt, Shigella flexneri 2a str. 2457T
aaaaaagauuggg

SEQ ID NO: 1920561 - RNA, 13 nt, Shigella flexneri 2a str. 2457T
aaaaaaagcauuu

SEQ ID NO: 1920562 - RNA, 16 nt, Shigella flexneri 2a str. 2457T
aaaaaacgaucauuau

SEQ ID NO: 1920563 - RNA, 20 nt, Shigella flexneri 2a str. 2457T
aaaaaacuggaaaaauaauu

SEQ ID NO: 1920564 - RNA, 19 nt, Shigella flexneri 2a str. 2457T
aaaaagagauuguauuuaa

SEQ ID NO: 1920565 - RNA, 21 nt, Shigella flexneri 2a str. 2457T
aaaaagagcagcugauugaaa

SEQ ID NO: 1920566 - RNA, 16 nt, Shigella flexneri 2a str. 2457T
aaaaagccaaucacaa

SEQ ID NO: 1920567 - RNA, 17 nt, Shigella flexneri 2a str. 2457T
aaaaagccaaucacaaa

SEQ ID NO: 1920568 - RNA, 19 nt, Shigella flexneri 2a str. 2457T
aaaaagccaaucacaaaaa

SEQ ID NO: 1920569 - RNA, 15 nt, Shigella flexneri 2a str. 2457T
aaaaagaaggaaaau

SEQ ID NO: 1920570 - RNA, 12 nt, Shigella flexneri 2a str. 2457T
aaaaagaacaac

SEQ ID NO: 1920571 - RNA, 13 nt, Shigella flexneri 2a str. 2457T
aaaaagaaggaaa

SEQ ID NO: 1920572 - RNA, 23 nt, Shigella flexneri 2a str. 2457T
aaaaacuugauacugaacaacuu

SEQ ID NO: 1920573 - RNA, 12 nt, Shigella flexneri 2a str. 2457T
aaaaagaaaaaa

SEQ ID NO: 1920574 - RNA, 19 nt, Shigella flexneri 2a str. 2457T
aaaaaggcugacaaaucag

SEQ ID NO: 1920575 - RNA, 19 nt, Shigella flexneri 2a str. 2457T
aaaaaggcgaaaggcuggc

SEQ ID NO: 1920576 - RNA, 21 nt, Shigella flexneri 2a str. 2457T
aaaaaggugagucgcaaaacu

SEQ ID NO: 1920577 - RNA, 22 nt, Shigella flexneri 2a str. 2457T
aaaaaguagggcugauaaacaa

SEQ ID NO: 1920578 - RNA, 17 nt, Shigella flexneri 2a str. 2457T
aaaaaguaguuccagca

SEQ ID NO: 1920579 - RNA, 18 nt, Shigella flexneri 2a str. 2457T
aaaaaguccaaaaggucc

SEQ ID NO: 1920580 - RNA, 18 nt, Shigella flexneri 2a str. 2457T
aaaaagcguauccugacg

SEQ ID NO: 1920581 - RNA, 19 nt, Shigella flexneri 2a str. 2457T
aaaaagcguauccugacgg

SEQ ID NO: 1920582 - RNA, 16 nt, Shigella flexneri 2a str. 2457T
aaaaagccuaagaagu

SEQ ID NO: 1920583 - RNA, 14 nt, Shigella flexneri 2a str. 2457T
aaaaacucauaaau

SEQ ID NO: 1920584 - RNA, 22 nt, Shigella flexneri 2a str. 2457T
aaaaacuccgccgcaucuuccc

SEQ ID NO: 1920585 - RNA, 12 nt, Shigella flexneri 2a str. 2457T
aaaaacccgccc

SEQ ID NO: 1920586 - RNA, 22 nt, Shigella flexneri 2a str. 2457T
aaaaaccuccggcguuucagau

SEQ ID NO: 1920587 - RNA, 20 nt, Shigella flexneri 2a str. 2457T
aaaaacacugggaugaaagu

SEQ ID NO: 1920588 - RNA, 23 nt, Shigella flexneri 2a str. 2457T
aaaaacaccccauugccccaugu

SEQ ID NO: 1920589 - RNA, 13 nt, Shigella flexneri 2a str. 2457T
aaaaaccugaccu

SEQ ID NO: 1920590 - RNA, 22 nt, Shigella flexneri 2a str. 2457T
aaaaacgccagcaacacauagu

SEQ ID NO: 1920591 - RNA, 13 nt, Shigella flexneri 2a str. 2457T
aaaaacuaauuca

SEQ ID NO: 1920592 - RNA, 14 nt, Shigella flexneri 2a str. 2457T
aaaaccgaggggcu

SEQ ID NO: 1920593 - RNA, 19 nt, Shigella flexneri 2a str. 2457T
aaaacccaacguuacucua

SEQ ID NO: 1920594 - RNA, 15 nt, Shigella flexneri 2a str. 2457T
aaaaccccaaaaaga

SEQ ID NO: 1920595 - RNA, 14 nt, Shigella flexneri 2a str. 2457T
aaaaccaguaauga

SEQ ID NO: 1920596 - RNA, 21 nt, Shigella flexneri 2a str. 2457T
aaaaccugaccuagcaaacua

SEQ ID NO: 1920597 - RNA, 17 nt, Shigella flexneri 2a str. 2457T
aaaaccucucuggaaga

SEQ ID NO: 1920598 - RNA, 20 nt, Shigella flexneri 2a str. 2457T
aaaaccucucuggaagaggc

SEQ ID NO: 1920599 - RNA, 13 nt, Shigella flexneri 2a str. 2457T
aaaaccucuucca

SEQ ID NO: 1920600 - RNA, 19 nt, Shigella flexneri 2a str. 2457T
aaaaccucuuccagcagau

SEQ ID NO: 1920601 - RNA, 18 nt, Shigella flexneri 2a str. 2457T
aaaaccgccucaggcaac

SEQ ID NO: 1920602 - RNA, 14 nt, Shigella flexneri 2a str. 2457T
aaaacagccagcgc

SEQ ID NO: 1920603 - RNA, 12 nt, Shigella flexneri 2a str. 2457T
aaaacagccccu

SEQ ID NO: 1920604 - RNA, 22 nt, Shigella flexneri 2a str. 2457T
aaaacagcgcaccagaaacaau

SEQ ID NO: 1920605 - RNA, 15 nt, Shigella flexneri 2a str. 2457T
aaaacaacgagccaa

SEQ ID NO: 1920606 - RNA, 20 nt, Shigella flexneri 2a str. 2457T
aaaacaacggaacgaaaaaa

SEQ ID NO: 1920607 - RNA, 22 nt, Shigella flexneri 2a str. 2457T
aaaacaacggaacgaaaaaaau

SEQ ID NO: 1920608 - RNA, 16 nt, Shigella flexneri 2a str. 2457T
aaaacaggcagcugcc

SEQ ID NO: 1920609 - RNA, 20 nt, Shigella flexneri 2a str. 2457T
aaaacaguaccagaccaaca

SEQ ID NO: 1920610 - RNA, 13 nt, Shigella flexneri 2a str. 2457T
aaaaccagagaau

SEQ ID NO: 1920611 - RNA, 22 nt, Shigella flexneri 2a str. 2457T
aaaaccagaaagggaagaacau

SEQ ID NO: 1920612 - RNA, 22 nt, Shigella flexneri 2a str. 2457T
aaaaccacacuucuucagccag

SEQ ID NO: 1920613 - RNA, 20 nt, Shigella flexneri 2a str. 2457T
aaaacauacccaguuucaug

SEQ ID NO: 1920614 - RNA, 14 nt, Shigella flexneri 2a str. 2457T
aaaaagucccuucc

SEQ ID NO: 1920615 - RNA, 17 nt, Shigella flexneri 2a str. 2457T
aaaaagugcuuucugaa

SEQ ID NO: 1920616 - RNA, 22 nt, Shigella flexneri 2a str. 2457T
aaaaaguugcagcgucaucaac

SEQ ID NO: 1920617 - RNA, 13 nt, Shigella flexneri 2a str. 2457T
aaaaaucaauaaa

SEQ ID NO: 1920618 - RNA, 14 nt, Shigella flexneri 2a str. 2457T
aaaaaucaauauau

SEQ ID NO: 1920619 - RNA, 14 nt, Shigella flexneri 2a str. 2457T
aaaaaucaaaaaac

SEQ ID NO: 1920620 - RNA, 17 nt, Shigella flexneri 2a str. 2457T
aaaaaucacauaaauuc

SEQ ID NO: 1920621 - RNA, 22 nt, Shigella flexneri 2a str. 2457T
aaaaaucgugcugcaauaaaca

SEQ ID NO: 1920622 - RNA, 17 nt, Shigella flexneri 2a str. 2457T
aaaaauggcuuuauucg

SEQ ID NO: 1920623 - RNA, 22 nt, Shigella flexneri 2a str. 2457T
aaaaauggccagacauuauaaa

SEQ ID NO: 1920624 - RNA, 18 nt, Shigella flexneri 2a str. 2457T
aaaaaugcccgauaagca

SEQ ID NO: 1920625 - RNA, 21 nt, Shigella flexneri 2a str. 2457T
aaaaaugcccgauaagcaaaa

SEQ ID NO: 1920626 - RNA, 20 nt, Shigella flexneri 2a str. 2457T
aaaaaugaccgggcuugaaa

SEQ ID NO: 1920627 - RNA, 22 nt, Shigella flexneri 2a str. 2457T
aaaaaugugcccggacaguccc

SEQ ID NO: 1920628 - RNA, 15 nt, Shigella flexneri 2a str. 2457T
aaacccgccagacca

SEQ ID NO: 1920629 - RNA, 11 nt, Shigella flexneri 2a str. 2457T
aaacccgcuca

SEQ ID NO: 1920630 - RNA, 15 nt, Shigella flexneri 2a str. 2457T
aaacccgcaggcgca

SEQ ID NO: 1920631 - RNA, 16 nt, Shigella flexneri 2a str. 2457T
aaacccggccacagcg

SEQ ID NO: 1920632 - RNA, 20 nt, Shigella flexneri 2a str. 2457T
aaacccggggcgguucaaau

SEQ ID NO: 1920633 - RNA, 18 nt, Shigella flexneri 2a str. 2457T
aaacccgauuuuuaaauu

SEQ ID NO: 1920634 - RNA, 22 nt, Shigella flexneri 2a str. 2457T
aaaccaugacgcacuuucgcuu

SEQ ID NO: 1920635 - RNA, 19 nt, Shigella flexneri 2a str. 2457T
aaaccagcccugguuuauc

SEQ ID NO: 1920636 - RNA, 19 nt, Shigella flexneri 2a str. 2457T
aaaccagcaaacaggugcu

SEQ ID NO: 1920637 - RNA, 24 nt, Shigella flexneri 2a str. 2457T
aaaccagcaaccaacgccagcagc

SEQ ID NO: 1920638 - RNA, 15 nt, Shigella flexneri 2a str. 2457T
aaaccagagaauauu

SEQ ID NO: 1920639 - RNA, 21 nt, Shigella flexneri 2a str. 2457T
aaaccagaaagggaagaacau

SEQ ID NO: 1920640 - RNA, 17 nt, Shigella flexneri 2a str. 2457T
aaaccagacagcacauu

SEQ ID NO: 1920641 - RNA, 14 nt, Shigella flexneri 2a str. 2457T
aaaccgaccaauca

SEQ ID NO: 1920642 - RNA, 13 nt, Shigella flexneri 2a str. 2457T
aaaccgacugccu

SEQ ID NO: 1920643 - RNA, 14 nt, Shigella flexneri 2a str. 2457T
aaaccgacuuaaaa

SEQ ID NO: 1920644 - RNA, 20 nt, Shigella flexneri 2a str. 2457T
aaaccgaugcagugcggcug

SEQ ID NO: 1920645 - RNA, 23 nt, Shigella flexneri 2a str. 2457T
aaaccgaaguuguagcuggcuuc

SEQ ID NO: 1920646 - RNA, 21 nt, Shigella flexneri 2a str. 2457T
aaacccgugugguaaaguuug

SEQ ID NO: 1920647 - RNA, 23 nt, Shigella flexneri 2a str. 2457T
aaaccguaaguaagauaaaagca

SEQ ID NO: 1920648 - RNA, 18 nt, Shigella flexneri 2a str. 2457T
aaaccgggagaacauugg

SEQ ID NO: 1920649 - RNA, 19 nt, Shigella flexneri 2a str. 2457T
aaaccgcucgugggcaucg

SEQ ID NO: 1920650 - RNA, 17 nt, Shigella flexneri 2a str. 2457T
aaaccggauacccugcc

SEQ ID NO: 1920651 - RNA, 19 nt, Shigella flexneri 2a str. 2457T
aaaccgccucaggcaacau

SEQ ID NO: 1920652 - RNA, 20 nt, Shigella flexneri 2a str. 2457T
aaaccaaacuuaugcagcug

SEQ ID NO: 1920653 - RNA, 20 nt, Shigella flexneri 2a str. 2457T
aaacauuuuugcagaaacau

SEQ ID NO: 1920654 - RNA, 16 nt, Shigella flexneri 2a str. 2457T
aaaccacuuaauuauu

SEQ ID NO: 1920655 - RNA, 20 nt, Shigella flexneri 2a str. 2457T
aaaccacuuaauuauuaaca

SEQ ID NO: 1920656 - RNA, 21 nt, Shigella flexneri 2a str. 2457T
aaaccacuuaauuauuaacaa

SEQ ID NO: 1920657 - RNA, 14 nt, Shigella flexneri 2a str. 2457T
aaaccacugacaca

SEQ ID NO: 1920658 - RNA, 17 nt, Shigella flexneri 2a str. 2457T
aaaccaccacuccccuc

SEQ ID NO: 1920659 - RNA, 19 nt, Shigella flexneri 2a str. 2457T
aaacaugccaacaaaaucu

SEQ ID NO: 1920660 - RNA, 17 nt, Shigella flexneri 2a str. 2457T
aaacaucgggacaugau

SEQ ID NO: 1920661 - RNA, 14 nt, Shigella flexneri 2a str. 2457T
aaacauuagcgcau

SEQ ID NO: 1920662 - RNA, 15 nt, Shigella flexneri 2a str. 2457T
aaacauugcugccag

SEQ ID NO: 1920663 - RNA, 15 nt, Shigella flexneri 2a str. 2457T
aaacauuaaaauucu

SEQ ID NO: 1920664 - RNA, 22 nt, Shigella flexneri 2a str. 2457T
aaacaaguucuucgaagcacuc

SEQ ID NO: 1920665 - RNA, 11 nt, Shigella flexneri 2a str. 2457T
aaacaauaugu

SEQ ID NO: 1920666 - RNA, 21 nt, Shigella flexneri 2a str. 2457T
aaacaauaauuaucauuaaaa

SEQ ID NO: 1920667 - RNA, 13 nt, Shigella flexneri 2a str. 2457T
aaacaauacgauc

SEQ ID NO: 1920668 - RNA, 12 nt, Shigella flexneri 2a str. 2457T
aaacaauaauug

SEQ ID NO: 1920669 - RNA, 18 nt, Shigella flexneri 2a str. 2457T
aaacaauguucaucugca

SEQ ID NO: 1920670 - RNA, 15 nt, Shigella flexneri 2a str. 2457T
aaaauuggcuucguu

SEQ ID NO: 1920671 - RNA, 14 nt, Shigella flexneri 2a str. 2457T
aaacacaaaguccu

SEQ ID NO: 1920672 - RNA, 21 nt, Shigella flexneri 2a str. 2457T
aaacacaucaaugaugaacgc

SEQ ID NO: 1920673 - RNA, 12 nt, Shigella flexneri 2a str. 2457T
aaacaccagcaa

SEQ ID NO: 1920674 - RNA, 19 nt, Shigella flexneri 2a str. 2457T
aaacacucuccaggaaacc

SEQ ID NO: 1920675 - RNA, 16 nt, Shigella flexneri 2a str. 2457T
aaacacugaaccgaaa

SEQ ID NO: 1920676 - RNA, 17 nt, Shigella flexneri 2a str. 2457T
aaacacgcgaccaaagg

SEQ ID NO: 1920677 - RNA, 15 nt, Shigella flexneri 2a str. 2457T
aaacacgacaugacc

SEQ ID NO: 1920678 - RNA, 22 nt, Shigella flexneri 2a str. 2457T
aaacagguaaagaccauaaaua

SEQ ID NO: 1920679 - RNA, 18 nt, Shigella flexneri 2a str. 2457T
aaacagugauuacuaaau

SEQ ID NO: 1920680 - RNA, 17 nt, Shigella flexneri 2a str. 2457T
aaacagggcaauuaaaa

SEQ ID NO: 1920681 - RNA, 21 nt, Shigella flexneri 2a str. 2457T
aaacaggcgacgcguccgguu

SEQ ID NO: 1920682 - RNA, 22 nt, Shigella flexneri 2a str. 2457T
aaacaggucuguaugacaacaa

SEQ ID NO: 1920683 - RNA, 21 nt, Shigella flexneri 2a str. 2457T
aaacaguacgagagaagagac

SEQ ID NO: 1920684 - RNA, 19 nt, Shigella flexneri 2a str. 2457T
aaacaucaccaaugaaagc

SEQ ID NO: 1920685 - RNA, 12 nt, Shigella flexneri 2a str. 2457T
aaacaucaaacc

SEQ ID NO: 1920686 - RNA, 17 nt, Shigella flexneri 2a str. 2457T
aaacaguuucugcagcu

SEQ ID NO: 1920687 - RNA, 20 nt, Shigella flexneri 2a str. 2457T
aaacauaaucaauaaaaaua

SEQ ID NO: 1920688 - RNA, 21 nt, Shigella flexneri 2a str. 2457T
aaacauaaucaauaaaaauac

SEQ ID NO: 1920689 - RNA, 12 nt, Shigella flexneri 2a str. 2457T
aaacaggaucug

SEQ ID NO: 1920690 - RNA, 12 nt, Shigella flexneri 2a str. 2457T
aaacaggaacac

SEQ ID NO: 1920691 - RNA, 15 nt, Shigella flexneri 2a str. 2457T
aaacaggaacaccag

SEQ ID NO: 1920692 - RNA, 17 nt, Shigella flexneri 2a str. 2457T
aaacaggaacaccagca

SEQ ID NO: 1920693 - RNA, 22 nt, Shigella flexneri 2a str. 2457T
aaacagcccaaucaucgcggca

SEQ ID NO: 1920694 - RNA, 22 nt, Shigella flexneri 2a str. 2457T
aaacagcgcaccagaaacaaua

SEQ ID NO: 1920695 - RNA, 16 nt, Shigella flexneri 2a str. 2457T
aaacagcgcugcgaaa

SEQ ID NO: 1920696 - RNA, 23 nt, Shigella flexneri 2a str. 2457T
aaacagccagcagcgaaucagcc

SEQ ID NO: 1920697 - RNA, 12 nt, Shigella flexneri 2a str. 2457T
aaacagccaacu

SEQ ID NO: 1920698 - RNA, 21 nt, Shigella flexneri 2a str. 2457T
aaacagcaaagcgugcaaaua

SEQ ID NO: 1920699 - RNA, 13 nt, Shigella flexneri 2a str. 2457T
aaacagaaauuca

SEQ ID NO: 1920700 - RNA, 14 nt, Shigella flexneri 2a str. 2457T
aaaaacuuuuguau

SEQ ID NO: 1920701 - RNA, 12 nt, Shigella flexneri 2a str. 2457T
aaaaagaaaguu

SEQ ID NO: 1920702 - RNA, 16 nt, Shigella flexneri 2a str. 2457T
aaaaacuugauacuga

SEQ ID NO: 1920703 - RNA, 21 nt, Shigella flexneri 2a str. 2457T
aaaacgaccaccuucaacguu

SEQ ID NO: 1920704 - RNA, 17 nt, Shigella flexneri 2a str. 2457T
aaaacgccgccagcuca

SEQ ID NO: 1920705 - RNA, 19 nt, Shigella flexneri 2a str. 2457T
aaaacgcagucuucccagc

SEQ ID NO: 1920706 - RNA, 22 nt, Shigella flexneri 2a str. 2457T
aaaacgccggagugaaaauucu

SEQ ID NO: 1920707 - RNA, 13 nt, Shigella flexneri 2a str. 2457T
aaaacgccugcuc

SEQ ID NO: 1920708 - RNA, 17 nt, Shigella flexneri 2a str. 2457T
aaaauaaaucaaaguca

SEQ ID NO: 1920709 - RNA, 18 nt, Shigella flexneri 2a str. 2457T
aaaauaaccaaauaaaau

SEQ ID NO: 1920710 - RNA, 21 nt, Shigella flexneri 2a str. 2457T
aaaauaacuuaaugucauaca

SEQ ID NO: 1920711 - RNA, 17 nt, Shigella flexneri 2a str. 2457T
aaaaggcgcuaaaaaua

SEQ ID NO: 1920712 - RNA, 16 nt, Shigella flexneri 2a str. 2457T
aaaaggcguucacgcc

SEQ ID NO: 1920713 - RNA, 18 nt, Shigella flexneri 2a str. 2457T
aaaagguaggccugauaa

SEQ ID NO: 1920714 - RNA, 16 nt, Shigella flexneri 2a str. 2457T
aaaauggccagccagc

SEQ ID NO: 1920715 - RNA, 22 nt, Shigella flexneri 2a str. 2457T
aaaauggcuuuauucgcuuaau

SEQ ID NO: 1920716 - RNA, 13 nt, Shigella flexneri 2a str. 2457T
aaaauggucagcc

SEQ ID NO: 1920717 - RNA, 14 nt, Shigella flexneri 2a str. 2457T
aaaauguugucauu

SEQ ID NO: 1920718 - RNA, 21 nt, Shigella flexneri 2a str. 2457T
aaaauguugucauuacaacaa

SEQ ID NO: 1920719 - RNA, 23 nt, Shigella flexneri 2a str. 2457T
aaaauguuuaugccugguugagu

SEQ ID NO: 1920720 - RNA, 15 nt, Shigella flexneri 2a str. 2457T
aaaaugugaugccua

SEQ ID NO: 1920721 - RNA, 22 nt, Shigella flexneri 2a str. 2457T
aaaauucuacagaaaugaaaaa

SEQ ID NO: 1920722 - RNA, 12 nt, Shigella flexneri 2a str. 2457T
aaaauuacaaaa

SEQ ID NO: 1920723 - RNA, 22 nt, Shigella flexneri 2a str. 2457T
aaaauaucguaggccugcucaa

SEQ ID NO: 1920724 - RNA, 12 nt, Shigella flexneri 2a str. 2457T
aaaauacacuuu

SEQ ID NO: 1920725 - RNA, 17 nt, Shigella flexneri 2a str. 2457T
aaaauacaauucucagc

SEQ ID NO: 1920726 - RNA, 13 nt, Shigella flexneri 2a str. 2457T
aaaauaucacucg

SEQ ID NO: 1920727 - RNA, 12 nt, Shigella flexneri 2a str. 2457T
aaaauacaugac

SEQ ID NO: 1920728 - RNA, 15 nt, Shigella flexneri 2a str. 2457T
aaaauaccaccaaug

SEQ ID NO: 1920729 - RNA, 12 nt, Shigella flexneri 2a str. 2457T
aaaauaccaaua

SEQ ID NO: 1920730 - RNA, 14 nt, Shigella flexneri 2a str. 2457T
aaaaucuucguuau

SEQ ID NO: 1920731 - RNA, 22 nt, Shigella flexneri 2a str. 2457T
aaaaucugcgggaacauaugca

SEQ ID NO: 1920732 - RNA, 14 nt, Shigella flexneri 2a str. 2457T
aaaaucaaaaaacu

SEQ ID NO: 1920733 - RNA, 13 nt, Shigella flexneri 2a str. 2457T
aaaaucaaaauaa

SEQ ID NO: 1920734 - RNA, 15 nt, Shigella flexneri 2a str. 2457T
aaaaucaugcaauaa

SEQ ID NO: 1920735 - RNA, 17 nt, Shigella flexneri 2a str. 2457T
aaaaucaucaauugcca

SEQ ID NO: 1920736 - RNA, 16 nt, Shigella flexneri 2a str. 2457T
aaagcgccagggcuua

SEQ ID NO: 1920737 - RNA, 23 nt, Shigella flexneri 2a str. 2457T
aaagcgcaggccaacagucuuaa

SEQ ID NO: 1920738 - RNA, 21 nt, Shigella flexneri 2a str. 2457T
aaagcgcacuuugucaaaaau

SEQ ID NO: 1920739 - RNA, 21 nt, Shigella flexneri 2a str. 2457T
aaagcgagcaguacagccgcc

SEQ ID NO: 1920740 - RNA, 20 nt, Shigella flexneri 2a str. 2457T
aaagcgcgguuucaauuucc

SEQ ID NO: 1920741 - RNA, 20 nt, Shigella flexneri 2a str. 2457T
aaagcggaacugaagcugau

SEQ ID NO: 1920742 - RNA, 16 nt, Shigella flexneri 2a str. 2457T
aaagcggcccuuuuuu

SEQ ID NO: 1920743 - RNA, 23 nt, Shigella flexneri 2a str. 2457T
aaagcgucaaguugacucucauc

SEQ ID NO: 1920744 - RNA, 14 nt, Shigella flexneri 2a str. 2457T
aaagcguauuaugc

SEQ ID NO: 1920745 - RNA, 14 nt, Shigella flexneri 2a str. 2457T
aaagcucccuaaaa

SEQ ID NO: 1920746 - RNA, 23 nt, Shigella flexneri 2a str. 2457T
aaagcaguaaggucaucaaucau

SEQ ID NO: 1920747 - RNA, 20 nt, Shigella flexneri 2a str. 2457T
aaagcaggcgauuuacuggc

SEQ ID NO: 1920748 - RNA, 22 nt, Shigella flexneri 2a str. 2457T
aaagcaggcuggaguuacccag

SEQ ID NO: 1920749 - RNA, 12 nt, Shigella flexneri 2a str. 2457T
aaagccugcuuc

SEQ ID NO: 1920750 - RNA, 22 nt, Shigella flexneri 2a str. 2457T
aaagccuguaacgccuuuucca

SEQ ID NO: 1920751 - RNA, 23 nt, Shigella flexneri 2a str. 2457T
aaagccucucgcgaggagaggcc

SEQ ID NO: 1920752 - RNA, 13 nt, Shigella flexneri 2a str. 2457T
aaagccuuucacu

SEQ ID NO: 1920753 - RNA, 19 nt, Shigella flexneri 2a str. 2457T
aaagcgacuuugccuggcg

SEQ ID NO: 1920754 - RNA, 21 nt, Shigella flexneri 2a str. 2457T
aaaggcgagguauaaaaugag

SEQ ID NO: 1920755 - RNA, 15 nt, Shigella flexneri 2a str. 2457T
aaaggaucaaccgaa

SEQ ID NO: 1920756 - RNA, 13 nt, Shigella flexneri 2a str. 2457T
aaaggauguuuau

SEQ ID NO: 1920757 - RNA, 21 nt, Shigella flexneri 2a str. 2457T
aaagcugcauacggugaaagu

SEQ ID NO: 1920758 - RNA, 15 nt, Shigella flexneri 2a str. 2457T
aaagggucagggaga

SEQ ID NO: 1920759 - RNA, 22 nt, Shigella flexneri 2a str. 2457T
aaaggcugacaaaucagaggcu

SEQ ID NO: 1920760 - RNA, 15 nt, Shigella flexneri 2a str. 2457T
aaagguaauggucag

SEQ ID NO: 1920761 - RNA, 20 nt, Shigella flexneri 2a str. 2457T
aaaggcggcagaacagaaca

SEQ ID NO: 1920762 - RNA, 18 nt, Shigella flexneri 2a str. 2457T
aaaggcggcagaacagaa

SEQ ID NO: 1920763 - RNA, 18 nt, Shigella flexneri 2a str. 2457T
aaaguaagaauugauaaa

SEQ ID NO: 1920764 - RNA, 19 nt, Shigella flexneri 2a str. 2457T
aaaguaacugacaguagcc

SEQ ID NO: 1920765 - RNA, 20 nt, Shigella flexneri 2a str. 2457T
aaaguaaaccagagagaagc

SEQ ID NO: 1920766 - RNA, 13 nt, Shigella flexneri 2a str. 2457T
aaaguaacaccau

SEQ ID NO: 1920767 - RNA, 21 nt, Shigella flexneri 2a str. 2457T
aaaggugaacaucgcagggaa

SEQ ID NO: 1920768 - RNA, 19 nt, Shigella flexneri 2a str. 2457T
aaagaagcggugaaaaaau

SEQ ID NO: 1920769 - RNA, 11 nt, Shigella flexneri 2a str. 2457T
aaagaaaagau

SEQ ID NO: 1920770 - RNA, 11 nt, Shigella flexneri 2a str. 2457T
aaagaaaaucu

SEQ ID NO: 1920771 - RNA, 16 nt, Shigella flexneri 2a str. 2457T
aaagaaaaucugaauu

SEQ ID NO: 1920772 - RNA, 14 nt, Shigella flexneri 2a str. 2457T
aaaccguauccauc

SEQ ID NO: 1920773 - RNA, 17 nt, Shigella flexneri 2a str. 2457T
aaaccgucagcaccagg

SEQ ID NO: 1920774 - RNA, 19 nt, Shigella flexneri 2a str. 2457T
aaaccguguuuaugaaagu

SEQ ID NO: 1920775 - RNA, 15 nt, Shigella flexneri 2a str. 2457T
aaaccucacgcaucc

SEQ ID NO: 1920776 - RNA, 19 nt, Shigella flexneri 2a str. 2457T
aaaccucacgcauccucua

SEQ ID NO: 1920777 - RNA, 23 nt, Shigella flexneri 2a str. 2457T
aaaccucguccuguugaaaaacc

SEQ ID NO: 1920778 - RNA, 17 nt, Shigella flexneri 2a str. 2457T
aaaccuccagcaucaga

SEQ ID NO: 1920779 - RNA, 16 nt, Shigella flexneri 2a str. 2457T
aaaccuccgcaaugcg

SEQ ID NO: 1920780 - RNA, 21 nt, Shigella flexneri 2a str. 2457T
aaagauuacugacaauuugcc

SEQ ID NO: 1920781 - RNA, 23 nt, Shigella flexneri 2a str. 2457T
aaagauuauugcuugaucaggaa

SEQ ID NO: 1920782 - RNA, 17 nt, Shigella flexneri 2a str. 2457T
aaagauuaaaaaaacac

SEQ ID NO: 1920783 - RNA, 23 nt, Shigella flexneri 2a str. 2457T
aaagauggauugcugaaauacag

SEQ ID NO: 1920784 - RNA, 23 nt, Shigella flexneri 2a str. 2457T
aaagauggcgcgcagaaagaggc

SEQ ID NO: 1920785 - RNA, 16 nt, Shigella flexneri 2a str. 2457T
aaagauggcggcgaau

SEQ ID NO: 1920786 - RNA, 13 nt, Shigella flexneri 2a str. 2457T
aaagcaaauuuug

SEQ ID NO: 1920787 - RNA, 12 nt, Shigella flexneri 2a str. 2457T
aaagauugaauu

SEQ ID NO: 1920788 - RNA, 12 nt, Shigella flexneri 2a str. 2457T
aaagcaacucca

SEQ ID NO: 1920789 - RNA, 17 nt, Shigella flexneri 2a str. 2457T
aaagcaauuccagcgcc

SEQ ID NO: 1920790 - RNA, 14 nt, Shigella flexneri 2a str. 2457T
aaagcaauuccagc

SEQ ID NO: 1920791 - RNA, 16 nt, Shigella flexneri 2a str. 2457T
aaagaguaaaguuagu

SEQ ID NO: 1920792 - RNA, 19 nt, Shigella flexneri 2a str. 2457T
aaagagucggcgcugaaau

SEQ ID NO: 1920793 - RNA, 22 nt, Shigella flexneri 2a str. 2457T
aaagaucugcgugaguuuuugu

SEQ ID NO: 1920794 - RNA, 17 nt, Shigella flexneri 2a str. 2457T
aaagaucgaucauuuuu

SEQ ID NO: 1920795 - RNA, 15 nt, Shigella flexneri 2a str. 2457T
aaagaucgccacugc

SEQ ID NO: 1920796 - RNA, 23 nt, Shigella flexneri 2a str. 2457T
aaagacaucgcccgauucacaua

SEQ ID NO: 1920797 - RNA, 13 nt, Shigella flexneri 2a str. 2457T
aaagacaucaaac

SEQ ID NO: 1920798 - RNA, 20 nt, Shigella flexneri 2a str. 2457T
aaauagcaaaguaauaauga

SEQ ID NO: 1920799 - RNA, 12 nt, Shigella flexneri 2a str. 2457T
aaauagcaaagu

SEQ ID NO: 1920800 - RNA, 14 nt, Shigella flexneri 2a str. 2457T
aaauagcaaaguaa

SEQ ID NO: 1920801 - RNA, 15 nt, Shigella flexneri 2a str. 2457T
aaauagcaaaguaau

SEQ ID NO: 1920802 - RNA, 13 nt, Shigella flexneri 2a str. 2457T
aaauauaaaacaa

SEQ ID NO: 1920803 - RNA, 16 nt, Shigella flexneri 2a str. 2457T
aaauauaaaacaacgg

SEQ ID NO: 1920804 - RNA, 22 nt, Shigella flexneri 2a str. 2457T
aaauauauuccccggucagcag

SEQ ID NO: 1920805 - RNA, 11 nt, Shigella flexneri 2a str. 2457T
aaauauauccu

SEQ ID NO: 1920806 - RNA, 23 nt, Shigella flexneri 2a str. 2457T
aaauaucaaagacaaauuuugaa

SEQ ID NO: 1920807 - RNA, 13 nt, Shigella flexneri 2a str. 2457T
aaauaucuuauag

SEQ ID NO: 1920808 - RNA, 19 nt, Shigella flexneri 2a str. 2457T
aaauagaauggcaucagaa

SEQ ID NO: 1920809 - RNA, 14 nt, Shigella flexneri 2a str. 2457T
aaauaccguucauu

SEQ ID NO: 1920810 - RNA, 20 nt, Shigella flexneri 2a str. 2457T
aaauaccggacacacuucau

SEQ ID NO: 1920811 - RNA, 11 nt, Shigella flexneri 2a str. 2457T
aaauacaugac

SEQ ID NO: 1920812 - RNA, 14 nt, Shigella flexneri 2a str. 2457T
aaauacccaaaaaa

SEQ ID NO: 1920813 - RNA, 22 nt, Shigella flexneri 2a str. 2457T
aaauacccaaaaaauagcaaag

SEQ ID NO: 1920814 - RNA, 14 nt, Shigella flexneri 2a str. 2457T
aaauacaauucuca

SEQ ID NO: 1920815 - RNA, 12 nt, Shigella flexneri 2a str. 2457T
aaauacaccuua

SEQ ID NO: 1920816 - RNA, 18 nt, Shigella flexneri 2a str. 2457T
aaauacagcaauggaaaa

SEQ ID NO: 1920817 - RNA, 23 nt, Shigella flexneri 2a str. 2457T
aaauaaugcgacaacagaaauaa

SEQ ID NO: 1920818 - RNA, 19 nt, Shigella flexneri 2a str. 2457T
aaauaaauaccguucauua

SEQ ID NO: 1920819 - RNA, 22 nt, Shigella flexneri 2a str. 2457T
aaauaaaucaaagucagaucaa

SEQ ID NO: 1920820 - RNA, 13 nt, Shigella flexneri 2a str. 2457T
aaauaaugcagcg

SEQ ID NO: 1920821 - RNA, 13 nt, Shigella flexneri 2a str. 2457T
aaauaauuuuaaa

SEQ ID NO: 1920822 - RNA, 21 nt, Shigella flexneri 2a str. 2457T
aaaguugcauuagcacaaacc

SEQ ID NO: 1920823 - RNA, 15 nt, Shigella flexneri 2a str. 2457T
aaaguuuaauugcca

SEQ ID NO: 1920824 - RNA, 13 nt, Shigella flexneri 2a str. 2457T
aaaguuauaaaua

SEQ ID NO: 1920825 - RNA, 17 nt, Shigella flexneri 2a str. 2457T
aaaguuaccuucgaaga

SEQ ID NO: 1920826 - RNA, 19 nt, Shigella flexneri 2a str. 2457T
aaaguucguuggauauuuu

SEQ ID NO: 1920827 - RNA, 17 nt, Shigella flexneri 2a str. 2457T
aaauaaaaagagauugu

SEQ ID NO: 1920828 - RNA, 18 nt, Shigella flexneri 2a str. 2457T
aaauaaacuuacugacau

SEQ ID NO: 1920829 - RNA, 18 nt, Shigella flexneri 2a str. 2457T
aaaguuuuucaacaccau

SEQ ID NO: 1920830 - RNA, 14 nt, Shigella flexneri 2a str. 2457T
aaaguuugcaacuu

SEQ ID NO: 1920831 - RNA, 23 nt, Shigella flexneri 2a str. 2457T
aaagugccgccagcuucgcuucc

SEQ ID NO: 1920832 - RNA, 14 nt, Shigella flexneri 2a str. 2457T
aaaguggaaaaaua

SEQ ID NO: 1920833 - RNA, 20 nt, Shigella flexneri 2a str. 2457T
aaaguggaaaaauaacaaau

SEQ ID NO: 1920834 - RNA, 20 nt, Shigella flexneri 2a str. 2457T
aaaguggcggggaucacucc

SEQ ID NO: 1920835 - RNA, 18 nt, Shigella flexneri 2a str. 2457T
aaaguguggggauaacua

SEQ ID NO: 1920836 - RNA, 14 nt, Shigella flexneri 2a str. 2457T
aaaguguugcagga

SEQ ID NO: 1920837 - RNA, 21 nt, Shigella flexneri 2a str. 2457T
aaaguguuccaucgcguuggu

SEQ ID NO: 1920838 - RNA, 21 nt, Shigella flexneri 2a str. 2457T
aaagugacacaaucaaauccu

SEQ ID NO: 1920839 - RNA, 16 nt, Shigella flexneri 2a str. 2457T
aaagugagcuuuguuc

SEQ ID NO: 1920840 - RNA, 16 nt, Shigella flexneri 2a str. 2457T
aaagugaauacagaac

SEQ ID NO: 1920841 - RNA, 17 nt, Shigella flexneri 2a str. 2457T
aaagugaauacagaaca

SEQ ID NO: 1920842 - RNA, 13 nt, Shigella flexneri 2a str. 2457T
aaagugaaaaaca

SEQ ID NO: 1920843 - RNA, 13 nt, Shigella flexneri 2a str. 2457T
aaagucuccuuug

SEQ ID NO: 1920844 - RNA, 19 nt, Shigella flexneri 2a str. 2457T
aaagucguaggccugauaa

SEQ ID NO: 1920845 - RNA, 18 nt, Shigella flexneri 2a str. 2457T
aaaguacuucacaaucag

SEQ ID NO: 1920846 - RNA, 17 nt, Shigella flexneri 2a str. 2457T
aaaguagaaauuauuuc

SEQ ID NO: 1920847 - RNA, 17 nt, Shigella flexneri 2a str. 2457T
aaaguaaucaagcccug

SEQ ID NO: 1920848 - RNA, 14 nt, Shigella flexneri 2a str. 2457T
aaaguagcggccug

SEQ ID NO: 1920849 - RNA, 17 nt, Shigella flexneri 2a str. 2457T
aaaguagggcugauaaa

SEQ ID NO: 1920850 - RNA, 21 nt, Shigella flexneri 2a str. 2457T
aaaguagggcugauaaacaag

SEQ ID NO: 1920851 - RNA, 18 nt, Shigella flexneri 2a str. 2457T
aaaguauauaaaaaacaa

SEQ ID NO: 1920852 - RNA, 20 nt, Shigella flexneri 2a str. 2457T
aaaguauauaaaaaacaaua

SEQ ID NO: 1920853 - RNA, 19 nt, Shigella flexneri 2a str. 2457T
aaaguagugucuaauuacc

SEQ ID NO: 1920854 - RNA, 21 nt, Shigella flexneri 2a str. 2457T
aaauuacugccuugaugaaaa

SEQ ID NO: 1920855 - RNA, 22 nt, Shigella flexneri 2a str. 2457T
aaauuacugccuugaugaaaaa

SEQ ID NO: 1920856 - RNA, 23 nt, Shigella flexneri 2a str. 2457T
aaauuacugccuugaugaaaaaa

SEQ ID NO: 1920857 - RNA, 20 nt, Shigella flexneri 2a str. 2457T
aaauuacugccuugaugaaa

SEQ ID NO: 1920858 - RNA, 16 nt, Shigella flexneri 2a str. 2457T
aaauuaggucaaagaa

SEQ ID NO: 1920859 - RNA, 22 nt, Shigella flexneri 2a str. 2457T
aaauuauagggaugcagaauga

SEQ ID NO: 1920860 - RNA, 14 nt, Shigella flexneri 2a str. 2457T
aaauuauuuuaaau

SEQ ID NO: 1920861 - RNA, 21 nt, Shigella flexneri 2a str. 2457T
aaauuauuucuuuuacauuau

SEQ ID NO: 1920862 - RNA, 15 nt, Shigella flexneri 2a str. 2457T
aaauuauuucuuuua

SEQ ID NO: 1920863 - RNA, 17 nt, Shigella flexneri 2a str. 2457T
aaaaagagauuguauuu

SEQ ID NO: 1920864 - RNA, 14 nt, Shigella flexneri 2a str. 2457T
aaaugguuuugcgu

SEQ ID NO: 1920865 - RNA, 18 nt, Shigella flexneri 2a str. 2457T
aaaugugaagaggaacaa

SEQ ID NO: 1920866 - RNA, 20 nt, Shigella flexneri 2a str. 2457T
aaaugugcaaucacaguuaa

SEQ ID NO: 1920867 - RNA, 14 nt, Shigella flexneri 2a str. 2457T
aaauguauucugaa

SEQ ID NO: 1920868 - RNA, 19 nt, Shigella flexneri 2a str. 2457T
aaaugggugucgccuucca

SEQ ID NO: 1920869 - RNA, 15 nt, Shigella flexneri 2a str. 2457T
aaaugggagcuggga

SEQ ID NO: 1920870 - RNA, 19 nt, Shigella flexneri 2a str. 2457T
aaauggcuggcuauacaca

SEQ ID NO: 1920871 - RNA, 18 nt, Shigella flexneri 2a str. 2457T
aaauggcacaauggagcu

SEQ ID NO: 1920872 - RNA, 20 nt, Shigella flexneri 2a str. 2457T
aaaugccaaauauuucuuua

SEQ ID NO: 1920873 - RNA, 23 nt, Shigella flexneri 2a str. 2457T
aaaugcaucagugacaaauuccg

SEQ ID NO: 1920874 - RNA, 20 nt, Shigella flexneri 2a str. 2457T
aaaugcaucggcauaaucau

SEQ ID NO: 1920875 - RNA, 21 nt, Shigella flexneri 2a str. 2457T
aaaugcaugcucagucacuuc

SEQ ID NO: 1920876 - RNA, 14 nt, Shigella flexneri 2a str. 2457T
aaaugauagccagg

SEQ ID NO: 1920877 - RNA, 14 nt, Shigella flexneri 2a str. 2457T
aaaucggugggcug

SEQ ID NO: 1920878 - RNA, 17 nt, Shigella flexneri 2a str. 2457T
aaaucgucgagggauuu

SEQ ID NO: 1920879 - RNA, 17 nt, Shigella flexneri 2a str. 2457T
aaaucgugaaaaaucaa

SEQ ID NO: 1920880 - RNA, 15 nt, Shigella flexneri 2a str. 2457T
aaaucgugcaaauuc

SEQ ID NO: 1920881 - RNA, 21 nt, Shigella flexneri 2a str. 2457T
aaaucuccugccaauacaaaa

SEQ ID NO: 1920882 - RNA, 16 nt, Shigella flexneri 2a str. 2457T
aaaucugaaaucauca

SEQ ID NO: 1920883 - RNA, 18 nt, Shigella flexneri 2a str. 2457T
aaaucugcgccuacggca

SEQ ID NO: 1920884 - RNA, 19 nt, Shigella flexneri 2a str. 2457T
aaaucugcccguuaaccau

SEQ ID NO: 1920885 - RNA, 16 nt, Shigella flexneri 2a str. 2457T
aaaucugcccguuaac

SEQ ID NO: 1920886 - RNA, 21 nt, Shigella flexneri 2a str. 2457T
aaaugacaaacuuagauugca

SEQ ID NO: 1920887 - RNA, 23 nt, Shigella flexneri 2a str. 2457T
aaaugacauucacgcugucggca

SEQ ID NO: 1920888 - RNA, 22 nt, Shigella flexneri 2a str. 2457T
aaaugacucgccgcuguggaua

SEQ ID NO: 1920889 - RNA, 14 nt, Shigella flexneri 2a str. 2457T
aaaugacucguuau

SEQ ID NO: 1920890 - RNA, 18 nt, Shigella flexneri 2a str. 2457T
aaaucccagugccugcau

SEQ ID NO: 1920891 - RNA, 23 nt, Shigella flexneri 2a str. 2457T
aaaucccgccgcuggcgggauuu

SEQ ID NO: 1920892 - RNA, 14 nt, Shigella flexneri 2a str. 2457T
aaaucccgccagcg

SEQ ID NO: 1920893 - RNA, 14 nt, Shigella flexneri 2a str. 2457T
aaaucccgcugaau

SEQ ID NO: 1920894 - RNA, 21 nt, Shigella flexneri 2a str. 2457T
aaauaugggugcaaugagaau

SEQ ID NO: 1920895 - RNA, 21 nt, Shigella flexneri 2a str. 2457T
aaauauggugaaaguaaaaaa

SEQ ID NO: 1920896 - RNA, 16 nt, Shigella flexneri 2a str. 2457T
aaauauuaauaauaca

SEQ ID NO: 1920897 - RNA, 18 nt, Shigella flexneri 2a str. 2457T
aaauauuaagaaaggcag

SEQ ID NO: 1920898 - RNA, 20 nt, Shigella flexneri 2a str. 2457T
aaaucgauaaaacuucccgu

SEQ ID NO: 1920899 - RNA, 22 nt, Shigella flexneri 2a str. 2457T
aaauccugccgcaguuucugau

SEQ ID NO: 1920900 - RNA, 14 nt, Shigella flexneri 2a str. 2457T
aaauccucaacaaa

SEQ ID NO: 1920901 - RNA, 16 nt, Shigella flexneri 2a str. 2457T
aaauccgcacucaucu

SEQ ID NO: 1920902 - RNA, 18 nt, Shigella flexneri 2a str. 2457T
aaauccgcacucaucuua

SEQ ID NO: 1920903 - RNA, 12 nt, Shigella flexneri 2a str. 2457T
aaaucccugauc

SEQ ID NO: 1920904 - RNA, 14 nt, Shigella flexneri 2a str. 2457T
aaauccggccagcg

SEQ ID NO: 1920905 - RNA, 21 nt, Shigella flexneri 2a str. 2457T
aaauugugauaaaaaucggca

SEQ ID NO: 1920906 - RNA, 18 nt, Shigella flexneri 2a str. 2457T
aaauuguuuuugauuuug

SEQ ID NO: 1920907 - RNA, 15 nt, Shigella flexneri 2a str. 2457T
aaauuuaauaauaag

SEQ ID NO: 1920908 - RNA, 13 nt, Shigella flexneri 2a str. 2457T
aaauuuaauaaua

SEQ ID NO: 1920909 - RNA, 17 nt, Shigella flexneri 2a str. 2457T
aaauuugcggauaaagc

SEQ ID NO: 1920910 - RNA, 23 nt, Shigella flexneri 2a str. 2457T
aaauuugcucaucgauaucgacc

SEQ ID NO: 1920911 - RNA, 16 nt, Shigella flexneri 2a str. 2457T
aaauuuggcuccucug

SEQ ID NO: 1920912 - RNA, 20 nt, Shigella flexneri 2a str. 2457T
aaauuuggcuccucugacug

SEQ ID NO: 1920913 - RNA, 18 nt, Shigella flexneri 2a str. 2457T
aaauuucuuguauuaaca

SEQ ID NO: 1920914 - RNA, 19 nt, Shigella flexneri 2a str. 2457T
aaauuucuuaccacugccg

SEQ ID NO: 1920915 - RNA, 21 nt, Shigella flexneri 2a str. 2457T
aaauuucuuaccacugccgca

SEQ ID NO: 1920916 - RNA, 18 nt, Shigella flexneri 2a str. 2457T
aaauuucuucccuuucug

SEQ ID NO: 1920917 - RNA, 16 nt, Shigella flexneri 2a str. 2457T
aaauuucuucccuuuc

SEQ ID NO: 1920918 - RNA, 12 nt, Shigella flexneri 2a str. 2457T
aaauuucuuccc

SEQ ID NO: 1920919 - RNA, 15 nt, Shigella flexneri 2a str. 2457T
aaauuucuucccuuu

SEQ ID NO: 1920920 - RNA, 16 nt, Shigella flexneri 2a str. 2457T
aaauugcugguuuugu

SEQ ID NO: 1920921 - RNA, 16 nt, Shigella flexneri 2a str. 2457T
aaauugguagaccaga

SEQ ID NO: 1920922 - RNA, 19 nt, Shigella flexneri 2a str. 2457T
aaauugucuccaccaauga

SEQ ID NO: 1920923 - RNA, 23 nt, Shigella flexneri 2a str. 2457T
aaauugcguaaagccugcuggca

SEQ ID NO: 1920924 - RNA, 17 nt, Shigella flexneri 2a str. 2457T
aaauugcguaaagccug

SEQ ID NO: 1920925 - RNA, 13 nt, Shigella flexneri 2a str. 2457T
aaauugccccaga

SEQ ID NO: 1920926 - RNA, 18 nt, Shigella flexneri 2a str. 2457T
aaauugcaccauccauuu

SEQ ID NO: 1920927 - RNA, 17 nt, Shigella flexneri 2a str. 2457T
aaauucauuaccaaccu

SEQ ID NO: 1920928 - RNA, 19 nt, Shigella flexneri 2a str. 2457T
aaauucauucaauuaauaa

SEQ ID NO: 1920929 - RNA, 22 nt, Shigella flexneri 2a str. 2457T
aaauucauucaauuaauaacac

SEQ ID NO: 1920930 - RNA, 13 nt, Shigella flexneri 2a str. 2457T
aaauuccagaaaa

SEQ ID NO: 1920931 - RNA, 13 nt, Shigella flexneri 2a str. 2457T
aaauucaaagugu

SEQ ID NO: 1920932 - RNA, 14 nt, Shigella flexneri 2a str. 2457T
aaauugaugugaaa

SEQ ID NO: 1920933 - RNA, 21 nt, Shigella flexneri 2a str. 2457T
aaauuuucagcgugcccacgu

SEQ ID NO: 1920934 - RNA, 11 nt, Shigella flexneri 2a str. 2457T
aaauuuuuccg

SEQ ID NO: 1920935 - RNA, 17 nt, Shigella flexneri 2a str. 2457T
aacaaaaaaaccgccuc

SEQ ID NO: 1920936 - RNA, 15 nt, Shigella flexneri 2a str. 2457T
aacaaagaaauguuc

SEQ ID NO: 1920937 - RNA, 18 nt, Shigella flexneri 2a str. 2457T
aacaaagaacgccauaaa

SEQ ID NO: 1920938 - RNA, 14 nt, Shigella flexneri 2a str. 2457T
aacaaagcgcaccu

SEQ ID NO: 1920939 - RNA, 18 nt, Shigella flexneri 2a str. 2457T
aacaaagcgcacuuuguc

SEQ ID NO: 1920940 - RNA, 14 nt, Shigella flexneri 2a str. 2457T
aacaaagaaauguu

SEQ ID NO: 1920941 - RNA, 19 nt, Shigella flexneri 2a str. 2457T
aacaaacgcaaaauugccu

SEQ ID NO: 1920942 - RNA, 13 nt, Shigella flexneri 2a str. 2457T
aacaaaaucuucu

SEQ ID NO: 1920943 - RNA, 21 nt, Shigella flexneri 2a str. 2457T
aacaaacagcgcgccagccac

SEQ ID NO: 1920944 - RNA, 12 nt, Shigella flexneri 2a str. 2457T
aacaaaaucgug

SEQ ID NO: 1920945 - RNA, 18 nt, Shigella flexneri 2a str. 2457T
aacaacgagccaauaaaa

SEQ ID NO: 1920946 - RNA, 21 nt, Shigella flexneri 2a str. 2457T
aacaacgugugcuuuguucau

SEQ ID NO: 1920947 - RNA, 16 nt, Shigella flexneri 2a str. 2457T
aacaacguuuuucuaa

SEQ ID NO: 1920948 - RNA, 20 nt, Shigella flexneri 2a str. 2457T
aacaacgccucguaaugcuc

SEQ ID NO: 1920949 - RNA, 18 nt, Shigella flexneri 2a str. 2457T
aacaacgcaacuccagcu

SEQ ID NO: 1920950 - RNA, 12 nt, Shigella flexneri 2a str. 2457T
aacaaauuuuuc

SEQ ID NO: 1920951 - RNA, 13 nt, Shigella flexneri 2a str. 2457T
aacaaauucacgc

SEQ ID NO: 1920952 - RNA, 17 nt, Shigella flexneri 2a str. 2457T
aacaaaguuugcaacuu

SEQ ID NO: 1920953 - RNA, 19 nt, Shigella flexneri 2a str. 2457T
aacaacaguuuuaucucca

SEQ ID NO: 1920954 - RNA, 19 nt, Shigella flexneri 2a str. 2457T
aacaacagcgauuauggau

SEQ ID NO: 1920955 - RNA, 19 nt, Shigella flexneri 2a str. 2457T
aacaacagaucaacauacu

SEQ ID NO: 1920956 - RNA, 19 nt, Shigella flexneri 2a str. 2457T
aacaacccuaaagcaccca

SEQ ID NO: 1920957 - RNA, 21 nt, Shigella flexneri 2a str. 2457T
aacaacccuaaagcacccagc

SEQ ID NO: 1920958 - RNA, 17 nt, Shigella flexneri 2a str. 2457T
caacuguugauccagga

SEQ ID NO: 1920959 - RNA, 21 nt, Shigella flexneri 2a str. 2457T
caacuucuaauuuuuccagca

SEQ ID NO: 1920960 - RNA, 20 nt, Shigella flexneri 2a str. 2457T
caacuuaacuugcuuaaaaa

SEQ ID NO: 1920961 - RNA, 23 nt, Shigella flexneri 2a str. 2457T
caacuuaacuugcuuaaaaaauc

SEQ ID NO: 1920962 - RNA, 22 nt, Shigella flexneri 2a str. 2457T
caacuguaacgcagaagguuau

SEQ ID NO: 1920963 - RNA, 12 nt, Shigella flexneri 2a str. 2457T
caacugacugac

SEQ ID NO: 1920964 - RNA, 21 nt, Shigella flexneri 2a str. 2457T
caacugacugacuucaacagg

SEQ ID NO: 1920965 - RNA, 17 nt, Shigella flexneri 2a str. 2457T
caacuccgucgcggugu

SEQ ID NO: 1920966 - RNA, 16 nt, Shigella flexneri 2a str. 2457T
caacuccagaauaccg

SEQ ID NO: 1920967 - RNA, 23 nt, Shigella flexneri 2a str. 2457T
caacuccagcuuagcauccccau

SEQ ID NO: 1920968 - RNA, 23 nt, Shigella flexneri 2a str. 2457T
caacgccuaaacuaaucgacagu

SEQ ID NO: 1920969 - RNA, 16 nt, Shigella flexneri 2a str. 2457T
caacgccccuucugcc

SEQ ID NO: 1920970 - RNA, 17 nt, Shigella flexneri 2a str. 2457T
caacgccccuucugccg

SEQ ID NO: 1920971 - RNA, 14 nt, Shigella flexneri 2a str. 2457T
caacgccaucgcca

SEQ ID NO: 1920972 - RNA, 12 nt, Shigella flexneri 2a str. 2457T
caacgcccagcg

SEQ ID NO: 1920973 - RNA, 17 nt, Shigella flexneri 2a str. 2457T
caacgcccagcgcgcgg

SEQ ID NO: 1920974 - RNA, 16 nt, Shigella flexneri 2a str. 2457T
caagacgaaaaaugaa

SEQ ID NO: 1920975 - RNA, 20 nt, Shigella flexneri 2a str. 2457T
caagacgaauaccuucuucc

SEQ ID NO: 1920976 - RNA, 15 nt, Shigella flexneri 2a str. 2457T
caagaacagccuuaa

SEQ ID NO: 1920977 - RNA, 12 nt, Shigella flexneri 2a str. 2457T
caagaaaugaca

SEQ ID NO: 1920978 - RNA, 15 nt, Shigella flexneri 2a str. 2457T
caagaaaccgaaguu

SEQ ID NO: 1920979 - RNA, 17 nt, Shigella flexneri 2a str. 2457T
caagaaaauuauucgcc

SEQ ID NO: 1920980 - RNA, 16 nt, Shigella flexneri 2a str. 2457T
caacuuucuuggcacc

SEQ ID NO: 1920981 - RNA, 21 nt, Shigella flexneri 2a str. 2457T
caacuuuaucuucgagauucu

SEQ ID NO: 1920982 - RNA, 12 nt, Shigella flexneri 2a str. 2457T
caacuucugcug

SEQ ID NO: 1920983 - RNA, 23 nt, Shigella flexneri 2a str. 2457T
caacuucucuuucggcagugcca

SEQ ID NO: 1920984 - RNA, 15 nt, Shigella flexneri 2a str. 2457T
caacuuuagcgaugu

SEQ ID NO: 1920985 - RNA, 15 nt, Shigella flexneri 2a str. 2457T
caacuuuaucuucga

SEQ ID NO: 1920986 - RNA, 14 nt, Shigella flexneri 2a str. 2457T
caagagguaaauuu

SEQ ID NO: 1920987 - RNA, 16 nt, Shigella flexneri 2a str. 2457T
caagaguaacccacgu

SEQ ID NO: 1920988 - RNA, 23 nt, Shigella flexneri 2a str. 2457T
caagauugauccccgcuuccugc

SEQ ID NO: 1920989 - RNA, 23 nt, Shigella flexneri 2a str. 2457T
caagcaaggccagguuuucuuuc

SEQ ID NO: 1920990 - RNA, 16 nt, Shigella flexneri 2a str. 2457T
caagcacaugcugaca

SEQ ID NO: 1920991 - RNA, 12 nt, Shigella flexneri 2a str. 2457T
caagcaaaugaa

SEQ ID NO: 1920992 - RNA, 13 nt, Shigella flexneri 2a str. 2457T
caagcaaaugaau

SEQ ID NO: 1920993 - RNA, 16 nt, Shigella flexneri 2a str. 2457T
caagccccagcaggau

SEQ ID NO: 1920994 - RNA, 22 nt, Shigella flexneri 2a str. 2457T
caagccaugcuuugcaucccag

SEQ ID NO: 1920995 - RNA, 12 nt, Shigella flexneri 2a str. 2457T
caagcagagaga

SEQ ID NO: 1920996 - RNA, 13 nt, Shigella flexneri 2a str. 2457T
caagcagagagac

SEQ ID NO: 1920997 - RNA, 13 nt, Shigella flexneri 2a str. 2457T
caagcgcugagac

SEQ ID NO: 1920998 - RNA, 23 nt, Shigella flexneri 2a str. 2457T
caagcccguguuucugauacagc

SEQ ID NO: 1920999 - RNA, 20 nt, Shigella flexneri 2a str. 2457T
caagcccugguaacugccag

SEQ ID NO: 1921000 - RNA, 22 nt, Shigella flexneri 2a str. 2457T
caagcgcugagacgcgcuugcu

SEQ ID NO: 1921001 - RNA, 15 nt, Shigella flexneri 2a str. 2457T
caagcggcucaugca

SEQ ID NO: 1921002 - RNA, 18 nt, Shigella flexneri 2a str. 2457T
caagcggggaaggaugag

SEQ ID NO: 1921003 - RNA, 24 nt, Shigella flexneri 2a str. 2457T
caagcggugcgaugccuggcaaug

SEQ ID NO: 1921004 - RNA, 21 nt, Shigella flexneri 2a str. 2457T
caaggaagccugacagggaag

SEQ ID NO: 1921005 - RNA, 17 nt, Shigella flexneri 2a str. 2457T
caaggaagccugacagg

SEQ ID NO: 1921006 - RNA, 20 nt, Shigella flexneri 2a str. 2457T
caaggcgcggguuucaacau

SEQ ID NO: 1921007 - RNA, 16 nt, Shigella flexneri 2a str. 2457T
caaggcuauucagcag

SEQ ID NO: 1921008 - RNA, 16 nt, Shigella flexneri 2a str. 2457T
caagguacgaaaaaaa

SEQ ID NO: 1921009 - RNA, 14 nt, Shigella flexneri 2a str. 2457T
caagguauugcacg

SEQ ID NO: 1921010 - RNA, 23 nt, Shigella flexneri 2a str. 2457T
caaggugcgcgaugcuuucccac

SEQ ID NO: 1921011 - RNA, 19 nt, Shigella flexneri 2a str. 2457T
caauacuuucacaaaaaua

SEQ ID NO: 1921012 - RNA, 23 nt, Shigella flexneri 2a str. 2457T
caauacuuucacaaaaauaauuu

SEQ ID NO: 1921013 - RNA, 13 nt, Shigella flexneri 2a str. 2457T
caauagcaacuga

SEQ ID NO: 1921014 - RNA, 13 nt, Shigella flexneri 2a str. 2457T
caauacccugacc

SEQ ID NO: 1921015 - RNA, 15 nt, Shigella flexneri 2a str. 2457T
caauacccugaccca

SEQ ID NO: 1921016 - RNA, 20 nt, Shigella flexneri 2a str. 2457T
caauacugacaucagcaucc

SEQ ID NO: 1921017 - RNA, 16 nt, Shigella flexneri 2a str. 2457T
caauacuuaaccccag

SEQ ID NO: 1921018 - RNA, 21 nt, Shigella flexneri 2a str. 2457T
caauaccgcccaccaccagcg

SEQ ID NO: 1921019 - RNA, 20 nt, Shigella flexneri 2a str. 2457T
caauacccguccacacggca

SEQ ID NO: 1921020 - RNA, 20 nt, Shigella flexneri 2a str. 2457T
caauaccgccugcaaauaaa

SEQ ID NO: 1921021 - RNA, 19 nt, Shigella flexneri 2a str. 2457T
caauaccgccugcaaauaa

SEQ ID NO: 1921022 - RNA, 22 nt, Shigella flexneri 2a str. 2457T
caauaguucuguugcugaaauu

SEQ ID NO: 1921023 - RNA, 18 nt, Shigella flexneri 2a str. 2457T
caauagcgccugcugcug

SEQ ID NO: 1921024 - RNA, 12 nt, Shigella flexneri 2a str. 2457T
caauauuaacuc

SEQ ID NO: 1921025 - RNA, 16 nt, Shigella flexneri 2a str. 2457T
caauauuaaucccugc

SEQ ID NO: 1921026 - RNA, 15 nt, Shigella flexneri 2a str. 2457T
caauaugauaaaccu

SEQ ID NO: 1921027 - RNA, 16 nt, Shigella flexneri 2a str. 2457T
caauaauuaaucuggu

SEQ ID NO: 1921028 - RNA, 13 nt, Shigella flexneri 2a str. 2457T
caauacauagaaa

SEQ ID NO: 1921029 - RNA, 17 nt, Shigella flexneri 2a str. 2457T
caauacaucaauuuucc

SEQ ID NO: 1921030 - RNA, 17 nt, Shigella flexneri 2a str. 2457T
caauaaucgccuuaccc

SEQ ID NO: 1921031 - RNA, 21 nt, Shigella flexneri 2a str. 2457T
caauaaucucuacaccaacgc

SEQ ID NO: 1921032 - RNA, 22 nt, Shigella flexneri 2a str. 2457T
caauaaucaaucuuuacacaca

SEQ ID NO: 1921033 - RNA, 14 nt, Shigella flexneri 2a str. 2457T
caauaacuccaucu

SEQ ID NO: 1921034 - RNA, 17 nt, Shigella flexneri 2a str. 2457T
caauaacacgcuaccac

SEQ ID NO: 1921035 - RNA, 18 nt, Shigella flexneri 2a str. 2457T
caauaaccaucagcucug

SEQ ID NO: 1921036 - RNA, 12 nt, Shigella flexneri 2a str. 2457T
caauaacgccau

SEQ ID NO: 1921037 - RNA, 18 nt, Shigella flexneri 2a str. 2457T
caaguuguauugcucaac

SEQ ID NO: 1921038 - RNA, 15 nt, Shigella flexneri 2a str. 2457T
caauaaauuccccgc

SEQ ID NO: 1921039 - RNA, 12 nt, Shigella flexneri 2a str. 2457T
caauaaauuccc

SEQ ID NO: 1921040 - RNA, 18 nt, Shigella flexneri 2a str. 2457T
caaguaaaaggagauaaa

SEQ ID NO: 1921041 - RNA, 13 nt, Shigella flexneri 2a str. 2457T
caaguaauaaagc

SEQ ID NO: 1921042 - RNA, 18 nt, Shigella flexneri 2a str. 2457T
caaguaauaauaucucca

SEQ ID NO: 1921043 - RNA, 19 nt, Shigella flexneri 2a str. 2457T
caaguaauucauucacgcu

SEQ ID NO: 1921044 - RNA, 18 nt, Shigella flexneri 2a str. 2457T
caaugccgcggcgcggcg

SEQ ID NO: 1921045 - RNA, 16 nt, Shigella flexneri 2a str. 2457T
caaugcccgguguucc

SEQ ID NO: 1921046 - RNA, 21 nt, Shigella flexneri 2a str. 2457T
caaugccuuuguccucaauga

SEQ ID NO: 1921047 - RNA, 14 nt, Shigella flexneri 2a str. 2457T
caaugcgcaucaaa

SEQ ID NO: 1921048 - RNA, 19 nt, Shigella flexneri 2a str. 2457T
caaugcgcaucaaagccag

SEQ ID NO: 1921049 - RNA, 18 nt, Shigella flexneri 2a str. 2457T
caaugcgcguaauuugcg

SEQ ID NO: 1921050 - RNA, 17 nt, Shigella flexneri 2a str. 2457T
caaugcaguuccauaug

SEQ ID NO: 1921051 - RNA, 15 nt, Shigella flexneri 2a str. 2457T
caaugccacgccaca

SEQ ID NO: 1921052 - RNA, 13 nt, Shigella flexneri 2a str. 2457T
caaugccacaaac

SEQ ID NO: 1921053 - RNA, 17 nt, Shigella flexneri 2a str. 2457T
caaugcaggcaccugcc

SEQ ID NO: 1921054 - RNA, 13 nt, Shigella flexneri 2a str. 2457T
caaugcaguucca

SEQ ID NO: 1921055 - RNA, 17 nt, Shigella flexneri 2a str. 2457T
caaugcaucgcgaccaa

SEQ ID NO: 1921056 - RNA, 19 nt, Shigella flexneri 2a str. 2457T
caaugcaucgcgaccaauc

SEQ ID NO: 1921057 - RNA, 18 nt, Shigella flexneri 2a str. 2457T
caaugcauuaucagagau

SEQ ID NO: 1921058 - RNA, 15 nt, Shigella flexneri 2a str. 2457T
caaucucuuuuucca

SEQ ID NO: 1921059 - RNA, 20 nt, Shigella flexneri 2a str. 2457T
caaugaaacgcaaauacuga

SEQ ID NO: 1921060 - RNA, 21 nt, Shigella flexneri 2a str. 2457T
caaugaaagccccaccagcaa

SEQ ID NO: 1921061 - RNA, 18 nt, Shigella flexneri 2a str. 2457T
caaugaaaggcuucccaa

SEQ ID NO: 1921062 - RNA, 21 nt, Shigella flexneri 2a str. 2457T
caaugaguucgcgcgcugcca

SEQ ID NO: 1921063 - RNA, 18 nt, Shigella flexneri 2a str. 2457T
caaugaguggugaaaaaa

SEQ ID NO: 1921064 - RNA, 17 nt, Shigella flexneri 2a str. 2457T
caaugaguucgcgcgcu

SEQ ID NO: 1921065 - RNA, 20 nt, Shigella flexneri 2a str. 2457T
caaugaguggugaaaaaaag

SEQ ID NO: 1921066 - RNA, 15 nt, Shigella flexneri 2a str. 2457T
caauccggaaaccaa

SEQ ID NO: 1921067 - RNA, 20 nt, Shigella flexneri 2a str. 2457T
caauccggccuacaaauuca

SEQ ID NO: 1921068 - RNA, 18 nt, Shigella flexneri 2a str. 2457T
caaucgccuccagcgcug

SEQ ID NO: 1921069 - RNA, 15 nt, Shigella flexneri 2a str. 2457T
caaucgcuucaucgc

SEQ ID NO: 1921070 - RNA, 21 nt, Shigella flexneri 2a str. 2457T
caaucgcgccagaacacgcuc

SEQ ID NO: 1921071 - RNA, 22 nt, Shigella flexneri 2a str. 2457T
caaucgcggcgauauccagcgc

SEQ ID NO: 1921072 - RNA, 20 nt, Shigella flexneri 2a str. 2457T
caaucucguggucaauauua

SEQ ID NO: 1921073 - RNA, 14 nt, Shigella flexneri 2a str. 2457T
caaucucuucacag

SEQ ID NO: 1921074 - RNA, 22 nt, Shigella flexneri 2a str. 2457T
caaucucuacgacuugaaaaag

SEQ ID NO: 1921075 - RNA, 21 nt, Shigella flexneri 2a str. 2457T
caaucucugguuuguuuucag

SEQ ID NO: 1921076 - RNA, 23 nt, Shigella flexneri 2a str. 2457T
caaucucugguuuguuuucagau

SEQ ID NO: 1921077 - RNA, 16 nt, Shigella flexneri 2a str. 2457T
caaucgggaaaaucug

SEQ ID NO: 1921078 - RNA, 14 nt, Shigella flexneri 2a str. 2457T
caaucucagcaaga

SEQ ID NO: 1921079 - RNA, 20 nt, Shigella flexneri 2a str. 2457T
caaucgguucgccugcacca

SEQ ID NO: 1921080 - RNA, 12 nt, Shigella flexneri 2a str. 2457T
caaucucagcga

SEQ ID NO: 1921081 - RNA, 16 nt, Shigella flexneri 2a str. 2457T
caaucauauucaccac

SEQ ID NO: 1921082 - RNA, 19 nt, Shigella flexneri 2a str. 2457T
caauauugaugcucacugc

SEQ ID NO: 1921083 - RNA, 14 nt, Shigella flexneri 2a str. 2457T
caaucauucccauu

SEQ ID NO: 1921084 - RNA, 18 nt, Shigella flexneri 2a str. 2457T
caaucccuuaguaacgcc

SEQ ID NO: 1921085 - RNA, 20 nt, Shigella flexneri 2a str. 2457T
caauccgccaaaacaucuuc

SEQ ID NO: 1921086 - RNA, 20 nt, Shigella flexneri 2a str. 2457T
caauccgauaaucccuuccc

SEQ ID NO: 1921087 - RNA, 20 nt, Shigella flexneri 2a str. 2457T
caaccgagcgccccagaccu

SEQ ID NO: 1921088 - RNA, 19 nt, Shigella flexneri 2a str. 2457T
caacccagcggaugaccca

SEQ ID NO: 1921089 - RNA, 15 nt, Shigella flexneri 2a str. 2457T
caaccagauaaccau

SEQ ID NO: 1921090 - RNA, 15 nt, Shigella flexneri 2a str. 2457T
caaccacucaccgcu

SEQ ID NO: 1921091 - RNA, 21 nt, Shigella flexneri 2a str. 2457T
caaccacuucaguaucuuuua

SEQ ID NO: 1921092 - RNA, 17 nt, Shigella flexneri 2a str. 2457T
caaccaccggcaccacu

SEQ ID NO: 1921093 - RNA, 19 nt, Shigella flexneri 2a str. 2457T
caaccacaaucucgcgccc

SEQ ID NO: 1921094 - RNA, 14 nt, Shigella flexneri 2a str. 2457T
caaccacaauguca

SEQ ID NO: 1921095 - RNA, 20 nt, Shigella flexneri 2a str. 2457T
caaccacaaaacacucuuca

SEQ ID NO: 1921096 - RNA, 12 nt, Shigella flexneri 2a str. 2457T
caaccaaucgcg

SEQ ID NO: 1921097 - RNA, 20 nt, Shigella flexneri 2a str. 2457T
caaccaauucuccaaugccg

SEQ ID NO: 1921098 - RNA, 23 nt, Shigella flexneri 2a str. 2457T
caacaggcccaacuguugaucca

SEQ ID NO: 1921099 - RNA, 19 nt, Shigella flexneri 2a str. 2457T
caacaggguugaaucugca

SEQ ID NO: 1921100 - RNA, 18 nt, Shigella flexneri 2a str. 2457T
caacauacuuugcuggcu

SEQ ID NO: 1921101 - RNA, 20 nt, Shigella flexneri 2a str. 2457T
caaccaaagcguaaaguggc

SEQ ID NO: 1921102 - RNA, 15 nt, Shigella flexneri 2a str. 2457T
caaccaacggccuug

SEQ ID NO: 1921103 - RNA, 19 nt, Shigella flexneri 2a str. 2457T
caaccugcacgaaaccacu

SEQ ID NO: 1921104 - RNA, 15 nt, Shigella flexneri 2a str. 2457T
caaccgcaaaugauu

SEQ ID NO: 1921105 - RNA, 13 nt, Shigella flexneri 2a str. 2457T
caaccugcuggaa

SEQ ID NO: 1921106 - RNA, 12 nt, Shigella flexneri 2a str. 2457T
caacgaagaaaa

SEQ ID NO: 1921107 - RNA, 18 nt, Shigella flexneri 2a str. 2457T
caacgcaucgcugcgcuu

SEQ ID NO: 1921108 - RNA, 14 nt, Shigella flexneri 2a str. 2457T
caacgccagcagca

SEQ ID NO: 1921109 - RNA, 20 nt, Shigella flexneri 2a str. 2457T
caacgcaauauccgccacuu

SEQ ID NO: 1921110 - RNA, 20 nt, Shigella flexneri 2a str. 2457T
caacgcaaagagagaagcca

SEQ ID NO: 1921111 - RNA, 20 nt, Shigella flexneri 2a str. 2457T
caacgcaaacgcccguccau

SEQ ID NO: 1921112 - RNA, 13 nt, Shigella flexneri 2a str. 2457T
caacgcaaagaga

SEQ ID NO: 1921113 - RNA, 18 nt, Shigella flexneri 2a str. 2457T
caacgcaaagagagaagc

SEQ ID NO: 1921114 - RNA, 12 nt, Shigella flexneri 2a str. 2457T
caacgagccaau

SEQ ID NO: 1921115 - RNA, 16 nt, Shigella flexneri 2a str. 2457T
caacgauucaagaaac

SEQ ID NO: 1921116 - RNA, 18 nt, Shigella flexneri 2a str. 2457T
caacgacguaccaacuga

SEQ ID NO: 1921117 - RNA, 21 nt, Shigella flexneri 2a str. 2457T
caacgacaccguuaaauaacu

SEQ ID NO: 1921118 - RNA, 18 nt, Shigella flexneri 2a str. 2457T
caacgacauacucagcgc

SEQ ID NO: 1921119 - RNA, 20 nt, Shigella flexneri 2a str. 2457T
caacacaucgauaagguuau

SEQ ID NO: 1921120 - RNA, 20 nt, Shigella flexneri 2a str. 2457T
caacacagauugauaaaaau

SEQ ID NO: 1921121 - RNA, 21 nt, Shigella flexneri 2a str. 2457T
caacacagauugauaaaaaua

SEQ ID NO: 1921122 - RNA, 15 nt, Shigella flexneri 2a str. 2457T
caacacucucugaag

SEQ ID NO: 1921123 - RNA, 22 nt, Shigella flexneri 2a str. 2457T
caacagaaauaaucgcaauuac

SEQ ID NO: 1921124 - RNA, 14 nt, Shigella flexneri 2a str. 2457T
caacagaaacgcca

SEQ ID NO: 1921125 - RNA, 12 nt, Shigella flexneri 2a str. 2457T
caacagaaauaa

SEQ ID NO: 1921126 - RNA, 17 nt, Shigella flexneri 2a str. 2457T
caacacuuucacuacaa

SEQ ID NO: 1921127 - RNA, 14 nt, Shigella flexneri 2a str. 2457T
caacaauugucgcc

SEQ ID NO: 1921128 - RNA, 16 nt, Shigella flexneri 2a str. 2457T
caacacaauuuguggc

SEQ ID NO: 1921129 - RNA, 22 nt, Shigella flexneri 2a str. 2457T
caacaaucucuuccagaauauc

SEQ ID NO: 1921130 - RNA, 15 nt, Shigella flexneri 2a str. 2457T
caacaaugccacgcc

SEQ ID NO: 1921131 - RNA, 15 nt, Shigella flexneri 2a str. 2457T
caacaaucucuucca

SEQ ID NO: 1921132 - RNA, 23 nt, Shigella flexneri 2a str. 2457T
caacaauugcgggccaaagacca

SEQ ID NO: 1921133 - RNA, 13 nt, Shigella flexneri 2a str. 2457T
caacaauaaaauu

SEQ ID NO: 1921134 - RNA, 15 nt, Shigella flexneri 2a str. 2457T
caacaauaaaauuga

SEQ ID NO: 1921135 - RNA, 20 nt, Shigella flexneri 2a str. 2457T
caacaagugggugcuucacu

SEQ ID NO: 1921136 - RNA, 23 nt, Shigella flexneri 2a str. 2457T
caacaauaaaaccaguaaugauc

SEQ ID NO: 1921137 - RNA, 16 nt, Shigella flexneri 2a str. 2457T
caacaacugaaaaaaa

SEQ ID NO: 1921138 - RNA, 10 nt, Shigella flexneri 2a str. 2457T
caacaacugg

SEQ ID NO: 1921139 - RNA, 14 nt, Shigella flexneri 2a str. 2457T
caacaacugaaaaa

SEQ ID NO: 1921140 - RNA, 17 nt, Shigella flexneri 2a str. 2457T
caacaaccagaagguga

SEQ ID NO: 1921141 - RNA, 18 nt, Shigella flexneri 2a str. 2457T
caacaacagucucugccg

SEQ ID NO: 1921142 - RNA, 11 nt, Shigella flexneri 2a str. 2457T
caacaacgcaa

SEQ ID NO: 1921143 - RNA, 21 nt, Shigella flexneri 2a str. 2457T
caaauuuggcaucgaggaucu

SEQ ID NO: 1921144 - RNA, 22 nt, Shigella flexneri 2a str. 2457T
caaauugcaccauccauuuuuc

SEQ ID NO: 1921145 - RNA, 19 nt, Shigella flexneri 2a str. 2457T
caaauucuuuaucgauaaa

SEQ ID NO: 1921146 - RNA, 21 nt, Shigella flexneri 2a str. 2457T
caaauucaauaaauugcagga

SEQ ID NO: 1921147 - RNA, 18 nt, Shigella flexneri 2a str. 2457T
caaauucaauauauugca

SEQ ID NO: 1921148 - RNA, 16 nt, Shigella flexneri 2a str. 2457T
caaauugacuacacca

SEQ ID NO: 1921149 - RNA, 15 nt, Shigella flexneri 2a str. 2457T
caaauugcaccaucc

SEQ ID NO: 1921150 - RNA, 11 nt, Shigella flexneri 2a str. 2457T
caaauggcgcu

SEQ ID NO: 1921151 - RNA, 18 nt, Shigella flexneri 2a str. 2457T
caaauuauuaccaucggu

SEQ ID NO: 1921152 - RNA, 15 nt, Shigella flexneri 2a str. 2457T
caaaugcgccgccaa

SEQ ID NO: 1921153 - RNA, 21 nt, Shigella flexneri 2a str. 2457T
caaaugcgcuuuauucagacg

SEQ ID NO: 1921154 - RNA, 15 nt, Shigella flexneri 2a str. 2457T
caaaugcaucaguga

SEQ ID NO: 1921155 - RNA, 15 nt, Shigella flexneri 2a str. 2457T
caaauagccugccag

SEQ ID NO: 1921156 - RNA, 16 nt, Shigella flexneri 2a str. 2457T
caaauagccagcagag

SEQ ID NO: 1921157 - RNA, 21 nt, Shigella flexneri 2a str. 2457T
caaagcauucguaaugaaugu

SEQ ID NO: 1921158 - RNA, 13 nt, Shigella flexneri 2a str. 2457T
caaagccaacagc

SEQ ID NO: 1921159 - RNA, 14 nt, Shigella flexneri 2a str. 2457T
caaagcaggcgauu

SEQ ID NO: 1921160 - RNA, 13 nt, Shigella flexneri 2a str. 2457T
caaagcacgcugu

SEQ ID NO: 1921161 - RNA, 23 nt, Shigella flexneri 2a str. 2457T
caaagcucuuuugacgcccccaa

SEQ ID NO: 1921162 - RNA, 18 nt, Shigella flexneri 2a str. 2457T
caaagcuguaucccagcc

SEQ ID NO: 1921163 - RNA, 17 nt, Shigella flexneri 2a str. 2457T
caaagcuguaucccagc

SEQ ID NO: 1921164 - RNA, 16 nt, Shigella flexneri 2a str. 2457T
caaagcugucaccaau

SEQ ID NO: 1921165 - RNA, 19 nt, Shigella flexneri 2a str. 2457T
caaagagcuuucauuucaa

SEQ ID NO: 1921166 - RNA, 21 nt, Shigella flexneri 2a str. 2457T
caaacugcucguucagcacuu

SEQ ID NO: 1921167 - RNA, 19 nt, Shigella flexneri 2a str. 2457T
caaacugguauugagcgac

SEQ ID NO: 1921168 - RNA, 17 nt, Shigella flexneri 2a str. 2457T
caaacuaucuguguaau

SEQ ID NO: 1921169 - RNA, 22 nt, Shigella flexneri 2a str. 2457T
caaacuccgcgaccacacucaa

SEQ ID NO: 1921170 - RNA, 21 nt, Shigella flexneri 2a str. 2457T
caaacucgcgcaggcugacau

SEQ ID NO: 1921171 - RNA, 23 nt, Shigella flexneri 2a str. 2457T
caaacucggcuucgcuaagauac

SEQ ID NO: 1921172 - RNA, 22 nt, Shigella flexneri 2a str. 2457T
caaacugcgcgagcgucauaua

SEQ ID NO: 1921173 - RNA, 16 nt, Shigella flexneri 2a str. 2457T
caaauacugacuggca

SEQ ID NO: 1921174 - RNA, 14 nt, Shigella flexneri 2a str. 2457T
caaauacuucaaua

SEQ ID NO: 1921175 - RNA, 20 nt, Shigella flexneri 2a str. 2457T
caaauacccaaaaaauagca

SEQ ID NO: 1921176 - RNA, 12 nt, Shigella flexneri 2a str. 2457T
caaauaaauacc

SEQ ID NO: 1921177 - RNA, 19 nt, Shigella flexneri 2a str. 2457T
caaauaaauagauccagga

SEQ ID NO: 1921178 - RNA, 18 nt, Shigella flexneri 2a str. 2457T
caaauaacguaaaaaccc

SEQ ID NO: 1921179 - RNA, 21 nt, Shigella flexneri 2a str. 2457T
caaauaaccgguauuacucca

SEQ ID NO: 1921180 - RNA, 12 nt, Shigella flexneri 2a str. 2457T
caaauaaaacau

SEQ ID NO: 1921181 - RNA, 18 nt, Shigella flexneri 2a str. 2457T
caaauaaacgaaucugca

SEQ ID NO: 1921182 - RNA, 13 nt, Shigella flexneri 2a str. 2457T
caaauaaaauccc

SEQ ID NO: 1921183 - RNA, 13 nt, Shigella flexneri 2a str. 2457T
caaaguuugcacc

SEQ ID NO: 1921184 - RNA, 13 nt, Shigella flexneri 2a str. 2457T
caaagugccccca

SEQ ID NO: 1921185 - RNA, 18 nt, Shigella flexneri 2a str. 2457T
caaagugcgcguuuuuua

SEQ ID NO: 1921186 - RNA, 14 nt, Shigella flexneri 2a str. 2457T
caaagugcccccaa

SEQ ID NO: 1921187 - RNA, 20 nt, Shigella flexneri 2a str. 2457T
caaaaccgagaagcuuaccg

SEQ ID NO: 1921188 - RNA, 20 nt, Shigella flexneri 2a str. 2457T
caaaaccacagugacccgca

SEQ ID NO: 1921189 - RNA, 15 nt, Shigella flexneri 2a str. 2457T
caaaauaauaaauua

SEQ ID NO: 1921190 - RNA, 23 nt, Shigella flexneri 2a str. 2457T
caaaauaauaaauuaacugcgcg

SEQ ID NO: 1921191 - RNA, 13 nt, Shigella flexneri 2a str. 2457T
caaaaucaaaaua

SEQ ID NO: 1921192 - RNA, 15 nt, Shigella flexneri 2a str. 2457T
caaaaucaaaauaau

SEQ ID NO: 1921193 - RNA, 22 nt, Shigella flexneri 2a str. 2457T
caaaaugagcucuaucucccug

SEQ ID NO: 1921194 - RNA, 15 nt, Shigella flexneri 2a str. 2457T
caaaaugcaucggca

SEQ ID NO: 1921195 - RNA, 19 nt, Shigella flexneri 2a str. 2457T
caaaauggguauauuugcc

SEQ ID NO: 1921196 - RNA, 16 nt, Shigella flexneri 2a str. 2457T
caaacacaauauucau

SEQ ID NO: 1921197 - RNA, 14 nt, Shigella flexneri 2a str. 2457T
caaacaauuuucau

SEQ ID NO: 1921198 - RNA, 19 nt, Shigella flexneri 2a str. 2457T
caaacaauuuucauugaaa

SEQ ID NO: 1921199 - RNA, 22 nt, Shigella flexneri 2a str. 2457T
caaaauuuaacaccaucauauu

SEQ ID NO: 1921200 - RNA, 21 nt, Shigella flexneri 2a str. 2457T
caaaauuuagcaaauuuuuaa

SEQ ID NO: 1921201 - RNA, 19 nt, Shigella flexneri 2a str. 2457T
caaaauugcuguuacgcca

SEQ ID NO: 1921202 - RNA, 18 nt, Shigella flexneri 2a str. 2457T
caaacgcaaaacugccug

SEQ ID NO: 1921203 - RNA, 16 nt, Shigella flexneri 2a str. 2457T
caaacgcaaacaccag

SEQ ID NO: 1921204 - RNA, 21 nt, Shigella flexneri 2a str. 2457T
caaacgauuuuuuuaauaaua

SEQ ID NO: 1921205 - RNA, 13 nt, Shigella flexneri 2a str. 2457T
caaacgacgcaga

SEQ ID NO: 1921206 - RNA, 14 nt, Shigella flexneri 2a str. 2457T
caaacgcucccugc

SEQ ID NO: 1921207 - RNA, 17 nt, Shigella flexneri 2a str. 2457T
caaacgcucccugccag

SEQ ID NO: 1921208 - RNA, 16 nt, Shigella flexneri 2a str. 2457T
caaacccuucuucaau

SEQ ID NO: 1921209 - RNA, 15 nt, Shigella flexneri 2a str. 2457T
caaacccugagcggu

SEQ ID NO: 1921210 - RNA, 15 nt, Shigella flexneri 2a str. 2457T
caaaccgacugccug

SEQ ID NO: 1921211 - RNA, 16 nt, Shigella flexneri 2a str. 2457T
caaacauugcugccag

SEQ ID NO: 1921212 - RNA, 19 nt, Shigella flexneri 2a str. 2457T
caaacauugcugccagaaa

SEQ ID NO: 1921213 - RNA, 12 nt, Shigella flexneri 2a str. 2457T
caaacaccagcg

SEQ ID NO: 1921214 - RNA, 15 nt, Shigella flexneri 2a str. 2457T
caaacacaucaauga

SEQ ID NO: 1921215 - RNA, 19 nt, Shigella flexneri 2a str. 2457T
caaacagcgcaaaacgcag

SEQ ID NO: 1921216 - RNA, 12 nt, Shigella flexneri 2a str. 2457T
caaacagaccau

SEQ ID NO: 1921217 - RNA, 16 nt, Shigella flexneri 2a str. 2457T
caaacagaauauugug

SEQ ID NO: 1921218 - RNA, 23 nt, Shigella flexneri 2a str. 2457T
caaacaguguuuugacauuggca

SEQ ID NO: 1921219 - RNA, 19 nt, Shigella flexneri 2a str. 2457T
caaacagucgcccgaccau

SEQ ID NO: 1921220 - RNA, 17 nt, Shigella flexneri 2a str. 2457T
caaacaggcugcugcug

SEQ ID NO: 1921221 - RNA, 16 nt, Shigella flexneri 2a str. 2457T
caaacaggaacaccag

SEQ ID NO: 1921222 - RNA, 17 nt, Shigella flexneri 2a str. 2457T
caaacaucggcuuauuc

SEQ ID NO: 1921223 - RNA, 20 nt, Shigella flexneri 2a str. 2457T
cacggguucgugacgucuca

SEQ ID NO: 1921224 - RNA, 14 nt, Shigella flexneri 2a str. 2457T
cacgguaaugacuc

SEQ ID NO: 1921225 - RNA, 19 nt, Shigella flexneri 2a str. 2457T
cacggugcuccagugcgcu

SEQ ID NO: 1921226 - RNA, 13 nt, Shigella flexneri 2a str. 2457T
cacgguucuccac

SEQ ID NO: 1921227 - RNA, 18 nt, Shigella flexneri 2a str. 2457T
cacguccgguggcauccg

SEQ ID NO: 1921228 - RNA, 16 nt, Shigella flexneri 2a str. 2457T
cacgucaucacguccc

SEQ ID NO: 1921229 - RNA, 15 nt, Shigella flexneri 2a str. 2457T
cacgucaucagcaau

SEQ ID NO: 1921230 - RNA, 13 nt, Shigella flexneri 2a str. 2457T
cacgcucuguucu

SEQ ID NO: 1921231 - RNA, 22 nt, Shigella flexneri 2a str. 2457T
cacgcugucuggcgucuccugc

SEQ ID NO: 1921232 - RNA, 18 nt, Shigella flexneri 2a str. 2457T
cacgcuguagccgccguc

SEQ ID NO: 1921233 - RNA, 21 nt, Shigella flexneri 2a str. 2457T
cacgcugucuggcgucuccug

SEQ ID NO: 1921234 - RNA, 17 nt, Shigella flexneri 2a str. 2457T
cacgcugucggcacuga

SEQ ID NO: 1921235 - RNA, 15 nt, Shigella flexneri 2a str. 2457T
cacgcugcaucgcca

SEQ ID NO: 1921236 - RNA, 17 nt, Shigella flexneri 2a str. 2457T
cacgcugcgguuuacgc

SEQ ID NO: 1921237 - RNA, 14 nt, Shigella flexneri 2a str. 2457T
cacgcugcucaucu

SEQ ID NO: 1921238 - RNA, 11 nt, Shigella flexneri 2a str. 2457T
cacggacaggu

SEQ ID NO: 1921239 - RNA, 15 nt, Shigella flexneri 2a str. 2457T
cacggaaucaccgcc

SEQ ID NO: 1921240 - RNA, 14 nt, Shigella flexneri 2a str. 2457T
cacggcaugaaagc

SEQ ID NO: 1921241 - RNA, 18 nt, Shigella flexneri 2a str. 2457T
cacggcauaagccguccc

SEQ ID NO: 1921242 - RNA, 19 nt, Shigella flexneri 2a str. 2457T
cacgauaaguuugcgcauc

SEQ ID NO: 1921243 - RNA, 21 nt, Shigella flexneri 2a str. 2457T
cacgacgucuccaucaauaca

SEQ ID NO: 1921244 - RNA, 16 nt, Shigella flexneri 2a str. 2457T
cacgacgucuccauca

SEQ ID NO: 1921245 - RNA, 16 nt, Shigella flexneri 2a str. 2457T
caccuuuuuuuaugcu

SEQ ID NO: 1921246 - RNA, 17 nt, Shigella flexneri 2a str. 2457T
caccuuuuuuuaugcuu

SEQ ID NO: 1921247 - RNA, 13 nt, Shigella flexneri 2a str. 2457T
caccuuuuuucug

SEQ ID NO: 1921248 - RNA, 15 nt, Shigella flexneri 2a str. 2457T
cacgaaggugcauug

SEQ ID NO: 1921249 - RNA, 17 nt, Shigella flexneri 2a str. 2457T
cacgaccggguuuucaa

SEQ ID NO: 1921250 - RNA, 13 nt, Shigella flexneri 2a str. 2457T
cacgaauauuucc

SEQ ID NO: 1921251 - RNA, 19 nt, Shigella flexneri 2a str. 2457T
caccugccagggugcuggc

SEQ ID NO: 1921252 - RNA, 12 nt, Shigella flexneri 2a str. 2457T
caccuuuaaccu

SEQ ID NO: 1921253 - RNA, 17 nt, Shigella flexneri 2a str. 2457T
cacgccaggccacgcuu

SEQ ID NO: 1921254 - RNA, 13 nt, Shigella flexneri 2a str. 2457T
cacgccaauaccg

SEQ ID NO: 1921255 - RNA, 11 nt, Shigella flexneri 2a str. 2457T
cacgccaagcu

SEQ ID NO: 1921256 - RNA, 14 nt, Shigella flexneri 2a str. 2457T
cacgccaacaaaca

SEQ ID NO: 1921257 - RNA, 15 nt, Shigella flexneri 2a str. 2457T
cacgcacagcccgcc

SEQ ID NO: 1921258 - RNA, 19 nt, Shigella flexneri 2a str. 2457T
cacgcagggggucgcgggu

SEQ ID NO: 1921259 - RNA, 22 nt, Shigella flexneri 2a str. 2457T
cacgcauaucguagccccaguc

SEQ ID NO: 1921260 - RNA, 23 nt, Shigella flexneri 2a str. 2457T
cacgcaucacuuucggugacaga

SEQ ID NO: 1921261 - RNA, 13 nt, Shigella flexneri 2a str. 2457T
cacgcauuaauaa

SEQ ID NO: 1921262 - RNA, 18 nt, Shigella flexneri 2a str. 2457T
cacgcagcguuggcaggu

SEQ ID NO: 1921263 - RNA, 24 nt, Shigella flexneri 2a str. 2457T
cacgcagcuucucgugaaacucac

SEQ ID NO: 1921264 - RNA, 15 nt, Shigella flexneri 2a str. 2457T
cacgcagcaagccgu

SEQ ID NO: 1921265 - RNA, 15 nt, Shigella flexneri 2a str. 2457T
cacgcagacacugcu

SEQ ID NO: 1921266 - RNA, 14 nt, Shigella flexneri 2a str. 2457T
caccgggugcagac

SEQ ID NO: 1921267 - RNA, 16 nt, Shigella flexneri 2a str. 2457T
caccggguaccagaau

SEQ ID NO: 1921268 - RNA, 20 nt, Shigella flexneri 2a str. 2457T
caccggggacaggcgggcca

SEQ ID NO: 1921269 - RNA, 16 nt, Shigella flexneri 2a str. 2457T
caccggcgacauccca

SEQ ID NO: 1921270 - RNA, 16 nt, Shigella flexneri 2a str. 2457T
caccgcgccgggcaga

SEQ ID NO: 1921271 - RNA, 19 nt, Shigella flexneri 2a str. 2457T
caccggauguagcaacgga

SEQ ID NO: 1921272 - RNA, 20 nt, Shigella flexneri 2a str. 2457T
caccggacuauccgccgcuu

SEQ ID NO: 1921273 - RNA, 18 nt, Shigella flexneri 2a str. 2457T
caccggacggacuuccag

SEQ ID NO: 1921274 - RNA, 19 nt, Shigella flexneri 2a str. 2457T
caccugcauucgagccaag

SEQ ID NO: 1921275 - RNA, 23 nt, Shigella flexneri 2a str. 2457T
caccugauugaccgccagcgcca

SEQ ID NO: 1921276 - RNA, 22 nt, Shigella flexneri 2a str. 2457T
caccugcaacgguugauggcag

SEQ ID NO: 1921277 - RNA, 18 nt, Shigella flexneri 2a str. 2457T
caccugauacgcgccaau

SEQ ID NO: 1921278 - RNA, 20 nt, Shigella flexneri 2a str. 2457T
caccugauccagcucuucuu

SEQ ID NO: 1921279 - RNA, 23 nt, Shigella flexneri 2a str. 2457T
caccugauccagcucuucuucac

SEQ ID NO: 1921280 - RNA, 14 nt, Shigella flexneri 2a str. 2457T
caccucuuuuucca

SEQ ID NO: 1921281 - RNA, 18 nt, Shigella flexneri 2a str. 2457T
caccgugauccgccgcug

SEQ ID NO: 1921282 - RNA, 15 nt, Shigella flexneri 2a str. 2457T
caccguguucaugac

SEQ ID NO: 1921283 - RNA, 12 nt, Shigella flexneri 2a str. 2457T
caccguuaaaua

SEQ ID NO: 1921284 - RNA, 15 nt, Shigella flexneri 2a str. 2457T
caccgcacagaccau

SEQ ID NO: 1921285 - RNA, 20 nt, Shigella flexneri 2a str. 2457T
caccgcaagccaaauacauu

SEQ ID NO: 1921286 - RNA, 17 nt, Shigella flexneri 2a str. 2457T
caccgaugaucaacagc

SEQ ID NO: 1921287 - RNA, 15 nt, Shigella flexneri 2a str. 2457T
caccgaugcacagca

SEQ ID NO: 1921288 - RNA, 18 nt, Shigella flexneri 2a str. 2457T
caccgaagcuuucuugca

SEQ ID NO: 1921289 - RNA, 16 nt, Shigella flexneri 2a str. 2457T
caccgcccagugcagu

SEQ ID NO: 1921290 - RNA, 15 nt, Shigella flexneri 2a str. 2457T
caccgccgacuguca

SEQ ID NO: 1921291 - RNA, 22 nt, Shigella flexneri 2a str. 2457T
caccgcgaucuuccacgccugc

SEQ ID NO: 1921292 - RNA, 20 nt, Shigella flexneri 2a str. 2457T
caccgcgaucuuccacgccu

SEQ ID NO: 1921293 - RNA, 16 nt, Shigella flexneri 2a str. 2457T
caccgcgaucuuccac

SEQ ID NO: 1921294 - RNA, 22 nt, Shigella flexneri 2a str. 2457T
caccgccguuaccuucggcccc

SEQ ID NO: 1921295 - RNA, 21 nt, Shigella flexneri 2a str. 2457T
caccccuuuacugacuguccc

SEQ ID NO: 1921296 - RNA, 14 nt, Shigella flexneri 2a str. 2457T
cacccaauccagua

SEQ ID NO: 1921297 - RNA, 15 nt, Shigella flexneri 2a str. 2457T
cacccaccagcgccg

SEQ ID NO: 1921298 - RNA, 16 nt, Shigella flexneri 2a str. 2457T
cacccaccagcgccga

SEQ ID NO: 1921299 - RNA, 17 nt, Shigella flexneri 2a str. 2457T
caccauguucacugccg

SEQ ID NO: 1921300 - RNA, 17 nt, Shigella flexneri 2a str. 2457T
caccauugcugccgcca

SEQ ID NO: 1921301 - RNA, 21 nt, Shigella flexneri 2a str. 2457T
caccauuuccggagacagcuu

SEQ ID NO: 1921302 - RNA, 19 nt, Shigella flexneri 2a str. 2457T
cacccggaggaaagcaccu

SEQ ID NO: 1921303 - RNA, 18 nt, Shigella flexneri 2a str. 2457T
cacccggaucucagcuca

SEQ ID NO: 1921304 - RNA, 19 nt, Shigella flexneri 2a str. 2457T
cacccguuuucuccaugcg

SEQ ID NO: 1921305 - RNA, 20 nt, Shigella flexneri 2a str. 2457T
cacccuaacccucuccccga

SEQ ID NO: 1921306 - RNA, 22 nt, Shigella flexneri 2a str. 2457T
cacccuauuuuuacccaggccu

SEQ ID NO: 1921307 - RNA, 20 nt, Shigella flexneri 2a str. 2457T
cacccucaaaauuucuccuu

SEQ ID NO: 1921308 - RNA, 22 nt, Shigella flexneri 2a str. 2457T
cacccucaaaauuucuccuuca

SEQ ID NO: 1921309 - RNA, 19 nt, Shigella flexneri 2a str. 2457T
caccagacaucccagugca

SEQ ID NO: 1921310 - RNA, 14 nt, Shigella flexneri 2a str. 2457T
caccagaccugaaa

SEQ ID NO: 1921311 - RNA, 18 nt, Shigella flexneri 2a str. 2457T
aaaaguuauaaauaaaaa

SEQ ID NO: 1921312 - RNA, 19 nt, Shigella flexneri 2a str. 2457T
caccagaaucgccagcauc

SEQ ID NO: 1921313 - RNA, 20 nt, Shigella flexneri 2a str. 2457T
caccagaaucgccagcaucg

SEQ ID NO: 1921314 - RNA, 15 nt, Shigella flexneri 2a str. 2457T
caccagaaucaaucc

SEQ ID NO: 1921315 - RNA, 20 nt, Shigella flexneri 2a str. 2457T
caccagaaucaaucccauca

SEQ ID NO: 1921316 - RNA, 15 nt, Shigella flexneri 2a str. 2457T
caccagaaucgccag

SEQ ID NO: 1921317 - RNA, 14 nt, Shigella flexneri 2a str. 2457T
caccagaaucgcca

SEQ ID NO: 1921318 - RNA, 22 nt, Shigella flexneri 2a str. 2457T
caccagaaaguuuuucaacacc

SEQ ID NO: 1921319 - RNA, 22 nt, Shigella flexneri 2a str. 2457T
caccagcgaaaucaccgccacc

SEQ ID NO: 1921320 - RNA, 19 nt, Shigella flexneri 2a str. 2457T
caccagccccagaauucac

SEQ ID NO: 1921321 - RNA, 19 nt, Shigella flexneri 2a str. 2457T
caccagcgauuguucaccc

SEQ ID NO: 1921322 - RNA, 19 nt, Shigella flexneri 2a str. 2457T
caccaggaacgcgccaaga

SEQ ID NO: 1921323 - RNA, 20 nt, Shigella flexneri 2a str. 2457T
caccaggcaguuuauccagc

SEQ ID NO: 1921324 - RNA, 20 nt, Shigella flexneri 2a str. 2457T
aaaaguuuuaucggagaaca

SEQ ID NO: 1921325 - RNA, 24 nt, Shigella flexneri 2a str. 2457T
aaaaguuuuaucggagaacaggaa

SEQ ID NO: 1921326 - RNA, 20 nt, Shigella flexneri 2a str. 2457T
caccaucaaaguuuuuauga

SEQ ID NO: 1921327 - RNA, 16 nt, Shigella flexneri 2a str. 2457T
caccauauucagcagc

SEQ ID NO: 1921328 - RNA, 13 nt, Shigella flexneri 2a str. 2457T
caccaguucacgc

SEQ ID NO: 1921329 - RNA, 23 nt, Shigella flexneri 2a str. 2457T
caccaguugguagguccagccgc

SEQ ID NO: 1921330 - RNA, 13 nt, Shigella flexneri 2a str. 2457T
caccaucaguggc

SEQ ID NO: 1921331 - RNA, 14 nt, Shigella flexneri 2a str. 2457T
caccaucagcagca

SEQ ID NO: 1921332 - RNA, 15 nt, Shigella flexneri 2a str. 2457T
caccaucagcagcaa

SEQ ID NO: 1921333 - RNA, 19 nt, Shigella flexneri 2a str. 2457T
caccauccccaccaaaaca

SEQ ID NO: 1921334 - RNA, 17 nt, Shigella flexneri 2a str. 2457T
caccauccgcccacacc

SEQ ID NO: 1921335 - RNA, 21 nt, Shigella flexneri 2a str. 2457T
caccaucgggccucuuuuuau

SEQ ID NO: 1921336 - RNA, 17 nt, Shigella flexneri 2a str. 2457T
caccaucgcaaacagua

SEQ ID NO: 1921337 - RNA, 22 nt, Shigella flexneri 2a str. 2457T
caccaucuugagaaaaaccuca

SEQ ID NO: 1921338 - RNA, 21 nt, Shigella flexneri 2a str. 2457T
caccaucguugcuaacggcca

SEQ ID NO: 1921339 - RNA, 22 nt, Shigella flexneri 2a str. 2457T
caccauggcuauaccccacccc

SEQ ID NO: 1921340 - RNA, 19 nt, Shigella flexneri 2a str. 2457T
caccaccuggcuugccggg

SEQ ID NO: 1921341 - RNA, 22 nt, Shigella flexneri 2a str. 2457T
caccacuugcagcucauauucc

SEQ ID NO: 1921342 - RNA, 22 nt, Shigella flexneri 2a str. 2457T
caccacuuuacgggcaaucucc

SEQ ID NO: 1921343 - RNA, 19 nt, Shigella flexneri 2a str. 2457T
caccaauggcuggccugga

SEQ ID NO: 1921344 - RNA, 15 nt, Shigella flexneri 2a str. 2457T
caccaauagcccaug

SEQ ID NO: 1921345 - RNA, 18 nt, Shigella flexneri 2a str. 2457T
caccaauagccgcgccga

SEQ ID NO: 1921346 - RNA, 13 nt, Shigella flexneri 2a str. 2457T
caccaauacgcau

SEQ ID NO: 1921347 - RNA, 18 nt, Shigella flexneri 2a str. 2457T
caccaauacgcauaugca

SEQ ID NO: 1921348 - RNA, 23 nt, Shigella flexneri 2a str. 2457T
caccaaugaaagccccaccagca

SEQ ID NO: 1921349 - RNA, 11 nt, Shigella flexneri 2a str. 2457T
caccaaugacg

SEQ ID NO: 1921350 - RNA, 18 nt, Shigella flexneri 2a str. 2457T
caccaaucgucaaugccg

SEQ ID NO: 1921351 - RNA, 13 nt, Shigella flexneri 2a str. 2457T
caccaaucagcgg

SEQ ID NO: 1921352 - RNA, 21 nt, Shigella flexneri 2a str. 2457T
caccaccgcaucggcaucaaa

SEQ ID NO: 1921353 - RNA, 15 nt, Shigella flexneri 2a str. 2457T
caccaccgcaaaaua

SEQ ID NO: 1921354 - RNA, 20 nt, Shigella flexneri 2a str. 2457T
caccaccgcaaucgccagua

SEQ ID NO: 1921355 - RNA, 19 nt, Shigella flexneri 2a str. 2457T
caccaccgcccguuccacc

SEQ ID NO: 1921356 - RNA, 17 nt, Shigella flexneri 2a str. 2457T
caccaccgauccugaag

SEQ ID NO: 1921357 - RNA, 13 nt, Shigella flexneri 2a str. 2457T
caccacccugccc

SEQ ID NO: 1921358 - RNA, 22 nt, Shigella flexneri 2a str. 2457T
caccacccguacuucugaccag

SEQ ID NO: 1921359 - RNA, 13 nt, Shigella flexneri 2a str. 2457T
cacaugcugacau

SEQ ID NO: 1921360 - RNA, 24 nt, Shigella flexneri 2a str. 2457T
cacauucugcaucgcgcugaacau

SEQ ID NO: 1921361 - RNA, 11 nt, Shigella flexneri 2a str. 2457T
cacauuucacu

SEQ ID NO: 1921362 - RNA, 22 nt, Shigella flexneri 2a str. 2457T
cacauuucagaaaguauauaaa

SEQ ID NO: 1921363 - RNA, 13 nt, Shigella flexneri 2a str. 2457T
cacaugcagcgcc

SEQ ID NO: 1921364 - RNA, 16 nt, Shigella flexneri 2a str. 2457T
cacaugaguugcugga

SEQ ID NO: 1921365 - RNA, 15 nt, Shigella flexneri 2a str. 2457T
cacaugaguugcugg

SEQ ID NO: 1921366 - RNA, 22 nt, Shigella flexneri 2a str. 2457T
cacaugcaacgucaucaccggc

SEQ ID NO: 1921367 - RNA, 22 nt, Shigella flexneri 2a str. 2457T
cacaugaauucgacuuucucug

SEQ ID NO: 1921368 - RNA, 20 nt, Shigella flexneri 2a str. 2457T
cacauaaaguagccaauccc

SEQ ID NO: 1921369 - RNA, 18 nt, Shigella flexneri 2a str. 2457T
cacaguuauaaaaugaua

SEQ ID NO: 1921370 - RNA, 21 nt, Shigella flexneri 2a str. 2457T
cacauaaccguacaaucguuu

SEQ ID NO: 1921371 - RNA, 21 nt, Shigella flexneri 2a str. 2457T
cacauaagagcgggacaacaa

SEQ ID NO: 1921372 - RNA, 17 nt, Shigella flexneri 2a str. 2457T
caauugacaguuuauuu

SEQ ID NO: 1921373 - RNA, 16 nt, Shigella flexneri 2a str. 2457T
caauugaccaguaaua

SEQ ID NO: 1921374 - RNA, 15 nt, Shigella flexneri 2a str. 2457T
caauugaagaauauc

SEQ ID NO: 1921375 - RNA, 13 nt, Shigella flexneri 2a str. 2457T
caauucuuucucg

SEQ ID NO: 1921376 - RNA, 19 nt, Shigella flexneri 2a str. 2457T
caauucacgaauauuuccc

SEQ ID NO: 1921377 - RNA, 20 nt, Shigella flexneri 2a str. 2457T
caauucacgaauauuucccg

SEQ ID NO: 1921378 - RNA, 21 nt, Shigella flexneri 2a str. 2457T
caauuacugcauugaauuucu

SEQ ID NO: 1921379 - RNA, 23 nt, Shigella flexneri 2a str. 2457T
caauuauaguaucguuaaauucu

SEQ ID NO: 1921380 - RNA, 22 nt, Shigella flexneri 2a str. 2457T
caauuaucuggaauuccuuucc

SEQ ID NO: 1921381 - RNA, 22 nt, Shigella flexneri 2a str. 2457T
caauuauuaaccuggucgcuga

SEQ ID NO: 1921382 - RNA, 14 nt, Shigella flexneri 2a str. 2457T
caauuaauugugaa

SEQ ID NO: 1921383 - RNA, 19 nt, Shigella flexneri 2a str. 2457T
caauuaaugcaccaacaaa

SEQ ID NO: 1921384 - RNA, 21 nt, Shigella flexneri 2a str. 2457T
caauuaaugcaccaacaaaua

SEQ ID NO: 1921385 - RNA, 12 nt, Shigella flexneri 2a str. 2457T
caauuaccuucc

SEQ ID NO: 1921386 - RNA, 17 nt, Shigella flexneri 2a str. 2457T
caauuaccacaaguaaa

SEQ ID NO: 1921387 - RNA, 22 nt, Shigella flexneri 2a str. 2457T
caauuacccaguagacagcaaa

SEQ ID NO: 1921388 - RNA, 11 nt, Shigella flexneri 2a str. 2457T
caauuaaauaa

SEQ ID NO: 1921389 - RNA, 16 nt, Shigella flexneri 2a str. 2457T
caauuaacgaaaucuc

SEQ ID NO: 1921390 - RNA, 15 nt, Shigella flexneri 2a str. 2457T
caauuaacgguaaua

SEQ ID NO: 1921391 - RNA, 14 nt, Shigella flexneri 2a str. 2457T
caauguucguccau

SEQ ID NO: 1921392 - RNA, 18 nt, Shigella flexneri 2a str. 2457T
caauguucguccauuuca

SEQ ID NO: 1921393 - RNA, 20 nt, Shigella flexneri 2a str. 2457T
caauguugcguuugucauca

SEQ ID NO: 1921394 - RNA, 20 nt, Shigella flexneri 2a str. 2457T
caauguuucucuggcgcgcu

SEQ ID NO: 1921395 - RNA, 22 nt, Shigella flexneri 2a str. 2457T
caauuuuuaccgccgucgaugc

SEQ ID NO: 1921396 - RNA, 19 nt, Shigella flexneri 2a str. 2457T
caauuuuaccuagcacugu

SEQ ID NO: 1921397 - RNA, 19 nt, Shigella flexneri 2a str. 2457T
caauuuacguuuuaaaccu

SEQ ID NO: 1921398 - RNA, 20 nt, Shigella flexneri 2a str. 2457T
caauuuguagucauuuuuug

SEQ ID NO: 1921399 - RNA, 16 nt, Shigella flexneri 2a str. 2457T
caauuuacgcuuuucu

SEQ ID NO: 1921400 - RNA, 21 nt, Shigella flexneri 2a str. 2457T
caauuuaccgaccucaacaaa

SEQ ID NO: 1921401 - RNA, 23 nt, Shigella flexneri 2a str. 2457T
caauuuaccgacgcugcucaaag

SEQ ID NO: 1921402 - RNA, 19 nt, Shigella flexneri 2a str. 2457T
caauuguucugcgcugaaa

SEQ ID NO: 1921403 - RNA, 21 nt, Shigella flexneri 2a str. 2457T
cacaaagcuguaucccagccc

SEQ ID NO: 1921404 - RNA, 19 nt, Shigella flexneri 2a str. 2457T
cacaaaggcgcgaagcugg

SEQ ID NO: 1921405 - RNA, 17 nt, Shigella flexneri 2a str. 2457T
cacaaacgccgugcaca

SEQ ID NO: 1921406 - RNA, 12 nt, Shigella flexneri 2a str. 2457T
cacaaacaucau

SEQ ID NO: 1921407 - RNA, 14 nt, Shigella flexneri 2a str. 2457T
cacaaaaucaugag

SEQ ID NO: 1921408 - RNA, 23 nt, Shigella flexneri 2a str. 2457T
cacaaaaucacgucgauuuuuaa

SEQ ID NO: 1921409 - RNA, 19 nt, Shigella flexneri 2a str. 2457T
cacaaaacacucuucaaca

SEQ ID NO: 1921410 - RNA, 19 nt, Shigella flexneri 2a str. 2457T
cacaaaacggauguuucuu

SEQ ID NO: 1921411 - RNA, 22 nt, Shigella flexneri 2a str. 2457T
cacaaaacggauguuucuucaa

SEQ ID NO: 1921412 - RNA, 13 nt, Shigella flexneri 2a str. 2457T
cacaaaaccugcc

SEQ ID NO: 1921413 - RNA, 20 nt, Shigella flexneri 2a str. 2457T
cacagggcucuuaagcaccg

SEQ ID NO: 1921414 - RNA, 23 nt, Shigella flexneri 2a str. 2457T
cacaggccugauaagacgcgcag

SEQ ID NO: 1921415 - RNA, 12 nt, Shigella flexneri 2a str. 2457T
cacaggccgcca

SEQ ID NO: 1921416 - RNA, 19 nt, Shigella flexneri 2a str. 2457T
cacaggccggagccagccg

SEQ ID NO: 1921417 - RNA, 14 nt, Shigella flexneri 2a str. 2457T
cacaguaaugauuu

SEQ ID NO: 1921418 - RNA, 12 nt, Shigella flexneri 2a str. 2457T
cacagugacccg

SEQ ID NO: 1921419 - RNA, 22 nt, Shigella flexneri 2a str. 2457T
cacagugacccgcagccagcac

SEQ ID NO: 1921420 - RNA, 16 nt, Shigella flexneri 2a str. 2457T
cacagugaaucucuua

SEQ ID NO: 1921421 - RNA, 16 nt, Shigella flexneri 2a str. 2457T
cacagugcugauuuug

SEQ ID NO: 1921422 - RNA, 15 nt, Shigella flexneri 2a str. 2457T
cacaggccaucacau

SEQ ID NO: 1921423 - RNA, 15 nt, Shigella flexneri 2a str. 2457T
cacaggccauuuccc

SEQ ID NO: 1921424 - RNA, 16 nt, Shigella flexneri 2a str. 2457T
cacagcgccagacacu

SEQ ID NO: 1921425 - RNA, 16 nt, Shigella flexneri 2a str. 2457T
cacagaggcagcaucu

SEQ ID NO: 1921426 - RNA, 17 nt, Shigella flexneri 2a str. 2457T
cacagagcugauuuccg

SEQ ID NO: 1921427 - RNA, 18 nt, Shigella flexneri 2a str. 2457T
cacagaggucuuuucucg

SEQ ID NO: 1921428 - RNA, 11 nt, Shigella flexneri 2a str. 2457T
cacagccgcag

SEQ ID NO: 1921429 - RNA, 15 nt, Shigella flexneri 2a str. 2457T
cacagccgcaggccu

SEQ ID NO: 1921430 - RNA, 18 nt, Shigella flexneri 2a str. 2457T
cacagaccggacugacuc

SEQ ID NO: 1921431 - RNA, 14 nt, Shigella flexneri 2a str. 2457T
cacagacaaacagc

SEQ ID NO: 1921432 - RNA, 12 nt, Shigella flexneri 2a str. 2457T
cacagacaaaca

SEQ ID NO: 1921433 - RNA, 19 nt, Shigella flexneri 2a str. 2457T
cacacaauuaccuuccaca

SEQ ID NO: 1921434 - RNA, 12 nt, Shigella flexneri 2a str. 2457T
cacaccaccaug

SEQ ID NO: 1921435 - RNA, 14 nt, Shigella flexneri 2a str. 2457T
cacaccaguaaagc

SEQ ID NO: 1921436 - RNA, 14 nt, Shigella flexneri 2a str. 2457T
cacaccagucagcg

SEQ ID NO: 1921437 - RNA, 12 nt, Shigella flexneri 2a str. 2457T
cacaccaucaaa

SEQ ID NO: 1921438 - RNA, 22 nt, Shigella flexneri 2a str. 2457T
cacaccauugauaauccaucac

SEQ ID NO: 1921439 - RNA, 22 nt, Shigella flexneri 2a str. 2457T
cacacaagccgugaaucacucc

SEQ ID NO: 1921440 - RNA, 18 nt, Shigella flexneri 2a str. 2457T
cacaaugucacaaauaaa

SEQ ID NO: 1921441 - RNA, 12 nt, Shigella flexneri 2a str. 2457T
cacaauuaccuu

SEQ ID NO: 1921442 - RNA, 23 nt, Shigella flexneri 2a str. 2457T
cacaauuaccuuccacaauggca

SEQ ID NO: 1921443 - RNA, 13 nt, Shigella flexneri 2a str. 2457T
cacaauugccgga

SEQ ID NO: 1921444 - RNA, 17 nt, Shigella flexneri 2a str. 2457T
cacaaugcuguaaccag

SEQ ID NO: 1921445 - RNA, 15 nt, Shigella flexneri 2a str. 2457T
cacaaugccugaugc

SEQ ID NO: 1921446 - RNA, 18 nt, Shigella flexneri 2a str. 2457T
cacaauggagcuaaacag

SEQ ID NO: 1921447 - RNA, 15 nt, Shigella flexneri 2a str. 2457T
cacaauggucaacau

SEQ ID NO: 1921448 - RNA, 17 nt, Shigella flexneri 2a str. 2457T
cacaaauggcaaugacu

SEQ ID NO: 1921449 - RNA, 18 nt, Shigella flexneri 2a str. 2457T
cacaaauacgcuuuuucc

SEQ ID NO: 1921450 - RNA, 16 nt, Shigella flexneri 2a str. 2457T
cacaaauaaaaaauga

SEQ ID NO: 1921451 - RNA, 16 nt, Shigella flexneri 2a str. 2457T
cacaaaguaaacaaua

SEQ ID NO: 1921452 - RNA, 13 nt, Shigella flexneri 2a str. 2457T
cacaccggcacca

SEQ ID NO: 1921453 - RNA, 21 nt, Shigella flexneri 2a str. 2457T
cacaccgcgaucuuccacgcc

SEQ ID NO: 1921454 - RNA, 23 nt, Shigella flexneri 2a str. 2457T
cacacccauguuuaauucacgca

SEQ ID NO: 1921455 - RNA, 19 nt, Shigella flexneri 2a str. 2457T
cacacccgguaucaaaccc

SEQ ID NO: 1921456 - RNA, 13 nt, Shigella flexneri 2a str. 2457T
cacacugaauaaa

SEQ ID NO: 1921457 - RNA, 21 nt, Shigella flexneri 2a str. 2457T
cacagaauucccccauugaaa

SEQ ID NO: 1921458 - RNA, 22 nt, Shigella flexneri 2a str. 2457T
cacacugguucccaacaacagc

SEQ ID NO: 1921459 - RNA, 13 nt, Shigella flexneri 2a str. 2457T
cacacugcuuaac

SEQ ID NO: 1921460 - RNA, 17 nt, Shigella flexneri 2a str. 2457T
cacacugcuuaacugcg

SEQ ID NO: 1921461 - RNA, 17 nt, Shigella flexneri 2a str. 2457T
auuucuacacccagccc

SEQ ID NO: 1921462 - RNA, 13 nt, Shigella flexneri 2a str. 2457T
auuucgagaaugu

SEQ ID NO: 1921463 - RNA, 15 nt, Shigella flexneri 2a str. 2457T
auuuccaagauuaaa

SEQ ID NO: 1921464 - RNA, 14 nt, Shigella flexneri 2a str. 2457T
auuuccaccucccc

SEQ ID NO: 1921465 - RNA, 21 nt, Shigella flexneri 2a str. 2457T
auuuccacccggccgucacga

SEQ ID NO: 1921466 - RNA, 13 nt, Shigella flexneri 2a str. 2457T
auuuccaccgcua

SEQ ID NO: 1921467 - RNA, 16 nt, Shigella flexneri 2a str. 2457T
auuuccaggagauuaa

SEQ ID NO: 1921468 - RNA, 15 nt, Shigella flexneri 2a str. 2457T
auuuccagaaaguga

SEQ ID NO: 1921469 - RNA, 15 nt, Shigella flexneri 2a str. 2457T
auuuccuguaacacu

SEQ ID NO: 1921470 - RNA, 16 nt, Shigella flexneri 2a str. 2457T
auuuccuuaaaaguga

SEQ ID NO: 1921471 - RNA, 23 nt, Shigella flexneri 2a str. 2457T
auuuccugcgugacuaaaacccu

SEQ ID NO: 1921472 - RNA, 14 nt, Shigella flexneri 2a str. 2457T
auuuccugagcacu

SEQ ID NO: 1921473 - RNA, 16 nt, Shigella flexneri 2a str. 2457T
auuuccugagcacugg

SEQ ID NO: 1921474 - RNA, 17 nt, Shigella flexneri 2a str. 2457T
auuuccauaaauugcug

SEQ ID NO: 1921475 - RNA, 23 nt, Shigella flexneri 2a str. 2457T
auuuccauaccuaaaaaauccca

SEQ ID NO: 1921476 - RNA, 15 nt, Shigella flexneri 2a str. 2457T
auuucaucaccagcu

SEQ ID NO: 1921477 - RNA, 14 nt, Shigella flexneri 2a str. 2457T
auuucaucaccagc

SEQ ID NO: 1921478 - RNA, 14 nt, Shigella flexneri 2a str. 2457T
auuucauguuugaa

SEQ ID NO: 1921479 - RNA, 13 nt, Shigella flexneri 2a str. 2457T
auuucauuauuca

SEQ ID NO: 1921480 - RNA, 18 nt, Shigella flexneri 2a str. 2457T
auuucagaccuguugccc

SEQ ID NO: 1921481 - RNA, 17 nt, Shigella flexneri 2a str. 2457T
auuucacuucaaccaca

SEQ ID NO: 1921482 - RNA, 19 nt, Shigella flexneri 2a str. 2457T
auuucacuucaaccacauu

SEQ ID NO: 1921483 - RNA, 18 nt, Shigella flexneri 2a str. 2457T
auuucagaaaguauauaa

SEQ ID NO: 1921484 - RNA, 15 nt, Shigella flexneri 2a str. 2457T
auuucaacagguuuu

SEQ ID NO: 1921485 - RNA, 18 nt, Shigella flexneri 2a str. 2457T
auuucaacagguuuuguu

SEQ ID NO: 1921486 - RNA, 13 nt, Shigella flexneri 2a str. 2457T
auuucaacagauu

SEQ ID NO: 1921487 - RNA, 13 nt, Shigella flexneri 2a str. 2457T
auuucaauaacuc

SEQ ID NO: 1921488 - RNA, 22 nt, Shigella flexneri 2a str. 2457T
auuugcggucguaugcuggaag

SEQ ID NO: 1921489 - RNA, 21 nt, Shigella flexneri 2a str. 2457T
auuugcgcucaauaaucaauc

SEQ ID NO: 1921490 - RNA, 23 nt, Shigella flexneri 2a str. 2457T
auuugcgcgaugccgccguagaa

SEQ ID NO: 1921491 - RNA, 19 nt, Shigella flexneri 2a str. 2457T
auuugccgcagcaguugcc

SEQ ID NO: 1921492 - RNA, 15 nt, Shigella flexneri 2a str. 2457T
auuugccuaauaaau

SEQ ID NO: 1921493 - RNA, 20 nt, Shigella flexneri 2a str. 2457T
auuugccuaauaaaucuaaa

SEQ ID NO: 1921494 - RNA, 17 nt, Shigella flexneri 2a str. 2457T
auuugcauacccagaac

SEQ ID NO: 1921495 - RNA, 14 nt, Shigella flexneri 2a str. 2457T
auuugacuguucua

SEQ ID NO: 1921496 - RNA, 17 nt, Shigella flexneri 2a str. 2457T
auuucuuuacugacagg

SEQ ID NO: 1921497 - RNA, 22 nt, Shigella flexneri 2a str. 2457T
auuucuuuguagaugauuuuuu

SEQ ID NO: 1921498 - RNA, 15 nt, Shigella flexneri 2a str. 2457T
auuucuuugcgcucu

SEQ ID NO: 1921499 - RNA, 19 nt, Shigella flexneri 2a str. 2457T
auuucuuuugguugccguc

SEQ ID NO: 1921500 - RNA, 20 nt, Shigella flexneri 2a str. 2457T
auuuggcugccgagcaaauc

SEQ ID NO: 1921501 - RNA, 21 nt, Shigella flexneri 2a str. 2457T
auuuggcauaucgccguacau

SEQ ID NO: 1921502 - RNA, 20 nt, Shigella flexneri 2a str. 2457T
auuugcuuguuucauuacuc

SEQ ID NO: 1921503 - RNA, 18 nt, Shigella flexneri 2a str. 2457T
auuugcuuuucauacaau

SEQ ID NO: 1921504 - RNA, 21 nt, Shigella flexneri 2a str. 2457T
auuugcuuuucauacaaucgg

SEQ ID NO: 1921505 - RNA, 13 nt, Shigella flexneri 2a str. 2457T
auuugucgaagau

SEQ ID NO: 1921506 - RNA, 15 nt, Shigella flexneri 2a str. 2457T
auuuguccacgccgc

SEQ ID NO: 1921507 - RNA, 14 nt, Shigella flexneri 2a str. 2457T
auuugucagcagcu

SEQ ID NO: 1921508 - RNA, 15 nt, Shigella flexneri 2a str. 2457T
auuuuuugaaguauu

SEQ ID NO: 1921509 - RNA, 18 nt, Shigella flexneri 2a str. 2457T
auuuuugugaagaauaaa

SEQ ID NO: 1921510 - RNA, 23 nt, Shigella flexneri 2a str. 2457T
auuuuuuaacugacuuucguuug

SEQ ID NO: 1921511 - RNA, 12 nt, Shigella flexneri 2a str. 2457T
caaaaaagaggg

SEQ ID NO: 1921512 - RNA, 21 nt, Shigella flexneri 2a str. 2457T
caaaaaacauugauuaaguga

SEQ ID NO: 1921513 - RNA, 13 nt, Shigella flexneri 2a str. 2457T
caaaaaaccaucc

SEQ ID NO: 1921514 - RNA, 21 nt, Shigella flexneri 2a str. 2457T
caaaaaacaaaccccguacag

SEQ ID NO: 1921515 - RNA, 22 nt, Shigella flexneri 2a str. 2457T
auuuuuuuaaucgucaguuuuu

SEQ ID NO: 1921516 - RNA, 15 nt, Shigella flexneri 2a str. 2457T
caaaacacucuucaa

SEQ ID NO: 1921517 - RNA, 23 nt, Shigella flexneri 2a str. 2457T
caaaacacucuucaacacacuga

SEQ ID NO: 1921518 - RNA, 20 nt, Shigella flexneri 2a str. 2457T
caaaacauacccaguuucau

SEQ ID NO: 1921519 - RNA, 14 nt, Shigella flexneri 2a str. 2457T
caaaacauacccag

SEQ ID NO: 1921520 - RNA, 21 nt, Shigella flexneri 2a str. 2457T
caaaaauccagauuuauaaaa

SEQ ID NO: 1921521 - RNA, 19 nt, Shigella flexneri 2a str. 2457T
caaaaaucgcaaauugacu

SEQ ID NO: 1921522 - RNA, 12 nt, Shigella flexneri 2a str. 2457T
caaaaaucggca

SEQ ID NO: 1921523 - RNA, 15 nt, Shigella flexneri 2a str. 2457T
caaaaaucggcaaca

SEQ ID NO: 1921524 - RNA, 14 nt, Shigella flexneri 2a str. 2457T
caaaaauggcuuua

SEQ ID NO: 1921525 - RNA, 18 nt, Shigella flexneri 2a str. 2457T
caaaaaucggcaacauua

SEQ ID NO: 1921526 - RNA, 21 nt, Shigella flexneri 2a str. 2457T
caaaaaguaguuccagcauga

SEQ ID NO: 1921527 - RNA, 15 nt, Shigella flexneri 2a str. 2457T
caaaaaguccaaaag

SEQ ID NO: 1921528 - RNA, 15 nt, Shigella flexneri 2a str. 2457T
caaaaauaaucaucu

SEQ ID NO: 1921529 - RNA, 13 nt, Shigella flexneri 2a str. 2457T
caaaaauaaaugc

SEQ ID NO: 1921530 - RNA, 20 nt, Shigella flexneri 2a str. 2457T
caaaaacaacgagccaauaa

SEQ ID NO: 1921531 - RNA, 19 nt, Shigella flexneri 2a str. 2457T
caaaaacauugccguaagc

SEQ ID NO: 1921532 - RNA, 19 nt, Shigella flexneri 2a str. 2457T
caaaaaaggccgcaggcug

SEQ ID NO: 1921533 - RNA, 20 nt, Shigella flexneri 2a str. 2457T
caaaaaccgcugauuccugc

SEQ ID NO: 1921534 - RNA, 16 nt, Shigella flexneri 2a str. 2457T
caaaaacccuucuucc

SEQ ID NO: 1921535 - RNA, 22 nt, Shigella flexneri 2a str. 2457T
auuuucccuucugagaucaaug

SEQ ID NO: 1921536 - RNA, 22 nt, Shigella flexneri 2a str. 2457T
auuuucagcgugcccacguuca

SEQ ID NO: 1921537 - RNA, 18 nt, Shigella flexneri 2a str. 2457T
auuuucagcguggccaua

SEQ ID NO: 1921538 - RNA, 18 nt, Shigella flexneri 2a str. 2457T
auuuucagcgugcccacg

SEQ ID NO: 1921539 - RNA, 17 nt, Shigella flexneri 2a str. 2457T
auuuucagccaucaucc

SEQ ID NO: 1921540 - RNA, 13 nt, Shigella flexneri 2a str. 2457T
auuuucagcgugc

SEQ ID NO: 1921541 - RNA, 17 nt, Shigella flexneri 2a str. 2457T
auuuucuauuuugcauu

SEQ ID NO: 1921542 - RNA, 14 nt, Shigella flexneri 2a str. 2457T
auuuucucuuucag

SEQ ID NO: 1921543 - RNA, 22 nt, Shigella flexneri 2a str. 2457T
auuuuccgugaagaauuugccc

SEQ ID NO: 1921544 - RNA, 19 nt, Shigella flexneri 2a str. 2457T
auuuucugcgcauuuccca

SEQ ID NO: 1921545 - RNA, 16 nt, Shigella flexneri 2a str. 2457T
auuuucugaaaaucau

SEQ ID NO: 1921546 - RNA, 22 nt, Shigella flexneri 2a str. 2457T
auuuucagaaggauaauuaauc

SEQ ID NO: 1921547 - RNA, 22 nt, Shigella flexneri 2a str. 2457T
auuuuauugcguaaucuuuuca

SEQ ID NO: 1921548 - RNA, 14 nt, Shigella flexneri 2a str. 2457T
auuuuguaaaagaa

SEQ ID NO: 1921549 - RNA, 22 nt, Shigella flexneri 2a str. 2457T
auuuugcggcuauucuugaagu

SEQ ID NO: 1921550 - RNA, 18 nt, Shigella flexneri 2a str. 2457T
auuuugcguguuucagaa

SEQ ID NO: 1921551 - RNA, 23 nt, Shigella flexneri 2a str. 2457T
auuuugcgagcagcauuccggca

SEQ ID NO: 1921552 - RNA, 18 nt, Shigella flexneri 2a str. 2457T
auuuugcaguaacaauau

SEQ ID NO: 1921553 - RNA, 17 nt, Shigella flexneri 2a str. 2457T
auuuugcauuuuaaaug

SEQ ID NO: 1921554 - RNA, 22 nt, Shigella flexneri 2a str. 2457T
auuuugccuucauacugcggcg

SEQ ID NO: 1921555 - RNA, 14 nt, Shigella flexneri 2a str. 2457T
auuuuuagcagaca

SEQ ID NO: 1921556 - RNA, 18 nt, Shigella flexneri 2a str. 2457T
auuuugacuuuuacagcu

SEQ ID NO: 1921557 - RNA, 20 nt, Shigella flexneri 2a str. 2457T
auuuugacuuuuacagcuua

SEQ ID NO: 1921558 - RNA, 21 nt, Shigella flexneri 2a str. 2457T
auuuugaugauaucagccugc

SEQ ID NO: 1921559 - RNA, 14 nt, Shigella flexneri 2a str. 2457T
auuuucuucauucg

SEQ ID NO: 1921560 - RNA, 15 nt, Shigella flexneri 2a str. 2457T
auuuucuuugacaaa

SEQ ID NO: 1921561 - RNA, 18 nt, Shigella flexneri 2a str. 2457T
auuuugaagucuuuuuuc

SEQ ID NO: 1921562 - RNA, 21 nt, Shigella flexneri 2a str. 2457T
auuuugacucggcucauuauu

SEQ ID NO: 1921563 - RNA, 21 nt, Shigella flexneri 2a str. 2457T
auuccaguucgaucucuucgc

SEQ ID NO: 1921564 - RNA, 15 nt, Shigella flexneri 2a str. 2457T
auuccagcgccgcca

SEQ ID NO: 1921565 - RNA, 16 nt, Shigella flexneri 2a str. 2457T
auuccagcaagccacu

SEQ ID NO: 1921566 - RNA, 14 nt, Shigella flexneri 2a str. 2457T
auuccagaaaagag

SEQ ID NO: 1921567 - RNA, 14 nt, Shigella flexneri 2a str. 2457T
auucauaaugccca

SEQ ID NO: 1921568 - RNA, 22 nt, Shigella flexneri 2a str. 2457T
auuccggugaccaguuauuugg

SEQ ID NO: 1921569 - RNA, 23 nt, Shigella flexneri 2a str. 2457T
auuccugacguaacgaccaccac

SEQ ID NO: 1921570 - RNA, 20 nt, Shigella flexneri 2a str. 2457T
auuccugacccagcaccagu

SEQ ID NO: 1921571 - RNA, 10 nt, Shigella flexneri 2a str. 2457T
auuccucuca

SEQ ID NO: 1921572 - RNA, 19 nt, Shigella flexneri 2a str. 2457T
auuccccggucagcagcac

SEQ ID NO: 1921573 - RNA, 20 nt, Shigella flexneri 2a str. 2457T
auuccgaauuucauccugua

SEQ ID NO: 1921574 - RNA, 23 nt, Shigella flexneri 2a str. 2457T
auuccgccaccugcgaacuguaa

SEQ ID NO: 1921575 - RNA, 18 nt, Shigella flexneri 2a str. 2457T
auuccgcgugaaaugcca

SEQ ID NO: 1921576 - RNA, 15 nt, Shigella flexneri 2a str. 2457T
auuccgccaguucuu

SEQ ID NO: 1921577 - RNA, 15 nt, Shigella flexneri 2a str. 2457T
auuccgccaguugcg

SEQ ID NO: 1921578 - RNA, 18 nt, Shigella flexneri 2a str. 2457T
auucgccgguuccagcuu

SEQ ID NO: 1921579 - RNA, 18 nt, Shigella flexneri 2a str. 2457T
auucgauucacauuuaaa

SEQ ID NO: 1921580 - RNA, 20 nt, Shigella flexneri 2a str. 2457T
auucgauucacauuuaaaca

SEQ ID NO: 1921581 - RNA, 22 nt, Shigella flexneri 2a str. 2457T
auuccugccgcguuggcaaugu

SEQ ID NO: 1921582 - RNA, 21 nt, Shigella flexneri 2a str. 2457T
auuccugcgcuuccagcucca

SEQ ID NO: 1921583 - RNA, 20 nt, Shigella flexneri 2a str. 2457T
auuccuggggucaucagcau

SEQ ID NO: 1921584 - RNA, 17 nt, Shigella flexneri 2a str. 2457T
auuccugcugacggcac

SEQ ID NO: 1921585 - RNA, 14 nt, Shigella flexneri 2a str. 2457T
auucggcaaucacc

SEQ ID NO: 1921586 - RNA, 19 nt, Shigella flexneri 2a str. 2457T
auucgccugacgcaauaac

SEQ ID NO: 1921587 - RNA, 13 nt, Shigella flexneri 2a str. 2457T
auucggccaguaa

SEQ ID NO: 1921588 - RNA, 19 nt, Shigella flexneri 2a str. 2457T
auucggauugcuauuuaac

SEQ ID NO: 1921589 - RNA, 16 nt, Shigella flexneri 2a str. 2457T
auucggcaagauaaau

SEQ ID NO: 1921590 - RNA, 24 nt, Shigella flexneri 2a str. 2457T
auucuacuuugcgagucugcucca

SEQ ID NO: 1921591 - RNA, 16 nt, Shigella flexneri 2a str. 2457T
auucuuugcuguacau

SEQ ID NO: 1921592 - RNA, 14 nt, Shigella flexneri 2a str. 2457T
auucuuuuccucuc

SEQ ID NO: 1921593 - RNA, 19 nt, Shigella flexneri 2a str. 2457T
auugaaagcauaguuuuua

SEQ ID NO: 1921594 - RNA, 21 nt, Shigella flexneri 2a str. 2457T
auugaaaucacuaacgacaua

SEQ ID NO: 1921595 - RNA, 13 nt, Shigella flexneri 2a str. 2457T
auucuguucagua

SEQ ID NO: 1921596 - RNA, 12 nt, Shigella flexneri 2a str. 2457T
auucuguuuuau

SEQ ID NO: 1921597 - RNA, 19 nt, Shigella flexneri 2a str. 2457T
auucucagcugcaagauga

SEQ ID NO: 1921598 - RNA, 15 nt, Shigella flexneri 2a str. 2457T
auucucagugguugu

SEQ ID NO: 1921599 - RNA, 17 nt, Shigella flexneri 2a str. 2457T
auugaggcgcugaaugu

SEQ ID NO: 1921600 - RNA, 12 nt, Shigella flexneri 2a str. 2457T
auugagcugccc

SEQ ID NO: 1921601 - RNA, 17 nt, Shigella flexneri 2a str. 2457T
auugaguacggucugca

SEQ ID NO: 1921602 - RNA, 15 nt, Shigella flexneri 2a str. 2457T
auugaguuugaugac

SEQ ID NO: 1921603 - RNA, 17 nt, Shigella flexneri 2a str. 2457T
auugagugagcacugaa

SEQ ID NO: 1921604 - RNA, 13 nt, Shigella flexneri 2a str. 2457T
auugagcaccgcg

SEQ ID NO: 1921605 - RNA, 21 nt, Shigella flexneri 2a str. 2457T
auugagcauuggcaugcacgu

SEQ ID NO: 1921606 - RNA, 20 nt, Shigella flexneri 2a str. 2457T
auugagaucgcuuaacagaa

SEQ ID NO: 1921607 - RNA, 23 nt, Shigella flexneri 2a str. 2457T
auugagacguaguauccacacca

SEQ ID NO: 1921608 - RNA, 23 nt, Shigella flexneri 2a str. 2457T
auugacucgccuucaggaauacg

SEQ ID NO: 1921609 - RNA, 15 nt, Shigella flexneri 2a str. 2457T
auugagaaccacaau

SEQ ID NO: 1921610 - RNA, 18 nt, Shigella flexneri 2a str. 2457T
auugaaucacgacaaaca

SEQ ID NO: 1921611 - RNA, 14 nt, Shigella flexneri 2a str. 2457T
auugaauuuuaugu

SEQ ID NO: 1921612 - RNA, 18 nt, Shigella flexneri 2a str. 2457T
auugaaugcggcaggcac

SEQ ID NO: 1921613 - RNA, 11 nt, Shigella flexneri 2a str. 2457T
auugaagccaa

SEQ ID NO: 1921614 - RNA, 15 nt, Shigella flexneri 2a str. 2457T
auugaagauuuugcu

SEQ ID NO: 1921615 - RNA, 14 nt, Shigella flexneri 2a str. 2457T
auugaccccagcca

SEQ ID NO: 1921616 - RNA, 20 nt, Shigella flexneri 2a str. 2457T
auugacaguuuauuuucugc

SEQ ID NO: 1921617 - RNA, 22 nt, Shigella flexneri 2a str. 2457T
auugcgcaggcgcgcguaaauu

SEQ ID NO: 1921618 - RNA, 21 nt, Shigella flexneri 2a str. 2457T
auugcgcaccagcuugcgaca

SEQ ID NO: 1921619 - RNA, 15 nt, Shigella flexneri 2a str. 2457T
auugauaacggaacg

SEQ ID NO: 1921620 - RNA, 22 nt, Shigella flexneri 2a str. 2457T
auugauccccgcuuccugcagc

SEQ ID NO: 1921621 - RNA, 16 nt, Shigella flexneri 2a str. 2457T
auugauuaaaggaagg

SEQ ID NO: 1921622 - RNA, 14 nt, Shigella flexneri 2a str. 2457T
auugauuaaaggaa

SEQ ID NO: 1921623 - RNA, 15 nt, Shigella flexneri 2a str. 2457T
auugaucaauucuaa

SEQ ID NO: 1921624 - RNA, 15 nt, Shigella flexneri 2a str. 2457T
auugcugaaauacag

SEQ ID NO: 1921625 - RNA, 16 nt, Shigella flexneri 2a str. 2457T
auugcugaaauacaga

SEQ ID NO: 1921626 - RNA, 13 nt, Shigella flexneri 2a str. 2457T
auugcuucugcuu

SEQ ID NO: 1921627 - RNA, 19 nt, Shigella flexneri 2a str. 2457T
auugcgcuaaaaaguuccu

SEQ ID NO: 1921628 - RNA, 18 nt, Shigella flexneri 2a str. 2457T
auugcgcugcuuguugau

SEQ ID NO: 1921629 - RNA, 19 nt, Shigella flexneri 2a str. 2457T
auugcgcuggcaccgcaga

SEQ ID NO: 1921630 - RNA, 17 nt, Shigella flexneri 2a str. 2457T
auugcgcgacuuuuucc

SEQ ID NO: 1921631 - RNA, 18 nt, Shigella flexneri 2a str. 2457T
auugcgcgacuuuuuccu

SEQ ID NO: 1921632 - RNA, 14 nt, Shigella flexneri 2a str. 2457T
auugcgccugcagg

SEQ ID NO: 1921633 - RNA, 21 nt, Shigella flexneri 2a str. 2457T
auugcgccagccuuucaauac

SEQ ID NO: 1921634 - RNA, 13 nt, Shigella flexneri 2a str. 2457T
auugcuccaucca

SEQ ID NO: 1921635 - RNA, 12 nt, Shigella flexneri 2a str. 2457T
auugcuccaucc

SEQ ID NO: 1921636 - RNA, 17 nt, Shigella flexneri 2a str. 2457T
aaaaggugcucaaugag

SEQ ID NO: 1921637 - RNA, 17 nt, Shigella flexneri 2a str. 2457T
aaaagguugccugucuu

SEQ ID NO: 1921638 - RNA, 21 nt, Shigella flexneri 2a str. 2457T
aaaaguaagauugccugaugc

SEQ ID NO: 1921639 - RNA, 18 nt, Shigella flexneri 2a str. 2457T
auugguacauaacacaau

SEQ ID NO: 1921640 - RNA, 18 nt, Shigella flexneri 2a str. 2457T
auugguaguguguuugau

SEQ ID NO: 1921641 - RNA, 21 nt, Shigella flexneri 2a str. 2457T
auugguaguguguuugaucac

SEQ ID NO: 1921642 - RNA, 14 nt, Shigella flexneri 2a str. 2457T
auuggucuggaacu

SEQ ID NO: 1921643 - RNA, 14 nt, Shigella flexneri 2a str. 2457T
aaaaggucacuccc

SEQ ID NO: 1921644 - RNA, 15 nt, Shigella flexneri 2a str. 2457T
auugguccaucuuuu

SEQ ID NO: 1921645 - RNA, 14 nt, Shigella flexneri 2a str. 2457T
auugguaaugacuc

SEQ ID NO: 1921646 - RNA, 15 nt, Shigella flexneri 2a str. 2457T
auugguagacgcacc

SEQ ID NO: 1921647 - RNA, 14 nt, Shigella flexneri 2a str. 2457T
auuggguauucauu

SEQ ID NO: 1921648 - RNA, 14 nt, Shigella flexneri 2a str. 2457T
auuggguucaucug

SEQ ID NO: 1921649 - RNA, 15 nt, Shigella flexneri 2a str. 2457T
auugggguuacgacc

SEQ ID NO: 1921650 - RNA, 20 nt, Shigella flexneri 2a str. 2457T
auuggagaguugcaccagca

SEQ ID NO: 1921651 - RNA, 20 nt, Shigella flexneri 2a str. 2457T
auugcuuuuaccauacugga

SEQ ID NO: 1921652 - RNA, 16 nt, Shigella flexneri 2a str. 2457T
auuggaauacauauau

SEQ ID NO: 1921653 - RNA, 14 nt, Shigella flexneri 2a str. 2457T
auuuaauuacugag

SEQ ID NO: 1921654 - RNA, 16 nt, Shigella flexneri 2a str. 2457T
auuuaagguguugcgu

SEQ ID NO: 1921655 - RNA, 17 nt, Shigella flexneri 2a str. 2457T
auuguuuugaugaauca

SEQ ID NO: 1921656 - RNA, 23 nt, Shigella flexneri 2a str. 2457T
auugucuuaaaccggacaauaaa

SEQ ID NO: 1921657 - RNA, 15 nt, Shigella flexneri 2a str. 2457T
auugugauaaaaauc

SEQ ID NO: 1921658 - RNA, 18 nt, Shigella flexneri 2a str. 2457T
auuguuugucaugacgac

SEQ ID NO: 1921659 - RNA, 14 nt, Shigella flexneri 2a str. 2457T
auuguuugucauga

SEQ ID NO: 1921660 - RNA, 17 nt, Shigella flexneri 2a str. 2457T
auuuacacaauuuugua

SEQ ID NO: 1921661 - RNA, 21 nt, Shigella flexneri 2a str. 2457T
auuuacacuucauccuucaca

SEQ ID NO: 1921662 - RNA, 14 nt, Shigella flexneri 2a str. 2457T
auuuacacuucauc

SEQ ID NO: 1921663 - RNA, 17 nt, Shigella flexneri 2a str. 2457T
auuuacguuuuaaaccu

SEQ ID NO: 1921664 - RNA, 15 nt, Shigella flexneri 2a str. 2457T
auuuacuauuauuuu

SEQ ID NO: 1921665 - RNA, 23 nt, Shigella flexneri 2a str. 2457T
auuuacgccgacguuggcuauau

SEQ ID NO: 1921666 - RNA, 23 nt, Shigella flexneri 2a str. 2457T
auuuacgcugucuuuugaucaaa

SEQ ID NO: 1921667 - RNA, 21 nt, Shigella flexneri 2a str. 2457T
auuuacucucaucaauaccug

SEQ ID NO: 1921668 - RNA, 15 nt, Shigella flexneri 2a str. 2457T
auuuagcaaauuuuu

SEQ ID NO: 1921669 - RNA, 21 nt, Shigella flexneri 2a str. 2457T
augccggguaauuucauuaaa

SEQ ID NO: 1921670 - RNA, 18 nt, Shigella flexneri 2a str. 2457T
augccggaugcgccagca

SEQ ID NO: 1921671 - RNA, 21 nt, Shigella flexneri 2a str. 2457T
augccgucaccagcaucaaca

SEQ ID NO: 1921672 - RNA, 16 nt, Shigella flexneri 2a str. 2457T
augccgguuaauacgc

SEQ ID NO: 1921673 - RNA, 21 nt, Shigella flexneri 2a str. 2457T
augcccccucacaugaguugc

SEQ ID NO: 1921674 - RNA, 12 nt, Shigella flexneri 2a str. 2457T
augcccccagca

SEQ ID NO: 1921675 - RNA, 21 nt, Shigella flexneri 2a str. 2457T
augccccuguaucaugcagua

SEQ ID NO: 1921676 - RNA, 19 nt, Shigella flexneri 2a str. 2457T
augcccgccgugcugccag

SEQ ID NO: 1921677 - RNA, 15 nt, Shigella flexneri 2a str. 2457T
augcccaucacuauc

SEQ ID NO: 1921678 - RNA, 15 nt, Shigella flexneri 2a str. 2457T
augccagucaaugaa

SEQ ID NO: 1921679 - RNA, 14 nt, Shigella flexneri 2a str. 2457T
augccagucaguua

SEQ ID NO: 1921680 - RNA, 14 nt, Shigella flexneri 2a str. 2457T
augccagcuuucac

SEQ ID NO: 1921681 - RNA, 11 nt, Shigella flexneri 2a str. 2457T
augcauuauau

SEQ ID NO: 1921682 - RNA, 22 nt, Shigella flexneri 2a str. 2457T
augccaaauauuucuuuaucac

SEQ ID NO: 1921683 - RNA, 24 nt, Shigella flexneri 2a str. 2457T
augccaaauauuucuuuaucacca

SEQ ID NO: 1921684 - RNA, 16 nt, Shigella flexneri 2a str. 2457T
augccaaauauuucuu

SEQ ID NO: 1921685 - RNA, 13 nt, Shigella flexneri 2a str. 2457T
augccaaaaggga

SEQ ID NO: 1921686 - RNA, 19 nt, Shigella flexneri 2a str. 2457T
augccagcacagaucgcac

SEQ ID NO: 1921687 - RNA, 15 nt, Shigella flexneri 2a str. 2457T
augccagauaagaca

SEQ ID NO: 1921688 - RNA, 18 nt, Shigella flexneri 2a str. 2457T
augccacugucaacugcu

SEQ ID NO: 1921689 - RNA, 21 nt, Shigella flexneri 2a str. 2457T
augccacgugagcuuuucugc

SEQ ID NO: 1921690 - RNA, 22 nt, Shigella flexneri 2a str. 2457T
augccagaaagcguauccauca

SEQ ID NO: 1921691 - RNA, 14 nt, Shigella flexneri 2a str. 2457T
augcaguaccagau

SEQ ID NO: 1921692 - RNA, 20 nt, Shigella flexneri 2a str. 2457T
augcagugcauccagcagcc

SEQ ID NO: 1921693 - RNA, 15 nt, Shigella flexneri 2a str. 2457T
augcaguaccagaua

SEQ ID NO: 1921694 - RNA, 23 nt, Shigella flexneri 2a str. 2457T
augcagugcggcuguagagcuac

SEQ ID NO: 1921695 - RNA, 15 nt, Shigella flexneri 2a str. 2457T
augcauaaaaaaacg

SEQ ID NO: 1921696 - RNA, 23 nt, Shigella flexneri 2a str. 2457T
augcaucgcauccgacaucaacc

SEQ ID NO: 1921697 - RNA, 16 nt, Shigella flexneri 2a str. 2457T
augcauccggcaguca

SEQ ID NO: 1921698 - RNA, 17 nt, Shigella flexneri 2a str. 2457T
augcauccggcagucag

SEQ ID NO: 1921699 - RNA, 16 nt, Shigella flexneri 2a str. 2457T
augcauauccaggcua

SEQ ID NO: 1921700 - RNA, 12 nt, Shigella flexneri 2a str. 2457T
augcaucccgcc

SEQ ID NO: 1921701 - RNA, 11 nt, Shigella flexneri 2a str. 2457T
augcaucagug

SEQ ID NO: 1921702 - RNA, 22 nt, Shigella flexneri 2a str. 2457T
augcaucauaaccugcucugcc

SEQ ID NO: 1921703 - RNA, 18 nt, Shigella flexneri 2a str. 2457T
augcaucaugaaaaccgu

SEQ ID NO: 1921704 - RNA, 23 nt, Shigella flexneri 2a str. 2457T
augaucgccaucagugccaguac

SEQ ID NO: 1921705 - RNA, 21 nt, Shigella flexneri 2a str. 2457T
augaucgccaucagugccagu

SEQ ID NO: 1921706 - RNA, 14 nt, Shigella flexneri 2a str. 2457T
augcaggaucgcuc

SEQ ID NO: 1921707 - RNA, 14 nt, Shigella flexneri 2a str. 2457T
augcaggccaccag

SEQ ID NO: 1921708 - RNA, 18 nt, Shigella flexneri 2a str. 2457T
augcaggcguuuuuggca

SEQ ID NO: 1921709 - RNA, 15 nt, Shigella flexneri 2a str. 2457T
augcagggcaaacuc

SEQ ID NO: 1921710 - RNA, 19 nt, Shigella flexneri 2a str. 2457T
augcagggcaaacucugag

SEQ ID NO: 1921711 - RNA, 18 nt, Shigella flexneri 2a str. 2457T
augcacucgcauccucuu

SEQ ID NO: 1921712 - RNA, 18 nt, Shigella flexneri 2a str. 2457T
augcagcuccaccgauuu

SEQ ID NO: 1921713 - RNA, 23 nt, Shigella flexneri 2a str. 2457T
augcucacugcgaaguuuuuccg

SEQ ID NO: 1921714 - RNA, 20 nt, Shigella flexneri 2a str. 2457T
augcugaaaagaguaguaau

SEQ ID NO: 1921715 - RNA, 17 nt, Shigella flexneri 2a str. 2457T
augcucuuuucugaagu

SEQ ID NO: 1921716 - RNA, 21 nt, Shigella flexneri 2a str. 2457T
augcuauuggucggaucauuc

SEQ ID NO: 1921717 - RNA, 17 nt, Shigella flexneri 2a str. 2457T
augcucaacuacuccaa

SEQ ID NO: 1921718 - RNA, 22 nt, Shigella flexneri 2a str. 2457T
augcucacaaccccggcaaaug

SEQ ID NO: 1921719 - RNA, 14 nt, Shigella flexneri 2a str. 2457T
augcuacaacaucg

SEQ ID NO: 1921720 - RNA, 14 nt, Shigella flexneri 2a str. 2457T
augcguucucccuc

SEQ ID NO: 1921721 - RNA, 13 nt, Shigella flexneri 2a str. 2457T
augcuaaaaacau

SEQ ID NO: 1921722 - RNA, 19 nt, Shigella flexneri 2a str. 2457T
augcuaaaaacaucaugau

SEQ ID NO: 1921723 - RNA, 22 nt, Shigella flexneri 2a str. 2457T
augcgcaguugcagcaagccau

SEQ ID NO: 1921724 - RNA, 20 nt, Shigella flexneri 2a str. 2457T
augcgcaucaaagccaggca

SEQ ID NO: 1921725 - RNA, 13 nt, Shigella flexneri 2a str. 2457T
augcgcuggcagu

SEQ ID NO: 1921726 - RNA, 19 nt, Shigella flexneri 2a str. 2457T
augcggagacucaaacccc

SEQ ID NO: 1921727 - RNA, 16 nt, Shigella flexneri 2a str. 2457T
augcggaauuugauga

SEQ ID NO: 1921728 - RNA, 20 nt, Shigella flexneri 2a str. 2457T
augcgcuuuaucgccgcugg

SEQ ID NO: 1921729 - RNA, 13 nt, Shigella flexneri 2a str. 2457T
augcgcuuccugc

SEQ ID NO: 1921730 - RNA, 21 nt, Shigella flexneri 2a str. 2457T
augcgcuucgcuuaccaugcc

SEQ ID NO: 1921731 - RNA, 17 nt, Shigella flexneri 2a str. 2457T
augcgaugcauccggca

SEQ ID NO: 1921732 - RNA, 16 nt, Shigella flexneri 2a str. 2457T
augcgauggagugaga

SEQ ID NO: 1921733 - RNA, 18 nt, Shigella flexneri 2a str. 2457T
augcggggauuacucccc

SEQ ID NO: 1921734 - RNA, 18 nt, Shigella flexneri 2a str. 2457T
augcgggucaggccagga

SEQ ID NO: 1921735 - RNA, 12 nt, Shigella flexneri 2a str. 2457T
augcggcgagga

SEQ ID NO: 1921736 - RNA, 17 nt, Shigella flexneri 2a str. 2457T
augcgguuaaaccgaaa

SEQ ID NO: 1921737 - RNA, 17 nt, Shigella flexneri 2a str. 2457T
augcgguggauccuguu

SEQ ID NO: 1921738 - RNA, 16 nt, Shigella flexneri 2a str. 2457T
augcgucuuccgugcc

SEQ ID NO: 1921739 - RNA, 18 nt, Shigella flexneri 2a str. 2457T
augucacccacuguggua

SEQ ID NO: 1921740 - RNA, 22 nt, Shigella flexneri 2a str. 2457T
augucacaaauaaaaaaugaga

SEQ ID NO: 1921741 - RNA, 19 nt, Shigella flexneri 2a str. 2457T
auguauggcgauagcccag

SEQ ID NO: 1921742 - RNA, 24 nt, Shigella flexneri 2a str. 2457T
augucaucagcauucucaucacca

SEQ ID NO: 1921743 - RNA, 16 nt, Shigella flexneri 2a str. 2457T
aaaagaugagaaaaau

SEQ ID NO: 1921744 - RNA, 16 nt, Shigella flexneri 2a str. 2457T
auguagucaucugcac

SEQ ID NO: 1921745 - RNA, 13 nt, Shigella flexneri 2a str. 2457T
auguauaucggcc

SEQ ID NO: 1921746 - RNA, 18 nt, Shigella flexneri 2a str. 2457T
aaaagauugaauuauuca

SEQ ID NO: 1921747 - RNA, 18 nt, Shigella flexneri 2a str. 2457T
aaaagauggauugcugaa

SEQ ID NO: 1921748 - RNA, 15 nt, Shigella flexneri 2a str. 2457T
aaaagauuaaaaaaa

SEQ ID NO: 1921749 - RNA, 16 nt, Shigella flexneri 2a str. 2457T
aaaagauuaaaaaaac

SEQ ID NO: 1921750 - RNA, 13 nt, Shigella flexneri 2a str. 2457T
auguaugaaguac

SEQ ID NO: 1921751 - RNA, 16 nt, Shigella flexneri 2a str. 2457T
auguaagaugaaauag

SEQ ID NO: 1921752 - RNA, 20 nt, Shigella flexneri 2a str. 2457T
auguaaucuguugaaauaau

SEQ ID NO: 1921753 - RNA, 16 nt, Shigella flexneri 2a str. 2457T
auguagcgcugcaaac

SEQ ID NO: 1921754 - RNA, 24 nt, Shigella flexneri 2a str. 2457T
auguagcgcugcaaaccacgguuc

SEQ ID NO: 1921755 - RNA, 14 nt, Shigella flexneri 2a str. 2457T
auguagcucaccuu

SEQ ID NO: 1921756 - RNA, 16 nt, Shigella flexneri 2a str. 2457T
augguugucacugcau

SEQ ID NO: 1921757 - RNA, 13 nt, Shigella flexneri 2a str. 2457T
augguuucauucu

SEQ ID NO: 1921758 - RNA, 16 nt, Shigella flexneri 2a str. 2457T
augguuuucaauuauc

SEQ ID NO: 1921759 - RNA, 22 nt, Shigella flexneri 2a str. 2457T
augguuucacggcaccagccau

SEQ ID NO: 1921760 - RNA, 12 nt, Shigella flexneri 2a str. 2457T
auguaaaaauac

SEQ ID NO: 1921761 - RNA, 19 nt, Shigella flexneri 2a str. 2457T
auguaaaaggcgcuaaaaa

SEQ ID NO: 1921762 - RNA, 20 nt, Shigella flexneri 2a str. 2457T
augguuuuuggguucagcau

SEQ ID NO: 1921763 - RNA, 13 nt, Shigella flexneri 2a str. 2457T
auguaaaaauacu

SEQ ID NO: 1921764 - RNA, 11 nt, Shigella flexneri 2a str. 2457T
augggguggaa

SEQ ID NO: 1921765 - RNA, 18 nt, Shigella flexneri 2a str. 2457T
augggaaaugacauucac

SEQ ID NO: 1921766 - RNA, 13 nt, Shigella flexneri 2a str. 2457T
auggcguacucaa

SEQ ID NO: 1921767 - RNA, 15 nt, Shigella flexneri 2a str. 2457T
auggcuucuuccccg

SEQ ID NO: 1921768 - RNA, 15 nt, Shigella flexneri 2a str. 2457T
auggcggcuuagcug

SEQ ID NO: 1921769 - RNA, 11 nt, Shigella flexneri 2a str. 2457T
auggcggcugg

SEQ ID NO: 1921770 - RNA, 16 nt, Shigella flexneri 2a str. 2457T
auggcgcugcggcgga

SEQ ID NO: 1921771 - RNA, 14 nt, Shigella flexneri 2a str. 2457T
auggcggaucacgc

SEQ ID NO: 1921772 - RNA, 14 nt, Shigella flexneri 2a str. 2457T
augcugguuccuga

SEQ ID NO: 1921773 - RNA, 19 nt, Shigella flexneri 2a str. 2457T
augcugacgcaucuucucc

SEQ ID NO: 1921774 - RNA, 17 nt, Shigella flexneri 2a str. 2457T
augcuguaaccagcgca

SEQ ID NO: 1921775 - RNA, 19 nt, Shigella flexneri 2a str. 2457T
augcuguauucuucagcga

SEQ ID NO: 1921776 - RNA, 16 nt, Shigella flexneri 2a str. 2457T
auggcaaacaaacugc

SEQ ID NO: 1921777 - RNA, 12 nt, Shigella flexneri 2a str. 2457T
auggcacaaugg

SEQ ID NO: 1921778 - RNA, 15 nt, Shigella flexneri 2a str. 2457T
auggcgcgcagaaag

SEQ ID NO: 1921779 - RNA, 16 nt, Shigella flexneri 2a str. 2457T
auggcgcgaaaacaac

SEQ ID NO: 1921780 - RNA, 20 nt, Shigella flexneri 2a str. 2457T
auggcgcgccaccucuuuca

SEQ ID NO: 1921781 - RNA, 14 nt, Shigella flexneri 2a str. 2457T
auggcgaauggcac

SEQ ID NO: 1921782 - RNA, 14 nt, Shigella flexneri 2a str. 2457T
auggcgacaaggcg

SEQ ID NO: 1921783 - RNA, 23 nt, Shigella flexneri 2a str. 2457T
auggcgauuagaaacagaaugau

SEQ ID NO: 1921784 - RNA, 15 nt, Shigella flexneri 2a str. 2457T
auggcgauuauauga

SEQ ID NO: 1921785 - RNA, 13 nt, Shigella flexneri 2a str. 2457T
auggcgacauaaa

SEQ ID NO: 1921786 - RNA, 12 nt, Shigella flexneri 2a str. 2457T
auggcgauacuc

SEQ ID NO: 1921787 - RNA, 23 nt, Shigella flexneri 2a str. 2457T
auggcauuuuuauuugugguugg

SEQ ID NO: 1921788 - RNA, 13 nt, Shigella flexneri 2a str. 2457T
auggcauccuguu

SEQ ID NO: 1921789 - RNA, 21 nt, Shigella flexneri 2a str. 2457T
auggcaucuacgcucucuuca

SEQ ID NO: 1921790 - RNA, 20 nt, Shigella flexneri 2a str. 2457T
auggccugaugugacgcugu

SEQ ID NO: 1921791 - RNA, 12 nt, Shigella flexneri 2a str. 2457T
auggccagccag

SEQ ID NO: 1921792 - RNA, 15 nt, Shigella flexneri 2a str. 2457T
auggccagccagcag

SEQ ID NO: 1921793 - RNA, 22 nt, Shigella flexneri 2a str. 2457T
auucagacaggcgaaacccgcu

SEQ ID NO: 1921794 - RNA, 16 nt, Shigella flexneri 2a str. 2457T
auucagaccauuccuc

SEQ ID NO: 1921795 - RNA, 23 nt, Shigella flexneri 2a str. 2457T
auucagagggcaaauucuucacg

SEQ ID NO: 1921796 - RNA, 23 nt, Shigella flexneri 2a str. 2457T
auucagauaauccccaaugaccu

SEQ ID NO: 1921797 - RNA, 16 nt, Shigella flexneri 2a str. 2457T
auucacuuucugaagg

SEQ ID NO: 1921798 - RNA, 17 nt, Shigella flexneri 2a str. 2457T
auucacuuucugaagga

SEQ ID NO: 1921799 - RNA, 23 nt, Shigella flexneri 2a str. 2457T
auucagaacacaaaaccgauuaa

SEQ ID NO: 1921800 - RNA, 21 nt, Shigella flexneri 2a str. 2457T
auucagacacgccgccagacc

SEQ ID NO: 1921801 - RNA, 15 nt, Shigella flexneri 2a str. 2457T
auucacucuauaccg

SEQ ID NO: 1921802 - RNA, 21 nt, Shigella flexneri 2a str. 2457T
auucacucuauaccgcugaag

SEQ ID NO: 1921803 - RNA, 16 nt, Shigella flexneri 2a str. 2457T
auucaccucugcggca

SEQ ID NO: 1921804 - RNA, 19 nt, Shigella flexneri 2a str. 2457T
auucaccgauacaaucauu

SEQ ID NO: 1921805 - RNA, 21 nt, Shigella flexneri 2a str. 2457T
auucaccguaauaguuucuga

SEQ ID NO: 1921806 - RNA, 17 nt, Shigella flexneri 2a str. 2457T
auucacgaauauuuccc

SEQ ID NO: 1921807 - RNA, 21 nt, Shigella flexneri 2a str. 2457T
auucacgaaucuauucauuua

SEQ ID NO: 1921808 - RNA, 11 nt, Shigella flexneri 2a str. 2457T
auucagcagca

SEQ ID NO: 1921809 - RNA, 20 nt, Shigella flexneri 2a str. 2457T
auucagcccgagguuauuuu

SEQ ID NO: 1921810 - RNA, 21 nt, Shigella flexneri 2a str. 2457T
auucagaugaugauacugaca

SEQ ID NO: 1921811 - RNA, 22 nt, Shigella flexneri 2a str. 2457T
auucagcgaguuuuucagucca

SEQ ID NO: 1921812 - RNA, 20 nt, Shigella flexneri 2a str. 2457T
auucagcaauguuucucugg

SEQ ID NO: 1921813 - RNA, 15 nt, Shigella flexneri 2a str. 2457T
auucagcucaagaau

SEQ ID NO: 1921814 - RNA, 23 nt, Shigella flexneri 2a str. 2457T
auucagcgucgucagcaguucac

SEQ ID NO: 1921815 - RNA, 20 nt, Shigella flexneri 2a str. 2457T
auucaggcguugaaaaauca

SEQ ID NO: 1921816 - RNA, 14 nt, Shigella flexneri 2a str. 2457T
auucaggcgcagca

SEQ ID NO: 1921817 - RNA, 18 nt, Shigella flexneri 2a str. 2457T
auucaggccguagagcac

SEQ ID NO: 1921818 - RNA, 18 nt, Shigella flexneri 2a str. 2457T
auucagugacagguugcu

SEQ ID NO: 1921819 - RNA, 16 nt, Shigella flexneri 2a str. 2457T
auucaaucucuucaca

SEQ ID NO: 1921820 - RNA, 13 nt, Shigella flexneri 2a str. 2457T
auucaaucucuuc

SEQ ID NO: 1921821 - RNA, 13 nt, Shigella flexneri 2a str. 2457T
auuauugagcgca

SEQ ID NO: 1921822 - RNA, 15 nt, Shigella flexneri 2a str. 2457T
auucaauuauaguau

SEQ ID NO: 1921823 - RNA, 17 nt, Shigella flexneri 2a str. 2457T
auucaauuaauaacaca

SEQ ID NO: 1921824 - RNA, 15 nt, Shigella flexneri 2a str. 2457T
auucaauuaauaaca

SEQ ID NO: 1921825 - RNA, 12 nt, Shigella flexneri 2a str. 2457T
aaaaggcagcgg

SEQ ID NO: 1921826 - RNA, 14 nt, Shigella flexneri 2a str. 2457T
auucaccagcaaau

SEQ ID NO: 1921827 - RNA, 14 nt, Shigella flexneri 2a str. 2457T
auucacauuuaaac

SEQ ID NO: 1921828 - RNA, 17 nt, Shigella flexneri 2a str. 2457T
auucacauuuuuaagcc

SEQ ID NO: 1921829 - RNA, 15 nt, Shigella flexneri 2a str. 2457T
auuaugaucaaaauc

SEQ ID NO: 1921830 - RNA, 16 nt, Shigella flexneri 2a str. 2457T
auuaugaaacaagaag

SEQ ID NO: 1921831 - RNA, 15 nt, Shigella flexneri 2a str. 2457T
auuaucuuuauuauc

SEQ ID NO: 1921832 - RNA, 18 nt, Shigella flexneri 2a str. 2457T
auuaucuuuauuaucaac

SEQ ID NO: 1921833 - RNA, 17 nt, Shigella flexneri 2a str. 2457T
auuauucauggcaggag

SEQ ID NO: 1921834 - RNA, 14 nt, Shigella flexneri 2a str. 2457T
auuauuauuuuugu

SEQ ID NO: 1921835 - RNA, 22 nt, Shigella flexneri 2a str. 2457T
auuaugaucaaaaucauauaau

SEQ ID NO: 1921836 - RNA, 21 nt, Shigella flexneri 2a str. 2457T
auuaugcccuuucaauggaag

SEQ ID NO: 1921837 - RNA, 14 nt, Shigella flexneri 2a str. 2457T
auuaucacucugcc

SEQ ID NO: 1921838 - RNA, 15 nt, Shigella flexneri 2a str. 2457T
auuaucagcaaagca

SEQ ID NO: 1921839 - RNA, 17 nt, Shigella flexneri 2a str. 2457T
auuauagacaucuuuau

SEQ ID NO: 1921840 - RNA, 16 nt, Shigella flexneri 2a str. 2457T
auuaucugcaauuacu

SEQ ID NO: 1921841 - RNA, 19 nt, Shigella flexneri 2a str. 2457T
auuaucuggaauuccuuuc

SEQ ID NO: 1921842 - RNA, 16 nt, Shigella flexneri 2a str. 2457T
auuaucuggcaagccu

SEQ ID NO: 1921843 - RNA, 21 nt, Shigella flexneri 2a str. 2457T
auuaucuggcaagccugaaaa

SEQ ID NO: 1921844 - RNA, 18 nt, Shigella flexneri 2a str. 2457T
auuaucugggcugccuga

SEQ ID NO: 1921845 - RNA, 21 nt, Shigella flexneri 2a str. 2457T
auuaucccgugcacaaauuuu

SEQ ID NO: 1921846 - RNA, 20 nt, Shigella flexneri 2a str. 2457T
auuagcgaccgaacagauca

SEQ ID NO: 1921847 - RNA, 19 nt, Shigella flexneri 2a str. 2457T
auuagccugaauauccaga

SEQ ID NO: 1921848 - RNA, 18 nt, Shigella flexneri 2a str. 2457T
aaaagcucccuaaaauau

SEQ ID NO: 1921849 - RNA, 17 nt, Shigella flexneri 2a str. 2457T
auuaccuuuuuacccau

SEQ ID NO: 1921850 - RNA, 19 nt, Shigella flexneri 2a str. 2457T
auuaccuuuuuacccaugg

SEQ ID NO: 1921851 - RNA, 21 nt, Shigella flexneri 2a str. 2457T
auuacgaauauaaauauuuuc

SEQ ID NO: 1921852 - RNA, 20 nt, Shigella flexneri 2a str. 2457T
auuacccguugcaauacuuc

SEQ ID NO: 1921853 - RNA, 17 nt, Shigella flexneri 2a str. 2457T
auuacgacucaacccca

SEQ ID NO: 1921854 - RNA, 18 nt, Shigella flexneri 2a str. 2457T
auuacgcucacugcaaaa

SEQ ID NO: 1921855 - RNA, 20 nt, Shigella flexneri 2a str. 2457T
auuacgcucacugcaaaaca

SEQ ID NO: 1921856 - RNA, 22 nt, Shigella flexneri 2a str. 2457T
aaaagcugcaaggugaaagcaa

SEQ ID NO: 1921857 - RNA, 17 nt, Shigella flexneri 2a str. 2457T
auguuguuucucuuucu

SEQ ID NO: 1921858 - RNA, 16 nt, Shigella flexneri 2a str. 2457T
auguuguugucuauuu

SEQ ID NO: 1921859 - RNA, 14 nt, Shigella flexneri 2a str. 2457T
auguuguuuuuaac

SEQ ID NO: 1921860 - RNA, 18 nt, Shigella flexneri 2a str. 2457T
auguuucaacggaccaau

SEQ ID NO: 1921861 - RNA, 18 nt, Shigella flexneri 2a str. 2457T
auguuuaguauuguuaaa

SEQ ID NO: 1921862 - RNA, 22 nt, Shigella flexneri 2a str. 2457T
auguuuaguauuguuaaauauu

SEQ ID NO: 1921863 - RNA, 20 nt, Shigella flexneri 2a str. 2457T
auguugucucagauucagau

SEQ ID NO: 1921864 - RNA, 19 nt, Shigella flexneri 2a str. 2457T
auguugcgcggucggaaaa

SEQ ID NO: 1921865 - RNA, 13 nt, Shigella flexneri 2a str. 2457T
auguugcuggaag

SEQ ID NO: 1921866 - RNA, 20 nt, Shigella flexneri 2a str. 2457T
auguucaucaagcugugccu

SEQ ID NO: 1921867 - RNA, 16 nt, Shigella flexneri 2a str. 2457T
auguugccacacgccc

SEQ ID NO: 1921868 - RNA, 15 nt, Shigella flexneri 2a str. 2457T
auguccggaaauuug

SEQ ID NO: 1921869 - RNA, 14 nt, Shigella flexneri 2a str. 2457T
auguccuuucaggg

SEQ ID NO: 1921870 - RNA, 20 nt, Shigella flexneri 2a str. 2457T
auguccuuuuaccacuacau

SEQ ID NO: 1921871 - RNA, 17 nt, Shigella flexneri 2a str. 2457T
auguucaauaaaagcau

SEQ ID NO: 1921872 - RNA, 22 nt, Shigella flexneri 2a str. 2457T
auguucaauaagcgcagccaaa

SEQ ID NO: 1921873 - RNA, 11 nt, Shigella flexneri 2a str. 2457T
auguucacugc

SEQ ID NO: 1921874 - RNA, 13 nt, Shigella flexneri 2a str. 2457T
auguucacugccg

SEQ ID NO: 1921875 - RNA, 15 nt, Shigella flexneri 2a str. 2457T
auguucaucaagcug

SEQ ID NO: 1921876 - RNA, 20 nt, Shigella flexneri 2a str. 2457T
auguugcaaaggccagccag

SEQ ID NO: 1921877 - RNA, 20 nt, Shigella flexneri 2a str. 2457T
auguucagaaagcgccagca

SEQ ID NO: 1921878 - RNA, 21 nt, Shigella flexneri 2a str. 2457T
auguucagaaagcgccagcaa

SEQ ID NO: 1921879 - RNA, 22 nt, Shigella flexneri 2a str. 2457T
auguucagccgucauccaggaa

SEQ ID NO: 1921880 - RNA, 17 nt, Shigella flexneri 2a str. 2457T
auguucaggauauuuau

SEQ ID NO: 1921881 - RNA, 21 nt, Shigella flexneri 2a str. 2457T
auuaaaaaaacaccacaaaac

SEQ ID NO: 1921882 - RNA, 19 nt, Shigella flexneri 2a str. 2457T
auguuuccgcgcagguaaa

SEQ ID NO: 1921883 - RNA, 16 nt, Shigella flexneri 2a str. 2457T
auuaaacagccaacug

SEQ ID NO: 1921884 - RNA, 15 nt, Shigella flexneri 2a str. 2457T
auuaacagcaaacag

SEQ ID NO: 1921885 - RNA, 23 nt, Shigella flexneri 2a str. 2457T
auuaacaccuagugcagauaguu

SEQ ID NO: 1921886 - RNA, 18 nt, Shigella flexneri 2a str. 2457T
auuaacagucagucucaa

SEQ ID NO: 1921887 - RNA, 17 nt, Shigella flexneri 2a str. 2457T
auuaaggguaaaaggau

SEQ ID NO: 1921888 - RNA, 15 nt, Shigella flexneri 2a str. 2457T
aaaagcacagaaucu

SEQ ID NO: 1921889 - RNA, 21 nt, Shigella flexneri 2a str. 2457T
aaaagcauagccccagcgcag

SEQ ID NO: 1921890 - RNA, 18 nt, Shigella flexneri 2a str. 2457T
auuaauaugcucaacaau

SEQ ID NO: 1921891 - RNA, 14 nt, Shigella flexneri 2a str. 2457T
auuaaucagcagau

SEQ ID NO: 1921892 - RNA, 21 nt, Shigella flexneri 2a str. 2457T
auuaaugacauucaggccgcc

SEQ ID NO: 1921893 - RNA, 22 nt, Shigella flexneri 2a str. 2457T
auuaaucgagauaccuaacauu

SEQ ID NO: 1921894 - RNA, 19 nt, Shigella flexneri 2a str. 2457T
auuaauccagggaucaaca

SEQ ID NO: 1921895 - RNA, 21 nt, Shigella flexneri 2a str. 2457T
auuaauuaacaacguuuuucu

SEQ ID NO: 1921896 - RNA, 21 nt, Shigella flexneri 2a str. 2457T
auuaaugcgcccagcgucagc

SEQ ID NO: 1921897 - RNA, 23 nt, Shigella flexneri 2a str. 2457T
auuaauggugauggucgucaauc

SEQ ID NO: 1921898 - RNA, 20 nt, Shigella flexneri 2a str. 2457T
auuaauugccguuaaaacua

SEQ ID NO: 1921899 - RNA, 17 nt, Shigella flexneri 2a str. 2457T
auuacacccuuaaucaa

SEQ ID NO: 1921900 - RNA, 18 nt, Shigella flexneri 2a str. 2457T
auuacaagaaucaugcca

SEQ ID NO: 1921901 - RNA, 14 nt, Shigella flexneri 2a str. 2457T
auauugcuguacuu

SEQ ID NO: 1921902 - RNA, 21 nt, Shigella flexneri 2a str. 2457T
auauugcacaguauagcauca

SEQ ID NO: 1921903 - RNA, 22 nt, Shigella flexneri 2a str. 2457T
auauugcacaguauagcaucau

SEQ ID NO: 1921904 - RNA, 21 nt, Shigella flexneri 2a str. 2457T
auauugcccgugacucccacu

SEQ ID NO: 1921905 - RNA, 21 nt, Shigella flexneri 2a str. 2457T
auauugccccacaccgcgacg

SEQ ID NO: 1921906 - RNA, 15 nt, Shigella flexneri 2a str. 2457T
auauuccccagacga

SEQ ID NO: 1921907 - RNA, 21 nt, Shigella flexneri 2a str. 2457T
auauuccccggucagcagcac

SEQ ID NO: 1921908 - RNA, 21 nt, Shigella flexneri 2a str. 2457T
auauuccgcaccugccagcgc

SEQ ID NO: 1921909 - RNA, 18 nt, Shigella flexneri 2a str. 2457T
auauuccgcaccugccag

SEQ ID NO: 1921910 - RNA, 14 nt, Shigella flexneri 2a str. 2457T
auauucagcagcag

SEQ ID NO: 1921911 - RNA, 20 nt, Shigella flexneri 2a str. 2457T
auauucaggcguugaaaaau

SEQ ID NO: 1921912 - RNA, 21 nt, Shigella flexneri 2a str. 2457T
auauucaggcguugaaaaauc

SEQ ID NO: 1921913 - RNA, 16 nt, Shigella flexneri 2a str. 2457T
auaugcagcagccagu

SEQ ID NO: 1921914 - RNA, 15 nt, Shigella flexneri 2a str. 2457T
auaugauuuaaaaaa

SEQ ID NO: 1921915 - RNA, 14 nt, Shigella flexneri 2a str. 2457T
auaugauucuuacu

SEQ ID NO: 1921916 - RNA, 17 nt, Shigella flexneri 2a str. 2457T
auauucaacgucacugg

SEQ ID NO: 1921917 - RNA, 13 nt, Shigella flexneri 2a str. 2457T
auauucaauugga

SEQ ID NO: 1921918 - RNA, 20 nt, Shigella flexneri 2a str. 2457T
auauuuugcuuuaaguucag

SEQ ID NO: 1921919 - RNA, 23 nt, Shigella flexneri 2a str. 2457T
auauuuugaaucggcggcggcag

SEQ ID NO: 1921920 - RNA, 17 nt, Shigella flexneri 2a str. 2457T
auauuuuuaaauauaaa

SEQ ID NO: 1921921 - RNA, 14 nt, Shigella flexneri 2a str. 2457T
aucaaaaauggcuu

SEQ ID NO: 1921922 - RNA, 13 nt, Shigella flexneri 2a str. 2457T
aucaaaacgcugg

SEQ ID NO: 1921923 - RNA, 14 nt, Shigella flexneri 2a str. 2457T
auauugguguugug

SEQ ID NO: 1921924 - RNA, 16 nt, Shigella flexneri 2a str. 2457T
auauugguguugugaa

SEQ ID NO: 1921925 - RNA, 19 nt, Shigella flexneri 2a str. 2457T
auauugucuucaagaucag

SEQ ID NO: 1921926 - RNA, 17 nt, Shigella flexneri 2a str. 2457T
auauugugguuggugug

SEQ ID NO: 1921927 - RNA, 19 nt, Shigella flexneri 2a str. 2457T
auauuuccccuguugcaaa

SEQ ID NO: 1921928 - RNA, 11 nt, Shigella flexneri 2a str. 2457T
auauuucacau

SEQ ID NO: 1921929 - RNA, 14 nt, Shigella flexneri 2a str. 2457T
auauuuauuuccuu

SEQ ID NO: 1921930 - RNA, 23 nt, Shigella flexneri 2a str. 2457T
auauuuaaauugcgguuuuuaag

SEQ ID NO: 1921931 - RNA, 18 nt, Shigella flexneri 2a str. 2457T
auauuuaaucaguucuac

SEQ ID NO: 1921932 - RNA, 23 nt, Shigella flexneri 2a str. 2457T
auauuguuacgguguucacucau

SEQ ID NO: 1921933 - RNA, 19 nt, Shigella flexneri 2a str. 2457T
aucaaggcauauaccacac

SEQ ID NO: 1921934 - RNA, 16 nt, Shigella flexneri 2a str. 2457T
aucaaguauuuuuaau

SEQ ID NO: 1921935 - RNA, 18 nt, Shigella flexneri 2a str. 2457T
aucaagccccagcaggau

SEQ ID NO: 1921936 - RNA, 18 nt, Shigella flexneri 2a str. 2457T
aucaagcgccgaguaaaa

SEQ ID NO: 1921937 - RNA, 18 nt, Shigella flexneri 2a str. 2457T
aucaagcaugauauucac

SEQ ID NO: 1921938 - RNA, 20 nt, Shigella flexneri 2a str. 2457T
aucaagcgccgaguaaaaaa

SEQ ID NO: 1921939 - RNA, 14 nt, Shigella flexneri 2a str. 2457T
aucaagcugugccu

SEQ ID NO: 1921940 - RNA, 14 nt, Shigella flexneri 2a str. 2457T
aucaagucagaugc

SEQ ID NO: 1921941 - RNA, 14 nt, Shigella flexneri 2a str. 2457T
aucaagucauugau

SEQ ID NO: 1921942 - RNA, 22 nt, Shigella flexneri 2a str. 2457T
aucaauaccgcguaauacauca

SEQ ID NO: 1921943 - RNA, 22 nt, Shigella flexneri 2a str. 2457T
aucaauaccugguccuucaucu

SEQ ID NO: 1921944 - RNA, 21 nt, Shigella flexneri 2a str. 2457T
aucaauaaguuacacaucauu

SEQ ID NO: 1921945 - RNA, 16 nt, Shigella flexneri 2a str. 2457T
aucaauaccauuauca

SEQ ID NO: 1921946 - RNA, 13 nt, Shigella flexneri 2a str. 2457T
aucaaucgccccu

SEQ ID NO: 1921947 - RNA, 15 nt, Shigella flexneri 2a str. 2457T
aucaaucgcaaucug

SEQ ID NO: 1921948 - RNA, 17 nt, Shigella flexneri 2a str. 2457T
aucaaucgcaaucuggc

SEQ ID NO: 1921949 - RNA, 13 nt, Shigella flexneri 2a str. 2457T
aucaaucugcugc

SEQ ID NO: 1921950 - RNA, 15 nt, Shigella flexneri 2a str. 2457T
aucaaucucagcaag

SEQ ID NO: 1921951 - RNA, 16 nt, Shigella flexneri 2a str. 2457T
aucaaucucagcgaug

SEQ ID NO: 1921952 - RNA, 15 nt, Shigella flexneri 2a str. 2457T
aucaauauccaccgg

SEQ ID NO: 1921953 - RNA, 12 nt, Shigella flexneri 2a str. 2457T
aucaauauuaag

SEQ ID NO: 1921954 - RNA, 22 nt, Shigella flexneri 2a str. 2457T
aucaauagcaacugauuuauag

SEQ ID NO: 1921955 - RNA, 22 nt, Shigella flexneri 2a str. 2457T
aucaaucacccguuuucuccau

SEQ ID NO: 1921956 - RNA, 14 nt, Shigella flexneri 2a str. 2457T
aucaaucaccgcuu

SEQ ID NO: 1921957 - RNA, 15 nt, Shigella flexneri 2a str. 2457T
aucaaccugaggcuc

SEQ ID NO: 1921958 - RNA, 19 nt, Shigella flexneri 2a str. 2457T
aucaaccgcuacauacuua

SEQ ID NO: 1921959 - RNA, 17 nt, Shigella flexneri 2a str. 2457T
aucaacaguuuguugca

SEQ ID NO: 1921960 - RNA, 24 nt, Shigella flexneri 2a str. 2457T
aucaacaguuuguugcauuugcag

SEQ ID NO: 1921961 - RNA, 23 nt, Shigella flexneri 2a str. 2457T
aucaacgagauaaaauuaacgac

SEQ ID NO: 1921962 - RNA, 22 nt, Shigella flexneri 2a str. 2457T
aucaacgcaccgacaaauuuca

SEQ ID NO: 1921963 - RNA, 17 nt, Shigella flexneri 2a str. 2457T
aucaacgccaucgccag

SEQ ID NO: 1921964 - RNA, 23 nt, Shigella flexneri 2a str. 2457T
aucaagcaaggccagguuuucuu

SEQ ID NO: 1921965 - RNA, 15 nt, Shigella flexneri 2a str. 2457T
aucaaacaauuuuca

SEQ ID NO: 1921966 - RNA, 22 nt, Shigella flexneri 2a str. 2457T
aucaaacagaauauugugcuca

SEQ ID NO: 1921967 - RNA, 13 nt, Shigella flexneri 2a str. 2457T
aucaacacaucca

SEQ ID NO: 1921968 - RNA, 14 nt, Shigella flexneri 2a str. 2457T
aucaacaagcgaau

SEQ ID NO: 1921969 - RNA, 17 nt, Shigella flexneri 2a str. 2457T
aucaccgcacggcgagu

SEQ ID NO: 1921970 - RNA, 15 nt, Shigella flexneri 2a str. 2457T
aucaccgccagcaag

SEQ ID NO: 1921971 - RNA, 22 nt, Shigella flexneri 2a str. 2457T
aucaaugugcugagaacaagau

SEQ ID NO: 1921972 - RNA, 11 nt, Shigella flexneri 2a str. 2457T
aucaccucuuc

SEQ ID NO: 1921973 - RNA, 17 nt, Shigella flexneri 2a str. 2457T
aucaccguucagcuugc

SEQ ID NO: 1921974 - RNA, 17 nt, Shigella flexneri 2a str. 2457T
aucacgaugcuaaaaac

SEQ ID NO: 1921975 - RNA, 18 nt, Shigella flexneri 2a str. 2457T
aucacgaugcuaaaaaca

SEQ ID NO: 1921976 - RNA, 13 nt, Shigella flexneri 2a str. 2457T
aucacgcauggac

SEQ ID NO: 1921977 - RNA, 21 nt, Shigella flexneri 2a str. 2457T
aucacgccaauaccgcccaga

SEQ ID NO: 1921978 - RNA, 13 nt, Shigella flexneri 2a str. 2457T
aucacgcaucacc

SEQ ID NO: 1921979 - RNA, 19 nt, Shigella flexneri 2a str. 2457T
aucacuuccagcaguucgc

SEQ ID NO: 1921980 - RNA, 18 nt, Shigella flexneri 2a str. 2457T
aucacggguaggagccac

SEQ ID NO: 1921981 - RNA, 16 nt, Shigella flexneri 2a str. 2457T
aucacgcgaccaucgc

SEQ ID NO: 1921982 - RNA, 15 nt, Shigella flexneri 2a str. 2457T
aucacuuucaaaagc

SEQ ID NO: 1921983 - RNA, 14 nt, Shigella flexneri 2a str. 2457T
aucagcgcaaagag

SEQ ID NO: 1921984 - RNA, 19 nt, Shigella flexneri 2a str. 2457T
aucagcgcagcacccagaa

SEQ ID NO: 1921985 - RNA, 12 nt, Shigella flexneri 2a str. 2457T
aucagcauucuc

SEQ ID NO: 1921986 - RNA, 16 nt, Shigella flexneri 2a str. 2457T
aucagcauaaucacca

SEQ ID NO: 1921987 - RNA, 11 nt, Shigella flexneri 2a str. 2457T
aucagcaugac

SEQ ID NO: 1921988 - RNA, 15 nt, Shigella flexneri 2a str. 2457T
aucagcgccaccagc

SEQ ID NO: 1921989 - RNA, 12 nt, Shigella flexneri 2a str. 2457T
aucagcuucacc

SEQ ID NO: 1921990 - RNA, 14 nt, Shigella flexneri 2a str. 2457T
aucagcuuauccau

SEQ ID NO: 1921991 - RNA, 11 nt, Shigella flexneri 2a str. 2457T
aucagagauuc

SEQ ID NO: 1921992 - RNA, 18 nt, Shigella flexneri 2a str. 2457T
aucagacgacgauuaaca

SEQ ID NO: 1921993 - RNA, 23 nt, Shigella flexneri 2a str. 2457T
aucagagcuggaaguuacucaaa

SEQ ID NO: 1921994 - RNA, 13 nt, Shigella flexneri 2a str. 2457T
aucagauccgcac

SEQ ID NO: 1921995 - RNA, 16 nt, Shigella flexneri 2a str. 2457T
aucagauggcggcugg

SEQ ID NO: 1921996 - RNA, 18 nt, Shigella flexneri 2a str. 2457T
aucagaucguugaacccg

SEQ ID NO: 1921997 - RNA, 23 nt, Shigella flexneri 2a str. 2457T
aucagaucguugaacccggcauc

SEQ ID NO: 1921998 - RNA, 15 nt, Shigella flexneri 2a str. 2457T
aucagauucagcagc

SEQ ID NO: 1921999 - RNA, 17 nt, Shigella flexneri 2a str. 2457T
aucagcaacacgcugcu

SEQ ID NO: 1922000 - RNA, 24 nt, Shigella flexneri 2a str. 2457T
aucagcaaauuuggcaucgaggau

SEQ ID NO: 1922001 - RNA, 13 nt, Shigella flexneri 2a str. 2457T
aucagcaaaucca

SEQ ID NO: 1922002 - RNA, 19 nt, Shigella flexneri 2a str. 2457T
aucagcaaacuaucccagc

SEQ ID NO: 1922003 - RNA, 20 nt, Shigella flexneri 2a str. 2457T
aucagcaaacuaucccagcc

SEQ ID NO: 1922004 - RNA, 21 nt, Shigella flexneri 2a str. 2457T
aucauagcgaauaaucccggc

SEQ ID NO: 1922005 - RNA, 16 nt, Shigella flexneri 2a str. 2457T
aucauaaccugcucug

SEQ ID NO: 1922006 - RNA, 14 nt, Shigella flexneri 2a str. 2457T
aucauaaaaauuaa

SEQ ID NO: 1922007 - RNA, 17 nt, Shigella flexneri 2a str. 2457T
aucagugguguagggca

SEQ ID NO: 1922008 - RNA, 23 nt, Shigella flexneri 2a str. 2457T
aaaacgcgcccucagcccacauc

SEQ ID NO: 1922009 - RNA, 11 nt, Shigella flexneri 2a str. 2457T
aaaacgccugc

SEQ ID NO: 1922010 - RNA, 20 nt, Shigella flexneri 2a str. 2457T
aaaacgccggagugaaaauu

SEQ ID NO: 1922011 - RNA, 19 nt, Shigella flexneri 2a str. 2457T
aucaggccuacauuuucuc

SEQ ID NO: 1922012 - RNA, 18 nt, Shigella flexneri 2a str. 2457T
aucaggccaaacagacca

SEQ ID NO: 1922013 - RNA, 14 nt, Shigella flexneri 2a str. 2457T
aucaggccagccag

SEQ ID NO: 1922014 - RNA, 12 nt, Shigella flexneri 2a str. 2457T
aucauccauccg

SEQ ID NO: 1922015 - RNA, 15 nt, Shigella flexneri 2a str. 2457T
aucauccauauuuuc

SEQ ID NO: 1922016 - RNA, 23 nt, Shigella flexneri 2a str. 2457T
aucauccauauuuucagcagugg

SEQ ID NO: 1922017 - RNA, 15 nt, Shigella flexneri 2a str. 2457T
aucauccgcacaauc

SEQ ID NO: 1922018 - RNA, 16 nt, Shigella flexneri 2a str. 2457T
aucaucccccugcgau

SEQ ID NO: 1922019 - RNA, 19 nt, Shigella flexneri 2a str. 2457T
aucauccccguaucuucau

SEQ ID NO: 1922020 - RNA, 12 nt, Shigella flexneri 2a str. 2457T
aucauccagcac

SEQ ID NO: 1922021 - RNA, 20 nt, Shigella flexneri 2a str. 2457T
aucauccacccgcagcaagc

SEQ ID NO: 1922022 - RNA, 18 nt, Shigella flexneri 2a str. 2457T
aucauccagaccgcucag

SEQ ID NO: 1922023 - RNA, 15 nt, Shigella flexneri 2a str. 2457T
aucauccagacugcu

SEQ ID NO: 1922024 - RNA, 13 nt, Shigella flexneri 2a str. 2457T
aucaucauuugca

SEQ ID NO: 1922025 - RNA, 17 nt, Shigella flexneri 2a str. 2457T
aucaucgcauccagugc

SEQ ID NO: 1922026 - RNA, 18 nt, Shigella flexneri 2a str. 2457T
aucauccgcacaaucccu

SEQ ID NO: 1922027 - RNA, 22 nt, Shigella flexneri 2a str. 2457T
aucauccugcggcagcuccagc

SEQ ID NO: 1922028 - RNA, 21 nt, Shigella flexneri 2a str. 2457T
aucauccgcucccuggcccau

SEQ ID NO: 1922029 - RNA, 19 nt, Shigella flexneri 2a str. 2457T
aucauccugcugcacgccc

SEQ ID NO: 1922030 - RNA, 20 nt, Shigella flexneri 2a str. 2457T
aucaucgcccagccggacug

SEQ ID NO: 1922031 - RNA, 22 nt, Shigella flexneri 2a str. 2457T
aaaacguugucaguucuuuuau

SEQ ID NO: 1922032 - RNA, 15 nt, Shigella flexneri 2a str. 2457T
aaaacuaaaaacagc

SEQ ID NO: 1922033 - RNA, 14 nt, Shigella flexneri 2a str. 2457T
aucauauuguuccc

SEQ ID NO: 1922034 - RNA, 11 nt, Shigella flexneri 2a str. 2457T
aucauauuaaa

SEQ ID NO: 1922035 - RNA, 13 nt, Shigella flexneri 2a str. 2457T
aucauauuuucca

SEQ ID NO: 1922036 - RNA, 15 nt, Shigella flexneri 2a str. 2457T
aucaucaacuggcaa

SEQ ID NO: 1922037 - RNA, 17 nt, Shigella flexneri 2a str. 2457T
aucaucaauaccagccc

SEQ ID NO: 1922038 - RNA, 18 nt, Shigella flexneri 2a str. 2457T
aucaucaauaccagcccg

SEQ ID NO: 1922039 - RNA, 20 nt, Shigella flexneri 2a str. 2457T
aucaucaggggcagcaccau

SEQ ID NO: 1922040 - RNA, 22 nt, Shigella flexneri 2a str. 2457T
aucaucaggggcagcaccauca

SEQ ID NO: 1922041 - RNA, 18 nt, Shigella flexneri 2a str. 2457T
aucaucaucgccaggcuu

SEQ ID NO: 1922042 - RNA, 15 nt, Shigella flexneri 2a str. 2457T
auaugagcgcaaaug

SEQ ID NO: 1922043 - RNA, 11 nt, Shigella flexneri 2a str. 2457T
auaucuucccg

SEQ ID NO: 1922044 - RNA, 18 nt, Shigella flexneri 2a str. 2457T
auaucuucuguugcaggg

SEQ ID NO: 1922045 - RNA, 12 nt, Shigella flexneri 2a str. 2457T
auaucuuuuuug

SEQ ID NO: 1922046 - RNA, 13 nt, Shigella flexneri 2a str. 2457T
auaucuuuucuua

SEQ ID NO: 1922047 - RNA, 20 nt, Shigella flexneri 2a str. 2457T
auaucuaugguuuuuucuac

SEQ ID NO: 1922048 - RNA, 24 nt, Shigella flexneri 2a str. 2457T
auaucguucaagagacugcuggcu

SEQ ID NO: 1922049 - RNA, 13 nt, Shigella flexneri 2a str. 2457T
auaucuccucugc

SEQ ID NO: 1922050 - RNA, 20 nt, Shigella flexneri 2a str. 2457T
auaucgauuucuacacccag

SEQ ID NO: 1922051 - RNA, 19 nt, Shigella flexneri 2a str. 2457T
auaucgccauuaaacaacc

SEQ ID NO: 1922052 - RNA, 22 nt, Shigella flexneri 2a str. 2457T
auaucgcauaccauccaggaga

SEQ ID NO: 1922053 - RNA, 17 nt, Shigella flexneri 2a str. 2457T
auaucgcggauaugcag

SEQ ID NO: 1922054 - RNA, 16 nt, Shigella flexneri 2a str. 2457T
auaucgcuggcagaaa

SEQ ID NO: 1922055 - RNA, 19 nt, Shigella flexneri 2a str. 2457T
auaucccgccagcaccagc

SEQ ID NO: 1922056 - RNA, 14 nt, Shigella flexneri 2a str. 2457T
auaucccuuccucc

SEQ ID NO: 1922057 - RNA, 17 nt, Shigella flexneri 2a str. 2457T
auaucgagcauauuuag

SEQ ID NO: 1922058 - RNA, 14 nt, Shigella flexneri 2a str. 2457T
auaucgacgaccug

SEQ ID NO: 1922059 - RNA, 14 nt, Shigella flexneri 2a str. 2457T
auaucaucaaaauu

SEQ ID NO: 1922060 - RNA, 22 nt, Shigella flexneri 2a str. 2457T
auauccaguucugcuucaacau

SEQ ID NO: 1922061 - RNA, 12 nt, Shigella flexneri 2a str. 2457T
auauccaggcua

SEQ ID NO: 1922062 - RNA, 23 nt, Shigella flexneri 2a str. 2457T
auaucagugauauauuuuuaaau

SEQ ID NO: 1922063 - RNA, 16 nt, Shigella flexneri 2a str. 2457T
auauauuuuuaaauau

SEQ ID NO: 1922064 - RNA, 17 nt, Shigella flexneri 2a str. 2457T
auauauuuuuaaauaua

SEQ ID NO: 1922065 - RNA, 17 nt, Shigella flexneri 2a str. 2457T
auauauugcugaaauaa

SEQ ID NO: 1922066 - RNA, 17 nt, Shigella flexneri 2a str. 2457T
auauauugaauuugcau

SEQ ID NO: 1922067 - RNA, 20 nt, Shigella flexneri 2a str. 2457T
auauacgccaucgccagcag

SEQ ID NO: 1922068 - RNA, 22 nt, Shigella flexneri 2a str. 2457T
auauacgccaucgccagcagcc

SEQ ID NO: 1922069 - RNA, 19 nt, Shigella flexneri 2a str. 2457T
auauaccucagcagacuga

SEQ ID NO: 1922070 - RNA, 21 nt, Shigella flexneri 2a str. 2457T
auauaccuuccgguuucaaau

SEQ ID NO: 1922071 - RNA, 18 nt, Shigella flexneri 2a str. 2457T
auauauccgaaaaaggau

SEQ ID NO: 1922072 - RNA, 14 nt, Shigella flexneri 2a str. 2457T
auauaauuaaaaau

SEQ ID NO: 1922073 - RNA, 15 nt, Shigella flexneri 2a str. 2457T
auauaauuaaaaaua

SEQ ID NO: 1922074 - RNA, 17 nt, Shigella flexneri 2a str. 2457T
auauaauaugcauuaua

SEQ ID NO: 1922075 - RNA, 19 nt, Shigella flexneri 2a str. 2457T
auauaccauggaagaaaaa

SEQ ID NO: 1922076 - RNA, 17 nt, Shigella flexneri 2a str. 2457T
auauacccgccaaacca

SEQ ID NO: 1922077 - RNA, 22 nt, Shigella flexneri 2a str. 2457T
auauaauuccauucaccauuuu

SEQ ID NO: 1922078 - RNA, 18 nt, Shigella flexneri 2a str. 2457T
auagcugcgacaucauuu

SEQ ID NO: 1922079 - RNA, 20 nt, Shigella flexneri 2a str. 2457T
auagcuaacucuaaucccuu

SEQ ID NO: 1922080 - RNA, 12 nt, Shigella flexneri 2a str. 2457T
auagcuaauccc

SEQ ID NO: 1922081 - RNA, 16 nt, Shigella flexneri 2a str. 2457T
auagugccuggcugcg

SEQ ID NO: 1922082 - RNA, 12 nt, Shigella flexneri 2a str. 2457T
auagucuuuucg

SEQ ID NO: 1922083 - RNA, 19 nt, Shigella flexneri 2a str. 2457T
auaguuuuuacaaacaaga

SEQ ID NO: 1922084 - RNA, 16 nt, Shigella flexneri 2a str. 2457T
auauaaagcaucaauu

SEQ ID NO: 1922085 - RNA, 20 nt, Shigella flexneri 2a str. 2457T
auaguuccacuauuucaaua

SEQ ID NO: 1922086 - RNA, 20 nt, Shigella flexneri 2a str. 2457T
auaguuggcccgauagaaac

SEQ ID NO: 1922087 - RNA, 19 nt, Shigella flexneri 2a str. 2457T
auaguugauuaauuucauu

SEQ ID NO: 1922088 - RNA, 14 nt, Shigella flexneri 2a str. 2457T
auagacuucccucc

SEQ ID NO: 1922089 - RNA, 17 nt, Shigella flexneri 2a str. 2457T
auacuuucacaaaaaua

SEQ ID NO: 1922090 - RNA, 13 nt, Shigella flexneri 2a str. 2457T
auacuuuucagga

SEQ ID NO: 1922091 - RNA, 21 nt, Shigella flexneri 2a str. 2457T
auacuuuuucgccaugaagac

SEQ ID NO: 1922092 - RNA, 16 nt, Shigella flexneri 2a str. 2457T
auacuuuuucaagaau

SEQ ID NO: 1922093 - RNA, 23 nt, Shigella flexneri 2a str. 2457T
auacuuuuucaagaaucggcuuu

SEQ ID NO: 1922094 - RNA, 13 nt, Shigella flexneri 2a str. 2457T
auagauccaggaa

SEQ ID NO: 1922095 - RNA, 16 nt, Shigella flexneri 2a str. 2457T
auagauuuuuaaugcu

SEQ ID NO: 1922096 - RNA, 12 nt, Shigella flexneri 2a str. 2457T
auagauuauuug

SEQ ID NO: 1922097 - RNA, 19 nt, Shigella flexneri 2a str. 2457T
auagccucaaauuccuuau

SEQ ID NO: 1922098 - RNA, 15 nt, Shigella flexneri 2a str. 2457T
auagccaaagcacca

SEQ ID NO: 1922099 - RNA, 18 nt, Shigella flexneri 2a str. 2457T
auagccagccucauccau

SEQ ID NO: 1922100 - RNA, 19 nt, Shigella flexneri 2a str. 2457T
auagccagcagagcaaaaa

SEQ ID NO: 1922101 - RNA, 15 nt, Shigella flexneri 2a str. 2457T
auagccagacguugu

SEQ ID NO: 1922102 - RNA, 17 nt, Shigella flexneri 2a str. 2457T
auagcguuaaucaucaa

SEQ ID NO: 1922103 - RNA, 15 nt, Shigella flexneri 2a str. 2457T
auagcgucauuucua

SEQ ID NO: 1922104 - RNA, 18 nt, Shigella flexneri 2a str. 2457T
auagcgacaggcuuucuu

SEQ ID NO: 1922105 - RNA, 17 nt, Shigella flexneri 2a str. 2457T
auagcgaaguagacagc

SEQ ID NO: 1922106 - RNA, 19 nt, Shigella flexneri 2a str. 2457T
auagccuuuauuaaugaca

SEQ ID NO: 1922107 - RNA, 15 nt, Shigella flexneri 2a str. 2457T
auagccuuucaauaa

SEQ ID NO: 1922108 - RNA, 23 nt, Shigella flexneri 2a str. 2457T
auagcgacuugggcgauuuuugc

SEQ ID NO: 1922109 - RNA, 18 nt, Shigella flexneri 2a str. 2457T
auagcauaauauaacagc

SEQ ID NO: 1922110 - RNA, 12 nt, Shigella flexneri 2a str. 2457T
auagcacacuuu

SEQ ID NO: 1922111 - RNA, 15 nt, Shigella flexneri 2a str. 2457T
auagcacacuuucgc

SEQ ID NO: 1922112 - RNA, 17 nt, Shigella flexneri 2a str. 2457T
auagcacgacguuucuu

SEQ ID NO: 1922113 - RNA, 13 nt, Shigella flexneri 2a str. 2457T
auagcaaaguaau

SEQ ID NO: 1922114 - RNA, 21 nt, Shigella flexneri 2a str. 2457T
auagcaaucuguaacaaggug

SEQ ID NO: 1922115 - RNA, 14 nt, Shigella flexneri 2a str. 2457T
auacgcuggcugaa

SEQ ID NO: 1922116 - RNA, 21 nt, Shigella flexneri 2a str. 2457T
auacgcuggcugaacauuaaa

SEQ ID NO: 1922117 - RNA, 16 nt, Shigella flexneri 2a str. 2457T
auacgcgccacaucag

SEQ ID NO: 1922118 - RNA, 14 nt, Shigella flexneri 2a str. 2457T
auacgcgcuaauca

SEQ ID NO: 1922119 - RNA, 16 nt, Shigella flexneri 2a str. 2457T
auacucaagcagccag

SEQ ID NO: 1922120 - RNA, 18 nt, Shigella flexneri 2a str. 2457T
auacuccccuuucuuauu

SEQ ID NO: 1922121 - RNA, 21 nt, Shigella flexneri 2a str. 2457T
auacuccugauggucuauugc

SEQ ID NO: 1922122 - RNA, 13 nt, Shigella flexneri 2a str. 2457T
auacucuccucca

SEQ ID NO: 1922123 - RNA, 22 nt, Shigella flexneri 2a str. 2457T
auacugccgauuacguaauuca

SEQ ID NO: 1922124 - RNA, 22 nt, Shigella flexneri 2a str. 2457T
auacuggauagauauucuccag

SEQ ID NO: 1922125 - RNA, 16 nt, Shigella flexneri 2a str. 2457T
auacuggcuaagaagc

SEQ ID NO: 1922126 - RNA, 22 nt, Shigella flexneri 2a str. 2457T
auacuucauaacguuuuuucgu

SEQ ID NO: 1922127 - RNA, 13 nt, Shigella flexneri 2a str. 2457T
auacuuucacaaa

SEQ ID NO: 1922128 - RNA, 15 nt, Shigella flexneri 2a str. 2457T
auacuuucacaaaaa

SEQ ID NO: 1922129 - RNA, 19 nt, Shigella flexneri 2a str. 2457T
auaccgccaauagcuauuc

SEQ ID NO: 1922130 - RNA, 18 nt, Shigella flexneri 2a str. 2457T
auaccgccugcaaauaaa

SEQ ID NO: 1922131 - RNA, 14 nt, Shigella flexneri 2a str. 2457T
auacagcggccagc

SEQ ID NO: 1922132 - RNA, 15 nt, Shigella flexneri 2a str. 2457T
auaccgggaucaggu

SEQ ID NO: 1922133 - RNA, 22 nt, Shigella flexneri 2a str. 2457T
auaccuucacagaaggccagga

SEQ ID NO: 1922134 - RNA, 15 nt, Shigella flexneri 2a str. 2457T
auaccuugcugcucc

SEQ ID NO: 1922135 - RNA, 18 nt, Shigella flexneri 2a str. 2457T
auaccuuucgauuucucu

SEQ ID NO: 1922136 - RNA, 18 nt, Shigella flexneri 2a str. 2457T
auacgcauaugcaucaga

SEQ ID NO: 1922137 - RNA, 18 nt, Shigella flexneri 2a str. 2457T
auacgcaccgcuccaucg

SEQ ID NO: 1922138 - RNA, 19 nt, Shigella flexneri 2a str. 2457T
auacgauuugucagcagcu

SEQ ID NO: 1922139 - RNA, 15 nt, Shigella flexneri 2a str. 2457T
aucgacagacgccag

SEQ ID NO: 1922140 - RNA, 13 nt, Shigella flexneri 2a str. 2457T
aucgacaucaacg

SEQ ID NO: 1922141 - RNA, 22 nt, Shigella flexneri 2a str. 2457T
aucgaccaggccaucagcagcg

SEQ ID NO: 1922142 - RNA, 16 nt, Shigella flexneri 2a str. 2457T
aucgacgcgccagcac

SEQ ID NO: 1922143 - RNA, 22 nt, Shigella flexneri 2a str. 2457T
aucgccaccguuauccugauaa

SEQ ID NO: 1922144 - RNA, 21 nt, Shigella flexneri 2a str. 2457T
aucgccacggcaugaaagcga

SEQ ID NO: 1922145 - RNA, 14 nt, Shigella flexneri 2a str. 2457T
aucgccaccacccu

SEQ ID NO: 1922146 - RNA, 16 nt, Shigella flexneri 2a str. 2457T
aucgccaaugaagugg

SEQ ID NO: 1922147 - RNA, 23 nt, Shigella flexneri 2a str. 2457T
aucgccagcaaaaucaccaucac

SEQ ID NO: 1922148 - RNA, 13 nt, Shigella flexneri 2a str. 2457T
aucgccaaauuug

SEQ ID NO: 1922149 - RNA, 16 nt, Shigella flexneri 2a str. 2457T
aucgccaaagcggcag

SEQ ID NO: 1922150 - RNA, 21 nt, Shigella flexneri 2a str. 2457T
aucgcauggcugcgaaucgcu

SEQ ID NO: 1922151 - RNA, 16 nt, Shigella flexneri 2a str. 2457T
auccugccgagauaca

SEQ ID NO: 1922152 - RNA, 19 nt, Shigella flexneri 2a str. 2457T
auccugcccacuccagcua

SEQ ID NO: 1922153 - RNA, 16 nt, Shigella flexneri 2a str. 2457T
auccuggacuuuaaac

SEQ ID NO: 1922154 - RNA, 15 nt, Shigella flexneri 2a str. 2457T
auccuggaacagacc

SEQ ID NO: 1922155 - RNA, 20 nt, Shigella flexneri 2a str. 2457T
auccugcugcacgcccugau

SEQ ID NO: 1922156 - RNA, 15 nt, Shigella flexneri 2a str. 2457T
auccuggauuuccuc

SEQ ID NO: 1922157 - RNA, 22 nt, Shigella flexneri 2a str. 2457T
auccuggcgaaaacgcccggca

SEQ ID NO: 1922158 - RNA, 18 nt, Shigella flexneri 2a str. 2457T
auccuggggguucaucac

SEQ ID NO: 1922159 - RNA, 19 nt, Shigella flexneri 2a str. 2457T
auccgcuucgguauauuuc

SEQ ID NO: 1922160 - RNA, 23 nt, Shigella flexneri 2a str. 2457T
auccgcuucaggaauaagacaau

SEQ ID NO: 1922161 - RNA, 13 nt, Shigella flexneri 2a str. 2457T
auccugcacuuuc

SEQ ID NO: 1922162 - RNA, 20 nt, Shigella flexneri 2a str. 2457T
auccgcuggcccaucagaau

SEQ ID NO: 1922163 - RNA, 17 nt, Shigella flexneri 2a str. 2457T
auccgcgacuggcaugc

SEQ ID NO: 1922164 - RNA, 16 nt, Shigella flexneri 2a str. 2457T
auccugguuauuucac

SEQ ID NO: 1922165 - RNA, 21 nt, Shigella flexneri 2a str. 2457T
auccuggggguucaucaccac

SEQ ID NO: 1922166 - RNA, 18 nt, Shigella flexneri 2a str. 2457T
aucgaagaacugcuggaa

SEQ ID NO: 1922167 - RNA, 22 nt, Shigella flexneri 2a str. 2457T
aucgaagaacugcuggaagcug

SEQ ID NO: 1922168 - RNA, 17 nt, Shigella flexneri 2a str. 2457T
aucgaacagaccaaacu

SEQ ID NO: 1922169 - RNA, 16 nt, Shigella flexneri 2a str. 2457T
aucgaaaugaauagag

SEQ ID NO: 1922170 - RNA, 17 nt, Shigella flexneri 2a str. 2457T
aucggccuuccauaaug

SEQ ID NO: 1922171 - RNA, 17 nt, Shigella flexneri 2a str. 2457T
aucggcguuuucugacc

SEQ ID NO: 1922172 - RNA, 17 nt, Shigella flexneri 2a str. 2457T
aucggcuaucgaaggau

SEQ ID NO: 1922173 - RNA, 13 nt, Shigella flexneri 2a str. 2457T
aucggcuuuggca

SEQ ID NO: 1922174 - RNA, 15 nt, Shigella flexneri 2a str. 2457T
aucgggagagauaag

SEQ ID NO: 1922175 - RNA, 18 nt, Shigella flexneri 2a str. 2457T
aucgggagagauaagaua

SEQ ID NO: 1922176 - RNA, 20 nt, Shigella flexneri 2a str. 2457T
aucgggcgauuuugcuuuug

SEQ ID NO: 1922177 - RNA, 19 nt, Shigella flexneri 2a str. 2457T
aucggggauaagaauaucg

SEQ ID NO: 1922178 - RNA, 18 nt, Shigella flexneri 2a str. 2457T
aucggugcacuccgccac

SEQ ID NO: 1922179 - RNA, 20 nt, Shigella flexneri 2a str. 2457T
aucgguguguccauccauac

SEQ ID NO: 1922180 - RNA, 23 nt, Shigella flexneri 2a str. 2457T
aucggugggcugacauuaucaga

SEQ ID NO: 1922181 - RNA, 21 nt, Shigella flexneri 2a str. 2457T
aucggugcuggccuauuauga

SEQ ID NO: 1922182 - RNA, 13 nt, Shigella flexneri 2a str. 2457T
aucggugccuucg

SEQ ID NO: 1922183 - RNA, 15 nt, Shigella flexneri 2a str. 2457T
aucgguauuuccauu

SEQ ID NO: 1922184 - RNA, 21 nt, Shigella flexneri 2a str. 2457T
aucguaguuuuugcccaucau

SEQ ID NO: 1922185 - RNA, 14 nt, Shigella flexneri 2a str. 2457T
aucguaaucagcau

SEQ ID NO: 1922186 - RNA, 19 nt, Shigella flexneri 2a str. 2457T
aucgcuuucgcuuucucuu

SEQ ID NO: 1922187 - RNA, 15 nt, Shigella flexneri 2a str. 2457T
aucgcugaaagaugg

SEQ ID NO: 1922188 - RNA, 22 nt, Shigella flexneri 2a str. 2457T
aucgcuuucgcuacuucaaaca

SEQ ID NO: 1922189 - RNA, 14 nt, Shigella flexneri 2a str. 2457T
aucgcuuucagugu

SEQ ID NO: 1922190 - RNA, 17 nt, Shigella flexneri 2a str. 2457T
aucgcugaaagauggcg

SEQ ID NO: 1922191 - RNA, 14 nt, Shigella flexneri 2a str. 2457T
aucgcuccacgcca

SEQ ID NO: 1922192 - RNA, 15 nt, Shigella flexneri 2a str. 2457T
aucgcucucagagag

SEQ ID NO: 1922193 - RNA, 12 nt, Shigella flexneri 2a str. 2457T
aucggcaggcag

SEQ ID NO: 1922194 - RNA, 14 nt, Shigella flexneri 2a str. 2457T
aucgcgccaaucag

SEQ ID NO: 1922195 - RNA, 18 nt, Shigella flexneri 2a str. 2457T
aucgcccuggauuucaau

SEQ ID NO: 1922196 - RNA, 14 nt, Shigella flexneri 2a str. 2457T
aucgcggcacagaa

SEQ ID NO: 1922197 - RNA, 24 nt, Shigella flexneri 2a str. 2457T
aucgcggcgauauccagcgcggcg

SEQ ID NO: 1922198 - RNA, 13 nt, Shigella flexneri 2a str. 2457T
aucgcuacaccaa

SEQ ID NO: 1922199 - RNA, 23 nt, Shigella flexneri 2a str. 2457T
aucgcgccgccgcccaugaugac

SEQ ID NO: 1922200 - RNA, 18 nt, Shigella flexneri 2a str. 2457T
aucgcgccaucaaaucug

SEQ ID NO: 1922201 - RNA, 16 nt, Shigella flexneri 2a str. 2457T
aucgcgcccaaaccac

SEQ ID NO: 1922202 - RNA, 21 nt, Shigella flexneri 2a str. 2457T
aucgcggcgauauccagcgcg

SEQ ID NO: 1922203 - RNA, 15 nt, Shigella flexneri 2a str. 2457T
aucccugcuguccug

SEQ ID NO: 1922204 - RNA, 13 nt, Shigella flexneri 2a str. 2457T
aucccuucuccac

SEQ ID NO: 1922205 - RNA, 14 nt, Shigella flexneri 2a str. 2457T
aucccuuagcuaau

SEQ ID NO: 1922206 - RNA, 17 nt, Shigella flexneri 2a str. 2457T
aucccuuccucccuuuc

SEQ ID NO: 1922207 - RNA, 13 nt, Shigella flexneri 2a str. 2457T
auccgaagaacca

SEQ ID NO: 1922208 - RNA, 19 nt, Shigella flexneri 2a str. 2457T
aucccgguuauuaaaacga

SEQ ID NO: 1922209 - RNA, 19 nt, Shigella flexneri 2a str. 2457T
aucccguaguauuuucuuu

SEQ ID NO: 1922210 - RNA, 13 nt, Shigella flexneri 2a str. 2457T
aucccucauauuu

SEQ ID NO: 1922211 - RNA, 14 nt, Shigella flexneri 2a str. 2457T
aucccucauauuua

SEQ ID NO: 1922212 - RNA, 12 nt, Shigella flexneri 2a str. 2457T
auccgacaaaug

SEQ ID NO: 1922213 - RNA, 13 nt, Shigella flexneri 2a str. 2457T
auccgcaaugugu

SEQ ID NO: 1922214 - RNA, 14 nt, Shigella flexneri 2a str. 2457T
auccgccacuucuu

SEQ ID NO: 1922215 - RNA, 20 nt, Shigella flexneri 2a str. 2457T
auccgccgcgcggugggcua

SEQ ID NO: 1922216 - RNA, 18 nt, Shigella flexneri 2a str. 2457T
auccgcccucuuccacau

SEQ ID NO: 1922217 - RNA, 17 nt, Shigella flexneri 2a str. 2457T
auccgccauuucuccuc

SEQ ID NO: 1922218 - RNA, 16 nt, Shigella flexneri 2a str. 2457T
aucccaggccaaaucc

SEQ ID NO: 1922219 - RNA, 16 nt, Shigella flexneri 2a str. 2457T
aucccagucuucauca

SEQ ID NO: 1922220 - RNA, 16 nt, Shigella flexneri 2a str. 2457T
aucccagugccugcau

SEQ ID NO: 1922221 - RNA, 19 nt, Shigella flexneri 2a str. 2457T
aucccaguucgauuuccca

SEQ ID NO: 1922222 - RNA, 12 nt, Shigella flexneri 2a str. 2457T
aucccccacuuu

SEQ ID NO: 1922223 - RNA, 17 nt, Shigella flexneri 2a str. 2457T
aucccccacuuuuaaau

SEQ ID NO: 1922224 - RNA, 20 nt, Shigella flexneri 2a str. 2457T
aucccggcuccaaugacuau

SEQ ID NO: 1922225 - RNA, 14 nt, Shigella flexneri 2a str. 2457T
aucccggaagccac

SEQ ID NO: 1922226 - RNA, 20 nt, Shigella flexneri 2a str. 2457T
aucccgcucuguaagacauu

SEQ ID NO: 1922227 - RNA, 14 nt, Shigella flexneri 2a str. 2457T
auccccgggcggcc

SEQ ID NO: 1922228 - RNA, 17 nt, Shigella flexneri 2a str. 2457T
auccccucuucagccgc

SEQ ID NO: 1922229 - RNA, 15 nt, Shigella flexneri 2a str. 2457T
auccaggguuuuauu

SEQ ID NO: 1922230 - RNA, 18 nt, Shigella flexneri 2a str. 2457T
auccagguuacgcaccag

SEQ ID NO: 1922231 - RNA, 14 nt, Shigella flexneri 2a str. 2457T
auccaggaacucca

SEQ ID NO: 1922232 - RNA, 20 nt, Shigella flexneri 2a str. 2457T
auccaggaacuccagaucca

SEQ ID NO: 1922233 - RNA, 21 nt, Shigella flexneri 2a str. 2457T
auccagcgcguaaauaccuuc

SEQ ID NO: 1922234 - RNA, 20 nt, Shigella flexneri 2a str. 2457T
auccauucggcgauuaacaa

SEQ ID NO: 1922235 - RNA, 17 nt, Shigella flexneri 2a str. 2457T
auccacccgcagcaagc

SEQ ID NO: 1922236 - RNA, 13 nt, Shigella flexneri 2a str. 2457T
auccacccgcagc

SEQ ID NO: 1922237 - RNA, 14 nt, Shigella flexneri 2a str. 2457T
auccaccgcguuca

SEQ ID NO: 1922238 - RNA, 16 nt, Shigella flexneri 2a str. 2457T
auccacccgcagccau

SEQ ID NO: 1922239 - RNA, 18 nt, Shigella flexneri 2a str. 2457T
auccagccggcaaagugg

SEQ ID NO: 1922240 - RNA, 14 nt, Shigella flexneri 2a str. 2457T
auccagccagucuu

SEQ ID NO: 1922241 - RNA, 17 nt, Shigella flexneri 2a str. 2457T
auccagccacggcucca

SEQ ID NO: 1922242 - RNA, 20 nt, Shigella flexneri 2a str. 2457T
auccagcgacugacgugccu

SEQ ID NO: 1922243 - RNA, 16 nt, Shigella flexneri 2a str. 2457T
auccagcagugacuca

SEQ ID NO: 1922244 - RNA, 11 nt, Shigella flexneri 2a str. 2457T
auccagccaaa

SEQ ID NO: 1922245 - RNA, 14 nt, Shigella flexneri 2a str. 2457T
auccagccaaacau

SEQ ID NO: 1922246 - RNA, 22 nt, Shigella flexneri 2a str. 2457T
aucauuuuacguugcauuucca

SEQ ID NO: 1922247 - RNA, 19 nt, Shigella flexneri 2a str. 2457T
auccaaugccgcagcggcg

SEQ ID NO: 1922248 - RNA, 13 nt, Shigella flexneri 2a str. 2457T
aaaacuacaggca

SEQ ID NO: 1922249 - RNA, 13 nt, Shigella flexneri 2a str. 2457T
aucauuacaauca

SEQ ID NO: 1922250 - RNA, 14 nt, Shigella flexneri 2a str. 2457T
aucauuacaaucac

SEQ ID NO: 1922251 - RNA, 23 nt, Shigella flexneri 2a str. 2457T
aucauuagcccaauaaucaccgu

SEQ ID NO: 1922252 - RNA, 22 nt, Shigella flexneri 2a str. 2457T
aaaacuuccauguguuuaucua

SEQ ID NO: 1922253 - RNA, 16 nt, Shigella flexneri 2a str. 2457T
aaaacuugauacugaa

SEQ ID NO: 1922254 - RNA, 17 nt, Shigella flexneri 2a str. 2457T
aaaacuuccggcagaaa

SEQ ID NO: 1922255 - RNA, 20 nt, Shigella flexneri 2a str. 2457T
aaaacuuacgccaaaugagg

SEQ ID NO: 1922256 - RNA, 11 nt, Shigella flexneri 2a str. 2457T
aaaacuuucca

SEQ ID NO: 1922257 - RNA, 19 nt, Shigella flexneri 2a str. 2457T
aaaacuuuuagcaucuuau

SEQ ID NO: 1922258 - RNA, 15 nt, Shigella flexneri 2a str. 2457T
aucauucaccagccc

SEQ ID NO: 1922259 - RNA, 12 nt, Shigella flexneri 2a str. 2457T
aaaagaaaaaau

SEQ ID NO: 1922260 - RNA, 12 nt, Shigella flexneri 2a str. 2457T
aaaagaaaaaac

SEQ ID NO: 1922261 - RNA, 11 nt, Shigella flexneri 2a str. 2457T
aaaagaaaguu

SEQ ID NO: 1922262 - RNA, 22 nt, Shigella flexneri 2a str. 2457T
aucugucaguggacgauaagca

SEQ ID NO: 1922263 - RNA, 21 nt, Shigella flexneri 2a str. 2457T
aucuguauaaccugaauauua

SEQ ID NO: 1922264 - RNA, 23 nt, Shigella flexneri 2a str. 2457T
aucuguaacggagguacaaccgc

SEQ ID NO: 1922265 - RNA, 16 nt, Shigella flexneri 2a str. 2457T
aucuggcuugccagca

SEQ ID NO: 1922266 - RNA, 17 nt, Shigella flexneri 2a str. 2457T
aucugaccgaaugcagu

SEQ ID NO: 1922267 - RNA, 21 nt, Shigella flexneri 2a str. 2457T
aucugcguaucgcccugccaa

SEQ ID NO: 1922268 - RNA, 14 nt, Shigella flexneri 2a str. 2457T
aucugcgggaacau

SEQ ID NO: 1922269 - RNA, 22 nt, Shigella flexneri 2a str. 2457T
aucugcgggaacauaugcacau

SEQ ID NO: 1922270 - RNA, 19 nt, Shigella flexneri 2a str. 2457T
aucugcggguuagucugca

SEQ ID NO: 1922271 - RNA, 16 nt, Shigella flexneri 2a str. 2457T
aucuggcauuugcacc

SEQ ID NO: 1922272 - RNA, 19 nt, Shigella flexneri 2a str. 2457T
aucuggcaagccugaaaac

SEQ ID NO: 1922273 - RNA, 16 nt, Shigella flexneri 2a str. 2457T
aucugcgucgcuuucc

SEQ ID NO: 1922274 - RNA, 14 nt, Shigella flexneri 2a str. 2457T
aucuuagguaauga

SEQ ID NO: 1922275 - RNA, 17 nt, Shigella flexneri 2a str. 2457T
aucuuagguaaugacuc

SEQ ID NO: 1922276 - RNA, 15 nt, Shigella flexneri 2a str. 2457T
aucuuaauggcgauu

SEQ ID NO: 1922277 - RNA, 22 nt, Shigella flexneri 2a str. 2457T
aucuuaauggcgauuagaaaca

SEQ ID NO: 1922278 - RNA, 11 nt, Shigella flexneri 2a str. 2457T
aucuuacccuu

SEQ ID NO: 1922279 - RNA, 16 nt, Shigella flexneri 2a str. 2457T
aucuucacaucaucau

SEQ ID NO: 1922280 - RNA, 15 nt, Shigella flexneri 2a str. 2457T
aucuucacaucauca

SEQ ID NO: 1922281 - RNA, 16 nt, Shigella flexneri 2a str. 2457T
aucuucacacacaucg

SEQ ID NO: 1922282 - RNA, 18 nt, Shigella flexneri 2a str. 2457T
aucuucacacugaugaca

SEQ ID NO: 1922283 - RNA, 15 nt, Shigella flexneri 2a str. 2457T
aucuucacacacauc

SEQ ID NO: 1922284 - RNA, 20 nt, Shigella flexneri 2a str. 2457T
aucuucaaccgucaccagcc

SEQ ID NO: 1922285 - RNA, 13 nt, Shigella flexneri 2a str. 2457T
aucuucccagccc

SEQ ID NO: 1922286 - RNA, 11 nt, Shigella flexneri 2a str. 2457T
aucuucccagc

SEQ ID NO: 1922287 - RNA, 19 nt, Shigella flexneri 2a str. 2457T
aucuucaugcuccagcaga

SEQ ID NO: 1922288 - RNA, 21 nt, Shigella flexneri 2a str. 2457T
aucuucaucgauacugcucug

SEQ ID NO: 1922289 - RNA, 16 nt, Shigella flexneri 2a str. 2457T
aucucaauuuucacuu

SEQ ID NO: 1922290 - RNA, 21 nt, Shigella flexneri 2a str. 2457T
aucucaauuuucacuuucggc

SEQ ID NO: 1922291 - RNA, 13 nt, Shigella flexneri 2a str. 2457T
aucucaccagauu

SEQ ID NO: 1922292 - RNA, 18 nt, Shigella flexneri 2a str. 2457T
aucucagcucauuaaaaa

SEQ ID NO: 1922293 - RNA, 21 nt, Shigella flexneri 2a str. 2457T
aucguauugguacauaacaca

SEQ ID NO: 1922294 - RNA, 14 nt, Shigella flexneri 2a str. 2457T
aucguauuucagac

SEQ ID NO: 1922295 - RNA, 21 nt, Shigella flexneri 2a str. 2457T
aucgucauggcuguccuuuac

SEQ ID NO: 1922296 - RNA, 13 nt, Shigella flexneri 2a str. 2457T
aucgucaguucac

SEQ ID NO: 1922297 - RNA, 21 nt, Shigella flexneri 2a str. 2457T
aucgucacgcgcgccaagccc

SEQ ID NO: 1922298 - RNA, 18 nt, Shigella flexneri 2a str. 2457T
aucgucaggaucagccau

SEQ ID NO: 1922299 - RNA, 19 nt, Shigella flexneri 2a str. 2457T
aucgucagcucgcugccau

SEQ ID NO: 1922300 - RNA, 20 nt, Shigella flexneri 2a str. 2457T
aucuacacgcuaccaaaaaa

SEQ ID NO: 1922301 - RNA, 19 nt, Shigella flexneri 2a str. 2457T
aucucgcucaaaaauccag

SEQ ID NO: 1922302 - RNA, 12 nt, Shigella flexneri 2a str. 2457T
aucucuccuuuc

SEQ ID NO: 1922303 - RNA, 17 nt, Shigella flexneri 2a str. 2457T
aucucgaucgagaagac

SEQ ID NO: 1922304 - RNA, 21 nt, Shigella flexneri 2a str. 2457T
aucucgccagagagcggagca

SEQ ID NO: 1922305 - RNA, 19 nt, Shigella flexneri 2a str. 2457T
aucucugcaacgucuuccc

SEQ ID NO: 1922306 - RNA, 20 nt, Shigella flexneri 2a str. 2457T
aucucugcaacgucuucccg

SEQ ID NO: 1922307 - RNA, 13 nt, Shigella flexneri 2a str. 2457T
aucucaucuucca

SEQ ID NO: 1922308 - RNA, 14 nt, Shigella flexneri 2a str. 2457T
aucuccggccugca

SEQ ID NO: 1922309 - RNA, 17 nt, Shigella flexneri 2a str. 2457T
aucuccguuaaaggcaa

SEQ ID NO: 1922310 - RNA, 18 nt, Shigella flexneri 2a str. 2457T
aucuccugccaauacaaa

SEQ ID NO: 1922311 - RNA, 22 nt, Shigella flexneri 2a str. 2457T
aucuccugccaauacaaaauuu

SEQ ID NO: 1922312 - RNA, 17 nt, Shigella flexneri 2a str. 2457T
augauauggucaaugau

SEQ ID NO: 1922313 - RNA, 16 nt, Shigella flexneri 2a str. 2457T
augauaggucauauca

SEQ ID NO: 1922314 - RNA, 15 nt, Shigella flexneri 2a str. 2457T
augaucaucaaggcu

SEQ ID NO: 1922315 - RNA, 19 nt, Shigella flexneri 2a str. 2457T
augaucgaggcaaagaguu

SEQ ID NO: 1922316 - RNA, 14 nt, Shigella flexneri 2a str. 2457T
augauccuggauuu

SEQ ID NO: 1922317 - RNA, 14 nt, Shigella flexneri 2a str. 2457T
augaucaccugcau

SEQ ID NO: 1922318 - RNA, 23 nt, Shigella flexneri 2a str. 2457T
augaucaccugcauacaaauaag

SEQ ID NO: 1922319 - RNA, 15 nt, Shigella flexneri 2a str. 2457T
augaucaaaaucaua

SEQ ID NO: 1922320 - RNA, 13 nt, Shigella flexneri 2a str. 2457T
augauauuuuucc

SEQ ID NO: 1922321 - RNA, 14 nt, Shigella flexneri 2a str. 2457T
augauaauuauuau

SEQ ID NO: 1922322 - RNA, 11 nt, Shigella flexneri 2a str. 2457T
augauaagccu

SEQ ID NO: 1922323 - RNA, 18 nt, Shigella flexneri 2a str. 2457T
augauaaaauucauucaa

SEQ ID NO: 1922324 - RNA, 15 nt, Shigella flexneri 2a str. 2457T
augaguugcuggacg

SEQ ID NO: 1922325 - RNA, 16 nt, Shigella flexneri 2a str. 2457T
augaguugaaaaccuc

SEQ ID NO: 1922326 - RNA, 21 nt, Shigella flexneri 2a str. 2457T
augagcgauuuuuuauaguac

SEQ ID NO: 1922327 - RNA, 12 nt, Shigella flexneri 2a str. 2457T
augaguacagcg

SEQ ID NO: 1922328 - RNA, 18 nt, Shigella flexneri 2a str. 2457T
augaggcuuuaauaccug

SEQ ID NO: 1922329 - RNA, 15 nt, Shigella flexneri 2a str. 2457T
augagguuucccgcc

SEQ ID NO: 1922330 - RNA, 20 nt, Shigella flexneri 2a str. 2457T
augacagucuggaagccagu

SEQ ID NO: 1922331 - RNA, 17 nt, Shigella flexneri 2a str. 2457T
augacguuaauaaaauu

SEQ ID NO: 1922332 - RNA, 23 nt, Shigella flexneri 2a str. 2457T
augacuggccggaagauaugcau

SEQ ID NO: 1922333 - RNA, 14 nt, Shigella flexneri 2a str. 2457T
augacuuaauaaaa

SEQ ID NO: 1922334 - RNA, 18 nt, Shigella flexneri 2a str. 2457T
augacuccaacuuacuga

SEQ ID NO: 1922335 - RNA, 22 nt, Shigella flexneri 2a str. 2457T
augacuccaacuuacugauagu

SEQ ID NO: 1922336 - RNA, 22 nt, Shigella flexneri 2a str. 2457T
augacuaccggggacaggcggc

SEQ ID NO: 1922337 - RNA, 23 nt, Shigella flexneri 2a str. 2457T
augacuagcgccauaauaaucau

SEQ ID NO: 1922338 - RNA, 15 nt, Shigella flexneri 2a str. 2457T
augaaugauaaaauu

SEQ ID NO: 1922339 - RNA, 22 nt, Shigella flexneri 2a str. 2457T
augaaugaugcggcgcuuucag

SEQ ID NO: 1922340 - RNA, 13 nt, Shigella flexneri 2a str. 2457T
augaaguccacgc

SEQ ID NO: 1922341 - RNA, 14 nt, Shigella flexneri 2a str. 2457T
augaaucaccacag

SEQ ID NO: 1922342 - RNA, 16 nt, Shigella flexneri 2a str. 2457T
augaaucagcaaggaa

SEQ ID NO: 1922343 - RNA, 13 nt, Shigella flexneri 2a str. 2457T
augaagcccgcug

SEQ ID NO: 1922344 - RNA, 14 nt, Shigella flexneri 2a str. 2457T
augaacucgagaac

SEQ ID NO: 1922345 - RNA, 15 nt, Shigella flexneri 2a str. 2457T
augaacaaaauucca

SEQ ID NO: 1922346 - RNA, 15 nt, Shigella flexneri 2a str. 2457T
aucuuuuacaagcaa

SEQ ID NO: 1922347 - RNA, 22 nt, Shigella flexneri 2a str. 2457T
aucuuuuacaagcaacuugcaa

SEQ ID NO: 1922348 - RNA, 15 nt, Shigella flexneri 2a str. 2457T
aucuuuaugaaauau

SEQ ID NO: 1922349 - RNA, 18 nt, Shigella flexneri 2a str. 2457T
aucuuuccggcagaagca

SEQ ID NO: 1922350 - RNA, 14 nt, Shigella flexneri 2a str. 2457T
aucuuuccucacuc

SEQ ID NO: 1922351 - RNA, 14 nt, Shigella flexneri 2a str. 2457T
aucuuucauuuccg

SEQ ID NO: 1922352 - RNA, 20 nt, Shigella flexneri 2a str. 2457T
aucuucgagauucuuaaagu

SEQ ID NO: 1922353 - RNA, 22 nt, Shigella flexneri 2a str. 2457T
aucuucgauaaacucaaucagg

SEQ ID NO: 1922354 - RNA, 23 nt, Shigella flexneri 2a str. 2457T
aucuuccguggaacaaaaucuua

SEQ ID NO: 1922355 - RNA, 19 nt, Shigella flexneri 2a str. 2457T
aucuucggcgucagaaaua

SEQ ID NO: 1922356 - RNA, 17 nt, Shigella flexneri 2a str. 2457T
aucuuuaucacacagau

SEQ ID NO: 1922357 - RNA, 23 nt, Shigella flexneri 2a str. 2457T
aucuucgugucuacgcccggcag

SEQ ID NO: 1922358 - RNA, 20 nt, Shigella flexneri 2a str. 2457T
aucuucguuaucccaggcgu

SEQ ID NO: 1922359 - RNA, 20 nt, Shigella flexneri 2a str. 2457T
aguucacugccguacaggca

SEQ ID NO: 1922360 - RNA, 18 nt, Shigella flexneri 2a str. 2457T
aguucacccucauucacc

SEQ ID NO: 1922361 - RNA, 17 nt, Shigella flexneri 2a str. 2457T
aguucacgcagcuucuc

SEQ ID NO: 1922362 - RNA, 19 nt, Shigella flexneri 2a str. 2457T
aguucacgcgauuucucau

SEQ ID NO: 1922363 - RNA, 11 nt, Shigella flexneri 2a str. 2457T
aguuauucauu

SEQ ID NO: 1922364 - RNA, 21 nt, Shigella flexneri 2a str. 2457T
aguuaucgcgauacaccagau

SEQ ID NO: 1922365 - RNA, 13 nt, Shigella flexneri 2a str. 2457T
aguuaucaagcca

SEQ ID NO: 1922366 - RNA, 19 nt, Shigella flexneri 2a str. 2457T
aguuagcaaggauguggcu

SEQ ID NO: 1922367 - RNA, 14 nt, Shigella flexneri 2a str. 2457T
aguuagaguagcca

SEQ ID NO: 1922368 - RNA, 16 nt, Shigella flexneri 2a str. 2457T
aguuagagccagggau

SEQ ID NO: 1922369 - RNA, 13 nt, Shigella flexneri 2a str. 2457T
aguuacagcucuc

SEQ ID NO: 1922370 - RNA, 14 nt, Shigella flexneri 2a str. 2457T
aguuacgugcugcg

SEQ ID NO: 1922371 - RNA, 21 nt, Shigella flexneri 2a str. 2457T
aguguccgccaauuucaucac

SEQ ID NO: 1922372 - RNA, 21 nt, Shigella flexneri 2a str. 2457T
aguucgguugggaucgccagg

SEQ ID NO: 1922373 - RNA, 12 nt, Shigella flexneri 2a str. 2457T
aguucuacaauc

SEQ ID NO: 1922374 - RNA, 18 nt, Shigella flexneri 2a str. 2457T
aguuccacuauuucaaua

SEQ ID NO: 1922375 - RNA, 18 nt, Shigella flexneri 2a str. 2457T
aguucauuuuucucaacg

SEQ ID NO: 1922376 - RNA, 20 nt, Shigella flexneri 2a str. 2457T
aguuccagggcagcaguuca

SEQ ID NO: 1922377 - RNA, 13 nt, Shigella flexneri 2a str. 2457T
aguuccagcauga

SEQ ID NO: 1922378 - RNA, 13 nt, Shigella flexneri 2a str. 2457T
aguugaucaccag

SEQ ID NO: 1922379 - RNA, 14 nt, Shigella flexneri 2a str. 2457T
aguugaucaccagu

SEQ ID NO: 1922380 - RNA, 21 nt, Shigella flexneri 2a str. 2457T
aguugauuggcgcgaaccauc

SEQ ID NO: 1922381 - RNA, 16 nt, Shigella flexneri 2a str. 2457T
aguugcagacugaaua

SEQ ID NO: 1922382 - RNA, 16 nt, Shigella flexneri 2a str. 2457T
aguugcagcaagccau

SEQ ID NO: 1922383 - RNA, 17 nt, Shigella flexneri 2a str. 2457T
aguugauuaauuucauu

SEQ ID NO: 1922384 - RNA, 18 nt, Shigella flexneri 2a str. 2457T
aguugauuaauuucauuu

SEQ ID NO: 1922385 - RNA, 19 nt, Shigella flexneri 2a str. 2457T
aguugaucuauaccaccgc

SEQ ID NO: 1922386 - RNA, 17 nt, Shigella flexneri 2a str. 2457T
aguugaucucuuuccac

SEQ ID NO: 1922387 - RNA, 18 nt, Shigella flexneri 2a str. 2457T
aguugauucggccaguaa

SEQ ID NO: 1922388 - RNA, 14 nt, Shigella flexneri 2a str. 2457T
aguucuucaaaaau

SEQ ID NO: 1922389 - RNA, 23 nt, Shigella flexneri 2a str. 2457T
aguucugaacguugcgcuucccg

SEQ ID NO: 1922390 - RNA, 19 nt, Shigella flexneri 2a str. 2457T
aguuucggacgcggcacgc

SEQ ID NO: 1922391 - RNA, 20 nt, Shigella flexneri 2a str. 2457T
aguuucggcaucagcagaau

SEQ ID NO: 1922392 - RNA, 14 nt, Shigella flexneri 2a str. 2457T
aguuucagaccaau

SEQ ID NO: 1922393 - RNA, 20 nt, Shigella flexneri 2a str. 2457T
aguuugcaccucugcugcug

SEQ ID NO: 1922394 - RNA, 19 nt, Shigella flexneri 2a str. 2457T
aguuugccguugaucucuc

SEQ ID NO: 1922395 - RNA, 15 nt, Shigella flexneri 2a str. 2457T
aguuugaucaguucu

SEQ ID NO: 1922396 - RNA, 14 nt, Shigella flexneri 2a str. 2457T
aguuuguuuagcca

SEQ ID NO: 1922397 - RNA, 18 nt, Shigella flexneri 2a str. 2457T
aguuuguucagcugcgug

SEQ ID NO: 1922398 - RNA, 19 nt, Shigella flexneri 2a str. 2457T
aguuugucuggcaauccua

SEQ ID NO: 1922399 - RNA, 19 nt, Shigella flexneri 2a str. 2457T
aguuuggugagaacaccaa

SEQ ID NO: 1922400 - RNA, 20 nt, Shigella flexneri 2a str. 2457T
aguuuggcuucguguacaaa

SEQ ID NO: 1922401 - RNA, 14 nt, Shigella flexneri 2a str. 2457T
aguuuaccagccaa

SEQ ID NO: 1922402 - RNA, 17 nt, Shigella flexneri 2a str. 2457T
aguuuacgaaccuucac

SEQ ID NO: 1922403 - RNA, 15 nt, Shigella flexneri 2a str. 2457T
aguuguuuacaguau

SEQ ID NO: 1922404 - RNA, 12 nt, Shigella flexneri 2a str. 2457T
aguuuaaacauu

SEQ ID NO: 1922405 - RNA, 18 nt, Shigella flexneri 2a str. 2457T
aguuuacuucuauaauga

SEQ ID NO: 1922406 - RNA, 17 nt, Shigella flexneri 2a str. 2457T
aguugccguucuucccg

SEQ ID NO: 1922407 - RNA, 16 nt, Shigella flexneri 2a str. 2457T
aguugugcaccaccaa

SEQ ID NO: 1922408 - RNA, 14 nt, Shigella flexneri 2a str. 2457T
aguugugcugaacg

SEQ ID NO: 1922409 - RNA, 19 nt, Shigella flexneri 2a str. 2457T
aguuguugagguucggagu

SEQ ID NO: 1922410 - RNA, 16 nt, Shigella flexneri 2a str. 2457T
aguuguucaacaguaa

SEQ ID NO: 1922411 - RNA, 14 nt, Shigella flexneri 2a str. 2457T
agugccgucagcag

SEQ ID NO: 1922412 - RNA, 19 nt, Shigella flexneri 2a str. 2457T
agugccgcccaccacucga

SEQ ID NO: 1922413 - RNA, 14 nt, Shigella flexneri 2a str. 2457T
agugccgcccacca

SEQ ID NO: 1922414 - RNA, 18 nt, Shigella flexneri 2a str. 2457T
agugcgcgcagcugcgca

SEQ ID NO: 1922415 - RNA, 20 nt, Shigella flexneri 2a str. 2457T
agugcggcgcaccagcaggc

SEQ ID NO: 1922416 - RNA, 16 nt, Shigella flexneri 2a str. 2457T
agugcgguaaauuuuu

SEQ ID NO: 1922417 - RNA, 16 nt, Shigella flexneri 2a str. 2457T
agugcugccaucuucu

SEQ ID NO: 1922418 - RNA, 14 nt, Shigella flexneri 2a str. 2457T
aguggugcggcuga

SEQ ID NO: 1922419 - RNA, 19 nt, Shigella flexneri 2a str. 2457T
agugguucugcaagaggaa

SEQ ID NO: 1922420 - RNA, 15 nt, Shigella flexneri 2a str. 2457T
aguggguuguaucaa

SEQ ID NO: 1922421 - RNA, 15 nt, Shigella flexneri 2a str. 2457T
aguggcaaccagcag

SEQ ID NO: 1922422 - RNA, 14 nt, Shigella flexneri 2a str. 2457T
aguggauuaucuuc

SEQ ID NO: 1922423 - RNA, 22 nt, Shigella flexneri 2a str. 2457T
agugcuucgcggacaucgucca

SEQ ID NO: 1922424 - RNA, 20 nt, Shigella flexneri 2a str. 2457T
aguggaucccagaagaauau

SEQ ID NO: 1922425 - RNA, 16 nt, Shigella flexneri 2a str. 2457T
aguggaucagcaaauc

SEQ ID NO: 1922426 - RNA, 20 nt, Shigella flexneri 2a str. 2457T
agugcacgaaccagagacag

SEQ ID NO: 1922427 - RNA, 20 nt, Shigella flexneri 2a str. 2457T
agugcauaaauaccggcaug

SEQ ID NO: 1922428 - RNA, 16 nt, Shigella flexneri 2a str. 2457T
agugcauccagcagcc

SEQ ID NO: 1922429 - RNA, 19 nt, Shigella flexneri 2a str. 2457T
agugcagcaugcacccuca

SEQ ID NO: 1922430 - RNA, 18 nt, Shigella flexneri 2a str. 2457T
agugcccgaccacuucau

SEQ ID NO: 1922431 - RNA, 13 nt, Shigella flexneri 2a str. 2457T
agugcccccaacu

SEQ ID NO: 1922432 - RNA, 19 nt, Shigella flexneri 2a str. 2457T
agugcccgaccacuucaug

SEQ ID NO: 1922433 - RNA, 14 nt, Shigella flexneri 2a str. 2457T
agugccaaagccag

SEQ ID NO: 1922434 - RNA, 15 nt, Shigella flexneri 2a str. 2457T
agugaugaaaacgaa

SEQ ID NO: 1922435 - RNA, 18 nt, Shigella flexneri 2a str. 2457T
agugaugaaaacgaaggc

SEQ ID NO: 1922436 - RNA, 17 nt, Shigella flexneri 2a str. 2457T
agugauugcuugccccu

SEQ ID NO: 1922437 - RNA, 23 nt, Shigella flexneri 2a str. 2457T
agugaauauaccauggaagaaaa

SEQ ID NO: 1922438 - RNA, 17 nt, Shigella flexneri 2a str. 2457T
agugaauaaauuuuauu

SEQ ID NO: 1922439 - RNA, 16 nt, Shigella flexneri 2a str. 2457T
agugaucaaacacaaa

SEQ ID NO: 1922440 - RNA, 23 nt, Shigella flexneri 2a str. 2457T
agugaucaaacacaaaguccuga

SEQ ID NO: 1922441 - RNA, 19 nt, Shigella flexneri 2a str. 2457T
agucaaaagccuccgaccg

SEQ ID NO: 1922442 - RNA, 23 nt, Shigella flexneri 2a str. 2457T
aguauuuuuaaccguauuuuggu

SEQ ID NO: 1922443 - RNA, 12 nt, Shigella flexneri 2a str. 2457T
aguauuuuuaau

SEQ ID NO: 1922444 - RNA, 23 nt, Shigella flexneri 2a str. 2457T
aguauuuucuuugacaaauuccg

SEQ ID NO: 1922445 - RNA, 13 nt, Shigella flexneri 2a str. 2457T
agucgacuucaga

SEQ ID NO: 1922446 - RNA, 20 nt, Shigella flexneri 2a str. 2457T
agucgcgguccgggccgcaa

SEQ ID NO: 1922447 - RNA, 20 nt, Shigella flexneri 2a str. 2457T
agucgcgcaauugccagaca

SEQ ID NO: 1922448 - RNA, 21 nt, Shigella flexneri 2a str. 2457T
aguccguugaaaaugcugguu

SEQ ID NO: 1922449 - RNA, 15 nt, Shigella flexneri 2a str. 2457T
aguccugagucagaa

SEQ ID NO: 1922450 - RNA, 21 nt, Shigella flexneri 2a str. 2457T
aguccugaccgucaccccauu

SEQ ID NO: 1922451 - RNA, 16 nt, Shigella flexneri 2a str. 2457T
agucgcuugcaggauc

SEQ ID NO: 1922452 - RNA, 14 nt, Shigella flexneri 2a str. 2457T
agucgggaccagca

SEQ ID NO: 1922453 - RNA, 19 nt, Shigella flexneri 2a str. 2457T
agucgggaccagcauucca

SEQ ID NO: 1922454 - RNA, 18 nt, Shigella flexneri 2a str. 2457T
agucgcuuucauucagaa

SEQ ID NO: 1922455 - RNA, 19 nt, Shigella flexneri 2a str. 2457T
agucgcuuucauucagaac

SEQ ID NO: 1922456 - RNA, 18 nt, Shigella flexneri 2a str. 2457T
agucggcgcugaaauucu

SEQ ID NO: 1922457 - RNA, 16 nt, Shigella flexneri 2a str. 2457T
agucuccauuuuuuug

SEQ ID NO: 1922458 - RNA, 14 nt, Shigella flexneri 2a str. 2457T
agucuccauuuuuu

SEQ ID NO: 1922459 - RNA, 21 nt, Shigella flexneri 2a str. 2457T
agucuuuguauuuauuuucag

SEQ ID NO: 1922460 - RNA, 16 nt, Shigella flexneri 2a str. 2457T
agucuuuuuucaacuu

SEQ ID NO: 1922461 - RNA, 23 nt, Shigella flexneri 2a str. 2457T
agucuuugcgaggcgcgucccag

SEQ ID NO: 1922462 - RNA, 13 nt, Shigella flexneri 2a str. 2457T
agucugcauuuuc

SEQ ID NO: 1922463 - RNA, 19 nt, Shigella flexneri 2a str. 2457T
agucucuucuuugcaggga

SEQ ID NO: 1922464 - RNA, 14 nt, Shigella flexneri 2a str. 2457T
agucucugaaauuc

SEQ ID NO: 1922465 - RNA, 21 nt, Shigella flexneri 2a str. 2457T
agucucuucuuugcagggagg

SEQ ID NO: 1922466 - RNA, 20 nt, Shigella flexneri 2a str. 2457T
agucugaccucuucuaccac

SEQ ID NO: 1922467 - RNA, 14 nt, Shigella flexneri 2a str. 2457T
auacaaccaaucgc

SEQ ID NO: 1922468 - RNA, 15 nt, Shigella flexneri 2a str. 2457T
auacaacgccaugaa

SEQ ID NO: 1922469 - RNA, 12 nt, Shigella flexneri 2a str. 2457T
auacaacccacc

SEQ ID NO: 1922470 - RNA, 20 nt, Shigella flexneri 2a str. 2457T
auacaacugccgcgccugaa

SEQ ID NO: 1922471 - RNA, 22 nt, Shigella flexneri 2a str. 2457T
auacaagagauaugaauaugaa

SEQ ID NO: 1922472 - RNA, 15 nt, Shigella flexneri 2a str. 2457T
auacagccgguacau

SEQ ID NO: 1922473 - RNA, 22 nt, Shigella flexneri 2a str. 2457T
auacagcgcggaccccacgcuc

SEQ ID NO: 1922474 - RNA, 15 nt, Shigella flexneri 2a str. 2457T
auacagcccagacaa

SEQ ID NO: 1922475 - RNA, 20 nt, Shigella flexneri 2a str. 2457T
auacagcccagacaaaugaa

SEQ ID NO: 1922476 - RNA, 17 nt, Shigella flexneri 2a str. 2457T
auacagcaauggaaaaa

SEQ ID NO: 1922477 - RNA, 23 nt, Shigella flexneri 2a str. 2457T
auacagcaauggaaaaaguuuua

SEQ ID NO: 1922478 - RNA, 15 nt, Shigella flexneri 2a str. 2457T
auacagccaaaucau

SEQ ID NO: 1922479 - RNA, 18 nt, Shigella flexneri 2a str. 2457T
auacacuucacacacuuu

SEQ ID NO: 1922480 - RNA, 20 nt, Shigella flexneri 2a str. 2457T
auacacuucacacacuuuua

SEQ ID NO: 1922481 - RNA, 17 nt, Shigella flexneri 2a str. 2457T
auacacgccgccgagca

SEQ ID NO: 1922482 - RNA, 17 nt, Shigella flexneri 2a str. 2457T
auacacuaacagaacaa

SEQ ID NO: 1922483 - RNA, 20 nt, Shigella flexneri 2a str. 2457T
auacacuaacagaacaauaa

SEQ ID NO: 1922484 - RNA, 22 nt, Shigella flexneri 2a str. 2457T
auaauuucuucguucgcugcau

SEQ ID NO: 1922485 - RNA, 15 nt, Shigella flexneri 2a str. 2457T
auaauuuuuucgcca

SEQ ID NO: 1922486 - RNA, 16 nt, Shigella flexneri 2a str. 2457T
auacaaaauuuaacac

SEQ ID NO: 1922487 - RNA, 22 nt, Shigella flexneri 2a str. 2457T
auaauuuucuuaucaguuucag

SEQ ID NO: 1922488 - RNA, 11 nt, Shigella flexneri 2a str. 2457T
auaauggcugu

SEQ ID NO: 1922489 - RNA, 22 nt, Shigella flexneri 2a str. 2457T
auaauugaccagaucuucauca

SEQ ID NO: 1922490 - RNA, 19 nt, Shigella flexneri 2a str. 2457T
auaauagguaaacauccgu

SEQ ID NO: 1922491 - RNA, 14 nt, Shigella flexneri 2a str. 2457T
auaaucaccacaca

SEQ ID NO: 1922492 - RNA, 19 nt, Shigella flexneri 2a str. 2457T
auaauaguauuaagccagu

SEQ ID NO: 1922493 - RNA, 20 nt, Shigella flexneri 2a str. 2457T
auaaucacaauggucaacau

SEQ ID NO: 1922494 - RNA, 20 nt, Shigella flexneri 2a str. 2457T
auaaucaccugccuucacuu

SEQ ID NO: 1922495 - RNA, 20 nt, Shigella flexneri 2a str. 2457T
auaaucgaaaacaucauggu

SEQ ID NO: 1922496 - RNA, 15 nt, Shigella flexneri 2a str. 2457T
auaaucgaaccaaac

SEQ ID NO: 1922497 - RNA, 22 nt, Shigella flexneri 2a str. 2457T
auaaucgaucgcguaauaaaau

SEQ ID NO: 1922498 - RNA, 16 nt, Shigella flexneri 2a str. 2457T
auaaucgcaauuaccc

SEQ ID NO: 1922499 - RNA, 15 nt, Shigella flexneri 2a str. 2457T
auaaucucuacacca

SEQ ID NO: 1922500 - RNA, 20 nt, Shigella flexneri 2a str. 2457T
auaaucucuacaccauuacc

SEQ ID NO: 1922501 - RNA, 13 nt, Shigella flexneri 2a str. 2457T
auaaucuuuaaaa

SEQ ID NO: 1922502 - RNA, 20 nt, Shigella flexneri 2a str. 2457T
auaaugagcaccgcaccuaa

SEQ ID NO: 1922503 - RNA, 17 nt, Shigella flexneri 2a str. 2457T
auaaugaaggaugaaac

SEQ ID NO: 1922504 - RNA, 18 nt, Shigella flexneri 2a str. 2457T
auaaugacggagaguacu

SEQ ID NO: 1922505 - RNA, 22 nt, Shigella flexneri 2a str. 2457T
auaagaacugacuuccacuucc

SEQ ID NO: 1922506 - RNA, 12 nt, Shigella flexneri 2a str. 2457T
auaagucucaga

SEQ ID NO: 1922507 - RNA, 15 nt, Shigella flexneri 2a str. 2457T
auaaguuacacauca

SEQ ID NO: 1922508 - RNA, 13 nt, Shigella flexneri 2a str. 2457T
auaauaaagcuac

SEQ ID NO: 1922509 - RNA, 21 nt, Shigella flexneri 2a str. 2457T
auaauacacuaacagaacaau

SEQ ID NO: 1922510 - RNA, 23 nt, Shigella flexneri 2a str. 2457T
auaauacagcccagacaaaugaa

SEQ ID NO: 1922511 - RNA, 22 nt, Shigella flexneri 2a str. 2457T
auaaaaucuauuauuauuuuug

SEQ ID NO: 1922512 - RNA, 23 nt, Shigella flexneri 2a str. 2457T
aguuuuaguugccguucuucccg

SEQ ID NO: 1922513 - RNA, 15 nt, Shigella flexneri 2a str. 2457T
aguuuucauauaccg

SEQ ID NO: 1922514 - RNA, 23 nt, Shigella flexneri 2a str. 2457T
auaaaauuauagggaugcagaau

SEQ ID NO: 1922515 - RNA, 17 nt, Shigella flexneri 2a str. 2457T
auaaaaugauuucgcaa

SEQ ID NO: 1922516 - RNA, 18 nt, Shigella flexneri 2a str. 2457T
auaaaaugauuucgcaac

SEQ ID NO: 1922517 - RNA, 14 nt, Shigella flexneri 2a str. 2457T
auaaaauuauccag

SEQ ID NO: 1922518 - RNA, 15 nt, Shigella flexneri 2a str. 2457T
auaaaauucauucaa

SEQ ID NO: 1922519 - RNA, 17 nt, Shigella flexneri 2a str. 2457T
auaaaauucauucaauu

SEQ ID NO: 1922520 - RNA, 15 nt, Shigella flexneri 2a str. 2457T
auaaacaaugagaua

SEQ ID NO: 1922521 - RNA, 20 nt, Shigella flexneri 2a str. 2457T
auaaacaaugagauauuuaa

SEQ ID NO: 1922522 - RNA, 15 nt, Shigella flexneri 2a str. 2457T
auaaacaccagcaau

SEQ ID NO: 1922523 - RNA, 16 nt, Shigella flexneri 2a str. 2457T
auaaacaccagcaaua

SEQ ID NO: 1922524 - RNA, 22 nt, Shigella flexneri 2a str. 2457T
auaaacaaagcgcacuuugcca

SEQ ID NO: 1922525 - RNA, 23 nt, Shigella flexneri 2a str. 2457T
auaaacaacggcaagaucagcau

SEQ ID NO: 1922526 - RNA, 22 nt, Shigella flexneri 2a str. 2457T
auaaaggucgacagcagccccg

SEQ ID NO: 1922527 - RNA, 16 nt, Shigella flexneri 2a str. 2457T
auaaaguagaaauuau

SEQ ID NO: 1922528 - RNA, 17 nt, Shigella flexneri 2a str. 2457T
auaaagucgauuugcaa

SEQ ID NO: 1922529 - RNA, 23 nt, Shigella flexneri 2a str. 2457T
auaaauagauccaggaacagaag

SEQ ID NO: 1922530 - RNA, 15 nt, Shigella flexneri 2a str. 2457T
auaaauauauaaaaa

SEQ ID NO: 1922531 - RNA, 23 nt, Shigella flexneri 2a str. 2457T
auaaauauggugaaaguaaaaaa

SEQ ID NO: 1922532 - RNA, 15 nt, Shigella flexneri 2a str. 2457T
auaaauauuaauaca

SEQ ID NO: 1922533 - RNA, 21 nt, Shigella flexneri 2a str. 2457T
auaaauauuaauacaacaaca

SEQ ID NO: 1922534 - RNA, 14 nt, Shigella flexneri 2a str. 2457T
auaaaguagaaauu

SEQ ID NO: 1922535 - RNA, 15 nt, Shigella flexneri 2a str. 2457T
auaaaggucaucaca

SEQ ID NO: 1922536 - RNA, 23 nt, Shigella flexneri 2a str. 2457T
auaaaggucaucacaucccagca

SEQ ID NO: 1922537 - RNA, 17 nt, Shigella flexneri 2a str. 2457T
auaaaggucgacagcag

SEQ ID NO: 1922538 - RNA, 13 nt, Shigella flexneri 2a str. 2457T
auaaagcgauaaa

SEQ ID NO: 1922539 - RNA, 15 nt, Shigella flexneri 2a str. 2457T
auaaagcagagcagg

SEQ ID NO: 1922540 - RNA, 15 nt, Shigella flexneri 2a str. 2457T
auaaagcagccuauu

SEQ ID NO: 1922541 - RNA, 20 nt, Shigella flexneri 2a str. 2457T
auaaacgaaucugcaaaucu

SEQ ID NO: 1922542 - RNA, 22 nt, Shigella flexneri 2a str. 2457T
auaaaccugccuuacauaucaa

SEQ ID NO: 1922543 - RNA, 21 nt, Shigella flexneri 2a str. 2457T
auaaaccagugccaaaccaga

SEQ ID NO: 1922544 - RNA, 20 nt, Shigella flexneri 2a str. 2457T
auaaccgguauuacuccaga

SEQ ID NO: 1922545 - RNA, 15 nt, Shigella flexneri 2a str. 2457T
auaaccgaaucccgc

SEQ ID NO: 1922546 - RNA, 21 nt, Shigella flexneri 2a str. 2457T
auaaccgcaucaacagugcca

SEQ ID NO: 1922547 - RNA, 20 nt, Shigella flexneri 2a str. 2457T
auaacccgcuguaaaugcug

SEQ ID NO: 1922548 - RNA, 15 nt, Shigella flexneri 2a str. 2457T
auaacccagggguca

SEQ ID NO: 1922549 - RNA, 15 nt, Shigella flexneri 2a str. 2457T
auaaccauauaugau

SEQ ID NO: 1922550 - RNA, 15 nt, Shigella flexneri 2a str. 2457T
auaaccaucagcucu

SEQ ID NO: 1922551 - RNA, 21 nt, Shigella flexneri 2a str. 2457T
auaacucucuuuugcuugaca

SEQ ID NO: 1922552 - RNA, 18 nt, Shigella flexneri 2a str. 2457T
auaacucuuugaugaaac

SEQ ID NO: 1922553 - RNA, 15 nt, Shigella flexneri 2a str. 2457T
auaacuggucaucaa

SEQ ID NO: 1922554 - RNA, 12 nt, Shigella flexneri 2a str. 2457T
auaacugcuauu

SEQ ID NO: 1922555 - RNA, 14 nt, Shigella flexneri 2a str. 2457T
auaacugcuauuca

SEQ ID NO: 1922556 - RNA, 17 nt, Shigella flexneri 2a str. 2457T
auaaccugcaaaauagu

SEQ ID NO: 1922557 - RNA, 17 nt, Shigella flexneri 2a str. 2457T
auaaccugugcaccaga

SEQ ID NO: 1922558 - RNA, 18 nt, Shigella flexneri 2a str. 2457T
auaaccugugcaccagaa

SEQ ID NO: 1922559 - RNA, 18 nt, Shigella flexneri 2a str. 2457T
auaacgcggcagcaggau

SEQ ID NO: 1922560 - RNA, 13 nt, Shigella flexneri 2a str. 2457T
auaacgcuuuucu

SEQ ID NO: 1922561 - RNA, 15 nt, Shigella flexneri 2a str. 2457T
auaacgcuuuucuca

SEQ ID NO: 1922562 - RNA, 22 nt, Shigella flexneri 2a str. 2457T
auaacggaggacuuauggcugg

SEQ ID NO: 1922563 - RNA, 22 nt, Shigella flexneri 2a str. 2457T
auaaauccuuuguacaggauau

SEQ ID NO: 1922564 - RNA, 16 nt, Shigella flexneri 2a str. 2457T
auaaauccaucgggcu

SEQ ID NO: 1922565 - RNA, 20 nt, Shigella flexneri 2a str. 2457T
auaacauccaacgguuugaa

SEQ ID NO: 1922566 - RNA, 21 nt, Shigella flexneri 2a str. 2457T
auaaccaauguggguguuaag

SEQ ID NO: 1922567 - RNA, 14 nt, Shigella flexneri 2a str. 2457T
auaaccaaauaaaa

SEQ ID NO: 1922568 - RNA, 16 nt, Shigella flexneri 2a str. 2457T
auaaccaaauaaaaua

SEQ ID NO: 1922569 - RNA, 14 nt, Shigella flexneri 2a str. 2457T
auaaccaaaugacu

SEQ ID NO: 1922570 - RNA, 14 nt, Shigella flexneri 2a str. 2457T
auaacauuuuucuc

SEQ ID NO: 1922571 - RNA, 23 nt, Shigella flexneri 2a str. 2457T
auaacaccgauuuuguaaaagaa

SEQ ID NO: 1922572 - RNA, 20 nt, Shigella flexneri 2a str. 2457T
auaacaccgauuuuguaaaa

SEQ ID NO: 1922573 - RNA, 22 nt, Shigella flexneri 2a str. 2457T
auaacaccgauuuuguaaaaga

SEQ ID NO: 1922574 - RNA, 14 nt, Shigella flexneri 2a str. 2457T
auaacaccagccag

SEQ ID NO: 1922575 - RNA, 10 nt, Shigella flexneri 2a str. 2457T
auaacagaau

SEQ ID NO: 1922576 - RNA, 23 nt, Shigella flexneri 2a str. 2457T
auaacagaaugcgggcgaaaaca

SEQ ID NO: 1922577 - RNA, 23 nt, Shigella flexneri 2a str. 2457T
auaacagaccuuucgaacccaac

SEQ ID NO: 1922578 - RNA, 18 nt, Shigella flexneri 2a str. 2457T
aggaaccuccauguccag

SEQ ID NO: 1922579 - RNA, 23 nt, Shigella flexneri 2a str. 2457T
aggaacgcgccaagauagaacca

SEQ ID NO: 1922580 - RNA, 15 nt, Shigella flexneri 2a str. 2457T
aggaacggcauuuac

SEQ ID NO: 1922581 - RNA, 15 nt, Shigella flexneri 2a str. 2457T
aggaagcagcuugcu

SEQ ID NO: 1922582 - RNA, 20 nt, Shigella flexneri 2a str. 2457T
aggaagccggaauuuuccuu

SEQ ID NO: 1922583 - RNA, 15 nt, Shigella flexneri 2a str. 2457T
aggaagauuacgcug

SEQ ID NO: 1922584 - RNA, 17 nt, Shigella flexneri 2a str. 2457T
aggaacuguuucaccau

SEQ ID NO: 1922585 - RNA, 22 nt, Shigella flexneri 2a str. 2457T
agcuuuucgcccuggacaacau

SEQ ID NO: 1922586 - RNA, 22 nt, Shigella flexneri 2a str. 2457T
agcuuuuccauaucaagcauga

SEQ ID NO: 1922587 - RNA, 19 nt, Shigella flexneri 2a str. 2457T
agcuuucuugcagcucuug

SEQ ID NO: 1922588 - RNA, 18 nt, Shigella flexneri 2a str. 2457T
agcuuucuuuuucugaca

SEQ ID NO: 1922589 - RNA, 13 nt, Shigella flexneri 2a str. 2457T
aggaaauaagcau

SEQ ID NO: 1922590 - RNA, 13 nt, Shigella flexneri 2a str. 2457T
aggaaauaauaua

SEQ ID NO: 1922591 - RNA, 13 nt, Shigella flexneri 2a str. 2457T
aggaaaguaaauu

SEQ ID NO: 1922592 - RNA, 17 nt, Shigella flexneri 2a str. 2457T
aggaaauguuccggguu

SEQ ID NO: 1922593 - RNA, 21 nt, Shigella flexneri 2a str. 2457T
aggaacagaagaaagcaauga

SEQ ID NO: 1922594 - RNA, 20 nt, Shigella flexneri 2a str. 2457T
aggagaguaugcgcgucaga

SEQ ID NO: 1922595 - RNA, 18 nt, Shigella flexneri 2a str. 2457T
aggagaguaugcgcguca

SEQ ID NO: 1922596 - RNA, 17 nt, Shigella flexneri 2a str. 2457T
aggagaagcaaauucuu

SEQ ID NO: 1922597 - RNA, 16 nt, Shigella flexneri 2a str. 2457T
aggagaaugggauggu

SEQ ID NO: 1922598 - RNA, 22 nt, Shigella flexneri 2a str. 2457T
aggacaucccggcagagaaaau

SEQ ID NO: 1922599 - RNA, 15 nt, Shigella flexneri 2a str. 2457T
aggacugaaauuaca

SEQ ID NO: 1922600 - RNA, 20 nt, Shigella flexneri 2a str. 2457T
aggaauucagaaaaauacaa

SEQ ID NO: 1922601 - RNA, 17 nt, Shigella flexneri 2a str. 2457T
aggaaggcaagaaagcg

SEQ ID NO: 1922602 - RNA, 20 nt, Shigella flexneri 2a str. 2457T
aggaagcuuucgcaguagau

SEQ ID NO: 1922603 - RNA, 16 nt, Shigella flexneri 2a str. 2457T
aggaaggucauccaaa

SEQ ID NO: 1922604 - RNA, 21 nt, Shigella flexneri 2a str. 2457T
aggacagagacgcacugcuug

SEQ ID NO: 1922605 - RNA, 16 nt, Shigella flexneri 2a str. 2457T
agcuugaucaauaacg

SEQ ID NO: 1922606 - RNA, 13 nt, Shigella flexneri 2a str. 2457T
agcuucucauccu

SEQ ID NO: 1922607 - RNA, 17 nt, Shigella flexneri 2a str. 2457T
agcuugugcaccagcug

SEQ ID NO: 1922608 - RNA, 20 nt, Shigella flexneri 2a str. 2457T
agcuuaccguccucuuccca

SEQ ID NO: 1922609 - RNA, 19 nt, Shigella flexneri 2a str. 2457T
agcuuacguuacccagcac

SEQ ID NO: 1922610 - RNA, 20 nt, Shigella flexneri 2a str. 2457T
agcuuacguuacccagcacg

SEQ ID NO: 1922611 - RNA, 15 nt, Shigella flexneri 2a str. 2457T
agcuucgcuucccaa

SEQ ID NO: 1922612 - RNA, 11 nt, Shigella flexneri 2a str. 2457T
agcugugccug

SEQ ID NO: 1922613 - RNA, 21 nt, Shigella flexneri 2a str. 2457T
agcugugggguauuuccaggg

SEQ ID NO: 1922614 - RNA, 14 nt, Shigella flexneri 2a str. 2457T
agcugucagaacgg

SEQ ID NO: 1922615 - RNA, 16 nt, Shigella flexneri 2a str. 2457T
agcugucagaacgguu

SEQ ID NO: 1922616 - RNA, 23 nt, Shigella flexneri 2a str. 2457T
agcugcuuuuccggucagcaauc

SEQ ID NO: 1922617 - RNA, 22 nt, Shigella flexneri 2a str. 2457T
agcucccacaguuucagcccca

SEQ ID NO: 1922618 - RNA, 16 nt, Shigella flexneri 2a str. 2457T
agcuccagccgcuccc

SEQ ID NO: 1922619 - RNA, 11 nt, Shigella flexneri 2a str. 2457T
agcuccagguc

SEQ ID NO: 1922620 - RNA, 14 nt, Shigella flexneri 2a str. 2457T
agcuccagguccuc

SEQ ID NO: 1922621 - RNA, 15 nt, Shigella flexneri 2a str. 2457T
agcuccaccaguucg

SEQ ID NO: 1922622 - RNA, 20 nt, Shigella flexneri 2a str. 2457T
agcugcugacggugauaauc

SEQ ID NO: 1922623 - RNA, 14 nt, Shigella flexneri 2a str. 2457T
agcugccgccaggc

SEQ ID NO: 1922624 - RNA, 15 nt, Shigella flexneri 2a str. 2457T
agcugccgccaggcu

SEQ ID NO: 1922625 - RNA, 16 nt, Shigella flexneri 2a str. 2457T
aggauuuucuaauauu

SEQ ID NO: 1922626 - RNA, 14 nt, Shigella flexneri 2a str. 2457T
aggcaaaaugccag

SEQ ID NO: 1922627 - RNA, 21 nt, Shigella flexneri 2a str. 2457T
aggcaacaugaaacagaaaau

SEQ ID NO: 1922628 - RNA, 15 nt, Shigella flexneri 2a str. 2457T
aggcaaccagcacgc

SEQ ID NO: 1922629 - RNA, 18 nt, Shigella flexneri 2a str. 2457T
aggcaacaugaaacagaa

SEQ ID NO: 1922630 - RNA, 18 nt, Shigella flexneri 2a str. 2457T
aggcaaguagcgccauac

SEQ ID NO: 1922631 - RNA, 21 nt, Shigella flexneri 2a str. 2457T
aggcaagccgcuaacagcagc

SEQ ID NO: 1922632 - RNA, 13 nt, Shigella flexneri 2a str. 2457T
aggcaagccacaa

SEQ ID NO: 1922633 - RNA, 14 nt, Shigella flexneri 2a str. 2457T
aggcaccagccccu

SEQ ID NO: 1922634 - RNA, 19 nt, Shigella flexneri 2a str. 2457T
aggagcgauuaugaaacaa

SEQ ID NO: 1922635 - RNA, 20 nt, Shigella flexneri 2a str. 2457T
aggagcacgccuggaaagug

SEQ ID NO: 1922636 - RNA, 13 nt, Shigella flexneri 2a str. 2457T
aggagcuggaugc

SEQ ID NO: 1922637 - RNA, 23 nt, Shigella flexneri 2a str. 2457T
aggagcuaauaaugagcagaaaa

SEQ ID NO: 1922638 - RNA, 16 nt, Shigella flexneri 2a str. 2457T
aggcaucuucuucauu

SEQ ID NO: 1922639 - RNA, 18 nt, Shigella flexneri 2a str. 2457T
aggcauuaaauccugaaa

SEQ ID NO: 1922640 - RNA, 15 nt, Shigella flexneri 2a str. 2457T
aggcaccuggaaauu

SEQ ID NO: 1922641 - RNA, 21 nt, Shigella flexneri 2a str. 2457T
aggcaccauuaaggcugauga

SEQ ID NO: 1922642 - RNA, 11 nt, Shigella flexneri 2a str. 2457T
aggcaccuucg

SEQ ID NO: 1922643 - RNA, 16 nt, Shigella flexneri 2a str. 2457T
aggcauucuuuuucau

SEQ ID NO: 1922644 - RNA, 20 nt, Shigella flexneri 2a str. 2457T
aggccaaaaaacagccccug

SEQ ID NO: 1922645 - RNA, 19 nt, Shigella flexneri 2a str. 2457T
aggccaaaaaacagccccu

SEQ ID NO: 1922646 - RNA, 12 nt, Shigella flexneri 2a str. 2457T
aggccaaagccg

SEQ ID NO: 1922647 - RNA, 17 nt, Shigella flexneri 2a str. 2457T
aggccaaauccuuccag

SEQ ID NO: 1922648 - RNA, 18 nt, Shigella flexneri 2a str. 2457T
aggccaaagccgccgagc

SEQ ID NO: 1922649 - RNA, 17 nt, Shigella flexneri 2a str. 2457T
aggccaacggcccauac

SEQ ID NO: 1922650 - RNA, 18 nt, Shigella flexneri 2a str. 2457T
aggccaaucagcaauaaa

SEQ ID NO: 1922651 - RNA, 16 nt, Shigella flexneri 2a str. 2457T
aggccaauccagcccu

SEQ ID NO: 1922652 - RNA, 21 nt, Shigella flexneri 2a str. 2457T
aggccaauccagcccugccag

SEQ ID NO: 1922653 - RNA, 23 nt, Shigella flexneri 2a str. 2457T
aggcccaacuguugauccaggag

SEQ ID NO: 1922654 - RNA, 14 nt, Shigella flexneri 2a str. 2457T
aggcgccauuuuca

SEQ ID NO: 1922655 - RNA, 21 nt, Shigella flexneri 2a str. 2457T
aggcgcugaaagaagcgguga

SEQ ID NO: 1922656 - RNA, 23 nt, Shigella flexneri 2a str. 2457T
aggcgcucgcgccgcauccgaca

SEQ ID NO: 1922657 - RNA, 13 nt, Shigella flexneri 2a str. 2457T
aggcgcuggcaga

SEQ ID NO: 1922658 - RNA, 14 nt, Shigella flexneri 2a str. 2457T
aggcgcuaaaagca

SEQ ID NO: 1922659 - RNA, 23 nt, Shigella flexneri 2a str. 2457T
aggcgcuaaaagcauagccccag

SEQ ID NO: 1922660 - RNA, 13 nt, Shigella flexneri 2a str. 2457T
aggcgcgcgguga

SEQ ID NO: 1922661 - RNA, 22 nt, Shigella flexneri 2a str. 2457T
aggcgcaacauauuccgcaccu

SEQ ID NO: 1922662 - RNA, 21 nt, Shigella flexneri 2a str. 2457T
aggcgcaauguugcgggggcu

SEQ ID NO: 1922663 - RNA, 21 nt, Shigella flexneri 2a str. 2457T
aggcgcauaagcguaaaaccu

SEQ ID NO: 1922664 - RNA, 15 nt, Shigella flexneri 2a str. 2457T
aggcgagcgcggcug

SEQ ID NO: 1922665 - RNA, 18 nt, Shigella flexneri 2a str. 2457T
aggcgaggggaccgcccc

SEQ ID NO: 1922666 - RNA, 21 nt, Shigella flexneri 2a str. 2457T
aggcgaccguuuucaccaguu

SEQ ID NO: 1922667 - RNA, 21 nt, Shigella flexneri 2a str. 2457T
aggcgagaucggcaggcaggu

SEQ ID NO: 1922668 - RNA, 18 nt, Shigella flexneri 2a str. 2457T
aggcgagaucggcaggca

SEQ ID NO: 1922669 - RNA, 21 nt, Shigella flexneri 2a str. 2457T
aggcgacauaucauuuugcug

SEQ ID NO: 1922670 - RNA, 17 nt, Shigella flexneri 2a str. 2457T
aggcgaccguuuucacc

SEQ ID NO: 1922671 - RNA, 20 nt, Shigella flexneri 2a str. 2457T
aggccuacauuggugccgga

SEQ ID NO: 1922672 - RNA, 19 nt, Shigella flexneri 2a str. 2457T
aggccuaacaccaucagug

SEQ ID NO: 1922673 - RNA, 19 nt, Shigella flexneri 2a str. 2457T
aggccugauuaccgcggga

SEQ ID NO: 1922674 - RNA, 23 nt, Shigella flexneri 2a str. 2457T
aggccugagaagcgcaacgcauc

SEQ ID NO: 1922675 - RNA, 17 nt, Shigella flexneri 2a str. 2457T
aggccuuaguagaagag

SEQ ID NO: 1922676 - RNA, 12 nt, Shigella flexneri 2a str. 2457T
aggccuucgccu

SEQ ID NO: 1922677 - RNA, 16 nt, Shigella flexneri 2a str. 2457T
aggccugggcgaugau

SEQ ID NO: 1922678 - RNA, 15 nt, Shigella flexneri 2a str. 2457T
aggccugcccacggg

SEQ ID NO: 1922679 - RNA, 20 nt, Shigella flexneri 2a str. 2457T
aggccugcccacgggcaggc

SEQ ID NO: 1922680 - RNA, 13 nt, Shigella flexneri 2a str. 2457T
aggcgaacaugcg

SEQ ID NO: 1922681 - RNA, 19 nt, Shigella flexneri 2a str. 2457T
aggcgaacaugcgcuggug

SEQ ID NO: 1922682 - RNA, 15 nt, Shigella flexneri 2a str. 2457T
aggccguggaucaca

SEQ ID NO: 1922683 - RNA, 22 nt, Shigella flexneri 2a str. 2457T
aggcccgcccccgggccucccc

SEQ ID NO: 1922684 - RNA, 16 nt, Shigella flexneri 2a str. 2457T
aggcccgcgugccgga

SEQ ID NO: 1922685 - RNA, 15 nt, Shigella flexneri 2a str. 2457T
aggccgacagcaggc

SEQ ID NO: 1922686 - RNA, 19 nt, Shigella flexneri 2a str. 2457T
agguaagaguuucaacauc

SEQ ID NO: 1922687 - RNA, 18 nt, Shigella flexneri 2a str. 2457T
agguaagauguucuaucu

SEQ ID NO: 1922688 - RNA, 20 nt, Shigella flexneri 2a str. 2457T
agguaaggauaaaaaagggu

SEQ ID NO: 1922689 - RNA, 23 nt, Shigella flexneri 2a str. 2457T
agguaaggcgcgagguuuuccuu

SEQ ID NO: 1922690 - RNA, 20 nt, Shigella flexneri 2a str. 2457T
aggguaguguccauaaaaca

SEQ ID NO: 1922691 - RNA, 14 nt, Shigella flexneri 2a str. 2457T
agggugaucaccag

SEQ ID NO: 1922692 - RNA, 18 nt, Shigella flexneri 2a str. 2457T
agggugcagaaucaaucu

SEQ ID NO: 1922693 - RNA, 16 nt, Shigella flexneri 2a str. 2457T
agguacgcuccagcag

SEQ ID NO: 1922694 - RNA, 23 nt, Shigella flexneri 2a str. 2457T
agguacaaccgcaaagguugcug

SEQ ID NO: 1922695 - RNA, 19 nt, Shigella flexneri 2a str. 2457T
agguacaaccgcaaagguu

SEQ ID NO: 1922696 - RNA, 20 nt, Shigella flexneri 2a str. 2457T
agguaccagcauuagcaaug

SEQ ID NO: 1922697 - RNA, 23 nt, Shigella flexneri 2a str. 2457T
agguaaucugucuuuuacaucau

SEQ ID NO: 1922698 - RNA, 12 nt, Shigella flexneri 2a str. 2457T
agguacaaagcc

SEQ ID NO: 1922699 - RNA, 18 nt, Shigella flexneri 2a str. 2457T
agguagccugaguuuaac

SEQ ID NO: 1922700 - RNA, 20 nt, Shigella flexneri 2a str. 2457T
agguagaacccuaccagcug

SEQ ID NO: 1922701 - RNA, 18 nt, Shigella flexneri 2a str. 2457T
agguaucgcgaaaaaaag

SEQ ID NO: 1922702 - RNA, 16 nt, Shigella flexneri 2a str. 2457T
aggucaucacauccca

SEQ ID NO: 1922703 - RNA, 21 nt, Shigella flexneri 2a str. 2457T
aggucgcccggauuacagcuc

SEQ ID NO: 1922704 - RNA, 18 nt, Shigella flexneri 2a str. 2457T
agguccccgagcacaugc

SEQ ID NO: 1922705 - RNA, 13 nt, Shigella flexneri 2a str. 2457T
aggucgcacugcu

SEQ ID NO: 1922706 - RNA, 19 nt, Shigella flexneri 2a str. 2457T
aggugcaaaaaaacuugau

SEQ ID NO: 1922707 - RNA, 20 nt, Shigella flexneri 2a str. 2457T
aggugcagcccguaagcaaa

SEQ ID NO: 1922708 - RNA, 14 nt, Shigella flexneri 2a str. 2457T
agggcggcaggcag

SEQ ID NO: 1922709 - RNA, 21 nt, Shigella flexneri 2a str. 2457T
agggcaauaaucucuacacca

SEQ ID NO: 1922710 - RNA, 15 nt, Shigella flexneri 2a str. 2457T
agggcaaagucagau

SEQ ID NO: 1922711 - RNA, 20 nt, Shigella flexneri 2a str. 2457T
agggcaagcgccuaaaucca

SEQ ID NO: 1922712 - RNA, 22 nt, Shigella flexneri 2a str. 2457T
aggggcggguuuuuuuauaucu

SEQ ID NO: 1922713 - RNA, 15 nt, Shigella flexneri 2a str. 2457T
aggggcguccagaug

SEQ ID NO: 1922714 - RNA, 14 nt, Shigella flexneri 2a str. 2457T
agggcuuccaccug

SEQ ID NO: 1922715 - RNA, 21 nt, Shigella flexneri 2a str. 2457T
agggcuguuuaucgugaauuc

SEQ ID NO: 1922716 - RNA, 15 nt, Shigella flexneri 2a str. 2457T
agggcugauaaacaa

SEQ ID NO: 1922717 - RNA, 22 nt, Shigella flexneri 2a str. 2457T
agggagucuugcuggaugccag

SEQ ID NO: 1922718 - RNA, 23 nt, Shigella flexneri 2a str. 2457T
agggaguaugcggucaaaagcug

SEQ ID NO: 1922719 - RNA, 14 nt, Shigella flexneri 2a str. 2457T
agggcaaacagcac

SEQ ID NO: 1922720 - RNA, 19 nt, Shigella flexneri 2a str. 2457T
agggaaugugaugaaaaaa

SEQ ID NO: 1922721 - RNA, 15 nt, Shigella flexneri 2a str. 2457T
agggaauccagcaau

SEQ ID NO: 1922722 - RNA, 17 nt, Shigella flexneri 2a str. 2457T
agggaaaugaggaauua

SEQ ID NO: 1922723 - RNA, 19 nt, Shigella flexneri 2a str. 2457T
aggcuuuuuuauugccauc

SEQ ID NO: 1922724 - RNA, 20 nt, Shigella flexneri 2a str. 2457T
aggcuuuuacgcauugcuca

SEQ ID NO: 1922725 - RNA, 14 nt, Shigella flexneri 2a str. 2457T
aggcuugcugaugc

SEQ ID NO: 1922726 - RNA, 21 nt, Shigella flexneri 2a str. 2457T
aggcgcuugucgucccaggca

SEQ ID NO: 1922727 - RNA, 16 nt, Shigella flexneri 2a str. 2457T
aguaguucauccccuc

SEQ ID NO: 1922728 - RNA, 23 nt, Shigella flexneri 2a str. 2457T
aguagugauuuuaauaaaucacg

SEQ ID NO: 1922729 - RNA, 17 nt, Shigella flexneri 2a str. 2457T
aguagguagaauauuuu

SEQ ID NO: 1922730 - RNA, 16 nt, Shigella flexneri 2a str. 2457T
aguagggcugauaaac

SEQ ID NO: 1922731 - RNA, 20 nt, Shigella flexneri 2a str. 2457T
aguagccaauaccaaaauca

SEQ ID NO: 1922732 - RNA, 14 nt, Shigella flexneri 2a str. 2457T
aguagccagacaau

SEQ ID NO: 1922733 - RNA, 16 nt, Shigella flexneri 2a str. 2457T
aguagcaaucggcuuu

SEQ ID NO: 1922734 - RNA, 16 nt, Shigella flexneri 2a str. 2457T
aguagcgucgccagca

SEQ ID NO: 1922735 - RNA, 22 nt, Shigella flexneri 2a str. 2457T
aguagccucgccgagcaguugc

SEQ ID NO: 1922736 - RNA, 17 nt, Shigella flexneri 2a str. 2457T
aguagcgcaaucaccac

SEQ ID NO: 1922737 - RNA, 22 nt, Shigella flexneri 2a str. 2457T
aguacccgaugcgcgaacugga

SEQ ID NO: 1922738 - RNA, 19 nt, Shigella flexneri 2a str. 2457T
aguaccauuuucgcuggca

SEQ ID NO: 1922739 - RNA, 21 nt, Shigella flexneri 2a str. 2457T
aguagagugguuuuucaacau

SEQ ID NO: 1922740 - RNA, 13 nt, Shigella flexneri 2a str. 2457T
aguagaucaacac

SEQ ID NO: 1922741 - RNA, 17 nt, Shigella flexneri 2a str. 2457T
aguagaucuugauuuac

SEQ ID NO: 1922742 - RNA, 10 nt, Shigella flexneri 2a str. 2457T
aguagcaaag

SEQ ID NO: 1922743 - RNA, 15 nt, Shigella flexneri 2a str. 2457T
aguauaacuacugau

SEQ ID NO: 1922744 - RNA, 16 nt, Shigella flexneri 2a str. 2457T
aguauacgccacauca

SEQ ID NO: 1922745 - RNA, 11 nt, Shigella flexneri 2a str. 2457T
aguaucuauuc

SEQ ID NO: 1922746 - RNA, 16 nt, Shigella flexneri 2a str. 2457T
aguaucuauucaucaa

SEQ ID NO: 1922747 - RNA, 21 nt, Shigella flexneri 2a str. 2457T
aguaucgcucaauauccugac

SEQ ID NO: 1922748 - RNA, 13 nt, Shigella flexneri 2a str. 2457T
aguauccacacca

SEQ ID NO: 1922749 - RNA, 14 nt, Shigella flexneri 2a str. 2457T
aguauccacaggua

SEQ ID NO: 1922750 - RNA, 18 nt, Shigella flexneri 2a str. 2457T
aguauccacacagacaau

SEQ ID NO: 1922751 - RNA, 11 nt, Shigella flexneri 2a str. 2457T
aguaucaucau

SEQ ID NO: 1922752 - RNA, 18 nt, Shigella flexneri 2a str. 2457T
aguauguaauaacaggga

SEQ ID NO: 1922753 - RNA, 15 nt, Shigella flexneri 2a str. 2457T
aguaugcgcgucaga

SEQ ID NO: 1922754 - RNA, 15 nt, Shigella flexneri 2a str. 2457T
aguaugcucagaaua

SEQ ID NO: 1922755 - RNA, 13 nt, Shigella flexneri 2a str. 2457T
aguaugaucuugc

SEQ ID NO: 1922756 - RNA, 18 nt, Shigella flexneri 2a str. 2457T
aguauggaucaaaucucg

SEQ ID NO: 1922757 - RNA, 18 nt, Shigella flexneri 2a str. 2457T
aguauugcgcaaauguuu

SEQ ID NO: 1922758 - RNA, 13 nt, Shigella flexneri 2a str. 2457T
aguauuuccagcu

SEQ ID NO: 1922759 - RNA, 16 nt, Shigella flexneri 2a str. 2457T
aguauuugacuguucu

SEQ ID NO: 1922760 - RNA, 19 nt, Shigella flexneri 2a str. 2457T
aguauuuggcggaauuucu

SEQ ID NO: 1922761 - RNA, 12 nt, Shigella flexneri 2a str. 2457T
aguauucuuuua

SEQ ID NO: 1922762 - RNA, 19 nt, Shigella flexneri 2a str. 2457T
aguaaucacaucaaagucu

SEQ ID NO: 1922763 - RNA, 13 nt, Shigella flexneri 2a str. 2457T
aguaaucacgaau

SEQ ID NO: 1922764 - RNA, 12 nt, Shigella flexneri 2a str. 2457T
aguaauaaugcc

SEQ ID NO: 1922765 - RNA, 19 nt, Shigella flexneri 2a str. 2457T
aguaaucaggcuaucuucg

SEQ ID NO: 1922766 - RNA, 17 nt, Shigella flexneri 2a str. 2457T
aguaaucgccagcaaaa

SEQ ID NO: 1922767 - RNA, 21 nt, Shigella flexneri 2a str. 2457T
aguaauccuuucucaauuaac

SEQ ID NO: 1922768 - RNA, 18 nt, Shigella flexneri 2a str. 2457T
aguaaucgccagcaaaau

SEQ ID NO: 1922769 - RNA, 18 nt, Shigella flexneri 2a str. 2457T
aguaaucgggcaacugcu

SEQ ID NO: 1922770 - RNA, 17 nt, Shigella flexneri 2a str. 2457T
aguaauugcuuuuacca

SEQ ID NO: 1922771 - RNA, 21 nt, Shigella flexneri 2a str. 2457T
aguaaucuacugcaccgcagg

SEQ ID NO: 1922772 - RNA, 19 nt, Shigella flexneri 2a str. 2457T
aguaauuuugaacggguga

SEQ ID NO: 1922773 - RNA, 18 nt, Shigella flexneri 2a str. 2457T
aguacauuguuuuccaga

SEQ ID NO: 1922774 - RNA, 13 nt, Shigella flexneri 2a str. 2457T
aguaccagcagcg

SEQ ID NO: 1922775 - RNA, 15 nt, Shigella flexneri 2a str. 2457T
aguaccaauggcaau

SEQ ID NO: 1922776 - RNA, 19 nt, Shigella flexneri 2a str. 2457T
aguaaccacggcagcaacu

SEQ ID NO: 1922777 - RNA, 23 nt, Shigella flexneri 2a str. 2457T
aguaaggcugcgagguuauccgc

SEQ ID NO: 1922778 - RNA, 17 nt, Shigella flexneri 2a str. 2457T
aguaacagucaguuauc

SEQ ID NO: 1922779 - RNA, 17 nt, Shigella flexneri 2a str. 2457T
aguaaguuacauuuuaa

SEQ ID NO: 1922780 - RNA, 14 nt, Shigella flexneri 2a str. 2457T
aguaauaaugccca

SEQ ID NO: 1922781 - RNA, 22 nt, Shigella flexneri 2a str. 2457T
aguaaauucacugccugcugau

SEQ ID NO: 1922782 - RNA, 15 nt, Shigella flexneri 2a str. 2457T
aguaacaccauccau

SEQ ID NO: 1922783 - RNA, 18 nt, Shigella flexneri 2a str. 2457T
aguaacagguuuugauua

SEQ ID NO: 1922784 - RNA, 19 nt, Shigella flexneri 2a str. 2457T
aguaaagcgcgucaccacc

SEQ ID NO: 1922785 - RNA, 17 nt, Shigella flexneri 2a str. 2457T
agguugaccuggaagga

SEQ ID NO: 1922786 - RNA, 15 nt, Shigella flexneri 2a str. 2457T
agguugacgcugcaa

SEQ ID NO: 1922787 - RNA, 17 nt, Shigella flexneri 2a str. 2457T
aggugcuuuaacgaaag

SEQ ID NO: 1922788 - RNA, 17 nt, Shigella flexneri 2a str. 2457T
agguuguuaaccaccag

SEQ ID NO: 1922789 - RNA, 23 nt, Shigella flexneri 2a str. 2457T
agguuguuaaccaccaguaaauu

SEQ ID NO: 1922790 - RNA, 17 nt, Shigella flexneri 2a str. 2457T
agguuguagauuuugca

SEQ ID NO: 1922791 - RNA, 20 nt, Shigella flexneri 2a str. 2457T
agguuguagauuuugcagau

SEQ ID NO: 1922792 - RNA, 16 nt, Shigella flexneri 2a str. 2457T
agguuggaucaacagg

SEQ ID NO: 1922793 - RNA, 20 nt, Shigella flexneri 2a str. 2457T
aguaaacgaccaugacacuu

SEQ ID NO: 1922794 - RNA, 19 nt, Shigella flexneri 2a str. 2457T
agguuucuuuuuaaagaga

SEQ ID NO: 1922795 - RNA, 11 nt, Shigella flexneri 2a str. 2457T
agguuucugcc

SEQ ID NO: 1922796 - RNA, 17 nt, Shigella flexneri 2a str. 2457T
agguuuaaccaucaggc

SEQ ID NO: 1922797 - RNA, 14 nt, Shigella flexneri 2a str. 2457T
agguuuaaacagag

SEQ ID NO: 1922798 - RNA, 13 nt, Shigella flexneri 2a str. 2457T
agguuuccggguc

SEQ ID NO: 1922799 - RNA, 21 nt, Shigella flexneri 2a str. 2457T
agguuucgccuuuugauacuc

SEQ ID NO: 1922800 - RNA, 18 nt, Shigella flexneri 2a str. 2457T
agguuucacguaccagau

SEQ ID NO: 1922801 - RNA, 20 nt, Shigella flexneri 2a str. 2457T
agguuucacguaccagaugc

SEQ ID NO: 1922802 - RNA, 15 nt, Shigella flexneri 2a str. 2457T
agcuaccacgccgau

SEQ ID NO: 1922803 - RNA, 21 nt, Shigella flexneri 2a str. 2457T
agcuaaugcaaaucacgcugc

SEQ ID NO: 1922804 - RNA, 22 nt, Shigella flexneri 2a str. 2457T
agcuaauggcugcgggcgacca

SEQ ID NO: 1922805 - RNA, 23 nt, Shigella flexneri 2a str. 2457T
agcuaauuuuuguuguuuaaaug

SEQ ID NO: 1922806 - RNA, 20 nt, Shigella flexneri 2a str. 2457T
agcuaaucaucaucagugcu

SEQ ID NO: 1922807 - RNA, 14 nt, Shigella flexneri 2a str. 2457T
agcuaaucaucauc

SEQ ID NO: 1922808 - RNA, 21 nt, Shigella flexneri 2a str. 2457T
agcuaacgaaaauggccugau

SEQ ID NO: 1922809 - RNA, 14 nt, Shigella flexneri 2a str. 2457T
agcguugcgccugu

SEQ ID NO: 1922810 - RNA, 15 nt, Shigella flexneri 2a str. 2457T
agcguuguaacaauc

SEQ ID NO: 1922811 - RNA, 13 nt, Shigella flexneri 2a str. 2457T
agcguuucaagug

SEQ ID NO: 1922812 - RNA, 20 nt, Shigella flexneri 2a str. 2457T
agcuauauuuugccggacgc

SEQ ID NO: 1922813 - RNA, 12 nt, Shigella flexneri 2a str. 2457T
agcucagugacc

SEQ ID NO: 1922814 - RNA, 15 nt, Shigella flexneri 2a str. 2457T
agcucagugaccgaa

SEQ ID NO: 1922815 - RNA, 19 nt, Shigella flexneri 2a str. 2457T
agcucagcuggauagagua

SEQ ID NO: 1922816 - RNA, 22 nt, Shigella flexneri 2a str. 2457T
agcucacaaauacgcuuuuucc

SEQ ID NO: 1922817 - RNA, 14 nt, Shigella flexneri 2a str. 2457T
agcucauuaaaaau

SEQ ID NO: 1922818 - RNA, 16 nt, Shigella flexneri 2a str. 2457T
agcucauuaaaaauau

SEQ ID NO: 1922819 - RNA, 19 nt, Shigella flexneri 2a str. 2457T
agcucaugggcuuucauca

SEQ ID NO: 1922820 - RNA, 18 nt, Shigella flexneri 2a str. 2457T
agcucaucguuacgccca

SEQ ID NO: 1922821 - RNA, 15 nt, Shigella flexneri 2a str. 2457T
agcucaucuaaugca

SEQ ID NO: 1922822 - RNA, 23 nt, Shigella flexneri 2a str. 2457T
agcucaguugguuagagcacauc

SEQ ID NO: 1922823 - RNA, 16 nt, Shigella flexneri 2a str. 2457T
agcucauauuugcugg

SEQ ID NO: 1922824 - RNA, 22 nt, Shigella flexneri 2a str. 2457T
agcucaucaagcuguucuuccc

SEQ ID NO: 1922825 - RNA, 16 nt, Shigella flexneri 2a str. 2457T
agcggcugccagcaug

SEQ ID NO: 1922826 - RNA, 23 nt, Shigella flexneri 2a str. 2457T
agcggcguuuuguagagcagcac

SEQ ID NO: 1922827 - RNA, 16 nt, Shigella flexneri 2a str. 2457T
agcggcuuccaccgcc

SEQ ID NO: 1922828 - RNA, 16 nt, Shigella flexneri 2a str. 2457T
agcgggcgcgcaggcg

SEQ ID NO: 1922829 - RNA, 13 nt, Shigella flexneri 2a str. 2457T
agcgguugcaggc

SEQ ID NO: 1922830 - RNA, 16 nt, Shigella flexneri 2a str. 2457T
agcggcgggcuuuaau

SEQ ID NO: 1922831 - RNA, 19 nt, Shigella flexneri 2a str. 2457T
agcggcggucuucucaccg

SEQ ID NO: 1922832 - RNA, 21 nt, Shigella flexneri 2a str. 2457T
agcgcuaauacgaugcaaccg

SEQ ID NO: 1922833 - RNA, 22 nt, Shigella flexneri 2a str. 2457T
agcgcguucuguucaaaugcgc

SEQ ID NO: 1922834 - RNA, 13 nt, Shigella flexneri 2a str. 2457T
agcgcguucuguu

SEQ ID NO: 1922835 - RNA, 19 nt, Shigella flexneri 2a str. 2457T
agcgucccaguaacguccc

SEQ ID NO: 1922836 - RNA, 15 nt, Shigella flexneri 2a str. 2457T
agcguccggcugcca

SEQ ID NO: 1922837 - RNA, 20 nt, Shigella flexneri 2a str. 2457T
agcguccggcugccagccag

SEQ ID NO: 1922838 - RNA, 12 nt, Shigella flexneri 2a str. 2457T
agcgugagggaa

SEQ ID NO: 1922839 - RNA, 14 nt, Shigella flexneri 2a str. 2457T
agcgguuuugccag

SEQ ID NO: 1922840 - RNA, 22 nt, Shigella flexneri 2a str. 2457T
agcguaaaggcggcagaacaga

SEQ ID NO: 1922841 - RNA, 15 nt, Shigella flexneri 2a str. 2457T
agcgucccaguaacg

SEQ ID NO: 1922842 - RNA, 21 nt, Shigella flexneri 2a str. 2457T
agcguccacagccaacacauu

SEQ ID NO: 1922843 - RNA, 16 nt, Shigella flexneri 2a str. 2457T
agcguuacuucaccuu

SEQ ID NO: 1922844 - RNA, 19 nt, Shigella flexneri 2a str. 2457T
agcguuccacgugcggccg

SEQ ID NO: 1922845 - RNA, 23 nt, Shigella flexneri 2a str. 2457T
agcguucagugaucgccugcaug

SEQ ID NO: 1922846 - RNA, 19 nt, Shigella flexneri 2a str. 2457T
agcguguaaaaagauaaac

SEQ ID NO: 1922847 - RNA, 22 nt, Shigella flexneri 2a str. 2457T
agcguguaaaaagauaaacggc

SEQ ID NO: 1922848 - RNA, 14 nt, Shigella flexneri 2a str. 2457T
agcguguugcggag

SEQ ID NO: 1922849 - RNA, 14 nt, Shigella flexneri 2a str. 2457T
agcgugcucucaaa

SEQ ID NO: 1922850 - RNA, 21 nt, Shigella flexneri 2a str. 2457T
agcgugauuguggcaaucaua

SEQ ID NO: 1922851 - RNA, 20 nt, Shigella flexneri 2a str. 2457T
agcgccgcaacuaccagcag

SEQ ID NO: 1922852 - RNA, 18 nt, Shigella flexneri 2a str. 2457T
agcgccgacagcagcccu

SEQ ID NO: 1922853 - RNA, 23 nt, Shigella flexneri 2a str. 2457T
agcgccgccagaaucaccucuuu

SEQ ID NO: 1922854 - RNA, 20 nt, Shigella flexneri 2a str. 2457T
agcgccgccagaaucaccuc

SEQ ID NO: 1922855 - RNA, 21 nt, Shigella flexneri 2a str. 2457T
agcgccugcgcggcaaugcgc

SEQ ID NO: 1922856 - RNA, 23 nt, Shigella flexneri 2a str. 2457T
agcgccucggggccacagguaua

SEQ ID NO: 1922857 - RNA, 18 nt, Shigella flexneri 2a str. 2457T
agcgccucuuccauaauc

SEQ ID NO: 1922858 - RNA, 20 nt, Shigella flexneri 2a str. 2457T
agcgccuucuacagcuucac

SEQ ID NO: 1922859 - RNA, 15 nt, Shigella flexneri 2a str. 2457T
agcgcggcgcaggca

SEQ ID NO: 1922860 - RNA, 17 nt, Shigella flexneri 2a str. 2457T
agcgcggcgcaggcaau

SEQ ID NO: 1922861 - RNA, 20 nt, Shigella flexneri 2a str. 2457T
agcgcgcgaauauggcggcg

SEQ ID NO: 1922862 - RNA, 19 nt, Shigella flexneri 2a str. 2457T
agcgccagggcaugguacc

SEQ ID NO: 1922863 - RNA, 16 nt, Shigella flexneri 2a str. 2457T
agcgcccugcaauguc

SEQ ID NO: 1922864 - RNA, 14 nt, Shigella flexneri 2a str. 2457T
agcgccagaaggga

SEQ ID NO: 1922865 - RNA, 16 nt, Shigella flexneri 2a str. 2457T
agcgccagaagggaca

SEQ ID NO: 1922866 - RNA, 17 nt, Shigella flexneri 2a str. 2457T
agcgccagacaaaccac

SEQ ID NO: 1922867 - RNA, 18 nt, Shigella flexneri 2a str. 2457T
agcgccagacacuggaaa

SEQ ID NO: 1922868 - RNA, 23 nt, Shigella flexneri 2a str. 2457T
agcgccagauaugaucgaaaaug

SEQ ID NO: 1922869 - RNA, 20 nt, Shigella flexneri 2a str. 2457T
agcgccagcaagagcaaaua

SEQ ID NO: 1922870 - RNA, 12 nt, Shigella flexneri 2a str. 2457T
agcgccagcaug

SEQ ID NO: 1922871 - RNA, 17 nt, Shigella flexneri 2a str. 2457T
agcgccagccagauggg

SEQ ID NO: 1922872 - RNA, 19 nt, Shigella flexneri 2a str. 2457T
agcgcaucaggcaaucucu

SEQ ID NO: 1922873 - RNA, 16 nt, Shigella flexneri 2a str. 2457T
agcgcaucaggcaaug

SEQ ID NO: 1922874 - RNA, 21 nt, Shigella flexneri 2a str. 2457T
agcgcauccggcaccagcgca

SEQ ID NO: 1922875 - RNA, 14 nt, Shigella flexneri 2a str. 2457T
agcgcaaucaccac

SEQ ID NO: 1922876 - RNA, 22 nt, Shigella flexneri 2a str. 2457T
agcgcacaacguuccuucguuc

SEQ ID NO: 1922877 - RNA, 14 nt, Shigella flexneri 2a str. 2457T
agcgcaccaauuca

SEQ ID NO: 1922878 - RNA, 15 nt, Shigella flexneri 2a str. 2457T
agcgcaaauggugac

SEQ ID NO: 1922879 - RNA, 17 nt, Shigella flexneri 2a str. 2457T
agcgcaagggccgcagc

SEQ ID NO: 1922880 - RNA, 18 nt, Shigella flexneri 2a str. 2457T
agcgcaagggccgcagcu

SEQ ID NO: 1922881 - RNA, 19 nt, Shigella flexneri 2a str. 2457T
agcgcaaaggccagcaauc

SEQ ID NO: 1922882 - RNA, 17 nt, Shigella flexneri 2a str. 2457T
agcgcaaaggccagcaa

SEQ ID NO: 1922883 - RNA, 20 nt, Shigella flexneri 2a str. 2457T
agcgcaaaauaccagcaauu

SEQ ID NO: 1922884 - RNA, 21 nt, Shigella flexneri 2a str. 2457T
agcgauucccguuuauggucg

SEQ ID NO: 1922885 - RNA, 15 nt, Shigella flexneri 2a str. 2457T
agcgauuccaguucg

SEQ ID NO: 1922886 - RNA, 18 nt, Shigella flexneri 2a str. 2457T
agcgauuaccauuucacc

SEQ ID NO: 1922887 - RNA, 21 nt, Shigella flexneri 2a str. 2457T
agcgagguauuuucugaaacg

SEQ ID NO: 1922888 - RNA, 16 nt, Shigella flexneri 2a str. 2457T
agcgagggagaaaacc

SEQ ID NO: 1922889 - RNA, 16 nt, Shigella flexneri 2a str. 2457T
agcgaauccagcaugc

SEQ ID NO: 1922890 - RNA, 18 nt, Shigella flexneri 2a str. 2457T
agcgaaugaggcagcaag

SEQ ID NO: 1922891 - RNA, 13 nt, Shigella flexneri 2a str. 2457T
agcgacguaaaaa

SEQ ID NO: 1922892 - RNA, 21 nt, Shigella flexneri 2a str. 2457T
agcgacgggcgacaaacgcug

SEQ ID NO: 1922893 - RNA, 23 nt, Shigella flexneri 2a str. 2457T
agcgacugcgggcgcaagggcug

SEQ ID NO: 1922894 - RNA, 16 nt, Shigella flexneri 2a str. 2457T
agcgacucucugagcc

SEQ ID NO: 1922895 - RNA, 18 nt, Shigella flexneri 2a str. 2457T
agcgacuuugccuggcgg

SEQ ID NO: 1922896 - RNA, 21 nt, Shigella flexneri 2a str. 2457T
agcgagcuggcgcugauaaau

SEQ ID NO: 1922897 - RNA, 16 nt, Shigella flexneri 2a str. 2457T
agccgcaucaccgcac

SEQ ID NO: 1922898 - RNA, 19 nt, Shigella flexneri 2a str. 2457T
agccgcaucaccgcaccag

SEQ ID NO: 1922899 - RNA, 10 nt, Shigella flexneri 2a str. 2457T
agccugaagg

SEQ ID NO: 1922900 - RNA, 14 nt, Shigella flexneri 2a str. 2457T
agccgccagcucuu

SEQ ID NO: 1922901 - RNA, 22 nt, Shigella flexneri 2a str. 2457T
agccugaacuaaagccuuuugc

SEQ ID NO: 1922902 - RNA, 18 nt, Shigella flexneri 2a str. 2457T
agccugauacaggaaggc

SEQ ID NO: 1922903 - RNA, 14 nt, Shigella flexneri 2a str. 2457T
agccgcauuuuuuc

SEQ ID NO: 1922904 - RNA, 19 nt, Shigella flexneri 2a str. 2457T
agccugccagaggagccau

SEQ ID NO: 1922905 - RNA, 19 nt, Shigella flexneri 2a str. 2457T
agccugcagugaaauuaaa

SEQ ID NO: 1922906 - RNA, 19 nt, Shigella flexneri 2a str. 2457T
agccugccaucuggcaggc

SEQ ID NO: 1922907 - RNA, 22 nt, Shigella flexneri 2a str. 2457T
agccugccauuggcaggcucug

SEQ ID NO: 1922908 - RNA, 21 nt, Shigella flexneri 2a str. 2457T
agccuguuacauaugcgcugg

SEQ ID NO: 1922909 - RNA, 19 nt, Shigella flexneri 2a str. 2457T
agccugugucaggccggca

SEQ ID NO: 1922910 - RNA, 17 nt, Shigella flexneri 2a str. 2457T
agccuguaccacaaccu

SEQ ID NO: 1922911 - RNA, 20 nt, Shigella flexneri 2a str. 2457T
agccuguaccacaaccugca

SEQ ID NO: 1922912 - RNA, 15 nt, Shigella flexneri 2a str. 2457T
agccuguaccacaac

SEQ ID NO: 1922913 - RNA, 15 nt, Shigella flexneri 2a str. 2457T
agcgaauccagcaug

SEQ ID NO: 1922914 - RNA, 18 nt, Shigella flexneri 2a str. 2457T
agcgaauaaaaaaagaaa

SEQ ID NO: 1922915 - RNA, 23 nt, Shigella flexneri 2a str. 2457T
agcgaaagucaggauagauagau

SEQ ID NO: 1922916 - RNA, 15 nt, Shigella flexneri 2a str. 2457T
agccuuuuucagccg

SEQ ID NO: 1922917 - RNA, 18 nt, Shigella flexneri 2a str. 2457T
agccuuuuucagccgcaa

SEQ ID NO: 1922918 - RNA, 18 nt, Shigella flexneri 2a str. 2457T
agccuuuuuuauuuuuua

SEQ ID NO: 1922919 - RNA, 15 nt, Shigella flexneri 2a str. 2457T
agcauaccgccgagg

SEQ ID NO: 1922920 - RNA, 18 nt, Shigella flexneri 2a str. 2457T
agcaguucaccgccgagg

SEQ ID NO: 1922921 - RNA, 20 nt, Shigella flexneri 2a str. 2457T
agcauaccggacgacggcau

SEQ ID NO: 1922922 - RNA, 20 nt, Shigella flexneri 2a str. 2457T
agcauaccgccgaggaacau

SEQ ID NO: 1922923 - RNA, 20 nt, Shigella flexneri 2a str. 2457T
agcaucaaugaccugacuuc

SEQ ID NO: 1922924 - RNA, 21 nt, Shigella flexneri 2a str. 2457T
agcauagcucgcuucaucugc

SEQ ID NO: 1922925 - RNA, 14 nt, Shigella flexneri 2a str. 2457T
agcaucaugaauau

SEQ ID NO: 1922926 - RNA, 21 nt, Shigella flexneri 2a str. 2457T
agcaucgcaacaugcuggccu

SEQ ID NO: 1922927 - RNA, 19 nt, Shigella flexneri 2a str. 2457T
agcaucgcauccggcacuu

SEQ ID NO: 1922928 - RNA, 22 nt, Shigella flexneri 2a str. 2457T
agcaucacauaaucgaaaacau

SEQ ID NO: 1922929 - RNA, 19 nt, Shigella flexneri 2a str. 2457T
agcaucagcccaaagcaga

SEQ ID NO: 1922930 - RNA, 16 nt, Shigella flexneri 2a str. 2457T
agcaucagcgccacca

SEQ ID NO: 1922931 - RNA, 16 nt, Shigella flexneri 2a str. 2457T
agcaucgucaucagcu

SEQ ID NO: 1922932 - RNA, 20 nt, Shigella flexneri 2a str. 2457T
agcaucgucaucagcuccau

SEQ ID NO: 1922933 - RNA, 18 nt, Shigella flexneri 2a str. 2457T
agcaugaaaugaaaauca

SEQ ID NO: 1922934 - RNA, 13 nt, Shigella flexneri 2a str. 2457T
agcaugaaaugaa

SEQ ID NO: 1922935 - RNA, 19 nt, Shigella flexneri 2a str. 2457T
agcagcggcagaucaaauu

SEQ ID NO: 1922936 - RNA, 20 nt, Shigella flexneri 2a str. 2457T
agcagcggucggcuucccug

SEQ ID NO: 1922937 - RNA, 21 nt, Shigella flexneri 2a str. 2457T
agcagcguaccucuaucuuga

SEQ ID NO: 1922938 - RNA, 16 nt, Shigella flexneri 2a str. 2457T
agcagcguuaaugaua

SEQ ID NO: 1922939 - RNA, 14 nt, Shigella flexneri 2a str. 2457T
agcaggauggcugg

SEQ ID NO: 1922940 - RNA, 21 nt, Shigella flexneri 2a str. 2457T
agcaggauggcuggccgugca

SEQ ID NO: 1922941 - RNA, 17 nt, Shigella flexneri 2a str. 2457T
agcaggccgucgcgcag

SEQ ID NO: 1922942 - RNA, 23 nt, Shigella flexneri 2a str. 2457T
agcaguacgccgagaauaaaaca

SEQ ID NO: 1922943 - RNA, 13 nt, Shigella flexneri 2a str. 2457T
agcaguacagccg

SEQ ID NO: 1922944 - RNA, 19 nt, Shigella flexneri 2a str. 2457T
agcaguaauugcagcagcu

SEQ ID NO: 1922945 - RNA, 20 nt, Shigella flexneri 2a str. 2457T
agcaguaauugcagcagcug

SEQ ID NO: 1922946 - RNA, 19 nt, Shigella flexneri 2a str. 2457T
agcaguaaggucaucaauc

SEQ ID NO: 1922947 - RNA, 20 nt, Shigella flexneri 2a str. 2457T
agcaggcguuaaaacagguc

SEQ ID NO: 1922948 - RNA, 13 nt, Shigella flexneri 2a str. 2457T
agcaggcuggcua

SEQ ID NO: 1922949 - RNA, 13 nt, Shigella flexneri 2a str. 2457T
agcagcagagcaa

SEQ ID NO: 1922950 - RNA, 20 nt, Shigella flexneri 2a str. 2457T
agcagcagagcaaucaccag

SEQ ID NO: 1922951 - RNA, 21 nt, Shigella flexneri 2a str. 2457T
agcagcagcgguugagagaag

SEQ ID NO: 1922952 - RNA, 20 nt, Shigella flexneri 2a str. 2457T
agcagcagcgccaacgguga

SEQ ID NO: 1922953 - RNA, 22 nt, Shigella flexneri 2a str. 2457T
agcagcaaugcaggcaccugcc

SEQ ID NO: 1922954 - RNA, 21 nt, Shigella flexneri 2a str. 2457T
agcagcaaugcaggcaccugc

SEQ ID NO: 1922955 - RNA, 17 nt, Shigella flexneri 2a str. 2457T
agcagcaccaccgcccg

SEQ ID NO: 1922956 - RNA, 18 nt, Shigella flexneri 2a str. 2457T
agcagcaccaccgcccgu

SEQ ID NO: 1922957 - RNA, 16 nt, Shigella flexneri 2a str. 2457T
agcagccaucugauga

SEQ ID NO: 1922958 - RNA, 17 nt, Shigella flexneri 2a str. 2457T
agcagccacaccaauca

SEQ ID NO: 1922959 - RNA, 13 nt, Shigella flexneri 2a str. 2457T
agcagaaagcgac

SEQ ID NO: 1922960 - RNA, 13 nt, Shigella flexneri 2a str. 2457T
agcagaaagcgga

SEQ ID NO: 1922961 - RNA, 13 nt, Shigella flexneri 2a str. 2457T
agcagaacaucag

SEQ ID NO: 1922962 - RNA, 20 nt, Shigella flexneri 2a str. 2457T
agcacuugcaggaacagugc

SEQ ID NO: 1922963 - RNA, 14 nt, Shigella flexneri 2a str. 2457T
agcacuugcaggaa

SEQ ID NO: 1922964 - RNA, 15 nt, Shigella flexneri 2a str. 2457T
agcacugcaucaaug

SEQ ID NO: 1922965 - RNA, 16 nt, Shigella flexneri 2a str. 2457T
agcagauaucccgcca

SEQ ID NO: 1922966 - RNA, 19 nt, Shigella flexneri 2a str. 2457T
agcagauaucccgccagca

SEQ ID NO: 1922967 - RNA, 14 nt, Shigella flexneri 2a str. 2457T
agcagaguugcuga

SEQ ID NO: 1922968 - RNA, 20 nt, Shigella flexneri 2a str. 2457T
agcagauaucccgccagcac

SEQ ID NO: 1922969 - RNA, 17 nt, Shigella flexneri 2a str. 2457T
agcagauguagcucacc

SEQ ID NO: 1922970 - RNA, 18 nt, Shigella flexneri 2a str. 2457T
agcagauguagcucaccu

SEQ ID NO: 1922971 - RNA, 13 nt, Shigella flexneri 2a str. 2457T
agcagagagacaa

SEQ ID NO: 1922972 - RNA, 18 nt, Shigella flexneri 2a str. 2457T
agcagauacggcgcaucu

SEQ ID NO: 1922973 - RNA, 21 nt, Shigella flexneri 2a str. 2457T
agcacuauccgacaucccgcc

SEQ ID NO: 1922974 - RNA, 15 nt, Shigella flexneri 2a str. 2457T
agcacuaugacugcc

SEQ ID NO: 1922975 - RNA, 18 nt, Shigella flexneri 2a str. 2457T
agcacgucuuccauugcc

SEQ ID NO: 1922976 - RNA, 21 nt, Shigella flexneri 2a str. 2457T
agcacguugggcgcuggcggc

SEQ ID NO: 1922977 - RNA, 14 nt, Shigella flexneri 2a str. 2457T
agcacguugaacug

SEQ ID NO: 1922978 - RNA, 14 nt, Shigella flexneri 2a str. 2457T
agcacgaccgccau

SEQ ID NO: 1922979 - RNA, 16 nt, Shigella flexneri 2a str. 2457T
agcacgaaugucguuu

SEQ ID NO: 1922980 - RNA, 16 nt, Shigella flexneri 2a str. 2457T
agcaaccaaugccacc

SEQ ID NO: 1922981 - RNA, 13 nt, Shigella flexneri 2a str. 2457T
agcaacaguaaua

SEQ ID NO: 1922982 - RNA, 17 nt, Shigella flexneri 2a str. 2457T
agcaacaggccaguucg

SEQ ID NO: 1922983 - RNA, 15 nt, Shigella flexneri 2a str. 2457T
agcaaccaacgccag

SEQ ID NO: 1922984 - RNA, 22 nt, Shigella flexneri 2a str. 2457T
agcaaccucgcccauuuuucau

SEQ ID NO: 1922985 - RNA, 16 nt, Shigella flexneri 2a str. 2457T
agcaaccugcacguua

SEQ ID NO: 1922986 - RNA, 21 nt, Shigella flexneri 2a str. 2457T
agcaaccugcacguuaucaga

SEQ ID NO: 1922987 - RNA, 17 nt, Shigella flexneri 2a str. 2457T
agcaaccggugucauca

SEQ ID NO: 1922988 - RNA, 17 nt, Shigella flexneri 2a str. 2457T
agcaaccgguaaagaag

SEQ ID NO: 1922989 - RNA, 17 nt, Shigella flexneri 2a str. 2457T
agcaacgaaacgccggu

SEQ ID NO: 1922990 - RNA, 17 nt, Shigella flexneri 2a str. 2457T
agcaccugcgcaggcau

SEQ ID NO: 1922991 - RNA, 17 nt, Shigella flexneri 2a str. 2457T
agccaguucgagaaaaa

SEQ ID NO: 1922992 - RNA, 13 nt, Shigella flexneri 2a str. 2457T
agccauaaagaaa

SEQ ID NO: 1922993 - RNA, 16 nt, Shigella flexneri 2a str. 2457T
agccaguuuuucuuuu

SEQ ID NO: 1922994 - RNA, 13 nt, Shigella flexneri 2a str. 2457T
agccagcuggcag

SEQ ID NO: 1922995 - RNA, 23 nt, Shigella flexneri 2a str. 2457T
agccaggagccaacacuuucacu

SEQ ID NO: 1922996 - RNA, 15 nt, Shigella flexneri 2a str. 2457T
agccaggcacgccgc

SEQ ID NO: 1922997 - RNA, 22 nt, Shigella flexneri 2a str. 2457T
agccauaaucacucuuccccgc

SEQ ID NO: 1922998 - RNA, 24 nt, Shigella flexneri 2a str. 2457T
agccauaaucacucuuccccgcuu

SEQ ID NO: 1922999 - RNA, 12 nt, Shigella flexneri 2a str. 2457T
agccauucccuc

SEQ ID NO: 1923000 - RNA, 15 nt, Shigella flexneri 2a str. 2457T
agccauuaaacacca

SEQ ID NO: 1923001 - RNA, 17 nt, Shigella flexneri 2a str. 2457T
agccauuaaacaccagu

SEQ ID NO: 1923002 - RNA, 21 nt, Shigella flexneri 2a str. 2457T
agccauuaaacaccaguaccu

SEQ ID NO: 1923003 - RNA, 19 nt, Shigella flexneri 2a str. 2457T
agccaugcggcaucuucuc

SEQ ID NO: 1923004 - RNA, 23 nt, Shigella flexneri 2a str. 2457T
agccaugcggcaucuucuccacg

SEQ ID NO: 1923005 - RNA, 13 nt, Shigella flexneri 2a str. 2457T
agcccaauaauca

SEQ ID NO: 1923006 - RNA, 18 nt, Shigella flexneri 2a str. 2457T
agcccaaagcagaguugc

SEQ ID NO: 1923007 - RNA, 20 nt, Shigella flexneri 2a str. 2457T
agcccaaagcagaguugcug

SEQ ID NO: 1923008 - RNA, 20 nt, Shigella flexneri 2a str. 2457T
agccaacagcagccacacca

SEQ ID NO: 1923009 - RNA, 13 nt, Shigella flexneri 2a str. 2457T
agccaacagcagc

SEQ ID NO: 1923010 - RNA, 19 nt, Shigella flexneri 2a str. 2457T
agccaacagcagccacacc

SEQ ID NO: 1923011 - RNA, 23 nt, Shigella flexneri 2a str. 2457T
agccaacguuucuggaaguaauc

SEQ ID NO: 1923012 - RNA, 12 nt, Shigella flexneri 2a str. 2457T
agccaagcaugu

SEQ ID NO: 1923013 - RNA, 22 nt, Shigella flexneri 2a str. 2457T
agccaauaaaugccaccacacc

SEQ ID NO: 1923014 - RNA, 13 nt, Shigella flexneri 2a str. 2457T
agccaccaucccg

SEQ ID NO: 1923015 - RNA, 20 nt, Shigella flexneri 2a str. 2457T
agccaagcgccgccucagcc

SEQ ID NO: 1923016 - RNA, 12 nt, Shigella flexneri 2a str. 2457T
agcaugcuggcu

SEQ ID NO: 1923017 - RNA, 16 nt, Shigella flexneri 2a str. 2457T
agccagacgccagcca

SEQ ID NO: 1923018 - RNA, 15 nt, Shigella flexneri 2a str. 2457T
agccagcaccaggcu

SEQ ID NO: 1923019 - RNA, 19 nt, Shigella flexneri 2a str. 2457T
agccagaccacccguaauc

SEQ ID NO: 1923020 - RNA, 18 nt, Shigella flexneri 2a str. 2457T
agccagaacagcggugca

SEQ ID NO: 1923021 - RNA, 13 nt, Shigella flexneri 2a str. 2457T
agccaccgccagc

SEQ ID NO: 1923022 - RNA, 13 nt, Shigella flexneri 2a str. 2457T
agccaccucaacg

SEQ ID NO: 1923023 - RNA, 21 nt, Shigella flexneri 2a str. 2457T
agccccgcuuuuuucagcgcc

SEQ ID NO: 1923024 - RNA, 12 nt, Shigella flexneri 2a str. 2457T
agccccuccaca

SEQ ID NO: 1923025 - RNA, 18 nt, Shigella flexneri 2a str. 2457T
agccccggaauucucaaa

SEQ ID NO: 1923026 - RNA, 20 nt, Shigella flexneri 2a str. 2457T
agccccggaauucucaaacg

SEQ ID NO: 1923027 - RNA, 13 nt, Shigella flexneri 2a str. 2457T
agccccguagcca

SEQ ID NO: 1923028 - RNA, 16 nt, Shigella flexneri 2a str. 2457T
agccccaccagcaaau

SEQ ID NO: 1923029 - RNA, 14 nt, Shigella flexneri 2a str. 2457T
agccccaccagcaa

SEQ ID NO: 1923030 - RNA, 12 nt, Shigella flexneri 2a str. 2457T
agccccaguucc

SEQ ID NO: 1923031 - RNA, 20 nt, Shigella flexneri 2a str. 2457T
agccccagcgucagcaucau

SEQ ID NO: 1923032 - RNA, 17 nt, Shigella flexneri 2a str. 2457T
agcccaguucagcggcu

SEQ ID NO: 1923033 - RNA, 22 nt, Shigella flexneri 2a str. 2457T
agcccaugaaucagcaaggaaa

SEQ ID NO: 1923034 - RNA, 23 nt, Shigella flexneri 2a str. 2457T
agcccagacaaaugaacaccaaa

SEQ ID NO: 1923035 - RNA, 14 nt, Shigella flexneri 2a str. 2457T
agcccagaugccgg

SEQ ID NO: 1923036 - RNA, 23 nt, Shigella flexneri 2a str. 2457T
agcccacauccaugugggcugcc

SEQ ID NO: 1923037 - RNA, 13 nt, Shigella flexneri 2a str. 2457T
agcccagccccca

SEQ ID NO: 1923038 - RNA, 16 nt, Shigella flexneri 2a str. 2457T
agccgaguagaucaac

SEQ ID NO: 1923039 - RNA, 13 nt, Shigella flexneri 2a str. 2457T
agccgcacgcugg

SEQ ID NO: 1923040 - RNA, 16 nt, Shigella flexneri 2a str. 2457T
agccgcagccaucagc

SEQ ID NO: 1923041 - RNA, 14 nt, Shigella flexneri 2a str. 2457T
agccgcagccauca

SEQ ID NO: 1923042 - RNA, 17 nt, Shigella flexneri 2a str. 2457T
agcccuggcucugcacu

SEQ ID NO: 1923043 - RNA, 12 nt, Shigella flexneri 2a str. 2457T
agcccugccgga

SEQ ID NO: 1923044 - RNA, 18 nt, Shigella flexneri 2a str. 2457T
agcccuugcuucgccagu

SEQ ID NO: 1923045 - RNA, 11 nt, Shigella flexneri 2a str. 2457T
agcccuucuuu

SEQ ID NO: 1923046 - RNA, 22 nt, Shigella flexneri 2a str. 2457T
agcccgcgcgaugagccgcugg

SEQ ID NO: 1923047 - RNA, 18 nt, Shigella flexneri 2a str. 2457T
agcccgugcauaggcggc

SEQ ID NO: 1923048 - RNA, 17 nt, Shigella flexneri 2a str. 2457T
agcccguaacucacuga

SEQ ID NO: 1923049 - RNA, 16 nt, Shigella flexneri 2a str. 2457T
agcccgguagcaugaa

SEQ ID NO: 1923050 - RNA, 15 nt, Shigella flexneri 2a str. 2457T
agcccgccaucgccc

SEQ ID NO: 1923051 - RNA, 19 nt, Shigella flexneri 2a str. 2457T
agcccgccaucgcccaucc

SEQ ID NO: 1923052 - RNA, 20 nt, Shigella flexneri 2a str. 2457T
agcccgauggcaucaccauc

SEQ ID NO: 1923053 - RNA, 17 nt, Shigella flexneri 2a str. 2457T
agcccgauggcaucacc

SEQ ID NO: 1923054 - RNA, 24 nt, Shigella flexneri 2a str. 2457T
agcccgaugauaaauccaucgggc

SEQ ID NO: 1923055 - RNA, 19 nt, Shigella flexneri 2a str. 2457T
agcaaaaucguaagcagga

SEQ ID NO: 1923056 - RNA, 21 nt, Shigella flexneri 2a str. 2457T
agcaaagcggucuucugugau

SEQ ID NO: 1923057 - RNA, 22 nt, Shigella flexneri 2a str. 2457T
agcaaacuugaacuuaucauca

SEQ ID NO: 1923058 - RNA, 14 nt, Shigella flexneri 2a str. 2457T
agcaaacgaaagca

SEQ ID NO: 1923059 - RNA, 15 nt, Shigella flexneri 2a str. 2457T
agcaaacgauucaaa

SEQ ID NO: 1923060 - RNA, 19 nt, Shigella flexneri 2a str. 2457T
agcaaacaauaauuaucau

SEQ ID NO: 1923061 - RNA, 21 nt, Shigella flexneri 2a str. 2457T
agcaaaaucguaagcaggaga

SEQ ID NO: 1923062 - RNA, 15 nt, Shigella flexneri 2a str. 2457T
agcaaacaggauaau

SEQ ID NO: 1923063 - RNA, 13 nt, Shigella flexneri 2a str. 2457T
agcaaacaggugc

SEQ ID NO: 1923064 - RNA, 13 nt, Shigella flexneri 2a str. 2457T
agcaacaaauaac

SEQ ID NO: 1923065 - RNA, 12 nt, Shigella flexneri 2a str. 2457T
agcaaauuuuua

SEQ ID NO: 1923066 - RNA, 23 nt, Shigella flexneri 2a str. 2457T
agcaaauugaggaucugcgccug

SEQ ID NO: 1923067 - RNA, 22 nt, Shigella flexneri 2a str. 2457T
agcaacacaaacgaauuaucac

SEQ ID NO: 1923068 - RNA, 15 nt, Shigella flexneri 2a str. 2457T
agcaacacaaucaga

SEQ ID NO: 1923069 - RNA, 22 nt, Shigella flexneri 2a str. 2457T
agcaacacgccagcguuauccc

SEQ ID NO: 1923070 - RNA, 12 nt, Shigella flexneri 2a str. 2457T
agcaacaggcca

SEQ ID NO: 1923071 - RNA, 22 nt, Shigella flexneri 2a str. 2457T
agcaaaguaccaucguccagca

SEQ ID NO: 1923072 - RNA, 17 nt, Shigella flexneri 2a str. 2457T
agcaaauaaaacaucac

SEQ ID NO: 1923073 - RNA, 22 nt, Shigella flexneri 2a str. 2457T
agcaaaggugccuuuaauacca

SEQ ID NO: 1923074 - RNA, 22 nt, Shigella flexneri 2a str. 2457T
agcaaaguggcgcagagccuga

SEQ ID NO: 1923075 - RNA, 22 nt, Shigella flexneri 2a str. 2457T
agcaaauaaaacaucaccaaug

SEQ ID NO: 1923076 - RNA, 20 nt, Shigella flexneri 2a str. 2457T
agcaaauccaucauaugcgc

SEQ ID NO: 1923077 - RNA, 23 nt, Shigella flexneri 2a str. 2457T
agcaaaucacccugugcgccacc

SEQ ID NO: 1923078 - RNA, 14 nt, Shigella flexneri 2a str. 2457T
agauuuuuccccac

SEQ ID NO: 1923079 - RNA, 12 nt, Shigella flexneri 2a str. 2457T
agauuuugccag

SEQ ID NO: 1923080 - RNA, 13 nt, Shigella flexneri 2a str. 2457T
agauuuugccagc

SEQ ID NO: 1923081 - RNA, 22 nt, Shigella flexneri 2a str. 2457T
agauuguugauuaacaggcugc

SEQ ID NO: 1923082 - RNA, 19 nt, Shigella flexneri 2a str. 2457T
agauuguuggcaaaaaaau

SEQ ID NO: 1923083 - RNA, 15 nt, Shigella flexneri 2a str. 2457T
agauuguugacaaag

SEQ ID NO: 1923084 - RNA, 23 nt, Shigella flexneri 2a str. 2457T
agauugguaaugcguaacguuuc

SEQ ID NO: 1923085 - RNA, 12 nt, Shigella flexneri 2a str. 2457T
agauuucaccaa

SEQ ID NO: 1923086 - RNA, 19 nt, Shigella flexneri 2a str. 2457T
agauucguauuuaaaaccc

SEQ ID NO: 1923087 - RNA, 14 nt, Shigella flexneri 2a str. 2457T
agauucgauagaga

SEQ ID NO: 1923088 - RNA, 23 nt, Shigella flexneri 2a str. 2457T
agauucgcggguaagcgcggagg

SEQ ID NO: 1923089 - RNA, 14 nt, Shigella flexneri 2a str. 2457T
agauugauaaaaau

SEQ ID NO: 1923090 - RNA, 16 nt, Shigella flexneri 2a str. 2457T
agauugauaaaaauag

SEQ ID NO: 1923091 - RNA, 19 nt, Shigella flexneri 2a str. 2457T
agauugcaaauucucuauu

SEQ ID NO: 1923092 - RNA, 19 nt, Shigella flexneri 2a str. 2457T
agauugcagacaaagugag

SEQ ID NO: 1923093 - RNA, 14 nt, Shigella flexneri 2a str. 2457T
agauucagccacau

SEQ ID NO: 1923094 - RNA, 16 nt, Shigella flexneri 2a str. 2457T
agauucaugcugcggc

SEQ ID NO: 1923095 - RNA, 22 nt, Shigella flexneri 2a str. 2457T
agauucagcagcguggugcuga

SEQ ID NO: 1923096 - RNA, 14 nt, Shigella flexneri 2a str. 2457T
agauucagauuaug

SEQ ID NO: 1923097 - RNA, 18 nt, Shigella flexneri 2a str. 2457T
agauuaaucagcagauau

SEQ ID NO: 1923098 - RNA, 20 nt, Shigella flexneri 2a str. 2457T
agauuaagagaaccagcugc

SEQ ID NO: 1923099 - RNA, 20 nt, Shigella flexneri 2a str. 2457T
agauguucuaucuuucagac

SEQ ID NO: 1923100 - RNA, 19 nt, Shigella flexneri 2a str. 2457T
agaugugggcaaucucacu

SEQ ID NO: 1923101 - RNA, 20 nt, Shigella flexneri 2a str. 2457T
agaugugagcgauacccauu

SEQ ID NO: 1923102 - RNA, 15 nt, Shigella flexneri 2a str. 2457T
agaugugauaacgcu

SEQ ID NO: 1923103 - RNA, 16 nt, Shigella flexneri 2a str. 2457T
agaugugcaguuccug

SEQ ID NO: 1923104 - RNA, 23 nt, Shigella flexneri 2a str. 2457T
agauuagcccccguuuuguuguc

SEQ ID NO: 1923105 - RNA, 14 nt, Shigella flexneri 2a str. 2457T
agauuagccgguaa

SEQ ID NO: 1923106 - RNA, 18 nt, Shigella flexneri 2a str. 2457T
agauuagccguuaaguuu

SEQ ID NO: 1923107 - RNA, 20 nt, Shigella flexneri 2a str. 2457T
agauuaccagcgacaucacc

SEQ ID NO: 1923108 - RNA, 16 nt, Shigella flexneri 2a str. 2457T
agaugcaggaguagaa

SEQ ID NO: 1923109 - RNA, 12 nt, Shigella flexneri 2a str. 2457T
agaugcauuuau

SEQ ID NO: 1923110 - RNA, 13 nt, Shigella flexneri 2a str. 2457T
agaugucccaucu

SEQ ID NO: 1923111 - RNA, 14 nt, Shigella flexneri 2a str. 2457T
agauggcggcuggc

SEQ ID NO: 1923112 - RNA, 23 nt, Shigella flexneri 2a str. 2457T
agauggcccacgacgucuccauc

SEQ ID NO: 1923113 - RNA, 18 nt, Shigella flexneri 2a str. 2457T
aaaaccgagaagcagcaa

SEQ ID NO: 1923114 - RNA, 15 nt, Shigella flexneri 2a str. 2457T
aaaaccgacuuaaaa

SEQ ID NO: 1923115 - RNA, 22 nt, Shigella flexneri 2a str. 2457T
agaugauaaccccgcaauuuca

SEQ ID NO: 1923116 - RNA, 20 nt, Shigella flexneri 2a str. 2457T
aaaaccgcgaugaccaaaaa

SEQ ID NO: 1923117 - RNA, 21 nt, Shigella flexneri 2a str. 2457T
agaugaauagcgcaaaauuau

SEQ ID NO: 1923118 - RNA, 14 nt, Shigella flexneri 2a str. 2457T
agauaaauaucaau

SEQ ID NO: 1923119 - RNA, 17 nt, Shigella flexneri 2a str. 2457T
agauaagauaaauuccu

SEQ ID NO: 1923120 - RNA, 21 nt, Shigella flexneri 2a str. 2457T
agauaaacgaccacucuuucg

SEQ ID NO: 1923121 - RNA, 17 nt, Shigella flexneri 2a str. 2457T
agauaaacgaccacucu

SEQ ID NO: 1923122 - RNA, 15 nt, Shigella flexneri 2a str. 2457T
agauaaaaugcgaaa

SEQ ID NO: 1923123 - RNA, 19 nt, Shigella flexneri 2a str. 2457T
agaguugaaaaacaugucu

SEQ ID NO: 1923124 - RNA, 23 nt, Shigella flexneri 2a str. 2457T
agaguugagcaguccccacauca

SEQ ID NO: 1923125 - RNA, 16 nt, Shigella flexneri 2a str. 2457T
agaguugcaccagcaa

SEQ ID NO: 1923126 - RNA, 22 nt, Shigella flexneri 2a str. 2457T
agaguuccggcccuaaacucuu

SEQ ID NO: 1923127 - RNA, 15 nt, Shigella flexneri 2a str. 2457T
agaguacugccggga

SEQ ID NO: 1923128 - RNA, 19 nt, Shigella flexneri 2a str. 2457T
agaguaggcuggaucagac

SEQ ID NO: 1923129 - RNA, 22 nt, Shigella flexneri 2a str. 2457T
agauaagcagcguguugcggag

SEQ ID NO: 1923130 - RNA, 12 nt, Shigella flexneri 2a str. 2457T
agauaagcaagg

SEQ ID NO: 1923131 - RNA, 15 nt, Shigella flexneri 2a str. 2457T
agauacgaccguucc

SEQ ID NO: 1923132 - RNA, 16 nt, Shigella flexneri 2a str. 2457T
agauaauaauguguuc

SEQ ID NO: 1923133 - RNA, 18 nt, Shigella flexneri 2a str. 2457T
agauaccuaacauuuuac

SEQ ID NO: 1923134 - RNA, 17 nt, Shigella flexneri 2a str. 2457T
agauacggauucuuaac

SEQ ID NO: 1923135 - RNA, 11 nt, Shigella flexneri 2a str. 2457T
agauacugcau

SEQ ID NO: 1923136 - RNA, 20 nt, Shigella flexneri 2a str. 2457T
agauccagcaccuuuugcug

SEQ ID NO: 1923137 - RNA, 22 nt, Shigella flexneri 2a str. 2457T
agaucauccugcggcagcucca

SEQ ID NO: 1923138 - RNA, 15 nt, Shigella flexneri 2a str. 2457T
agaucagaccaaucc

SEQ ID NO: 1923139 - RNA, 21 nt, Shigella flexneri 2a str. 2457T
agauagccagguuuaccagca

SEQ ID NO: 1923140 - RNA, 21 nt, Shigella flexneri 2a str. 2457T
agauaucccgccagcaccagc

SEQ ID NO: 1923141 - RNA, 15 nt, Shigella flexneri 2a str. 2457T
agauauucuccagcu

SEQ ID NO: 1923142 - RNA, 15 nt, Shigella flexneri 2a str. 2457T
agauauuuaaaugau

SEQ ID NO: 1923143 - RNA, 23 nt, Shigella flexneri 2a str. 2457T
agauauuuaauggcgacauaaaa

SEQ ID NO: 1923144 - RNA, 15 nt, Shigella flexneri 2a str. 2457T
agaucacgcaucacc

SEQ ID NO: 1923145 - RNA, 23 nt, Shigella flexneri 2a str. 2457T
agagcuuuucagccugaagauca

SEQ ID NO: 1923146 - RNA, 22 nt, Shigella flexneri 2a str. 2457T
agagcuuuguugcgcugaagua

SEQ ID NO: 1923147 - RNA, 18 nt, Shigella flexneri 2a str. 2457T
aaaacauugccguaagca

SEQ ID NO: 1923148 - RNA, 22 nt, Shigella flexneri 2a str. 2457T
agagcuugugcaccagcuggcu

SEQ ID NO: 1923149 - RNA, 21 nt, Shigella flexneri 2a str. 2457T
agaggguuagggugaggggaa

SEQ ID NO: 1923150 - RNA, 20 nt, Shigella flexneri 2a str. 2457T
agagguaaaaccugacaaca

SEQ ID NO: 1923151 - RNA, 23 nt, Shigella flexneri 2a str. 2457T
agaggcugaaggcgcuccccugc

SEQ ID NO: 1923152 - RNA, 20 nt, Shigella flexneri 2a str. 2457T
agagggccggggugggggug

SEQ ID NO: 1923153 - RNA, 20 nt, Shigella flexneri 2a str. 2457T
agagggcgauaaaucuccac

SEQ ID NO: 1923154 - RNA, 23 nt, Shigella flexneri 2a str. 2457T
agacguugauucacuuucugaag

SEQ ID NO: 1923155 - RNA, 21 nt, Shigella flexneri 2a str. 2457T
agacguucuuccuguggaucg

SEQ ID NO: 1923156 - RNA, 18 nt, Shigella flexneri 2a str. 2457T
agacguccggcgcugcaa

SEQ ID NO: 1923157 - RNA, 21 nt, Shigella flexneri 2a str. 2457T
agacguguugucagcucaucc

SEQ ID NO: 1923158 - RNA, 15 nt, Shigella flexneri 2a str. 2457T
agacguucuuccugu

SEQ ID NO: 1923159 - RNA, 13 nt, Shigella flexneri 2a str. 2457T
agagauccuggcg

SEQ ID NO: 1923160 - RNA, 20 nt, Shigella flexneri 2a str. 2457T
agagauccaccacgcuguag

SEQ ID NO: 1923161 - RNA, 16 nt, Shigella flexneri 2a str. 2457T
agagcaaucaccagau

SEQ ID NO: 1923162 - RNA, 13 nt, Shigella flexneri 2a str. 2457T
agagcacaucacu

SEQ ID NO: 1923163 - RNA, 22 nt, Shigella flexneri 2a str. 2457T
agagauuacuuuauuuauauca

SEQ ID NO: 1923164 - RNA, 23 nt, Shigella flexneri 2a str. 2457T
agagcagcaucaauaacccuggu

SEQ ID NO: 1923165 - RNA, 22 nt, Shigella flexneri 2a str. 2457T
agagccucgucggcgguuuuca

SEQ ID NO: 1923166 - RNA, 22 nt, Shigella flexneri 2a str. 2457T
agagcaucaguuaacggcacca

SEQ ID NO: 1923167 - RNA, 16 nt, Shigella flexneri 2a str. 2457T
agagccggacugacau

SEQ ID NO: 1923168 - RNA, 21 nt, Shigella flexneri 2a str. 2457T
agagcuggcgaacgugcagga

SEQ ID NO: 1923169 - RNA, 18 nt, Shigella flexneri 2a str. 2457T
agaccaauggcuuuugcc

SEQ ID NO: 1923170 - RNA, 13 nt, Shigella flexneri 2a str. 2457T
agaccaauagaaa

SEQ ID NO: 1923171 - RNA, 22 nt, Shigella flexneri 2a str. 2457T
agaccaauccagccggcaaagu

SEQ ID NO: 1923172 - RNA, 14 nt, Shigella flexneri 2a str. 2457T
agaccaaacagcau

SEQ ID NO: 1923173 - RNA, 22 nt, Shigella flexneri 2a str. 2457T
agaccaaaacgugcagcugccu

SEQ ID NO: 1923174 - RNA, 12 nt, Shigella flexneri 2a str. 2457T
agaccagcaaaa

SEQ ID NO: 1923175 - RNA, 12 nt, Shigella flexneri 2a str. 2457T
agaccagacugc

SEQ ID NO: 1923176 - RNA, 11 nt, Shigella flexneri 2a str. 2457T
agaccagcacc

SEQ ID NO: 1923177 - RNA, 14 nt, Shigella flexneri 2a str. 2457T
agaccagcaaaaau

SEQ ID NO: 1923178 - RNA, 16 nt, Shigella flexneri 2a str. 2457T
agacaguucuuccugg

SEQ ID NO: 1923179 - RNA, 19 nt, Shigella flexneri 2a str. 2457T
agacaucaauaaacaauga

SEQ ID NO: 1923180 - RNA, 15 nt, Shigella flexneri 2a str. 2457T
agacauagcacauaa

SEQ ID NO: 1923181 - RNA, 14 nt, Shigella flexneri 2a str. 2457T
agacauaacccagc

SEQ ID NO: 1923182 - RNA, 20 nt, Shigella flexneri 2a str. 2457T
agacauaaggaaacuccagc

SEQ ID NO: 1923183 - RNA, 19 nt, Shigella flexneri 2a str. 2457T
agacauucgcgcacggugc

SEQ ID NO: 1923184 - RNA, 18 nt, Shigella flexneri 2a str. 2457T
agacaucuuuauaugcaa

SEQ ID NO: 1923185 - RNA, 14 nt, Shigella flexneri 2a str. 2457T
agacaucuguuauc

SEQ ID NO: 1923186 - RNA, 14 nt, Shigella flexneri 2a str. 2457T
agacaucgcaggga

SEQ ID NO: 1923187 - RNA, 22 nt, Shigella flexneri 2a str. 2457T
agacaucgcccgauucacauaa

SEQ ID NO: 1923188 - RNA, 15 nt, Shigella flexneri 2a str. 2457T
aaaacauaaucaaua

SEQ ID NO: 1923189 - RNA, 16 nt, Shigella flexneri 2a str. 2457T
aaaacagugauuacua

SEQ ID NO: 1923190 - RNA, 20 nt, Shigella flexneri 2a str. 2457T
aaaacagcgcccaacacuuc

SEQ ID NO: 1923191 - RNA, 20 nt, Shigella flexneri 2a str. 2457T
aaaacaggucgccagucccu

SEQ ID NO: 1923192 - RNA, 14 nt, Shigella flexneri 2a str. 2457T
aaaacaguaccaga

SEQ ID NO: 1923193 - RNA, 20 nt, Shigella flexneri 2a str. 2457T
aaaacaggcagcugccagac

SEQ ID NO: 1923194 - RNA, 20 nt, Shigella flexneri 2a str. 2457T
agacgcacccucaaaauuuc

SEQ ID NO: 1923195 - RNA, 18 nt, Shigella flexneri 2a str. 2457T
agacgcaaaguagcggcc

SEQ ID NO: 1923196 - RNA, 18 nt, Shigella flexneri 2a str. 2457T
agacguaaaaauagcgaa

SEQ ID NO: 1923197 - RNA, 18 nt, Shigella flexneri 2a str. 2457T
agacgguuauauuuacaa

SEQ ID NO: 1923198 - RNA, 21 nt, Shigella flexneri 2a str. 2457T
agacgccacaaucucacccgc

SEQ ID NO: 1923199 - RNA, 18 nt, Shigella flexneri 2a str. 2457T
agaccggcaaccagcacc

SEQ ID NO: 1923200 - RNA, 22 nt, Shigella flexneri 2a str. 2457T
agaccugaauuugcuccagaaa

SEQ ID NO: 1923201 - RNA, 17 nt, Shigella flexneri 2a str. 2457T
agaccugauacauagca

SEQ ID NO: 1923202 - RNA, 15 nt, Shigella flexneri 2a str. 2457T
agaccugauccggau

SEQ ID NO: 1923203 - RNA, 13 nt, Shigella flexneri 2a str. 2457T
agaccugcguuca

SEQ ID NO: 1923204 - RNA, 21 nt, Shigella flexneri 2a str. 2457T
agaccugggcgaugcuggcag

SEQ ID NO: 1923205 - RNA, 19 nt, Shigella flexneri 2a str. 2457T
aaaacagccagcagcgaau

SEQ ID NO: 1923206 - RNA, 23 nt, Shigella flexneri 2a str. 2457T
aaaacagcgaguucaggcgcugc

SEQ ID NO: 1923207 - RNA, 18 nt, Shigella flexneri 2a str. 2457T
aaaacagcagggccugaa

SEQ ID NO: 1923208 - RNA, 15 nt, Shigella flexneri 2a str. 2457T
agaccuucugccaga

SEQ ID NO: 1923209 - RNA, 14 nt, Shigella flexneri 2a str. 2457T
agaccgcuucugcg

SEQ ID NO: 1923210 - RNA, 20 nt, Shigella flexneri 2a str. 2457T
agaaguacguagcguaagga

SEQ ID NO: 1923211 - RNA, 23 nt, Shigella flexneri 2a str. 2457T
agaaguaaucuacugcaccgcag

SEQ ID NO: 1923212 - RNA, 19 nt, Shigella flexneri 2a str. 2457T
agaauguccauuauuucaa

SEQ ID NO: 1923213 - RNA, 15 nt, Shigella flexneri 2a str. 2457T
agaauugauaaaaaa

SEQ ID NO: 1923214 - RNA, 21 nt, Shigella flexneri 2a str. 2457T
agaauugcagauaccacauca

SEQ ID NO: 1923215 - RNA, 22 nt, Shigella flexneri 2a str. 2457T
agaauguuaacgccaauuaaug

SEQ ID NO: 1923216 - RNA, 14 nt, Shigella flexneri 2a str. 2457T
agaauuaacgcuga

SEQ ID NO: 1923217 - RNA, 13 nt, Shigella flexneri 2a str. 2457T
agaauuuuucacu

SEQ ID NO: 1923218 - RNA, 16 nt, Shigella flexneri 2a str. 2457T
agacaaauuuugaaca

SEQ ID NO: 1923219 - RNA, 19 nt, Shigella flexneri 2a str. 2457T
agacaaauuuugaacagaa

SEQ ID NO: 1923220 - RNA, 20 nt, Shigella flexneri 2a str. 2457T
agacaaauuuugaacagaac

SEQ ID NO: 1923221 - RNA, 20 nt, Shigella flexneri 2a str. 2457T
agaauuuuucgcuaaaaaau

SEQ ID NO: 1923222 - RNA, 13 nt, Shigella flexneri 2a str. 2457T
agacaacccacac

SEQ ID NO: 1923223 - RNA, 17 nt, Shigella flexneri 2a str. 2457T
agacaacaacaucagcg

SEQ ID NO: 1923224 - RNA, 14 nt, Shigella flexneri 2a str. 2457T
agacaaaugaacac

SEQ ID NO: 1923225 - RNA, 16 nt, Shigella flexneri 2a str. 2457T
agacaaaugucacugc

SEQ ID NO: 1923226 - RNA, 21 nt, Shigella flexneri 2a str. 2457T
agacaacaugagaacaguuca

SEQ ID NO: 1923227 - RNA, 14 nt, Shigella flexneri 2a str. 2457T
agacaacuucccug

SEQ ID NO: 1923228 - RNA, 13 nt, Shigella flexneri 2a str. 2457T
agacaacuucccu

SEQ ID NO: 1923229 - RNA, 14 nt, Shigella flexneri 2a str. 2457T
agacaaucgccagu

SEQ ID NO: 1923230 - RNA, 20 nt, Shigella flexneri 2a str. 2457T
agacaauuuuucauaaucau

SEQ ID NO: 1923231 - RNA, 17 nt, Shigella flexneri 2a str. 2457T
agacaccccuucauuca

SEQ ID NO: 1923232 - RNA, 21 nt, Shigella flexneri 2a str. 2457T
agacacgccgccagaccaaua

SEQ ID NO: 1923233 - RNA, 17 nt, Shigella flexneri 2a str. 2457T
agacacgcaauaccagc

SEQ ID NO: 1923234 - RNA, 13 nt, Shigella flexneri 2a str. 2457T
agacaccaaggaa

SEQ ID NO: 1923235 - RNA, 15 nt, Shigella flexneri 2a str. 2457T
agacagccuaccaga

SEQ ID NO: 1923236 - RNA, 18 nt, Shigella flexneri 2a str. 2457T
agacagcaaagugccccc

SEQ ID NO: 1923237 - RNA, 15 nt, Shigella flexneri 2a str. 2457T
agacagacagccuca

SEQ ID NO: 1923238 - RNA, 14 nt, Shigella flexneri 2a str. 2457T
agacacuuuaucua

SEQ ID NO: 1923239 - RNA, 13 nt, Shigella flexneri 2a str. 2457T
agacacuggaaac

SEQ ID NO: 1923240 - RNA, 16 nt, Shigella flexneri 2a str. 2457T
agacacuccagagaau

SEQ ID NO: 1923241 - RNA, 19 nt, Shigella flexneri 2a str. 2457T
agacacuccagagaauuua

SEQ ID NO: 1923242 - RNA, 16 nt, Shigella flexneri 2a str. 2457T
agacacgcugccccug

SEQ ID NO: 1923243 - RNA, 15 nt, Shigella flexneri 2a str. 2457T
agaaauuauuucuuu

SEQ ID NO: 1923244 - RNA, 23 nt, Shigella flexneri 2a str. 2457T
aaaacacaacgcuuucaacaacc

SEQ ID NO: 1923245 - RNA, 18 nt, Shigella flexneri 2a str. 2457T
agaaauacuggcuaagaa

SEQ ID NO: 1923246 - RNA, 15 nt, Shigella flexneri 2a str. 2457T
agaacauaaacagcg

SEQ ID NO: 1923247 - RNA, 18 nt, Shigella flexneri 2a str. 2457T
agaacacuucuucugucg

SEQ ID NO: 1923248 - RNA, 19 nt, Shigella flexneri 2a str. 2457T
agaacacgcucccagcaga

SEQ ID NO: 1923249 - RNA, 21 nt, Shigella flexneri 2a str. 2457T
agaacacgcucccagcagaga

SEQ ID NO: 1923250 - RNA, 18 nt, Shigella flexneri 2a str. 2457T
agaacacgguaaugacuc

SEQ ID NO: 1923251 - RNA, 16 nt, Shigella flexneri 2a str. 2457T
agaacaauaauaacuc

SEQ ID NO: 1923252 - RNA, 19 nt, Shigella flexneri 2a str. 2457T
agaacugagcgaucauuag

SEQ ID NO: 1923253 - RNA, 20 nt, Shigella flexneri 2a str. 2457T
agaacugauaacgcauuuca

SEQ ID NO: 1923254 - RNA, 16 nt, Shigella flexneri 2a str. 2457T
agaacuccagcccgga

SEQ ID NO: 1923255 - RNA, 13 nt, Shigella flexneri 2a str. 2457T
agaacugcuggaa

SEQ ID NO: 1923256 - RNA, 14 nt, Shigella flexneri 2a str. 2457T
agaacugcgccaga

SEQ ID NO: 1923257 - RNA, 21 nt, Shigella flexneri 2a str. 2457T
agaacuguagacaaaauguuc

SEQ ID NO: 1923258 - RNA, 16 nt, Shigella flexneri 2a str. 2457T
agaaccguaaacagau

SEQ ID NO: 1923259 - RNA, 15 nt, Shigella flexneri 2a str. 2457T
agaaccuaagaacca

SEQ ID NO: 1923260 - RNA, 19 nt, Shigella flexneri 2a str. 2457T
agaaccuaagaaccagaau

SEQ ID NO: 1923261 - RNA, 22 nt, Shigella flexneri 2a str. 2457T
agaacuauuaguuuguugaagu

SEQ ID NO: 1923262 - RNA, 13 nt, Shigella flexneri 2a str. 2457T
agaagcugcagga

SEQ ID NO: 1923263 - RNA, 13 nt, Shigella flexneri 2a str. 2457T
agaagcuggaagg

SEQ ID NO: 1923264 - RNA, 14 nt, Shigella flexneri 2a str. 2457T
agaagcuuuccauc

SEQ ID NO: 1923265 - RNA, 23 nt, Shigella flexneri 2a str. 2457T
agaaggaaaauacagcaauggaa

SEQ ID NO: 1923266 - RNA, 20 nt, Shigella flexneri 2a str. 2457T
agaagaucguggagaacaau

SEQ ID NO: 1923267 - RNA, 19 nt, Shigella flexneri 2a str. 2457T
agaagauuuuuugccagca

SEQ ID NO: 1923268 - RNA, 19 nt, Shigella flexneri 2a str. 2457T
agaagcagcaacacaauca

SEQ ID NO: 1923269 - RNA, 16 nt, Shigella flexneri 2a str. 2457T
agaagcggaaaucacg

SEQ ID NO: 1923270 - RNA, 17 nt, Shigella flexneri 2a str. 2457T
agaaaacuuccggcaga

SEQ ID NO: 1923271 - RNA, 20 nt, Shigella flexneri 2a str. 2457T
agaaaacgguugauauacca

SEQ ID NO: 1923272 - RNA, 14 nt, Shigella flexneri 2a str. 2457T
agaaacagaaugau

SEQ ID NO: 1923273 - RNA, 17 nt, Shigella flexneri 2a str. 2457T
agaaaaaccuccggcgu

SEQ ID NO: 1923274 - RNA, 18 nt, Shigella flexneri 2a str. 2457T
acuuuuuaugucauuaac

SEQ ID NO: 1923275 - RNA, 16 nt, Shigella flexneri 2a str. 2457T
agaaaaacuuaauccu

SEQ ID NO: 1923276 - RNA, 15 nt, Shigella flexneri 2a str. 2457T
acuuuugcccggcau

SEQ ID NO: 1923277 - RNA, 15 nt, Shigella flexneri 2a str. 2457T
agaaaguuuuucaac

SEQ ID NO: 1923278 - RNA, 22 nt, Shigella flexneri 2a str. 2457T
agaaauaaucgcaauuacccag

SEQ ID NO: 1923279 - RNA, 13 nt, Shigella flexneri 2a str. 2457T
agaaaguuguuuu

SEQ ID NO: 1923280 - RNA, 20 nt, Shigella flexneri 2a str. 2457T
agaaaguugccagauaaaua

SEQ ID NO: 1923281 - RNA, 19 nt, Shigella flexneri 2a str. 2457T
agaaaguugccagauaaau

SEQ ID NO: 1923282 - RNA, 15 nt, Shigella flexneri 2a str. 2457T
agaaagggaagaaca

SEQ ID NO: 1923283 - RNA, 14 nt, Shigella flexneri 2a str. 2457T
agaaagggaagaac

SEQ ID NO: 1923284 - RNA, 16 nt, Shigella flexneri 2a str. 2457T
agaaaguaaucuauau

SEQ ID NO: 1923285 - RNA, 22 nt, Shigella flexneri 2a str. 2457T
agaaaguaacaauagcgaacag

SEQ ID NO: 1923286 - RNA, 23 nt, Shigella flexneri 2a str. 2457T
agaaagcugcugaccaccagcac

SEQ ID NO: 1923287 - RNA, 17 nt, Shigella flexneri 2a str. 2457T
agaaaggcagagugcaa

SEQ ID NO: 1923288 - RNA, 22 nt, Shigella flexneri 2a str. 2457T
agaaagcggaucaguuccagca

SEQ ID NO: 1923289 - RNA, 16 nt, Shigella flexneri 2a str. 2457T
agaaagcgccagcaag

SEQ ID NO: 1923290 - RNA, 19 nt, Shigella flexneri 2a str. 2457T
agaaacuguaauugagaac

SEQ ID NO: 1923291 - RNA, 22 nt, Shigella flexneri 2a str. 2457T
agaaagcaauauugauggaaag

SEQ ID NO: 1923292 - RNA, 14 nt, Shigella flexneri 2a str. 2457T
acccggcggcgcgc

SEQ ID NO: 1923293 - RNA, 14 nt, Shigella flexneri 2a str. 2457T
acccggccugcucc

SEQ ID NO: 1923294 - RNA, 12 nt, Shigella flexneri 2a str. 2457T
acccgcuucagu

SEQ ID NO: 1923295 - RNA, 14 nt, Shigella flexneri 2a str. 2457T
acccggccacagcg

SEQ ID NO: 1923296 - RNA, 15 nt, Shigella flexneri 2a str. 2457T
acccggcaucaacca

SEQ ID NO: 1923297 - RNA, 16 nt, Shigella flexneri 2a str. 2457T
acccggaccgucuuuu

SEQ ID NO: 1923298 - RNA, 15 nt, Shigella flexneri 2a str. 2457T
acccgcgaucgccug

SEQ ID NO: 1923299 - RNA, 16 nt, Shigella flexneri 2a str. 2457T
acccgcgacgcgcuuu

SEQ ID NO: 1923300 - RNA, 15 nt, Shigella flexneri 2a str. 2457T
acccgcgaccaccag

SEQ ID NO: 1923301 - RNA, 19 nt, Shigella flexneri 2a str. 2457T
accccuuucucgcccagca

SEQ ID NO: 1923302 - RNA, 15 nt, Shigella flexneri 2a str. 2457T
accccuugccacccg

SEQ ID NO: 1923303 - RNA, 15 nt, Shigella flexneri 2a str. 2457T
accccuuccugaaua

SEQ ID NO: 1923304 - RNA, 13 nt, Shigella flexneri 2a str. 2457T
acccaccgcagcc

SEQ ID NO: 1923305 - RNA, 18 nt, Shigella flexneri 2a str. 2457T
acccaucaacaacuggcg

SEQ ID NO: 1923306 - RNA, 19 nt, Shigella flexneri 2a str. 2457T
acccaucaagcgaaaaugc

SEQ ID NO: 1923307 - RNA, 19 nt, Shigella flexneri 2a str. 2457T
acccauauuuaaucaguuc

SEQ ID NO: 1923308 - RNA, 22 nt, Shigella flexneri 2a str. 2457T
acccaccaugccgauggcaaaa

SEQ ID NO: 1923309 - RNA, 22 nt, Shigella flexneri 2a str. 2457T
acccacauguugcgcuucacca

SEQ ID NO: 1923310 - RNA, 21 nt, Shigella flexneri 2a str. 2457T
accccacgcucucgcagcuca

SEQ ID NO: 1923311 - RNA, 24 nt, Shigella flexneri 2a str. 2457T
acccaugacuuugaucugaccgaa

SEQ ID NO: 1923312 - RNA, 15 nt, Shigella flexneri 2a str. 2457T
accccggcccucucc

SEQ ID NO: 1923313 - RNA, 21 nt, Shigella flexneri 2a str. 2457T
accccucuauccagcucaucc

SEQ ID NO: 1923314 - RNA, 16 nt, Shigella flexneri 2a str. 2457T
acccccauccacgcau

SEQ ID NO: 1923315 - RNA, 19 nt, Shigella flexneri 2a str. 2457T
accccauggagaaaaugug

SEQ ID NO: 1923316 - RNA, 17 nt, Shigella flexneri 2a str. 2457T
acccccaccccggcccu

SEQ ID NO: 1923317 - RNA, 14 nt, Shigella flexneri 2a str. 2457T
accccauuugccac

SEQ ID NO: 1923318 - RNA, 20 nt, Shigella flexneri 2a str. 2457T
accccaggccgcguaccgca

SEQ ID NO: 1923319 - RNA, 22 nt, Shigella flexneri 2a str. 2457T
accccaggccgcguaccgcagc

SEQ ID NO: 1923320 - RNA, 22 nt, Shigella flexneri 2a str. 2457T
accccagugguuucgccagcac

SEQ ID NO: 1923321 - RNA, 17 nt, Shigella flexneri 2a str. 2457T
acccacaucagcggcac

SEQ ID NO: 1923322 - RNA, 20 nt, Shigella flexneri 2a str. 2457T
acccaaucccccacuuuuaa

SEQ ID NO: 1923323 - RNA, 14 nt, Shigella flexneri 2a str. 2457T
acccaaucccccac

SEQ ID NO: 1923324 - RNA, 18 nt, Shigella flexneri 2a str. 2457T
acccaacguaacaaaacu

SEQ ID NO: 1923325 - RNA, 16 nt, Shigella flexneri 2a str. 2457T
acccaagcuucgggau

SEQ ID NO: 1923326 - RNA, 17 nt, Shigella flexneri 2a str. 2457T
acccaacgcaaagagag

SEQ ID NO: 1923327 - RNA, 21 nt, Shigella flexneri 2a str. 2457T
acccaacgcaaagagagaagc

SEQ ID NO: 1923328 - RNA, 19 nt, Shigella flexneri 2a str. 2457T
accauuaaucgauaaacca

SEQ ID NO: 1923329 - RNA, 15 nt, Shigella flexneri 2a str. 2457T
accauguucacugcc

SEQ ID NO: 1923330 - RNA, 13 nt, Shigella flexneri 2a str. 2457T
accaugucaucaa

SEQ ID NO: 1923331 - RNA, 14 nt, Shigella flexneri 2a str. 2457T
accaugucaucaau

SEQ ID NO: 1923332 - RNA, 14 nt, Shigella flexneri 2a str. 2457T
accauuaucaccaa

SEQ ID NO: 1923333 - RNA, 14 nt, Shigella flexneri 2a str. 2457T
accauuauuaaauu

SEQ ID NO: 1923334 - RNA, 17 nt, Shigella flexneri 2a str. 2457T
accauugaggauugcgc

SEQ ID NO: 1923335 - RNA, 16 nt, Shigella flexneri 2a str. 2457T
accauugaagcaaucc

SEQ ID NO: 1923336 - RNA, 20 nt, Shigella flexneri 2a str. 2457T
accauuggcauugguaucgg

SEQ ID NO: 1923337 - RNA, 15 nt, Shigella flexneri 2a str. 2457T
accauccauuuuuca

SEQ ID NO: 1923338 - RNA, 14 nt, Shigella flexneri 2a str. 2457T
accaucccgccgau

SEQ ID NO: 1923339 - RNA, 14 nt, Shigella flexneri 2a str. 2457T
accauccaggagau

SEQ ID NO: 1923340 - RNA, 21 nt, Shigella flexneri 2a str. 2457T
accaucauaccgaucaccgau

SEQ ID NO: 1923341 - RNA, 17 nt, Shigella flexneri 2a str. 2457T
accaucagcugccaggg

SEQ ID NO: 1923342 - RNA, 20 nt, Shigella flexneri 2a str. 2457T
accaucagcugccagggcac

SEQ ID NO: 1923343 - RNA, 18 nt, Shigella flexneri 2a str. 2457T
accaucaggaugacaaac

SEQ ID NO: 1923344 - RNA, 19 nt, Shigella flexneri 2a str. 2457T
accaucaggaugacaaacu

SEQ ID NO: 1923345 - RNA, 22 nt, Shigella flexneri 2a str. 2457T
accaucacuuucaaaagccccg

SEQ ID NO: 1923346 - RNA, 15 nt, Shigella flexneri 2a str. 2457T
accaucaccucuuca

SEQ ID NO: 1923347 - RNA, 13 nt, Shigella flexneri 2a str. 2457T
accaucagcagca

SEQ ID NO: 1923348 - RNA, 13 nt, Shigella flexneri 2a str. 2457T
accaucagcauga

SEQ ID NO: 1923349 - RNA, 18 nt, Shigella flexneri 2a str. 2457T
accauggcucaccagcag

SEQ ID NO: 1923350 - RNA, 16 nt, Shigella flexneri 2a str. 2457T
accauggaagaaaaau

SEQ ID NO: 1923351 - RNA, 22 nt, Shigella flexneri 2a str. 2457T
accaugccggugaugccgccag

SEQ ID NO: 1923352 - RNA, 14 nt, Shigella flexneri 2a str. 2457T
accaugcaccaacc

SEQ ID NO: 1923353 - RNA, 23 nt, Shigella flexneri 2a str. 2457T
accaugcaauuaccgccaccagg

SEQ ID NO: 1923354 - RNA, 20 nt, Shigella flexneri 2a str. 2457T
accaugcaaaaugguuccug

SEQ ID NO: 1923355 - RNA, 12 nt, Shigella flexneri 2a str. 2457T
accagaagagaa

SEQ ID NO: 1923356 - RNA, 14 nt, Shigella flexneri 2a str. 2457T
accagaaacaauaa

SEQ ID NO: 1923357 - RNA, 15 nt, Shigella flexneri 2a str. 2457T
accauacagcagcaa

SEQ ID NO: 1923358 - RNA, 19 nt, Shigella flexneri 2a str. 2457T
accauacagcagcaacgau

SEQ ID NO: 1923359 - RNA, 22 nt, Shigella flexneri 2a str. 2457T
accaucaaguagcagguaaucu

SEQ ID NO: 1923360 - RNA, 21 nt, Shigella flexneri 2a str. 2457T
accaucaaguagcagguaauc

SEQ ID NO: 1923361 - RNA, 18 nt, Shigella flexneri 2a str. 2457T
accaucaacaaacgccag

SEQ ID NO: 1923362 - RNA, 13 nt, Shigella flexneri 2a str. 2457T
accaucaccucuu

SEQ ID NO: 1923363 - RNA, 16 nt, Shigella flexneri 2a str. 2457T
accgccugcaaauaaa

SEQ ID NO: 1923364 - RNA, 13 nt, Shigella flexneri 2a str. 2457T
accgcgaagaaca

SEQ ID NO: 1923365 - RNA, 23 nt, Shigella flexneri 2a str. 2457T
accgcgaggccuaacaccaucag

SEQ ID NO: 1923366 - RNA, 16 nt, Shigella flexneri 2a str. 2457T
accgccuggcgcugcu

SEQ ID NO: 1923367 - RNA, 17 nt, Shigella flexneri 2a str. 2457T
accgcgcucagccagcc

SEQ ID NO: 1923368 - RNA, 15 nt, Shigella flexneri 2a str. 2457T
accgcgaucuuccac

SEQ ID NO: 1923369 - RNA, 22 nt, Shigella flexneri 2a str. 2457T
accgcugagcgauaaaaucaga

SEQ ID NO: 1923370 - RNA, 18 nt, Shigella flexneri 2a str. 2457T
accggcguaacggccacg

SEQ ID NO: 1923371 - RNA, 16 nt, Shigella flexneri 2a str. 2457T
accggauaaaggcggc

SEQ ID NO: 1923372 - RNA, 18 nt, Shigella flexneri 2a str. 2457T
accggauaaaggcggccc

SEQ ID NO: 1923373 - RNA, 16 nt, Shigella flexneri 2a str. 2457T
accggauaaucggcaa

SEQ ID NO: 1923374 - RNA, 23 nt, Shigella flexneri 2a str. 2457T
accgcugcuuaauuacugccuua

SEQ ID NO: 1923375 - RNA, 16 nt, Shigella flexneri 2a str. 2457T
accggcaauaauuaac

SEQ ID NO: 1923376 - RNA, 13 nt, Shigella flexneri 2a str. 2457T
accggauuuucac

SEQ ID NO: 1923377 - RNA, 15 nt, Shigella flexneri 2a str. 2457T
accggcaaccagcac

SEQ ID NO: 1923378 - RNA, 16 nt, Shigella flexneri 2a str. 2457T
accggcaaccagcacc

SEQ ID NO: 1923379 - RNA, 14 nt, Shigella flexneri 2a str. 2457T
accggauuuucacc

SEQ ID NO: 1923380 - RNA, 16 nt, Shigella flexneri 2a str. 2457T
accggcaaacuucguc

SEQ ID NO: 1923381 - RNA, 23 nt, Shigella flexneri 2a str. 2457T
acccguuaagcguucauccaaca

SEQ ID NO: 1923382 - RNA, 18 nt, Shigella flexneri 2a str. 2457T
acccguugguuugauagc

SEQ ID NO: 1923383 - RNA, 22 nt, Shigella flexneri 2a str. 2457T
acccguugguuugauagcaaua

SEQ ID NO: 1923384 - RNA, 13 nt, Shigella flexneri 2a str. 2457T
acccuaaagcacc

SEQ ID NO: 1923385 - RNA, 17 nt, Shigella flexneri 2a str. 2457T
acccuaaauccgccauc

SEQ ID NO: 1923386 - RNA, 15 nt, Shigella flexneri 2a str. 2457T
accgagaagcagcaa

SEQ ID NO: 1923387 - RNA, 22 nt, Shigella flexneri 2a str. 2457T
accgagauaaugguuuccagca

SEQ ID NO: 1923388 - RNA, 12 nt, Shigella flexneri 2a str. 2457T
accgagaaaauc

SEQ ID NO: 1923389 - RNA, 15 nt, Shigella flexneri 2a str. 2457T
accgagaaaaucauc

SEQ ID NO: 1923390 - RNA, 23 nt, Shigella flexneri 2a str. 2457T
acccucgaccaucuccuuacugc

SEQ ID NO: 1923391 - RNA, 14 nt, Shigella flexneri 2a str. 2457T
acccucuccccaag

SEQ ID NO: 1923392 - RNA, 23 nt, Shigella flexneri 2a str. 2457T
acccucucccgaaugaccgcccc

SEQ ID NO: 1923393 - RNA, 16 nt, Shigella flexneri 2a str. 2457T
accgaucgccagcagg

SEQ ID NO: 1923394 - RNA, 17 nt, Shigella flexneri 2a str. 2457T
accgaucgccagcaggg

SEQ ID NO: 1923395 - RNA, 20 nt, Shigella flexneri 2a str. 2457T
accgcaaaugauuagugcca

SEQ ID NO: 1923396 - RNA, 13 nt, Shigella flexneri 2a str. 2457T
accgcaccgcccg

SEQ ID NO: 1923397 - RNA, 14 nt, Shigella flexneri 2a str. 2457T
accgcaccgcccgu

SEQ ID NO: 1923398 - RNA, 14 nt, Shigella flexneri 2a str. 2457T
accgcaucggcauc

SEQ ID NO: 1923399 - RNA, 16 nt, Shigella flexneri 2a str. 2457T
accgcagugaaauuuc

SEQ ID NO: 1923400 - RNA, 21 nt, Shigella flexneri 2a str. 2457T
accgcaucacgacagcaccac

SEQ ID NO: 1923401 - RNA, 13 nt, Shigella flexneri 2a str. 2457T
accgcaucggcau

SEQ ID NO: 1923402 - RNA, 19 nt, Shigella flexneri 2a str. 2457T
accgcauccgcuugcguau

SEQ ID NO: 1923403 - RNA, 19 nt, Shigella flexneri 2a str. 2457T
accgcauuggacagauuca

SEQ ID NO: 1923404 - RNA, 15 nt, Shigella flexneri 2a str. 2457T
accgcacgcaggcca

SEQ ID NO: 1923405 - RNA, 20 nt, Shigella flexneri 2a str. 2457T
accgcagaagcgauaaccuu

SEQ ID NO: 1923406 - RNA, 13 nt, Shigella flexneri 2a str. 2457T
accgcaggcuuuu

SEQ ID NO: 1923407 - RNA, 16 nt, Shigella flexneri 2a str. 2457T
accgcagccgccacaa

SEQ ID NO: 1923408 - RNA, 15 nt, Shigella flexneri 2a str. 2457T
accgccagugcagcg

SEQ ID NO: 1923409 - RNA, 19 nt, Shigella flexneri 2a str. 2457T
accgccauuaaacgcagua

SEQ ID NO: 1923410 - RNA, 15 nt, Shigella flexneri 2a str. 2457T
accgccaucauggau

SEQ ID NO: 1923411 - RNA, 16 nt, Shigella flexneri 2a str. 2457T
accgccauauuuaaag

SEQ ID NO: 1923412 - RNA, 17 nt, Shigella flexneri 2a str. 2457T
accgccacuaccaucag

SEQ ID NO: 1923413 - RNA, 16 nt, Shigella flexneri 2a str. 2457T
accgccacagcagccu

SEQ ID NO: 1923414 - RNA, 13 nt, Shigella flexneri 2a str. 2457T
accgccagcaagg

SEQ ID NO: 1923415 - RNA, 14 nt, Shigella flexneri 2a str. 2457T
accgccccugcgcu

SEQ ID NO: 1923416 - RNA, 18 nt, Shigella flexneri 2a str. 2457T
accgcccagaccugcguu

SEQ ID NO: 1923417 - RNA, 20 nt, Shigella flexneri 2a str. 2457T
accgcccagugccagcacca

SEQ ID NO: 1923418 - RNA, 17 nt, Shigella flexneri 2a str. 2457T
acgccaagaaacaccag

SEQ ID NO: 1923419 - RNA, 15 nt, Shigella flexneri 2a str. 2457T
acgccaaauucuuua

SEQ ID NO: 1923420 - RNA, 16 nt, Shigella flexneri 2a str. 2457T
acgccacgacucaaau

SEQ ID NO: 1923421 - RNA, 20 nt, Shigella flexneri 2a str. 2457T
acgccaccuuucucggcauc

SEQ ID NO: 1923422 - RNA, 14 nt, Shigella flexneri 2a str. 2457T
acgccacagcaauu

SEQ ID NO: 1923423 - RNA, 22 nt, Shigella flexneri 2a str. 2457T
acgccagucacggugcagcucg

SEQ ID NO: 1923424 - RNA, 19 nt, Shigella flexneri 2a str. 2457T
acgccagcgcuuuuggcgc

SEQ ID NO: 1923425 - RNA, 17 nt, Shigella flexneri 2a str. 2457T
acgccagaacagcuaca

SEQ ID NO: 1923426 - RNA, 12 nt, Shigella flexneri 2a str. 2457T
acgcaugcacau

SEQ ID NO: 1923427 - RNA, 18 nt, Shigella flexneri 2a str. 2457T
acgcauugcucacuuccu

SEQ ID NO: 1923428 - RNA, 21 nt, Shigella flexneri 2a str. 2457T
acgcauucucuuuucacgcaa

SEQ ID NO: 1923429 - RNA, 18 nt, Shigella flexneri 2a str. 2457T
acgcaucggcuaaaccau

SEQ ID NO: 1923430 - RNA, 16 nt, Shigella flexneri 2a str. 2457T
acgcaucgccaaacag

SEQ ID NO: 1923431 - RNA, 15 nt, Shigella flexneri 2a str. 2457T
acgcaucgcccgguu

SEQ ID NO: 1923432 - RNA, 21 nt, Shigella flexneri 2a str. 2457T
acgcauacucuuugacaacau

SEQ ID NO: 1923433 - RNA, 22 nt, Shigella flexneri 2a str. 2457T
acgcauacucuuugacaacauc

SEQ ID NO: 1923434 - RNA, 16 nt, Shigella flexneri 2a str. 2457T
acgcauaccagucuau

SEQ ID NO: 1923435 - RNA, 13 nt, Shigella flexneri 2a str. 2457T
acgcauaaaacca

SEQ ID NO: 1923436 - RNA, 22 nt, Shigella flexneri 2a str. 2457T
acgcaguggguaaugcugugaa

SEQ ID NO: 1923437 - RNA, 16 nt, Shigella flexneri 2a str. 2457T
acgcagugguuaacaa

SEQ ID NO: 1923438 - RNA, 23 nt, Shigella flexneri 2a str. 2457T
acgcagugguuaacaaucacaau

SEQ ID NO: 1923439 - RNA, 17 nt, Shigella flexneri 2a str. 2457T
acgcacgcgggugccug

SEQ ID NO: 1923440 - RNA, 17 nt, Shigella flexneri 2a str. 2457T
acgcaccgccaccaccg

SEQ ID NO: 1923441 - RNA, 23 nt, Shigella flexneri 2a str. 2457T
acgcaauuccagcaagccacugg

SEQ ID NO: 1923442 - RNA, 22 nt, Shigella flexneri 2a str. 2457T
acgcacacaugcgauaaagcau

SEQ ID NO: 1923443 - RNA, 20 nt, Shigella flexneri 2a str. 2457T
acgcacagcccgccgccauc

SEQ ID NO: 1923444 - RNA, 18 nt, Shigella flexneri 2a str. 2457T
acgcaagcggcauccagg

SEQ ID NO: 1923445 - RNA, 16 nt, Shigella flexneri 2a str. 2457T
acgcaauaauggacaa

SEQ ID NO: 1923446 - RNA, 15 nt, Shigella flexneri 2a str. 2457T
acgcaaucaaaaaag

SEQ ID NO: 1923447 - RNA, 15 nt, Shigella flexneri 2a str. 2457T
acgcaacuuccccuc

SEQ ID NO: 1923448 - RNA, 22 nt, Shigella flexneri 2a str. 2457T
acgcaacugccaguaaagcagc

SEQ ID NO: 1923449 - RNA, 18 nt, Shigella flexneri 2a str. 2457T
acgcaacugguccagccc

SEQ ID NO: 1923450 - RNA, 22 nt, Shigella flexneri 2a str. 2457T
acgcaaccacaacgcacuggcg

SEQ ID NO: 1923451 - RNA, 19 nt, Shigella flexneri 2a str. 2457T
acgcaacaucgcaauccuu

SEQ ID NO: 1923452 - RNA, 16 nt, Shigella flexneri 2a str. 2457T
acgcaggcgagaauca

SEQ ID NO: 1923453 - RNA, 20 nt, Shigella flexneri 2a str. 2457T
acgcagccgggucagcgggg

SEQ ID NO: 1923454 - RNA, 21 nt, Shigella flexneri 2a str. 2457T
acgcagcauuggguaaaaugg

SEQ ID NO: 1923455 - RNA, 18 nt, Shigella flexneri 2a str. 2457T
acgcagcgguauaaucug

SEQ ID NO: 1923456 - RNA, 21 nt, Shigella flexneri 2a str. 2457T
acgcagcgguauaaucugcac

SEQ ID NO: 1923457 - RNA, 15 nt, Shigella flexneri 2a str. 2457T
acgcagcucacuucg

SEQ ID NO: 1923458 - RNA, 23 nt, Shigella flexneri 2a str. 2457T
acgcagacacugcugauaaucca

SEQ ID NO: 1923459 - RNA, 18 nt, Shigella flexneri 2a str. 2457T
acgcagagacaucaccaa

SEQ ID NO: 1923460 - RNA, 23 nt, Shigella flexneri 2a str. 2457T
acgcacuggcgagcgccagcaug

SEQ ID NO: 1923461 - RNA, 16 nt, Shigella flexneri 2a str. 2457T
acgcacuucuuccggg

SEQ ID NO: 1923462 - RNA, 12 nt, Shigella flexneri 2a str. 2457T
acgcagaacuga

SEQ ID NO: 1923463 - RNA, 21 nt, Shigella flexneri 2a str. 2457T
acgcagaccaaagucaaacug

SEQ ID NO: 1923464 - RNA, 16 nt, Shigella flexneri 2a str. 2457T
acgcagaaucucugcg

SEQ ID NO: 1923465 - RNA, 13 nt, Shigella flexneri 2a str. 2457T
acgauaauucagc

SEQ ID NO: 1923466 - RNA, 18 nt, Shigella flexneri 2a str. 2457T
acgagucaacgcuucagc

SEQ ID NO: 1923467 - RNA, 18 nt, Shigella flexneri 2a str. 2457T
acgaggggagaccucacu

SEQ ID NO: 1923468 - RNA, 19 nt, Shigella flexneri 2a str. 2457T
acgagacgguuaaaaacag

SEQ ID NO: 1923469 - RNA, 23 nt, Shigella flexneri 2a str. 2457T
acgagacgguuaaaaacagccag

SEQ ID NO: 1923470 - RNA, 13 nt, Shigella flexneri 2a str. 2457T
acgagauaaaauu

SEQ ID NO: 1923471 - RNA, 13 nt, Shigella flexneri 2a str. 2457T
acgaggagacugc

SEQ ID NO: 1923472 - RNA, 14 nt, Shigella flexneri 2a str. 2457T
acgacuuuuuccau

SEQ ID NO: 1923473 - RNA, 15 nt, Shigella flexneri 2a str. 2457T
acgacuugaaaaagu

SEQ ID NO: 1923474 - RNA, 19 nt, Shigella flexneri 2a str. 2457T
acgagaauuucucgugcca

SEQ ID NO: 1923475 - RNA, 13 nt, Shigella flexneri 2a str. 2457T
acgaaguacucaa

SEQ ID NO: 1923476 - RNA, 19 nt, Shigella flexneri 2a str. 2457T
acgaugcuaaaaacaucau

SEQ ID NO: 1923477 - RNA, 14 nt, Shigella flexneri 2a str. 2457T
acgaugccagcacc

SEQ ID NO: 1923478 - RNA, 19 nt, Shigella flexneri 2a str. 2457T
acgaugccugaugcgacgc

SEQ ID NO: 1923479 - RNA, 13 nt, Shigella flexneri 2a str. 2457T
acgaugguuuuug

SEQ ID NO: 1923480 - RNA, 14 nt, Shigella flexneri 2a str. 2457T
acgauccaccaccg

SEQ ID NO: 1923481 - RNA, 19 nt, Shigella flexneri 2a str. 2457T
acgaucgauaaccaucuuc

SEQ ID NO: 1923482 - RNA, 19 nt, Shigella flexneri 2a str. 2457T
acgauccuucaaacguuuu

SEQ ID NO: 1923483 - RNA, 16 nt, Shigella flexneri 2a str. 2457T
acgaucgcuuucaacg

SEQ ID NO: 1923484 - RNA, 21 nt, Shigella flexneri 2a str. 2457T
acgaugaccgcaucaaugacc

SEQ ID NO: 1923485 - RNA, 17 nt, Shigella flexneri 2a str. 2457T
acgaugaaagaaaaaac

SEQ ID NO: 1923486 - RNA, 15 nt, Shigella flexneri 2a str. 2457T
acgauguuugcugcg

SEQ ID NO: 1923487 - RNA, 19 nt, Shigella flexneri 2a str. 2457T
acgauuaacgcuucuccca

SEQ ID NO: 1923488 - RNA, 13 nt, Shigella flexneri 2a str. 2457T
acgauuaauuaca

SEQ ID NO: 1923489 - RNA, 17 nt, Shigella flexneri 2a str. 2457T
acgcaaaguagcggccu

SEQ ID NO: 1923490 - RNA, 19 nt, Shigella flexneri 2a str. 2457T
acgcaaagagagaagccag

SEQ ID NO: 1923491 - RNA, 15 nt, Shigella flexneri 2a str. 2457T
acgcaaacuucgguu

SEQ ID NO: 1923492 - RNA, 16 nt, Shigella flexneri 2a str. 2457T
acgcaaaacugccuga

SEQ ID NO: 1923493 - RNA, 13 nt, Shigella flexneri 2a str. 2457T
acgcaaacaccag

SEQ ID NO: 1923494 - RNA, 14 nt, Shigella flexneri 2a str. 2457T
acgcaaacgugggg

SEQ ID NO: 1923495 - RNA, 18 nt, Shigella flexneri 2a str. 2457T
accugggcgaugcuggca

SEQ ID NO: 1923496 - RNA, 20 nt, Shigella flexneri 2a str. 2457T
accugggcgaugcuggcaga

SEQ ID NO: 1923497 - RNA, 15 nt, Shigella flexneri 2a str. 2457T
accugauccagcucu

SEQ ID NO: 1923498 - RNA, 20 nt, Shigella flexneri 2a str. 2457T
accugauccagcucuucuuc

SEQ ID NO: 1923499 - RNA, 23 nt, Shigella flexneri 2a str. 2457T
accugagcuugauccuacacaua

SEQ ID NO: 1923500 - RNA, 18 nt, Shigella flexneri 2a str. 2457T
accuguuccaguggcuga

SEQ ID NO: 1923501 - RNA, 17 nt, Shigella flexneri 2a str. 2457T
accuggugcagcggcuc

SEQ ID NO: 1923502 - RNA, 13 nt, Shigella flexneri 2a str. 2457T
accuguucuccug

SEQ ID NO: 1923503 - RNA, 12 nt, Shigella flexneri 2a str. 2457T
accuguuuucac

SEQ ID NO: 1923504 - RNA, 17 nt, Shigella flexneri 2a str. 2457T
accuguugaaauuauug

SEQ ID NO: 1923505 - RNA, 23 nt, Shigella flexneri 2a str. 2457T
accuuacuuccgguuacgccacc

SEQ ID NO: 1923506 - RNA, 17 nt, Shigella flexneri 2a str. 2457T
accuuacggcacuccuc

SEQ ID NO: 1923507 - RNA, 20 nt, Shigella flexneri 2a str. 2457T
accuuacggcacuccucuuc

SEQ ID NO: 1923508 - RNA, 21 nt, Shigella flexneri 2a str. 2457T
accuuaaucagaauuuuucgc

SEQ ID NO: 1923509 - RNA, 20 nt, Shigella flexneri 2a str. 2457T
accuuaccuguguuuugcau

SEQ ID NO: 1923510 - RNA, 17 nt, Shigella flexneri 2a str. 2457T
accuuaugagucagaau

SEQ ID NO: 1923511 - RNA, 15 nt, Shigella flexneri 2a str. 2457T
accuuaucgacaugc

SEQ ID NO: 1923512 - RNA, 17 nt, Shigella flexneri 2a str. 2457T
accuucggauugcccug

SEQ ID NO: 1923513 - RNA, 19 nt, Shigella flexneri 2a str. 2457T
accuucgccgcccagccag

SEQ ID NO: 1923514 - RNA, 20 nt, Shigella flexneri 2a str. 2457T
accuucgccgcccagccagc

SEQ ID NO: 1923515 - RNA, 23 nt, Shigella flexneri 2a str. 2457T
accuucgccucccguuuauuuac

SEQ ID NO: 1923516 - RNA, 19 nt, Shigella flexneri 2a str. 2457T
accuugcggaaacugucaa

SEQ ID NO: 1923517 - RNA, 16 nt, Shigella flexneri 2a str. 2457T
accuugcggaaacugu

SEQ ID NO: 1923518 - RNA, 15 nt, Shigella flexneri 2a str. 2457T
accuugcuuauccuc

SEQ ID NO: 1923519 - RNA, 21 nt, Shigella flexneri 2a str. 2457T
accuugcgguggugcuugcuc

SEQ ID NO: 1923520 - RNA, 18 nt, Shigella flexneri 2a str. 2457T
accuuuaaucaggcuggu

SEQ ID NO: 1923521 - RNA, 18 nt, Shigella flexneri 2a str. 2457T
acgaaccgucccucgccc

SEQ ID NO: 1923522 - RNA, 17 nt, Shigella flexneri 2a str. 2457T
acgaacagcgauugcuu

SEQ ID NO: 1923523 - RNA, 12 nt, Shigella flexneri 2a str. 2457T
acgaaccagaga

SEQ ID NO: 1923524 - RNA, 16 nt, Shigella flexneri 2a str. 2457T
accuuucagaacggca

SEQ ID NO: 1923525 - RNA, 18 nt, Shigella flexneri 2a str. 2457T
acgaaaaaaauuacucau

SEQ ID NO: 1923526 - RNA, 14 nt, Shigella flexneri 2a str. 2457T
acgaaaaaucaaua

SEQ ID NO: 1923527 - RNA, 23 nt, Shigella flexneri 2a str. 2457T
accucaguacccgcguucuggau

SEQ ID NO: 1923528 - RNA, 15 nt, Shigella flexneri 2a str. 2457T
accucaggcaccuuc

SEQ ID NO: 1923529 - RNA, 22 nt, Shigella flexneri 2a str. 2457T
accucacuuucuggcagcugcg

SEQ ID NO: 1923530 - RNA, 12 nt, Shigella flexneri 2a str. 2457T
accucagcaagu

SEQ ID NO: 1923531 - RNA, 22 nt, Shigella flexneri 2a str. 2457T
accuaugccgaucaauuucaca

SEQ ID NO: 1923532 - RNA, 21 nt, Shigella flexneri 2a str. 2457T
accucaccgggcuuggcacca

SEQ ID NO: 1923533 - RNA, 22 nt, Shigella flexneri 2a str. 2457T
accucaccgggcuuggcaccau

SEQ ID NO: 1923534 - RNA, 17 nt, Shigella flexneri 2a str. 2457T
accucaucaccacagac

SEQ ID NO: 1923535 - RNA, 23 nt, Shigella flexneri 2a str. 2457T
accucccgucgcccacaccagau

SEQ ID NO: 1923536 - RNA, 15 nt, Shigella flexneri 2a str. 2457T
accucgagaucauca

SEQ ID NO: 1923537 - RNA, 17 nt, Shigella flexneri 2a str. 2457T
accggggacaggcgggc

SEQ ID NO: 1923538 - RNA, 17 nt, Shigella flexneri 2a str. 2457T
accgggcguccugcuug

SEQ ID NO: 1923539 - RNA, 21 nt, Shigella flexneri 2a str. 2457T
accuagcaaacuaucugugua

SEQ ID NO: 1923540 - RNA, 15 nt, Shigella flexneri 2a str. 2457T
accuagcacuguaaa

SEQ ID NO: 1923541 - RNA, 12 nt, Shigella flexneri 2a str. 2457T
accuauaaaaga

SEQ ID NO: 1923542 - RNA, 21 nt, Shigella flexneri 2a str. 2457T
accucuggcgaauagaaagca

SEQ ID NO: 1923543 - RNA, 11 nt, Shigella flexneri 2a str. 2457T
accucuuccag

SEQ ID NO: 1923544 - RNA, 13 nt, Shigella flexneri 2a str. 2457T
accucuuucuaga

SEQ ID NO: 1923545 - RNA, 11 nt, Shigella flexneri 2a str. 2457T
accugaacucg

SEQ ID NO: 1923546 - RNA, 13 nt, Shigella flexneri 2a str. 2457T
accugaccgcgag

SEQ ID NO: 1923547 - RNA, 14 nt, Shigella flexneri 2a str. 2457T
accugacauuaagu

SEQ ID NO: 1923548 - RNA, 13 nt, Shigella flexneri 2a str. 2457T
accucguccuguu

SEQ ID NO: 1923549 - RNA, 17 nt, Shigella flexneri 2a str. 2457T
accucgcccauuuuuca

SEQ ID NO: 1923550 - RNA, 19 nt, Shigella flexneri 2a str. 2457T
accucgcccauuuuucaug

SEQ ID NO: 1923551 - RNA, 19 nt, Shigella flexneri 2a str. 2457T
accucgccccgugaugaac

SEQ ID NO: 1923552 - RNA, 23 nt, Shigella flexneri 2a str. 2457T
accucgccccgugaugaacugcg

SEQ ID NO: 1923553 - RNA, 15 nt, Shigella flexneri 2a str. 2457T
acggcggagucauuc

SEQ ID NO: 1923554 - RNA, 16 nt, Shigella flexneri 2a str. 2457T
acggcggaaagggccg

SEQ ID NO: 1923555 - RNA, 23 nt, Shigella flexneri 2a str. 2457T
acggcgcuuuuuuugugccugaa

SEQ ID NO: 1923556 - RNA, 14 nt, Shigella flexneri 2a str. 2457T
acggcuaaagccgu

SEQ ID NO: 1923557 - RNA, 22 nt, Shigella flexneri 2a str. 2457T
acggcuaaaaaaagccgccauc

SEQ ID NO: 1923558 - RNA, 20 nt, Shigella flexneri 2a str. 2457T
acggcguuaacuguacaggc

SEQ ID NO: 1923559 - RNA, 19 nt, Shigella flexneri 2a str. 2457T
acggcgcuaaaaagcgccg

SEQ ID NO: 1923560 - RNA, 21 nt, Shigella flexneri 2a str. 2457T
acggcaauuuuaccuagcacu

SEQ ID NO: 1923561 - RNA, 19 nt, Shigella flexneri 2a str. 2457T
acggcaauucccagaaugu

SEQ ID NO: 1923562 - RNA, 22 nt, Shigella flexneri 2a str. 2457T
acggcaauucccagaauguuaa

SEQ ID NO: 1923563 - RNA, 16 nt, Shigella flexneri 2a str. 2457T
acggcugcuaauauuu

SEQ ID NO: 1923564 - RNA, 18 nt, Shigella flexneri 2a str. 2457T
acggcugcuucggucagc

SEQ ID NO: 1923565 - RNA, 19 nt, Shigella flexneri 2a str. 2457T
acggcugggaaaucaccac

SEQ ID NO: 1923566 - RNA, 17 nt, Shigella flexneri 2a str. 2457T
acggcugggaaaucacc

SEQ ID NO: 1923567 - RNA, 18 nt, Shigella flexneri 2a str. 2457T
acgggaaacucugcuggc

SEQ ID NO: 1923568 - RNA, 15 nt, Shigella flexneri 2a str. 2457T
acggcuuguggugaa

SEQ ID NO: 1923569 - RNA, 15 nt, Shigella flexneri 2a str. 2457T
acgggccauccauca

SEQ ID NO: 1923570 - RNA, 22 nt, Shigella flexneri 2a str. 2457T
acgggcgcgagguaacaucccu

SEQ ID NO: 1923571 - RNA, 20 nt, Shigella flexneri 2a str. 2457T
acgggcgauggaaccacaug

SEQ ID NO: 1923572 - RNA, 17 nt, Shigella flexneri 2a str. 2457T
acgggcugauuucaccc

SEQ ID NO: 1923573 - RNA, 18 nt, Shigella flexneri 2a str. 2457T
acgguaaguucacgcagg

SEQ ID NO: 1923574 - RNA, 17 nt, Shigella flexneri 2a str. 2457T
acguaaguacugauuga

SEQ ID NO: 1923575 - RNA, 20 nt, Shigella flexneri 2a str. 2457T
acguaauuauaugccagccc

SEQ ID NO: 1923576 - RNA, 17 nt, Shigella flexneri 2a str. 2457T
acguaauggaugcccgc

SEQ ID NO: 1923577 - RNA, 22 nt, Shigella flexneri 2a str. 2457T
acguaauuuauaaucuuuaaaa

SEQ ID NO: 1923578 - RNA, 14 nt, Shigella flexneri 2a str. 2457T
acguaccaacugau

SEQ ID NO: 1923579 - RNA, 17 nt, Shigella flexneri 2a str. 2457T
acguaacgaccaccacc

SEQ ID NO: 1923580 - RNA, 15 nt, Shigella flexneri 2a str. 2457T
acguaacaaaacuca

SEQ ID NO: 1923581 - RNA, 15 nt, Shigella flexneri 2a str. 2457T
acguaaacgcagcau

SEQ ID NO: 1923582 - RNA, 13 nt, Shigella flexneri 2a str. 2457T
acgguuucagugg

SEQ ID NO: 1923583 - RNA, 14 nt, Shigella flexneri 2a str. 2457T
acgguuucagcagc

SEQ ID NO: 1923584 - RNA, 17 nt, Shigella flexneri 2a str. 2457T
acgguuuuuugaacaga

SEQ ID NO: 1923585 - RNA, 14 nt, Shigella flexneri 2a str. 2457T
acguaaaaaacacu

SEQ ID NO: 1923586 - RNA, 13 nt, Shigella flexneri 2a str. 2457T
acgcuuucuuugg

SEQ ID NO: 1923587 - RNA, 14 nt, Shigella flexneri 2a str. 2457T
acgcuuucacccgg

SEQ ID NO: 1923588 - RNA, 22 nt, Shigella flexneri 2a str. 2457T
acgcuuucaacaaccuugcguu

SEQ ID NO: 1923589 - RNA, 16 nt, Shigella flexneri 2a str. 2457T
acgcuuugcaggcugg

SEQ ID NO: 1923590 - RNA, 20 nt, Shigella flexneri 2a str. 2457T
acgcuugauucuguucagua

SEQ ID NO: 1923591 - RNA, 16 nt, Shigella flexneri 2a str. 2457T
acgcuugaagcacacg

SEQ ID NO: 1923592 - RNA, 16 nt, Shigella flexneri 2a str. 2457T
acggaaugauauuggu

SEQ ID NO: 1923593 - RNA, 15 nt, Shigella flexneri 2a str. 2457T
acggaauaaccagcg

SEQ ID NO: 1923594 - RNA, 14 nt, Shigella flexneri 2a str. 2457T
acggaauaaaccca

SEQ ID NO: 1923595 - RNA, 19 nt, Shigella flexneri 2a str. 2457T
acggaagacguucaguuca

SEQ ID NO: 1923596 - RNA, 19 nt, Shigella flexneri 2a str. 2457T
acgcuuuuucccugguaaa

SEQ ID NO: 1923597 - RNA, 14 nt, Shigella flexneri 2a str. 2457T
acggaaagcagcau

SEQ ID NO: 1923598 - RNA, 23 nt, Shigella flexneri 2a str. 2457T
acggacguccggugauaucggcc

SEQ ID NO: 1923599 - RNA, 14 nt, Shigella flexneri 2a str. 2457T
acggacuuccagcg

SEQ ID NO: 1923600 - RNA, 15 nt, Shigella flexneri 2a str. 2457T
acggacuuccagcgg

SEQ ID NO: 1923601 - RNA, 15 nt, Shigella flexneri 2a str. 2457T
acggacgcgcggcga

SEQ ID NO: 1923602 - RNA, 15 nt, Shigella flexneri 2a str. 2457T
acggacacuccuucc

SEQ ID NO: 1923603 - RNA, 13 nt, Shigella flexneri 2a str. 2457T
acggaccaauaaa

SEQ ID NO: 1923604 - RNA, 11 nt, Shigella flexneri 2a str. 2457T
acggacaugaa

SEQ ID NO: 1923605 - RNA, 13 nt, Shigella flexneri 2a str. 2457T
acggaugcgaaug

SEQ ID NO: 1923606 - RNA, 22 nt, Shigella flexneri 2a str. 2457T
acggauugcuuguucgaugccu

SEQ ID NO: 1923607 - RNA, 20 nt, Shigella flexneri 2a str. 2457T
acggaucaggcggcucaccu

SEQ ID NO: 1923608 - RNA, 15 nt, Shigella flexneri 2a str. 2457T
acggauaugauuuaa

SEQ ID NO: 1923609 - RNA, 21 nt, Shigella flexneri 2a str. 2457T
acgcuguucaucccgaccaau

SEQ ID NO: 1923610 - RNA, 18 nt, Shigella flexneri 2a str. 2457T
acgcugucuuuugaucaa

SEQ ID NO: 1923611 - RNA, 13 nt, Shigella flexneri 2a str. 2457T
acgcugucggcac

SEQ ID NO: 1923612 - RNA, 23 nt, Shigella flexneri 2a str. 2457T
acgcugaauacgcaccgcuccau

SEQ ID NO: 1923613 - RNA, 19 nt, Shigella flexneri 2a str. 2457T
acgcugaauacgcaccgcu

SEQ ID NO: 1923614 - RNA, 22 nt, Shigella flexneri 2a str. 2457T
acgcugcaucgccaaucugcug

SEQ ID NO: 1923615 - RNA, 22 nt, Shigella flexneri 2a str. 2457T
acgcugcauggcaacuuuaaua

SEQ ID NO: 1923616 - RNA, 23 nt, Shigella flexneri 2a str. 2457T
acgcugcaaggcucuauacgcau

SEQ ID NO: 1923617 - RNA, 19 nt, Shigella flexneri 2a str. 2457T
acgcugaugucagcacuuc

SEQ ID NO: 1923618 - RNA, 13 nt, Shigella flexneri 2a str. 2457T
acgcugauugcau

SEQ ID NO: 1923619 - RNA, 22 nt, Shigella flexneri 2a str. 2457T
acgcugaaaagcgucucuuuuc

SEQ ID NO: 1923620 - RNA, 17 nt, Shigella flexneri 2a str. 2457T
acgcucuguucugcgcu

SEQ ID NO: 1923621 - RNA, 22 nt, Shigella flexneri 2a str. 2457T
acgcucuguucugcgcuugguu

SEQ ID NO: 1923622 - RNA, 15 nt, Shigella flexneri 2a str. 2457T
acgcucaggguuuuc

SEQ ID NO: 1923623 - RNA, 18 nt, Shigella flexneri 2a str. 2457T
acgcucaggcuacuuuuc

SEQ ID NO: 1923624 - RNA, 21 nt, Shigella flexneri 2a str. 2457T
acgcucaauauuugcaccuaa

SEQ ID NO: 1923625 - RNA, 17 nt, Shigella flexneri 2a str. 2457T
acgccaucgccagcagc

SEQ ID NO: 1923626 - RNA, 18 nt, Shigella flexneri 2a str. 2457T
acgcuaccaaaaaaucaa

SEQ ID NO: 1923627 - RNA, 16 nt, Shigella flexneri 2a str. 2457T
acgccaucaucggcaa

SEQ ID NO: 1923628 - RNA, 16 nt, Shigella flexneri 2a str. 2457T
acuaaaacuuuauuca

SEQ ID NO: 1923629 - RNA, 13 nt, Shigella flexneri 2a str. 2457T
acguuuugcugau

SEQ ID NO: 1923630 - RNA, 14 nt, Shigella flexneri 2a str. 2457T
acguuuuuacguuc

SEQ ID NO: 1923631 - RNA, 17 nt, Shigella flexneri 2a str. 2457T
acuaaacccgaccacuu

SEQ ID NO: 1923632 - RNA, 20 nt, Shigella flexneri 2a str. 2457T
acuaaacccgaccacuucca

SEQ ID NO: 1923633 - RNA, 19 nt, Shigella flexneri 2a str. 2457T
acguugucagcaaccugcu

SEQ ID NO: 1923634 - RNA, 17 nt, Shigella flexneri 2a str. 2457T
acguuggcgcauaacuc

SEQ ID NO: 1923635 - RNA, 18 nt, Shigella flexneri 2a str. 2457T
acguugcguugcagcagg

SEQ ID NO: 1923636 - RNA, 21 nt, Shigella flexneri 2a str. 2457T
acguugcuguugguucagugg

SEQ ID NO: 1923637 - RNA, 20 nt, Shigella flexneri 2a str. 2457T
acguuuccacggauaacaaa

SEQ ID NO: 1923638 - RNA, 16 nt, Shigella flexneri 2a str. 2457T
acguuucuggugugca

SEQ ID NO: 1923639 - RNA, 14 nt, Shigella flexneri 2a str. 2457T
acguuuacuucgcu

SEQ ID NO: 1923640 - RNA, 17 nt, Shigella flexneri 2a str. 2457T
acguuuaacacgcucug

SEQ ID NO: 1923641 - RNA, 22 nt, Shigella flexneri 2a str. 2457T
acguuguuccuuccagcuggcu

SEQ ID NO: 1923642 - RNA, 19 nt, Shigella flexneri 2a str. 2457T
acguuucaaccugcacauc

SEQ ID NO: 1923643 - RNA, 14 nt, Shigella flexneri 2a str. 2457T
acguuuauuauaga

SEQ ID NO: 1923644 - RNA, 17 nt, Shigella flexneri 2a str. 2457T
acguuucaaacaggcug

SEQ ID NO: 1923645 - RNA, 22 nt, Shigella flexneri 2a str. 2457T
acgugcguaccauuaucaccaa

SEQ ID NO: 1923646 - RNA, 22 nt, Shigella flexneri 2a str. 2457T
acguuacucuaaagaguucaaa

SEQ ID NO: 1923647 - RNA, 16 nt, Shigella flexneri 2a str. 2457T
acguuagcccuuugua

SEQ ID NO: 1923648 - RNA, 14 nt, Shigella flexneri 2a str. 2457T
acguuagaaacaaa

SEQ ID NO: 1923649 - RNA, 21 nt, Shigella flexneri 2a str. 2457T
acguuaugcaccgacaauccg

SEQ ID NO: 1923650 - RNA, 17 nt, Shigella flexneri 2a str. 2457T
acguucuuccuguggau

SEQ ID NO: 1923651 - RNA, 22 nt, Shigella flexneri 2a str. 2457T
acguugagagguaaaaccugac

SEQ ID NO: 1923652 - RNA, 13 nt, Shigella flexneri 2a str. 2457T
acguucagcgcaa

SEQ ID NO: 1923653 - RNA, 16 nt, Shigella flexneri 2a str. 2457T
acguucacccaucacu

SEQ ID NO: 1923654 - RNA, 20 nt, Shigella flexneri 2a str. 2457T
acguucugaucuuucuucag

SEQ ID NO: 1923655 - RNA, 13 nt, Shigella flexneri 2a str. 2457T
acgugacagcaua

SEQ ID NO: 1923656 - RNA, 14 nt, Shigella flexneri 2a str. 2457T
acgugacauucuga

SEQ ID NO: 1923657 - RNA, 15 nt, Shigella flexneri 2a str. 2457T
acgucuuaauguaau

SEQ ID NO: 1923658 - RNA, 15 nt, Shigella flexneri 2a str. 2457T
acguagcuauauuuu

SEQ ID NO: 1923659 - RNA, 22 nt, Shigella flexneri 2a str. 2457T
acguagcaauucggauguuagu

SEQ ID NO: 1923660 - RNA, 24 nt, Shigella flexneri 2a str. 2457T
acguagugaaaucgccaacaaucu

SEQ ID NO: 1923661 - RNA, 22 nt, Shigella flexneri 2a str. 2457T
acguaguugcccuuuucaccau

SEQ ID NO: 1923662 - RNA, 15 nt, Shigella flexneri 2a str. 2457T
acuauuucaauauga

SEQ ID NO: 1923663 - RNA, 19 nt, Shigella flexneri 2a str. 2457T
acuauauucucaaaauaca

SEQ ID NO: 1923664 - RNA, 14 nt, Shigella flexneri 2a str. 2457T
acuaccggaaccca

SEQ ID NO: 1923665 - RNA, 20 nt, Shigella flexneri 2a str. 2457T
acuaccauuuguucuuuuuu

SEQ ID NO: 1923666 - RNA, 23 nt, Shigella flexneri 2a str. 2457T
acuacccgcauuuucuucauucg

SEQ ID NO: 1923667 - RNA, 15 nt, Shigella flexneri 2a str. 2457T
acuaccauccgaguu

SEQ ID NO: 1923668 - RNA, 17 nt, Shigella flexneri 2a str. 2457T
acuacaggacaucuuga

SEQ ID NO: 1923669 - RNA, 23 nt, Shigella flexneri 2a str. 2457T
acuaauccguaaaguuaccugug

SEQ ID NO: 1923670 - RNA, 16 nt, Shigella flexneri 2a str. 2457T
acuacaaauccaacac

SEQ ID NO: 1923671 - RNA, 19 nt, Shigella flexneri 2a str. 2457T
acuacaaauccaacaccag

SEQ ID NO: 1923672 - RNA, 23 nt, Shigella flexneri 2a str. 2457T
acuaacuucugaucuacagccuu

SEQ ID NO: 1923673 - RNA, 17 nt, Shigella flexneri 2a str. 2457T
acuaaggcgaacauaag

SEQ ID NO: 1923674 - RNA, 15 nt, Shigella flexneri 2a str. 2457T
acuaaaugcugcagc

SEQ ID NO: 1923675 - RNA, 16 nt, Shigella flexneri 2a str. 2457T
acuuaauuauuaacaa

SEQ ID NO: 1923676 - RNA, 22 nt, Shigella flexneri 2a str. 2457T
acuuaaccccagaccaaucccg

SEQ ID NO: 1923677 - RNA, 12 nt, Shigella flexneri 2a str. 2457T
acuuacacauca

SEQ ID NO: 1923678 - RNA, 20 nt, Shigella flexneri 2a str. 2457T
acuuacugauaguguuuuau

SEQ ID NO: 1923679 - RNA, 14 nt, Shigella flexneri 2a str. 2457T
acuuaccuucacga

SEQ ID NO: 1923680 - RNA, 15 nt, Shigella flexneri 2a str. 2457T
acuuaaauaaugcuu

SEQ ID NO: 1923681 - RNA, 15 nt, Shigella flexneri 2a str. 2457T
acuuaacaggaucug

SEQ ID NO: 1923682 - RNA, 18 nt, Shigella flexneri 2a str. 2457T
acuggcagccaggcgcga

SEQ ID NO: 1923683 - RNA, 18 nt, Shigella flexneri 2a str. 2457T
acugucgucgcuuucacu

SEQ ID NO: 1923684 - RNA, 22 nt, Shigella flexneri 2a str. 2457T
acugucugcucggaaauauuca

SEQ ID NO: 1923685 - RNA, 18 nt, Shigella flexneri 2a str. 2457T
acugucugcuucugccug

SEQ ID NO: 1923686 - RNA, 16 nt, Shigella flexneri 2a str. 2457T
acugucuaauggugaa

SEQ ID NO: 1923687 - RNA, 23 nt, Shigella flexneri 2a str. 2457T
acugucguuaaauccagauccug

SEQ ID NO: 1923688 - RNA, 17 nt, Shigella flexneri 2a str. 2457T
acuggcaaaaaccaauc

SEQ ID NO: 1923689 - RNA, 11 nt, Shigella flexneri 2a str. 2457T
acuggcaaaag

SEQ ID NO: 1923690 - RNA, 17 nt, Shigella flexneri 2a str. 2457T
acuggcagagaaagaaa

SEQ ID NO: 1923691 - RNA, 23 nt, Shigella flexneri 2a str. 2457T
acuggcaauagcggacacuacca

SEQ ID NO: 1923692 - RNA, 13 nt, Shigella flexneri 2a str. 2457T
acuggcaauccag

SEQ ID NO: 1923693 - RNA, 18 nt, Shigella flexneri 2a str. 2457T
acuggcaauccagcucuu

SEQ ID NO: 1923694 - RNA, 12 nt, Shigella flexneri 2a str. 2457T
acuggcaaugac

SEQ ID NO: 1923695 - RNA, 18 nt, Shigella flexneri 2a str. 2457T
acuggcaaugacgggcuu

SEQ ID NO: 1923696 - RNA, 20 nt, Shigella flexneri 2a str. 2457T
acugugcagguggaauaucc

SEQ ID NO: 1923697 - RNA, 23 nt, Shigella flexneri 2a str. 2457T
acugugcacccgcuucagugacu

SEQ ID NO: 1923698 - RNA, 13 nt, Shigella flexneri 2a str. 2457T
acugugcacccgc

SEQ ID NO: 1923699 - RNA, 21 nt, Shigella flexneri 2a str. 2457T
acugugcacccgcuucaguga

SEQ ID NO: 1923700 - RNA, 23 nt, Shigella flexneri 2a str. 2457T
acugugaaccucgaucagagugg

SEQ ID NO: 1923701 - RNA, 19 nt, Shigella flexneri 2a str. 2457T
acuuacugaugcacacacg

SEQ ID NO: 1923702 - RNA, 13 nt, Shigella flexneri 2a str. 2457T
acuuacuuuccuu

SEQ ID NO: 1923703 - RNA, 13 nt, Shigella flexneri 2a str. 2457T
acuuauuaaaauu

SEQ ID NO: 1923704 - RNA, 20 nt, Shigella flexneri 2a str. 2457T
acuuauucaaucucuucaca

SEQ ID NO: 1923705 - RNA, 15 nt, Shigella flexneri 2a str. 2457T
acuuaugcagcugcu

SEQ ID NO: 1923706 - RNA, 16 nt, Shigella flexneri 2a str. 2457T
acuuaugcucugcgau

SEQ ID NO: 1923707 - RNA, 20 nt, Shigella flexneri 2a str. 2457T
acuucacggcugcuaauauu

SEQ ID NO: 1923708 - RNA, 23 nt, Shigella flexneri 2a str. 2457T
acuucacggcugcuaauauuuuc

SEQ ID NO: 1923709 - RNA, 13 nt, Shigella flexneri 2a str. 2457T
acuucacuucuuc

SEQ ID NO: 1923710 - RNA, 16 nt, Shigella flexneri 2a str. 2457T
acuucagacggucagc

SEQ ID NO: 1923711 - RNA, 22 nt, Shigella flexneri 2a str. 2457T
acuucaacgcaagaacgugccg

SEQ ID NO: 1923712 - RNA, 13 nt, Shigella flexneri 2a str. 2457T
acuucaaccacau

SEQ ID NO: 1923713 - RNA, 14 nt, Shigella flexneri 2a str. 2457T
acuucaaccacauu

SEQ ID NO: 1923714 - RNA, 22 nt, Shigella flexneri 2a str. 2457T
acuucacaaucagcgcgauaaa

SEQ ID NO: 1923715 - RNA, 16 nt, Shigella flexneri 2a str. 2457T
acuucacaucaccaua

SEQ ID NO: 1923716 - RNA, 12 nt, Shigella flexneri 2a str. 2457T
acuucacacacu

SEQ ID NO: 1923717 - RNA, 16 nt, Shigella flexneri 2a str. 2457T
acuucacacacuuuua

SEQ ID NO: 1923718 - RNA, 22 nt, Shigella flexneri 2a str. 2457T
acuucuucguagcguuuuuuca

SEQ ID NO: 1923719 - RNA, 17 nt, Shigella flexneri 2a str. 2457T
acuucuucugucgggca

SEQ ID NO: 1923720 - RNA, 14 nt, Shigella flexneri 2a str. 2457T
acuucuucuucgcu

SEQ ID NO: 1923721 - RNA, 18 nt, Shigella flexneri 2a str. 2457T
acuucuucuucgcugcag

SEQ ID NO: 1923722 - RNA, 16 nt, Shigella flexneri 2a str. 2457T
acuucuucuuguucau

SEQ ID NO: 1923723 - RNA, 17 nt, Shigella flexneri 2a str. 2457T
acuugaacgcgagaaaa

SEQ ID NO: 1923724 - RNA, 13 nt, Shigella flexneri 2a str. 2457T
acuugaaaauuau

SEQ ID NO: 1923725 - RNA, 14 nt, Shigella flexneri 2a str. 2457T
acuucuuuuugaac

SEQ ID NO: 1923726 - RNA, 16 nt, Shigella flexneri 2a str. 2457T
acuucuauaaugagau

SEQ ID NO: 1923727 - RNA, 22 nt, Shigella flexneri 2a str. 2457T
acuucuuagucccaaacagcag

SEQ ID NO: 1923728 - RNA, 11 nt, Shigella flexneri 2a str. 2457T
acuucuucaca

SEQ ID NO: 1923729 - RNA, 22 nt, Shigella flexneri 2a str. 2457T
acuucuucacaccaucaaagaa

SEQ ID NO: 1923730 - RNA, 24 nt, Shigella flexneri 2a str. 2457T
acuucuuagucccaaacagcagaa

SEQ ID NO: 1923731 - RNA, 14 nt, Shigella flexneri 2a str. 2457T
acuuccaccacuuc

SEQ ID NO: 1923732 - RNA, 22 nt, Shigella flexneri 2a str. 2457T
acuucaucacuaccuucuuccc

SEQ ID NO: 1923733 - RNA, 13 nt, Shigella flexneri 2a str. 2457T
acuucaucagcaa

SEQ ID NO: 1923734 - RNA, 22 nt, Shigella flexneri 2a str. 2457T
acuucauccggauacagcccca

SEQ ID NO: 1923735 - RNA, 19 nt, Shigella flexneri 2a str. 2457T
acuucaucggaaugcaccg

SEQ ID NO: 1923736 - RNA, 23 nt, Shigella flexneri 2a str. 2457T
acuucaucggcggugaccagcag

SEQ ID NO: 1923737 - RNA, 22 nt, Shigella flexneri 2a str. 2457T
acuuccgacagaauauaaguca

SEQ ID NO: 1923738 - RNA, 14 nt, Shigella flexneri 2a str. 2457T
acuuccccucugcg

SEQ ID NO: 1923739 - RNA, 13 nt, Shigella flexneri 2a str. 2457T
acuuccccucugc

SEQ ID NO: 1923740 - RNA, 21 nt, Shigella flexneri 2a str. 2457T
acuuccguaccagccuugcca

SEQ ID NO: 1923741 - RNA, 21 nt, Shigella flexneri 2a str. 2457T
acuuccgggauuucccggcac

SEQ ID NO: 1923742 - RNA, 15 nt, Shigella flexneri 2a str. 2457T
acuuccugcggagca

SEQ ID NO: 1923743 - RNA, 21 nt, Shigella flexneri 2a str. 2457T
acuuccugcggagcaaccugc

SEQ ID NO: 1923744 - RNA, 16 nt, Shigella flexneri 2a str. 2457T
acuucgccaucugcca

SEQ ID NO: 1923745 - RNA, 18 nt, Shigella flexneri 2a str. 2457T
acuucgcugguguacugc

SEQ ID NO: 1923746 - RNA, 23 nt, Shigella flexneri 2a str. 2457T
acuucgcguucuguggcagggca

SEQ ID NO: 1923747 - RNA, 20 nt, Shigella flexneri 2a str. 2457T
acuucgcuaaaucuggugcu

SEQ ID NO: 1923748 - RNA, 17 nt, Shigella flexneri 2a str. 2457T
acucuucguucuucuuc

SEQ ID NO: 1923749 - RNA, 18 nt, Shigella flexneri 2a str. 2457T
acucugcugccacauucc

SEQ ID NO: 1923750 - RNA, 19 nt, Shigella flexneri 2a str. 2457T
acucuuagcaaacaggaua

SEQ ID NO: 1923751 - RNA, 18 nt, Shigella flexneri 2a str. 2457T
acucuuauuuaaauccua

SEQ ID NO: 1923752 - RNA, 21 nt, Shigella flexneri 2a str. 2457T
acucugaaacucgaccagcag

SEQ ID NO: 1923753 - RNA, 19 nt, Shigella flexneri 2a str. 2457T
acucugaccugacaaccgg

SEQ ID NO: 1923754 - RNA, 15 nt, Shigella flexneri 2a str. 2457T
acucucuuuugcuug

SEQ ID NO: 1923755 - RNA, 14 nt, Shigella flexneri 2a str. 2457T
acucucgaaaucca

SEQ ID NO: 1923756 - RNA, 20 nt, Shigella flexneri 2a str. 2457T
acucucgacccgacagaugc

SEQ ID NO: 1923757 - RNA, 15 nt, Shigella flexneri 2a str. 2457T
acucuccuguuuaau

SEQ ID NO: 1923758 - RNA, 17 nt, Shigella flexneri 2a str. 2457T
acucuacgcaagucaua

SEQ ID NO: 1923759 - RNA, 20 nt, Shigella flexneri 2a str. 2457T
acucucaucuuugaaaucac

SEQ ID NO: 1923760 - RNA, 17 nt, Shigella flexneri 2a str. 2457T
acucuaccguuaaaaua

SEQ ID NO: 1923761 - RNA, 20 nt, Shigella flexneri 2a str. 2457T
acucgauaauaaagcggcuc

SEQ ID NO: 1923762 - RNA, 15 nt, Shigella flexneri 2a str. 2457T
acucgcugccagcac

SEQ ID NO: 1923763 - RNA, 20 nt, Shigella flexneri 2a str. 2457T
acucgcuuugcccagaggau

SEQ ID NO: 1923764 - RNA, 23 nt, Shigella flexneri 2a str. 2457T
acucgagaacacgguaaugacuc

SEQ ID NO: 1923765 - RNA, 19 nt, Shigella flexneri 2a str. 2457T
acucgaggauaaauuuucu

SEQ ID NO: 1923766 - RNA, 15 nt, Shigella flexneri 2a str. 2457T
acuccugaaagcgaa

SEQ ID NO: 1923767 - RNA, 20 nt, Shigella flexneri 2a str. 2457T
acuccggcuugaaccagcca

SEQ ID NO: 1923768 - RNA, 21 nt, Shigella flexneri 2a str. 2457T
acuccguugaaauugcugguu

SEQ ID NO: 1923769 - RNA, 14 nt, Shigella flexneri 2a str. 2457T
acucccccuuucug

SEQ ID NO: 1923770 - RNA, 14 nt, Shigella flexneri 2a str. 2457T
acuccccgcacaac

SEQ ID NO: 1923771 - RNA, 18 nt, Shigella flexneri 2a str. 2457T
acucaaaaauaaucaucu

SEQ ID NO: 1923772 - RNA, 14 nt, Shigella flexneri 2a str. 2457T
acuauuucuuugua

SEQ ID NO: 1923773 - RNA, 17 nt, Shigella flexneri 2a str. 2457T
acuauuucuuuguagau

SEQ ID NO: 1923774 - RNA, 17 nt, Shigella flexneri 2a str. 2457T
acugcugcucaaucugc

SEQ ID NO: 1923775 - RNA, 13 nt, Shigella flexneri 2a str. 2457T
acugcugcauccg

SEQ ID NO: 1923776 - RNA, 21 nt, Shigella flexneri 2a str. 2457T
acugcugauguuguuucucuu

SEQ ID NO: 1923777 - RNA, 19 nt, Shigella flexneri 2a str. 2457T
acugcggucuaaaucuucc

SEQ ID NO: 1923778 - RNA, 22 nt, Shigella flexneri 2a str. 2457T
acugcggucuaaaucuuccgcc

SEQ ID NO: 1923779 - RNA, 14 nt, Shigella flexneri 2a str. 2457T
acugcucguucagc

SEQ ID NO: 1923780 - RNA, 16 nt, Shigella flexneri 2a str. 2457T
acugcucguucagcac

SEQ ID NO: 1923781 - RNA, 17 nt, Shigella flexneri 2a str. 2457T
acugcugaaugaggcuu

SEQ ID NO: 1923782 - RNA, 13 nt, Shigella flexneri 2a str. 2457T
acuggauagauau

SEQ ID NO: 1923783 - RNA, 22 nt, Shigella flexneri 2a str. 2457T
acuggaacggggcgauuuuguu

SEQ ID NO: 1923784 - RNA, 16 nt, Shigella flexneri 2a str. 2457T
acugcgcccgccagca

SEQ ID NO: 1923785 - RNA, 15 nt, Shigella flexneri 2a str. 2457T
acugcgccacucgau

SEQ ID NO: 1923786 - RNA, 19 nt, Shigella flexneri 2a str. 2457T
acugcgaccguacaaccaa

SEQ ID NO: 1923787 - RNA, 17 nt, Shigella flexneri 2a str. 2457T
acugcgacguggaucaa

SEQ ID NO: 1923788 - RNA, 14 nt, Shigella flexneri 2a str. 2457T
acugcgagcaaaau

SEQ ID NO: 1923789 - RNA, 23 nt, Shigella flexneri 2a str. 2457T
acugcgaugggagcagccagcca

SEQ ID NO: 1923790 - RNA, 21 nt, Shigella flexneri 2a str. 2457T
acugcgcgauuaucauuuuac

SEQ ID NO: 1923791 - RNA, 17 nt, Shigella flexneri 2a str. 2457T
acugcgccugcaggauc

SEQ ID NO: 1923792 - RNA, 22 nt, Shigella flexneri 2a str. 2457T
acugcgcgagcgucauauagcc

SEQ ID NO: 1923793 - RNA, 14 nt, Shigella flexneri 2a str. 2457T
acugcggucuaaau

SEQ ID NO: 1923794 - RNA, 16 nt, Shigella flexneri 2a str. 2457T
acugcgcugcauuacu

SEQ ID NO: 1923795 - RNA, 14 nt, Shigella flexneri 2a str. 2457T
acugccuuaaucaa

SEQ ID NO: 1923796 - RNA, 23 nt, Shigella flexneri 2a str. 2457T
acugccaccagcagcguuuugua

SEQ ID NO: 1923797 - RNA, 22 nt, Shigella flexneri 2a str. 2457T
acugccacacaggccauuuccc

SEQ ID NO: 1923798 - RNA, 17 nt, Shigella flexneri 2a str. 2457T
acugcauucccaucgca

SEQ ID NO: 1923799 - RNA, 20 nt, Shigella flexneri 2a str. 2457T
acugccacaagggcauauuu

SEQ ID NO: 1923800 - RNA, 17 nt, Shigella flexneri 2a str. 2457T
acugaguucucaugguu

SEQ ID NO: 1923801 - RNA, 18 nt, Shigella flexneri 2a str. 2457T
acugauaagcugagcaca

SEQ ID NO: 1923802 - RNA, 18 nt, Shigella flexneri 2a str. 2457T
acugauaauaaauaacag

SEQ ID NO: 1923803 - RNA, 22 nt, Shigella flexneri 2a str. 2457T
acugaucccgauggucagcuuc

SEQ ID NO: 1923804 - RNA, 16 nt, Shigella flexneri 2a str. 2457T
acugaucgucaucaaa

SEQ ID NO: 1923805 - RNA, 15 nt, Shigella flexneri 2a str. 2457T
acugcaacucaccuu

SEQ ID NO: 1923806 - RNA, 15 nt, Shigella flexneri 2a str. 2457T
acugcaaaucaccac

SEQ ID NO: 1923807 - RNA, 23 nt, Shigella flexneri 2a str. 2457T
acugcauaaucgcaacgccuucc

SEQ ID NO: 1923808 - RNA, 20 nt, Shigella flexneri 2a str. 2457T
acugcaaauacccaaaaaau

SEQ ID NO: 1923809 - RNA, 17 nt, Shigella flexneri 2a str. 2457T
acucuuucaauuuguag

SEQ ID NO: 1923810 - RNA, 12 nt, Shigella flexneri 2a str. 2457T
acucuuucccgg

SEQ ID NO: 1923811 - RNA, 23 nt, Shigella flexneri 2a str. 2457T
acucuuucucggaguaacuauaa

SEQ ID NO: 1923812 - RNA, 13 nt, Shigella flexneri 2a str. 2457T
acucuuuuuuccg

SEQ ID NO: 1923813 - RNA, 18 nt, Shigella flexneri 2a str. 2457T
acucuuuuuccugcugca

SEQ ID NO: 1923814 - RNA, 18 nt, Shigella flexneri 2a str. 2457T
acugaaauuuuaugauaa

SEQ ID NO: 1923815 - RNA, 22 nt, Shigella flexneri 2a str. 2457T
acucuuuuuuccgcuuugugua

SEQ ID NO: 1923816 - RNA, 22 nt, Shigella flexneri 2a str. 2457T
acugagccaaacgcccagcuaa

SEQ ID NO: 1923817 - RNA, 23 nt, Shigella flexneri 2a str. 2457T
aaucgccuuaauaacccacacca

SEQ ID NO: 1923818 - RNA, 17 nt, Shigella flexneri 2a str. 2457T
aaucgcgaaauaacugc

SEQ ID NO: 1923819 - RNA, 20 nt, Shigella flexneri 2a str. 2457T
aaucgcccgcuguuuauguu

SEQ ID NO: 1923820 - RNA, 17 nt, Shigella flexneri 2a str. 2457T
aaucgccaguaguaacc

SEQ ID NO: 1923821 - RNA, 13 nt, Shigella flexneri 2a str. 2457T
aaucgaaaucaac

SEQ ID NO: 1923822 - RNA, 14 nt, Shigella flexneri 2a str. 2457T
aaucgaacuucccg

SEQ ID NO: 1923823 - RNA, 20 nt, Shigella flexneri 2a str. 2457T
aauccugaguuaagcaaaaa

SEQ ID NO: 1923824 - RNA, 21 nt, Shigella flexneri 2a str. 2457T
aauccugaguuaagcaaaaaa

SEQ ID NO: 1923825 - RNA, 20 nt, Shigella flexneri 2a str. 2457T
aauccugccgcaguuucuga

SEQ ID NO: 1923826 - RNA, 23 nt, Shigella flexneri 2a str. 2457T
aauccucuuugcuuccugaguaa

SEQ ID NO: 1923827 - RNA, 20 nt, Shigella flexneri 2a str. 2457T
aaucccaucuucgaguaaaa

SEQ ID NO: 1923828 - RNA, 20 nt, Shigella flexneri 2a str. 2457T
aaucccauccgcgcugaugc

SEQ ID NO: 1923829 - RNA, 19 nt, Shigella flexneri 2a str. 2457T
aauccccuucucaaucccu

SEQ ID NO: 1923830 - RNA, 15 nt, Shigella flexneri 2a str. 2457T
aaucccccacuuuua

SEQ ID NO: 1923831 - RNA, 21 nt, Shigella flexneri 2a str. 2457T
aaucccgcugcaaucuuuaac

SEQ ID NO: 1923832 - RNA, 14 nt, Shigella flexneri 2a str. 2457T
aaucccggcaccaa

SEQ ID NO: 1923833 - RNA, 13 nt, Shigella flexneri 2a str. 2457T
aauccccggccuu

SEQ ID NO: 1923834 - RNA, 16 nt, Shigella flexneri 2a str. 2457T
aaucccgcgcaacaaa

SEQ ID NO: 1923835 - RNA, 13 nt, Shigella flexneri 2a str. 2457T
aaucgcucagcgc

SEQ ID NO: 1923836 - RNA, 16 nt, Shigella flexneri 2a str. 2457T
aaucgcuacugauaau

SEQ ID NO: 1923837 - RNA, 18 nt, Shigella flexneri 2a str. 2457T
aaucgcugcggcaauaau

SEQ ID NO: 1923838 - RNA, 13 nt, Shigella flexneri 2a str. 2457T
aaucgcugcggca

SEQ ID NO: 1923839 - RNA, 22 nt, Shigella flexneri 2a str. 2457T
aaucgcuucaucgcccacauca

SEQ ID NO: 1923840 - RNA, 14 nt, Shigella flexneri 2a str. 2457T
aaucgcuucauuua

SEQ ID NO: 1923841 - RNA, 24 nt, Shigella flexneri 2a str. 2457T
aaucgcuuuuucugcaucaaccaa

SEQ ID NO: 1923842 - RNA, 19 nt, Shigella flexneri 2a str. 2457T
aaucgguucgccugcacca

SEQ ID NO: 1923843 - RNA, 20 nt, Shigella flexneri 2a str. 2457T
aaucggugcaaaugccagau

SEQ ID NO: 1923844 - RNA, 14 nt, Shigella flexneri 2a str. 2457T
aaucgguaacgcuu

SEQ ID NO: 1923845 - RNA, 21 nt, Shigella flexneri 2a str. 2457T
aaucggcgaagagagcgccag

SEQ ID NO: 1923846 - RNA, 17 nt, Shigella flexneri 2a str. 2457T
aaucgggaaaaucugcg

SEQ ID NO: 1923847 - RNA, 20 nt, Shigella flexneri 2a str. 2457T
aaucgggaaaaucugcggga

SEQ ID NO: 1923848 - RNA, 14 nt, Shigella flexneri 2a str. 2457T
aaucgggaaauaac

SEQ ID NO: 1923849 - RNA, 17 nt, Shigella flexneri 2a str. 2457T
aaucguacucaccagac

SEQ ID NO: 1923850 - RNA, 23 nt, Shigella flexneri 2a str. 2457T
aaucguucugugccgucugcccc

SEQ ID NO: 1923851 - RNA, 13 nt, Shigella flexneri 2a str. 2457T
aaucuccugcgca

SEQ ID NO: 1923852 - RNA, 19 nt, Shigella flexneri 2a str. 2457T
aaucucgccguggauggga

SEQ ID NO: 1923853 - RNA, 15 nt, Shigella flexneri 2a str. 2457T
aaucuccauuucauu

SEQ ID NO: 1923854 - RNA, 19 nt, Shigella flexneri 2a str. 2457T
aaucuccugccaauacaaa

SEQ ID NO: 1923855 - RNA, 13 nt, Shigella flexneri 2a str. 2457T
aaucuauugcaac

SEQ ID NO: 1923856 - RNA, 14 nt, Shigella flexneri 2a str. 2457T
aaucuauucauuua

SEQ ID NO: 1923857 - RNA, 16 nt, Shigella flexneri 2a str. 2457T
aaucuaaaacccggua

SEQ ID NO: 1923858 - RNA, 18 nt, Shigella flexneri 2a str. 2457T
aaucuaaccuacuuuuua

SEQ ID NO: 1923859 - RNA, 16 nt, Shigella flexneri 2a str. 2457T
aaaaauuacaaaaagu

SEQ ID NO: 1923860 - RNA, 21 nt, Shigella flexneri 2a str. 2457T
aaaaaugugaagaggaacaaa

SEQ ID NO: 1923861 - RNA, 19 nt, Shigella flexneri 2a str. 2457T
aaucauaauguugcugccu

SEQ ID NO: 1923862 - RNA, 22 nt, Shigella flexneri 2a str. 2457T
aaucauacaagcggaaacguaa

SEQ ID NO: 1923863 - RNA, 19 nt, Shigella flexneri 2a str. 2457T
aaucagcuuuuccauauca

SEQ ID NO: 1923864 - RNA, 17 nt, Shigella flexneri 2a str. 2457T
aaucagcuuuuccauau

SEQ ID NO: 1923865 - RNA, 17 nt, Shigella flexneri 2a str. 2457T
aaucaggcaggucuuuc

SEQ ID NO: 1923866 - RNA, 14 nt, Shigella flexneri 2a str. 2457T
aaucaggccgaggc

SEQ ID NO: 1923867 - RNA, 12 nt, Shigella flexneri 2a str. 2457T
aaucagcggcag

SEQ ID NO: 1923868 - RNA, 15 nt, Shigella flexneri 2a str. 2457T
aaucagcgccagcgc

SEQ ID NO: 1923869 - RNA, 19 nt, Shigella flexneri 2a str. 2457T
aauaugaacaugaaaaaac

SEQ ID NO: 1923870 - RNA, 21 nt, Shigella flexneri 2a str. 2457T
aauaugaauuaacgucaggug

SEQ ID NO: 1923871 - RNA, 14 nt, Shigella flexneri 2a str. 2457T
aaucauauuaaauu

SEQ ID NO: 1923872 - RNA, 18 nt, Shigella flexneri 2a str. 2457T
aaucauauuaaauuuuuu

SEQ ID NO: 1923873 - RNA, 15 nt, Shigella flexneri 2a str. 2457T
aaucauauucaccac

SEQ ID NO: 1923874 - RNA, 13 nt, Shigella flexneri 2a str. 2457T
aaucaucaucagu

SEQ ID NO: 1923875 - RNA, 15 nt, Shigella flexneri 2a str. 2457T
aaucaucacgccaau

SEQ ID NO: 1923876 - RNA, 19 nt, Shigella flexneri 2a str. 2457T
aaucauccuaccgccaggu

SEQ ID NO: 1923877 - RNA, 13 nt, Shigella flexneri 2a str. 2457T
aaucauccagcac

SEQ ID NO: 1923878 - RNA, 22 nt, Shigella flexneri 2a str. 2457T
aaucauccauauuuucagcagu

SEQ ID NO: 1923879 - RNA, 17 nt, Shigella flexneri 2a str. 2457T
aaucaucgacuccagcg

SEQ ID NO: 1923880 - RNA, 20 nt, Shigella flexneri 2a str. 2457T
aaucaucgcggcacacagca

SEQ ID NO: 1923881 - RNA, 13 nt, Shigella flexneri 2a str. 2457T
aaucaucgccuua

SEQ ID NO: 1923882 - RNA, 21 nt, Shigella flexneri 2a str. 2457T
aaucaucgcggcacacagcac

SEQ ID NO: 1923883 - RNA, 19 nt, Shigella flexneri 2a str. 2457T
aaucaucugauaucucacc

SEQ ID NO: 1923884 - RNA, 17 nt, Shigella flexneri 2a str. 2457T
aaucauucccauuuauu

SEQ ID NO: 1923885 - RNA, 22 nt, Shigella flexneri 2a str. 2457T
aaucauucgccgguuccagcuu

SEQ ID NO: 1923886 - RNA, 13 nt, Shigella flexneri 2a str. 2457T
aaucauucccauu

SEQ ID NO: 1923887 - RNA, 15 nt, Shigella flexneri 2a str. 2457T
aauccaguacaugaa

SEQ ID NO: 1923888 - RNA, 20 nt, Shigella flexneri 2a str. 2457T
aauccaguguaaaacagcac

SEQ ID NO: 1923889 - RNA, 21 nt, Shigella flexneri 2a str. 2457T
aauccacaacggcauuauuca

SEQ ID NO: 1923890 - RNA, 21 nt, Shigella flexneri 2a str. 2457T
aauccagcucggcgcuaauca

SEQ ID NO: 1923891 - RNA, 20 nt, Shigella flexneri 2a str. 2457T
aauccagcucuuuuccagcc

SEQ ID NO: 1923892 - RNA, 17 nt, Shigella flexneri 2a str. 2457T
aaugccgucgaggaaca

SEQ ID NO: 1923893 - RNA, 23 nt, Shigella flexneri 2a str. 2457T
aaugccugagacagacagccuca

SEQ ID NO: 1923894 - RNA, 20 nt, Shigella flexneri 2a str. 2457T
aaugcguuuaaagugaauac

SEQ ID NO: 1923895 - RNA, 19 nt, Shigella flexneri 2a str. 2457T
aaugcucuccguaggccag

SEQ ID NO: 1923896 - RNA, 17 nt, Shigella flexneri 2a str. 2457T
aauggcuggcacaaaaa

SEQ ID NO: 1923897 - RNA, 17 nt, Shigella flexneri 2a str. 2457T
aauggcggugaucccaa

SEQ ID NO: 1923898 - RNA, 17 nt, Shigella flexneri 2a str. 2457T
aauggcgucaacaacac

SEQ ID NO: 1923899 - RNA, 15 nt, Shigella flexneri 2a str. 2457T
aauggcaggcucaga

SEQ ID NO: 1923900 - RNA, 15 nt, Shigella flexneri 2a str. 2457T
aaugcuggaucacuu

SEQ ID NO: 1923901 - RNA, 17 nt, Shigella flexneri 2a str. 2457T
aaugcauuaucagagau

SEQ ID NO: 1923902 - RNA, 23 nt, Shigella flexneri 2a str. 2457T
aaugcaguuccauaugaauuccu

SEQ ID NO: 1923903 - RNA, 22 nt, Shigella flexneri 2a str. 2457T
aaugcaggggcguccagaugcg

SEQ ID NO: 1923904 - RNA, 14 nt, Shigella flexneri 2a str. 2457T
aaugcaggcaccug

SEQ ID NO: 1923905 - RNA, 14 nt, Shigella flexneri 2a str. 2457T
aaugccgccgauac

SEQ ID NO: 1923906 - RNA, 22 nt, Shigella flexneri 2a str. 2457T
aaugcccgaugaccuugucaug

SEQ ID NO: 1923907 - RNA, 16 nt, Shigella flexneri 2a str. 2457T
aaugcccagaaaccag

SEQ ID NO: 1923908 - RNA, 13 nt, Shigella flexneri 2a str. 2457T
aaugcccacgccg

SEQ ID NO: 1923909 - RNA, 17 nt, Shigella flexneri 2a str. 2457T
aaugcccauggcaagaa

SEQ ID NO: 1923910 - RNA, 16 nt, Shigella flexneri 2a str. 2457T
aaugauguaaaaauac

SEQ ID NO: 1923911 - RNA, 17 nt, Shigella flexneri 2a str. 2457T
aaugaugucggcauaaa

SEQ ID NO: 1923912 - RNA, 21 nt, Shigella flexneri 2a str. 2457T
aaugaugucggcauaaagcug

SEQ ID NO: 1923913 - RNA, 16 nt, Shigella flexneri 2a str. 2457T
aaugaugccgccagaa

SEQ ID NO: 1923914 - RNA, 21 nt, Shigella flexneri 2a str. 2457T
aaugaugcggcgcuuucagca

SEQ ID NO: 1923915 - RNA, 13 nt, Shigella flexneri 2a str. 2457T
aaugaucagugga

SEQ ID NO: 1923916 - RNA, 15 nt, Shigella flexneri 2a str. 2457T
aaugaucaguggaag

SEQ ID NO: 1923917 - RNA, 22 nt, Shigella flexneri 2a str. 2457T
aaugaucggauaucuccuauug

SEQ ID NO: 1923918 - RNA, 14 nt, Shigella flexneri 2a str. 2457T
aaugacccacccca

SEQ ID NO: 1923919 - RNA, 20 nt, Shigella flexneri 2a str. 2457T
aaugacccaccccagcagca

SEQ ID NO: 1923920 - RNA, 15 nt, Shigella flexneri 2a str. 2457T
aaugacaaaauugcu

SEQ ID NO: 1923921 - RNA, 17 nt, Shigella flexneri 2a str. 2457T
aaugacguuaauaaaau

SEQ ID NO: 1923922 - RNA, 18 nt, Shigella flexneri 2a str. 2457T
aaugacguuaauaaaauu

SEQ ID NO: 1923923 - RNA, 11 nt, Shigella flexneri 2a str. 2457T
aaugauaagcc

SEQ ID NO: 1923924 - RNA, 15 nt, Shigella flexneri 2a str. 2457T
aaugaguuauacaga

SEQ ID NO: 1923925 - RNA, 15 nt, Shigella flexneri 2a str. 2457T
aaugauagccaggcg

SEQ ID NO: 1923926 - RNA, 13 nt, Shigella flexneri 2a str. 2457T
aaugaguauuacu

SEQ ID NO: 1923927 - RNA, 15 nt, Shigella flexneri 2a str. 2457T
aaugaggcagcaagg

SEQ ID NO: 1923928 - RNA, 19 nt, Shigella flexneri 2a str. 2457T
aaugagaaagccgacugca

SEQ ID NO: 1923929 - RNA, 17 nt, Shigella flexneri 2a str. 2457T
aaugagagggcgauaaa

SEQ ID NO: 1923930 - RNA, 22 nt, Shigella flexneri 2a str. 2457T
aaugagagggcgauaaaucucc

SEQ ID NO: 1923931 - RNA, 19 nt, Shigella flexneri 2a str. 2457T
aaucuuugcagcuuugcug

SEQ ID NO: 1923932 - RNA, 14 nt, Shigella flexneri 2a str. 2457T
aaugaaaaucacca

SEQ ID NO: 1923933 - RNA, 22 nt, Shigella flexneri 2a str. 2457T
aaugaaacgcaaauacugacug

SEQ ID NO: 1923934 - RNA, 22 nt, Shigella flexneri 2a str. 2457T
aaucucgucgaugcgcaauuaa

SEQ ID NO: 1923935 - RNA, 21 nt, Shigella flexneri 2a str. 2457T
aaucuuuagcauaaaaacucg

SEQ ID NO: 1923936 - RNA, 14 nt, Shigella flexneri 2a str. 2457T
aaucuuuaaaaaaa

SEQ ID NO: 1923937 - RNA, 11 nt, Shigella flexneri 2a str. 2457T
aaugaagaugc

SEQ ID NO: 1923938 - RNA, 23 nt, Shigella flexneri 2a str. 2457T
aaugaagaugcggaauuugauga

SEQ ID NO: 1923939 - RNA, 17 nt, Shigella flexneri 2a str. 2457T
aauuccggugcgccaga

SEQ ID NO: 1923940 - RNA, 21 nt, Shigella flexneri 2a str. 2457T
aauuccggcuugguguggaua

SEQ ID NO: 1923941 - RNA, 16 nt, Shigella flexneri 2a str. 2457T
aauuccuaugcaacaa

SEQ ID NO: 1923942 - RNA, 21 nt, Shigella flexneri 2a str. 2457T
aauuccuccggcaccgggcuu

SEQ ID NO: 1923943 - RNA, 18 nt, Shigella flexneri 2a str. 2457T
aauuccgaauuucauccu

SEQ ID NO: 1923944 - RNA, 17 nt, Shigella flexneri 2a str. 2457T
aauuccgcuucucuuuc

SEQ ID NO: 1923945 - RNA, 19 nt, Shigella flexneri 2a str. 2457T
aauucccgcuucuucugcc

SEQ ID NO: 1923946 - RNA, 22 nt, Shigella flexneri 2a str. 2457T
aauucaaugacaguaucgccaa

SEQ ID NO: 1923947 - RNA, 16 nt, Shigella flexneri 2a str. 2457T
aauucaagacaucaau

SEQ ID NO: 1923948 - RNA, 14 nt, Shigella flexneri 2a str. 2457T
aauucaauauauug

SEQ ID NO: 1923949 - RNA, 23 nt, Shigella flexneri 2a str. 2457T
aauucggauggcgauacucugcc

SEQ ID NO: 1923950 - RNA, 13 nt, Shigella flexneri 2a str. 2457T
aauucuaaaacgg

SEQ ID NO: 1923951 - RNA, 14 nt, Shigella flexneri 2a str. 2457T
aauucuacagaaau

SEQ ID NO: 1923952 - RNA, 21 nt, Shigella flexneri 2a str. 2457T
aauucuacagaaaugaaaaaa

SEQ ID NO: 1923953 - RNA, 15 nt, Shigella flexneri 2a str. 2457T
aauucuguaauccuc

SEQ ID NO: 1923954 - RNA, 15 nt, Shigella flexneri 2a str. 2457T
aauugaagguuuaau

SEQ ID NO: 1923955 - RNA, 16 nt, Shigella flexneri 2a str. 2457T
aauugaagguuuaaua

SEQ ID NO: 1923956 - RNA, 14 nt, Shigella flexneri 2a str. 2457T
aauugacaguuuau

SEQ ID NO: 1923957 - RNA, 13 nt, Shigella flexneri 2a str. 2457T
aaaacaaaaaccg

SEQ ID NO: 1923958 - RNA, 16 nt, Shigella flexneri 2a str. 2457T
aauugauggaaaauug

SEQ ID NO: 1923959 - RNA, 19 nt, Shigella flexneri 2a str. 2457T
aauugaucucacaaucauc

SEQ ID NO: 1923960 - RNA, 17 nt, Shigella flexneri 2a str. 2457T
aauugaugugaaaacuc

SEQ ID NO: 1923961 - RNA, 23 nt, Shigella flexneri 2a str. 2457T
aauugcaccauccauuuuucacg

SEQ ID NO: 1923962 - RNA, 12 nt, Shigella flexneri 2a str. 2457T
aauugcagauac

SEQ ID NO: 1923963 - RNA, 23 nt, Shigella flexneri 2a str. 2457T
aauugcgagccuguaccacaacc

SEQ ID NO: 1923964 - RNA, 20 nt, Shigella flexneri 2a str. 2457T
aauugcacauauuuuucacc

SEQ ID NO: 1923965 - RNA, 22 nt, Shigella flexneri 2a str. 2457T
aauuacaaaaagugcuuucuga

SEQ ID NO: 1923966 - RNA, 18 nt, Shigella flexneri 2a str. 2457T
aauuacgcuguucauccc

SEQ ID NO: 1923967 - RNA, 17 nt, Shigella flexneri 2a str. 2457T
aauuacagcgcauugcu

SEQ ID NO: 1923968 - RNA, 19 nt, Shigella flexneri 2a str. 2457T
aauuacacagcgacguaaa

SEQ ID NO: 1923969 - RNA, 13 nt, Shigella flexneri 2a str. 2457T
aaugguagccgcc

SEQ ID NO: 1923970 - RNA, 19 nt, Shigella flexneri 2a str. 2457T
aauggucuggugaccuggg

SEQ ID NO: 1923971 - RNA, 18 nt, Shigella flexneri 2a str. 2457T
aaugguccgugacccgga

SEQ ID NO: 1923972 - RNA, 23 nt, Shigella flexneri 2a str. 2457T
aaugguccgugacccggaauaaa

SEQ ID NO: 1923973 - RNA, 10 nt, Shigella flexneri 2a str. 2457T
aauguagccg

SEQ ID NO: 1923974 - RNA, 17 nt, Shigella flexneri 2a str. 2457T
aauuaauaaucacauaa

SEQ ID NO: 1923975 - RNA, 16 nt, Shigella flexneri 2a str. 2457T
aauuagcacgauuuug

SEQ ID NO: 1923976 - RNA, 18 nt, Shigella flexneri 2a str. 2457T
aauuacugccuuaaucaa

SEQ ID NO: 1923977 - RNA, 18 nt, Shigella flexneri 2a str. 2457T
aauuacugccuugaugaa

SEQ ID NO: 1923978 - RNA, 19 nt, Shigella flexneri 2a str. 2457T
aauuacugccuugaugaaa

SEQ ID NO: 1923979 - RNA, 21 nt, Shigella flexneri 2a str. 2457T
aauuacugccuugaugaaaaa

SEQ ID NO: 1923980 - RNA, 17 nt, Shigella flexneri 2a str. 2457T
aauuacuggcagauuau

SEQ ID NO: 1923981 - RNA, 20 nt, Shigella flexneri 2a str. 2457T
aauuacuggcggcaaaacug

SEQ ID NO: 1923982 - RNA, 17 nt, Shigella flexneri 2a str. 2457T
aauuacggauuacaugg

SEQ ID NO: 1923983 - RNA, 13 nt, Shigella flexneri 2a str. 2457T
aauuacucauacu

SEQ ID NO: 1923984 - RNA, 21 nt, Shigella flexneri 2a str. 2457T
aauuacucccgugccagagca

SEQ ID NO: 1923985 - RNA, 14 nt, Shigella flexneri 2a str. 2457T
aauuauuaacaaaa

SEQ ID NO: 1923986 - RNA, 12 nt, Shigella flexneri 2a str. 2457T
aauuaugcagcc

SEQ ID NO: 1923987 - RNA, 14 nt, Shigella flexneri 2a str. 2457T
aauuaguaaugaua

SEQ ID NO: 1923988 - RNA, 12 nt, Shigella flexneri 2a str. 2457T
aauuuuaaauau

SEQ ID NO: 1923989 - RNA, 15 nt, Shigella flexneri 2a str. 2457T
aauuugaacaaggug

SEQ ID NO: 1923990 - RNA, 14 nt, Shigella flexneri 2a str. 2457T
aauuugaggaagcu

SEQ ID NO: 1923991 - RNA, 14 nt, Shigella flexneri 2a str. 2457T
aauuugaucaaaua

SEQ ID NO: 1923992 - RNA, 14 nt, Shigella flexneri 2a str. 2457T
aauuugcuccagaa

SEQ ID NO: 1923993 - RNA, 15 nt, Shigella flexneri 2a str. 2457T
aauuuggggccgucc

SEQ ID NO: 1923994 - RNA, 14 nt, Shigella flexneri 2a str. 2457T
aauuuggaagaauu

SEQ ID NO: 1923995 - RNA, 15 nt, Shigella flexneri 2a str. 2457T
aauuuggcuccucug

SEQ ID NO: 1923996 - RNA, 17 nt, Shigella flexneri 2a str. 2457T
aauuugcaggucauggu

SEQ ID NO: 1923997 - RNA, 20 nt, Shigella flexneri 2a str. 2457T
aauuuugaacgggugauuaa

SEQ ID NO: 1923998 - RNA, 14 nt, Shigella flexneri 2a str. 2457T
aauuuugugcagca

SEQ ID NO: 1923999 - RNA, 22 nt, Shigella flexneri 2a str. 2457T
aauuuuucguuuaugaucauca

SEQ ID NO: 1924000 - RNA, 19 nt, Shigella flexneri 2a str. 2457T
aauuuuccuugaaaaagag

SEQ ID NO: 1924001 - RNA, 20 nt, Shigella flexneri 2a str. 2457T
aauuuuccuugaaaaagagg

SEQ ID NO: 1924002 - RNA, 19 nt, Shigella flexneri 2a str. 2457T
aauuuuauacuuuuucgcc

SEQ ID NO: 1924003 - RNA, 12 nt, Shigella flexneri 2a str. 2457T
aauuuuauguuu

SEQ ID NO: 1924004 - RNA, 14 nt, Shigella flexneri 2a str. 2457T
aauuuaucagacaa

SEQ ID NO: 1924005 - RNA, 17 nt, Shigella flexneri 2a str. 2457T
aauugcucccugaauaa

SEQ ID NO: 1924006 - RNA, 19 nt, Shigella flexneri 2a str. 2457T
aauugcgcgacuuuuuccu

SEQ ID NO: 1924007 - RNA, 19 nt, Shigella flexneri 2a str. 2457T
aauugcgguuuucucuugu

SEQ ID NO: 1924008 - RNA, 12 nt, Shigella flexneri 2a str. 2457T
aauugcgucagu

SEQ ID NO: 1924009 - RNA, 14 nt, Shigella flexneri 2a str. 2457T
aauugcgucaguau

SEQ ID NO: 1924010 - RNA, 16 nt, Shigella flexneri 2a str. 2457T
aauugcguaaagccug

SEQ ID NO: 1924011 - RNA, 20 nt, Shigella flexneri 2a str. 2457T
aauugcgggccaaagaccag

SEQ ID NO: 1924012 - RNA, 17 nt, Shigella flexneri 2a str. 2457T
aauuuaccgacgcugcu

SEQ ID NO: 1924013 - RNA, 23 nt, Shigella flexneri 2a str. 2457T
aauuucgcguaguuaugaaaaua

SEQ ID NO: 1924014 - RNA, 18 nt, Shigella flexneri 2a str. 2457T
aauuucuucccuuucugc

SEQ ID NO: 1924015 - RNA, 21 nt, Shigella flexneri 2a str. 2457T
aauuucugugcagccaaaaau

SEQ ID NO: 1924016 - RNA, 17 nt, Shigella flexneri 2a str. 2457T
aauuucugacugagcug

SEQ ID NO: 1924017 - RNA, 13 nt, Shigella flexneri 2a str. 2457T
aauuuccauugcu

SEQ ID NO: 1924018 - RNA, 14 nt, Shigella flexneri 2a str. 2457T
aauuucauuuugau

SEQ ID NO: 1924019 - RNA, 18 nt, Shigella flexneri 2a str. 2457T
aauuucaucgcuacacca

SEQ ID NO: 1924020 - RNA, 22 nt, Shigella flexneri 2a str. 2457T
aauuucaucacugaauuucgcc

SEQ ID NO: 1924021 - RNA, 17 nt, Shigella flexneri 2a str. 2457T
aauuucaucgccgguaa

SEQ ID NO: 1924022 - RNA, 17 nt, Shigella flexneri 2a str. 2457T
aauuucagcguccugcc

SEQ ID NO: 1924023 - RNA, 13 nt, Shigella flexneri 2a str. 2457T
aauuucacuugcu

SEQ ID NO: 1924024 - RNA, 12 nt, Shigella flexneri 2a str. 2457T
aauuucacugcu

SEQ ID NO: 1924025 - RNA, 17 nt, Shigella flexneri 2a str. 2457T
aauuucacguucaccca

SEQ ID NO: 1924026 - RNA, 21 nt, Shigella flexneri 2a str. 2457T
aauuucacaguaaugauuuaa

SEQ ID NO: 1924027 - RNA, 12 nt, Shigella flexneri 2a str. 2457T
aauuucacacca

SEQ ID NO: 1924028 - RNA, 19 nt, Shigella flexneri 2a str. 2457T
aauuucacaccaucaacaa

SEQ ID NO: 1924029 - RNA, 16 nt, Shigella flexneri 2a str. 2457T
accaccguuuucccgc

SEQ ID NO: 1924030 - RNA, 23 nt, Shigella flexneri 2a str. 2457T
accaccguuuuuucugccucugc

SEQ ID NO: 1924031 - RNA, 12 nt, Shigella flexneri 2a str. 2457T
accaccuccacg

SEQ ID NO: 1924032 - RNA, 21 nt, Shigella flexneri 2a str. 2457T
accaccuccacgcccagcgca

SEQ ID NO: 1924033 - RNA, 15 nt, Shigella flexneri 2a str. 2457T
accaccuccacgccc

SEQ ID NO: 1924034 - RNA, 23 nt, Shigella flexneri 2a str. 2457T
accaccggauguagcaacggagg

SEQ ID NO: 1924035 - RNA, 22 nt, Shigella flexneri 2a str. 2457T
accaccggaauuguggugauca

SEQ ID NO: 1924036 - RNA, 14 nt, Shigella flexneri 2a str. 2457T
accacgaaaacagc

SEQ ID NO: 1924037 - RNA, 19 nt, Shigella flexneri 2a str. 2457T
accaccauauucgccaccg

SEQ ID NO: 1924038 - RNA, 15 nt, Shigella flexneri 2a str. 2457T
accacccaccgcagc

SEQ ID NO: 1924039 - RNA, 14 nt, Shigella flexneri 2a str. 2457T
accacccaccagcg

SEQ ID NO: 1924040 - RNA, 19 nt, Shigella flexneri 2a str. 2457T
accaccaguaaauugucgc

SEQ ID NO: 1924041 - RNA, 18 nt, Shigella flexneri 2a str. 2457T
accaccagcggaauauca

SEQ ID NO: 1924042 - RNA, 13 nt, Shigella flexneri 2a str. 2457T
accaccagcacac

SEQ ID NO: 1924043 - RNA, 14 nt, Shigella flexneri 2a str. 2457T
accaccagacgagc

SEQ ID NO: 1924044 - RNA, 15 nt, Shigella flexneri 2a str. 2457T
accaccagcagcugc

SEQ ID NO: 1924045 - RNA, 12 nt, Shigella flexneri 2a str. 2457T
accaccagcacg

SEQ ID NO: 1924046 - RNA, 12 nt, Shigella flexneri 2a str. 2457T
accacccagcgg

SEQ ID NO: 1924047 - RNA, 15 nt, Shigella flexneri 2a str. 2457T
accacccgcagugau

SEQ ID NO: 1924048 - RNA, 17 nt, Shigella flexneri 2a str. 2457T
accaccgcaaucgccag

SEQ ID NO: 1924049 - RNA, 23 nt, Shigella flexneri 2a str. 2457T
accaccgcaucggcaucaaacca

SEQ ID NO: 1924050 - RNA, 22 nt, Shigella flexneri 2a str. 2457T
accacugcgacgcggcgguucu

SEQ ID NO: 1924051 - RNA, 15 nt, Shigella flexneri 2a str. 2457T
accacugauggaauu

SEQ ID NO: 1924052 - RNA, 14 nt, Shigella flexneri 2a str. 2457T
accacuccggcaug

SEQ ID NO: 1924053 - RNA, 18 nt, Shigella flexneri 2a str. 2457T
accacugacacggaacaa

SEQ ID NO: 1924054 - RNA, 18 nt, Shigella flexneri 2a str. 2457T
accacucugaccugacaa

SEQ ID NO: 1924055 - RNA, 15 nt, Shigella flexneri 2a str. 2457T
accacuacaucaagu

SEQ ID NO: 1924056 - RNA, 20 nt, Shigella flexneri 2a str. 2457T
accacguuuuucaauucacg

SEQ ID NO: 1924057 - RNA, 21 nt, Shigella flexneri 2a str. 2457T
accacuauuauggcgcaggcc

SEQ ID NO: 1924058 - RNA, 15 nt, Shigella flexneri 2a str. 2457T
accacuuccagcaga

SEQ ID NO: 1924059 - RNA, 19 nt, Shigella flexneri 2a str. 2457T
accacuugcagaccaaggu

SEQ ID NO: 1924060 - RNA, 15 nt, Shigella flexneri 2a str. 2457T
accacugcgccagcg

SEQ ID NO: 1924061 - RNA, 16 nt, Shigella flexneri 2a str. 2457T
accacugcgcauaauc

SEQ ID NO: 1924062 - RNA, 13 nt, Shigella flexneri 2a str. 2457T
accacuucacccg

SEQ ID NO: 1924063 - RNA, 14 nt, Shigella flexneri 2a str. 2457T
accacuucacccgc

SEQ ID NO: 1924064 - RNA, 21 nt, Shigella flexneri 2a str. 2457T
accacuuaauuauuaacaaaa

SEQ ID NO: 1924065 - RNA, 14 nt, Shigella flexneri 2a str. 2457T
accacgauauguuc

SEQ ID NO: 1924066 - RNA, 17 nt, Shigella flexneri 2a str. 2457T
accacgcagcguuggca

SEQ ID NO: 1924067 - RNA, 17 nt, Shigella flexneri 2a str. 2457T
accacgccaagaaacac

SEQ ID NO: 1924068 - RNA, 16 nt, Shigella flexneri 2a str. 2457T
accacgccgauaauca

SEQ ID NO: 1924069 - RNA, 13 nt, Shigella flexneri 2a str. 2457T
accacgcgggcca

SEQ ID NO: 1924070 - RNA, 15 nt, Shigella flexneri 2a str. 2457T
accacggcagcaacu

SEQ ID NO: 1924071 - RNA, 18 nt, Shigella flexneri 2a str. 2457T
accacgcuccaucauguc

SEQ ID NO: 1924072 - RNA, 15 nt, Shigella flexneri 2a str. 2457T
accacguucauuuca

SEQ ID NO: 1924073 - RNA, 16 nt, Shigella flexneri 2a str. 2457T
accacguucauuucau

SEQ ID NO: 1924074 - RNA, 14 nt, Shigella flexneri 2a str. 2457T
accacguugacaaa

SEQ ID NO: 1924075 - RNA, 16 nt, Shigella flexneri 2a str. 2457T
accacggccuuccucg

SEQ ID NO: 1924076 - RNA, 15 nt, Shigella flexneri 2a str. 2457T
accacacgaauucca

SEQ ID NO: 1924077 - RNA, 21 nt, Shigella flexneri 2a str. 2457T
accacaccggaccagacgauc

SEQ ID NO: 1924078 - RNA, 14 nt, Shigella flexneri 2a str. 2457T
accaccaaaaccac

SEQ ID NO: 1924079 - RNA, 13 nt, Shigella flexneri 2a str. 2457T
accacaaccgccg

SEQ ID NO: 1924080 - RNA, 12 nt, Shigella flexneri 2a str. 2457T
accacaaaagcg

SEQ ID NO: 1924081 - RNA, 16 nt, Shigella flexneri 2a str. 2457T
accacaaugaagaaag

SEQ ID NO: 1924082 - RNA, 12 nt, Shigella flexneri 2a str. 2457T
accacaccaacc

SEQ ID NO: 1924083 - RNA, 15 nt, Shigella flexneri 2a str. 2457T
accacaauugaccag

SEQ ID NO: 1924084 - RNA, 16 nt, Shigella flexneri 2a str. 2457T
accacacccgcaagac

SEQ ID NO: 1924085 - RNA, 23 nt, Shigella flexneri 2a str. 2457T
accaaugucgaaagccccagccc

SEQ ID NO: 1924086 - RNA, 22 nt, Shigella flexneri 2a str. 2457T
accaauguuacgaccuuccuga

SEQ ID NO: 1924087 - RNA, 13 nt, Shigella flexneri 2a str. 2457T
accaauggcuuuu

SEQ ID NO: 1924088 - RNA, 16 nt, Shigella flexneri 2a str. 2457T
accaaugucgaaagcc

SEQ ID NO: 1924089 - RNA, 19 nt, Shigella flexneri 2a str. 2457T
accaaucaccgccagcaag

SEQ ID NO: 1924090 - RNA, 20 nt, Shigella flexneri 2a str. 2457T
accaaucaccgccagcaagg

SEQ ID NO: 1924091 - RNA, 12 nt, Shigella flexneri 2a str. 2457T
accaaucaccac

SEQ ID NO: 1924092 - RNA, 13 nt, Shigella flexneri 2a str. 2457T
accaauaaucaau

SEQ ID NO: 1924093 - RNA, 12 nt, Shigella flexneri 2a str. 2457T
accaauaauccc

SEQ ID NO: 1924094 - RNA, 19 nt, Shigella flexneri 2a str. 2457T
accaauaccgcccaccacc

SEQ ID NO: 1924095 - RNA, 18 nt, Shigella flexneri 2a str. 2457T
accaauaccaaugaccag

SEQ ID NO: 1924096 - RNA, 21 nt, Shigella flexneri 2a str. 2457T
accaaugauugggucauuucc

SEQ ID NO: 1924097 - RNA, 14 nt, Shigella flexneri 2a str. 2457T
accaaugccgcggc

SEQ ID NO: 1924098 - RNA, 16 nt, Shigella flexneri 2a str. 2457T
accaaugccgcggcgc

SEQ ID NO: 1924099 - RNA, 17 nt, Shigella flexneri 2a str. 2457T
accaaugacguuaauaa

SEQ ID NO: 1924100 - RNA, 19 nt, Shigella flexneri 2a str. 2457T
accaaugauaaguuucacu

SEQ ID NO: 1924101 - RNA, 20 nt, Shigella flexneri 2a str. 2457T
accaaucgcggcgauaucca

SEQ ID NO: 1924102 - RNA, 18 nt, Shigella flexneri 2a str. 2457T
accaaucgcgggcaacgu

SEQ ID NO: 1924103 - RNA, 17 nt, Shigella flexneri 2a str. 2457T
accaaucucccagccgg

SEQ ID NO: 1924104 - RNA, 17 nt, Shigella flexneri 2a str. 2457T
accaaucggcagaacgg

SEQ ID NO: 1924105 - RNA, 14 nt, Shigella flexneri 2a str. 2457T
accaacuccagcgg

SEQ ID NO: 1924106 - RNA, 16 nt, Shigella flexneri 2a str. 2457T
accaagucucaagagu

SEQ ID NO: 1924107 - RNA, 22 nt, Shigella flexneri 2a str. 2457T
accaauaacaggauuuucuaau

SEQ ID NO: 1924108 - RNA, 12 nt, Shigella flexneri 2a str. 2457T
acauuucugcug

SEQ ID NO: 1924109 - RNA, 19 nt, Shigella flexneri 2a str. 2457T
acauuuccaggaaggccag

SEQ ID NO: 1924110 - RNA, 15 nt, Shigella flexneri 2a str. 2457T
accaacgacggccag

SEQ ID NO: 1924111 - RNA, 23 nt, Shigella flexneri 2a str. 2457T
accaacggucgugcgagauaacc

SEQ ID NO: 1924112 - RNA, 15 nt, Shigella flexneri 2a str. 2457T
accaacggcgagcca

SEQ ID NO: 1924113 - RNA, 19 nt, Shigella flexneri 2a str. 2457T
accaacggcgagccagcgc

SEQ ID NO: 1924114 - RNA, 24 nt, Shigella flexneri 2a str. 2457T
accaacggacgagucgcuucaugc

SEQ ID NO: 1924115 - RNA, 19 nt, Shigella flexneri 2a str. 2457T
acaucccgcgaacgagaau

SEQ ID NO: 1924116 - RNA, 13 nt, Shigella flexneri 2a str. 2457T
acaucccagcaga

SEQ ID NO: 1924117 - RNA, 23 nt, Shigella flexneri 2a str. 2457T
acaucccagcagagaucuuucac

SEQ ID NO: 1924118 - RNA, 14 nt, Shigella flexneri 2a str. 2457T
acaucgcaauccuu

SEQ ID NO: 1924119 - RNA, 18 nt, Shigella flexneri 2a str. 2457T
acaucgcagggaucaucc

SEQ ID NO: 1924120 - RNA, 17 nt, Shigella flexneri 2a str. 2457T
acaucgauaagguuaug

SEQ ID NO: 1924121 - RNA, 14 nt, Shigella flexneri 2a str. 2457T
acaucuuccagaau

SEQ ID NO: 1924122 - RNA, 19 nt, Shigella flexneri 2a str. 2457T
acaucuucuccagcgaauc

SEQ ID NO: 1924123 - RNA, 13 nt, Shigella flexneri 2a str. 2457T
acauguucauuua

SEQ ID NO: 1924124 - RNA, 23 nt, Shigella flexneri 2a str. 2457T
acauguugaaucuucaugcguuu

SEQ ID NO: 1924125 - RNA, 22 nt, Shigella flexneri 2a str. 2457T
acauggcaaccgggucgauaaa

SEQ ID NO: 1924126 - RNA, 14 nt, Shigella flexneri 2a str. 2457T
acaugaguugcugg

SEQ ID NO: 1924127 - RNA, 16 nt, Shigella flexneri 2a str. 2457T
acaugaguugcuggac

SEQ ID NO: 1924128 - RNA, 15 nt, Shigella flexneri 2a str. 2457T
acaugauguggaucg

SEQ ID NO: 1924129 - RNA, 21 nt, Shigella flexneri 2a str. 2457T
acaugauguggugcaaggaaa

SEQ ID NO: 1924130 - RNA, 11 nt, Shigella flexneri 2a str. 2457T
acaugcugcuu

SEQ ID NO: 1924131 - RNA, 16 nt, Shigella flexneri 2a str. 2457T
acaugcuggaaccaca

SEQ ID NO: 1924132 - RNA, 18 nt, Shigella flexneri 2a str. 2457T
acaugcauaaagcgguuu

SEQ ID NO: 1924133 - RNA, 21 nt, Shigella flexneri 2a str. 2457T
acauuaucgcgucuaaauuuu

SEQ ID NO: 1924134 - RNA, 13 nt, Shigella flexneri 2a str. 2457T
acauuaucagaca

SEQ ID NO: 1924135 - RNA, 17 nt, Shigella flexneri 2a str. 2457T
acauuaacgugaucaaa

SEQ ID NO: 1924136 - RNA, 23 nt, Shigella flexneri 2a str. 2457T
acauuccaggcccgcguggauaa

SEQ ID NO: 1924137 - RNA, 14 nt, Shigella flexneri 2a str. 2457T
acauucccugcagu

SEQ ID NO: 1924138 - RNA, 21 nt, Shigella flexneri 2a str. 2457T
acauugccguaagcaacgcca

SEQ ID NO: 1924139 - RNA, 17 nt, Shigella flexneri 2a str. 2457T
acauugcaucugauaac

SEQ ID NO: 1924140 - RNA, 13 nt, Shigella flexneri 2a str. 2457T
acauugcugcuga

SEQ ID NO: 1924141 - RNA, 15 nt, Shigella flexneri 2a str. 2457T
acauugcguaaccaa

SEQ ID NO: 1924142 - RNA, 19 nt, Shigella flexneri 2a str. 2457T
acauugcguaaccaaucac

SEQ ID NO: 1924143 - RNA, 19 nt, Shigella flexneri 2a str. 2457T
acauuucagaaaguauaua

SEQ ID NO: 1924144 - RNA, 21 nt, Shigella flexneri 2a str. 2457T
acauuucagaaaguauauaaa

SEQ ID NO: 1924145 - RNA, 14 nt, Shigella flexneri 2a str. 2457T
acauacacaagcca

SEQ ID NO: 1924146 - RNA, 19 nt, Shigella flexneri 2a str. 2457T
acauacccuugaucaccgu

SEQ ID NO: 1924147 - RNA, 16 nt, Shigella flexneri 2a str. 2457T
acauacaaauagccaa

SEQ ID NO: 1924148 - RNA, 22 nt, Shigella flexneri 2a str. 2457T
acaggccaucacauccugauag

SEQ ID NO: 1924149 - RNA, 14 nt, Shigella flexneri 2a str. 2457T
acaggcagcuuaga

SEQ ID NO: 1924150 - RNA, 20 nt, Shigella flexneri 2a str. 2457T
acaggcaagcauaugacgaa

SEQ ID NO: 1924151 - RNA, 22 nt, Shigella flexneri 2a str. 2457T
acaggauuuucuaauauuagau

SEQ ID NO: 1924152 - RNA, 19 nt, Shigella flexneri 2a str. 2457T
acaggcaaccgauagcugg

SEQ ID NO: 1924153 - RNA, 21 nt, Shigella flexneri 2a str. 2457T
acauacuuaaauaaugcuucu

SEQ ID NO: 1924154 - RNA, 22 nt, Shigella flexneri 2a str. 2457T
acauaccuaaaagcacgccaga

SEQ ID NO: 1924155 - RNA, 23 nt, Shigella flexneri 2a str. 2457T
acauaccuaaaagcacgccagac

SEQ ID NO: 1924156 - RNA, 16 nt, Shigella flexneri 2a str. 2457T
acauagcgugacacca

SEQ ID NO: 1924157 - RNA, 15 nt, Shigella flexneri 2a str. 2457T
acauagcacaacagg

SEQ ID NO: 1924158 - RNA, 14 nt, Shigella flexneri 2a str. 2457T
acauagccaucccu

SEQ ID NO: 1924159 - RNA, 18 nt, Shigella flexneri 2a str. 2457T
acauaguagccagccaga

SEQ ID NO: 1924160 - RNA, 17 nt, Shigella flexneri 2a str. 2457T
acauauccuucacacau

SEQ ID NO: 1924161 - RNA, 16 nt, Shigella flexneri 2a str. 2457T
acauauccuucacaca

SEQ ID NO: 1924162 - RNA, 23 nt, Shigella flexneri 2a str. 2457T
acauaucaggcuccggaaauuug

SEQ ID NO: 1924163 - RNA, 20 nt, Shigella flexneri 2a str. 2457T
acauauaucgaaaaaucgac

SEQ ID NO: 1924164 - RNA, 20 nt, Shigella flexneri 2a str. 2457T
acauauaaccggcaacagaa

SEQ ID NO: 1924165 - RNA, 14 nt, Shigella flexneri 2a str. 2457T
acauauugcagcuu

SEQ ID NO: 1924166 - RNA, 15 nt, Shigella flexneri 2a str. 2457T
acauauucuggagca

SEQ ID NO: 1924167 - RNA, 14 nt, Shigella flexneri 2a str. 2457T
acauauuccccugg

SEQ ID NO: 1924168 - RNA, 12 nt, Shigella flexneri 2a str. 2457T
acauauucacca

SEQ ID NO: 1924169 - RNA, 12 nt, Shigella flexneri 2a str. 2457T
acauaugcacau

SEQ ID NO: 1924170 - RNA, 13 nt, Shigella flexneri 2a str. 2457T
acaucacucauaa

SEQ ID NO: 1924171 - RNA, 22 nt, Shigella flexneri 2a str. 2457T
acaucacuccauccagcaacaa

SEQ ID NO: 1924172 - RNA, 19 nt, Shigella flexneri 2a str. 2457T
acaucaaauuacagcaccu

SEQ ID NO: 1924173 - RNA, 19 nt, Shigella flexneri 2a str. 2457T
acauauuuuuguugaaaua

SEQ ID NO: 1924174 - RNA, 13 nt, Shigella flexneri 2a str. 2457T
acaucagcgacaa

SEQ ID NO: 1924175 - RNA, 21 nt, Shigella flexneri 2a str. 2457T
acaucagcuaaaucacaccau

SEQ ID NO: 1924176 - RNA, 16 nt, Shigella flexneri 2a str. 2457T
acaucaucaaagccaa

SEQ ID NO: 1924177 - RNA, 14 nt, Shigella flexneri 2a str. 2457T
acauccaucugcuu

SEQ ID NO: 1924178 - RNA, 14 nt, Shigella flexneri 2a str. 2457T
acagaacagugcca

SEQ ID NO: 1924179 - RNA, 16 nt, Shigella flexneri 2a str. 2457T
acagaaaugaaaaaau

SEQ ID NO: 1924180 - RNA, 20 nt, Shigella flexneri 2a str. 2457T
acagaaaugguaaagaaggc

SEQ ID NO: 1924181 - RNA, 23 nt, Shigella flexneri 2a str. 2457T
acagaacgcgccuuaaaaaccag

SEQ ID NO: 1924182 - RNA, 15 nt, Shigella flexneri 2a str. 2457T
acagaaauucagcgu

SEQ ID NO: 1924183 - RNA, 22 nt, Shigella flexneri 2a str. 2457T
acagaaacgccauccagccggg

SEQ ID NO: 1924184 - RNA, 18 nt, Shigella flexneri 2a str. 2457T
acacuuuuauuaacucag

SEQ ID NO: 1924185 - RNA, 14 nt, Shigella flexneri 2a str. 2457T
acagaaaacucacg

SEQ ID NO: 1924186 - RNA, 16 nt, Shigella flexneri 2a str. 2457T
acacuuuaucuaucag

SEQ ID NO: 1924187 - RNA, 14 nt, Shigella flexneri 2a str. 2457T
acagaauuacuggc

SEQ ID NO: 1924188 - RNA, 21 nt, Shigella flexneri 2a str. 2457T
acagaauucccccauugaaac

SEQ ID NO: 1924189 - RNA, 14 nt, Shigella flexneri 2a str. 2457T
acagaaggccagga

SEQ ID NO: 1924190 - RNA, 19 nt, Shigella flexneri 2a str. 2457T
acagacgagggaaaauaaa

SEQ ID NO: 1924191 - RNA, 19 nt, Shigella flexneri 2a str. 2457T
acagaccuuucgaacccaa

SEQ ID NO: 1924192 - RNA, 19 nt, Shigella flexneri 2a str. 2457T
acagacuugacgccuuuac

SEQ ID NO: 1924193 - RNA, 13 nt, Shigella flexneri 2a str. 2457T
acagacaguaaua

SEQ ID NO: 1924194 - RNA, 20 nt, Shigella flexneri 2a str. 2457T
acagacagccucaagcaccc

SEQ ID NO: 1924195 - RNA, 24 nt, Shigella flexneri 2a str. 2457T
acagaccaaaacgugcagcugccu

SEQ ID NO: 1924196 - RNA, 19 nt, Shigella flexneri 2a str. 2457T
acagaccacauuccaggcc

SEQ ID NO: 1924197 - RNA, 12 nt, Shigella flexneri 2a str. 2457T
acagaccaucaa

SEQ ID NO: 1924198 - RNA, 11 nt, Shigella flexneri 2a str. 2457T
acagacccagg

SEQ ID NO: 1924199 - RNA, 18 nt, Shigella flexneri 2a str. 2457T
acagaccgcgcaguacca

SEQ ID NO: 1924200 - RNA, 16 nt, Shigella flexneri 2a str. 2457T
acacuaacagaacaau

SEQ ID NO: 1924201 - RNA, 18 nt, Shigella flexneri 2a str. 2457T
acacuaacagaacaauaa

SEQ ID NO: 1924202 - RNA, 16 nt, Shigella flexneri 2a str. 2457T
acacuaccggaaccca

SEQ ID NO: 1924203 - RNA, 22 nt, Shigella flexneri 2a str. 2457T
acaccauugauaauccaucacu

SEQ ID NO: 1924204 - RNA, 20 nt, Shigella flexneri 2a str. 2457T
acacccgguaucaaacccuu

SEQ ID NO: 1924205 - RNA, 17 nt, Shigella flexneri 2a str. 2457T
acacuccuaucaccagc

SEQ ID NO: 1924206 - RNA, 17 nt, Shigella flexneri 2a str. 2457T
acacugaauaaaaaugu

SEQ ID NO: 1924207 - RNA, 21 nt, Shigella flexneri 2a str. 2457T
acacugaaccgaaauggcugc

SEQ ID NO: 1924208 - RNA, 14 nt, Shigella flexneri 2a str. 2457T
acacugaugacagg

SEQ ID NO: 1924209 - RNA, 18 nt, Shigella flexneri 2a str. 2457T
acacugaugacaggcuac

SEQ ID NO: 1924210 - RNA, 20 nt, Shigella flexneri 2a str. 2457T
acacuucagccaucaaagau

SEQ ID NO: 1924211 - RNA, 17 nt, Shigella flexneri 2a str. 2457T
acacugcguacagcgcg

SEQ ID NO: 1924212 - RNA, 22 nt, Shigella flexneri 2a str. 2457T
acacuggcauccccgcccuucc

SEQ ID NO: 1924213 - RNA, 17 nt, Shigella flexneri 2a str. 2457T
acacuggcaaaaucaaa

SEQ ID NO: 1924214 - RNA, 20 nt, Shigella flexneri 2a str. 2457T
acacugguucccaacaacag

SEQ ID NO: 1924215 - RNA, 21 nt, Shigella flexneri 2a str. 2457T
acacugguucccaacaacagc

SEQ ID NO: 1924216 - RNA, 16 nt, Shigella flexneri 2a str. 2457T
acagauugauaaaaau

SEQ ID NO: 1924217 - RNA, 15 nt, Shigella flexneri 2a str. 2457T
acagauucaugcugc

SEQ ID NO: 1924218 - RNA, 14 nt, Shigella flexneri 2a str. 2457T
acagauucaggcgc

SEQ ID NO: 1924219 - RNA, 22 nt, Shigella flexneri 2a str. 2457T
acagauuuugccagcaugacua

SEQ ID NO: 1924220 - RNA, 16 nt, Shigella flexneri 2a str. 2457T
acagcaccagcaggug

SEQ ID NO: 1924221 - RNA, 18 nt, Shigella flexneri 2a str. 2457T
acagauuuugccagcaug

SEQ ID NO: 1924222 - RNA, 23 nt, Shigella flexneri 2a str. 2457T
acagcaccauccgcccacaccag

SEQ ID NO: 1924223 - RNA, 17 nt, Shigella flexneri 2a str. 2457T
acagcauauaaugcaac

SEQ ID NO: 1924224 - RNA, 19 nt, Shigella flexneri 2a str. 2457T
acagcaguuguuuaauggc

SEQ ID NO: 1924225 - RNA, 13 nt, Shigella flexneri 2a str. 2457T
acagcauaccuuc

SEQ ID NO: 1924226 - RNA, 14 nt, Shigella flexneri 2a str. 2457T
acagcagagcaugg

SEQ ID NO: 1924227 - RNA, 16 nt, Shigella flexneri 2a str. 2457T
acagcagaacgaccag

SEQ ID NO: 1924228 - RNA, 20 nt, Shigella flexneri 2a str. 2457T
acagcacgccccggcggccg

SEQ ID NO: 1924229 - RNA, 20 nt, Shigella flexneri 2a str. 2457T
acagauaggcaucagcaauu

SEQ ID NO: 1924230 - RNA, 22 nt, Shigella flexneri 2a str. 2457T
acagaugcaggauuucuucacc

SEQ ID NO: 1924231 - RNA, 20 nt, Shigella flexneri 2a str. 2457T
acagagaacaucaauccaaa

SEQ ID NO: 1924232 - RNA, 23 nt, Shigella flexneri 2a str. 2457T
acagagaaucgggaaauaacauc

SEQ ID NO: 1924233 - RNA, 18 nt, Shigella flexneri 2a str. 2457T
acagcucuugcuccacaa

SEQ ID NO: 1924234 - RNA, 23 nt, Shigella flexneri 2a str. 2457T
acagcggugauuuccgccgccag

SEQ ID NO: 1924235 - RNA, 19 nt, Shigella flexneri 2a str. 2457T
acagcuuaaucaccagcgc

SEQ ID NO: 1924236 - RNA, 15 nt, Shigella flexneri 2a str. 2457T
acagcuuagacagcg

SEQ ID NO: 1924237 - RNA, 18 nt, Shigella flexneri 2a str. 2457T
acagcuggaguagauaau

SEQ ID NO: 1924238 - RNA, 21 nt, Shigella flexneri 2a str. 2457T
acagcuggaguacggccuugg

SEQ ID NO: 1924239 - RNA, 21 nt, Shigella flexneri 2a str. 2457T
acaggauauauuucaucaacu

SEQ ID NO: 1924240 - RNA, 14 nt, Shigella flexneri 2a str. 2457T
acaggauauauuuc

SEQ ID NO: 1924241 - RNA, 14 nt, Shigella flexneri 2a str. 2457T
acaggauaaugcaa

SEQ ID NO: 1924242 - RNA, 23 nt, Shigella flexneri 2a str. 2457T
acaggauaaugcaauggaauggc

SEQ ID NO: 1924243 - RNA, 18 nt, Shigella flexneri 2a str. 2457T
acaggauaauuagagguc

SEQ ID NO: 1924244 - RNA, 19 nt, Shigella flexneri 2a str. 2457T
acagccaugcgaaugccaa

SEQ ID NO: 1924245 - RNA, 11 nt, Shigella flexneri 2a str. 2457T
acagcauuucc

SEQ ID NO: 1924246 - RNA, 13 nt, Shigella flexneri 2a str. 2457T
acagcccggcaug

SEQ ID NO: 1924247 - RNA, 15 nt, Shigella flexneri 2a str. 2457T
acagcgcgcugacau

SEQ ID NO: 1924248 - RNA, 17 nt, Shigella flexneri 2a str. 2457T
acagccgacaaugccac

SEQ ID NO: 1924249 - RNA, 18 nt, Shigella flexneri 2a str. 2457T
acagccgacaaugccaca

SEQ ID NO: 1924250 - RNA, 20 nt, Shigella flexneri 2a str. 2457T
acagcggccagccauccguc

SEQ ID NO: 1924251 - RNA, 19 nt, Shigella flexneri 2a str. 2457T
acagcggaguaaucgccag

SEQ ID NO: 1924252 - RNA, 22 nt, Shigella flexneri 2a str. 2457T
acaccauaucuaugguuuuuuc

SEQ ID NO: 1924253 - RNA, 21 nt, Shigella flexneri 2a str. 2457T
acaccauaaaacaaauccgcu

SEQ ID NO: 1924254 - RNA, 14 nt, Shigella flexneri 2a str. 2457T
acaccaucaacaaa

SEQ ID NO: 1924255 - RNA, 12 nt, Shigella flexneri 2a str. 2457T
acaccaucaaca

SEQ ID NO: 1924256 - RNA, 15 nt, Shigella flexneri 2a str. 2457T
acaccaucuuccuca

SEQ ID NO: 1924257 - RNA, 18 nt, Shigella flexneri 2a str. 2457T
acaccagagccugccaau

SEQ ID NO: 1924258 - RNA, 17 nt, Shigella flexneri 2a str. 2457T
acaccagcacaucauca

SEQ ID NO: 1924259 - RNA, 16 nt, Shigella flexneri 2a str. 2457T
acaccagcaauaaugc

SEQ ID NO: 1924260 - RNA, 18 nt, Shigella flexneri 2a str. 2457T
acaccagcaguaaaccac

SEQ ID NO: 1924261 - RNA, 20 nt, Shigella flexneri 2a str. 2457T
acacaguucuucaaaaauaa

SEQ ID NO: 1924262 - RNA, 20 nt, Shigella flexneri 2a str. 2457T
acacauaaacagguaaagac

SEQ ID NO: 1924263 - RNA, 19 nt, Shigella flexneri 2a str. 2457T
acacauaacgccaauucau

SEQ ID NO: 1924264 - RNA, 15 nt, Shigella flexneri 2a str. 2457T
acacauauauuaauu

SEQ ID NO: 1924265 - RNA, 16 nt, Shigella flexneri 2a str. 2457T
acaccagaaugcccca

SEQ ID NO: 1924266 - RNA, 12 nt, Shigella flexneri 2a str. 2457T
acaccagaugag

SEQ ID NO: 1924267 - RNA, 15 nt, Shigella flexneri 2a str. 2457T
acaccagaugauuag

SEQ ID NO: 1924268 - RNA, 14 nt, Shigella flexneri 2a str. 2457T
acaccagagccugc

SEQ ID NO: 1924269 - RNA, 17 nt, Shigella flexneri 2a str. 2457T
acacagcgugcauagca

SEQ ID NO: 1924270 - RNA, 13 nt, Shigella flexneri 2a str. 2457T
acacagccacagg

SEQ ID NO: 1924271 - RNA, 16 nt, Shigella flexneri 2a str. 2457T
acacagguaacuuaaa

SEQ ID NO: 1924272 - RNA, 21 nt, Shigella flexneri 2a str. 2457T
acacagugaaucucuuaucau

SEQ ID NO: 1924273 - RNA, 16 nt, Shigella flexneri 2a str. 2457T
acacagacgguuuuuc

SEQ ID NO: 1924274 - RNA, 16 nt, Shigella flexneri 2a str. 2457T
acacacgcccagcuca

SEQ ID NO: 1924275 - RNA, 19 nt, Shigella flexneri 2a str. 2457T
acacacuuuuauuaacuca

SEQ ID NO: 1924276 - RNA, 13 nt, Shigella flexneri 2a str. 2457T
acacacuuuccag

SEQ ID NO: 1924277 - RNA, 15 nt, Shigella flexneri 2a str. 2457T
acacacuucauuuuc

SEQ ID NO: 1924278 - RNA, 15 nt, Shigella flexneri 2a str. 2457T
acaauuucagcaaua

SEQ ID NO: 1924279 - RNA, 16 nt, Shigella flexneri 2a str. 2457T
acacaauaccuucugc

SEQ ID NO: 1924280 - RNA, 15 nt, Shigella flexneri 2a str. 2457T
acaauugucgccaca

SEQ ID NO: 1924281 - RNA, 23 nt, Shigella flexneri 2a str. 2457T
acaauugucgccacaaacgccag

SEQ ID NO: 1924282 - RNA, 16 nt, Shigella flexneri 2a str. 2457T
acaauguuucugcaau

SEQ ID NO: 1924283 - RNA, 12 nt, Shigella flexneri 2a str. 2457T
acaauaucaaau

SEQ ID NO: 1924284 - RNA, 18 nt, Shigella flexneri 2a str. 2457T
acaaucucaauuuucacu

SEQ ID NO: 1924285 - RNA, 14 nt, Shigella flexneri 2a str. 2457T
acaaucucacccgc

SEQ ID NO: 1924286 - RNA, 19 nt, Shigella flexneri 2a str. 2457T
acaaucucacccgcuucau

SEQ ID NO: 1924287 - RNA, 16 nt, Shigella flexneri 2a str. 2457T
acaaucugcgcuggaa

SEQ ID NO: 1924288 - RNA, 17 nt, Shigella flexneri 2a str. 2457T
acaaugcuguaaccagc

SEQ ID NO: 1924289 - RNA, 20 nt, Shigella flexneri 2a str. 2457T
acaauggagcacauugccug

SEQ ID NO: 1924290 - RNA, 14 nt, Shigella flexneri 2a str. 2457T
acaaugaagaaagu

SEQ ID NO: 1924291 - RNA, 20 nt, Shigella flexneri 2a str. 2457T
acaauggucaacauucccug

SEQ ID NO: 1924292 - RNA, 16 nt, Shigella flexneri 2a str. 2457T
acaauggcggugaucc

SEQ ID NO: 1924293 - RNA, 16 nt, Shigella flexneri 2a str. 2457T
acaauaaacuggcugu

SEQ ID NO: 1924294 - RNA, 20 nt, Shigella flexneri 2a str. 2457T
acaaguccguugaaaaugcu

SEQ ID NO: 1924295 - RNA, 17 nt, Shigella flexneri 2a str. 2457T
acaauaaucaccacaca

SEQ ID NO: 1924296 - RNA, 19 nt, Shigella flexneri 2a str. 2457T
acaauagccacauugcugc

SEQ ID NO: 1924297 - RNA, 13 nt, Shigella flexneri 2a str. 2457T
acaauaauaucuu

SEQ ID NO: 1924298 - RNA, 14 nt, Shigella flexneri 2a str. 2457T
acaauaauaucuuu

SEQ ID NO: 1924299 - RNA, 17 nt, Shigella flexneri 2a str. 2457T
acaauaauaucuuuuuu

SEQ ID NO: 1924300 - RNA, 12 nt, Shigella flexneri 2a str. 2457T
acaauaauaucu

SEQ ID NO: 1924301 - RNA, 14 nt, Shigella flexneri 2a str. 2457T
acaagaucgcccug

SEQ ID NO: 1924302 - RNA, 16 nt, Shigella flexneri 2a str. 2457T
acaagauaacagacau

SEQ ID NO: 1924303 - RNA, 17 nt, Shigella flexneri 2a str. 2457T
acaagauacggaacugc

SEQ ID NO: 1924304 - RNA, 21 nt, Shigella flexneri 2a str. 2457T
acaagaauacagggaaagaag

SEQ ID NO: 1924305 - RNA, 23 nt, Shigella flexneri 2a str. 2457T
acaagaaugccugccagcuugcg

SEQ ID NO: 1924306 - RNA, 16 nt, Shigella flexneri 2a str. 2457T
acaagaaucaugccaa

SEQ ID NO: 1924307 - RNA, 17 nt, Shigella flexneri 2a str. 2457T
acaagaaucaugccaaa

SEQ ID NO: 1924308 - RNA, 22 nt, Shigella flexneri 2a str. 2457T
acaagcauuaaggcaagaaaau

SEQ ID NO: 1924309 - RNA, 14 nt, Shigella flexneri 2a str. 2457T
acaagaaauauaca

SEQ ID NO: 1924310 - RNA, 20 nt, Shigella flexneri 2a str. 2457T
acaagaaauauacaggcggg

SEQ ID NO: 1924311 - RNA, 23 nt, Shigella flexneri 2a str. 2457T
acaacugcgaccguacaaccaaa

SEQ ID NO: 1924312 - RNA, 16 nt, Shigella flexneri 2a str. 2457T
acaacgucgccagucc

SEQ ID NO: 1924313 - RNA, 17 nt, Shigella flexneri 2a str. 2457T
acaacgucgccaguccu

SEQ ID NO: 1924314 - RNA, 15 nt, Shigella flexneri 2a str. 2457T
acaacgugugcuuug

SEQ ID NO: 1924315 - RNA, 18 nt, Shigella flexneri 2a str. 2457T
acaacuaagccaguucau

SEQ ID NO: 1924316 - RNA, 19 nt, Shigella flexneri 2a str. 2457T
acaacucaucacuguaggc

SEQ ID NO: 1924317 - RNA, 23 nt, Shigella flexneri 2a str. 2457T
acaacucgcuuaagccaucauca

SEQ ID NO: 1924318 - RNA, 18 nt, Shigella flexneri 2a str. 2457T
acaacugaaaaaaaauua

SEQ ID NO: 1924319 - RNA, 14 nt, Shigella flexneri 2a str. 2457T
acaacugaaaaaaa

SEQ ID NO: 1924320 - RNA, 19 nt, Shigella flexneri 2a str. 2457T
acaacgcgcacuuugucuu

SEQ ID NO: 1924321 - RNA, 16 nt, Shigella flexneri 2a str. 2457T
acaacggguuuggccg

SEQ ID NO: 1924322 - RNA, 12 nt, Shigella flexneri 2a str. 2457T
aauuuuuucgcc

SEQ ID NO: 1924323 - RNA, 21 nt, Shigella flexneri 2a str. 2457T
aauuuuuucacuguucugaua

SEQ ID NO: 1924324 - RNA, 15 nt, Shigella flexneri 2a str. 2457T
aagccugauaagcgu

SEQ ID NO: 1924325 - RNA, 23 nt, Shigella flexneri 2a str. 2457T
aagccugcccgugggcaggccug

SEQ ID NO: 1924326 - RNA, 22 nt, Shigella flexneri 2a str. 2457T
aagccuucgccuuucaguucaa

SEQ ID NO: 1924327 - RNA, 17 nt, Shigella flexneri 2a str. 2457T
aagccuuccgcaaacag

SEQ ID NO: 1924328 - RNA, 16 nt, Shigella flexneri 2a str. 2457T
aagccuuuuaccgccu

SEQ ID NO: 1924329 - RNA, 19 nt, Shigella flexneri 2a str. 2457T
aagccuuuaccgcgcucga

SEQ ID NO: 1924330 - RNA, 19 nt, Shigella flexneri 2a str. 2457T
aagcgagaguuacagcucu

SEQ ID NO: 1924331 - RNA, 15 nt, Shigella flexneri 2a str. 2457T
aagcgauaaccuuca

SEQ ID NO: 1924332 - RNA, 15 nt, Shigella flexneri 2a str. 2457T
aagcgaucuuucugu

SEQ ID NO: 1924333 - RNA, 18 nt, Shigella flexneri 2a str. 2457T
aagcgacuuugccuggcg

SEQ ID NO: 1924334 - RNA, 16 nt, Shigella flexneri 2a str. 2457T
aagaucaucggccaga

SEQ ID NO: 1924335 - RNA, 13 nt, Shigella flexneri 2a str. 2457T
aagccgugaauca

SEQ ID NO: 1924336 - RNA, 18 nt, Shigella flexneri 2a str. 2457T
aagccgucgagggccuga

SEQ ID NO: 1924337 - RNA, 17 nt, Shigella flexneri 2a str. 2457T
aagccuaagaagucauu

SEQ ID NO: 1924338 - RNA, 14 nt, Shigella flexneri 2a str. 2457T
aagccggugaacgu

SEQ ID NO: 1924339 - RNA, 17 nt, Shigella flexneri 2a str. 2457T
aagcgcaaaggccagca

SEQ ID NO: 1924340 - RNA, 15 nt, Shigella flexneri 2a str. 2457T
aagcgcaaaggccag

SEQ ID NO: 1924341 - RNA, 17 nt, Shigella flexneri 2a str. 2457T
aagcgauucagcaccuu

SEQ ID NO: 1924342 - RNA, 21 nt, Shigella flexneri 2a str. 2457T
aagcgauucucgccgcccuga

SEQ ID NO: 1924343 - RNA, 14 nt, Shigella flexneri 2a str. 2457T
aagcgcagccaaaa

SEQ ID NO: 1924344 - RNA, 22 nt, Shigella flexneri 2a str. 2457T
aagcgcacuuugucaaaaaucu

SEQ ID NO: 1924345 - RNA, 18 nt, Shigella flexneri 2a str. 2457T
aagcgcacuuugccagaa

SEQ ID NO: 1924346 - RNA, 20 nt, Shigella flexneri 2a str. 2457T
aagcgcaccugaucagcaau

SEQ ID NO: 1924347 - RNA, 20 nt, Shigella flexneri 2a str. 2457T
aagcgcacuuuacuggucug

SEQ ID NO: 1924348 - RNA, 18 nt, Shigella flexneri 2a str. 2457T
aagcgcauccggcaccag

SEQ ID NO: 1924349 - RNA, 16 nt, Shigella flexneri 2a str. 2457T
aagcgccaaaucugcc

SEQ ID NO: 1924350 - RNA, 16 nt, Shigella flexneri 2a str. 2457T
aagcgccacaaucgcu

SEQ ID NO: 1924351 - RNA, 15 nt, Shigella flexneri 2a str. 2457T
aagcgccucaagcuc

SEQ ID NO: 1924352 - RNA, 19 nt, Shigella flexneri 2a str. 2457T
aagcgccgaguaaaaaaac

SEQ ID NO: 1924353 - RNA, 17 nt, Shigella flexneri 2a str. 2457T
aagcgccgaguaaaaaa

SEQ ID NO: 1924354 - RNA, 19 nt, Shigella flexneri 2a str. 2457T
aagcggccgucagaucgcc

SEQ ID NO: 1924355 - RNA, 15 nt, Shigella flexneri 2a str. 2457T
aagcggcgcucugcc

SEQ ID NO: 1924356 - RNA, 23 nt, Shigella flexneri 2a str. 2457T
aagcggcguuccaccgcucccag

SEQ ID NO: 1924357 - RNA, 15 nt, Shigella flexneri 2a str. 2457T
aagcggugauaaacc

SEQ ID NO: 1924358 - RNA, 15 nt, Shigella flexneri 2a str. 2457T
aagcggcguuuucag

SEQ ID NO: 1924359 - RNA, 14 nt, Shigella flexneri 2a str. 2457T
aagcuccaccaguu

SEQ ID NO: 1924360 - RNA, 13 nt, Shigella flexneri 2a str. 2457T
aagcuggcaaagu

SEQ ID NO: 1924361 - RNA, 16 nt, Shigella flexneri 2a str. 2457T
aagcuggcagaaguug

SEQ ID NO: 1924362 - RNA, 18 nt, Shigella flexneri 2a str. 2457T
aagcuggcagaaguuguc

SEQ ID NO: 1924363 - RNA, 17 nt, Shigella flexneri 2a str. 2457T
aagcuggaaaucaaugg

SEQ ID NO: 1924364 - RNA, 22 nt, Shigella flexneri 2a str. 2457T
aagcuggcgauauuauccccug

SEQ ID NO: 1924365 - RNA, 11 nt, Shigella flexneri 2a str. 2457T
aagcuggcauu

SEQ ID NO: 1924366 - RNA, 13 nt, Shigella flexneri 2a str. 2457T
aaggaugagaagc

SEQ ID NO: 1924367 - RNA, 15 nt, Shigella flexneri 2a str. 2457T
aaggacauuauucag

SEQ ID NO: 1924368 - RNA, 23 nt, Shigella flexneri 2a str. 2457T
aaggaagccugacagggaaggga

SEQ ID NO: 1924369 - RNA, 20 nt, Shigella flexneri 2a str. 2457T
aaggacaaaaauucaggaau

SEQ ID NO: 1924370 - RNA, 19 nt, Shigella flexneri 2a str. 2457T
aaggaauuuuacagcccug

SEQ ID NO: 1924371 - RNA, 15 nt, Shigella flexneri 2a str. 2457T
aaggcccuuccccuu

SEQ ID NO: 1924372 - RNA, 15 nt, Shigella flexneri 2a str. 2457T
aaggccggagcaugc

SEQ ID NO: 1924373 - RNA, 16 nt, Shigella flexneri 2a str. 2457T
aaggcugacaaaucag

SEQ ID NO: 1924374 - RNA, 17 nt, Shigella flexneri 2a str. 2457T
aaggcuagguugaccug

SEQ ID NO: 1924375 - RNA, 12 nt, Shigella flexneri 2a str. 2457T
aaggcuucaacg

SEQ ID NO: 1924376 - RNA, 15 nt, Shigella flexneri 2a str. 2457T
aaggccagccaggca

SEQ ID NO: 1924377 - RNA, 22 nt, Shigella flexneri 2a str. 2457T
aaggccagcaggucaaagcagg

SEQ ID NO: 1924378 - RNA, 13 nt, Shigella flexneri 2a str. 2457T
aaggccagaacca

SEQ ID NO: 1924379 - RNA, 16 nt, Shigella flexneri 2a str. 2457T
aaggauggucgcuuug

SEQ ID NO: 1924380 - RNA, 13 nt, Shigella flexneri 2a str. 2457T
aaggauuacucag

SEQ ID NO: 1924381 - RNA, 19 nt, Shigella flexneri 2a str. 2457T
aaggcaccaauauugacug

SEQ ID NO: 1924382 - RNA, 15 nt, Shigella flexneri 2a str. 2457T
aaggcagccuuucuc

SEQ ID NO: 1924383 - RNA, 20 nt, Shigella flexneri 2a str. 2457T
aaggcagccuuucucagaga

SEQ ID NO: 1924384 - RNA, 15 nt, Shigella flexneri 2a str. 2457T
aaggcagaaacaaac

SEQ ID NO: 1924385 - RNA, 16 nt, Shigella flexneri 2a str. 2457T
aaguuacauuuuaaua

SEQ ID NO: 1924386 - RNA, 16 nt, Shigella flexneri 2a str. 2457T
aaguuaauccacagca

SEQ ID NO: 1924387 - RNA, 17 nt, Shigella flexneri 2a str. 2457T
aaguguuuaaauuucuu

SEQ ID NO: 1924388 - RNA, 12 nt, Shigella flexneri 2a str. 2457T
aagucucagaaa

SEQ ID NO: 1924389 - RNA, 16 nt, Shigella flexneri 2a str. 2457T
aagucuuuguauuuau

SEQ ID NO: 1924390 - RNA, 19 nt, Shigella flexneri 2a str. 2457T
aagugaaaaacaccccauu

SEQ ID NO: 1924391 - RNA, 20 nt, Shigella flexneri 2a str. 2457T
aagucuuuuuucaacuuuau

SEQ ID NO: 1924392 - RNA, 21 nt, Shigella flexneri 2a str. 2457T
aagucuuuuuucaacuuuauc

SEQ ID NO: 1924393 - RNA, 14 nt, Shigella flexneri 2a str. 2457T
aagugaagaugaau

SEQ ID NO: 1924394 - RNA, 15 nt, Shigella flexneri 2a str. 2457T
aagucguucagaucu

SEQ ID NO: 1924395 - RNA, 16 nt, Shigella flexneri 2a str. 2457T
aaguccaaaagguccu

SEQ ID NO: 1924396 - RNA, 14 nt, Shigella flexneri 2a str. 2457T
aagucauuccuuca

SEQ ID NO: 1924397 - RNA, 22 nt, Shigella flexneri 2a str. 2457T
aaguccgaggaaggcacguaca

SEQ ID NO: 1924398 - RNA, 17 nt, Shigella flexneri 2a str. 2457T
aaguauauaaaaaacaa

SEQ ID NO: 1924399 - RNA, 18 nt, Shigella flexneri 2a str. 2457T
aaguauggaaaucaccca

SEQ ID NO: 1924400 - RNA, 17 nt, Shigella flexneri 2a str. 2457T
aaguaguuccagcauga

SEQ ID NO: 1924401 - RNA, 18 nt, Shigella flexneri 2a str. 2457T
aaguaguuccagcaugau

SEQ ID NO: 1924402 - RNA, 15 nt, Shigella flexneri 2a str. 2457T
aaguagcugaaaauc

SEQ ID NO: 1924403 - RNA, 17 nt, Shigella flexneri 2a str. 2457T
aaguagccuucaucaga

SEQ ID NO: 1924404 - RNA, 17 nt, Shigella flexneri 2a str. 2457T
aaguauuugacuguucu

SEQ ID NO: 1924405 - RNA, 18 nt, Shigella flexneri 2a str. 2457T
aaguauuugacuguucua

SEQ ID NO: 1924406 - RNA, 21 nt, Shigella flexneri 2a str. 2457T
aaguauucuuuuaauggcugg

SEQ ID NO: 1924407 - RNA, 16 nt, Shigella flexneri 2a str. 2457T
aaguauguaauaacag

SEQ ID NO: 1924408 - RNA, 19 nt, Shigella flexneri 2a str. 2457T
aaguaaaaaagaaggaaaa

SEQ ID NO: 1924409 - RNA, 16 nt, Shigella flexneri 2a str. 2457T
aaguaaaaaagaagga

SEQ ID NO: 1924410 - RNA, 18 nt, Shigella flexneri 2a str. 2457T
aaguaaaaaagaaggaaa

SEQ ID NO: 1924411 - RNA, 16 nt, Shigella flexneri 2a str. 2457T
aaguaaaccaccaguc

SEQ ID NO: 1924412 - RNA, 15 nt, Shigella flexneri 2a str. 2457T
aaggggugaaaaaaa

SEQ ID NO: 1924413 - RNA, 23 nt, Shigella flexneri 2a str. 2457T
aagggccgcaguggauaauacac

SEQ ID NO: 1924414 - RNA, 15 nt, Shigella flexneri 2a str. 2457T
aagggacaaaccaca

SEQ ID NO: 1924415 - RNA, 14 nt, Shigella flexneri 2a str. 2457T
aagggcuaacgugc

SEQ ID NO: 1924416 - RNA, 15 nt, Shigella flexneri 2a str. 2457T
aaguacgauacagaa

SEQ ID NO: 1924417 - RNA, 18 nt, Shigella flexneri 2a str. 2457T
aaguacgauacagaagca

SEQ ID NO: 1924418 - RNA, 19 nt, Shigella flexneri 2a str. 2457T
aaguacucuuugaacagcc

SEQ ID NO: 1924419 - RNA, 14 nt, Shigella flexneri 2a str. 2457T
aaguagcagguaau

SEQ ID NO: 1924420 - RNA, 20 nt, Shigella flexneri 2a str. 2457T
aaguagagcgaaacgaaagu

SEQ ID NO: 1924421 - RNA, 13 nt, Shigella flexneri 2a str. 2457T
aaguagaaauuau

SEQ ID NO: 1924422 - RNA, 21 nt, Shigella flexneri 2a str. 2457T
aaguaccaucguccagcagca

SEQ ID NO: 1924423 - RNA, 13 nt, Shigella flexneri 2a str. 2457T
aaguacauuaaaa

SEQ ID NO: 1924424 - RNA, 16 nt, Shigella flexneri 2a str. 2457T
aauauccgucacuuca

SEQ ID NO: 1924425 - RNA, 22 nt, Shigella flexneri 2a str. 2457T
aauauccaccgggguaaaucca

SEQ ID NO: 1924426 - RNA, 14 nt, Shigella flexneri 2a str. 2457T
aauaucaauacauc

SEQ ID NO: 1924427 - RNA, 19 nt, Shigella flexneri 2a str. 2457T
aauaucaggcauucuuuuu

SEQ ID NO: 1924428 - RNA, 14 nt, Shigella flexneri 2a str. 2457T
aauaucaucccccu

SEQ ID NO: 1924429 - RNA, 19 nt, Shigella flexneri 2a str. 2457T
aauaucgcggcacagaaac

SEQ ID NO: 1924430 - RNA, 13 nt, Shigella flexneri 2a str. 2457T
aauaucuccucug

SEQ ID NO: 1924431 - RNA, 12 nt, Shigella flexneri 2a str. 2457T
aauaucuccucu

SEQ ID NO: 1924432 - RNA, 18 nt, Shigella flexneri 2a str. 2457T
aauaucuauccaguaucu

SEQ ID NO: 1924433 - RNA, 13 nt, Shigella flexneri 2a str. 2457T
aauaucguugauu

SEQ ID NO: 1924434 - RNA, 22 nt, Shigella flexneri 2a str. 2457T
aauaucguugauuguugcgcga

SEQ ID NO: 1924435 - RNA, 19 nt, Shigella flexneri 2a str. 2457T
aauaucugccggaagacac

SEQ ID NO: 1924436 - RNA, 16 nt, Shigella flexneri 2a str. 2457T
aauaucuuccuggcgc

SEQ ID NO: 1924437 - RNA, 11 nt, Shigella flexneri 2a str. 2457T
aauaucuuccu

SEQ ID NO: 1924438 - RNA, 23 nt, Shigella flexneri 2a str. 2457T
aauaucuuauagacuaaauuuca

SEQ ID NO: 1924439 - RNA, 15 nt, Shigella flexneri 2a str. 2457T
aauaucuuuucuuaa

SEQ ID NO: 1924440 - RNA, 22 nt, Shigella flexneri 2a str. 2457T
aauauaccauggaagaaaaaua

SEQ ID NO: 1924441 - RNA, 16 nt, Shigella flexneri 2a str. 2457T
aauauagcgccacgcu

SEQ ID NO: 1924442 - RNA, 13 nt, Shigella flexneri 2a str. 2457T
aauauauaaagau

SEQ ID NO: 1924443 - RNA, 20 nt, Shigella flexneri 2a str. 2457T
aauauaguagaucuugauuu

SEQ ID NO: 1924444 - RNA, 15 nt, Shigella flexneri 2a str. 2457T
aauaucaaauaaaaa

SEQ ID NO: 1924445 - RNA, 15 nt, Shigella flexneri 2a str. 2457T
aauauaugcauugau

SEQ ID NO: 1924446 - RNA, 18 nt, Shigella flexneri 2a str. 2457T
aauaguuucugacauuuu

SEQ ID NO: 1924447 - RNA, 17 nt, Shigella flexneri 2a str. 2457T
aauauaaaacaacggaa

SEQ ID NO: 1924448 - RNA, 22 nt, Shigella flexneri 2a str. 2457T
aauaguuauagccguaacugua

SEQ ID NO: 1924449 - RNA, 21 nt, Shigella flexneri 2a str. 2457T
aauagugacagauuugauuau

SEQ ID NO: 1924450 - RNA, 22 nt, Shigella flexneri 2a str. 2457T
aauagugccuggcugcgugagg

SEQ ID NO: 1924451 - RNA, 15 nt, Shigella flexneri 2a str. 2457T
aauagcuucuucaac

SEQ ID NO: 1924452 - RNA, 13 nt, Shigella flexneri 2a str. 2457T
aauagcuuuaccc

SEQ ID NO: 1924453 - RNA, 15 nt, Shigella flexneri 2a str. 2457T
aauaguaauuuugaa

SEQ ID NO: 1924454 - RNA, 21 nt, Shigella flexneri 2a str. 2457T
aauaccugccugucacgcagg

SEQ ID NO: 1924455 - RNA, 20 nt, Shigella flexneri 2a str. 2457T
aauaccguucucuuuaaaaa

SEQ ID NO: 1924456 - RNA, 19 nt, Shigella flexneri 2a str. 2457T
aauaccuuucgauuucucu

SEQ ID NO: 1924457 - RNA, 17 nt, Shigella flexneri 2a str. 2457T
aauagcaacugauuuau

SEQ ID NO: 1924458 - RNA, 19 nt, Shigella flexneri 2a str. 2457T
aauagcguuaauggcagau

SEQ ID NO: 1924459 - RNA, 21 nt, Shigella flexneri 2a str. 2457T
aauagcgugauuguggcaauc

SEQ ID NO: 1924460 - RNA, 20 nt, Shigella flexneri 2a str. 2457T
aauagcgaacagacaaaaag

SEQ ID NO: 1924461 - RNA, 19 nt, Shigella flexneri 2a str. 2457T
aauagcggacacuaccauu

SEQ ID NO: 1924462 - RNA, 19 nt, Shigella flexneri 2a str. 2457T
aauaccauggcucaccagc

SEQ ID NO: 1924463 - RNA, 22 nt, Shigella flexneri 2a str. 2457T
aauaccauggcucaccagcagc

SEQ ID NO: 1924464 - RNA, 12 nt, Shigella flexneri 2a str. 2457T
aaaaauggcugg

SEQ ID NO: 1924465 - RNA, 13 nt, Shigella flexneri 2a str. 2457T
aaaaauggcuggc

SEQ ID NO: 1924466 - RNA, 18 nt, Shigella flexneri 2a str. 2457T
aauaccaucggcagcgcc

SEQ ID NO: 1924467 - RNA, 17 nt, Shigella flexneri 2a str. 2457T
aauaccauggcucacca

SEQ ID NO: 1924468 - RNA, 21 nt, Shigella flexneri 2a str. 2457T
aaaaaugcgcggucagaaaau

SEQ ID NO: 1924469 - RNA, 12 nt, Shigella flexneri 2a str. 2457T
aaaaaugcccga

SEQ ID NO: 1924470 - RNA, 17 nt, Shigella flexneri 2a str. 2457T
aauacacuaacagaaca

SEQ ID NO: 1924471 - RNA, 21 nt, Shigella flexneri 2a str. 2457T
aauacacuaacagaacaauaa

SEQ ID NO: 1924472 - RNA, 12 nt, Shigella flexneri 2a str. 2457T
aauacacccuga

SEQ ID NO: 1924473 - RNA, 22 nt, Shigella flexneri 2a str. 2457T
aauaccacccgucgggcagaaa

SEQ ID NO: 1924474 - RNA, 21 nt, Shigella flexneri 2a str. 2457T
aauaauacagcccagacaaau

SEQ ID NO: 1924475 - RNA, 21 nt, Shigella flexneri 2a str. 2457T
aauaaugcccaucgugauaaa

SEQ ID NO: 1924476 - RNA, 13 nt, Shigella flexneri 2a str. 2457T
aauaaugcagauc

SEQ ID NO: 1924477 - RNA, 13 nt, Shigella flexneri 2a str. 2457T
aauaaugcaaaaa

SEQ ID NO: 1924478 - RNA, 14 nt, Shigella flexneri 2a str. 2457T
aauaauggugaauu

SEQ ID NO: 1924479 - RNA, 23 nt, Shigella flexneri 2a str. 2457T
aauaaugcgacaacagaaauaau

SEQ ID NO: 1924480 - RNA, 21 nt, Shigella flexneri 2a str. 2457T
aauaauggccuuuucgccacc

SEQ ID NO: 1924481 - RNA, 17 nt, Shigella flexneri 2a str. 2457T
aauaaugcgacaacaga

SEQ ID NO: 1924482 - RNA, 18 nt, Shigella flexneri 2a str. 2457T
aaaaaucuaaccuacuuu

SEQ ID NO: 1924483 - RNA, 12 nt, Shigella flexneri 2a str. 2457T
aaaaaucgccga

SEQ ID NO: 1924484 - RNA, 18 nt, Shigella flexneri 2a str. 2457T
aaaaaucgacaaaaucgg

SEQ ID NO: 1924485 - RNA, 14 nt, Shigella flexneri 2a str. 2457T
aauaauuuuaaaua

SEQ ID NO: 1924486 - RNA, 16 nt, Shigella flexneri 2a str. 2457T
aauaauuuuuucgcca

SEQ ID NO: 1924487 - RNA, 21 nt, Shigella flexneri 2a str. 2457T
aaaaaugaaacuggaagauuu

SEQ ID NO: 1924488 - RNA, 20 nt, Shigella flexneri 2a str. 2457T
aaaaaguuuuauugcaaaac

SEQ ID NO: 1924489 - RNA, 13 nt, Shigella flexneri 2a str. 2457T
aaaaauaacaaau

SEQ ID NO: 1924490 - RNA, 18 nt, Shigella flexneri 2a str. 2457T
aauaagcauggacuggcu

SEQ ID NO: 1924491 - RNA, 13 nt, Shigella flexneri 2a str. 2457T
aauaagcuuuuuc

SEQ ID NO: 1924492 - RNA, 17 nt, Shigella flexneri 2a str. 2457T
aauaaggcuuucgugaa

SEQ ID NO: 1924493 - RNA, 17 nt, Shigella flexneri 2a str. 2457T
aauaaguacgauacaga

SEQ ID NO: 1924494 - RNA, 16 nt, Shigella flexneri 2a str. 2457T
aauaacucuuugauga

SEQ ID NO: 1924495 - RNA, 21 nt, Shigella flexneri 2a str. 2457T
aauaacucuuugaugaaacau

SEQ ID NO: 1924496 - RNA, 19 nt, Shigella flexneri 2a str. 2457T
aauaacugcuauucaccag

SEQ ID NO: 1924497 - RNA, 21 nt, Shigella flexneri 2a str. 2457T
aauaacuggugcuaacagcaa

SEQ ID NO: 1924498 - RNA, 13 nt, Shigella flexneri 2a str. 2457T
aauaaccauauau

SEQ ID NO: 1924499 - RNA, 14 nt, Shigella flexneri 2a str. 2457T
aauaagacaauuga

SEQ ID NO: 1924500 - RNA, 11 nt, Shigella flexneri 2a str. 2457T
aaguuuaaccu

SEQ ID NO: 1924501 - RNA, 23 nt, Shigella flexneri 2a str. 2457T
aauaaauccccggcggcguucag

SEQ ID NO: 1924502 - RNA, 16 nt, Shigella flexneri 2a str. 2457T
aauaaaucuaaaagau

SEQ ID NO: 1924503 - RNA, 17 nt, Shigella flexneri 2a str. 2457T
aauaaaucuaaaagaug

SEQ ID NO: 1924504 - RNA, 13 nt, Shigella flexneri 2a str. 2457T
aagagagaagcca

SEQ ID NO: 1924505 - RNA, 15 nt, Shigella flexneri 2a str. 2457T
aagagagaagccaga

SEQ ID NO: 1924506 - RNA, 19 nt, Shigella flexneri 2a str. 2457T
aagagauaaacgaccacuc

SEQ ID NO: 1924507 - RNA, 17 nt, Shigella flexneri 2a str. 2457T
aagagauuguauuuaaa

SEQ ID NO: 1924508 - RNA, 14 nt, Shigella flexneri 2a str. 2457T
aagagauggaucaa

SEQ ID NO: 1924509 - RNA, 13 nt, Shigella flexneri 2a str. 2457T
aagaggaacaaau

SEQ ID NO: 1924510 - RNA, 13 nt, Shigella flexneri 2a str. 2457T
aagaggcgcagau

SEQ ID NO: 1924511 - RNA, 15 nt, Shigella flexneri 2a str. 2457T
aagaggcgcagauga

SEQ ID NO: 1924512 - RNA, 17 nt, Shigella flexneri 2a str. 2457T
aagagcgacaaucccug

SEQ ID NO: 1924513 - RNA, 19 nt, Shigella flexneri 2a str. 2457T
aagagcgauccguucagau

SEQ ID NO: 1924514 - RNA, 21 nt, Shigella flexneri 2a str. 2457T
aagagcuggcaucagcaaaca

SEQ ID NO: 1924515 - RNA, 22 nt, Shigella flexneri 2a str. 2457T
aagauaaaucgcacguugucag

SEQ ID NO: 1924516 - RNA, 22 nt, Shigella flexneri 2a str. 2457T
aagagugugaauauucagaaua

SEQ ID NO: 1924517 - RNA, 17 nt, Shigella flexneri 2a str. 2457T
aagaguucaaagccgaa

SEQ ID NO: 1924518 - RNA, 21 nt, Shigella flexneri 2a str. 2457T
aagaguucaaagccgaagcug

SEQ ID NO: 1924519 - RNA, 13 nt, Shigella flexneri 2a str. 2457T
aagaguuccaacg

SEQ ID NO: 1924520 - RNA, 15 nt, Shigella flexneri 2a str. 2457T
aagaguuuaucuguu

SEQ ID NO: 1924521 - RNA, 16 nt, Shigella flexneri 2a str. 2457T
aagauagcgucauuuc

SEQ ID NO: 1924522 - RNA, 18 nt, Shigella flexneri 2a str. 2457T
aagauagcgucauuucua

SEQ ID NO: 1924523 - RNA, 19 nt, Shigella flexneri 2a str. 2457T
aagauagcgucauuucuac

SEQ ID NO: 1924524 - RNA, 19 nt, Shigella flexneri 2a str. 2457T
aagauauuucaccagcgca

SEQ ID NO: 1924525 - RNA, 21 nt, Shigella flexneri 2a str. 2457T
aagauauuggggguaauuccc

SEQ ID NO: 1924526 - RNA, 18 nt, Shigella flexneri 2a str. 2457T
aagauaguuggcagcgcg

SEQ ID NO: 1924527 - RNA, 15 nt, Shigella flexneri 2a str. 2457T
aagaaugccugccag

SEQ ID NO: 1924528 - RNA, 22 nt, Shigella flexneri 2a str. 2457T
aagaaugacacuuucagcgcag

SEQ ID NO: 1924529 - RNA, 16 nt, Shigella flexneri 2a str. 2457T
aagaaugacacuuuca

SEQ ID NO: 1924530 - RNA, 23 nt, Shigella flexneri 2a str. 2457T
aagaauugauaaaaaaaacgcca

SEQ ID NO: 1924531 - RNA, 16 nt, Shigella flexneri 2a str. 2457T
aagaauugcagauacc

SEQ ID NO: 1924532 - RNA, 22 nt, Shigella flexneri 2a str. 2457T
aagaaaguuugcagaaauuguc

SEQ ID NO: 1924533 - RNA, 17 nt, Shigella flexneri 2a str. 2457T
aagaaauccacaaauuc

SEQ ID NO: 1924534 - RNA, 13 nt, Shigella flexneri 2a str. 2457T
aagacaauuuaau

SEQ ID NO: 1924535 - RNA, 11 nt, Shigella flexneri 2a str. 2457T
aagacacacua

SEQ ID NO: 1924536 - RNA, 20 nt, Shigella flexneri 2a str. 2457T
aagacacuaacgcgucuuau

SEQ ID NO: 1924537 - RNA, 13 nt, Shigella flexneri 2a str. 2457T
aagaauuuuauac

SEQ ID NO: 1924538 - RNA, 23 nt, Shigella flexneri 2a str. 2457T
aagaauuuuauacuuuuucgcca

SEQ ID NO: 1924539 - RNA, 21 nt, Shigella flexneri 2a str. 2457T
aagacaucgcccgauucacau

SEQ ID NO: 1924540 - RNA, 19 nt, Shigella flexneri 2a str. 2457T
aagacaucaauaaacaaug

SEQ ID NO: 1924541 - RNA, 21 nt, Shigella flexneri 2a str. 2457T
aagacauagcacauaaaaugg

SEQ ID NO: 1924542 - RNA, 18 nt, Shigella flexneri 2a str. 2457T
aagacaucaauaaacaau

SEQ ID NO: 1924543 - RNA, 20 nt, Shigella flexneri 2a str. 2457T
aagacacugacgcgucuuau

SEQ ID NO: 1924544 - RNA, 17 nt, Shigella flexneri 2a str. 2457T
aagaccaggaaacccaa

SEQ ID NO: 1924545 - RNA, 16 nt, Shigella flexneri 2a str. 2457T
aagaccauugaugcuc

SEQ ID NO: 1924546 - RNA, 16 nt, Shigella flexneri 2a str. 2457T
aagacgcguaaagcgu

SEQ ID NO: 1924547 - RNA, 20 nt, Shigella flexneri 2a str. 2457T
aagaccugccgggcugaugc

SEQ ID NO: 1924548 - RNA, 23 nt, Shigella flexneri 2a str. 2457T
aagaccugggcgaugcuggcaga

SEQ ID NO: 1924549 - RNA, 22 nt, Shigella flexneri 2a str. 2457T
aagacucuuacucuuucaauuu

SEQ ID NO: 1924550 - RNA, 18 nt, Shigella flexneri 2a str. 2457T
aagacguuaaaaaaggug

SEQ ID NO: 1924551 - RNA, 17 nt, Shigella flexneri 2a str. 2457T
aagacgugcgccacaac

SEQ ID NO: 1924552 - RNA, 23 nt, Shigella flexneri 2a str. 2457T
aagacguugauucacuuucugaa

SEQ ID NO: 1924553 - RNA, 17 nt, Shigella flexneri 2a str. 2457T
aagacguuuugugagaa

SEQ ID NO: 1924554 - RNA, 18 nt, Shigella flexneri 2a str. 2457T
aagacuuaccagcccuaa

SEQ ID NO: 1924555 - RNA, 15 nt, Shigella flexneri 2a str. 2457T
aagagaacucuuuuu

SEQ ID NO: 1924556 - RNA, 20 nt, Shigella flexneri 2a str. 2457T
aagagaaagaacgaguaaaa

SEQ ID NO: 1924557 - RNA, 16 nt, Shigella flexneri 2a str. 2457T
aacuccagcggcgcgu

SEQ ID NO: 1924558 - RNA, 18 nt, Shigella flexneri 2a str. 2457T
aacuccagaauaccgcca

SEQ ID NO: 1924559 - RNA, 22 nt, Shigella flexneri 2a str. 2457T
aacuccacuucaccgcgaauau

SEQ ID NO: 1924560 - RNA, 17 nt, Shigella flexneri 2a str. 2457T
aacuccccgagaaauac

SEQ ID NO: 1924561 - RNA, 22 nt, Shigella flexneri 2a str. 2457T
aacuccgccagcaacugauaaa

SEQ ID NO: 1924562 - RNA, 16 nt, Shigella flexneri 2a str. 2457T
aacucgaccagcagcu

SEQ ID NO: 1924563 - RNA, 11 nt, Shigella flexneri 2a str. 2457T
aacuccuggag

SEQ ID NO: 1924564 - RNA, 21 nt, Shigella flexneri 2a str. 2457T
aacuccugaaagcgaaccaua

SEQ ID NO: 1924565 - RNA, 15 nt, Shigella flexneri 2a str. 2457T
aacuccggcgaaaau

SEQ ID NO: 1924566 - RNA, 22 nt, Shigella flexneri 2a str. 2457T
aacucgcguaaauccagcggca

SEQ ID NO: 1924567 - RNA, 19 nt, Shigella flexneri 2a str. 2457T
aacucgaggauaaauuuuc

SEQ ID NO: 1924568 - RNA, 22 nt, Shigella flexneri 2a str. 2457T
aacucgcuuaagccaucaucaa

SEQ ID NO: 1924569 - RNA, 22 nt, Shigella flexneri 2a str. 2457T
aacucugccgcaaucaucgacc

SEQ ID NO: 1924570 - RNA, 15 nt, Shigella flexneri 2a str. 2457T
aacugacgaaucaaa

SEQ ID NO: 1924571 - RNA, 16 nt, Shigella flexneri 2a str. 2457T
aacugacagagaacau

SEQ ID NO: 1924572 - RNA, 14 nt, Shigella flexneri 2a str. 2457T
aacugacuggcucu

SEQ ID NO: 1924573 - RNA, 18 nt, Shigella flexneri 2a str. 2457T
aacggcugauaacaauau

SEQ ID NO: 1924574 - RNA, 19 nt, Shigella flexneri 2a str. 2457T
aacgggcggcguugaccac

SEQ ID NO: 1924575 - RNA, 19 nt, Shigella flexneri 2a str. 2457T
aacucaaucgccucgccga

SEQ ID NO: 1924576 - RNA, 21 nt, Shigella flexneri 2a str. 2457T
aacuaucaggcaaaaaaaugc

SEQ ID NO: 1924577 - RNA, 20 nt, Shigella flexneri 2a str. 2457T
aacuauauucucaaaauaca

SEQ ID NO: 1924578 - RNA, 18 nt, Shigella flexneri 2a str. 2457T
aacucaucaccaucaggc

SEQ ID NO: 1924579 - RNA, 15 nt, Shigella flexneri 2a str. 2457T
aacucauaaauucaa

SEQ ID NO: 1924580 - RNA, 18 nt, Shigella flexneri 2a str. 2457T
aacucauacaccagcggc

SEQ ID NO: 1924581 - RNA, 20 nt, Shigella flexneri 2a str. 2457T
aacucauacaccagcggcac

SEQ ID NO: 1924582 - RNA, 18 nt, Shigella flexneri 2a str. 2457T
aacucauuuacagaaacu

SEQ ID NO: 1924583 - RNA, 12 nt, Shigella flexneri 2a str. 2457T
aacuccacuuca

SEQ ID NO: 1924584 - RNA, 13 nt, Shigella flexneri 2a str. 2457T
aacucaccaucaa

SEQ ID NO: 1924585 - RNA, 16 nt, Shigella flexneri 2a str. 2457T
aacucaauuaccaacu

SEQ ID NO: 1924586 - RNA, 17 nt, Shigella flexneri 2a str. 2457T
aacucaauuaccaacuc

SEQ ID NO: 1924587 - RNA, 14 nt, Shigella flexneri 2a str. 2457T
aacucaccuuuaaa

SEQ ID NO: 1924588 - RNA, 16 nt, Shigella flexneri 2a str. 2457T
aacucaccuuuuuugu

SEQ ID NO: 1924589 - RNA, 17 nt, Shigella flexneri 2a str. 2457T
aacuuugccgugaacaa

SEQ ID NO: 1924590 - RNA, 17 nt, Shigella flexneri 2a str. 2457T
aacuuuucccuacugcu

SEQ ID NO: 1924591 - RNA, 14 nt, Shigella flexneri 2a str. 2457T
aacuuuucaacaaa

SEQ ID NO: 1924592 - RNA, 17 nt, Shigella flexneri 2a str. 2457T
aacuuuucaacaaauuc

SEQ ID NO: 1924593 - RNA, 21 nt, Shigella flexneri 2a str. 2457T
aagaaacaccagaaugcccca

SEQ ID NO: 1924594 - RNA, 15 nt, Shigella flexneri 2a str. 2457T
aagaaaccgaaguug

SEQ ID NO: 1924595 - RNA, 19 nt, Shigella flexneri 2a str. 2457T
aagaaaaaacuaacagugu

SEQ ID NO: 1924596 - RNA, 23 nt, Shigella flexneri 2a str. 2457T
aagaaaaucaauccaguguaaaa

SEQ ID NO: 1924597 - RNA, 17 nt, Shigella flexneri 2a str. 2457T
aacuuuagucgcccauu

SEQ ID NO: 1924598 - RNA, 19 nt, Shigella flexneri 2a str. 2457T
aacuucucuucuuccgcuu

SEQ ID NO: 1924599 - RNA, 15 nt, Shigella flexneri 2a str. 2457T
aacuuuaagcugaaa

SEQ ID NO: 1924600 - RNA, 19 nt, Shigella flexneri 2a str. 2457T
aacuugugcucguguugca

SEQ ID NO: 1924601 - RNA, 15 nt, Shigella flexneri 2a str. 2457T
aacuguaccagcaac

SEQ ID NO: 1924602 - RNA, 15 nt, Shigella flexneri 2a str. 2457T
aacuguaaaucgcca

SEQ ID NO: 1924603 - RNA, 21 nt, Shigella flexneri 2a str. 2457T
aacuguaacgcagaagguuau

SEQ ID NO: 1924604 - RNA, 20 nt, Shigella flexneri 2a str. 2457T
aacugccgcgccugaaucug

SEQ ID NO: 1924605 - RNA, 22 nt, Shigella flexneri 2a str. 2457T
aacugccaugaccgcuccgcca

SEQ ID NO: 1924606 - RNA, 16 nt, Shigella flexneri 2a str. 2457T
aacugcgccagaccca

SEQ ID NO: 1924607 - RNA, 15 nt, Shigella flexneri 2a str. 2457T
aacugccguugcugc

SEQ ID NO: 1924608 - RNA, 20 nt, Shigella flexneri 2a str. 2457T
aacugccucgggauccaugc

SEQ ID NO: 1924609 - RNA, 22 nt, Shigella flexneri 2a str. 2457T
aacugacuuucguuugaaaacu

SEQ ID NO: 1924610 - RNA, 22 nt, Shigella flexneri 2a str. 2457T
aacugauaaaccuucaucguuu

SEQ ID NO: 1924611 - RNA, 17 nt, Shigella flexneri 2a str. 2457T
aacugccaguaaagcag

SEQ ID NO: 1924612 - RNA, 18 nt, Shigella flexneri 2a str. 2457T
aacugccaguucccccug

SEQ ID NO: 1924613 - RNA, 23 nt, Shigella flexneri 2a str. 2457T
aacuguuucgcgguaaacugcau

SEQ ID NO: 1924614 - RNA, 15 nt, Shigella flexneri 2a str. 2457T
aacuucacucucuuu

SEQ ID NO: 1924615 - RNA, 24 nt, Shigella flexneri 2a str. 2457T
aacuucacuuccccgagcucaaua

SEQ ID NO: 1924616 - RNA, 23 nt, Shigella flexneri 2a str. 2457T
aacuguuucaccauuugugcaua

SEQ ID NO: 1924617 - RNA, 14 nt, Shigella flexneri 2a str. 2457T
aacuguguaaugcg

SEQ ID NO: 1924618 - RNA, 16 nt, Shigella flexneri 2a str. 2457T
aacugugguccuggcu

SEQ ID NO: 1924619 - RNA, 13 nt, Shigella flexneri 2a str. 2457T
aacuucaucagca

SEQ ID NO: 1924620 - RNA, 21 nt, Shigella flexneri 2a str. 2457T
aacggauaugauuuaaaaaau

SEQ ID NO: 1924621 - RNA, 20 nt, Shigella flexneri 2a str. 2457T
aacgcucggcaacaccucag

SEQ ID NO: 1924622 - RNA, 17 nt, Shigella flexneri 2a str. 2457T
aacggccugaccauuac

SEQ ID NO: 1924623 - RNA, 21 nt, Shigella flexneri 2a str. 2457T
aacggcaagaucagcauccau

SEQ ID NO: 1924624 - RNA, 18 nt, Shigella flexneri 2a str. 2457T
aacggcacgauaaauggc

SEQ ID NO: 1924625 - RNA, 16 nt, Shigella flexneri 2a str. 2457T
aacggcacgaugagca

SEQ ID NO: 1924626 - RNA, 19 nt, Shigella flexneri 2a str. 2457T
aacggcacggaaagcagca

SEQ ID NO: 1924627 - RNA, 15 nt, Shigella flexneri 2a str. 2457T
aacgccacgcucacu

SEQ ID NO: 1924628 - RNA, 22 nt, Shigella flexneri 2a str. 2457T
aacgccugggcgagguggauau

SEQ ID NO: 1924629 - RNA, 14 nt, Shigella flexneri 2a str. 2457T
aacgccuguguccu

SEQ ID NO: 1924630 - RNA, 13 nt, Shigella flexneri 2a str. 2457T
aacgccaaauucu

SEQ ID NO: 1924631 - RNA, 16 nt, Shigella flexneri 2a str. 2457T
aacgccuuauccggcc

SEQ ID NO: 1924632 - RNA, 16 nt, Shigella flexneri 2a str. 2457T
aacgccuuauccggcu

SEQ ID NO: 1924633 - RNA, 16 nt, Shigella flexneri 2a str. 2457T
aacgcgaccgccgcca

SEQ ID NO: 1924634 - RNA, 15 nt, Shigella flexneri 2a str. 2457T
aacgcggcccaggcg

SEQ ID NO: 1924635 - RNA, 15 nt, Shigella flexneri 2a str. 2457T
aacgcguacccagca

SEQ ID NO: 1924636 - RNA, 13 nt, Shigella flexneri 2a str. 2457T
aacgcgccaagau

SEQ ID NO: 1924637 - RNA, 17 nt, Shigella flexneri 2a str. 2457T
aacgcgcaaccagcagg

SEQ ID NO: 1924638 - RNA, 20 nt, Shigella flexneri 2a str. 2457T
aacgcgcuacugaaucccug

SEQ ID NO: 1924639 - RNA, 21 nt, Shigella flexneri 2a str. 2457T
aacgacaccguuaaauaacug

SEQ ID NO: 1924640 - RNA, 19 nt, Shigella flexneri 2a str. 2457T
aacgacaccguuaaauaac

SEQ ID NO: 1924641 - RNA, 19 nt, Shigella flexneri 2a str. 2457T
aacgacagugacuuccguc

SEQ ID NO: 1924642 - RNA, 22 nt, Shigella flexneri 2a str. 2457T
aacgacaccguuaaauaacugg

SEQ ID NO: 1924643 - RNA, 21 nt, Shigella flexneri 2a str. 2457T
aacgaccggccauuccagcac

SEQ ID NO: 1924644 - RNA, 19 nt, Shigella flexneri 2a str. 2457T
aacgacgcauacucuuuga

SEQ ID NO: 1924645 - RNA, 21 nt, Shigella flexneri 2a str. 2457T
aacgacgacugccgcucaccu

SEQ ID NO: 1924646 - RNA, 18 nt, Shigella flexneri 2a str. 2457T
aacgacgagcgcugguga

SEQ ID NO: 1924647 - RNA, 21 nt, Shigella flexneri 2a str. 2457T
aacgaccaucagcugccaggg

SEQ ID NO: 1924648 - RNA, 18 nt, Shigella flexneri 2a str. 2457T
aacgacugcgagcaaaau

SEQ ID NO: 1924649 - RNA, 14 nt, Shigella flexneri 2a str. 2457T
aacgacggcguggu

SEQ ID NO: 1924650 - RNA, 17 nt, Shigella flexneri 2a str. 2457T
aacgagccaauaaaaau

SEQ ID NO: 1924651 - RNA, 15 nt, Shigella flexneri 2a str. 2457T
aacgagcgcaaugaa

SEQ ID NO: 1924652 - RNA, 18 nt, Shigella flexneri 2a str. 2457T
aacgcacgucugauguaa

SEQ ID NO: 1924653 - RNA, 23 nt, Shigella flexneri 2a str. 2457T
aacgcauuuaucuucaaggcaga

SEQ ID NO: 1924654 - RNA, 16 nt, Shigella flexneri 2a str. 2457T
aacgcaugcacaucca

SEQ ID NO: 1924655 - RNA, 15 nt, Shigella flexneri 2a str. 2457T
aaccgucagcaccag

SEQ ID NO: 1924656 - RNA, 21 nt, Shigella flexneri 2a str. 2457T
aaccguaguggccacagauaa

SEQ ID NO: 1924657 - RNA, 16 nt, Shigella flexneri 2a str. 2457T
aaccguuuacgucauu

SEQ ID NO: 1924658 - RNA, 19 nt, Shigella flexneri 2a str. 2457T
aaccgugcgggcaucaucu

SEQ ID NO: 1924659 - RNA, 14 nt, Shigella flexneri 2a str. 2457T
aaccgugggaaaca

SEQ ID NO: 1924660 - RNA, 19 nt, Shigella flexneri 2a str. 2457T
aacccgcagccgccagaaa

SEQ ID NO: 1924661 - RNA, 13 nt, Shigella flexneri 2a str. 2457T
aacccgccagacc

SEQ ID NO: 1924662 - RNA, 15 nt, Shigella flexneri 2a str. 2457T
aacccgcgaauauca

SEQ ID NO: 1924663 - RNA, 23 nt, Shigella flexneri 2a str. 2457T
aaccguaaacagauaggcaucag

SEQ ID NO: 1924664 - RNA, 15 nt, Shigella flexneri 2a str. 2457T
aaccuaaaaagaaaa

SEQ ID NO: 1924665 - RNA, 18 nt, Shigella flexneri 2a str. 2457T
aaccuaagaaccagaauu

SEQ ID NO: 1924666 - RNA, 19 nt, Shigella flexneri 2a str. 2457T
aaccuacgugcgcaauaac

SEQ ID NO: 1924667 - RNA, 17 nt, Shigella flexneri 2a str. 2457T
aaccuauaaaagauagu

SEQ ID NO: 1924668 - RNA, 21 nt, Shigella flexneri 2a str. 2457T
aaccucgcccauuuuucauga

SEQ ID NO: 1924669 - RNA, 14 nt, Shigella flexneri 2a str. 2457T
aaccucgcccgcag

SEQ ID NO: 1924670 - RNA, 18 nt, Shigella flexneri 2a str. 2457T
aaccuccucggcaaaaca

SEQ ID NO: 1924671 - RNA, 22 nt, Shigella flexneri 2a str. 2457T
aaccucacagaggucuuuucuc

SEQ ID NO: 1924672 - RNA, 12 nt, Shigella flexneri 2a str. 2457T
aaccugccuuac

SEQ ID NO: 1924673 - RNA, 16 nt, Shigella flexneri 2a str. 2457T
aaccugcacgaaacca

SEQ ID NO: 1924674 - RNA, 19 nt, Shigella flexneri 2a str. 2457T
aaccugcacgaaaccacug

SEQ ID NO: 1924675 - RNA, 17 nt, Shigella flexneri 2a str. 2457T
aaccugacucgguucaa

SEQ ID NO: 1924676 - RNA, 14 nt, Shigella flexneri 2a str. 2457T
aaccugacaacaaa

SEQ ID NO: 1924677 - RNA, 16 nt, Shigella flexneri 2a str. 2457T
aaccucuuccagcaga

SEQ ID NO: 1924678 - RNA, 13 nt, Shigella flexneri 2a str. 2457T
aaccuguuuucac

SEQ ID NO: 1924679 - RNA, 17 nt, Shigella flexneri 2a str. 2457T
aaccugugacagcagcg

SEQ ID NO: 1924680 - RNA, 19 nt, Shigella flexneri 2a str. 2457T
aaccuguugaaauuauugc

SEQ ID NO: 1924681 - RNA, 19 nt, Shigella flexneri 2a str. 2457T
aaccuucaucguuucugcu

SEQ ID NO: 1924682 - RNA, 18 nt, Shigella flexneri 2a str. 2457T
aaccuuggucgaagcuuc

SEQ ID NO: 1924683 - RNA, 21 nt, Shigella flexneri 2a str. 2457T
aaccuuuucucaaucaaaaga

SEQ ID NO: 1924684 - RNA, 21 nt, Shigella flexneri 2a str. 2457T
aaccuuugcgguuaaaaauaa

SEQ ID NO: 1924685 - RNA, 21 nt, Shigella flexneri 2a str. 2457T
aacgaaccauaaaaucacagg

SEQ ID NO: 1924686 - RNA, 21 nt, Shigella flexneri 2a str. 2457T
aacgaaagucccgauaaccgc

SEQ ID NO: 1924687 - RNA, 20 nt, Shigella flexneri 2a str. 2457T
aacgaaagcagggcggcagg

SEQ ID NO: 1924688 - RNA, 17 nt, Shigella flexneri 2a str. 2457T
aacgaaaagcgcacaac

SEQ ID NO: 1924689 - RNA, 18 nt, Shigella flexneri 2a str. 2457T
aaccagccaaauaaaauc

SEQ ID NO: 1924690 - RNA, 20 nt, Shigella flexneri 2a str. 2457T
aaccagcacuucgccaucug

SEQ ID NO: 1924691 - RNA, 22 nt, Shigella flexneri 2a str. 2457T
aaccagcacuucgccaucugcc

SEQ ID NO: 1924692 - RNA, 14 nt, Shigella flexneri 2a str. 2457T
aaccagacugugaa

SEQ ID NO: 1924693 - RNA, 18 nt, Shigella flexneri 2a str. 2457T
aaccaggcgagaucggca

SEQ ID NO: 1924694 - RNA, 23 nt, Shigella flexneri 2a str. 2457T
aaccaggcgagaucggcaggcag

SEQ ID NO: 1924695 - RNA, 22 nt, Shigella flexneri 2a str. 2457T
aaccaggaagauguacgccagu

SEQ ID NO: 1924696 - RNA, 14 nt, Shigella flexneri 2a str. 2457T
aaccagcgucagcc

SEQ ID NO: 1924697 - RNA, 18 nt, Shigella flexneri 2a str. 2457T
aaccagcgucagccagaa

SEQ ID NO: 1924698 - RNA, 23 nt, Shigella flexneri 2a str. 2457T
aaccagcguuuccagcaccaguu

SEQ ID NO: 1924699 - RNA, 21 nt, Shigella flexneri 2a str. 2457T
aaccagcguuuccagcaccag

SEQ ID NO: 1924700 - RNA, 17 nt, Shigella flexneri 2a str. 2457T
aaccccggcaaaugucg

SEQ ID NO: 1924701 - RNA, 18 nt, Shigella flexneri 2a str. 2457T
aaccauauaugauaauua

SEQ ID NO: 1924702 - RNA, 19 nt, Shigella flexneri 2a str. 2457T
aaccagugaauacugcgcg

SEQ ID NO: 1924703 - RNA, 14 nt, Shigella flexneri 2a str. 2457T
aaccagugacauac

SEQ ID NO: 1924704 - RNA, 22 nt, Shigella flexneri 2a str. 2457T
aaccagugccaaaccagaugaa

SEQ ID NO: 1924705 - RNA, 23 nt, Shigella flexneri 2a str. 2457T
aaccagugccaaaccagaugaau

SEQ ID NO: 1924706 - RNA, 21 nt, Shigella flexneri 2a str. 2457T
aaccaguucauuuuucucaac

SEQ ID NO: 1924707 - RNA, 20 nt, Shigella flexneri 2a str. 2457T
aaccaguugugcaccaccaa

SEQ ID NO: 1924708 - RNA, 13 nt, Shigella flexneri 2a str. 2457T
aaccauaaucuca

SEQ ID NO: 1924709 - RNA, 23 nt, Shigella flexneri 2a str. 2457T
aacaucguaucuggcaagcagga

SEQ ID NO: 1924710 - RNA, 22 nt, Shigella flexneri 2a str. 2457T
aacauggcacugcgaucccggc

SEQ ID NO: 1924711 - RNA, 22 nt, Shigella flexneri 2a str. 2457T
aacauggauucgaugaucaacc

SEQ ID NO: 1924712 - RNA, 13 nt, Shigella flexneri 2a str. 2457T
aaccacaucaauc

SEQ ID NO: 1924713 - RNA, 13 nt, Shigella flexneri 2a str. 2457T
aaccacagcgccg

SEQ ID NO: 1924714 - RNA, 20 nt, Shigella flexneri 2a str. 2457T
aaccaccgucgucccuuccg

SEQ ID NO: 1924715 - RNA, 15 nt, Shigella flexneri 2a str. 2457T
aaccagaaagggaag

SEQ ID NO: 1924716 - RNA, 16 nt, Shigella flexneri 2a str. 2457T
aaccacuuaauuauua

SEQ ID NO: 1924717 - RNA, 14 nt, Shigella flexneri 2a str. 2457T
aaccacccagcagc

SEQ ID NO: 1924718 - RNA, 20 nt, Shigella flexneri 2a str. 2457T
aaccaccccaccuuaccugu

SEQ ID NO: 1924719 - RNA, 21 nt, Shigella flexneri 2a str. 2457T
aaccaccuccacgcccagcgc

SEQ ID NO: 1924720 - RNA, 14 nt, Shigella flexneri 2a str. 2457T
aaccaaacagucac

SEQ ID NO: 1924721 - RNA, 16 nt, Shigella flexneri 2a str. 2457T
aaccaaaaauuuccac

SEQ ID NO: 1924722 - RNA, 14 nt, Shigella flexneri 2a str. 2457T
aacaguucagcagc

SEQ ID NO: 1924723 - RNA, 18 nt, Shigella flexneri 2a str. 2457T
aacagucuggagcaaaaa

SEQ ID NO: 1924724 - RNA, 20 nt, Shigella flexneri 2a str. 2457T
aacagugccaugccaaucag

SEQ ID NO: 1924725 - RNA, 16 nt, Shigella flexneri 2a str. 2457T
aacagugaaacacaug

SEQ ID NO: 1924726 - RNA, 12 nt, Shigella flexneri 2a str. 2457T
aacaguuuucaa

SEQ ID NO: 1924727 - RNA, 23 nt, Shigella flexneri 2a str. 2457T
aacaguuuucaagacgccgucca

SEQ ID NO: 1924728 - RNA, 13 nt, Shigella flexneri 2a str. 2457T
aacaguuucugca

SEQ ID NO: 1924729 - RNA, 12 nt, Shigella flexneri 2a str. 2457T
aacaguuucugc

SEQ ID NO: 1924730 - RNA, 17 nt, Shigella flexneri 2a str. 2457T
aacaguucuggaagaga

SEQ ID NO: 1924731 - RNA, 13 nt, Shigella flexneri 2a str. 2457T
aacaguuucgcca

SEQ ID NO: 1924732 - RNA, 17 nt, Shigella flexneri 2a str. 2457T
aacauauccuucacaca

SEQ ID NO: 1924733 - RNA, 20 nt, Shigella flexneri 2a str. 2457T
aacaucagcguggcgagaau

SEQ ID NO: 1924734 - RNA, 12 nt, Shigella flexneri 2a str. 2457T
aacaucauaaua

SEQ ID NO: 1924735 - RNA, 21 nt, Shigella flexneri 2a str. 2457T
aacaucgccugccgcaggacg

SEQ ID NO: 1924736 - RNA, 20 nt, Shigella flexneri 2a str. 2457T
aacaucggcuuauucauauc

SEQ ID NO: 1924737 - RNA, 19 nt, Shigella flexneri 2a str. 2457T
aacagcgcgccagccacca

SEQ ID NO: 1924738 - RNA, 14 nt, Shigella flexneri 2a str. 2457T
aacagcggcauuac

SEQ ID NO: 1924739 - RNA, 15 nt, Shigella flexneri 2a str. 2457T
aacaaggcaggauua

SEQ ID NO: 1924740 - RNA, 14 nt, Shigella flexneri 2a str. 2457T
aacaggaaguuuca

SEQ ID NO: 1924741 - RNA, 19 nt, Shigella flexneri 2a str. 2457T
aacaguaaacucgacuuuc

SEQ ID NO: 1924742 - RNA, 20 nt, Shigella flexneri 2a str. 2457T
aacaguacauuguuuuccag

SEQ ID NO: 1924743 - RNA, 11 nt, Shigella flexneri 2a str. 2457T
aacaguacauu

SEQ ID NO: 1924744 - RNA, 18 nt, Shigella flexneri 2a str. 2457T
aacaguacacagacgaag

SEQ ID NO: 1924745 - RNA, 21 nt, Shigella flexneri 2a str. 2457T
aacaguagacaauuuuucaua

SEQ ID NO: 1924746 - RNA, 22 nt, Shigella flexneri 2a str. 2457T
aacaggcagggccaccagcgug

SEQ ID NO: 1924747 - RNA, 14 nt, Shigella flexneri 2a str. 2457T
aacaggcagcugcc

SEQ ID NO: 1924748 - RNA, 12 nt, Shigella flexneri 2a str. 2457T
aacaggaucugg

SEQ ID NO: 1924749 - RNA, 13 nt, Shigella flexneri 2a str. 2457T
aacaggcaacaac

SEQ ID NO: 1924750 - RNA, 16 nt, Shigella flexneri 2a str. 2457T
cgccuggaccagcggg

SEQ ID NO: 1924751 - RNA, 16 nt, Shigella flexneri 2a str. 2457T
cgccugguaccagcac

SEQ ID NO: 1924752 - RNA, 14 nt, Shigella flexneri 2a str. 2457T
cgccugcaucucuu

SEQ ID NO: 1924753 - RNA, 14 nt, Shigella flexneri 2a str. 2457T
cgccugcauacguu

SEQ ID NO: 1924754 - RNA, 14 nt, Shigella flexneri 2a str. 2457T
cgccugcagggcuu

SEQ ID NO: 1924755 - RNA, 13 nt, Shigella flexneri 2a str. 2457T
cgccugaaaguau

SEQ ID NO: 1924756 - RNA, 18 nt, Shigella flexneri 2a str. 2457T
cgccugaaauacccgcuc

SEQ ID NO: 1924757 - RNA, 22 nt, Shigella flexneri 2a str. 2457T
cgccucuaacagaucauccauc

SEQ ID NO: 1924758 - RNA, 12 nt, Shigella flexneri 2a str. 2457T
cgccucuucaua

SEQ ID NO: 1924759 - RNA, 17 nt, Shigella flexneri 2a str. 2457T
cgccucuucauacaucu

SEQ ID NO: 1924760 - RNA, 23 nt, Shigella flexneri 2a str. 2457T
cgccucugcaagguucuuugcug

SEQ ID NO: 1924761 - RNA, 17 nt, Shigella flexneri 2a str. 2457T
cgccugauagcccgcac

SEQ ID NO: 1924762 - RNA, 14 nt, Shigella flexneri 2a str. 2457T
cgccucgcgccagc

SEQ ID NO: 1924763 - RNA, 24 nt, Shigella flexneri 2a str. 2457T
cgccucguaaugcuccggcuccgc

SEQ ID NO: 1924764 - RNA, 21 nt, Shigella flexneri 2a str. 2457T
cgcgaacuaaacaacgccgcc

SEQ ID NO: 1924765 - RNA, 18 nt, Shigella flexneri 2a str. 2457T
cgcgaaucuccacgccuu

SEQ ID NO: 1924766 - RNA, 15 nt, Shigella flexneri 2a str. 2457T
cgccuuauccggccu

SEQ ID NO: 1924767 - RNA, 20 nt, Shigella flexneri 2a str. 2457T
cgccuuauccggccuaccgu

SEQ ID NO: 1924768 - RNA, 15 nt, Shigella flexneri 2a str. 2457T
cgccuucauucaggc

SEQ ID NO: 1924769 - RNA, 13 nt, Shigella flexneri 2a str. 2457T
cgccuucaugcca

SEQ ID NO: 1924770 - RNA, 18 nt, Shigella flexneri 2a str. 2457T
cgccuucagguuuuucag

SEQ ID NO: 1924771 - RNA, 11 nt, Shigella flexneri 2a str. 2457T
cgcgaccacca

SEQ ID NO: 1924772 - RNA, 14 nt, Shigella flexneri 2a str. 2457T
cgccgggguuaugu

SEQ ID NO: 1924773 - RNA, 17 nt, Shigella flexneri 2a str. 2457T
cgccgguuccagcuuca

SEQ ID NO: 1924774 - RNA, 21 nt, Shigella flexneri 2a str. 2457T
cgccgugcacuucugcgguga

SEQ ID NO: 1924775 - RNA, 20 nt, Shigella flexneri 2a str. 2457T
cgccgugcaacugcggcgca

SEQ ID NO: 1924776 - RNA, 15 nt, Shigella flexneri 2a str. 2457T
cgccgucaucacgca

SEQ ID NO: 1924777 - RNA, 18 nt, Shigella flexneri 2a str. 2457T
cgccgucaucacgcaggc

SEQ ID NO: 1924778 - RNA, 14 nt, Shigella flexneri 2a str. 2457T
cgccguccggcgcu

SEQ ID NO: 1924779 - RNA, 15 nt, Shigella flexneri 2a str. 2457T
cgccguugccgcagc

SEQ ID NO: 1924780 - RNA, 14 nt, Shigella flexneri 2a str. 2457T
cgccucaacccauu

SEQ ID NO: 1924781 - RNA, 19 nt, Shigella flexneri 2a str. 2457T
cgccuaccggaaucgcgcg

SEQ ID NO: 1924782 - RNA, 17 nt, Shigella flexneri 2a str. 2457T
cgccuacggcauucugc

SEQ ID NO: 1924783 - RNA, 16 nt, Shigella flexneri 2a str. 2457T
cgccuaauaaauuugg

SEQ ID NO: 1924784 - RNA, 19 nt, Shigella flexneri 2a str. 2457T
cgccguuuuuuuucuguca

SEQ ID NO: 1924785 - RNA, 14 nt, Shigella flexneri 2a str. 2457T
cgccuccuguucug

SEQ ID NO: 1924786 - RNA, 14 nt, Shigella flexneri 2a str. 2457T
cgccucgcauaauc

SEQ ID NO: 1924787 - RNA, 17 nt, Shigella flexneri 2a str. 2457T
cgccucccuucgcugcu

SEQ ID NO: 1924788 - RNA, 13 nt, Shigella flexneri 2a str. 2457T
cgccucagccaga

SEQ ID NO: 1924789 - RNA, 14 nt, Shigella flexneri 2a str. 2457T
cgccucagccagaa

SEQ ID NO: 1924790 - RNA, 14 nt, Shigella flexneri 2a str. 2457T
cgcgccgccaaccc

SEQ ID NO: 1924791 - RNA, 16 nt, Shigella flexneri 2a str. 2457T
cgcgccgggcagaguc

SEQ ID NO: 1924792 - RNA, 13 nt, Shigella flexneri 2a str. 2457T
cgcgcgccaccau

SEQ ID NO: 1924793 - RNA, 13 nt, Shigella flexneri 2a str. 2457T
cgcgccugccagg

SEQ ID NO: 1924794 - RNA, 18 nt, Shigella flexneri 2a str. 2457T
cgcgagcuuuccggcggu

SEQ ID NO: 1924795 - RNA, 15 nt, Shigella flexneri 2a str. 2457T
cgcgagguuuuccuu

SEQ ID NO: 1924796 - RNA, 18 nt, Shigella flexneri 2a str. 2457T
cgcgcaauauccugcgcu

SEQ ID NO: 1924797 - RNA, 16 nt, Shigella flexneri 2a str. 2457T
cgcgcacaucaggacg

SEQ ID NO: 1924798 - RNA, 22 nt, Shigella flexneri 2a str. 2457T
cgcgccagaacacgcucccagc

SEQ ID NO: 1924799 - RNA, 12 nt, Shigella flexneri 2a str. 2457T
cgcgccagccag

SEQ ID NO: 1924800 - RNA, 14 nt, Shigella flexneri 2a str. 2457T
cgcgccaccgacca

SEQ ID NO: 1924801 - RNA, 19 nt, Shigella flexneri 2a str. 2457T
cgcgccacaucagacucag

SEQ ID NO: 1924802 - RNA, 20 nt, Shigella flexneri 2a str. 2457T
cgcgcaguuaaacgccuugc

SEQ ID NO: 1924803 - RNA, 18 nt, Shigella flexneri 2a str. 2457T
cgcgcaguuucuuaccua

SEQ ID NO: 1924804 - RNA, 22 nt, Shigella flexneri 2a str. 2457T
cgcgcucgaagcgggcgcgcag

SEQ ID NO: 1924805 - RNA, 15 nt, Shigella flexneri 2a str. 2457T
cgcgcguucgcagag

SEQ ID NO: 1924806 - RNA, 16 nt, Shigella flexneri 2a str. 2457T
cgcggaagacccggcg

SEQ ID NO: 1924807 - RNA, 17 nt, Shigella flexneri 2a str. 2457T
cgcgcuuuuuuuaugcc

SEQ ID NO: 1924808 - RNA, 18 nt, Shigella flexneri 2a str. 2457T
cgcgcucgucagcuuauu

SEQ ID NO: 1924809 - RNA, 14 nt, Shigella flexneri 2a str. 2457T
cgcgcucuucuucg

SEQ ID NO: 1924810 - RNA, 18 nt, Shigella flexneri 2a str. 2457T
cgcgcugagguccggcca

SEQ ID NO: 1924811 - RNA, 13 nt, Shigella flexneri 2a str. 2457T
cgcggcuccagaa

SEQ ID NO: 1924812 - RNA, 19 nt, Shigella flexneri 2a str. 2457T
cgcggauuuuauucagcag

SEQ ID NO: 1924813 - RNA, 16 nt, Shigella flexneri 2a str. 2457T
cgcggcccaggcggcg

SEQ ID NO: 1924814 - RNA, 23 nt, Shigella flexneri 2a str. 2457T
cgcggcgauaaugcccagcaacg

SEQ ID NO: 1924815 - RNA, 14 nt, Shigella flexneri 2a str. 2457T
cgcuucuucagccu

SEQ ID NO: 1924816 - RNA, 21 nt, Shigella flexneri 2a str. 2457T
cgcuucggcuccagcgcgucu

SEQ ID NO: 1924817 - RNA, 17 nt, Shigella flexneri 2a str. 2457T
cgcuucggcggguuuuu

SEQ ID NO: 1924818 - RNA, 14 nt, Shigella flexneri 2a str. 2457T
cgcuucucccagcc

SEQ ID NO: 1924819 - RNA, 14 nt, Shigella flexneri 2a str. 2457T
cgcuucguuuucag

SEQ ID NO: 1924820 - RNA, 19 nt, Shigella flexneri 2a str. 2457T
cgcuucccaacgcagcaac

SEQ ID NO: 1924821 - RNA, 19 nt, Shigella flexneri 2a str. 2457T
cgcuuccagcgcaucugcc

SEQ ID NO: 1924822 - RNA, 13 nt, Shigella flexneri 2a str. 2457T
cgcuuccagcaga

SEQ ID NO: 1924823 - RNA, 14 nt, Shigella flexneri 2a str. 2457T
cgcuucagugacuu

SEQ ID NO: 1924824 - RNA, 19 nt, Shigella flexneri 2a str. 2457T
cgcuucagugacuucugcc

SEQ ID NO: 1924825 - RNA, 14 nt, Shigella flexneri 2a str. 2457T
cgcuucaggaauaa

SEQ ID NO: 1924826 - RNA, 17 nt, Shigella flexneri 2a str. 2457T
cgcuuacgccugccagc

SEQ ID NO: 1924827 - RNA, 23 nt, Shigella flexneri 2a str. 2457T
cgcuuacgcgucuuaucaugccu

SEQ ID NO: 1924828 - RNA, 17 nt, Shigella flexneri 2a str. 2457T
cgcuuacccuaaauccg

SEQ ID NO: 1924829 - RNA, 17 nt, Shigella flexneri 2a str. 2457T
cgcuuacacacccggcc

SEQ ID NO: 1924830 - RNA, 19 nt, Shigella flexneri 2a str. 2457T
cgcuuacucauccacugcc

SEQ ID NO: 1924831 - RNA, 22 nt, Shigella flexneri 2a str. 2457T
cgcuucaccgacaucuuucugc

SEQ ID NO: 1924832 - RNA, 13 nt, Shigella flexneri 2a str. 2457T
cgcuucaccaccg

SEQ ID NO: 1924833 - RNA, 20 nt, Shigella flexneri 2a str. 2457T
cgcuguugaggcacaucuua

SEQ ID NO: 1924834 - RNA, 17 nt, Shigella flexneri 2a str. 2457T
cgcuguugcguaacuga

SEQ ID NO: 1924835 - RNA, 14 nt, Shigella flexneri 2a str. 2457T
cgcuuaauccgcgc

SEQ ID NO: 1924836 - RNA, 18 nt, Shigella flexneri 2a str. 2457T
cgcuuaaauuuccaccgc

SEQ ID NO: 1924837 - RNA, 15 nt, Shigella flexneri 2a str. 2457T
cgcuggcgcgccgcc

SEQ ID NO: 1924838 - RNA, 19 nt, Shigella flexneri 2a str. 2457T
cgcuggcgcucaagucgaa

SEQ ID NO: 1924839 - RNA, 11 nt, Shigella flexneri 2a str. 2457T
cgcuguaaaug

SEQ ID NO: 1924840 - RNA, 14 nt, Shigella flexneri 2a str. 2457T
cgcugguguacugc

SEQ ID NO: 1924841 - RNA, 19 nt, Shigella flexneri 2a str. 2457T
cgcuggugauugcaccgac

SEQ ID NO: 1924842 - RNA, 20 nt, Shigella flexneri 2a str. 2457T
cgcuguaauuuuuuuauuga

SEQ ID NO: 1924843 - RNA, 23 nt, Shigella flexneri 2a str. 2457T
cgcugcauugacaagcucaccuc

SEQ ID NO: 1924844 - RNA, 20 nt, Shigella flexneri 2a str. 2457T
cgcugcauugcccaauacag

SEQ ID NO: 1924845 - RNA, 14 nt, Shigella flexneri 2a str. 2457T
cgcugauuuuucug

SEQ ID NO: 1924846 - RNA, 20 nt, Shigella flexneri 2a str. 2457T
cgcugauuucaccaucuuca

SEQ ID NO: 1924847 - RNA, 21 nt, Shigella flexneri 2a str. 2457T
cgcugauauucgacaccaucu

SEQ ID NO: 1924848 - RNA, 18 nt, Shigella flexneri 2a str. 2457T
cgcugagguuaugcaaac

SEQ ID NO: 1924849 - RNA, 15 nt, Shigella flexneri 2a str. 2457T
cgcugacucuacuga

SEQ ID NO: 1924850 - RNA, 14 nt, Shigella flexneri 2a str. 2457T
cgcugacggcagcg

SEQ ID NO: 1924851 - RNA, 19 nt, Shigella flexneri 2a str. 2457T
cgcugagacgcgcuugcau

SEQ ID NO: 1924852 - RNA, 15 nt, Shigella flexneri 2a str. 2457T
cgcugagagaagcac

SEQ ID NO: 1924853 - RNA, 21 nt, Shigella flexneri 2a str. 2457T
cgcugagauacucaagcagcc

SEQ ID NO: 1924854 - RNA, 22 nt, Shigella flexneri 2a str. 2457T
cgcugagcgauaaaaucagaaa

SEQ ID NO: 1924855 - RNA, 20 nt, Shigella flexneri 2a str. 2457T
cgcugacgcgucuuaucugg

SEQ ID NO: 1924856 - RNA, 24 nt, Shigella flexneri 2a str. 2457T
cgcugacgauuguagaaaaucuca

SEQ ID NO: 1924857 - RNA, 17 nt, Shigella flexneri 2a str. 2457T
cgcugcgguuuacgcca

SEQ ID NO: 1924858 - RNA, 13 nt, Shigella flexneri 2a str. 2457T
cgcugcguagcca

SEQ ID NO: 1924859 - RNA, 19 nt, Shigella flexneri 2a str. 2457T
cgcugcggcggacaaaguu

SEQ ID NO: 1924860 - RNA, 18 nt, Shigella flexneri 2a str. 2457T
cgcugcuguacuuuuucc

SEQ ID NO: 1924861 - RNA, 22 nt, Shigella flexneri 2a str. 2457T
cgcuggagaacaaggcuuuaau

SEQ ID NO: 1924862 - RNA, 16 nt, Shigella flexneri 2a str. 2457T
cgcugcuuuccugcug

SEQ ID NO: 1924863 - RNA, 11 nt, Shigella flexneri 2a str. 2457T
cgcuggcaaca

SEQ ID NO: 1924864 - RNA, 19 nt, Shigella flexneri 2a str. 2457T
cgcugcgcuuauccggccc

SEQ ID NO: 1924865 - RNA, 23 nt, Shigella flexneri 2a str. 2457T
cgcugccuucggcgucuccaccu

SEQ ID NO: 1924866 - RNA, 16 nt, Shigella flexneri 2a str. 2457T
cgcugccgcuucuucu

SEQ ID NO: 1924867 - RNA, 20 nt, Shigella flexneri 2a str. 2457T
cgcugccucucuucgcugcu

SEQ ID NO: 1924868 - RNA, 23 nt, Shigella flexneri 2a str. 2457T
cgcguggcaauggcgacuucugc

SEQ ID NO: 1924869 - RNA, 22 nt, Shigella flexneri 2a str. 2457T
cgcgugccuaacaauucgccag

SEQ ID NO: 1924870 - RNA, 18 nt, Shigella flexneri 2a str. 2457T
cgcguuguugcaggaaca

SEQ ID NO: 1924871 - RNA, 22 nt, Shigella flexneri 2a str. 2457T
cgcguuguauaacguggugaaa

SEQ ID NO: 1924872 - RNA, 14 nt, Shigella flexneri 2a str. 2457T
cgcuaccgcccuga

SEQ ID NO: 1924873 - RNA, 14 nt, Shigella flexneri 2a str. 2457T
cgcguuuacagagc

SEQ ID NO: 1924874 - RNA, 21 nt, Shigella flexneri 2a str. 2457T
cgcguuuccacgcugauugca

SEQ ID NO: 1924875 - RNA, 18 nt, Shigella flexneri 2a str. 2457T
cgcgucgaccauaagaaa

SEQ ID NO: 1924876 - RNA, 18 nt, Shigella flexneri 2a str. 2457T
cgcgggccauccaccagu

SEQ ID NO: 1924877 - RNA, 15 nt, Shigella flexneri 2a str. 2457T
cgcuagugcauugag

SEQ ID NO: 1924878 - RNA, 21 nt, Shigella flexneri 2a str. 2457T
cgcuaucguccacgucaucaa

SEQ ID NO: 1924879 - RNA, 21 nt, Shigella flexneri 2a str. 2457T
cgcuagcgucguggcaaaaug

SEQ ID NO: 1924880 - RNA, 15 nt, Shigella flexneri 2a str. 2457T
cgcuacuucaaacaa

SEQ ID NO: 1924881 - RNA, 20 nt, Shigella flexneri 2a str. 2457T
cgcuacuuuuuucacccaca

SEQ ID NO: 1924882 - RNA, 16 nt, Shigella flexneri 2a str. 2457T
cgcucagcgccacauc

SEQ ID NO: 1924883 - RNA, 23 nt, Shigella flexneri 2a str. 2457T
cgcuauuugcgccuggauuuucu

SEQ ID NO: 1924884 - RNA, 19 nt, Shigella flexneri 2a str. 2457T
cgcuauucgaaccaacacu

SEQ ID NO: 1924885 - RNA, 14 nt, Shigella flexneri 2a str. 2457T
cgcuauguuuauca

SEQ ID NO: 1924886 - RNA, 18 nt, Shigella flexneri 2a str. 2457T
cgcucaauaaucaaucuu

SEQ ID NO: 1924887 - RNA, 19 nt, Shigella flexneri 2a str. 2457T
cgcucaauauccugaccuu

SEQ ID NO: 1924888 - RNA, 18 nt, Shigella flexneri 2a str. 2457T
cgcucaaucguaugauca

SEQ ID NO: 1924889 - RNA, 12 nt, Shigella flexneri 2a str. 2457T
cgcuccacuuca

SEQ ID NO: 1924890 - RNA, 20 nt, Shigella flexneri 2a str. 2457T
cgcuccaggaguuccggguc

SEQ ID NO: 1924891 - RNA, 19 nt, Shigella flexneri 2a str. 2457T
cgcuccauugcccgcccga

SEQ ID NO: 1924892 - RNA, 22 nt, Shigella flexneri 2a str. 2457T
cgcuccaaggucuccgcccagc

SEQ ID NO: 1924893 - RNA, 15 nt, Shigella flexneri 2a str. 2457T
cgcucaucaggccua

SEQ ID NO: 1924894 - RNA, 17 nt, Shigella flexneri 2a str. 2457T
cgcucgaacagcugguu

SEQ ID NO: 1924895 - RNA, 18 nt, Shigella flexneri 2a str. 2457T
cgcucccggauaucccag

SEQ ID NO: 1924896 - RNA, 18 nt, Shigella flexneri 2a str. 2457T
cgcucccgcaggagcgcc

SEQ ID NO: 1924897 - RNA, 18 nt, Shigella flexneri 2a str. 2457T
cgcugaauaauggugaau

SEQ ID NO: 1924898 - RNA, 22 nt, Shigella flexneri 2a str. 2457T
cgcugaaucaacaggcgguaac

SEQ ID NO: 1924899 - RNA, 17 nt, Shigella flexneri 2a str. 2457T
cgcugaagaaaauggcc

SEQ ID NO: 1924900 - RNA, 14 nt, Shigella flexneri 2a str. 2457T
cgcugaaaguucau

SEQ ID NO: 1924901 - RNA, 23 nt, Shigella flexneri 2a str. 2457T
cgcugaaagaagcggugaaaaaa

SEQ ID NO: 1924902 - RNA, 19 nt, Shigella flexneri 2a str. 2457T
cgcucucgcagcucaucaa

SEQ ID NO: 1924903 - RNA, 16 nt, Shigella flexneri 2a str. 2457T
cgcucugcccaugcug

SEQ ID NO: 1924904 - RNA, 22 nt, Shigella flexneri 2a str. 2457T
cgcucuguagggagagggccgg

SEQ ID NO: 1924905 - RNA, 21 nt, Shigella flexneri 2a str. 2457T
cgcucuucgaggccgcggcuc

SEQ ID NO: 1924906 - RNA, 23 nt, Shigella flexneri 2a str. 2457T
cgcucuucaucgcuaaaauacug

SEQ ID NO: 1924907 - RNA, 22 nt, Shigella flexneri 2a str. 2457T
cgcucguuaaaacgcgcggcgu

SEQ ID NO: 1924908 - RNA, 21 nt, Shigella flexneri 2a str. 2457T
cgcucggcaaagcgcugaaga

SEQ ID NO: 1924909 - RNA, 16 nt, Shigella flexneri 2a str. 2457T
cgcucgcgccgcaucc

SEQ ID NO: 1924910 - RNA, 14 nt, Shigella flexneri 2a str. 2457T
cgauggcccgcuug

SEQ ID NO: 1924911 - RNA, 16 nt, Shigella flexneri 2a str. 2457T
cgaugucaaucagggc

SEQ ID NO: 1924912 - RNA, 17 nt, Shigella flexneri 2a str. 2457T
cgauguacuucaacaua

SEQ ID NO: 1924913 - RNA, 19 nt, Shigella flexneri 2a str. 2457T
cgaugguugcccugcuggu

SEQ ID NO: 1924914 - RNA, 20 nt, Shigella flexneri 2a str. 2457T
cgaugguugcugucaacuga

SEQ ID NO: 1924915 - RNA, 23 nt, Shigella flexneri 2a str. 2457T
cgaugguugucacugcaucuucc

SEQ ID NO: 1924916 - RNA, 16 nt, Shigella flexneri 2a str. 2457T
cgauggugguggggga

SEQ ID NO: 1924917 - RNA, 20 nt, Shigella flexneri 2a str. 2457T
cgauggugaagucauugaag

SEQ ID NO: 1924918 - RNA, 17 nt, Shigella flexneri 2a str. 2457T
cgauggugaugagcuga

SEQ ID NO: 1924919 - RNA, 14 nt, Shigella flexneri 2a str. 2457T
cgauuauuuauucc

SEQ ID NO: 1924920 - RNA, 21 nt, Shigella flexneri 2a str. 2457T
cgauuauuuauucccgccaga

SEQ ID NO: 1924921 - RNA, 17 nt, Shigella flexneri 2a str. 2457T
cgauucacauuuaaaca

SEQ ID NO: 1924922 - RNA, 19 nt, Shigella flexneri 2a str. 2457T
cgauuuaugauauuuuuuu

SEQ ID NO: 1924923 - RNA, 16 nt, Shigella flexneri 2a str. 2457T
cgauucucgccgcccu

SEQ ID NO: 1924924 - RNA, 16 nt, Shigella flexneri 2a str. 2457T
cgauucgguucaauac

SEQ ID NO: 1924925 - RNA, 15 nt, Shigella flexneri 2a str. 2457T
cgauucggcaaucac

SEQ ID NO: 1924926 - RNA, 21 nt, Shigella flexneri 2a str. 2457T
cgauucgguucaauacccacu

SEQ ID NO: 1924927 - RNA, 16 nt, Shigella flexneri 2a str. 2457T
cgauguuuucugccuc

SEQ ID NO: 1924928 - RNA, 19 nt, Shigella flexneri 2a str. 2457T
cgauuaaaaacccugcaga

SEQ ID NO: 1924929 - RNA, 16 nt, Shigella flexneri 2a str. 2457T
cgauuaccauuucacc

SEQ ID NO: 1924930 - RNA, 21 nt, Shigella flexneri 2a str. 2457T
cgauuaauaaaauuauccagc

SEQ ID NO: 1924931 - RNA, 18 nt, Shigella flexneri 2a str. 2457T
cgauuaauugccgccaga

SEQ ID NO: 1924932 - RNA, 18 nt, Shigella flexneri 2a str. 2457T
cgauuauagcuaacucua

SEQ ID NO: 1924933 - RNA, 18 nt, Shigella flexneri 2a str. 2457T
cgaucucuucgccugccu

SEQ ID NO: 1924934 - RNA, 17 nt, Shigella flexneri 2a str. 2457T
cgaucuuccacgccugc

SEQ ID NO: 1924935 - RNA, 22 nt, Shigella flexneri 2a str. 2457T
cgaucgcuuucgcuuucucuuc

SEQ ID NO: 1924936 - RNA, 13 nt, Shigella flexneri 2a str. 2457T
cgaucucaaucuu

SEQ ID NO: 1924937 - RNA, 21 nt, Shigella flexneri 2a str. 2457T
cgaucuaggaucgggcauuuu

SEQ ID NO: 1924938 - RNA, 23 nt, Shigella flexneri 2a str. 2457T
cgaucgugauacaacugccgcgc

SEQ ID NO: 1924939 - RNA, 23 nt, Shigella flexneri 2a str. 2457T
cgaucuugcgaccgcucuuuuuu

SEQ ID NO: 1924940 - RNA, 14 nt, Shigella flexneri 2a str. 2457T
cgaugaaucaccac

SEQ ID NO: 1924941 - RNA, 19 nt, Shigella flexneri 2a str. 2457T
cgaugaccuugucaugcag

SEQ ID NO: 1924942 - RNA, 14 nt, Shigella flexneri 2a str. 2457T
cgaugacagucugg

SEQ ID NO: 1924943 - RNA, 22 nt, Shigella flexneri 2a str. 2457T
cgaugaccuugucaugcagcuc

SEQ ID NO: 1924944 - RNA, 14 nt, Shigella flexneri 2a str. 2457T
cgaugagaugacgc

SEQ ID NO: 1924945 - RNA, 17 nt, Shigella flexneri 2a str. 2457T
cgaugacuguacagauc

SEQ ID NO: 1924946 - RNA, 16 nt, Shigella flexneri 2a str. 2457T
cgaugaguuaagaaga

SEQ ID NO: 1924947 - RNA, 15 nt, Shigella flexneri 2a str. 2457T
cgaucaucauccagc

SEQ ID NO: 1924948 - RNA, 23 nt, Shigella flexneri 2a str. 2457T
cgaucaucacguuggucuggucg

SEQ ID NO: 1924949 - RNA, 19 nt, Shigella flexneri 2a str. 2457T
cgauccccaaagagagcac

SEQ ID NO: 1924950 - RNA, 17 nt, Shigella flexneri 2a str. 2457T
cgaucgcccgccaagca

SEQ ID NO: 1924951 - RNA, 13 nt, Shigella flexneri 2a str. 2457T
cgauccuucaaac

SEQ ID NO: 1924952 - RNA, 19 nt, Shigella flexneri 2a str. 2457T
cgauaacgccccaauccac

SEQ ID NO: 1924953 - RNA, 12 nt, Shigella flexneri 2a str. 2457T
cgauaagcaccg

SEQ ID NO: 1924954 - RNA, 12 nt, Shigella flexneri 2a str. 2457T
cgauaagggagc

SEQ ID NO: 1924955 - RNA, 22 nt, Shigella flexneri 2a str. 2457T
cgauacgccucgggaaggucag

SEQ ID NO: 1924956 - RNA, 16 nt, Shigella flexneri 2a str. 2457T
cgauacgggcucgggc

SEQ ID NO: 1924957 - RNA, 15 nt, Shigella flexneri 2a str. 2457T
cgauacggucgagga

SEQ ID NO: 1924958 - RNA, 15 nt, Shigella flexneri 2a str. 2457T
cgauaucgaugacgc

SEQ ID NO: 1924959 - RNA, 22 nt, Shigella flexneri 2a str. 2457T
cgauaucgccauuaaacaaccc

SEQ ID NO: 1924960 - RNA, 16 nt, Shigella flexneri 2a str. 2457T
cgauagaauauuucua

SEQ ID NO: 1924961 - RNA, 21 nt, Shigella flexneri 2a str. 2457T
cgauaggggggauugccgcga

SEQ ID NO: 1924962 - RNA, 12 nt, Shigella flexneri 2a str. 2457T
cgauauaauaaa

SEQ ID NO: 1924963 - RNA, 12 nt, Shigella flexneri 2a str. 2457T
cgaucacagcag

SEQ ID NO: 1924964 - RNA, 19 nt, Shigella flexneri 2a str. 2457T
cgaucagcaauuucuccgc

SEQ ID NO: 1924965 - RNA, 20 nt, Shigella flexneri 2a str. 2457T
cgcaggucauccggcacgcu

SEQ ID NO: 1924966 - RNA, 18 nt, Shigella flexneri 2a str. 2457T
cgcagcuucacuucuuac

SEQ ID NO: 1924967 - RNA, 21 nt, Shigella flexneri 2a str. 2457T
cgcaggugacgcgggcagcag

SEQ ID NO: 1924968 - RNA, 17 nt, Shigella flexneri 2a str. 2457T
aaacggucccucaacaa

SEQ ID NO: 1924969 - RNA, 17 nt, Shigella flexneri 2a str. 2457T
aaacgguuuauccccaa

SEQ ID NO: 1924970 - RNA, 19 nt, Shigella flexneri 2a str. 2457T
aaacgguuuauccccaagg

SEQ ID NO: 1924971 - RNA, 19 nt, Shigella flexneri 2a str. 2457T
cgcaguaaauccgccacuu

SEQ ID NO: 1924972 - RNA, 16 nt, Shigella flexneri 2a str. 2457T
cgcaguaccagcaacg

SEQ ID NO: 1924973 - RNA, 23 nt, Shigella flexneri 2a str. 2457T
cgcaguaugcgauacccccagua

SEQ ID NO: 1924974 - RNA, 13 nt, Shigella flexneri 2a str. 2457T
cgcagucaccagc

SEQ ID NO: 1924975 - RNA, 19 nt, Shigella flexneri 2a str. 2457T
cgcagucaugcgagaagca

SEQ ID NO: 1924976 - RNA, 17 nt, Shigella flexneri 2a str. 2457T
cgcaguugcaguaccag

SEQ ID NO: 1924977 - RNA, 13 nt, Shigella flexneri 2a str. 2457T
cgcagucuuccca

SEQ ID NO: 1924978 - RNA, 21 nt, Shigella flexneri 2a str. 2457T
cgcagugagaagccaccgcgc

SEQ ID NO: 1924979 - RNA, 14 nt, Shigella flexneri 2a str. 2457T
cgcagcagcgcgcc

SEQ ID NO: 1924980 - RNA, 13 nt, Shigella flexneri 2a str. 2457T
cgcagccccagag

SEQ ID NO: 1924981 - RNA, 11 nt, Shigella flexneri 2a str. 2457T
cgcagccauca

SEQ ID NO: 1924982 - RNA, 14 nt, Shigella flexneri 2a str. 2457T
cgcagccagcgcgc

SEQ ID NO: 1924983 - RNA, 16 nt, Shigella flexneri 2a str. 2457T
cgcagccagcgcgccu

SEQ ID NO: 1924984 - RNA, 23 nt, Shigella flexneri 2a str. 2457T
cgcagccagcgucgcacccggca

SEQ ID NO: 1924985 - RNA, 12 nt, Shigella flexneri 2a str. 2457T
cgcagccagcac

SEQ ID NO: 1924986 - RNA, 21 nt, Shigella flexneri 2a str. 2457T
cgcagccacgucaccugcccg

SEQ ID NO: 1924987 - RNA, 13 nt, Shigella flexneri 2a str. 2457T
cgcagcugagaaa

SEQ ID NO: 1924988 - RNA, 14 nt, Shigella flexneri 2a str. 2457T
cgauuucgccaccc

SEQ ID NO: 1924989 - RNA, 15 nt, Shigella flexneri 2a str. 2457T
cgauuucucagcaga

SEQ ID NO: 1924990 - RNA, 15 nt, Shigella flexneri 2a str. 2457T
cgcaagcggcaucca

SEQ ID NO: 1924991 - RNA, 15 nt, Shigella flexneri 2a str. 2457T
cgcaauacagccagc

SEQ ID NO: 1924992 - RNA, 22 nt, Shigella flexneri 2a str. 2457T
cgcaaucaccgggccgaugcgg

SEQ ID NO: 1924993 - RNA, 21 nt, Shigella flexneri 2a str. 2457T
cgcaauggccguuccggcaac

SEQ ID NO: 1924994 - RNA, 18 nt, Shigella flexneri 2a str. 2457T
cgcaccccugauaaccgc

SEQ ID NO: 1924995 - RNA, 12 nt, Shigella flexneri 2a str. 2457T
cgcaaugugcuc

SEQ ID NO: 1924996 - RNA, 16 nt, Shigella flexneri 2a str. 2457T
cgcaaugguguacuca

SEQ ID NO: 1924997 - RNA, 18 nt, Shigella flexneri 2a str. 2457T
cgcaauggucccuugcug

SEQ ID NO: 1924998 - RNA, 23 nt, Shigella flexneri 2a str. 2457T
cgcaaucgcccagcgcguaaaua

SEQ ID NO: 1924999 - RNA, 21 nt, Shigella flexneri 2a str. 2457T
cgcaaucgccuccagcgcugg

SEQ ID NO: 1925000 - RNA, 15 nt, Shigella flexneri 2a str. 2457T
cgcaaucgcccagcg

SEQ ID NO: 1925001 - RNA, 18 nt, Shigella flexneri 2a str. 2457T
cgcaaucagcaccgcgcg

SEQ ID NO: 1925002 - RNA, 17 nt, Shigella flexneri 2a str. 2457T
cgcaccggaacaaccca

SEQ ID NO: 1925003 - RNA, 17 nt, Shigella flexneri 2a str. 2457T
cgcaccgccaccaccga

SEQ ID NO: 1925004 - RNA, 18 nt, Shigella flexneri 2a str. 2457T
cgcaccgugacaguaauc

SEQ ID NO: 1925005 - RNA, 17 nt, Shigella flexneri 2a str. 2457T
cgcaccgggcuuccggc

SEQ ID NO: 1925006 - RNA, 17 nt, Shigella flexneri 2a str. 2457T
cgcacggccgcaagcag

SEQ ID NO: 1925007 - RNA, 19 nt, Shigella flexneri 2a str. 2457T
cgcacgcucuauggcaccu

SEQ ID NO: 1925008 - RNA, 16 nt, Shigella flexneri 2a str. 2457T
cgcacgcugucaccag

SEQ ID NO: 1925009 - RNA, 20 nt, Shigella flexneri 2a str. 2457T
cgcacuggcgagcgccagca

SEQ ID NO: 1925010 - RNA, 22 nt, Shigella flexneri 2a str. 2457T
cgcacuggggggcuauccgcgc

SEQ ID NO: 1925011 - RNA, 18 nt, Shigella flexneri 2a str. 2457T
cgcacugcguggagaugu

SEQ ID NO: 1925012 - RNA, 22 nt, Shigella flexneri 2a str. 2457T
cgcagacacuuucccuggcgcu

SEQ ID NO: 1925013 - RNA, 22 nt, Shigella flexneri 2a str. 2457T
cgcagacaaucacaucacugcc

SEQ ID NO: 1925014 - RNA, 13 nt, Shigella flexneri 2a str. 2457T
cgcacuuaauaua

SEQ ID NO: 1925015 - RNA, 21 nt, Shigella flexneri 2a str. 2457T
cgcacuguuggcgaaaauccu

SEQ ID NO: 1925016 - RNA, 12 nt, Shigella flexneri 2a str. 2457T
cgcacuuaauau

SEQ ID NO: 1925017 - RNA, 15 nt, Shigella flexneri 2a str. 2457T
cgcacuuacagcaac

SEQ ID NO: 1925018 - RNA, 15 nt, Shigella flexneri 2a str. 2457T
cgcagacuuaagauc

SEQ ID NO: 1925019 - RNA, 17 nt, Shigella flexneri 2a str. 2457T
cgcagagacaucaccaa

SEQ ID NO: 1925020 - RNA, 12 nt, Shigella flexneri 2a str. 2457T
cgccagaccuga

SEQ ID NO: 1925021 - RNA, 22 nt, Shigella flexneri 2a str. 2457T
cgccagacugcgcuaccaggaa

SEQ ID NO: 1925022 - RNA, 14 nt, Shigella flexneri 2a str. 2457T
cgccagaaguugcu

SEQ ID NO: 1925023 - RNA, 22 nt, Shigella flexneri 2a str. 2457T
cgccagaacgacgacugccgcu

SEQ ID NO: 1925024 - RNA, 20 nt, Shigella flexneri 2a str. 2457T
cgccagaaaaccuggcgcag

SEQ ID NO: 1925025 - RNA, 15 nt, Shigella flexneri 2a str. 2457T
cgccagaaaaccugg

SEQ ID NO: 1925026 - RNA, 19 nt, Shigella flexneri 2a str. 2457T
cgccacuuucacgccgcca

SEQ ID NO: 1925027 - RNA, 19 nt, Shigella flexneri 2a str. 2457T
cgccagaacacgcucccag

SEQ ID NO: 1925028 - RNA, 13 nt, Shigella flexneri 2a str. 2457T
cgccagaaaucag

SEQ ID NO: 1925029 - RNA, 20 nt, Shigella flexneri 2a str. 2457T
cgccagcaagagcaaauaaa

SEQ ID NO: 1925030 - RNA, 13 nt, Shigella flexneri 2a str. 2457T
cgccagcaacaca

SEQ ID NO: 1925031 - RNA, 11 nt, Shigella flexneri 2a str. 2457T
cgccagcaccg

SEQ ID NO: 1925032 - RNA, 20 nt, Shigella flexneri 2a str. 2457T
cgccagcagcagcguaccuc

SEQ ID NO: 1925033 - RNA, 12 nt, Shigella flexneri 2a str. 2457T
cgccagccacca

SEQ ID NO: 1925034 - RNA, 16 nt, Shigella flexneri 2a str. 2457T
cgccagccagccaagc

SEQ ID NO: 1925035 - RNA, 22 nt, Shigella flexneri 2a str. 2457T
cgccagcauucccgccagcggc

SEQ ID NO: 1925036 - RNA, 17 nt, Shigella flexneri 2a str. 2457T
cgccagcauucccgcca

SEQ ID NO: 1925037 - RNA, 18 nt, Shigella flexneri 2a str. 2457T
cgccagcauucccgccag

SEQ ID NO: 1925038 - RNA, 12 nt, Shigella flexneri 2a str. 2457T
cgccacgacuca

SEQ ID NO: 1925039 - RNA, 18 nt, Shigella flexneri 2a str. 2457T
cgccaccucuuucaccaa

SEQ ID NO: 1925040 - RNA, 20 nt, Shigella flexneri 2a str. 2457T
cgccaccucuuucaccaacg

SEQ ID NO: 1925041 - RNA, 19 nt, Shigella flexneri 2a str. 2457T
cgccacccagcgccgccau

SEQ ID NO: 1925042 - RNA, 13 nt, Shigella flexneri 2a str. 2457T
cgccacccagucc

SEQ ID NO: 1925043 - RNA, 16 nt, Shigella flexneri 2a str. 2457T
cgccacuuucacgccg

SEQ ID NO: 1925044 - RNA, 18 nt, Shigella flexneri 2a str. 2457T
cgccacuucccagccuuc

SEQ ID NO: 1925045 - RNA, 23 nt, Shigella flexneri 2a str. 2457T
cgccacgguaucaagcccgccgg

SEQ ID NO: 1925046 - RNA, 22 nt, Shigella flexneri 2a str. 2457T
cgccacgacucaaaucacgcag

SEQ ID NO: 1925047 - RNA, 19 nt, Shigella flexneri 2a str. 2457T
cgcauccggcauaaacaaa

SEQ ID NO: 1925048 - RNA, 18 nt, Shigella flexneri 2a str. 2457T
cgcauccggucacuuuca

SEQ ID NO: 1925049 - RNA, 13 nt, Shigella flexneri 2a str. 2457T
cgcauccggcauu

SEQ ID NO: 1925050 - RNA, 23 nt, Shigella flexneri 2a str. 2457T
cgcauccggcauucagugcaaau

SEQ ID NO: 1925051 - RNA, 17 nt, Shigella flexneri 2a str. 2457T
cgcauccggcauuuuac

SEQ ID NO: 1925052 - RNA, 18 nt, Shigella flexneri 2a str. 2457T
cgcauccggcauuuugug

SEQ ID NO: 1925053 - RNA, 17 nt, Shigella flexneri 2a str. 2457T
cgcaucccauuucucca

SEQ ID NO: 1925054 - RNA, 17 nt, Shigella flexneri 2a str. 2457T
cgcauccgaucgcgcau

SEQ ID NO: 1925055 - RNA, 15 nt, Shigella flexneri 2a str. 2457T
cgcauccgacauuug

SEQ ID NO: 1925056 - RNA, 15 nt, Shigella flexneri 2a str. 2457T
cgcauccggcaugaa

SEQ ID NO: 1925057 - RNA, 19 nt, Shigella flexneri 2a str. 2457T
cgcauccggcaugaacaaa

SEQ ID NO: 1925058 - RNA, 16 nt, Shigella flexneri 2a str. 2457T
cgcauccggcaauaag

SEQ ID NO: 1925059 - RNA, 13 nt, Shigella flexneri 2a str. 2457T
cgcauccggcaau

SEQ ID NO: 1925060 - RNA, 17 nt, Shigella flexneri 2a str. 2457T
cgcauaaucugaagaaa

SEQ ID NO: 1925061 - RNA, 22 nt, Shigella flexneri 2a str. 2457T
cgcaguuucgaggcgaugggcg

SEQ ID NO: 1925062 - RNA, 14 nt, Shigella flexneri 2a str. 2457T
cgcauaagccaccu

SEQ ID NO: 1925063 - RNA, 13 nt, Shigella flexneri 2a str. 2457T
cgccagcgucuga

SEQ ID NO: 1925064 - RNA, 21 nt, Shigella flexneri 2a str. 2457T
cgccagcguugauguuccucc

SEQ ID NO: 1925065 - RNA, 22 nt, Shigella flexneri 2a str. 2457T
cgccagcguuacuucaccuucu

SEQ ID NO: 1925066 - RNA, 14 nt, Shigella flexneri 2a str. 2457T
cgccagcgugguca

SEQ ID NO: 1925067 - RNA, 18 nt, Shigella flexneri 2a str. 2457T
cgccagcucacgggcggc

SEQ ID NO: 1925068 - RNA, 22 nt, Shigella flexneri 2a str. 2457T
cgccagcgaauuccaguugauu

SEQ ID NO: 1925069 - RNA, 17 nt, Shigella flexneri 2a str. 2457T
cgccagcggcccggaga

SEQ ID NO: 1925070 - RNA, 14 nt, Shigella flexneri 2a str. 2457T
cgccagcggcggca

SEQ ID NO: 1925071 - RNA, 20 nt, Shigella flexneri 2a str. 2457T
cgccagcggguucccggcgu

SEQ ID NO: 1925072 - RNA, 19 nt, Shigella flexneri 2a str. 2457T
cgccagguaacgaagaugg

SEQ ID NO: 1925073 - RNA, 14 nt, Shigella flexneri 2a str. 2457T
cgccaggcgcugau

SEQ ID NO: 1925074 - RNA, 20 nt, Shigella flexneri 2a str. 2457T
cgccaggugaaauccggcau

SEQ ID NO: 1925075 - RNA, 15 nt, Shigella flexneri 2a str. 2457T
cgccagguucaucaa

SEQ ID NO: 1925076 - RNA, 22 nt, Shigella flexneri 2a str. 2457T
cgccagguguuuaaccaacaca

SEQ ID NO: 1925077 - RNA, 19 nt, Shigella flexneri 2a str. 2457T
cgccagguuucaauauccg

SEQ ID NO: 1925078 - RNA, 23 nt, Shigella flexneri 2a str. 2457T
cgccagguuuuagaucccacggc

SEQ ID NO: 1925079 - RNA, 23 nt, Shigella flexneri 2a str. 2457T
cgccaguaaucuggccaaugccu

SEQ ID NO: 1925080 - RNA, 15 nt, Shigella flexneri 2a str. 2457T
cgccagugccaaagc

SEQ ID NO: 1925081 - RNA, 19 nt, Shigella flexneri 2a str. 2457T
cgccagugccgcccaccac

SEQ ID NO: 1925082 - RNA, 22 nt, Shigella flexneri 2a str. 2457T
cgccagugauugcuugccccuu

SEQ ID NO: 1925083 - RNA, 15 nt, Shigella flexneri 2a str. 2457T
cgccaguuacugcca

SEQ ID NO: 1925084 - RNA, 13 nt, Shigella flexneri 2a str. 2457T
cgccaguugcggc

SEQ ID NO: 1925085 - RNA, 16 nt, Shigella flexneri 2a str. 2457T
cgccauaucauucgac

SEQ ID NO: 1925086 - RNA, 20 nt, Shigella flexneri 2a str. 2457T
cgccaguuuuuucgcuugau

SEQ ID NO: 1925087 - RNA, 14 nt, Shigella flexneri 2a str. 2457T
cgccaguuuugcca

SEQ ID NO: 1925088 - RNA, 19 nt, Shigella flexneri 2a str. 2457T
cgccauaacggcuguccau

SEQ ID NO: 1925089 - RNA, 16 nt, Shigella flexneri 2a str. 2457T
cgccauccgguuauca

SEQ ID NO: 1925090 - RNA, 22 nt, Shigella flexneri 2a str. 2457T
cgccauccgguuaucagaagau

SEQ ID NO: 1925091 - RNA, 21 nt, Shigella flexneri 2a str. 2457T
cgccaucccuaccgcccgcgc

SEQ ID NO: 1925092 - RNA, 14 nt, Shigella flexneri 2a str. 2457T
cgccauccggcagc

SEQ ID NO: 1925093 - RNA, 16 nt, Shigella flexneri 2a str. 2457T
cgccauguugccuggg

SEQ ID NO: 1925094 - RNA, 14 nt, Shigella flexneri 2a str. 2457T
cgccauccuuacgc

SEQ ID NO: 1925095 - RNA, 16 nt, Shigella flexneri 2a str. 2457T
cgccaucgccagcagc

SEQ ID NO: 1925096 - RNA, 22 nt, Shigella flexneri 2a str. 2457T
cgccaucaauuuugaugauauc

SEQ ID NO: 1925097 - RNA, 17 nt, Shigella flexneri 2a str. 2457T
cgccaucaaugugcuga

SEQ ID NO: 1925098 - RNA, 13 nt, Shigella flexneri 2a str. 2457T
cgccauaucggca

SEQ ID NO: 1925099 - RNA, 12 nt, Shigella flexneri 2a str. 2457T
cgccauauuucu

SEQ ID NO: 1925100 - RNA, 13 nt, Shigella flexneri 2a str. 2457T
cgccaucaggcag

SEQ ID NO: 1925101 - RNA, 20 nt, Shigella flexneri 2a str. 2457T
cgccaucagugccaguacgc

SEQ ID NO: 1925102 - RNA, 13 nt, Shigella flexneri 2a str. 2457T
cgcccaacacuuc

SEQ ID NO: 1925103 - RNA, 22 nt, Shigella flexneri 2a str. 2457T
cgcccaaucgaugggauauaac

SEQ ID NO: 1925104 - RNA, 17 nt, Shigella flexneri 2a str. 2457T
cgcccagaccugcguuc

SEQ ID NO: 1925105 - RNA, 19 nt, Shigella flexneri 2a str. 2457T
cgccauugacguuccuuuc

SEQ ID NO: 1925106 - RNA, 17 nt, Shigella flexneri 2a str. 2457T
cgccauuucgucgucgg

SEQ ID NO: 1925107 - RNA, 20 nt, Shigella flexneri 2a str. 2457T
cgccauuucuucuccggcau

SEQ ID NO: 1925108 - RNA, 18 nt, Shigella flexneri 2a str. 2457T
cgccauuuugcgcggcau

SEQ ID NO: 1925109 - RNA, 15 nt, Shigella flexneri 2a str. 2457T
cgcccaaaccaccca

SEQ ID NO: 1925110 - RNA, 15 nt, Shigella flexneri 2a str. 2457T
cgccccgugaugaac

SEQ ID NO: 1925111 - RNA, 22 nt, Shigella flexneri 2a str. 2457T
cgccccugcgcuaaacaggauc

SEQ ID NO: 1925112 - RNA, 17 nt, Shigella flexneri 2a str. 2457T
cgccccuucugccgcaa

SEQ ID NO: 1925113 - RNA, 11 nt, Shigella flexneri 2a str. 2457T
cgcccagcaga

SEQ ID NO: 1925114 - RNA, 21 nt, Shigella flexneri 2a str. 2457T
cgcccagcguacguaacuucu

SEQ ID NO: 1925115 - RNA, 13 nt, Shigella flexneri 2a str. 2457T
cgcccagcuucau

SEQ ID NO: 1925116 - RNA, 18 nt, Shigella flexneri 2a str. 2457T
cgcccagcuaaucgagcc

SEQ ID NO: 1925117 - RNA, 21 nt, Shigella flexneri 2a str. 2457T
cgccccagaccugaauuugcu

SEQ ID NO: 1925118 - RNA, 17 nt, Shigella flexneri 2a str. 2457T
cgcccauaaugcgugca

SEQ ID NO: 1925119 - RNA, 12 nt, Shigella flexneri 2a str. 2457T
cgcccaucauuc

SEQ ID NO: 1925120 - RNA, 22 nt, Shigella flexneri 2a str. 2457T
cgcccgucacguucugcgccgu

SEQ ID NO: 1925121 - RNA, 14 nt, Shigella flexneri 2a str. 2457T
cgcccgucaacggu

SEQ ID NO: 1925122 - RNA, 21 nt, Shigella flexneri 2a str. 2457T
cgcccguuuucuccagcgccg

SEQ ID NO: 1925123 - RNA, 15 nt, Shigella flexneri 2a str. 2457T
cgcccguuuucucca

SEQ ID NO: 1925124 - RNA, 12 nt, Shigella flexneri 2a str. 2457T
cgcccugccuuu

SEQ ID NO: 1925125 - RNA, 22 nt, Shigella flexneri 2a str. 2457T
cgcccugauaaaucaccugcgc

SEQ ID NO: 1925126 - RNA, 18 nt, Shigella flexneri 2a str. 2457T
cgcccgguuuucgcgcgc

SEQ ID NO: 1925127 - RNA, 20 nt, Shigella flexneri 2a str. 2457T
cgcccugcgucgcacucuca

SEQ ID NO: 1925128 - RNA, 13 nt, Shigella flexneri 2a str. 2457T
cgcccugcuccag

SEQ ID NO: 1925129 - RNA, 15 nt, Shigella flexneri 2a str. 2457T
cgcccugcagcauca

SEQ ID NO: 1925130 - RNA, 18 nt, Shigella flexneri 2a str. 2457T
cgcccugcgcuggugaaa

SEQ ID NO: 1925131 - RNA, 23 nt, Shigella flexneri 2a str. 2457T
cgccgccagucgaauggcaucua

SEQ ID NO: 1925132 - RNA, 14 nt, Shigella flexneri 2a str. 2457T
cgccgccacugcaa

SEQ ID NO: 1925133 - RNA, 22 nt, Shigella flexneri 2a str. 2457T
cgccgcaaaucguauccggcau

SEQ ID NO: 1925134 - RNA, 20 nt, Shigella flexneri 2a str. 2457T
cgccgcacaauacauagaaa

SEQ ID NO: 1925135 - RNA, 20 nt, Shigella flexneri 2a str. 2457T
cgccgcaaccguaguggcca

SEQ ID NO: 1925136 - RNA, 13 nt, Shigella flexneri 2a str. 2457T
cgccgcaaaucgu

SEQ ID NO: 1925137 - RNA, 21 nt, Shigella flexneri 2a str. 2457T
cgccgauuuugccuucauacu

SEQ ID NO: 1925138 - RNA, 13 nt, Shigella flexneri 2a str. 2457T
cgccgacugucaa

SEQ ID NO: 1925139 - RNA, 17 nt, Shigella flexneri 2a str. 2457T
cggccaguugcgcaacg

SEQ ID NO: 1925140 - RNA, 14 nt, Shigella flexneri 2a str. 2457T
cggccauauccagc

SEQ ID NO: 1925141 - RNA, 14 nt, Shigella flexneri 2a str. 2457T
cggccagcgggcgu

SEQ ID NO: 1925142 - RNA, 12 nt, Shigella flexneri 2a str. 2457T
cggccagcagcu

SEQ ID NO: 1925143 - RNA, 16 nt, Shigella flexneri 2a str. 2457T
cggcauuaccggcaau

SEQ ID NO: 1925144 - RNA, 23 nt, Shigella flexneri 2a str. 2457T
cggcauauuaaccaugacgccga

SEQ ID NO: 1925145 - RNA, 13 nt, Shigella flexneri 2a str. 2457T
cggcaucaaccag

SEQ ID NO: 1925146 - RNA, 23 nt, Shigella flexneri 2a str. 2457T
cggcauagccaccuggcugcguu

SEQ ID NO: 1925147 - RNA, 20 nt, Shigella flexneri 2a str. 2457T
cggcauccagguuucuucca

SEQ ID NO: 1925148 - RNA, 16 nt, Shigella flexneri 2a str. 2457T
cggcaugaaagcgaug

SEQ ID NO: 1925149 - RNA, 18 nt, Shigella flexneri 2a str. 2457T
cggcaucuucuccacgcc

SEQ ID NO: 1925150 - RNA, 22 nt, Shigella flexneri 2a str. 2457T
cggcaucgccgcuaucgcugau

SEQ ID NO: 1925151 - RNA, 13 nt, Shigella flexneri 2a str. 2457T
cgcuugggcagaa

SEQ ID NO: 1925152 - RNA, 15 nt, Shigella flexneri 2a str. 2457T
cgcuugcucgcgcac

SEQ ID NO: 1925153 - RNA, 19 nt, Shigella flexneri 2a str. 2457T
cgcuugauucuguucagua

SEQ ID NO: 1925154 - RNA, 17 nt, Shigella flexneri 2a str. 2457T
cggcagccaccgccagc

SEQ ID NO: 1925155 - RNA, 19 nt, Shigella flexneri 2a str. 2457T
cggcagaacagaacauccc

SEQ ID NO: 1925156 - RNA, 22 nt, Shigella flexneri 2a str. 2457T
cggcagacgcucgccauuuuuc

SEQ ID NO: 1925157 - RNA, 20 nt, Shigella flexneri 2a str. 2457T
cggcagagaaaccacaucaa

SEQ ID NO: 1925158 - RNA, 15 nt, Shigella flexneri 2a str. 2457T
cggcagaaugguaac

SEQ ID NO: 1925159 - RNA, 14 nt, Shigella flexneri 2a str. 2457T
cggcagcugcucgc

SEQ ID NO: 1925160 - RNA, 18 nt, Shigella flexneri 2a str. 2457T
cggcagcgucggaagcga

SEQ ID NO: 1925161 - RNA, 15 nt, Shigella flexneri 2a str. 2457T
cggcagcggcuucau

SEQ ID NO: 1925162 - RNA, 13 nt, Shigella flexneri 2a str. 2457T
cggcagcgcgcuc

SEQ ID NO: 1925163 - RNA, 15 nt, Shigella flexneri 2a str. 2457T
cggcagucugcugac

SEQ ID NO: 1925164 - RNA, 18 nt, Shigella flexneri 2a str. 2457T
cggcaguauagcggcaug

SEQ ID NO: 1925165 - RNA, 17 nt, Shigella flexneri 2a str. 2457T
cggcagguugaugauga

SEQ ID NO: 1925166 - RNA, 17 nt, Shigella flexneri 2a str. 2457T
cggcaggguuugcgccc

SEQ ID NO: 1925167 - RNA, 19 nt, Shigella flexneri 2a str. 2457T
cggcauaaccggaucgcca

SEQ ID NO: 1925168 - RNA, 16 nt, Shigella flexneri 2a str. 2457T
cggcauaaacaaagug

SEQ ID NO: 1925169 - RNA, 16 nt, Shigella flexneri 2a str. 2457T
cggcaguuugagauug

SEQ ID NO: 1925170 - RNA, 17 nt, Shigella flexneri 2a str. 2457T
cggcagugccaguucuu

SEQ ID NO: 1925171 - RNA, 23 nt, Shigella flexneri 2a str. 2457T
cggcagugacugccccaguuccu

SEQ ID NO: 1925172 - RNA, 22 nt, Shigella flexneri 2a str. 2457T
cggcaguucgguugggaucgcc

SEQ ID NO: 1925173 - RNA, 13 nt, Shigella flexneri 2a str. 2457T
cggcccagugagu

SEQ ID NO: 1925174 - RNA, 15 nt, Shigella flexneri 2a str. 2457T
cggccauugaauauu

SEQ ID NO: 1925175 - RNA, 18 nt, Shigella flexneri 2a str. 2457T
cggccccaucgaaccauc

SEQ ID NO: 1925176 - RNA, 13 nt, Shigella flexneri 2a str. 2457T
cggcgacugaggc

SEQ ID NO: 1925177 - RNA, 18 nt, Shigella flexneri 2a str. 2457T
cggcgacuggauaaugaa

SEQ ID NO: 1925178 - RNA, 14 nt, Shigella flexneri 2a str. 2457T
cggcgaaagcuggc

SEQ ID NO: 1925179 - RNA, 12 nt, Shigella flexneri 2a str. 2457T
cggcgaaagagc

SEQ ID NO: 1925180 - RNA, 20 nt, Shigella flexneri 2a str. 2457T
cggcgaaacgguaauuauug

SEQ ID NO: 1925181 - RNA, 17 nt, Shigella flexneri 2a str. 2457T
cggccugcguauugcuu

SEQ ID NO: 1925182 - RNA, 19 nt, Shigella flexneri 2a str. 2457T
cggccucgcuacgccagca

SEQ ID NO: 1925183 - RNA, 13 nt, Shigella flexneri 2a str. 2457T
cggcgcaugccuc

SEQ ID NO: 1925184 - RNA, 14 nt, Shigella flexneri 2a str. 2457T
cggcgaucgugagc

SEQ ID NO: 1925185 - RNA, 20 nt, Shigella flexneri 2a str. 2457T
cggcgaguauucuugcugau

SEQ ID NO: 1925186 - RNA, 19 nt, Shigella flexneri 2a str. 2457T
cggcguaccuucaggcaca

SEQ ID NO: 1925187 - RNA, 18 nt, Shigella flexneri 2a str. 2457T
cggcggugaccagcagca

SEQ ID NO: 1925188 - RNA, 18 nt, Shigella flexneri 2a str. 2457T
cggcguaaccgcccagug

SEQ ID NO: 1925189 - RNA, 15 nt, Shigella flexneri 2a str. 2457T
cggcguaacgccacg

SEQ ID NO: 1925190 - RNA, 15 nt, Shigella flexneri 2a str. 2457T
cggcggugucgccag

SEQ ID NO: 1925191 - RNA, 17 nt, Shigella flexneri 2a str. 2457T
cggcggaaagggccgca

SEQ ID NO: 1925192 - RNA, 22 nt, Shigella flexneri 2a str. 2457T
cggcggaauagcguacggcaug

SEQ ID NO: 1925193 - RNA, 18 nt, Shigella flexneri 2a str. 2457T
cggcgcugacggucuggu

SEQ ID NO: 1925194 - RNA, 12 nt, Shigella flexneri 2a str. 2457T
cggcgcugaucu

SEQ ID NO: 1925195 - RNA, 13 nt, Shigella flexneri 2a str. 2457T
cggcgcucugccc

SEQ ID NO: 1925196 - RNA, 15 nt, Shigella flexneri 2a str. 2457T
cggcgcggugcugga

SEQ ID NO: 1925197 - RNA, 18 nt, Shigella flexneri 2a str. 2457T
cggcgcggugcuggauga

SEQ ID NO: 1925198 - RNA, 14 nt, Shigella flexneri 2a str. 2457T
cggcggcgggcgca

SEQ ID NO: 1925199 - RNA, 13 nt, Shigella flexneri 2a str. 2457T
ccagguaauuuga

SEQ ID NO: 1925200 - RNA, 23 nt, Shigella flexneri 2a str. 2457T
ccaguacggcuucgaucaggaac

SEQ ID NO: 1925201 - RNA, 22 nt, Shigella flexneri 2a str. 2457T
ccaguacgcguacacuuuccug

SEQ ID NO: 1925202 - RNA, 13 nt, Shigella flexneri 2a str. 2457T
ccaguaucugaca

SEQ ID NO: 1925203 - RNA, 16 nt, Shigella flexneri 2a str. 2457T
ccaguaucugacagca

SEQ ID NO: 1925204 - RNA, 23 nt, Shigella flexneri 2a str. 2457T
ccaguaugcauguaaaucaagcg

SEQ ID NO: 1925205 - RNA, 22 nt, Shigella flexneri 2a str. 2457T
ccagucagcucucagccagcug

SEQ ID NO: 1925206 - RNA, 17 nt, Shigella flexneri 2a str. 2457T
ccagucagaaagugcca

SEQ ID NO: 1925207 - RNA, 15 nt, Shigella flexneri 2a str. 2457T
ccagucaaucaucca

SEQ ID NO: 1925208 - RNA, 17 nt, Shigella flexneri 2a str. 2457T
ccaguauuucauagauu

SEQ ID NO: 1925209 - RNA, 15 nt, Shigella flexneri 2a str. 2457T
ccaguccagcugccg

SEQ ID NO: 1925210 - RNA, 14 nt, Shigella flexneri 2a str. 2457T
ccagucaggcauga

SEQ ID NO: 1925211 - RNA, 21 nt, Shigella flexneri 2a str. 2457T
ccaguaauucagccgcgcgcu

SEQ ID NO: 1925212 - RNA, 21 nt, Shigella flexneri 2a str. 2457T
ccaguaaucuggccaaugccu

SEQ ID NO: 1925213 - RNA, 21 nt, Shigella flexneri 2a str. 2457T
ccaguaaucgggcaacugcug

SEQ ID NO: 1925214 - RNA, 13 nt, Shigella flexneri 2a str. 2457T
ccaguaccgccag

SEQ ID NO: 1925215 - RNA, 18 nt, Shigella flexneri 2a str. 2457T
ccaguaccgccagugcag

SEQ ID NO: 1925216 - RNA, 17 nt, Shigella flexneri 2a str. 2457T
ccaguaccagcagcgcc

SEQ ID NO: 1925217 - RNA, 21 nt, Shigella flexneri 2a str. 2457T
ccaguaagcugugcgauagca

SEQ ID NO: 1925218 - RNA, 13 nt, Shigella flexneri 2a str. 2457T
ccaguaaggcugc

SEQ ID NO: 1925219 - RNA, 23 nt, Shigella flexneri 2a str. 2457T
ccaguaaccacgcagcguuggca

SEQ ID NO: 1925220 - RNA, 17 nt, Shigella flexneri 2a str. 2457T
ccagguuuaccagcagc

SEQ ID NO: 1925221 - RNA, 15 nt, Shigella flexneri 2a str. 2457T
ccagucgcugcugac

SEQ ID NO: 1925222 - RNA, 22 nt, Shigella flexneri 2a str. 2457T
ccagucguaguggaucagcaaa

SEQ ID NO: 1925223 - RNA, 20 nt, Shigella flexneri 2a str. 2457T
ccagucguucaaccacuuca

SEQ ID NO: 1925224 - RNA, 18 nt, Shigella flexneri 2a str. 2457T
ccagugagucggggccag

SEQ ID NO: 1925225 - RNA, 16 nt, Shigella flexneri 2a str. 2457T
ccagugaauuucacuu

SEQ ID NO: 1925226 - RNA, 19 nt, Shigella flexneri 2a str. 2457T
ccagucuuccugcggcaga

SEQ ID NO: 1925227 - RNA, 14 nt, Shigella flexneri 2a str. 2457T
ccagucaguuaagc

SEQ ID NO: 1925228 - RNA, 21 nt, Shigella flexneri 2a str. 2457T
ccagucccguacccagcaaga

SEQ ID NO: 1925229 - RNA, 17 nt, Shigella flexneri 2a str. 2457T
ccaguuccacuucugca

SEQ ID NO: 1925230 - RNA, 21 nt, Shigella flexneri 2a str. 2457T
ccagugccggaugauucacau

SEQ ID NO: 1925231 - RNA, 23 nt, Shigella flexneri 2a str. 2457T
ccaguuacccagcggauaaagca

SEQ ID NO: 1925232 - RNA, 15 nt, Shigella flexneri 2a str. 2457T
ccagugccucaagaa

SEQ ID NO: 1925233 - RNA, 16 nt, Shigella flexneri 2a str. 2457T
ccaguucacgaauauu

SEQ ID NO: 1925234 - RNA, 22 nt, Shigella flexneri 2a str. 2457T
ccaguucaacgcccgcuuucac

SEQ ID NO: 1925235 - RNA, 18 nt, Shigella flexneri 2a str. 2457T
ccagugccgcccaccacu

SEQ ID NO: 1925236 - RNA, 21 nt, Shigella flexneri 2a str. 2457T
ccagugccguuccagccagug

SEQ ID NO: 1925237 - RNA, 18 nt, Shigella flexneri 2a str. 2457T
ccagugccggaugauuca

SEQ ID NO: 1925238 - RNA, 19 nt, Shigella flexneri 2a str. 2457T
ccagugccggaugauucac

SEQ ID NO: 1925239 - RNA, 18 nt, Shigella flexneri 2a str. 2457T
ccagugauuuuugcugaa

SEQ ID NO: 1925240 - RNA, 14 nt, Shigella flexneri 2a str. 2457T
ccagugauucagga

SEQ ID NO: 1925241 - RNA, 21 nt, Shigella flexneri 2a str. 2457T
ccagugaugcgcaggguaacg

SEQ ID NO: 1925242 - RNA, 15 nt, Shigella flexneri 2a str. 2457T
ccagugccaaaccag

SEQ ID NO: 1925243 - RNA, 15 nt, Shigella flexneri 2a str. 2457T
ccagugccaaagcca

SEQ ID NO: 1925244 - RNA, 16 nt, Shigella flexneri 2a str. 2457T
ccagugcauccagcac

SEQ ID NO: 1925245 - RNA, 15 nt, Shigella flexneri 2a str. 2457T
ccagugcagcgaagu

SEQ ID NO: 1925246 - RNA, 20 nt, Shigella flexneri 2a str. 2457T
ccauaggaugagguuucccg

SEQ ID NO: 1925247 - RNA, 18 nt, Shigella flexneri 2a str. 2457T
ccauacggcucagcucug

SEQ ID NO: 1925248 - RNA, 21 nt, Shigella flexneri 2a str. 2457T
ccauagcaucccaauacccgc

SEQ ID NO: 1925249 - RNA, 16 nt, Shigella flexneri 2a str. 2457T
ccauagcgauguauuu

SEQ ID NO: 1925250 - RNA, 18 nt, Shigella flexneri 2a str. 2457T
ccauacauguacauggug

SEQ ID NO: 1925251 - RNA, 20 nt, Shigella flexneri 2a str. 2457T
ccauaccacuuccagcagac

SEQ ID NO: 1925252 - RNA, 16 nt, Shigella flexneri 2a str. 2457T
ccauacaucuucauca

SEQ ID NO: 1925253 - RNA, 15 nt, Shigella flexneri 2a str. 2457T
ccauaccugcacaaa

SEQ ID NO: 1925254 - RNA, 13 nt, Shigella flexneri 2a str. 2457T
ccauaccugcaca

SEQ ID NO: 1925255 - RNA, 17 nt, Shigella flexneri 2a str. 2457T
ccaguugcauaauuucu

SEQ ID NO: 1925256 - RNA, 16 nt, Shigella flexneri 2a str. 2457T
ccaguucccccugcca

SEQ ID NO: 1925257 - RNA, 18 nt, Shigella flexneri 2a str. 2457T
ccaguugcuccagcaaua

SEQ ID NO: 1925258 - RNA, 18 nt, Shigella flexneri 2a str. 2457T
ccaguuuuucuuuuucaa

SEQ ID NO: 1925259 - RNA, 24 nt, Shigella flexneri 2a str. 2457T
ccaguuuuuucgcuugaucuuccu

SEQ ID NO: 1925260 - RNA, 18 nt, Shigella flexneri 2a str. 2457T
ccaguuuuuacgcccgug

SEQ ID NO: 1925261 - RNA, 16 nt, Shigella flexneri 2a str. 2457T
ccauaaaaaagaagcc

SEQ ID NO: 1925262 - RNA, 19 nt, Shigella flexneri 2a str. 2457T
ccauaauuacgcuguucau

SEQ ID NO: 1925263 - RNA, 21 nt, Shigella flexneri 2a str. 2457T
ccauugcucuggcaaacucgc

SEQ ID NO: 1925264 - RNA, 23 nt, Shigella flexneri 2a str. 2457T
ccauugcccgaugcgcaaacuua

SEQ ID NO: 1925265 - RNA, 23 nt, Shigella flexneri 2a str. 2457T
ccauuuggcggggauuuuuuuau

SEQ ID NO: 1925266 - RNA, 19 nt, Shigella flexneri 2a str. 2457T
ccauuucugccagugcugc

SEQ ID NO: 1925267 - RNA, 14 nt, Shigella flexneri 2a str. 2457T
ccauuucugcugcc

SEQ ID NO: 1925268 - RNA, 11 nt, Shigella flexneri 2a str. 2457T
ccauuuuucag

SEQ ID NO: 1925269 - RNA, 22 nt, Shigella flexneri 2a str. 2457T
ccauuuuucagacguucuuccu

SEQ ID NO: 1925270 - RNA, 15 nt, Shigella flexneri 2a str. 2457T
cccaacgcagcaaca

SEQ ID NO: 1925271 - RNA, 20 nt, Shigella flexneri 2a str. 2457T
cccaacgcgccaccgaccag

SEQ ID NO: 1925272 - RNA, 17 nt, Shigella flexneri 2a str. 2457T
cccaacguaacaaaacu

SEQ ID NO: 1925273 - RNA, 14 nt, Shigella flexneri 2a str. 2457T
cccaacguaacaaa

SEQ ID NO: 1925274 - RNA, 16 nt, Shigella flexneri 2a str. 2457T
cccaacugccugaugc

SEQ ID NO: 1925275 - RNA, 17 nt, Shigella flexneri 2a str. 2457T
ccauuacaagcccgcug

SEQ ID NO: 1925276 - RNA, 14 nt, Shigella flexneri 2a str. 2457T
ccauuaccgccacu

SEQ ID NO: 1925277 - RNA, 16 nt, Shigella flexneri 2a str. 2457T
ccauuaacuacaccgu

SEQ ID NO: 1925278 - RNA, 14 nt, Shigella flexneri 2a str. 2457T
ccauuaaccagcca

SEQ ID NO: 1925279 - RNA, 16 nt, Shigella flexneri 2a str. 2457T
ccauuaaccagccacu

SEQ ID NO: 1925280 - RNA, 15 nt, Shigella flexneri 2a str. 2457T
ccauuauucaacgca

SEQ ID NO: 1925281 - RNA, 22 nt, Shigella flexneri 2a str. 2457T
ccauuauuaaauuuaauaauaa

SEQ ID NO: 1925282 - RNA, 12 nt, Shigella flexneri 2a str. 2457T
ccauguugccug

SEQ ID NO: 1925283 - RNA, 16 nt, Shigella flexneri 2a str. 2457T
ccauguguuuaucuau

SEQ ID NO: 1925284 - RNA, 23 nt, Shigella flexneri 2a str. 2457T
ccaucguccagcagcaaugcagg

SEQ ID NO: 1925285 - RNA, 16 nt, Shigella flexneri 2a str. 2457T
ccaucgucacaccuuc

SEQ ID NO: 1925286 - RNA, 19 nt, Shigella flexneri 2a str. 2457T
ccaucgggcuagacugaug

SEQ ID NO: 1925287 - RNA, 15 nt, Shigella flexneri 2a str. 2457T
ccaucggcuuuggca

SEQ ID NO: 1925288 - RNA, 15 nt, Shigella flexneri 2a str. 2457T
ccaucggcagcgcca

SEQ ID NO: 1925289 - RNA, 20 nt, Shigella flexneri 2a str. 2457T
ccaucgcuacauaacgcagc

SEQ ID NO: 1925290 - RNA, 22 nt, Shigella flexneri 2a str. 2457T
ccaugccaucugccagcaagcg

SEQ ID NO: 1925291 - RNA, 19 nt, Shigella flexneri 2a str. 2457T
ccauggacauacgcaccuu

SEQ ID NO: 1925292 - RNA, 13 nt, Shigella flexneri 2a str. 2457T
ccaugaccgccgc

SEQ ID NO: 1925293 - RNA, 13 nt, Shigella flexneri 2a str. 2457T
ccaugacgcacuu

SEQ ID NO: 1925294 - RNA, 15 nt, Shigella flexneri 2a str. 2457T
ccaugacgaggagcu

SEQ ID NO: 1925295 - RNA, 18 nt, Shigella flexneri 2a str. 2457T
ccaugacgaggagcugca

SEQ ID NO: 1925296 - RNA, 23 nt, Shigella flexneri 2a str. 2457T
ccaugaccugcaaauucaauaaa

SEQ ID NO: 1925297 - RNA, 14 nt, Shigella flexneri 2a str. 2457T
ccaugacuuucugg

SEQ ID NO: 1925298 - RNA, 23 nt, Shigella flexneri 2a str. 2457T
ccaugacuuucuggcacgaccug

SEQ ID NO: 1925299 - RNA, 20 nt, Shigella flexneri 2a str. 2457T
ccaugcaauauuguagcaac

SEQ ID NO: 1925300 - RNA, 21 nt, Shigella flexneri 2a str. 2457T
ccaugcaauuaccgccaccag

SEQ ID NO: 1925301 - RNA, 21 nt, Shigella flexneri 2a str. 2457T
ccaugcacgauauaccgugcu

SEQ ID NO: 1925302 - RNA, 18 nt, Shigella flexneri 2a str. 2457T
ccaugcauaaugcagcca

SEQ ID NO: 1925303 - RNA, 15 nt, Shigella flexneri 2a str. 2457T
ccaucaggcagucug

SEQ ID NO: 1925304 - RNA, 21 nt, Shigella flexneri 2a str. 2457T
ccaucaggcagucugcgcccu

SEQ ID NO: 1925305 - RNA, 16 nt, Shigella flexneri 2a str. 2457T
ccaucaggcauuacug

SEQ ID NO: 1925306 - RNA, 14 nt, Shigella flexneri 2a str. 2457T
ccaucagugccagu

SEQ ID NO: 1925307 - RNA, 15 nt, Shigella flexneri 2a str. 2457T
ccaucauucgccgcu

SEQ ID NO: 1925308 - RNA, 14 nt, Shigella flexneri 2a str. 2457T
ccaucauacccaac

SEQ ID NO: 1925309 - RNA, 16 nt, Shigella flexneri 2a str. 2457T
ccauacgggcaugugu

SEQ ID NO: 1925310 - RNA, 17 nt, Shigella flexneri 2a str. 2457T
ccauauggcccaucauc

SEQ ID NO: 1925311 - RNA, 19 nt, Shigella flexneri 2a str. 2457T
ccauauggcugcauucaga

SEQ ID NO: 1925312 - RNA, 22 nt, Shigella flexneri 2a str. 2457T
ccauauuagccgccagcucuuu

SEQ ID NO: 1925313 - RNA, 20 nt, Shigella flexneri 2a str. 2457T
ccauauucguuaucguacca

SEQ ID NO: 1925314 - RNA, 21 nt, Shigella flexneri 2a str. 2457T
ccauauuuugaaucggcggcg

SEQ ID NO: 1925315 - RNA, 19 nt, Shigella flexneri 2a str. 2457T
ccauccgucauccauacca

SEQ ID NO: 1925316 - RNA, 17 nt, Shigella flexneri 2a str. 2457T
ccauccgucauccauac

SEQ ID NO: 1925317 - RNA, 14 nt, Shigella flexneri 2a str. 2457T
ccaucgccagcagc

SEQ ID NO: 1925318 - RNA, 20 nt, Shigella flexneri 2a str. 2457T
ccaucgccagcagccauucc

SEQ ID NO: 1925319 - RNA, 18 nt, Shigella flexneri 2a str. 2457T
ccauccugacggauagcc

SEQ ID NO: 1925320 - RNA, 14 nt, Shigella flexneri 2a str. 2457T
ccaucgccagugcc

SEQ ID NO: 1925321 - RNA, 15 nt, Shigella flexneri 2a str. 2457T
ccaucgccagugccg

SEQ ID NO: 1925322 - RNA, 18 nt, Shigella flexneri 2a str. 2457T
ccaucgccuggugaccgc

SEQ ID NO: 1925323 - RNA, 18 nt, Shigella flexneri 2a str. 2457T
ccauccagcaacaacagc

SEQ ID NO: 1925324 - RNA, 21 nt, Shigella flexneri 2a str. 2457T
ccauccaggagauauugcugc

SEQ ID NO: 1925325 - RNA, 14 nt, Shigella flexneri 2a str. 2457T
ccauccagugaaac

SEQ ID NO: 1925326 - RNA, 10 nt, Shigella flexneri 2a str. 2457T
ccauccauac

SEQ ID NO: 1925327 - RNA, 21 nt, Shigella flexneri 2a str. 2457T
ccauccaucaacgccagcggg

SEQ ID NO: 1925328 - RNA, 15 nt, Shigella flexneri 2a str. 2457T
ccauccaucaacgcc

SEQ ID NO: 1925329 - RNA, 13 nt, Shigella flexneri 2a str. 2457T
ccauccggcagca

SEQ ID NO: 1925330 - RNA, 18 nt, Shigella flexneri 2a str. 2457T
ccauccggccgccacaca

SEQ ID NO: 1925331 - RNA, 20 nt, Shigella flexneri 2a str. 2457T
ccauccgggaucacaucaua

SEQ ID NO: 1925332 - RNA, 16 nt, Shigella flexneri 2a str. 2457T
cccagcgcaucaggca

SEQ ID NO: 1925333 - RNA, 13 nt, Shigella flexneri 2a str. 2457T
cccagcgccgcca

SEQ ID NO: 1925334 - RNA, 14 nt, Shigella flexneri 2a str. 2457T
cccagcggaaaaua

SEQ ID NO: 1925335 - RNA, 20 nt, Shigella flexneri 2a str. 2457T
cccagcgcggugacgcacag

SEQ ID NO: 1925336 - RNA, 19 nt, Shigella flexneri 2a str. 2457T
cccagcguggagagcagca

SEQ ID NO: 1925337 - RNA, 21 nt, Shigella flexneri 2a str. 2457T
cccagcgugcguuuuuuguac

SEQ ID NO: 1925338 - RNA, 13 nt, Shigella flexneri 2a str. 2457T
cccaggcaccguc

SEQ ID NO: 1925339 - RNA, 13 nt, Shigella flexneri 2a str. 2457T
cccagcccagcgc

SEQ ID NO: 1925340 - RNA, 16 nt, Shigella flexneri 2a str. 2457T
cccagcccagcggaaa

SEQ ID NO: 1925341 - RNA, 21 nt, Shigella flexneri 2a str. 2457T
cccagcaggauguuccggcaa

SEQ ID NO: 1925342 - RNA, 23 nt, Shigella flexneri 2a str. 2457T
cccagcagagaucuuucacgccc

SEQ ID NO: 1925343 - RNA, 23 nt, Shigella flexneri 2a str. 2457T
cccagccgcgucugaauaucauc

SEQ ID NO: 1925344 - RNA, 16 nt, Shigella flexneri 2a str. 2457T
cccagccuaagccauu

SEQ ID NO: 1925345 - RNA, 17 nt, Shigella flexneri 2a str. 2457T
cccagccuuuccggcaa

SEQ ID NO: 1925346 - RNA, 17 nt, Shigella flexneri 2a str. 2457T
cccacuuucaggccagc

SEQ ID NO: 1925347 - RNA, 19 nt, Shigella flexneri 2a str. 2457T
cccacuuucaggccagcgg

SEQ ID NO: 1925348 - RNA, 23 nt, Shigella flexneri 2a str. 2457T
cccaaggcgaggggaccgccccu

SEQ ID NO: 1925349 - RNA, 17 nt, Shigella flexneri 2a str. 2457T
cccagaacaacccggcg

SEQ ID NO: 1925350 - RNA, 13 nt, Shigella flexneri 2a str. 2457T
cccagaacaaaua

SEQ ID NO: 1925351 - RNA, 16 nt, Shigella flexneri 2a str. 2457T
cccagaacuaucauac

SEQ ID NO: 1925352 - RNA, 22 nt, Shigella flexneri 2a str. 2457T
cccagaaucucuuuuguuuccc

SEQ ID NO: 1925353 - RNA, 18 nt, Shigella flexneri 2a str. 2457T
cccagaauguuaacgcca

SEQ ID NO: 1925354 - RNA, 20 nt, Shigella flexneri 2a str. 2457T
cccagaagguuucgccgcug

SEQ ID NO: 1925355 - RNA, 23 nt, Shigella flexneri 2a str. 2457T
cccagguaucguugaugcucuug

SEQ ID NO: 1925356 - RNA, 16 nt, Shigella flexneri 2a str. 2457T
cccagggccaacuggc

SEQ ID NO: 1925357 - RNA, 21 nt, Shigella flexneri 2a str. 2457T
cccaggcuucaggugcccaac

SEQ ID NO: 1925358 - RNA, 16 nt, Shigella flexneri 2a str. 2457T
cccaggcugugcgcca

SEQ ID NO: 1925359 - RNA, 15 nt, Shigella flexneri 2a str. 2457T
cccagucgucauccc

SEQ ID NO: 1925360 - RNA, 21 nt, Shigella flexneri 2a str. 2457T
cccagugaguuggggccagca

SEQ ID NO: 1925361 - RNA, 16 nt, Shigella flexneri 2a str. 2457T
cccagugccagcacca

SEQ ID NO: 1925362 - RNA, 22 nt, Shigella flexneri 2a str. 2457T
cccagugguuucgccagcaccg

SEQ ID NO: 1925363 - RNA, 21 nt, Shigella flexneri 2a str. 2457T
cccaguaucugacagcaaaua

SEQ ID NO: 1925364 - RNA, 17 nt, Shigella flexneri 2a str. 2457T
cccaguaaccacgcagc

SEQ ID NO: 1925365 - RNA, 11 nt, Shigella flexneri 2a str. 2457T
cccaucacuau

SEQ ID NO: 1925366 - RNA, 23 nt, Shigella flexneri 2a str. 2457T
cccauauuuaaucaguucuacca

SEQ ID NO: 1925367 - RNA, 23 nt, Shigella flexneri 2a str. 2457T
cccaucaucuggcugugauccau

SEQ ID NO: 1925368 - RNA, 13 nt, Shigella flexneri 2a str. 2457T
cccaucaguagca

SEQ ID NO: 1925369 - RNA, 19 nt, Shigella flexneri 2a str. 2457T
cccaucgcgcccgccgcca

SEQ ID NO: 1925370 - RNA, 23 nt, Shigella flexneri 2a str. 2457T
cccaguuucggcaucagcagaau

SEQ ID NO: 1925371 - RNA, 23 nt, Shigella flexneri 2a str. 2457T
cccaguugugggugcccacaaac

SEQ ID NO: 1925372 - RNA, 11 nt, Shigella flexneri 2a str. 2457T
cccaguuucau

SEQ ID NO: 1925373 - RNA, 21 nt, Shigella flexneri 2a str. 2457T
cccaguuucaugauauguuuu

SEQ ID NO: 1925374 - RNA, 16 nt, Shigella flexneri 2a str. 2457T
aaacaauuaauauagu

SEQ ID NO: 1925375 - RNA, 17 nt, Shigella flexneri 2a str. 2457T
aaacaauuuucauugaa

SEQ ID NO: 1925376 - RNA, 16 nt, Shigella flexneri 2a str. 2457T
aaacacaauauucaua

SEQ ID NO: 1925377 - RNA, 13 nt, Shigella flexneri 2a str. 2457T
aaacacaaagucc

SEQ ID NO: 1925378 - RNA, 13 nt, Shigella flexneri 2a str. 2457T
aaacaccagaaug

SEQ ID NO: 1925379 - RNA, 14 nt, Shigella flexneri 2a str. 2457T
aaacaccagaaugc

SEQ ID NO: 1925380 - RNA, 18 nt, Shigella flexneri 2a str. 2457T
aaacaccagaaugcccca

SEQ ID NO: 1925381 - RNA, 22 nt, Shigella flexneri 2a str. 2457T
ccccgguuuuucuggcaccugu

SEQ ID NO: 1925382 - RNA, 12 nt, Shigella flexneri 2a str. 2457T
ccccgucaccac

SEQ ID NO: 1925383 - RNA, 14 nt, Shigella flexneri 2a str. 2457T
ccccgcuuccugca

SEQ ID NO: 1925384 - RNA, 13 nt, Shigella flexneri 2a str. 2457T
ccccucuucagcc

SEQ ID NO: 1925385 - RNA, 21 nt, Shigella flexneri 2a str. 2457T
ccccugagcguuacccgcagc

SEQ ID NO: 1925386 - RNA, 17 nt, Shigella flexneri 2a str. 2457T
ccccugauaaccgcauc

SEQ ID NO: 1925387 - RNA, 17 nt, Shigella flexneri 2a str. 2457T
ccccuuucgaaaucauu

SEQ ID NO: 1925388 - RNA, 13 nt, Shigella flexneri 2a str. 2457T
ccccuucugccgc

SEQ ID NO: 1925389 - RNA, 21 nt, Shigella flexneri 2a str. 2457T
ccccuuucuuauuuuucugca

SEQ ID NO: 1925390 - RNA, 15 nt, Shigella flexneri 2a str. 2457T
ccccuuugaccagcc

SEQ ID NO: 1925391 - RNA, 19 nt, Shigella flexneri 2a str. 2457T
cccgacgauaccgccgcac

SEQ ID NO: 1925392 - RNA, 21 nt, Shigella flexneri 2a str. 2457T
cccgcaaacaggaacaccagc

SEQ ID NO: 1925393 - RNA, 13 nt, Shigella flexneri 2a str. 2457T
cccgcaagcugcg

SEQ ID NO: 1925394 - RNA, 12 nt, Shigella flexneri 2a str. 2457T
cccgcagccacg

SEQ ID NO: 1925395 - RNA, 18 nt, Shigella flexneri 2a str. 2457T
cccgcagccagcacugcc

SEQ ID NO: 1925396 - RNA, 16 nt, Shigella flexneri 2a str. 2457T
cccgcauuuacucuca

SEQ ID NO: 1925397 - RNA, 14 nt, Shigella flexneri 2a str. 2457T
cccgccaccggcuu

SEQ ID NO: 1925398 - RNA, 12 nt, Shigella flexneri 2a str. 2457T
ccccacagcucu

SEQ ID NO: 1925399 - RNA, 21 nt, Shigella flexneri 2a str. 2457T
ccccacacuaccaucggcgcu

SEQ ID NO: 1925400 - RNA, 19 nt, Shigella flexneri 2a str. 2457T
ccccacagacccagguaga

SEQ ID NO: 1925401 - RNA, 13 nt, Shigella flexneri 2a str. 2457T
ccccaccucauca

SEQ ID NO: 1925402 - RNA, 22 nt, Shigella flexneri 2a str. 2457T
ccccagaugacggcugccauca

SEQ ID NO: 1925403 - RNA, 22 nt, Shigella flexneri 2a str. 2457T
ccccagaucccauaaccaacaa

SEQ ID NO: 1925404 - RNA, 15 nt, Shigella flexneri 2a str. 2457T
cccaucucaauauua

SEQ ID NO: 1925405 - RNA, 22 nt, Shigella flexneri 2a str. 2457T
cccaugaugcgcggcuccagaa

SEQ ID NO: 1925406 - RNA, 19 nt, Shigella flexneri 2a str. 2457T
cccaugaugcgcggcucca

SEQ ID NO: 1925407 - RNA, 13 nt, Shigella flexneri 2a str. 2457T
ccccauccacgca

SEQ ID NO: 1925408 - RNA, 21 nt, Shigella flexneri 2a str. 2457T
ccccaucaacgccaucgccag

SEQ ID NO: 1925409 - RNA, 17 nt, Shigella flexneri 2a str. 2457T
ccccagugguuucgcca

SEQ ID NO: 1925410 - RNA, 21 nt, Shigella flexneri 2a str. 2457T
ccccagugguuucgccagcac

SEQ ID NO: 1925411 - RNA, 20 nt, Shigella flexneri 2a str. 2457T
cccccagaugacggcugcca

SEQ ID NO: 1925412 - RNA, 15 nt, Shigella flexneri 2a str. 2457T
cccccagcagcgccg

SEQ ID NO: 1925413 - RNA, 13 nt, Shigella flexneri 2a str. 2457T
cccccaccccggc

SEQ ID NO: 1925414 - RNA, 14 nt, Shigella flexneri 2a str. 2457T
cccugcucuuucag

SEQ ID NO: 1925415 - RNA, 15 nt, Shigella flexneri 2a str. 2457T
cccugcucuuucagc

SEQ ID NO: 1925416 - RNA, 22 nt, Shigella flexneri 2a str. 2457T
cccugcucgucggcaaagcggg

SEQ ID NO: 1925417 - RNA, 19 nt, Shigella flexneri 2a str. 2457T
cccugcggcgaugaccgcc

SEQ ID NO: 1925418 - RNA, 17 nt, Shigella flexneri 2a str. 2457T
cccugagcguuacccgc

SEQ ID NO: 1925419 - RNA, 17 nt, Shigella flexneri 2a str. 2457T
cccugauaaaucaccug

SEQ ID NO: 1925420 - RNA, 14 nt, Shigella flexneri 2a str. 2457T
cccugauaaaucac

SEQ ID NO: 1925421 - RNA, 14 nt, Shigella flexneri 2a str. 2457T
cccugcaaacgggg

SEQ ID NO: 1925422 - RNA, 21 nt, Shigella flexneri 2a str. 2457T
cccugauuaacgacacucucu

SEQ ID NO: 1925423 - RNA, 14 nt, Shigella flexneri 2a str. 2457T
cccugacauugcgu

SEQ ID NO: 1925424 - RNA, 14 nt, Shigella flexneri 2a str. 2457T
cccucuccccagaa

SEQ ID NO: 1925425 - RNA, 23 nt, Shigella flexneri 2a str. 2457T
cccucguuuugccgccaucaucg

SEQ ID NO: 1925426 - RNA, 19 nt, Shigella flexneri 2a str. 2457T
cccucgaucggcucuuccg

SEQ ID NO: 1925427 - RNA, 16 nt, Shigella flexneri 2a str. 2457T
cccucgcccgccgucc

SEQ ID NO: 1925428 - RNA, 14 nt, Shigella flexneri 2a str. 2457T
cccucgcccccuug

SEQ ID NO: 1925429 - RNA, 19 nt, Shigella flexneri 2a str. 2457T
cccucccguuucccugucu

SEQ ID NO: 1925430 - RNA, 15 nt, Shigella flexneri 2a str. 2457T
cccucaaacaacaca

SEQ ID NO: 1925431 - RNA, 11 nt, Shigella flexneri 2a str. 2457T
cccucaaacaa

SEQ ID NO: 1925432 - RNA, 16 nt, Shigella flexneri 2a str. 2457T
cccgucguugcaauca

SEQ ID NO: 1925433 - RNA, 17 nt, Shigella flexneri 2a str. 2457T
cccgugagucuccuuua

SEQ ID NO: 1925434 - RNA, 19 nt, Shigella flexneri 2a str. 2457T
cccguucauccgcuucagg

SEQ ID NO: 1925435 - RNA, 23 nt, Shigella flexneri 2a str. 2457T
cccguggcgagcgauaacccagc

SEQ ID NO: 1925436 - RNA, 14 nt, Shigella flexneri 2a str. 2457T
cccuaacucuuuca

SEQ ID NO: 1925437 - RNA, 20 nt, Shigella flexneri 2a str. 2457T
cccuaacugacgggcggcuu

SEQ ID NO: 1925438 - RNA, 18 nt, Shigella flexneri 2a str. 2457T
cccuaacccucuccccaa

SEQ ID NO: 1925439 - RNA, 13 nt, Shigella flexneri 2a str. 2457T
cccguuucccugu

SEQ ID NO: 1925440 - RNA, 13 nt, Shigella flexneri 2a str. 2457T
cccguuuucucca

SEQ ID NO: 1925441 - RNA, 19 nt, Shigella flexneri 2a str. 2457T
cccguuuucuccagcgccg

SEQ ID NO: 1925442 - RNA, 15 nt, Shigella flexneri 2a str. 2457T
cccuaggcauagaaa

SEQ ID NO: 1925443 - RNA, 15 nt, Shigella flexneri 2a str. 2457T
cccggcucauccccu

SEQ ID NO: 1925444 - RNA, 12 nt, Shigella flexneri 2a str. 2457T
cccgccggcgua

SEQ ID NO: 1925445 - RNA, 15 nt, Shigella flexneri 2a str. 2457T
cccgccgccauccug

SEQ ID NO: 1925446 - RNA, 22 nt, Shigella flexneri 2a str. 2457T
cccgguauccaucagacuuugc

SEQ ID NO: 1925447 - RNA, 23 nt, Shigella flexneri 2a str. 2457T
cccggucagcagcaccaccgccc

SEQ ID NO: 1925448 - RNA, 21 nt, Shigella flexneri 2a str. 2457T
cccgguaccuuugaacugcug

SEQ ID NO: 1925449 - RNA, 22 nt, Shigella flexneri 2a str. 2457T
cccgucaauuaccacuggccca

SEQ ID NO: 1925450 - RNA, 16 nt, Shigella flexneri 2a str. 2457T
ccgaccaucgccagcu

SEQ ID NO: 1925451 - RNA, 17 nt, Shigella flexneri 2a str. 2457T
ccgacauuugcacaaga

SEQ ID NO: 1925452 - RNA, 13 nt, Shigella flexneri 2a str. 2457T
ccgaccacuucca

SEQ ID NO: 1925453 - RNA, 16 nt, Shigella flexneri 2a str. 2457T
aaaccacuccugacga

SEQ ID NO: 1925454 - RNA, 19 nt, Shigella flexneri 2a str. 2457T
aaaccacugauaagcugag

SEQ ID NO: 1925455 - RNA, 15 nt, Shigella flexneri 2a str. 2457T
aaaccacuuaauuau

SEQ ID NO: 1925456 - RNA, 17 nt, Shigella flexneri 2a str. 2457T
aaaccacuuaauuauua

SEQ ID NO: 1925457 - RNA, 22 nt, Shigella flexneri 2a str. 2457T
aaaccacuuaauuauuaacaaa

SEQ ID NO: 1925458 - RNA, 17 nt, Shigella flexneri 2a str. 2457T
aaaccacgacuuuuugu

SEQ ID NO: 1925459 - RNA, 21 nt, Shigella flexneri 2a str. 2457T
aaacauuucacguucacguaa

SEQ ID NO: 1925460 - RNA, 23 nt, Shigella flexneri 2a str. 2457T
aaacauuagcgcaugaccaguga

SEQ ID NO: 1925461 - RNA, 23 nt, Shigella flexneri 2a str. 2457T
ccgacgagaaaugucggcccgca

SEQ ID NO: 1925462 - RNA, 12 nt, Shigella flexneri 2a str. 2457T
ccgaccucaaca

SEQ ID NO: 1925463 - RNA, 19 nt, Shigella flexneri 2a str. 2457T
ccgagcaaaucgcggcagu

SEQ ID NO: 1925464 - RNA, 11 nt, Shigella flexneri 2a str. 2457T
ccgagcagcca

SEQ ID NO: 1925465 - RNA, 18 nt, Shigella flexneri 2a str. 2457T
ccgagaauggacaccagc

SEQ ID NO: 1925466 - RNA, 16 nt, Shigella flexneri 2a str. 2457T
ccgagaagcagcaaca

SEQ ID NO: 1925467 - RNA, 21 nt, Shigella flexneri 2a str. 2457T
aaacaucaccaaugaaagccc

SEQ ID NO: 1925468 - RNA, 12 nt, Shigella flexneri 2a str. 2457T
aaacaucaaaaa

SEQ ID NO: 1925469 - RNA, 14 nt, Shigella flexneri 2a str. 2457T
aaacaucaccaaug

SEQ ID NO: 1925470 - RNA, 16 nt, Shigella flexneri 2a str. 2457T
aaacaucauaauaauu

SEQ ID NO: 1925471 - RNA, 14 nt, Shigella flexneri 2a str. 2457T
aaacaucagcuauu

SEQ ID NO: 1925472 - RNA, 21 nt, Shigella flexneri 2a str. 2457T
aaacaucagcuauucuuauaa

SEQ ID NO: 1925473 - RNA, 15 nt, Shigella flexneri 2a str. 2457T
aaacauaauauaaau

SEQ ID NO: 1925474 - RNA, 16 nt, Shigella flexneri 2a str. 2457T
ccgaaugaccgccccu

SEQ ID NO: 1925475 - RNA, 22 nt, Shigella flexneri 2a str. 2457T
ccgaagagggggcgauagaaua

SEQ ID NO: 1925476 - RNA, 19 nt, Shigella flexneri 2a str. 2457T
ccgaagaguaaccaaacgu

SEQ ID NO: 1925477 - RNA, 12 nt, Shigella flexneri 2a str. 2457T
ccgaagaggaac

SEQ ID NO: 1925478 - RNA, 13 nt, Shigella flexneri 2a str. 2457T
ccgaagcagcuac

SEQ ID NO: 1925479 - RNA, 13 nt, Shigella flexneri 2a str. 2457T
aaacagcccaauc

SEQ ID NO: 1925480 - RNA, 18 nt, Shigella flexneri 2a str. 2457T
aaacagcgacaccagcca

SEQ ID NO: 1925481 - RNA, 13 nt, Shigella flexneri 2a str. 2457T
aaacagcgccaga

SEQ ID NO: 1925482 - RNA, 19 nt, Shigella flexneri 2a str. 2457T
aaacagcgcaccagaaaca

SEQ ID NO: 1925483 - RNA, 23 nt, Shigella flexneri 2a str. 2457T
aaacagcgcaccagaaacaauaa

SEQ ID NO: 1925484 - RNA, 18 nt, Shigella flexneri 2a str. 2457T
aaacagcggccacucuuu

SEQ ID NO: 1925485 - RNA, 23 nt, Shigella flexneri 2a str. 2457T
aaacagcgcugcgaaaguaccau

SEQ ID NO: 1925486 - RNA, 23 nt, Shigella flexneri 2a str. 2457T
aaacagcguauuaauuccgguga

SEQ ID NO: 1925487 - RNA, 11 nt, Shigella flexneri 2a str. 2457T
aaacaggaaca

SEQ ID NO: 1925488 - RNA, 13 nt, Shigella flexneri 2a str. 2457T
aaacaggauaaug

SEQ ID NO: 1925489 - RNA, 13 nt, Shigella flexneri 2a str. 2457T
aaacaggaucugg

SEQ ID NO: 1925490 - RNA, 15 nt, Shigella flexneri 2a str. 2457T
cccuuuuucacgcua

SEQ ID NO: 1925491 - RNA, 16 nt, Shigella flexneri 2a str. 2457T
aaacagguaaagacca

SEQ ID NO: 1925492 - RNA, 20 nt, Shigella flexneri 2a str. 2457T
aaacagggcuggaagaguuu

SEQ ID NO: 1925493 - RNA, 15 nt, Shigella flexneri 2a str. 2457T
cccuuuuuucaggug

SEQ ID NO: 1925494 - RNA, 12 nt, Shigella flexneri 2a str. 2457T
ccgaaaaaggau

SEQ ID NO: 1925495 - RNA, 17 nt, Shigella flexneri 2a str. 2457T
ccgaaaaaagucauuac

SEQ ID NO: 1925496 - RNA, 19 nt, Shigella flexneri 2a str. 2457T
cccuggucaguuucagcca

SEQ ID NO: 1925497 - RNA, 21 nt, Shigella flexneri 2a str. 2457T
cccugggcuucauccagcagu

SEQ ID NO: 1925498 - RNA, 17 nt, Shigella flexneri 2a str. 2457T
cccugguaaaaaaugau

SEQ ID NO: 1925499 - RNA, 14 nt, Shigella flexneri 2a str. 2457T
cccuuacccuuacu

SEQ ID NO: 1925500 - RNA, 22 nt, Shigella flexneri 2a str. 2457T
cccuuacgucccgaccccgacc

SEQ ID NO: 1925501 - RNA, 14 nt, Shigella flexneri 2a str. 2457T
cccuucaucacgca

SEQ ID NO: 1925502 - RNA, 20 nt, Shigella flexneri 2a str. 2457T
cccuucacgacauaaacauu

SEQ ID NO: 1925503 - RNA, 18 nt, Shigella flexneri 2a str. 2457T
cccuucacucugcugcca

SEQ ID NO: 1925504 - RNA, 17 nt, Shigella flexneri 2a str. 2457T
cccuucagccaccaggu

SEQ ID NO: 1925505 - RNA, 13 nt, Shigella flexneri 2a str. 2457T
aaacagcaggcag

SEQ ID NO: 1925506 - RNA, 21 nt, Shigella flexneri 2a str. 2457T
ccgcaucacuccacaccauau

SEQ ID NO: 1925507 - RNA, 23 nt, Shigella flexneri 2a str. 2457T
ccgcauaugcgggcguuuugcuu

SEQ ID NO: 1925508 - RNA, 16 nt, Shigella flexneri 2a str. 2457T
ccgcauaccccuucac

SEQ ID NO: 1925509 - RNA, 19 nt, Shigella flexneri 2a str. 2457T
ccgcauccggcaauaagca

SEQ ID NO: 1925510 - RNA, 22 nt, Shigella flexneri 2a str. 2457T
ccgcauccugcaccacgacacc

SEQ ID NO: 1925511 - RNA, 21 nt, Shigella flexneri 2a str. 2457T
ccgcauccggugauuuucauc

SEQ ID NO: 1925512 - RNA, 19 nt, Shigella flexneri 2a str. 2457T
ccgcauccggcaucaacaa

SEQ ID NO: 1925513 - RNA, 18 nt, Shigella flexneri 2a str. 2457T
ccgcagugauuucaaccg

SEQ ID NO: 1925514 - RNA, 16 nt, Shigella flexneri 2a str. 2457T
ccgcaggcgcaauggc

SEQ ID NO: 1925515 - RNA, 21 nt, Shigella flexneri 2a str. 2457T
ccgcagaucagaccaauccag

SEQ ID NO: 1925516 - RNA, 13 nt, Shigella flexneri 2a str. 2457T
ccgcagcuccagc

SEQ ID NO: 1925517 - RNA, 14 nt, Shigella flexneri 2a str. 2457T
ccgcagcuccagcc

SEQ ID NO: 1925518 - RNA, 12 nt, Shigella flexneri 2a str. 2457T
ccgauuuaaccc

SEQ ID NO: 1925519 - RNA, 20 nt, Shigella flexneri 2a str. 2457T
ccgauuucaugaagcugaca

SEQ ID NO: 1925520 - RNA, 15 nt, Shigella flexneri 2a str. 2457T
ccgauugauucccaa

SEQ ID NO: 1925521 - RNA, 21 nt, Shigella flexneri 2a str. 2457T
ccgauuaaucuuccagaucac

SEQ ID NO: 1925522 - RNA, 18 nt, Shigella flexneri 2a str. 2457T
ccgauuaauugccgccag

SEQ ID NO: 1925523 - RNA, 17 nt, Shigella flexneri 2a str. 2457T
ccgcaaacauaaucccc

SEQ ID NO: 1925524 - RNA, 17 nt, Shigella flexneri 2a str. 2457T
ccgcaaaaccaacgccu

SEQ ID NO: 1925525 - RNA, 20 nt, Shigella flexneri 2a str. 2457T
ccgauuuucagccaucaucc

SEQ ID NO: 1925526 - RNA, 23 nt, Shigella flexneri 2a str. 2457T
ccgcaaucaucgaccccaggccg

SEQ ID NO: 1925527 - RNA, 15 nt, Shigella flexneri 2a str. 2457T
ccgcaccagucgaug

SEQ ID NO: 1925528 - RNA, 18 nt, Shigella flexneri 2a str. 2457T
ccgcacaauacauagaaa

SEQ ID NO: 1925529 - RNA, 17 nt, Shigella flexneri 2a str. 2457T
ccgccaguaaucuggcc

SEQ ID NO: 1925530 - RNA, 17 nt, Shigella flexneri 2a str. 2457T
ccgccagugccaaagcc

SEQ ID NO: 1925531 - RNA, 18 nt, Shigella flexneri 2a str. 2457T
ccgccagugccaaagcca

SEQ ID NO: 1925532 - RNA, 18 nt, Shigella flexneri 2a str. 2457T
ccgccaguuuguagccaa

SEQ ID NO: 1925533 - RNA, 15 nt, Shigella flexneri 2a str. 2457T
ccgccaguucuucca

SEQ ID NO: 1925534 - RNA, 14 nt, Shigella flexneri 2a str. 2457T
ccgccaucgacaac

SEQ ID NO: 1925535 - RNA, 13 nt, Shigella flexneri 2a str. 2457T
ccgccauaaacag

SEQ ID NO: 1925536 - RNA, 19 nt, Shigella flexneri 2a str. 2457T
ccgccauaaacagcaggca

SEQ ID NO: 1925537 - RNA, 17 nt, Shigella flexneri 2a str. 2457T
ccgccaguuuugugccc

SEQ ID NO: 1925538 - RNA, 18 nt, Shigella flexneri 2a str. 2457T
ccgccaguuacugccacc

SEQ ID NO: 1925539 - RNA, 18 nt, Shigella flexneri 2a str. 2457T
ccgccaguuuugugcccg

SEQ ID NO: 1925540 - RNA, 14 nt, Shigella flexneri 2a str. 2457T
ccgccagcggcggc

SEQ ID NO: 1925541 - RNA, 22 nt, Shigella flexneri 2a str. 2457T
ccgccagcucacgggcggcagg

SEQ ID NO: 1925542 - RNA, 14 nt, Shigella flexneri 2a str. 2457T
aaaccaguaaugau

SEQ ID NO: 1925543 - RNA, 18 nt, Shigella flexneri 2a str. 2457T
aaaccaucaggaugacaa

SEQ ID NO: 1925544 - RNA, 21 nt, Shigella flexneri 2a str. 2457T
aaaccagacacuucaagaaua

SEQ ID NO: 1925545 - RNA, 19 nt, Shigella flexneri 2a str. 2457T
aaaccagaaagggaagaac

SEQ ID NO: 1925546 - RNA, 15 nt, Shigella flexneri 2a str. 2457T
aaaccagaaagggaa

SEQ ID NO: 1925547 - RNA, 18 nt, Shigella flexneri 2a str. 2457T
aaaccagaugaauagcgc

SEQ ID NO: 1925548 - RNA, 20 nt, Shigella flexneri 2a str. 2457T
aaaccagacagcacauuuca

SEQ ID NO: 1925549 - RNA, 12 nt, Shigella flexneri 2a str. 2457T
aaaccagcgcau

SEQ ID NO: 1925550 - RNA, 19 nt, Shigella flexneri 2a str. 2457T
aaaccagcgcauggcggua

SEQ ID NO: 1925551 - RNA, 22 nt, Shigella flexneri 2a str. 2457T
ccgccaccaggaacgcgccaag

SEQ ID NO: 1925552 - RNA, 21 nt, Shigella flexneri 2a str. 2457T
ccgccaauaaccggcacuuca

SEQ ID NO: 1925553 - RNA, 14 nt, Shigella flexneri 2a str. 2457T
ccgccaaacgcggu

SEQ ID NO: 1925554 - RNA, 15 nt, Shigella flexneri 2a str. 2457T
ccgccagaccacugc

SEQ ID NO: 1925555 - RNA, 13 nt, Shigella flexneri 2a str. 2457T
ccgccagauaguu

SEQ ID NO: 1925556 - RNA, 22 nt, Shigella flexneri 2a str. 2457T
ccgccacgguaucaagcccgcc

SEQ ID NO: 1925557 - RNA, 15 nt, Shigella flexneri 2a str. 2457T
ccgccacgcccuccu

SEQ ID NO: 1925558 - RNA, 13 nt, Shigella flexneri 2a str. 2457T
aaaccauguccau

SEQ ID NO: 1925559 - RNA, 20 nt, Shigella flexneri 2a str. 2457T
ccgccgaggauacagccgaa

SEQ ID NO: 1925560 - RNA, 16 nt, Shigella flexneri 2a str. 2457T
aaacccaccagcugau

SEQ ID NO: 1925561 - RNA, 19 nt, Shigella flexneri 2a str. 2457T
aaaccccaaaaagauuaaa

SEQ ID NO: 1925562 - RNA, 17 nt, Shigella flexneri 2a str. 2457T
ccgccgauguugcauga

SEQ ID NO: 1925563 - RNA, 18 nt, Shigella flexneri 2a str. 2457T
aaacccgguaagcauuua

SEQ ID NO: 1925564 - RNA, 23 nt, Shigella flexneri 2a str. 2457T
ccgcccguuuucuccagcgccgc

SEQ ID NO: 1925565 - RNA, 19 nt, Shigella flexneri 2a str. 2457T
ccgcccguuuucuccagcg

SEQ ID NO: 1925566 - RNA, 18 nt, Shigella flexneri 2a str. 2457T
ccgcccguuuucuccagc

SEQ ID NO: 1925567 - RNA, 13 nt, Shigella flexneri 2a str. 2457T
ccgcccaccacca

SEQ ID NO: 1925568 - RNA, 19 nt, Shigella flexneri 2a str. 2457T
ccgcccagaagcacugcca

SEQ ID NO: 1925569 - RNA, 12 nt, Shigella flexneri 2a str. 2457T
ccgcccagugcc

SEQ ID NO: 1925570 - RNA, 14 nt, Shigella flexneri 2a str. 2457T
ccgcccccgacucc

SEQ ID NO: 1925571 - RNA, 18 nt, Shigella flexneri 2a str. 2457T
ccgccccggguuuccugg

SEQ ID NO: 1925572 - RNA, 12 nt, Shigella flexneri 2a str. 2457T
ccgccccaggcc

SEQ ID NO: 1925573 - RNA, 17 nt, Shigella flexneri 2a str. 2457T
ccgcccagugccagcac

SEQ ID NO: 1925574 - RNA, 12 nt, Shigella flexneri 2a str. 2457T
ccgccgcuccuc

SEQ ID NO: 1925575 - RNA, 14 nt, Shigella flexneri 2a str. 2457T
ccgccgcuucgccc

SEQ ID NO: 1925576 - RNA, 19 nt, Shigella flexneri 2a str. 2457T
ccgccgcgaaccugugaaa

SEQ ID NO: 1925577 - RNA, 21 nt, Shigella flexneri 2a str. 2457T
ccgccgcacaauacauagaaa

SEQ ID NO: 1925578 - RNA, 14 nt, Shigella flexneri 2a str. 2457T
ccgccgcagccgca

SEQ ID NO: 1925579 - RNA, 21 nt, Shigella flexneri 2a str. 2457T
ccgccgguagucaccgcccag

SEQ ID NO: 1925580 - RNA, 19 nt, Shigella flexneri 2a str. 2457T
ccgccgguagucaccgccc

SEQ ID NO: 1925581 - RNA, 16 nt, Shigella flexneri 2a str. 2457T
ccgccgguugccccgc

SEQ ID NO: 1925582 - RNA, 23 nt, Shigella flexneri 2a str. 2457T
ccgccgguggcguuuccagcagu

SEQ ID NO: 1925583 - RNA, 13 nt, Shigella flexneri 2a str. 2457T
ccgccucagccag

SEQ ID NO: 1925584 - RNA, 16 nt, Shigella flexneri 2a str. 2457T
ccgccguugccgcagc

SEQ ID NO: 1925585 - RNA, 22 nt, Shigella flexneri 2a str. 2457T
ccgccguugccuuuaccgccac

SEQ ID NO: 1925586 - RNA, 13 nt, Shigella flexneri 2a str. 2457T
ccgccguugcucu

SEQ ID NO: 1925587 - RNA, 19 nt, Shigella flexneri 2a str. 2457T
ccgccguuaccuucggccc

SEQ ID NO: 1925588 - RNA, 14 nt, Shigella flexneri 2a str. 2457T
ccgccguaacuggc

SEQ ID NO: 1925589 - RNA, 20 nt, Shigella flexneri 2a str. 2457T
ccgccgucgaugccccagua

SEQ ID NO: 1925590 - RNA, 14 nt, Shigella flexneri 2a str. 2457T
ccgucgugaaugcc

SEQ ID NO: 1925591 - RNA, 16 nt, Shigella flexneri 2a str. 2457T
ccgugccccauauggc

SEQ ID NO: 1925592 - RNA, 19 nt, Shigella flexneri 2a str. 2457T
ccgugcaucuccugaaaca

SEQ ID NO: 1925593 - RNA, 17 nt, Shigella flexneri 2a str. 2457T
ccgugcaacugcggcgc

SEQ ID NO: 1925594 - RNA, 23 nt, Shigella flexneri 2a str. 2457T
ccgugcagcgcaaucgccuccag

SEQ ID NO: 1925595 - RNA, 13 nt, Shigella flexneri 2a str. 2457T
ccgugcacaccga

SEQ ID NO: 1925596 - RNA, 19 nt, Shigella flexneri 2a str. 2457T
ccgugguggcagccagcca

SEQ ID NO: 1925597 - RNA, 23 nt, Shigella flexneri 2a str. 2457T
ccguggugaguuguggcgcgucg

SEQ ID NO: 1925598 - RNA, 16 nt, Shigella flexneri 2a str. 2457T
ccgugguucauaugau

SEQ ID NO: 1925599 - RNA, 17 nt, Shigella flexneri 2a str. 2457T
ccgugcugacucagcgg

SEQ ID NO: 1925600 - RNA, 21 nt, Shigella flexneri 2a str. 2457T
ccgugcugacucagcggcugc

SEQ ID NO: 1925601 - RNA, 15 nt, Shigella flexneri 2a str. 2457T
ccgugcuguacagca

SEQ ID NO: 1925602 - RNA, 17 nt, Shigella flexneri 2a str. 2457T
aaacgaccacucuuucg

SEQ ID NO: 1925603 - RNA, 17 nt, Shigella flexneri 2a str. 2457T
ccgucgcgcccuccugc

SEQ ID NO: 1925604 - RNA, 17 nt, Shigella flexneri 2a str. 2457T
ccgucgccuucaacgua

SEQ ID NO: 1925605 - RNA, 17 nt, Shigella flexneri 2a str. 2457T
ccgucguagccaccauc

SEQ ID NO: 1925606 - RNA, 14 nt, Shigella flexneri 2a str. 2457T
ccgucgucccuucc

SEQ ID NO: 1925607 - RNA, 22 nt, Shigella flexneri 2a str. 2457T
ccgguuacgccaccagcugaca

SEQ ID NO: 1925608 - RNA, 15 nt, Shigella flexneri 2a str. 2457T
ccgguucccagaccu

SEQ ID NO: 1925609 - RNA, 15 nt, Shigella flexneri 2a str. 2457T
ccgguuaaccuuuaa

SEQ ID NO: 1925610 - RNA, 15 nt, Shigella flexneri 2a str. 2457T
ccgguuaacgccgcg

SEQ ID NO: 1925611 - RNA, 19 nt, Shigella flexneri 2a str. 2457T
ccgguugcaguucugccau

SEQ ID NO: 1925612 - RNA, 21 nt, Shigella flexneri 2a str. 2457T
ccgguuggcgacugaugaagu

SEQ ID NO: 1925613 - RNA, 17 nt, Shigella flexneri 2a str. 2457T
ccgguuucaauccaggu

SEQ ID NO: 1925614 - RNA, 16 nt, Shigella flexneri 2a str. 2457T
ccgucgagcagagaaa

SEQ ID NO: 1925615 - RNA, 22 nt, Shigella flexneri 2a str. 2457T
ccgucgagcagagaaacgccag

SEQ ID NO: 1925616 - RNA, 18 nt, Shigella flexneri 2a str. 2457T
ccguuuuuuaguuagcaa

SEQ ID NO: 1925617 - RNA, 13 nt, Shigella flexneri 2a str. 2457T
ccguuuuuuuucu

SEQ ID NO: 1925618 - RNA, 19 nt, Shigella flexneri 2a str. 2457T
ccuaaaaaguuauaaauaa

SEQ ID NO: 1925619 - RNA, 18 nt, Shigella flexneri 2a str. 2457T
ccuaaaagcacgccagac

SEQ ID NO: 1925620 - RNA, 18 nt, Shigella flexneri 2a str. 2457T
ccuaaacguuuaaaaacu

SEQ ID NO: 1925621 - RNA, 20 nt, Shigella flexneri 2a str. 2457T
ccguuuuccagccuuuuucu

SEQ ID NO: 1925622 - RNA, 14 nt, Shigella flexneri 2a str. 2457T
ccguuuucaccuua

SEQ ID NO: 1925623 - RNA, 12 nt, Shigella flexneri 2a str. 2457T
ccguuucuccac

SEQ ID NO: 1925624 - RNA, 20 nt, Shigella flexneri 2a str. 2457T
ccguuuggugguuuggcggc

SEQ ID NO: 1925625 - RNA, 19 nt, Shigella flexneri 2a str. 2457T
ccguuugcgucaguuuuug

SEQ ID NO: 1925626 - RNA, 14 nt, Shigella flexneri 2a str. 2457T
ccuaacauuuuacu

SEQ ID NO: 1925627 - RNA, 17 nt, Shigella flexneri 2a str. 2457T
ccuaaauggaaaauugg

SEQ ID NO: 1925628 - RNA, 14 nt, Shigella flexneri 2a str. 2457T
ccuaacauaaugca

SEQ ID NO: 1925629 - RNA, 16 nt, Shigella flexneri 2a str. 2457T
ccuaacauaaugcaac

SEQ ID NO: 1925630 - RNA, 13 nt, Shigella flexneri 2a str. 2457T
ccuaacaucaucc

SEQ ID NO: 1925631 - RNA, 18 nt, Shigella flexneri 2a str. 2457T
ccuaacaaccauccccaa

SEQ ID NO: 1925632 - RNA, 21 nt, Shigella flexneri 2a str. 2457T
ccuaacacaugcaagucgaac

SEQ ID NO: 1925633 - RNA, 22 nt, Shigella flexneri 2a str. 2457T
ccuaaaggcaaaaugccagccc

SEQ ID NO: 1925634 - RNA, 12 nt, Shigella flexneri 2a str. 2457T
ccuaagcuuucg

SEQ ID NO: 1925635 - RNA, 13 nt, Shigella flexneri 2a str. 2457T
ccuaaggaaucca

SEQ ID NO: 1925636 - RNA, 11 nt, Shigella flexneri 2a str. 2457T
ccuaauaaacc

SEQ ID NO: 1925637 - RNA, 15 nt, Shigella flexneri 2a str. 2457T
ccguuaagaugguua

SEQ ID NO: 1925638 - RNA, 20 nt, Shigella flexneri 2a str. 2457T
ccguuaacccgucugguuug

SEQ ID NO: 1925639 - RNA, 13 nt, Shigella flexneri 2a str. 2457T
ccguuaagcugga

SEQ ID NO: 1925640 - RNA, 15 nt, Shigella flexneri 2a str. 2457T
ccguuaacccuugcg

SEQ ID NO: 1925641 - RNA, 19 nt, Shigella flexneri 2a str. 2457T
ccguuauccugaucaagca

SEQ ID NO: 1925642 - RNA, 21 nt, Shigella flexneri 2a str. 2457T
ccguuauacaucgcuuuccag

SEQ ID NO: 1925643 - RNA, 17 nt, Shigella flexneri 2a str. 2457T
ccguuccacccagcuca

SEQ ID NO: 1925644 - RNA, 17 nt, Shigella flexneri 2a str. 2457T
ccguucgcuaccuuuca

SEQ ID NO: 1925645 - RNA, 19 nt, Shigella flexneri 2a str. 2457T
ccguucuuaagauauaaag

SEQ ID NO: 1925646 - RNA, 12 nt, Shigella flexneri 2a str. 2457T
ccguucuucccg

SEQ ID NO: 1925647 - RNA, 15 nt, Shigella flexneri 2a str. 2457T
ccguugaccagcauc

SEQ ID NO: 1925648 - RNA, 18 nt, Shigella flexneri 2a str. 2457T
ccguuucccugucucuca

SEQ ID NO: 1925649 - RNA, 13 nt, Shigella flexneri 2a str. 2457T
ccguuuaauauua

SEQ ID NO: 1925650 - RNA, 19 nt, Shigella flexneri 2a str. 2457T
ccguugugcgauccacgcc

SEQ ID NO: 1925651 - RNA, 15 nt, Shigella flexneri 2a str. 2457T
ccucgaucagagugg

SEQ ID NO: 1925652 - RNA, 17 nt, Shigella flexneri 2a str. 2457T
ccucgaucggcucuucc

SEQ ID NO: 1925653 - RNA, 15 nt, Shigella flexneri 2a str. 2457T
ccucgccguuuucug

SEQ ID NO: 1925654 - RNA, 23 nt, Shigella flexneri 2a str. 2457T
ccucggagaacggauucagugag

SEQ ID NO: 1925655 - RNA, 19 nt, Shigella flexneri 2a str. 2457T
ccucgcuggucagcgccag

SEQ ID NO: 1925656 - RNA, 17 nt, Shigella flexneri 2a str. 2457T
ccuccauugaauuuuau

SEQ ID NO: 1925657 - RNA, 20 nt, Shigella flexneri 2a str. 2457T
ccuccauaagaguagcccga

SEQ ID NO: 1925658 - RNA, 12 nt, Shigella flexneri 2a str. 2457T
ccuccggcuggg

SEQ ID NO: 1925659 - RNA, 11 nt, Shigella flexneri 2a str. 2457T
ccuccggcguu

SEQ ID NO: 1925660 - RNA, 18 nt, Shigella flexneri 2a str. 2457T
ccuccgggaccuuucuga

SEQ ID NO: 1925661 - RNA, 14 nt, Shigella flexneri 2a str. 2457T
ccuccugucuuccc

SEQ ID NO: 1925662 - RNA, 15 nt, Shigella flexneri 2a str. 2457T
ccuccugucuucccu

SEQ ID NO: 1925663 - RNA, 18 nt, Shigella flexneri 2a str. 2457T
ccuccugucuucccugcu

SEQ ID NO: 1925664 - RNA, 19 nt, Shigella flexneri 2a str. 2457T
ccuccuguucugugcgcca

SEQ ID NO: 1925665 - RNA, 17 nt, Shigella flexneri 2a str. 2457T
ccuccuguaccuucacg

SEQ ID NO: 1925666 - RNA, 22 nt, Shigella flexneri 2a str. 2457T
ccucagcgaacaggaccuugac

SEQ ID NO: 1925667 - RNA, 22 nt, Shigella flexneri 2a str. 2457T
ccucaucgauauuaucuucauc

SEQ ID NO: 1925668 - RNA, 21 nt, Shigella flexneri 2a str. 2457T
aaacgauuuuuuuaauaauau

SEQ ID NO: 1925669 - RNA, 19 nt, Shigella flexneri 2a str. 2457T
aaacgcaaacaccagcgaa

SEQ ID NO: 1925670 - RNA, 15 nt, Shigella flexneri 2a str. 2457T
ccucacccuaacccu

SEQ ID NO: 1925671 - RNA, 20 nt, Shigella flexneri 2a str. 2457T
ccucacagcuaaucaucauc

SEQ ID NO: 1925672 - RNA, 16 nt, Shigella flexneri 2a str. 2457T
ccucacaugaguugcu

SEQ ID NO: 1925673 - RNA, 17 nt, Shigella flexneri 2a str. 2457T
ccucacagcuaaucauc

SEQ ID NO: 1925674 - RNA, 12 nt, Shigella flexneri 2a str. 2457T
ccuauugcugcu

SEQ ID NO: 1925675 - RNA, 18 nt, Shigella flexneri 2a str. 2457T
ccuauauuccuuuaucau

SEQ ID NO: 1925676 - RNA, 14 nt, Shigella flexneri 2a str. 2457T
ccuaucaccagcgg

SEQ ID NO: 1925677 - RNA, 16 nt, Shigella flexneri 2a str. 2457T
ccuaucaccagcggug

SEQ ID NO: 1925678 - RNA, 22 nt, Shigella flexneri 2a str. 2457T
ccuagugcgguaaauuuuuuga

SEQ ID NO: 1925679 - RNA, 17 nt, Shigella flexneri 2a str. 2457T
ccuacgcgcccgcgcag

SEQ ID NO: 1925680 - RNA, 21 nt, Shigella flexneri 2a str. 2457T
ccuacgugguuuaugcaauau

SEQ ID NO: 1925681 - RNA, 19 nt, Shigella flexneri 2a str. 2457T
ccuaccgccagguuucaau

SEQ ID NO: 1925682 - RNA, 18 nt, Shigella flexneri 2a str. 2457T
ccuaccugcaguucauca

SEQ ID NO: 1925683 - RNA, 17 nt, Shigella flexneri 2a str. 2457T
ccuacgaggaguuuuuc

SEQ ID NO: 1925684 - RNA, 17 nt, Shigella flexneri 2a str. 2457T
ccuaccugcaguucauc

SEQ ID NO: 1925685 - RNA, 13 nt, Shigella flexneri 2a str. 2457T
ccuacugcuccua

SEQ ID NO: 1925686 - RNA, 19 nt, Shigella flexneri 2a str. 2457T
ccuacaacuccguugaaau

SEQ ID NO: 1925687 - RNA, 18 nt, Shigella flexneri 2a str. 2457T
ccuacacauuaucucaac

SEQ ID NO: 1925688 - RNA, 18 nt, Shigella flexneri 2a str. 2457T
ccuacagguaagguaaug

SEQ ID NO: 1925689 - RNA, 22 nt, Shigella flexneri 2a str. 2457T
ccuacacauuaucucaacacac

SEQ ID NO: 1925690 - RNA, 19 nt, Shigella flexneri 2a str. 2457T
ccggcaacaaugccacgcc

SEQ ID NO: 1925691 - RNA, 14 nt, Shigella flexneri 2a str. 2457T
ccggcaaauaacag

SEQ ID NO: 1925692 - RNA, 11 nt, Shigella flexneri 2a str. 2457T
ccggcaaaugu

SEQ ID NO: 1925693 - RNA, 16 nt, Shigella flexneri 2a str. 2457T
ccggauuuuuuuuccg

SEQ ID NO: 1925694 - RNA, 17 nt, Shigella flexneri 2a str. 2457T
ccggauuuucaccaucg

SEQ ID NO: 1925695 - RNA, 13 nt, Shigella flexneri 2a str. 2457T
ccggcaauaaaac

SEQ ID NO: 1925696 - RNA, 15 nt, Shigella flexneri 2a str. 2457T
ccggcaauaaaacag

SEQ ID NO: 1925697 - RNA, 14 nt, Shigella flexneri 2a str. 2457T
ccggcaagauucca

SEQ ID NO: 1925698 - RNA, 19 nt, Shigella flexneri 2a str. 2457T
ccggcaagauuccagugcc

SEQ ID NO: 1925699 - RNA, 19 nt, Shigella flexneri 2a str. 2457T
ccggcaacguugcccguac

SEQ ID NO: 1925700 - RNA, 16 nt, Shigella flexneri 2a str. 2457T
ccggaugcgacgccgg

SEQ ID NO: 1925701 - RNA, 13 nt, Shigella flexneri 2a str. 2457T
ccggauggcagag

SEQ ID NO: 1925702 - RNA, 17 nt, Shigella flexneri 2a str. 2457T
ccggaugcgccagcauc

SEQ ID NO: 1925703 - RNA, 22 nt, Shigella flexneri 2a str. 2457T
ccggaugcggcguaaacgcuuu

SEQ ID NO: 1925704 - RNA, 16 nt, Shigella flexneri 2a str. 2457T
ccggaugacagacucc

SEQ ID NO: 1925705 - RNA, 16 nt, Shigella flexneri 2a str. 2457T
ccggauaugcggggau

SEQ ID NO: 1925706 - RNA, 16 nt, Shigella flexneri 2a str. 2457T
ccggauauccacccgc

SEQ ID NO: 1925707 - RNA, 14 nt, Shigella flexneri 2a str. 2457T
ccggauaucccagc

SEQ ID NO: 1925708 - RNA, 19 nt, Shigella flexneri 2a str. 2457T
ccggacggacuuccagcgg

SEQ ID NO: 1925709 - RNA, 17 nt, Shigella flexneri 2a str. 2457T
ccgcuuccagcgcaucu

SEQ ID NO: 1925710 - RNA, 17 nt, Shigella flexneri 2a str. 2457T
ccgcuuccagcauuucu

SEQ ID NO: 1925711 - RNA, 18 nt, Shigella flexneri 2a str. 2457T
ccgcuuccagcauuucug

SEQ ID NO: 1925712 - RNA, 19 nt, Shigella flexneri 2a str. 2457T
ccgcuuccagcauuucugg

SEQ ID NO: 1925713 - RNA, 21 nt, Shigella flexneri 2a str. 2457T
ccgcuuacaucaacucucuuu

SEQ ID NO: 1925714 - RNA, 16 nt, Shigella flexneri 2a str. 2457T
ccgcuucaaaguucug

SEQ ID NO: 1925715 - RNA, 15 nt, Shigella flexneri 2a str. 2457T
ccgcuucaccaccgc

SEQ ID NO: 1925716 - RNA, 16 nt, Shigella flexneri 2a str. 2457T
ccgcugugauuucagc

SEQ ID NO: 1925717 - RNA, 21 nt, Shigella flexneri 2a str. 2457T
ccgccucgcggcagcagagaa

SEQ ID NO: 1925718 - RNA, 13 nt, Shigella flexneri 2a str. 2457T
ccggaccgucauc

SEQ ID NO: 1925719 - RNA, 13 nt, Shigella flexneri 2a str. 2457T
ccggacccacacc

SEQ ID NO: 1925720 - RNA, 22 nt, Shigella flexneri 2a str. 2457T
ccggaaaaacagaggcccgccc

SEQ ID NO: 1925721 - RNA, 22 nt, Shigella flexneri 2a str. 2457T
ccgcuuuguguaaguuuaaccu

SEQ ID NO: 1925722 - RNA, 15 nt, Shigella flexneri 2a str. 2457T
ccgcuuuuccagcau

SEQ ID NO: 1925723 - RNA, 16 nt, Shigella flexneri 2a str. 2457T
ccgcuuuccaggcauc

SEQ ID NO: 1925724 - RNA, 20 nt, Shigella flexneri 2a str. 2457T
ccgcuuucucugcaagaacu

SEQ ID NO: 1925725 - RNA, 20 nt, Shigella flexneri 2a str. 2457T
ccggcacguuuuggcagaca

SEQ ID NO: 1925726 - RNA, 16 nt, Shigella flexneri 2a str. 2457T
ccggcaaucgccagau

SEQ ID NO: 1925727 - RNA, 21 nt, Shigella flexneri 2a str. 2457T
ccggcaaucaccgccagcggc

SEQ ID NO: 1925728 - RNA, 20 nt, Shigella flexneri 2a str. 2457T
ccggcaccaauguaggccug

SEQ ID NO: 1925729 - RNA, 15 nt, Shigella flexneri 2a str. 2457T
ccggcauaaacaacg

SEQ ID NO: 1925730 - RNA, 22 nt, Shigella flexneri 2a str. 2457T
ccggcauaaccggaucgccaau

SEQ ID NO: 1925731 - RNA, 17 nt, Shigella flexneri 2a str. 2457T
ccggcagccccaaacag

SEQ ID NO: 1925732 - RNA, 16 nt, Shigella flexneri 2a str. 2457T
ccggcagaagcaauca

SEQ ID NO: 1925733 - RNA, 14 nt, Shigella flexneri 2a str. 2457T
ccggcacuucaacu

SEQ ID NO: 1925734 - RNA, 11 nt, Shigella flexneri 2a str. 2457T
ccggcagagaa

SEQ ID NO: 1925735 - RNA, 13 nt, Shigella flexneri 2a str. 2457T
ccggcagagaaaa

SEQ ID NO: 1925736 - RNA, 17 nt, Shigella flexneri 2a str. 2457T
ccggccuacaagaacca

SEQ ID NO: 1925737 - RNA, 14 nt, Shigella flexneri 2a str. 2457T
ccggccuacacaug

SEQ ID NO: 1925738 - RNA, 20 nt, Shigella flexneri 2a str. 2457T
ccggcccuaaacucuuuacc

SEQ ID NO: 1925739 - RNA, 14 nt, Shigella flexneri 2a str. 2457T
ccggcaugaacaaa

SEQ ID NO: 1925740 - RNA, 17 nt, Shigella flexneri 2a str. 2457T
ccggcauggcauuuuua

SEQ ID NO: 1925741 - RNA, 22 nt, Shigella flexneri 2a str. 2457T
ccggccccugaucggccaugau

SEQ ID NO: 1925742 - RNA, 16 nt, Shigella flexneri 2a str. 2457T
ccggccccggaaccgg

SEQ ID NO: 1925743 - RNA, 22 nt, Shigella flexneri 2a str. 2457T
ccggcguccaccugcgucgcgc

SEQ ID NO: 1925744 - RNA, 17 nt, Shigella flexneri 2a str. 2457T
ccggcgucgcauccggc

SEQ ID NO: 1925745 - RNA, 15 nt, Shigella flexneri 2a str. 2457T
aaaccgccuucugcg

SEQ ID NO: 1925746 - RNA, 23 nt, Shigella flexneri 2a str. 2457T
aaaccgccuucugcgccgccucu

SEQ ID NO: 1925747 - RNA, 22 nt, Shigella flexneri 2a str. 2457T
aaaccgcgaugaccaaaaacau

SEQ ID NO: 1925748 - RNA, 16 nt, Shigella flexneri 2a str. 2457T
aaaccuguugaaauua

SEQ ID NO: 1925749 - RNA, 14 nt, Shigella flexneri 2a str. 2457T
ccgggcauauuucc

SEQ ID NO: 1925750 - RNA, 16 nt, Shigella flexneri 2a str. 2457T
ccggcucccgcagcca

SEQ ID NO: 1925751 - RNA, 14 nt, Shigella flexneri 2a str. 2457T
ccgggcaaaaguca

SEQ ID NO: 1925752 - RNA, 13 nt, Shigella flexneri 2a str. 2457T
ccgggauugagau

SEQ ID NO: 1925753 - RNA, 18 nt, Shigella flexneri 2a str. 2457T
aaaccguguugaggccaa

SEQ ID NO: 1925754 - RNA, 15 nt, Shigella flexneri 2a str. 2457T
ccgguaaagcaauga

SEQ ID NO: 1925755 - RNA, 17 nt, Shigella flexneri 2a str. 2457T
ccggguuugccacauca

SEQ ID NO: 1925756 - RNA, 21 nt, Shigella flexneri 2a str. 2457T
ccgguacaaacaucauccagu

SEQ ID NO: 1925757 - RNA, 14 nt, Shigella flexneri 2a str. 2457T
ccgguaagcauuua

SEQ ID NO: 1925758 - RNA, 13 nt, Shigella flexneri 2a str. 2457T
ccgggugcagaca

SEQ ID NO: 1925759 - RNA, 16 nt, Shigella flexneri 2a str. 2457T
ccgggugaacugccac

SEQ ID NO: 1925760 - RNA, 15 nt, Shigella flexneri 2a str. 2457T
ccgggucauccagga

SEQ ID NO: 1925761 - RNA, 11 nt, Shigella flexneri 2a str. 2457T
ccggugcauuc

SEQ ID NO: 1925762 - RNA, 18 nt, Shigella flexneri 2a str. 2457T
ccggucagcagcaccacc

SEQ ID NO: 1925763 - RNA, 13 nt, Shigella flexneri 2a str. 2457T
ccggucagcagca

SEQ ID NO: 1925764 - RNA, 13 nt, Shigella flexneri 2a str. 2457T
ccgguacgccgcg

SEQ ID NO: 1925765 - RNA, 13 nt, Shigella flexneri 2a str. 2457T
ccgguauccagcg

SEQ ID NO: 1925766 - RNA, 15 nt, Shigella flexneri 2a str. 2457T
ccggucaaaugaccg

SEQ ID NO: 1925767 - RNA, 13 nt, Shigella flexneri 2a str. 2457T
cgacaaugccaca

SEQ ID NO: 1925768 - RNA, 18 nt, Shigella flexneri 2a str. 2457T
cgacaauaaucaccacac

SEQ ID NO: 1925769 - RNA, 14 nt, Shigella flexneri 2a str. 2457T
cgacaauauugaug

SEQ ID NO: 1925770 - RNA, 16 nt, Shigella flexneri 2a str. 2457T
cgacacaaccaccguu

SEQ ID NO: 1925771 - RNA, 23 nt, Shigella flexneri 2a str. 2457T
cgacaauucgcguaguaaagccu

SEQ ID NO: 1925772 - RNA, 16 nt, Shigella flexneri 2a str. 2457T
cgacaaucgcaaauau

SEQ ID NO: 1925773 - RNA, 16 nt, Shigella flexneri 2a str. 2457T
cgacaagauccugaua

SEQ ID NO: 1925774 - RNA, 16 nt, Shigella flexneri 2a str. 2457T
cgacaccguuaaauaa

SEQ ID NO: 1925775 - RNA, 14 nt, Shigella flexneri 2a str. 2457T
cgaauuugaacaag

SEQ ID NO: 1925776 - RNA, 24 nt, Shigella flexneri 2a str. 2457T
cgaauuucauccuguacgacaaaa

SEQ ID NO: 1925777 - RNA, 23 nt, Shigella flexneri 2a str. 2457T
cgaauuuuccaugaccugccagg

SEQ ID NO: 1925778 - RNA, 18 nt, Shigella flexneri 2a str. 2457T
cgacaaaaauuacugccu

SEQ ID NO: 1925779 - RNA, 20 nt, Shigella flexneri 2a str. 2457T
cgacaaaaauaccaccaaug

SEQ ID NO: 1925780 - RNA, 16 nt, Shigella flexneri 2a str. 2457T
cgacaaaaauuacugc

SEQ ID NO: 1925781 - RNA, 22 nt, Shigella flexneri 2a str. 2457T
cgacaaaaucggaaacaaauac

SEQ ID NO: 1925782 - RNA, 15 nt, Shigella flexneri 2a str. 2457T
cgacaaacaccgaac

SEQ ID NO: 1925783 - RNA, 22 nt, Shigella flexneri 2a str. 2457T
cgacaaauuucaucgcuacacc

SEQ ID NO: 1925784 - RNA, 13 nt, Shigella flexneri 2a str. 2457T
cgacaacagaaau

SEQ ID NO: 1925785 - RNA, 23 nt, Shigella flexneri 2a str. 2457T
cgacaaccugaccuuuuuucagc

SEQ ID NO: 1925786 - RNA, 18 nt, Shigella flexneri 2a str. 2457T
cgacaacgcggcacagca

SEQ ID NO: 1925787 - RNA, 14 nt, Shigella flexneri 2a str. 2457T
cgacagaugcucgc

SEQ ID NO: 1925788 - RNA, 19 nt, Shigella flexneri 2a str. 2457T
cgacacuggcagugugucu

SEQ ID NO: 1925789 - RNA, 21 nt, Shigella flexneri 2a str. 2457T
cgacagaacggauaucgagaa

SEQ ID NO: 1925790 - RNA, 16 nt, Shigella flexneri 2a str. 2457T
cgacagacgacgacgc

SEQ ID NO: 1925791 - RNA, 19 nt, Shigella flexneri 2a str. 2457T
cgacagcguuucgccaccc

SEQ ID NO: 1925792 - RNA, 23 nt, Shigella flexneri 2a str. 2457T
cgacaucgccacggcaugaaagc

SEQ ID NO: 1925793 - RNA, 13 nt, Shigella flexneri 2a str. 2457T
cgacaucaucagc

SEQ ID NO: 1925794 - RNA, 20 nt, Shigella flexneri 2a str. 2457T
cgacaguaccagcaguacag

SEQ ID NO: 1925795 - RNA, 23 nt, Shigella flexneri 2a str. 2457T
cgacaguugcugcgugaccgcca

SEQ ID NO: 1925796 - RNA, 13 nt, Shigella flexneri 2a str. 2457T
cgacaggaacgcc

SEQ ID NO: 1925797 - RNA, 22 nt, Shigella flexneri 2a str. 2457T
cgacagggaucucuuccagugc

SEQ ID NO: 1925798 - RNA, 17 nt, Shigella flexneri 2a str. 2457T
cgacagggaucucuucc

SEQ ID NO: 1925799 - RNA, 18 nt, Shigella flexneri 2a str. 2457T
cgacagggaucucuucca

SEQ ID NO: 1925800 - RNA, 17 nt, Shigella flexneri 2a str. 2457T
cgaauguuccaucacca

SEQ ID NO: 1925801 - RNA, 16 nt, Shigella flexneri 2a str. 2457T
cgaaugcgaaaauccu

SEQ ID NO: 1925802 - RNA, 22 nt, Shigella flexneri 2a str. 2457T
cgaauggcaucuacgcucucuu

SEQ ID NO: 1925803 - RNA, 13 nt, Shigella flexneri 2a str. 2457T
cgaauccuucccc

SEQ ID NO: 1925804 - RNA, 17 nt, Shigella flexneri 2a str. 2457T
cgaaucgcuucauuuac

SEQ ID NO: 1925805 - RNA, 16 nt, Shigella flexneri 2a str. 2457T
cgaaucugauuagccu

SEQ ID NO: 1925806 - RNA, 16 nt, Shigella flexneri 2a str. 2457T
cgaaguuuuccucagu

SEQ ID NO: 1925807 - RNA, 12 nt, Shigella flexneri 2a str. 2457T
cgaauauuuccc

SEQ ID NO: 1925808 - RNA, 13 nt, Shigella flexneri 2a str. 2457T
cgaauaaaaaaag

SEQ ID NO: 1925809 - RNA, 16 nt, Shigella flexneri 2a str. 2457T
cgaauaaaaaaagaaa

SEQ ID NO: 1925810 - RNA, 14 nt, Shigella flexneri 2a str. 2457T
cgaaucaacuccag

SEQ ID NO: 1925811 - RNA, 19 nt, Shigella flexneri 2a str. 2457T
cgaaucccgcugcaaucuu

SEQ ID NO: 1925812 - RNA, 22 nt, Shigella flexneri 2a str. 2457T
cgaacucauacaccagcggcac

SEQ ID NO: 1925813 - RNA, 17 nt, Shigella flexneri 2a str. 2457T
cgaacuccgaucccugc

SEQ ID NO: 1925814 - RNA, 16 nt, Shigella flexneri 2a str. 2457T
cgaacuaaccgcgcuc

SEQ ID NO: 1925815 - RNA, 20 nt, Shigella flexneri 2a str. 2457T
ccuuuuuauuuauucaaacc

SEQ ID NO: 1925816 - RNA, 22 nt, Shigella flexneri 2a str. 2457T
ccuuuuuauuuauucaaaccaa

SEQ ID NO: 1925817 - RNA, 20 nt, Shigella flexneri 2a str. 2457T
ccuuuuguuuguucuucucg

SEQ ID NO: 1925818 - RNA, 15 nt, Shigella flexneri 2a str. 2457T
ccuuuuuacccaugg

SEQ ID NO: 1925819 - RNA, 17 nt, Shigella flexneri 2a str. 2457T
cgaaccgucccucgccc

SEQ ID NO: 1925820 - RNA, 21 nt, Shigella flexneri 2a str. 2457T
cgaacuggaugaaaaaauccc

SEQ ID NO: 1925821 - RNA, 21 nt, Shigella flexneri 2a str. 2457T
cgaacugucgguuuguacucu

SEQ ID NO: 1925822 - RNA, 24 nt, Shigella flexneri 2a str. 2457T
cgaagaaguaagcugagugcucaa

SEQ ID NO: 1925823 - RNA, 23 nt, Shigella flexneri 2a str. 2457T
cgaagcccaucaguacaccaccu

SEQ ID NO: 1925824 - RNA, 21 nt, Shigella flexneri 2a str. 2457T
cgaagcccaucaguacaccac

SEQ ID NO: 1925825 - RNA, 17 nt, Shigella flexneri 2a str. 2457T
cgaagcccucaaacaac

SEQ ID NO: 1925826 - RNA, 18 nt, Shigella flexneri 2a str. 2457T
cgaccuacgcgcccgcgc

SEQ ID NO: 1925827 - RNA, 22 nt, Shigella flexneri 2a str. 2457T
cgaccucaaaggccgacagcag

SEQ ID NO: 1925828 - RNA, 15 nt, Shigella flexneri 2a str. 2457T
cgaccguuccauuca

SEQ ID NO: 1925829 - RNA, 15 nt, Shigella flexneri 2a str. 2457T
cgaccgaacagauca

SEQ ID NO: 1925830 - RNA, 17 nt, Shigella flexneri 2a str. 2457T
cgaccgaacagaucacg

SEQ ID NO: 1925831 - RNA, 19 nt, Shigella flexneri 2a str. 2457T
cgacccagccagacgccag

SEQ ID NO: 1925832 - RNA, 16 nt, Shigella flexneri 2a str. 2457T
cgacccagaaacaggc

SEQ ID NO: 1925833 - RNA, 21 nt, Shigella flexneri 2a str. 2457T
cgacccgacagaugcucgcca

SEQ ID NO: 1925834 - RNA, 12 nt, Shigella flexneri 2a str. 2457T
cgaccaggcaaa

SEQ ID NO: 1925835 - RNA, 13 nt, Shigella flexneri 2a str. 2457T
cgaccacuucaug

SEQ ID NO: 1925836 - RNA, 18 nt, Shigella flexneri 2a str. 2457T
cgaccagaauaagucugg

SEQ ID NO: 1925837 - RNA, 14 nt, Shigella flexneri 2a str. 2457T
cgaccagaaaugca

SEQ ID NO: 1925838 - RNA, 12 nt, Shigella flexneri 2a str. 2457T
cgaccagaaaug

SEQ ID NO: 1925839 - RNA, 13 nt, Shigella flexneri 2a str. 2457T
cgaccaggcaaac

SEQ ID NO: 1925840 - RNA, 19 nt, Shigella flexneri 2a str. 2457T
cgaccaggccaucagcagc

SEQ ID NO: 1925841 - RNA, 15 nt, Shigella flexneri 2a str. 2457T
cgaccacucuuucga

SEQ ID NO: 1925842 - RNA, 12 nt, Shigella flexneri 2a str. 2457T
cgaccaccaccg

SEQ ID NO: 1925843 - RNA, 17 nt, Shigella flexneri 2a str. 2457T
cgaccacccaccgcagc

SEQ ID NO: 1925844 - RNA, 15 nt, Shigella flexneri 2a str. 2457T
cgacaucugucagug

SEQ ID NO: 1925845 - RNA, 23 nt, Shigella flexneri 2a str. 2457T
cgacaucuuucugcgcaucuucc

SEQ ID NO: 1925846 - RNA, 19 nt, Shigella flexneri 2a str. 2457T
cgacauggcgaaaauuggu

SEQ ID NO: 1925847 - RNA, 12 nt, Shigella flexneri 2a str. 2457T
cgacauggcaac

SEQ ID NO: 1925848 - RNA, 19 nt, Shigella flexneri 2a str. 2457T
cgacauggcaauagcuucu

SEQ ID NO: 1925849 - RNA, 16 nt, Shigella flexneri 2a str. 2457T
cgacauuucugcugcc

SEQ ID NO: 1925850 - RNA, 18 nt, Shigella flexneri 2a str. 2457T
cgacauugauguuuucag

SEQ ID NO: 1925851 - RNA, 12 nt, Shigella flexneri 2a str. 2457T
cgaccugauuuu

SEQ ID NO: 1925852 - RNA, 16 nt, Shigella flexneri 2a str. 2457T
cgaccuguucuccugg

SEQ ID NO: 1925853 - RNA, 14 nt, Shigella flexneri 2a str. 2457T
cgacgacaggcaag

SEQ ID NO: 1925854 - RNA, 16 nt, Shigella flexneri 2a str. 2457T
cgacgcauacgauccu

SEQ ID NO: 1925855 - RNA, 14 nt, Shigella flexneri 2a str. 2457T
cgacgacgcgcgcg

SEQ ID NO: 1925856 - RNA, 13 nt, Shigella flexneri 2a str. 2457T
cgacgacgcgcgc

SEQ ID NO: 1925857 - RNA, 22 nt, Shigella flexneri 2a str. 2457T
cgacgccguuuaaauacaccuu

SEQ ID NO: 1925858 - RNA, 18 nt, Shigella flexneri 2a str. 2457T
cgacgcuugccgcgucuu

SEQ ID NO: 1925859 - RNA, 21 nt, Shigella flexneri 2a str. 2457T
cgacggcuggacaaaauacug

SEQ ID NO: 1925860 - RNA, 18 nt, Shigella flexneri 2a str. 2457T
cgacggcgcacaggcaau

SEQ ID NO: 1925861 - RNA, 13 nt, Shigella flexneri 2a str. 2457T
cgacguagcccgg

SEQ ID NO: 1925862 - RNA, 13 nt, Shigella flexneri 2a str. 2457T
cgacguaauuuag

SEQ ID NO: 1925863 - RNA, 13 nt, Shigella flexneri 2a str. 2457T
ccuugcuucgcca

SEQ ID NO: 1925864 - RNA, 18 nt, Shigella flexneri 2a str. 2457T
ccuugcuucgccaguucg

SEQ ID NO: 1925865 - RNA, 20 nt, Shigella flexneri 2a str. 2457T
ccuugcuuugcaacugcugu

SEQ ID NO: 1925866 - RNA, 19 nt, Shigella flexneri 2a str. 2457T
ccuugcucauccauugcuu

SEQ ID NO: 1925867 - RNA, 14 nt, Shigella flexneri 2a str. 2457T
ccuugcguuucuga

SEQ ID NO: 1925868 - RNA, 21 nt, Shigella flexneri 2a str. 2457T
ccuugcguacaccaacaucac

SEQ ID NO: 1925869 - RNA, 22 nt, Shigella flexneri 2a str. 2457T
ccuugucaucgucggccuuaau

SEQ ID NO: 1925870 - RNA, 18 nt, Shigella flexneri 2a str. 2457T
ccuugucaugcagcucca

SEQ ID NO: 1925871 - RNA, 22 nt, Shigella flexneri 2a str. 2457T
ccuugucaugcagcuccaccga

SEQ ID NO: 1925872 - RNA, 22 nt, Shigella flexneri 2a str. 2457T
ccuuguugcuauggggaaaaau

SEQ ID NO: 1925873 - RNA, 18 nt, Shigella flexneri 2a str. 2457T
ccuuguuguaaugacaac

SEQ ID NO: 1925874 - RNA, 23 nt, Shigella flexneri 2a str. 2457T
ccuuucacgccgggaaauuuuuc

SEQ ID NO: 1925875 - RNA, 23 nt, Shigella flexneri 2a str. 2457T
ccuuuaucgaaguacuccugcuc

SEQ ID NO: 1925876 - RNA, 18 nt, Shigella flexneri 2a str. 2457T
ccuuuaucgcgcagcaga

SEQ ID NO: 1925877 - RNA, 19 nt, Shigella flexneri 2a str. 2457T
ccuuuacggcgcgucagau

SEQ ID NO: 1925878 - RNA, 16 nt, Shigella flexneri 2a str. 2457T
ccuuuacggcgcguca

SEQ ID NO: 1925879 - RNA, 11 nt, Shigella flexneri 2a str. 2457T
ccuuguuucuu

SEQ ID NO: 1925880 - RNA, 20 nt, Shigella flexneri 2a str. 2457T
ccuuucagaguuguaccagc

SEQ ID NO: 1925881 - RNA, 23 nt, Shigella flexneri 2a str. 2457T
ccuuucaugguugucaccgccag

SEQ ID NO: 1925882 - RNA, 18 nt, Shigella flexneri 2a str. 2457T
ccuuuccagucuucuugc

SEQ ID NO: 1925883 - RNA, 17 nt, Shigella flexneri 2a str. 2457T
ccuuucccuauuuuuuc

SEQ ID NO: 1925884 - RNA, 12 nt, Shigella flexneri 2a str. 2457T
ccuuuccuccug

SEQ ID NO: 1925885 - RNA, 15 nt, Shigella flexneri 2a str. 2457T
ccuuucgaacccaac

SEQ ID NO: 1925886 - RNA, 21 nt, Shigella flexneri 2a str. 2457T
ccuuucguuaaauucuucuga

SEQ ID NO: 1925887 - RNA, 16 nt, Shigella flexneri 2a str. 2457T
ccuuucggcugcagca

SEQ ID NO: 1925888 - RNA, 13 nt, Shigella flexneri 2a str. 2457T
ccuuucggccaug

SEQ ID NO: 1925889 - RNA, 18 nt, Shigella flexneri 2a str. 2457T
ccuuucggcgcagucaca

SEQ ID NO: 1925890 - RNA, 16 nt, Shigella flexneri 2a str. 2457T
ccuuuguaugccuggc

SEQ ID NO: 1925891 - RNA, 14 nt, Shigella flexneri 2a str. 2457T
ccuucagccaccag

SEQ ID NO: 1925892 - RNA, 16 nt, Shigella flexneri 2a str. 2457T
ccuucagguuuuucag

SEQ ID NO: 1925893 - RNA, 19 nt, Shigella flexneri 2a str. 2457T
ccuucaggugguuagcugc

SEQ ID NO: 1925894 - RNA, 19 nt, Shigella flexneri 2a str. 2457T
ccuucgaaugccgcagcac

SEQ ID NO: 1925895 - RNA, 18 nt, Shigella flexneri 2a str. 2457T
ccuuccuuagcaaaauag

SEQ ID NO: 1925896 - RNA, 11 nt, Shigella flexneri 2a str. 2457T
ccuucuucauc

SEQ ID NO: 1925897 - RNA, 21 nt, Shigella flexneri 2a str. 2457T
ccuucgcggaauuucagaaaa

SEQ ID NO: 1925898 - RNA, 20 nt, Shigella flexneri 2a str. 2457T
ccuucuuuacugcccgcuug

SEQ ID NO: 1925899 - RNA, 16 nt, Shigella flexneri 2a str. 2457T
ccuucuuuaugucgca

SEQ ID NO: 1925900 - RNA, 13 nt, Shigella flexneri 2a str. 2457T
ccuucuucuuuca

SEQ ID NO: 1925901 - RNA, 23 nt, Shigella flexneri 2a str. 2457T
ccuugaaaucguuugcauccagc

SEQ ID NO: 1925902 - RNA, 13 nt, Shigella flexneri 2a str. 2457T
ccuuaauaaccca

SEQ ID NO: 1925903 - RNA, 21 nt, Shigella flexneri 2a str. 2457T
ccuguaccuucagcggcagcu

SEQ ID NO: 1925904 - RNA, 16 nt, Shigella flexneri 2a str. 2457T
ccuguacggcagugaa

SEQ ID NO: 1925905 - RNA, 17 nt, Shigella flexneri 2a str. 2457T
ccuguaccuucagcggc

SEQ ID NO: 1925906 - RNA, 14 nt, Shigella flexneri 2a str. 2457T
ccuguaccagcccg

SEQ ID NO: 1925907 - RNA, 16 nt, Shigella flexneri 2a str. 2457T
ccuguaccacaaccug

SEQ ID NO: 1925908 - RNA, 14 nt, Shigella flexneri 2a str. 2457T
ccuuaucgaagagg

SEQ ID NO: 1925909 - RNA, 20 nt, Shigella flexneri 2a str. 2457T
ccuuacccuuacucacuaaa

SEQ ID NO: 1925910 - RNA, 18 nt, Shigella flexneri 2a str. 2457T
ccuuaccccugacgcuua

SEQ ID NO: 1925911 - RNA, 12 nt, Shigella flexneri 2a str. 2457T
ccuuauccagcc

SEQ ID NO: 1925912 - RNA, 19 nt, Shigella flexneri 2a str. 2457T
ccuucacccauugccgccu

SEQ ID NO: 1925913 - RNA, 18 nt, Shigella flexneri 2a str. 2457T
ccuucacgacauaaacau

SEQ ID NO: 1925914 - RNA, 14 nt, Shigella flexneri 2a str. 2457T
ccuucacacugccu

SEQ ID NO: 1925915 - RNA, 17 nt, Shigella flexneri 2a str. 2457T
ccuucacaggccgccag

SEQ ID NO: 1925916 - RNA, 22 nt, Shigella flexneri 2a str. 2457T
ccuucacauuucccggaauaau

SEQ ID NO: 1925917 - RNA, 17 nt, Shigella flexneri 2a str. 2457T
ccuucagcaacuuguuc

SEQ ID NO: 1925918 - RNA, 17 nt, Shigella flexneri 2a str. 2457T
ccuucacgcgcuccagg

SEQ ID NO: 1925919 - RNA, 19 nt, Shigella flexneri 2a str. 2457T
ccuucaacuugcuguuucg

SEQ ID NO: 1925920 - RNA, 15 nt, Shigella flexneri 2a str. 2457T
ccuucaagaauuaaa

SEQ ID NO: 1925921 - RNA, 13 nt, Shigella flexneri 2a str. 2457T
ccuucaacgcggc

SEQ ID NO: 1925922 - RNA, 19 nt, Shigella flexneri 2a str. 2457T
ccuucaaacguuuugcaau

SEQ ID NO: 1925923 - RNA, 15 nt, Shigella flexneri 2a str. 2457T
ccuucaacccaucaa

SEQ ID NO: 1925924 - RNA, 20 nt, Shigella flexneri 2a str. 2457T
ccuucaacacuggcaaaauc

SEQ ID NO: 1925925 - RNA, 17 nt, Shigella flexneri 2a str. 2457T
ccugggcgaugcuggca

SEQ ID NO: 1925926 - RNA, 15 nt, Shigella flexneri 2a str. 2457T
ccugggcgauuuccu

SEQ ID NO: 1925927 - RNA, 16 nt, Shigella flexneri 2a str. 2457T
ccugggcaauggugaa

SEQ ID NO: 1925928 - RNA, 17 nt, Shigella flexneri 2a str. 2457T
ccuggugaauauuccuu

SEQ ID NO: 1925929 - RNA, 16 nt, Shigella flexneri 2a str. 2457T
ccuggcuugccagcca

SEQ ID NO: 1925930 - RNA, 23 nt, Shigella flexneri 2a str. 2457T
ccuggcuuggcuggcgugagccg

SEQ ID NO: 1925931 - RNA, 16 nt, Shigella flexneri 2a str. 2457T
ccuggcgucuggccca

SEQ ID NO: 1925932 - RNA, 23 nt, Shigella flexneri 2a str. 2457T
ccuggcgggaauaaaagccagga

SEQ ID NO: 1925933 - RNA, 18 nt, Shigella flexneri 2a str. 2457T
ccuggcgguuaauaauga

SEQ ID NO: 1925934 - RNA, 16 nt, Shigella flexneri 2a str. 2457T
ccuggcgggaauaaaa

SEQ ID NO: 1925935 - RNA, 21 nt, Shigella flexneri 2a str. 2457T
ccuggcgagcauuaauacacc

SEQ ID NO: 1925936 - RNA, 18 nt, Shigella flexneri 2a str. 2457T
ccuggcgcagcugcgcuu

SEQ ID NO: 1925937 - RNA, 20 nt, Shigella flexneri 2a str. 2457T
ccuggcgaugcccccagcag

SEQ ID NO: 1925938 - RNA, 19 nt, Shigella flexneri 2a str. 2457T
ccuggcaauagcgcacgcc

SEQ ID NO: 1925939 - RNA, 22 nt, Shigella flexneri 2a str. 2457T
ccuggcaacccgggcucccggc

SEQ ID NO: 1925940 - RNA, 21 nt, Shigella flexneri 2a str. 2457T
ccuggagaguguuuuaucugu

SEQ ID NO: 1925941 - RNA, 14 nt, Shigella flexneri 2a str. 2457T
ccuggacuuuaaac

SEQ ID NO: 1925942 - RNA, 18 nt, Shigella flexneri 2a str. 2457T
ccugcuuuugccagcgug

SEQ ID NO: 1925943 - RNA, 13 nt, Shigella flexneri 2a str. 2457T
ccuggacagcucg

SEQ ID NO: 1925944 - RNA, 21 nt, Shigella flexneri 2a str. 2457T
ccugcuuaucgcccugcucca

SEQ ID NO: 1925945 - RNA, 22 nt, Shigella flexneri 2a str. 2457T
ccugcuuccuuaaucccuggau

SEQ ID NO: 1925946 - RNA, 21 nt, Shigella flexneri 2a str. 2457T
ccugcuuaauaucccuuccuc

SEQ ID NO: 1925947 - RNA, 22 nt, Shigella flexneri 2a str. 2457T
ccugcuuauagcgcaucgcagc

SEQ ID NO: 1925948 - RNA, 23 nt, Shigella flexneri 2a str. 2457T
ccugcuggaaaggccgcgaaccg

SEQ ID NO: 1925949 - RNA, 17 nt, Shigella flexneri 2a str. 2457T
ccugcugguuagcggcc

SEQ ID NO: 1925950 - RNA, 22 nt, Shigella flexneri 2a str. 2457T
ccugcugcgccuguaacuguuc

SEQ ID NO: 1925951 - RNA, 19 nt, Shigella flexneri 2a str. 2457T
ccugcucccgaaccuuuuc

SEQ ID NO: 1925952 - RNA, 23 nt, Shigella flexneri 2a str. 2457T
ccugcuccagcaacucaaucgcc

SEQ ID NO: 1925953 - RNA, 18 nt, Shigella flexneri 2a str. 2457T
ccugcgggcauuucgcuu

SEQ ID NO: 1925954 - RNA, 18 nt, Shigella flexneri 2a str. 2457T
ccugcgguaagucccggc

SEQ ID NO: 1925955 - RNA, 16 nt, Shigella flexneri 2a str. 2457T
ccugcggguucuuacc

SEQ ID NO: 1925956 - RNA, 13 nt, Shigella flexneri 2a str. 2457T
ccugcucaucagc

SEQ ID NO: 1925957 - RNA, 23 nt, Shigella flexneri 2a str. 2457T
ccugcucaagcguuucaucuuca

SEQ ID NO: 1925958 - RNA, 12 nt, Shigella flexneri 2a str. 2457T
ccugccugcagc

SEQ ID NO: 1925959 - RNA, 23 nt, Shigella flexneri 2a str. 2457T
ccugccgucugggcaaaaucauc

SEQ ID NO: 1925960 - RNA, 22 nt, Shigella flexneri 2a str. 2457T
ccugcggcaccuaauaacucuc

SEQ ID NO: 1925961 - RNA, 22 nt, Shigella flexneri 2a str. 2457T
ccugcgacagggaucucuucca

SEQ ID NO: 1925962 - RNA, 18 nt, Shigella flexneri 2a str. 2457T
ccugcauacgacgugccg

SEQ ID NO: 1925963 - RNA, 13 nt, Shigella flexneri 2a str. 2457T
ccugcagugaaau

SEQ ID NO: 1925964 - RNA, 17 nt, Shigella flexneri 2a str. 2457T
ccugcagugaaauuaaa

SEQ ID NO: 1925965 - RNA, 18 nt, Shigella flexneri 2a str. 2457T
ccugccagaugcagcggu

SEQ ID NO: 1925966 - RNA, 19 nt, Shigella flexneri 2a str. 2457T
ccugccagaggagccauca

SEQ ID NO: 1925967 - RNA, 13 nt, Shigella flexneri 2a str. 2457T
ccugccaguccug

SEQ ID NO: 1925968 - RNA, 21 nt, Shigella flexneri 2a str. 2457T
ccugccaguuauagcgcagac

SEQ ID NO: 1925969 - RNA, 13 nt, Shigella flexneri 2a str. 2457T
ccugcccacucca

SEQ ID NO: 1925970 - RNA, 17 nt, Shigella flexneri 2a str. 2457T
ccugcacuuaacaggau

SEQ ID NO: 1925971 - RNA, 19 nt, Shigella flexneri 2a str. 2457T
ccugcaccggugcauccac

SEQ ID NO: 1925972 - RNA, 16 nt, Shigella flexneri 2a str. 2457T
ccugcacugcaggccg

SEQ ID NO: 1925973 - RNA, 15 nt, Shigella flexneri 2a str. 2457T
ccugcagggcuuuca

SEQ ID NO: 1925974 - RNA, 16 nt, Shigella flexneri 2a str. 2457T
ccugcagggcuuucac

SEQ ID NO: 1925975 - RNA, 10 nt, Shigella flexneri 2a str. 2457T
ccugcacaug

SEQ ID NO: 1925976 - RNA, 19 nt, Shigella flexneri 2a str. 2457T
ccucggcuguaugaccuuu

SEQ ID NO: 1925977 - RNA, 22 nt, Shigella flexneri 2a str. 2457T
cauucugcgcugacucuacuga

SEQ ID NO: 1925978 - RNA, 15 nt, Shigella flexneri 2a str. 2457T
cauucugcgcugacu

SEQ ID NO: 1925979 - RNA, 12 nt, Shigella flexneri 2a str. 2457T
cauucugacugg

SEQ ID NO: 1925980 - RNA, 15 nt, Shigella flexneri 2a str. 2457T
cauucugacuggguc

SEQ ID NO: 1925981 - RNA, 21 nt, Shigella flexneri 2a str. 2457T
cauucccuggcggaagagcac

SEQ ID NO: 1925982 - RNA, 12 nt, Shigella flexneri 2a str. 2457T
cauucuccgagg

SEQ ID NO: 1925983 - RNA, 13 nt, Shigella flexneri 2a str. 2457T
cauucucacucca

SEQ ID NO: 1925984 - RNA, 18 nt, Shigella flexneri 2a str. 2457T
cauucucgcgacccauga

SEQ ID NO: 1925985 - RNA, 16 nt, Shigella flexneri 2a str. 2457T
cauucucacuccagcc

SEQ ID NO: 1925986 - RNA, 18 nt, Shigella flexneri 2a str. 2457T
cauucccccuuugaccag

SEQ ID NO: 1925987 - RNA, 21 nt, Shigella flexneri 2a str. 2457T
cauuccaguccacaucaacca

SEQ ID NO: 1925988 - RNA, 13 nt, Shigella flexneri 2a str. 2457T
cauuccaguccac

SEQ ID NO: 1925989 - RNA, 22 nt, Shigella flexneri 2a str. 2457T
cauucccggucaguagaauaau

SEQ ID NO: 1925990 - RNA, 23 nt, Shigella flexneri 2a str. 2457T
cauucccugcagucaccugcccu

SEQ ID NO: 1925991 - RNA, 23 nt, Shigella flexneri 2a str. 2457T
cauucuugccaucaaucacuuug

SEQ ID NO: 1925992 - RNA, 16 nt, Shigella flexneri 2a str. 2457T
cauucuuccuccagcg

SEQ ID NO: 1925993 - RNA, 17 nt, Shigella flexneri 2a str. 2457T
cauucuuccuccagcgg

SEQ ID NO: 1925994 - RNA, 15 nt, Shigella flexneri 2a str. 2457T
cauugaccagcugcc

SEQ ID NO: 1925995 - RNA, 20 nt, Shigella flexneri 2a str. 2457T
cauugaacuuguagcuuuca

SEQ ID NO: 1925996 - RNA, 11 nt, Shigella flexneri 2a str. 2457T
cauugaaugcg

SEQ ID NO: 1925997 - RNA, 14 nt, Shigella flexneri 2a str. 2457T
cauugacguuccuu

SEQ ID NO: 1925998 - RNA, 23 nt, Shigella flexneri 2a str. 2457T
cauucagacacgccgccagacca

SEQ ID NO: 1925999 - RNA, 19 nt, Shigella flexneri 2a str. 2457T
cauucaugcgaauacaccc

SEQ ID NO: 1926000 - RNA, 21 nt, Shigella flexneri 2a str. 2457T
cauucaugcgaauacacccug

SEQ ID NO: 1926001 - RNA, 23 nt, Shigella flexneri 2a str. 2457T
cauucaugcgaauacacccugaa

SEQ ID NO: 1926002 - RNA, 22 nt, Shigella flexneri 2a str. 2457T
cauuccagauacgaccguucca

SEQ ID NO: 1926003 - RNA, 12 nt, Shigella flexneri 2a str. 2457T
cauucauuuuuu

SEQ ID NO: 1926004 - RNA, 18 nt, Shigella flexneri 2a str. 2457T
cauuccaccgaaacuuuu

SEQ ID NO: 1926005 - RNA, 22 nt, Shigella flexneri 2a str. 2457T
cauuccacuguucguaccugaa

SEQ ID NO: 1926006 - RNA, 14 nt, Shigella flexneri 2a str. 2457T
cauucaccaagcaa

SEQ ID NO: 1926007 - RNA, 14 nt, Shigella flexneri 2a str. 2457T
cauucaccaguuga

SEQ ID NO: 1926008 - RNA, 19 nt, Shigella flexneri 2a str. 2457T
cauucaccagcccacaugc

SEQ ID NO: 1926009 - RNA, 21 nt, Shigella flexneri 2a str. 2457T
cauucacgcugucggcacuga

SEQ ID NO: 1926010 - RNA, 20 nt, Shigella flexneri 2a str. 2457T
cauucacaaacagcgccugu

SEQ ID NO: 1926011 - RNA, 22 nt, Shigella flexneri 2a str. 2457T
cauuauucauuguucucccaua

SEQ ID NO: 1926012 - RNA, 15 nt, Shigella flexneri 2a str. 2457T
cauuauucaggcacu

SEQ ID NO: 1926013 - RNA, 14 nt, Shigella flexneri 2a str. 2457T
cauuauucaucugg

SEQ ID NO: 1926014 - RNA, 21 nt, Shigella flexneri 2a str. 2457T
cauuaucucuugccaggcuua

SEQ ID NO: 1926015 - RNA, 21 nt, Shigella flexneri 2a str. 2457T
cauuauuagcuuucuuuuucu

SEQ ID NO: 1926016 - RNA, 13 nt, Shigella flexneri 2a str. 2457T
cauuaucaccaaa

SEQ ID NO: 1926017 - RNA, 19 nt, Shigella flexneri 2a str. 2457T
cauuaugagauugagcgau

SEQ ID NO: 1926018 - RNA, 21 nt, Shigella flexneri 2a str. 2457T
cauuaaucgauaaaccagcaa

SEQ ID NO: 1926019 - RNA, 14 nt, Shigella flexneri 2a str. 2457T
cauuacaaccgcug

SEQ ID NO: 1926020 - RNA, 23 nt, Shigella flexneri 2a str. 2457T
cauuaucacaucagcgcauuuac

SEQ ID NO: 1926021 - RNA, 18 nt, Shigella flexneri 2a str. 2457T
cauuaagaacuccagccc

SEQ ID NO: 1926022 - RNA, 19 nt, Shigella flexneri 2a str. 2457T
cauuaaccguuuacgucau

SEQ ID NO: 1926023 - RNA, 18 nt, Shigella flexneri 2a str. 2457T
cauuaacaggugucacau

SEQ ID NO: 1926024 - RNA, 16 nt, Shigella flexneri 2a str. 2457T
cauuaacaggccaaau

SEQ ID NO: 1926025 - RNA, 20 nt, Shigella flexneri 2a str. 2457T
cauuaaaacugauacgucau

SEQ ID NO: 1926026 - RNA, 16 nt, Shigella flexneri 2a str. 2457T
cauuaaaauucuuacg

SEQ ID NO: 1926027 - RNA, 14 nt, Shigella flexneri 2a str. 2457T
cauuaaaccagugc

SEQ ID NO: 1926028 - RNA, 19 nt, Shigella flexneri 2a str. 2457T
cauguuuguauuaauuaac

SEQ ID NO: 1926029 - RNA, 20 nt, Shigella flexneri 2a str. 2457T
cauguucuaugaagaacugg

SEQ ID NO: 1926030 - RNA, 18 nt, Shigella flexneri 2a str. 2457T
cauguuccugccagucuu

SEQ ID NO: 1926031 - RNA, 18 nt, Shigella flexneri 2a str. 2457T
caugguuugcauccacaa

SEQ ID NO: 1926032 - RNA, 20 nt, Shigella flexneri 2a str. 2457T
cauguagccgcuuuuucugc

SEQ ID NO: 1926033 - RNA, 18 nt, Shigella flexneri 2a str. 2457T
cauguagccgcuuuuucu

SEQ ID NO: 1926034 - RNA, 14 nt, Shigella flexneri 2a str. 2457T
caugggguuuuucg

SEQ ID NO: 1926035 - RNA, 14 nt, Shigella flexneri 2a str. 2457T
caugguguucagau

SEQ ID NO: 1926036 - RNA, 17 nt, Shigella flexneri 2a str. 2457T
cauggugucugaugagg

SEQ ID NO: 1926037 - RNA, 15 nt, Shigella flexneri 2a str. 2457T
cauggugucugauga

SEQ ID NO: 1926038 - RNA, 14 nt, Shigella flexneri 2a str. 2457T
caugcguuuguagg

SEQ ID NO: 1926039 - RNA, 16 nt, Shigella flexneri 2a str. 2457T
cauggcgaauggcacg

SEQ ID NO: 1926040 - RNA, 14 nt, Shigella flexneri 2a str. 2457T
caugcucacagagu

SEQ ID NO: 1926041 - RNA, 18 nt, Shigella flexneri 2a str. 2457T
caugaugauaucacuggu

SEQ ID NO: 1926042 - RNA, 18 nt, Shigella flexneri 2a str. 2457T
caugauguaagaugaaau

SEQ ID NO: 1926043 - RNA, 20 nt, Shigella flexneri 2a str. 2457T
caugauguggugcaaggaaa

SEQ ID NO: 1926044 - RNA, 16 nt, Shigella flexneri 2a str. 2457T
caugauucugagaaac

SEQ ID NO: 1926045 - RNA, 22 nt, Shigella flexneri 2a str. 2457T
caugauucggcgguaguuaagc

SEQ ID NO: 1926046 - RNA, 18 nt, Shigella flexneri 2a str. 2457T
caugaucauucaccagcc

SEQ ID NO: 1926047 - RNA, 13 nt, Shigella flexneri 2a str. 2457T
caugauaugccug

SEQ ID NO: 1926048 - RNA, 14 nt, Shigella flexneri 2a str. 2457T
caugaucuuuuuug

SEQ ID NO: 1926049 - RNA, 12 nt, Shigella flexneri 2a str. 2457T
caugcacccuca

SEQ ID NO: 1926050 - RNA, 13 nt, Shigella flexneri 2a str. 2457T
caugcacccucaa

SEQ ID NO: 1926051 - RNA, 20 nt, Shigella flexneri 2a str. 2457T
caugcacccucaacaacagc

SEQ ID NO: 1926052 - RNA, 10 nt, Shigella flexneri 2a str. 2457T
caugcaauaa

SEQ ID NO: 1926053 - RNA, 15 nt, Shigella flexneri 2a str. 2457T
caugcaauacaaccc

SEQ ID NO: 1926054 - RNA, 15 nt, Shigella flexneri 2a str. 2457T
caugcaacgucauca

SEQ ID NO: 1926055 - RNA, 14 nt, Shigella flexneri 2a str. 2457T
caugauuucauaac

SEQ ID NO: 1926056 - RNA, 14 nt, Shigella flexneri 2a str. 2457T
caugcagcuccacc

SEQ ID NO: 1926057 - RNA, 16 nt, Shigella flexneri 2a str. 2457T
caugcaguaccagaua

SEQ ID NO: 1926058 - RNA, 15 nt, Shigella flexneri 2a str. 2457T
caugcauaaugcagc

SEQ ID NO: 1926059 - RNA, 14 nt, Shigella flexneri 2a str. 2457T
caugccaaaaggga

SEQ ID NO: 1926060 - RNA, 16 nt, Shigella flexneri 2a str. 2457T
caugcccgugcugaca

SEQ ID NO: 1926061 - RNA, 23 nt, Shigella flexneri 2a str. 2457T
caugcccgcgcaaaccaccuggc

SEQ ID NO: 1926062 - RNA, 15 nt, Shigella flexneri 2a str. 2457T
caugccauccgcauc

SEQ ID NO: 1926063 - RNA, 17 nt, Shigella flexneri 2a str. 2457T
caugccauauuguuuca

SEQ ID NO: 1926064 - RNA, 14 nt, Shigella flexneri 2a str. 2457T
caugccauauuguu

SEQ ID NO: 1926065 - RNA, 22 nt, Shigella flexneri 2a str. 2457T
caugccaacgcggaugaggcgu

SEQ ID NO: 1926066 - RNA, 20 nt, Shigella flexneri 2a str. 2457T
caugccaacaaaaucuucua

SEQ ID NO: 1926067 - RNA, 21 nt, Shigella flexneri 2a str. 2457T
caugcgauggagugagaaugc

SEQ ID NO: 1926068 - RNA, 23 nt, Shigella flexneri 2a str. 2457T
caugcgaucccacgccgaaugcc

SEQ ID NO: 1926069 - RNA, 23 nt, Shigella flexneri 2a str. 2457T
caugcgaauacacccugaacuga

SEQ ID NO: 1926070 - RNA, 17 nt, Shigella flexneri 2a str. 2457T
caugccugcauaaagga

SEQ ID NO: 1926071 - RNA, 17 nt, Shigella flexneri 2a str. 2457T
caugccggugaugccgc

SEQ ID NO: 1926072 - RNA, 17 nt, Shigella flexneri 2a str. 2457T
caugccggccagcgcca

SEQ ID NO: 1926073 - RNA, 20 nt, Shigella flexneri 2a str. 2457T
caugccggccagcgccacca

SEQ ID NO: 1926074 - RNA, 19 nt, Shigella flexneri 2a str. 2457T
caugacgcacuuucgcuuu

SEQ ID NO: 1926075 - RNA, 17 nt, Shigella flexneri 2a str. 2457T
caugacgaggagcugca

SEQ ID NO: 1926076 - RNA, 15 nt, Shigella flexneri 2a str. 2457T
caugacuuugaucug

SEQ ID NO: 1926077 - RNA, 19 nt, Shigella flexneri 2a str. 2457T
caugacuuuguaggccgga

SEQ ID NO: 1926078 - RNA, 16 nt, Shigella flexneri 2a str. 2457T
caugacuacacuaaac

SEQ ID NO: 1926079 - RNA, 18 nt, Shigella flexneri 2a str. 2457T
caugauaccgauuacuca

SEQ ID NO: 1926080 - RNA, 20 nt, Shigella flexneri 2a str. 2457T
caugaguaacagucaguuau

SEQ ID NO: 1926081 - RNA, 17 nt, Shigella flexneri 2a str. 2457T
caugagcgaauaaaaaa

SEQ ID NO: 1926082 - RNA, 19 nt, Shigella flexneri 2a str. 2457T
caugagcgaauaaaaaaag

SEQ ID NO: 1926083 - RNA, 22 nt, Shigella flexneri 2a str. 2457T
caugagcgaauaaaaaaagaaa

SEQ ID NO: 1926084 - RNA, 23 nt, Shigella flexneri 2a str. 2457T
caugaccagugaggaugcggguc

SEQ ID NO: 1926085 - RNA, 16 nt, Shigella flexneri 2a str. 2457T
caugaccgcuccgcca

SEQ ID NO: 1926086 - RNA, 16 nt, Shigella flexneri 2a str. 2457T
caugaccgaucaaggc

SEQ ID NO: 1926087 - RNA, 18 nt, Shigella flexneri 2a str. 2457T
caugaauucgacuuucuc

SEQ ID NO: 1926088 - RNA, 13 nt, Shigella flexneri 2a str. 2457T
caugacagcgccc

SEQ ID NO: 1926089 - RNA, 14 nt, Shigella flexneri 2a str. 2457T
caugacacagaauc

SEQ ID NO: 1926090 - RNA, 15 nt, Shigella flexneri 2a str. 2457T
caugaauauauaauu

SEQ ID NO: 1926091 - RNA, 22 nt, Shigella flexneri 2a str. 2457T
caugaagcugacaggcgcugau

SEQ ID NO: 1926092 - RNA, 17 nt, Shigella flexneri 2a str. 2457T
caugaaaaaacuggcua

SEQ ID NO: 1926093 - RNA, 20 nt, Shigella flexneri 2a str. 2457T
caugaacaccuucucaggcc

SEQ ID NO: 1926094 - RNA, 14 nt, Shigella flexneri 2a str. 2457T
caugaaacagaaaa

SEQ ID NO: 1926095 - RNA, 12 nt, Shigella flexneri 2a str. 2457T
caugaaaugaaa

SEQ ID NO: 1926096 - RNA, 18 nt, Shigella flexneri 2a str. 2457T
caugaacaaagcgcaccu

SEQ ID NO: 1926097 - RNA, 14 nt, Shigella flexneri 2a str. 2457T
caugaaaugaaaau

SEQ ID NO: 1926098 - RNA, 13 nt, Shigella flexneri 2a str. 2457T
caugaaaugaaaa

SEQ ID NO: 1926099 - RNA, 19 nt, Shigella flexneri 2a str. 2457T
caucgugcucgcuuuccau

SEQ ID NO: 1926100 - RNA, 14 nt, Shigella flexneri 2a str. 2457T
caucgugcaccaau

SEQ ID NO: 1926101 - RNA, 12 nt, Shigella flexneri 2a str. 2457T
caucuucuccac

SEQ ID NO: 1926102 - RNA, 16 nt, Shigella flexneri 2a str. 2457T
caucuucuccacgcca

SEQ ID NO: 1926103 - RNA, 15 nt, Shigella flexneri 2a str. 2457T
caucuucuccagcga

SEQ ID NO: 1926104 - RNA, 19 nt, Shigella flexneri 2a str. 2457T
caucuucuugcagcuuaau

SEQ ID NO: 1926105 - RNA, 12 nt, Shigella flexneri 2a str. 2457T
caucuucuucac

SEQ ID NO: 1926106 - RNA, 14 nt, Shigella flexneri 2a str. 2457T
caucuugauaccaa

SEQ ID NO: 1926107 - RNA, 11 nt, Shigella flexneri 2a str. 2457T
caucuuuaacg

SEQ ID NO: 1926108 - RNA, 20 nt, Shigella flexneri 2a str. 2457T
cauccagaccgcucagcucc

SEQ ID NO: 1926109 - RNA, 12 nt, Shigella flexneri 2a str. 2457T
cauccagcacuu

SEQ ID NO: 1926110 - RNA, 11 nt, Shigella flexneri 2a str. 2457T
cauccagcagu

SEQ ID NO: 1926111 - RNA, 14 nt, Shigella flexneri 2a str. 2457T
cauccagcagcccu

SEQ ID NO: 1926112 - RNA, 22 nt, Shigella flexneri 2a str. 2457T
cauccagcagcggaucgaacuc

SEQ ID NO: 1926113 - RNA, 22 nt, Shigella flexneri 2a str. 2457T
cauccagcacuugcaggaacag

SEQ ID NO: 1926114 - RNA, 20 nt, Shigella flexneri 2a str. 2457T
cauccagcguuaccggcuuc

SEQ ID NO: 1926115 - RNA, 13 nt, Shigella flexneri 2a str. 2457T
cauccacauucga

SEQ ID NO: 1926116 - RNA, 18 nt, Shigella flexneri 2a str. 2457T
cauccacauucgaaugcc

SEQ ID NO: 1926117 - RNA, 20 nt, Shigella flexneri 2a str. 2457T
cauccacauucgaaugccgu

SEQ ID NO: 1926118 - RNA, 17 nt, Shigella flexneri 2a str. 2457T
cauccaccagcaugaaa

SEQ ID NO: 1926119 - RNA, 22 nt, Shigella flexneri 2a str. 2457T
caucagcaugacaaaaaagcca

SEQ ID NO: 1926120 - RNA, 13 nt, Shigella flexneri 2a str. 2457T
caucagcauucuc

SEQ ID NO: 1926121 - RNA, 18 nt, Shigella flexneri 2a str. 2457T
caucagcaugacaaaaaa

SEQ ID NO: 1926122 - RNA, 18 nt, Shigella flexneri 2a str. 2457T
caucagcauaaucaccag

SEQ ID NO: 1926123 - RNA, 14 nt, Shigella flexneri 2a str. 2457T
caucaugccaccca

SEQ ID NO: 1926124 - RNA, 17 nt, Shigella flexneri 2a str. 2457T
caucaugcacuccgcug

SEQ ID NO: 1926125 - RNA, 22 nt, Shigella flexneri 2a str. 2457T
caucauggcgaugagaaucagu

SEQ ID NO: 1926126 - RNA, 23 nt, Shigella flexneri 2a str. 2457T
caucaugcucagaugccugaugc

SEQ ID NO: 1926127 - RNA, 18 nt, Shigella flexneri 2a str. 2457T
cauccaaaucgcccagca

SEQ ID NO: 1926128 - RNA, 19 nt, Shigella flexneri 2a str. 2457T
cauccaaaucgcccagcaa

SEQ ID NO: 1926129 - RNA, 19 nt, Shigella flexneri 2a str. 2457T
cauccaguacgccuucacg

SEQ ID NO: 1926130 - RNA, 21 nt, Shigella flexneri 2a str. 2457T
cauccaguggcagaguaauug

SEQ ID NO: 1926131 - RNA, 20 nt, Shigella flexneri 2a str. 2457T
cauccaggugaaaaauaaaa

SEQ ID NO: 1926132 - RNA, 21 nt, Shigella flexneri 2a str. 2457T
cauccaggaacuccagaucca

SEQ ID NO: 1926133 - RNA, 22 nt, Shigella flexneri 2a str. 2457T
cauccagcuuuuuaaucgccau

SEQ ID NO: 1926134 - RNA, 23 nt, Shigella flexneri 2a str. 2457T
cauccagcuuuuuaaucgccauc

SEQ ID NO: 1926135 - RNA, 14 nt, Shigella flexneri 2a str. 2457T
cauccauuuuucac

SEQ ID NO: 1926136 - RNA, 21 nt, Shigella flexneri 2a str. 2457T
cauccccggcaaccacaccca

SEQ ID NO: 1926137 - RNA, 19 nt, Shigella flexneri 2a str. 2457T
cauccccggcaaccacacc

SEQ ID NO: 1926138 - RNA, 13 nt, Shigella flexneri 2a str. 2457T
cauccccucuucc

SEQ ID NO: 1926139 - RNA, 14 nt, Shigella flexneri 2a str. 2457T
cauccccucuucca

SEQ ID NO: 1926140 - RNA, 16 nt, Shigella flexneri 2a str. 2457T
caucccggcagagaaa

SEQ ID NO: 1926141 - RNA, 18 nt, Shigella flexneri 2a str. 2457T
caucccggcagagaaaau

SEQ ID NO: 1926142 - RNA, 22 nt, Shigella flexneri 2a str. 2457T
cauccccauaucccggaaggca

SEQ ID NO: 1926143 - RNA, 17 nt, Shigella flexneri 2a str. 2457T
cauccccgcccuuccag

SEQ ID NO: 1926144 - RNA, 17 nt, Shigella flexneri 2a str. 2457T
cauccccggcaaccaca

SEQ ID NO: 1926145 - RNA, 15 nt, Shigella flexneri 2a str. 2457T
caucccagacaccgc

SEQ ID NO: 1926146 - RNA, 15 nt, Shigella flexneri 2a str. 2457T
caucccagcagagau

SEQ ID NO: 1926147 - RNA, 18 nt, Shigella flexneri 2a str. 2457T
caucccagacaccgccca

SEQ ID NO: 1926148 - RNA, 22 nt, Shigella flexneri 2a str. 2457T
caucccaggccaaauccuucca

SEQ ID NO: 1926149 - RNA, 16 nt, Shigella flexneri 2a str. 2457T
cauccggcauauuaac

SEQ ID NO: 1926150 - RNA, 14 nt, Shigella flexneri 2a str. 2457T
cauccggcauucag

SEQ ID NO: 1926151 - RNA, 15 nt, Shigella flexneri 2a str. 2457T
cauccggcauaaaca

SEQ ID NO: 1926152 - RNA, 15 nt, Shigella flexneri 2a str. 2457T
cauccggcagcaaau

SEQ ID NO: 1926153 - RNA, 16 nt, Shigella flexneri 2a str. 2457T
cauccggcauuuugug

SEQ ID NO: 1926154 - RNA, 23 nt, Shigella flexneri 2a str. 2457T
cauccggcuuuuuuacaucauca

SEQ ID NO: 1926155 - RNA, 22 nt, Shigella flexneri 2a str. 2457T
cauccuuccccgcuugggcaga

SEQ ID NO: 1926156 - RNA, 16 nt, Shigella flexneri 2a str. 2457T
caucgaaaacgccacc

SEQ ID NO: 1926157 - RNA, 18 nt, Shigella flexneri 2a str. 2457T
caucgaaccaucggcuuu

SEQ ID NO: 1926158 - RNA, 15 nt, Shigella flexneri 2a str. 2457T
caucgcaucaaaguu

SEQ ID NO: 1926159 - RNA, 15 nt, Shigella flexneri 2a str. 2457T
caucgcaucuucgcc

SEQ ID NO: 1926160 - RNA, 22 nt, Shigella flexneri 2a str. 2457T
caucgcauguugauuaccuguc

SEQ ID NO: 1926161 - RNA, 22 nt, Shigella flexneri 2a str. 2457T
caucgcccaguugaucaccagu

SEQ ID NO: 1926162 - RNA, 14 nt, Shigella flexneri 2a str. 2457T
caucgccagaaauc

SEQ ID NO: 1926163 - RNA, 18 nt, Shigella flexneri 2a str. 2457T
caucgccagagaagaaca

SEQ ID NO: 1926164 - RNA, 17 nt, Shigella flexneri 2a str. 2457T
caucgccacggcaugaa

SEQ ID NO: 1926165 - RNA, 17 nt, Shigella flexneri 2a str. 2457T
caucggcaaucacauca

SEQ ID NO: 1926166 - RNA, 20 nt, Shigella flexneri 2a str. 2457T
caucggcagcgccaaucgcu

SEQ ID NO: 1926167 - RNA, 15 nt, Shigella flexneri 2a str. 2457T
caucgcugugcugcu

SEQ ID NO: 1926168 - RNA, 15 nt, Shigella flexneri 2a str. 2457T
caucgcuugaaaagg

SEQ ID NO: 1926169 - RNA, 21 nt, Shigella flexneri 2a str. 2457T
caucgcccugauggcgcgcca

SEQ ID NO: 1926170 - RNA, 16 nt, Shigella flexneri 2a str. 2457T
caucgcccugauggcg

SEQ ID NO: 1926171 - RNA, 13 nt, Shigella flexneri 2a str. 2457T
caucgcccgcaac

SEQ ID NO: 1926172 - RNA, 12 nt, Shigella flexneri 2a str. 2457T
caucgugcacca

SEQ ID NO: 1926173 - RNA, 15 nt, Shigella flexneri 2a str. 2457T
caucgguauaaccaa

SEQ ID NO: 1926174 - RNA, 16 nt, Shigella flexneri 2a str. 2457T
caucgguaucuuccca

SEQ ID NO: 1926175 - RNA, 19 nt, Shigella flexneri 2a str. 2457T
caucgguauaaccaaauga

SEQ ID NO: 1926176 - RNA, 19 nt, Shigella flexneri 2a str. 2457T
caucggugaggaucaccag

SEQ ID NO: 1926177 - RNA, 20 nt, Shigella flexneri 2a str. 2457T
caucggcuuauucauaucaa

SEQ ID NO: 1926178 - RNA, 15 nt, Shigella flexneri 2a str. 2457T
caucgggggaagcug

SEQ ID NO: 1926179 - RNA, 22 nt, Shigella flexneri 2a str. 2457T
caucgggaagaggaucugcucu

SEQ ID NO: 1926180 - RNA, 18 nt, Shigella flexneri 2a str. 2457T
caucacauagcgguaagc

SEQ ID NO: 1926181 - RNA, 23 nt, Shigella flexneri 2a str. 2457T
caucacaccgcgaucuuccacgc

SEQ ID NO: 1926182 - RNA, 20 nt, Shigella flexneri 2a str. 2457T
caucaccacgcugagagaag

SEQ ID NO: 1926183 - RNA, 17 nt, Shigella flexneri 2a str. 2457T
caucacccaacaauaac

SEQ ID NO: 1926184 - RNA, 12 nt, Shigella flexneri 2a str. 2457T
caucaauaccau

SEQ ID NO: 1926185 - RNA, 21 nt, Shigella flexneri 2a str. 2457T
caucaauaccugguccuucau

SEQ ID NO: 1926186 - RNA, 21 nt, Shigella flexneri 2a str. 2457T
caucaaguugauuuuucguuu

SEQ ID NO: 1926187 - RNA, 20 nt, Shigella flexneri 2a str. 2457T
caucaauugcucacucccgg

SEQ ID NO: 1926188 - RNA, 17 nt, Shigella flexneri 2a str. 2457T
caucaauugcucacucc

SEQ ID NO: 1926189 - RNA, 13 nt, Shigella flexneri 2a str. 2457T
caucaauuugccc

SEQ ID NO: 1926190 - RNA, 13 nt, Shigella flexneri 2a str. 2457T
caucacaauggca

SEQ ID NO: 1926191 - RNA, 17 nt, Shigella flexneri 2a str. 2457T
caucaccuuccacauau

SEQ ID NO: 1926192 - RNA, 13 nt, Shigella flexneri 2a str. 2457T
caucacgaaaucc

SEQ ID NO: 1926193 - RNA, 17 nt, Shigella flexneri 2a str. 2457T
caucacuccauccagca

SEQ ID NO: 1926194 - RNA, 23 nt, Shigella flexneri 2a str. 2457T
caucacuccauccagcaacaaca

SEQ ID NO: 1926195 - RNA, 21 nt, Shigella flexneri 2a str. 2457T
caucacgaaaucccacauccu

SEQ ID NO: 1926196 - RNA, 17 nt, Shigella flexneri 2a str. 2457T
caucacgacagcaccac

SEQ ID NO: 1926197 - RNA, 13 nt, Shigella flexneri 2a str. 2457T
caucaccggcuuc

SEQ ID NO: 1926198 - RNA, 20 nt, Shigella flexneri 2a str. 2457T
caucaccgaugcccucaaua

SEQ ID NO: 1926199 - RNA, 23 nt, Shigella flexneri 2a str. 2457T
caucaccgaugcccucaauaucu

SEQ ID NO: 1926200 - RNA, 12 nt, Shigella flexneri 2a str. 2457T
caucagcagcaa

SEQ ID NO: 1926201 - RNA, 16 nt, Shigella flexneri 2a str. 2457T
caucagcagaaucgca

SEQ ID NO: 1926202 - RNA, 16 nt, Shigella flexneri 2a str. 2457T
caucacugcaaauacc

SEQ ID NO: 1926203 - RNA, 18 nt, Shigella flexneri 2a str. 2457T
caucacuuucaaaagccc

SEQ ID NO: 1926204 - RNA, 21 nt, Shigella flexneri 2a str. 2457T
caucacuuucggugacagaaa

SEQ ID NO: 1926205 - RNA, 18 nt, Shigella flexneri 2a str. 2457T
cauauucugaucgugcuc

SEQ ID NO: 1926206 - RNA, 15 nt, Shigella flexneri 2a str. 2457T
cauauucgccaccgc

SEQ ID NO: 1926207 - RNA, 15 nt, Shigella flexneri 2a str. 2457T
cauauuccugaccca

SEQ ID NO: 1926208 - RNA, 22 nt, Shigella flexneri 2a str. 2457T
cauauucgccgcccugcagcau

SEQ ID NO: 1926209 - RNA, 13 nt, Shigella flexneri 2a str. 2457T
cauauuccccugg

SEQ ID NO: 1926210 - RNA, 17 nt, Shigella flexneri 2a str. 2457T
cauauucccgcaacuua

SEQ ID NO: 1926211 - RNA, 19 nt, Shigella flexneri 2a str. 2457T
cauaucgaaccagcggaca

SEQ ID NO: 1926212 - RNA, 17 nt, Shigella flexneri 2a str. 2457T
cauaucaaaaagcugua

SEQ ID NO: 1926213 - RNA, 17 nt, Shigella flexneri 2a str. 2457T
caucaagucauugauuc

SEQ ID NO: 1926214 - RNA, 22 nt, Shigella flexneri 2a str. 2457T
caucaaguagcagguaaucugc

SEQ ID NO: 1926215 - RNA, 22 nt, Shigella flexneri 2a str. 2457T
caucaaguagcgcuuguaggaa

SEQ ID NO: 1926216 - RNA, 18 nt, Shigella flexneri 2a str. 2457T
caucaagcugugccugaa

SEQ ID NO: 1926217 - RNA, 18 nt, Shigella flexneri 2a str. 2457T
caucaagcuguucuuccc

SEQ ID NO: 1926218 - RNA, 19 nt, Shigella flexneri 2a str. 2457T
caucaaauuugucgccaac

SEQ ID NO: 1926219 - RNA, 13 nt, Shigella flexneri 2a str. 2457T
caucaaagucucc

SEQ ID NO: 1926220 - RNA, 14 nt, Shigella flexneri 2a str. 2457T
caucaaauccccac

SEQ ID NO: 1926221 - RNA, 14 nt, Shigella flexneri 2a str. 2457T
cauauuucuccauu

SEQ ID NO: 1926222 - RNA, 16 nt, Shigella flexneri 2a str. 2457T
cauauuugugagcuac

SEQ ID NO: 1926223 - RNA, 22 nt, Shigella flexneri 2a str. 2457T
cauauuuucauuauugcgcaca

SEQ ID NO: 1926224 - RNA, 22 nt, Shigella flexneri 2a str. 2457T
cauauuuuucauauuuuacauc

SEQ ID NO: 1926225 - RNA, 20 nt, Shigella flexneri 2a str. 2457T
cauagcuaauccccuccagc

SEQ ID NO: 1926226 - RNA, 13 nt, Shigella flexneri 2a str. 2457T
cauagcucgcuuc

SEQ ID NO: 1926227 - RNA, 20 nt, Shigella flexneri 2a str. 2457T
cauagcgacaggcuuucuuc

SEQ ID NO: 1926228 - RNA, 14 nt, Shigella flexneri 2a str. 2457T
cauauaaauuucau

SEQ ID NO: 1926229 - RNA, 19 nt, Shigella flexneri 2a str. 2457T
cauauaaccggcaacagaa

SEQ ID NO: 1926230 - RNA, 20 nt, Shigella flexneri 2a str. 2457T
cauauaaccggcaacagaac

SEQ ID NO: 1926231 - RNA, 13 nt, Shigella flexneri 2a str. 2457T
cauaguaagcaga

SEQ ID NO: 1926232 - RNA, 17 nt, Shigella flexneri 2a str. 2457T
cauagguucuuuuaaau

SEQ ID NO: 1926233 - RNA, 21 nt, Shigella flexneri 2a str. 2457T
cauagaaacucauaugcagca

SEQ ID NO: 1926234 - RNA, 22 nt, Shigella flexneri 2a str. 2457T
cauagcaaccgcgacugggagg

SEQ ID NO: 1926235 - RNA, 12 nt, Shigella flexneri 2a str. 2457T
cauagcacacuu

SEQ ID NO: 1926236 - RNA, 19 nt, Shigella flexneri 2a str. 2457T
cauagcacacuuucgccac

SEQ ID NO: 1926237 - RNA, 15 nt, Shigella flexneri 2a str. 2457T
cauagauaccuucuu

SEQ ID NO: 1926238 - RNA, 17 nt, Shigella flexneri 2a str. 2457T
cauagauaccuucuuga

SEQ ID NO: 1926239 - RNA, 12 nt, Shigella flexneri 2a str. 2457T
cauacugacgga

SEQ ID NO: 1926240 - RNA, 18 nt, Shigella flexneri 2a str. 2457T
cauacugacaaacugcgc

SEQ ID NO: 1926241 - RNA, 15 nt, Shigella flexneri 2a str. 2457T
cauacucuccuccag

SEQ ID NO: 1926242 - RNA, 17 nt, Shigella flexneri 2a str. 2457T
cauacuuaaauaaugcu

SEQ ID NO: 1926243 - RNA, 14 nt, Shigella flexneri 2a str. 2457T
cauacuuauuauga

SEQ ID NO: 1926244 - RNA, 18 nt, Shigella flexneri 2a str. 2457T
cauacuuauuaugaauga

SEQ ID NO: 1926245 - RNA, 22 nt, Shigella flexneri 2a str. 2457T
cauagaaaaagaauugcagaua

SEQ ID NO: 1926246 - RNA, 17 nt, Shigella flexneri 2a str. 2457T
ccagcaucgaccaggau

SEQ ID NO: 1926247 - RNA, 12 nt, Shigella flexneri 2a str. 2457T
ccagcaucuccu

SEQ ID NO: 1926248 - RNA, 22 nt, Shigella flexneri 2a str. 2457T
ccagcaugacuaccggggacag

SEQ ID NO: 1926249 - RNA, 22 nt, Shigella flexneri 2a str. 2457T
ccagcaugaugcucucccaaau

SEQ ID NO: 1926250 - RNA, 16 nt, Shigella flexneri 2a str. 2457T
ccagcauggcaauaac

SEQ ID NO: 1926251 - RNA, 15 nt, Shigella flexneri 2a str. 2457T
ccagcauucccgcca

SEQ ID NO: 1926252 - RNA, 11 nt, Shigella flexneri 2a str. 2457T
ccagcauuucu

SEQ ID NO: 1926253 - RNA, 22 nt, Shigella flexneri 2a str. 2457T
ccagcauuucuggugucacagu

SEQ ID NO: 1926254 - RNA, 14 nt, Shigella flexneri 2a str. 2457T
ccagcauuucuucc

SEQ ID NO: 1926255 - RNA, 18 nt, Shigella flexneri 2a str. 2457T
ccagcagggcaaacagca

SEQ ID NO: 1926256 - RNA, 16 nt, Shigella flexneri 2a str. 2457T
ccagcagguuuaacca

SEQ ID NO: 1926257 - RNA, 16 nt, Shigella flexneri 2a str. 2457T
ccagcaguaaaccacc

SEQ ID NO: 1926258 - RNA, 23 nt, Shigella flexneri 2a str. 2457T
ccagcaguaaaccacccaccagc

SEQ ID NO: 1926259 - RNA, 18 nt, Shigella flexneri 2a str. 2457T
ccagcaguaaaccaccca

SEQ ID NO: 1926260 - RNA, 12 nt, Shigella flexneri 2a str. 2457T
ccagcaguuucu

SEQ ID NO: 1926261 - RNA, 12 nt, Shigella flexneri 2a str. 2457T
ccagcagugccg

SEQ ID NO: 1926262 - RNA, 14 nt, Shigella flexneri 2a str. 2457T
ccagcaguucgccc

SEQ ID NO: 1926263 - RNA, 21 nt, Shigella flexneri 2a str. 2457T
ccagcccgacgauaccgccgc

SEQ ID NO: 1926264 - RNA, 17 nt, Shigella flexneri 2a str. 2457T
ccagcccgaucggcugg

SEQ ID NO: 1926265 - RNA, 13 nt, Shigella flexneri 2a str. 2457T
ccagcccacaugc

SEQ ID NO: 1926266 - RNA, 19 nt, Shigella flexneri 2a str. 2457T
ccagcccuuuugacgcgug

SEQ ID NO: 1926267 - RNA, 14 nt, Shigella flexneri 2a str. 2457T
ccagccgaacagcg

SEQ ID NO: 1926268 - RNA, 17 nt, Shigella flexneri 2a str. 2457T
ccagccgaacagcgcca

SEQ ID NO: 1926269 - RNA, 13 nt, Shigella flexneri 2a str. 2457T
ccagcccuuuuga

SEQ ID NO: 1926270 - RNA, 14 nt, Shigella flexneri 2a str. 2457T
ccagccagguguug

SEQ ID NO: 1926271 - RNA, 13 nt, Shigella flexneri 2a str. 2457T
ccagccaguucaa

SEQ ID NO: 1926272 - RNA, 13 nt, Shigella flexneri 2a str. 2457T
ccagccaggaauc

SEQ ID NO: 1926273 - RNA, 14 nt, Shigella flexneri 2a str. 2457T
ccagccacugcgcc

SEQ ID NO: 1926274 - RNA, 22 nt, Shigella flexneri 2a str. 2457T
ccagccagacgccagccacagg

SEQ ID NO: 1926275 - RNA, 12 nt, Shigella flexneri 2a str. 2457T
ccagccagcaga

SEQ ID NO: 1926276 - RNA, 14 nt, Shigella flexneri 2a str. 2457T
ccagccaacgcccu

SEQ ID NO: 1926277 - RNA, 19 nt, Shigella flexneri 2a str. 2457T
ccagcaauccccagacaaa

SEQ ID NO: 1926278 - RNA, 23 nt, Shigella flexneri 2a str. 2457T
ccagcaauuuacgcuuuucuucc

SEQ ID NO: 1926279 - RNA, 15 nt, Shigella flexneri 2a str. 2457T
ccagcacaaaguggc

SEQ ID NO: 1926280 - RNA, 22 nt, Shigella flexneri 2a str. 2457T
ccagcacacugguucccaacaa

SEQ ID NO: 1926281 - RNA, 14 nt, Shigella flexneri 2a str. 2457T
ccagcaauccccag

SEQ ID NO: 1926282 - RNA, 21 nt, Shigella flexneri 2a str. 2457T
ccagcaaggguucaccgguga

SEQ ID NO: 1926283 - RNA, 19 nt, Shigella flexneri 2a str. 2457T
ccagcaaggcgcuaaaagc

SEQ ID NO: 1926284 - RNA, 12 nt, Shigella flexneri 2a str. 2457T
ccagcaccagca

SEQ ID NO: 1926285 - RNA, 13 nt, Shigella flexneri 2a str. 2457T
ccagcaccaguac

SEQ ID NO: 1926286 - RNA, 12 nt, Shigella flexneri 2a str. 2457T
ccagcaccagcu

SEQ ID NO: 1926287 - RNA, 16 nt, Shigella flexneri 2a str. 2457T
ccagcaccaggcuugc

SEQ ID NO: 1926288 - RNA, 20 nt, Shigella flexneri 2a str. 2457T
ccagcacaucaucaaagcca

SEQ ID NO: 1926289 - RNA, 20 nt, Shigella flexneri 2a str. 2457T
ccagauuuauuuacuucugc

SEQ ID NO: 1926290 - RNA, 14 nt, Shigella flexneri 2a str. 2457T
ccagcaaaaucacc

SEQ ID NO: 1926291 - RNA, 22 nt, Shigella flexneri 2a str. 2457T
ccagauuuuuauccaguuguuc

SEQ ID NO: 1926292 - RNA, 18 nt, Shigella flexneri 2a str. 2457T
ccagauuuauaaaagaaa

SEQ ID NO: 1926293 - RNA, 23 nt, Shigella flexneri 2a str. 2457T
ccagauugugugauacuucuucg

SEQ ID NO: 1926294 - RNA, 15 nt, Shigella flexneri 2a str. 2457T
ccagcaaaaucacca

SEQ ID NO: 1926295 - RNA, 13 nt, Shigella flexneri 2a str. 2457T
ccagcaacaaaua

SEQ ID NO: 1926296 - RNA, 17 nt, Shigella flexneri 2a str. 2457T
ccagcaacacaaacgaa

SEQ ID NO: 1926297 - RNA, 23 nt, Shigella flexneri 2a str. 2457T
ccagcaacaagccaguccagaaa

SEQ ID NO: 1926298 - RNA, 17 nt, Shigella flexneri 2a str. 2457T
ccagcaacaacagcgcg

SEQ ID NO: 1926299 - RNA, 16 nt, Shigella flexneri 2a str. 2457T
ccagcaacaaauaacc

SEQ ID NO: 1926300 - RNA, 20 nt, Shigella flexneri 2a str. 2457T
ccagcaacaaauaaccgccu

SEQ ID NO: 1926301 - RNA, 17 nt, Shigella flexneri 2a str. 2457T
ccagcaaccaacgccag

SEQ ID NO: 1926302 - RNA, 14 nt, Shigella flexneri 2a str. 2457T
ccagcaacaacagc

SEQ ID NO: 1926303 - RNA, 18 nt, Shigella flexneri 2a str. 2457T
ccagcaacugauggccca

SEQ ID NO: 1926304 - RNA, 15 nt, Shigella flexneri 2a str. 2457T
ccagcaacugauaaa

SEQ ID NO: 1926305 - RNA, 13 nt, Shigella flexneri 2a str. 2457T
ccagcaagaacca

SEQ ID NO: 1926306 - RNA, 16 nt, Shigella flexneri 2a str. 2457T
ccagcaagagcaaaua

SEQ ID NO: 1926307 - RNA, 20 nt, Shigella flexneri 2a str. 2457T
ccagcaagagcaaauaaaac

SEQ ID NO: 1926308 - RNA, 23 nt, Shigella flexneri 2a str. 2457T
ccagcaagagcaaauaaaacauc

SEQ ID NO: 1926309 - RNA, 20 nt, Shigella flexneri 2a str. 2457T
ccagcacggauaccgcacgc

SEQ ID NO: 1926310 - RNA, 23 nt, Shigella flexneri 2a str. 2457T
ccagcacggugaagaagcggaaa

SEQ ID NO: 1926311 - RNA, 15 nt, Shigella flexneri 2a str. 2457T
ccagcacggugaaga

SEQ ID NO: 1926312 - RNA, 13 nt, Shigella flexneri 2a str. 2457T
ccagcacugccgc

SEQ ID NO: 1926313 - RNA, 14 nt, Shigella flexneri 2a str. 2457T
ccagcagaccagca

SEQ ID NO: 1926314 - RNA, 18 nt, Shigella flexneri 2a str. 2457T
ccagcagagaucuuucac

SEQ ID NO: 1926315 - RNA, 20 nt, Shigella flexneri 2a str. 2457T
ccagcagacguaaaaauagc

SEQ ID NO: 1926316 - RNA, 17 nt, Shigella flexneri 2a str. 2457T
ccagcagaccuucugcc

SEQ ID NO: 1926317 - RNA, 19 nt, Shigella flexneri 2a str. 2457T
ccagcaccgucaaacacag

SEQ ID NO: 1926318 - RNA, 16 nt, Shigella flexneri 2a str. 2457T
ccagcaccgcagagau

SEQ ID NO: 1926319 - RNA, 23 nt, Shigella flexneri 2a str. 2457T
ccagcaccgcagagaucgccccg

SEQ ID NO: 1926320 - RNA, 17 nt, Shigella flexneri 2a str. 2457T
ccagcagcggucggcuu

SEQ ID NO: 1926321 - RNA, 13 nt, Shigella flexneri 2a str. 2457T
ccagcagcugcuc

SEQ ID NO: 1926322 - RNA, 18 nt, Shigella flexneri 2a str. 2457T
ccagcagcugcucccagc

SEQ ID NO: 1926323 - RNA, 16 nt, Shigella flexneri 2a str. 2457T
ccagcagcgccgcgcc

SEQ ID NO: 1926324 - RNA, 13 nt, Shigella flexneri 2a str. 2457T
ccagcagcagcgg

SEQ ID NO: 1926325 - RNA, 12 nt, Shigella flexneri 2a str. 2457T
ccagcagauggc

SEQ ID NO: 1926326 - RNA, 14 nt, Shigella flexneri 2a str. 2457T
ccagagagaagcug

SEQ ID NO: 1926327 - RNA, 19 nt, Shigella flexneri 2a str. 2457T
ccagagagcggagcaauga

SEQ ID NO: 1926328 - RNA, 14 nt, Shigella flexneri 2a str. 2457T
ccagagcagcaaca

SEQ ID NO: 1926329 - RNA, 15 nt, Shigella flexneri 2a str. 2457T
ccagacucaacaggc

SEQ ID NO: 1926330 - RNA, 16 nt, Shigella flexneri 2a str. 2457T
ccagacucaacaggcc

SEQ ID NO: 1926331 - RNA, 19 nt, Shigella flexneri 2a str. 2457T
ccagaggagccaucaccau

SEQ ID NO: 1926332 - RNA, 16 nt, Shigella flexneri 2a str. 2457T
ccagagcaucuacugg

SEQ ID NO: 1926333 - RNA, 14 nt, Shigella flexneri 2a str. 2457T
ccagagccaccaac

SEQ ID NO: 1926334 - RNA, 14 nt, Shigella flexneri 2a str. 2457T
ccagagccugaagg

SEQ ID NO: 1926335 - RNA, 14 nt, Shigella flexneri 2a str. 2457T
ccagaccgcacacc

SEQ ID NO: 1926336 - RNA, 23 nt, Shigella flexneri 2a str. 2457T
ccagacaucaccaguaccgccac

SEQ ID NO: 1926337 - RNA, 16 nt, Shigella flexneri 2a str. 2457T
ccagacaucccagugc

SEQ ID NO: 1926338 - RNA, 19 nt, Shigella flexneri 2a str. 2457T
ccagacaucaccaguaccg

SEQ ID NO: 1926339 - RNA, 14 nt, Shigella flexneri 2a str. 2457T
ccagaccaauagaa

SEQ ID NO: 1926340 - RNA, 19 nt, Shigella flexneri 2a str. 2457T
ccagacagcacauuucaga

SEQ ID NO: 1926341 - RNA, 16 nt, Shigella flexneri 2a str. 2457T
ccagacaucaccagua

SEQ ID NO: 1926342 - RNA, 18 nt, Shigella flexneri 2a str. 2457T
ccagaccugaaaccgccu

SEQ ID NO: 1926343 - RNA, 20 nt, Shigella flexneri 2a str. 2457T
ccagaccugaauuugcucca

SEQ ID NO: 1926344 - RNA, 16 nt, Shigella flexneri 2a str. 2457T
ccagaccugagcaucg

SEQ ID NO: 1926345 - RNA, 14 nt, Shigella flexneri 2a str. 2457T
ccagacgaauaaaa

SEQ ID NO: 1926346 - RNA, 20 nt, Shigella flexneri 2a str. 2457T
ccagacgcgcagcuucacuu

SEQ ID NO: 1926347 - RNA, 19 nt, Shigella flexneri 2a str. 2457T
ccagacgguaaccccucuu

SEQ ID NO: 1926348 - RNA, 20 nt, Shigella flexneri 2a str. 2457T
ccagacgccagaugcggcgu

SEQ ID NO: 1926349 - RNA, 15 nt, Shigella flexneri 2a str. 2457T
ccagacgcagcaagg

SEQ ID NO: 1926350 - RNA, 16 nt, Shigella flexneri 2a str. 2457T
ccagacgcaacagaaa

SEQ ID NO: 1926351 - RNA, 22 nt, Shigella flexneri 2a str. 2457T
ccagacgcaacagaaacgccau

SEQ ID NO: 1926352 - RNA, 16 nt, Shigella flexneri 2a str. 2457T
ccagauaauggcuguu

SEQ ID NO: 1926353 - RNA, 23 nt, Shigella flexneri 2a str. 2457T
ccagauaauggcuguugaaugcc

SEQ ID NO: 1926354 - RNA, 17 nt, Shigella flexneri 2a str. 2457T
ccagauacaaaaaaggc

SEQ ID NO: 1926355 - RNA, 18 nt, Shigella flexneri 2a str. 2457T
ccagauacaaaaaaggcc

SEQ ID NO: 1926356 - RNA, 17 nt, Shigella flexneri 2a str. 2457T
ccagauaaggcguucac

SEQ ID NO: 1926357 - RNA, 12 nt, Shigella flexneri 2a str. 2457T
ccagauaagacg

SEQ ID NO: 1926358 - RNA, 15 nt, Shigella flexneri 2a str. 2457T
ccagauaagacacug

SEQ ID NO: 1926359 - RNA, 15 nt, Shigella flexneri 2a str. 2457T
ccagauaaauauuau

SEQ ID NO: 1926360 - RNA, 14 nt, Shigella flexneri 2a str. 2457T
ccagagugaccgcc

SEQ ID NO: 1926361 - RNA, 16 nt, Shigella flexneri 2a str. 2457T
ccagagugaccgccaa

SEQ ID NO: 1926362 - RNA, 21 nt, Shigella flexneri 2a str. 2457T
ccagaguggauuaucuucacc

SEQ ID NO: 1926363 - RNA, 22 nt, Shigella flexneri 2a str. 2457T
ccagauagaacaucucuuccca

SEQ ID NO: 1926364 - RNA, 19 nt, Shigella flexneri 2a str. 2457T
ccagauagcaacagcagcc

SEQ ID NO: 1926365 - RNA, 19 nt, Shigella flexneri 2a str. 2457T
ccagauagagccgguuuug

SEQ ID NO: 1926366 - RNA, 16 nt, Shigella flexneri 2a str. 2457T
ccagauaugaucgaaa

SEQ ID NO: 1926367 - RNA, 15 nt, Shigella flexneri 2a str. 2457T
ccagauagccagguu

SEQ ID NO: 1926368 - RNA, 17 nt, Shigella flexneri 2a str. 2457T
ccagaucgaucauauuu

SEQ ID NO: 1926369 - RNA, 14 nt, Shigella flexneri 2a str. 2457T
ccagaucgccugcc

SEQ ID NO: 1926370 - RNA, 15 nt, Shigella flexneri 2a str. 2457T
ccagaucgccugccg

SEQ ID NO: 1926371 - RNA, 21 nt, Shigella flexneri 2a str. 2457T
ccagauggcuuuccaccauca

SEQ ID NO: 1926372 - RNA, 15 nt, Shigella flexneri 2a str. 2457T
ccagauuaauuauug

SEQ ID NO: 1926373 - RNA, 15 nt, Shigella flexneri 2a str. 2457T
ccagauuccucucau

SEQ ID NO: 1926374 - RNA, 17 nt, Shigella flexneri 2a str. 2457T
ccagauucuccaacauc

SEQ ID NO: 1926375 - RNA, 18 nt, Shigella flexneri 2a str. 2457T
ccagauugccgauauaaa

SEQ ID NO: 1926376 - RNA, 17 nt, Shigella flexneri 2a str. 2457T
ccagaacaccauaauga

SEQ ID NO: 1926377 - RNA, 18 nt, Shigella flexneri 2a str. 2457T
ccagaacacgcucccagc

SEQ ID NO: 1926378 - RNA, 19 nt, Shigella flexneri 2a str. 2457T
ccagaacacuguuaccgcu

SEQ ID NO: 1926379 - RNA, 15 nt, Shigella flexneri 2a str. 2457T
ccagaacaaauaaau

SEQ ID NO: 1926380 - RNA, 12 nt, Shigella flexneri 2a str. 2457T
ccagaacaaccc

SEQ ID NO: 1926381 - RNA, 19 nt, Shigella flexneri 2a str. 2457T
ccagaaauggcccaaaagg

SEQ ID NO: 1926382 - RNA, 16 nt, Shigella flexneri 2a str. 2457T
ccagaaaucagcagcu

SEQ ID NO: 1926383 - RNA, 17 nt, Shigella flexneri 2a str. 2457T
ccagaaaucggccuucc

SEQ ID NO: 1926384 - RNA, 11 nt, Shigella flexneri 2a str. 2457T
ccagaaaucag

SEQ ID NO: 1926385 - RNA, 18 nt, Shigella flexneri 2a str. 2457T
ccacuuuuaaaucgccaa

SEQ ID NO: 1926386 - RNA, 15 nt, Shigella flexneri 2a str. 2457T
ccacuuugcaguucc

SEQ ID NO: 1926387 - RNA, 15 nt, Shigella flexneri 2a str. 2457T
ccagaaagugaguuu

SEQ ID NO: 1926388 - RNA, 13 nt, Shigella flexneri 2a str. 2457T
ccagaaaaccugg

SEQ ID NO: 1926389 - RNA, 15 nt, Shigella flexneri 2a str. 2457T
ccagaaacaauaagu

SEQ ID NO: 1926390 - RNA, 21 nt, Shigella flexneri 2a str. 2457T
ccagaaaagagacgcugaaaa

SEQ ID NO: 1926391 - RNA, 17 nt, Shigella flexneri 2a str. 2457T
ccagaagaugcguucac

SEQ ID NO: 1926392 - RNA, 13 nt, Shigella flexneri 2a str. 2457T
ccagaacugaucc

SEQ ID NO: 1926393 - RNA, 18 nt, Shigella flexneri 2a str. 2457T
ccagaauagccgcagcca

SEQ ID NO: 1926394 - RNA, 12 nt, Shigella flexneri 2a str. 2457T
ccagaauaccuu

SEQ ID NO: 1926395 - RNA, 23 nt, Shigella flexneri 2a str. 2457T
ccagaauauugccgaagaccaga

SEQ ID NO: 1926396 - RNA, 18 nt, Shigella flexneri 2a str. 2457T
ccagaauaaacaacugug

SEQ ID NO: 1926397 - RNA, 20 nt, Shigella flexneri 2a str. 2457T
ccagaauucacgcacuuccg

SEQ ID NO: 1926398 - RNA, 14 nt, Shigella flexneri 2a str. 2457T
ccagacaccccuuc

SEQ ID NO: 1926399 - RNA, 15 nt, Shigella flexneri 2a str. 2457T
ccagacacaguucuu

SEQ ID NO: 1926400 - RNA, 23 nt, Shigella flexneri 2a str. 2457T
ccagacaaucgaaaaagaaucga

SEQ ID NO: 1926401 - RNA, 12 nt, Shigella flexneri 2a str. 2457T
ccagacaaauga

SEQ ID NO: 1926402 - RNA, 16 nt, Shigella flexneri 2a str. 2457T
ccagacaaaugaacac

SEQ ID NO: 1926403 - RNA, 13 nt, Shigella flexneri 2a str. 2457T
ccacuugcagcuc

SEQ ID NO: 1926404 - RNA, 13 nt, Shigella flexneri 2a str. 2457T
ccacuuuccucau

SEQ ID NO: 1926405 - RNA, 17 nt, Shigella flexneri 2a str. 2457T
ccacuuucacgccgcca

SEQ ID NO: 1926406 - RNA, 17 nt, Shigella flexneri 2a str. 2457T
ccacuuucacgcccaua

SEQ ID NO: 1926407 - RNA, 22 nt, Shigella flexneri 2a str. 2457T
ccacuuuacgggcaaucuccug

SEQ ID NO: 1926408 - RNA, 15 nt, Shigella flexneri 2a str. 2457T
ccacuuuacgggcaa

SEQ ID NO: 1926409 - RNA, 21 nt, Shigella flexneri 2a str. 2457T
ccacuuuacccgguuugugaa

SEQ ID NO: 1926410 - RNA, 16 nt, Shigella flexneri 2a str. 2457T
ccacugugcgcgccag

SEQ ID NO: 1926411 - RNA, 21 nt, Shigella flexneri 2a str. 2457T
ccacuuccaccacuuccugcu

SEQ ID NO: 1926412 - RNA, 14 nt, Shigella flexneri 2a str. 2457T
ccacuuccaccagc

SEQ ID NO: 1926413 - RNA, 16 nt, Shigella flexneri 2a str. 2457T
ccacuuccaccagcgg

SEQ ID NO: 1926414 - RNA, 15 nt, Shigella flexneri 2a str. 2457T
ccacuucaucaagca

SEQ ID NO: 1926415 - RNA, 22 nt, Shigella flexneri 2a str. 2457T
ccacuuccugccaguuuuuccg

SEQ ID NO: 1926416 - RNA, 23 nt, Shigella flexneri 2a str. 2457T
ccacuuccgcgucaaucugcccg

SEQ ID NO: 1926417 - RNA, 22 nt, Shigella flexneri 2a str. 2457T
ccacuggugagcgguguugccg

SEQ ID NO: 1926418 - RNA, 21 nt, Shigella flexneri 2a str. 2457T
ccacugguuccgguuuaucca

SEQ ID NO: 1926419 - RNA, 16 nt, Shigella flexneri 2a str. 2457T
ccacuggucgcccugg

SEQ ID NO: 1926420 - RNA, 14 nt, Shigella flexneri 2a str. 2457T
ccacugcgccgcuc

SEQ ID NO: 1926421 - RNA, 12 nt, Shigella flexneri 2a str. 2457T
ccacgccacagc

SEQ ID NO: 1926422 - RNA, 15 nt, Shigella flexneri 2a str. 2457T
ccacaucaaucccuu

SEQ ID NO: 1926423 - RNA, 14 nt, Shigella flexneri 2a str. 2457T
ccacaguuucauau

SEQ ID NO: 1926424 - RNA, 18 nt, Shigella flexneri 2a str. 2457T
ccacagggugaucaccag

SEQ ID NO: 1926425 - RNA, 12 nt, Shigella flexneri 2a str. 2457T
ccacaaucucac

SEQ ID NO: 1926426 - RNA, 19 nt, Shigella flexneri 2a str. 2457T
ccacaucggcaucaggcca

SEQ ID NO: 1926427 - RNA, 23 nt, Shigella flexneri 2a str. 2457T
ccacauccagcuuuuuaaucgcc

SEQ ID NO: 1926428 - RNA, 13 nt, Shigella flexneri 2a str. 2457T
ccacauccagugg

SEQ ID NO: 1926429 - RNA, 19 nt, Shigella flexneri 2a str. 2457T
ccacauccggcaaaaacaa

SEQ ID NO: 1926430 - RNA, 21 nt, Shigella flexneri 2a str. 2457T
ccacauccggcauauuaacca

SEQ ID NO: 1926431 - RNA, 13 nt, Shigella flexneri 2a str. 2457T
ccacauccggccu

SEQ ID NO: 1926432 - RNA, 16 nt, Shigella flexneri 2a str. 2457T
ccacauccggccuaua

SEQ ID NO: 1926433 - RNA, 13 nt, Shigella flexneri 2a str. 2457T
ccacauccggcuu

SEQ ID NO: 1926434 - RNA, 14 nt, Shigella flexneri 2a str. 2457T
ccacaucagacuca

SEQ ID NO: 1926435 - RNA, 12 nt, Shigella flexneri 2a str. 2457T
ccacaucagcgg

SEQ ID NO: 1926436 - RNA, 23 nt, Shigella flexneri 2a str. 2457T
ccacaucacuccauccagcaaca

SEQ ID NO: 1926437 - RNA, 14 nt, Shigella flexneri 2a str. 2457T
ccacauuuuccauc

SEQ ID NO: 1926438 - RNA, 21 nt, Shigella flexneri 2a str. 2457T
ccacauugugggauuccagcg

SEQ ID NO: 1926439 - RNA, 16 nt, Shigella flexneri 2a str. 2457T
ccacauuagauaaaaa

SEQ ID NO: 1926440 - RNA, 21 nt, Shigella flexneri 2a str. 2457T
ccacaugaucauucaccagcc

SEQ ID NO: 1926441 - RNA, 23 nt, Shigella flexneri 2a str. 2457T
ccacaugaucauucaccagccca

SEQ ID NO: 1926442 - RNA, 17 nt, Shigella flexneri 2a str. 2457T
ccacaugccugcauaaa

SEQ ID NO: 1926443 - RNA, 20 nt, Shigella flexneri 2a str. 2457T
ccacaugccugcauaaagga

SEQ ID NO: 1926444 - RNA, 23 nt, Shigella flexneri 2a str. 2457T
ccacaaagcagacaacccacaca

SEQ ID NO: 1926445 - RNA, 18 nt, Shigella flexneri 2a str. 2457T
ccacaaagggagagggau

SEQ ID NO: 1926446 - RNA, 20 nt, Shigella flexneri 2a str. 2457T
ccacaaagcagacaacccac

SEQ ID NO: 1926447 - RNA, 13 nt, Shigella flexneri 2a str. 2457T
ccacaaacucuuu

SEQ ID NO: 1926448 - RNA, 21 nt, Shigella flexneri 2a str. 2457T
ccacaaacccgccagaccagc

SEQ ID NO: 1926449 - RNA, 23 nt, Shigella flexneri 2a str. 2457T
ccacaaaacggauguuucuucaa

SEQ ID NO: 1926450 - RNA, 23 nt, Shigella flexneri 2a str. 2457T
ccaauucguaaguacauuaaaau

SEQ ID NO: 1926451 - RNA, 14 nt, Shigella flexneri 2a str. 2457T
ccaauuccgcagcg

SEQ ID NO: 1926452 - RNA, 14 nt, Shigella flexneri 2a str. 2457T
ccaaugccugaugc

SEQ ID NO: 1926453 - RNA, 17 nt, Shigella flexneri 2a str. 2457T
ccaaugccguucucugg

SEQ ID NO: 1926454 - RNA, 22 nt, Shigella flexneri 2a str. 2457T
ccaauuaaugcaccaacaaaua

SEQ ID NO: 1926455 - RNA, 15 nt, Shigella flexneri 2a str. 2457T
ccaaugaccacuccg

SEQ ID NO: 1926456 - RNA, 16 nt, Shigella flexneri 2a str. 2457T
ccaaugacuauuugcg

SEQ ID NO: 1926457 - RNA, 18 nt, Shigella flexneri 2a str. 2457T
ccaaugaaguggcauccg

SEQ ID NO: 1926458 - RNA, 14 nt, Shigella flexneri 2a str. 2457T
ccaaguaauagaac

SEQ ID NO: 1926459 - RNA, 14 nt, Shigella flexneri 2a str. 2457T
ccaauaaacgccag

SEQ ID NO: 1926460 - RNA, 17 nt, Shigella flexneri 2a str. 2457T
ccaaucuucucuuccgg

SEQ ID NO: 1926461 - RNA, 18 nt, Shigella flexneri 2a str. 2457T
ccaauaauccccaauacg

SEQ ID NO: 1926462 - RNA, 18 nt, Shigella flexneri 2a str. 2457T
ccacccgaucgcucauau

SEQ ID NO: 1926463 - RNA, 14 nt, Shigella flexneri 2a str. 2457T
ccaccgcaaaaggc

SEQ ID NO: 1926464 - RNA, 23 nt, Shigella flexneri 2a str. 2457T
ccaccgauuuucagccaucaucc

SEQ ID NO: 1926465 - RNA, 16 nt, Shigella flexneri 2a str. 2457T
ccaccgaugcacagca

SEQ ID NO: 1926466 - RNA, 17 nt, Shigella flexneri 2a str. 2457T
ccaccgacgcagucaug

SEQ ID NO: 1926467 - RNA, 16 nt, Shigella flexneri 2a str. 2457T
ccaccagcgucagaaa

SEQ ID NO: 1926468 - RNA, 13 nt, Shigella flexneri 2a str. 2457T
ccaccaggaacgc

SEQ ID NO: 1926469 - RNA, 19 nt, Shigella flexneri 2a str. 2457T
ccaccaggaacgcgccaag

SEQ ID NO: 1926470 - RNA, 13 nt, Shigella flexneri 2a str. 2457T
ccacccagcagcg

SEQ ID NO: 1926471 - RNA, 23 nt, Shigella flexneri 2a str. 2457T
ccaccagccccagaauucacgca

SEQ ID NO: 1926472 - RNA, 12 nt, Shigella flexneri 2a str. 2457T
ccaccaccagac

SEQ ID NO: 1926473 - RNA, 21 nt, Shigella flexneri 2a str. 2457T
ccaccacagacaaucgccagu

SEQ ID NO: 1926474 - RNA, 15 nt, Shigella flexneri 2a str. 2457T
ccaccaaacugcgcc

SEQ ID NO: 1926475 - RNA, 12 nt, Shigella flexneri 2a str. 2457T
ccacgaaacugc

SEQ ID NO: 1926476 - RNA, 18 nt, Shigella flexneri 2a str. 2457T
ccacgcacgccugcaucu

SEQ ID NO: 1926477 - RNA, 13 nt, Shigella flexneri 2a str. 2457T
ccaccgcucugcg

SEQ ID NO: 1926478 - RNA, 16 nt, Shigella flexneri 2a str. 2457T
ccaccgcucaucgccc

SEQ ID NO: 1926479 - RNA, 19 nt, Shigella flexneri 2a str. 2457T
ccaccggacggacuuccag

SEQ ID NO: 1926480 - RNA, 13 nt, Shigella flexneri 2a str. 2457T
ccaccggauaaag

SEQ ID NO: 1926481 - RNA, 23 nt, Shigella flexneri 2a str. 2457T
ccaccggauaaaggcggcccagu

SEQ ID NO: 1926482 - RNA, 18 nt, Shigella flexneri 2a str. 2457T
ccaccguuucuacaagca

SEQ ID NO: 1926483 - RNA, 21 nt, Shigella flexneri 2a str. 2457T
ccaccgucgggcugacguuaa

SEQ ID NO: 1926484 - RNA, 13 nt, Shigella flexneri 2a str. 2457T
ccaaccagcugac

SEQ ID NO: 1926485 - RNA, 13 nt, Shigella flexneri 2a str. 2457T
ccaacagcagcca

SEQ ID NO: 1926486 - RNA, 21 nt, Shigella flexneri 2a str. 2457T
ccaacauucgagaagcccaua

SEQ ID NO: 1926487 - RNA, 21 nt, Shigella flexneri 2a str. 2457T
ccaaccacggaguugaccagc

SEQ ID NO: 1926488 - RNA, 17 nt, Shigella flexneri 2a str. 2457T
ccaaauacauugauaua

SEQ ID NO: 1926489 - RNA, 15 nt, Shigella flexneri 2a str. 2457T
ccaaaucuuuucugc

SEQ ID NO: 1926490 - RNA, 21 nt, Shigella flexneri 2a str. 2457T
ccaaagaccaggaaacccaac

SEQ ID NO: 1926491 - RNA, 19 nt, Shigella flexneri 2a str. 2457T
ccaaagcaccacuccucaa

SEQ ID NO: 1926492 - RNA, 13 nt, Shigella flexneri 2a str. 2457T
ccaaauaaaauaa

SEQ ID NO: 1926493 - RNA, 19 nt, Shigella flexneri 2a str. 2457T
ccaaacuuaugcagcugcu

SEQ ID NO: 1926494 - RNA, 13 nt, Shigella flexneri 2a str. 2457T
ccaaagaaaucag

SEQ ID NO: 1926495 - RNA, 15 nt, Shigella flexneri 2a str. 2457T
ccaacuugcccaggu

SEQ ID NO: 1926496 - RNA, 19 nt, Shigella flexneri 2a str. 2457T
ccaacuugcccaggugugu

SEQ ID NO: 1926497 - RNA, 13 nt, Shigella flexneri 2a str. 2457T
ccaaccgccaccg

SEQ ID NO: 1926498 - RNA, 23 nt, Shigella flexneri 2a str. 2457T
ccaaccgcggcacguuccugcau

SEQ ID NO: 1926499 - RNA, 19 nt, Shigella flexneri 2a str. 2457T
ccaacguucguacugcccu

SEQ ID NO: 1926500 - RNA, 21 nt, Shigella flexneri 2a str. 2457T
ccaaccguggcguaaaucauc

SEQ ID NO: 1926501 - RNA, 23 nt, Shigella flexneri 2a str. 2457T
ccaaccuaaaaaguuauaaauaa

SEQ ID NO: 1926502 - RNA, 15 nt, Shigella flexneri 2a str. 2457T
ccaagcuccagcauc

SEQ ID NO: 1926503 - RNA, 19 nt, Shigella flexneri 2a str. 2457T
ccaagcagcgcgcagaaca

SEQ ID NO: 1926504 - RNA, 17 nt, Shigella flexneri 2a str. 2457T
ccaagcgcggcaggcau

SEQ ID NO: 1926505 - RNA, 15 nt, Shigella flexneri 2a str. 2457T
ccaaacgccuagaug

SEQ ID NO: 1926506 - RNA, 15 nt, Shigella flexneri 2a str. 2457T
ccaaacgcucccugc

SEQ ID NO: 1926507 - RNA, 16 nt, Shigella flexneri 2a str. 2457T
ccaaaccgacugccug

SEQ ID NO: 1926508 - RNA, 14 nt, Shigella flexneri 2a str. 2457T
ccaaacagcagaac

SEQ ID NO: 1926509 - RNA, 20 nt, Shigella flexneri 2a str. 2457T
ccaaaacagcgacaccagcc

SEQ ID NO: 1926510 - RNA, 13 nt, Shigella flexneri 2a str. 2457T
ccaaaaacgccau

SEQ ID NO: 1926511 - RNA, 23 nt, Shigella flexneri 2a str. 2457T
ccaaaaaagcgaaucuuuaucgg

SEQ ID NO: 1926512 - RNA, 20 nt, Shigella flexneri 2a str. 2457T
ccaaaaagaaccugaacgcc

SEQ ID NO: 1926513 - RNA, 17 nt, Shigella flexneri 2a str. 2457T
ccaaaaagauuaaaaaa

SEQ ID NO: 1926514 - RNA, 11 nt, Shigella flexneri 2a str. 2457T
ccaaaaugccu

SEQ ID NO: 1926515 - RNA, 18 nt, Shigella flexneri 2a str. 2457T
ccaaaauaauaaauuaac

SEQ ID NO: 1926516 - RNA, 20 nt, Shigella flexneri 2a str. 2457T
cauuuuuucacauguucauu

SEQ ID NO: 1926517 - RNA, 22 nt, Shigella flexneri 2a str. 2457T
cauuuuuucacauguucauuua

SEQ ID NO: 1926518 - RNA, 19 nt, Shigella flexneri 2a str. 2457T
cauuuuuuguggcuucuau

SEQ ID NO: 1926519 - RNA, 19 nt, Shigella flexneri 2a str. 2457T
cauuuuucagcguucccca

SEQ ID NO: 1926520 - RNA, 15 nt, Shigella flexneri 2a str. 2457T
cauuuuucacugcgg

SEQ ID NO: 1926521 - RNA, 22 nt, Shigella flexneri 2a str. 2457T
cauuuuuacuccuuagcaacag

SEQ ID NO: 1926522 - RNA, 18 nt, Shigella flexneri 2a str. 2457T
cauuuuggacaaugcagu

SEQ ID NO: 1926523 - RNA, 23 nt, Shigella flexneri 2a str. 2457T
cauuuucucgcggacugccuggc

SEQ ID NO: 1926524 - RNA, 17 nt, Shigella flexneri 2a str. 2457T
cauuuucugcccauuua

SEQ ID NO: 1926525 - RNA, 23 nt, Shigella flexneri 2a str. 2457T
cauuuucucgcgaaccgccuggc

SEQ ID NO: 1926526 - RNA, 16 nt, Shigella flexneri 2a str. 2457T
cauugauauacagccc

SEQ ID NO: 1926527 - RNA, 23 nt, Shigella flexneri 2a str. 2457T
cauugaguuugaugaccagauca

SEQ ID NO: 1926528 - RNA, 14 nt, Shigella flexneri 2a str. 2457T
cauugauaauguua

SEQ ID NO: 1926529 - RNA, 18 nt, Shigella flexneri 2a str. 2457T
caguaaccgcuuuuucaa

SEQ ID NO: 1926530 - RNA, 19 nt, Shigella flexneri 2a str. 2457T
caguaaccuuucagauguu

SEQ ID NO: 1926531 - RNA, 17 nt, Shigella flexneri 2a str. 2457T
caguaaccgcuuuuuca

SEQ ID NO: 1926532 - RNA, 18 nt, Shigella flexneri 2a str. 2457T
caguaagcaguccagcgc

SEQ ID NO: 1926533 - RNA, 19 nt, Shigella flexneri 2a str. 2457T
caguaagcaguccagcgcc

SEQ ID NO: 1926534 - RNA, 20 nt, Shigella flexneri 2a str. 2457T
caguaaggucaucaaucauu

SEQ ID NO: 1926535 - RNA, 21 nt, Shigella flexneri 2a str. 2457T
caguaagcugugcgauagcaa

SEQ ID NO: 1926536 - RNA, 22 nt, Shigella flexneri 2a str. 2457T
caguaaauucucgcuaauuuau

SEQ ID NO: 1926537 - RNA, 15 nt, Shigella flexneri 2a str. 2457T
caguaaauuuaucaa

SEQ ID NO: 1926538 - RNA, 20 nt, Shigella flexneri 2a str. 2457T
caguaaccaaaagcugggau

SEQ ID NO: 1926539 - RNA, 23 nt, Shigella flexneri 2a str. 2457T
caguaaagcgcaaaauaccagca

SEQ ID NO: 1926540 - RNA, 19 nt, Shigella flexneri 2a str. 2457T
caguaaauggugauaucac

SEQ ID NO: 1926541 - RNA, 21 nt, Shigella flexneri 2a str. 2457T
caguaaaccacccaccagcgc

SEQ ID NO: 1926542 - RNA, 19 nt, Shigella flexneri 2a str. 2457T
caguaaaccacccaccagc

SEQ ID NO: 1926543 - RNA, 17 nt, Shigella flexneri 2a str. 2457T
caguaaaccgucagcac

SEQ ID NO: 1926544 - RNA, 13 nt, Shigella flexneri 2a str. 2457T
caguaaugagcac

SEQ ID NO: 1926545 - RNA, 15 nt, Shigella flexneri 2a str. 2457T
caguacagccgccag

SEQ ID NO: 1926546 - RNA, 13 nt, Shigella flexneri 2a str. 2457T
caguaccagcagu

SEQ ID NO: 1926547 - RNA, 14 nt, Shigella flexneri 2a str. 2457T
caguaccagcagcg

SEQ ID NO: 1926548 - RNA, 16 nt, Shigella flexneri 2a str. 2457T
caguacaguaccgaac

SEQ ID NO: 1926549 - RNA, 22 nt, Shigella flexneri 2a str. 2457T
caguacauuguuuuccagacug

SEQ ID NO: 1926550 - RNA, 17 nt, Shigella flexneri 2a str. 2457T
caguaauaccagaccuu

SEQ ID NO: 1926551 - RNA, 19 nt, Shigella flexneri 2a str. 2457T
caguaagggaucacgcggu

SEQ ID NO: 1926552 - RNA, 14 nt, Shigella flexneri 2a str. 2457T
caguaauccuuucu

SEQ ID NO: 1926553 - RNA, 16 nt, Shigella flexneri 2a str. 2457T
caguaaugauuuaaaa

SEQ ID NO: 1926554 - RNA, 13 nt, Shigella flexneri 2a str. 2457T
caguaauucagcc

SEQ ID NO: 1926555 - RNA, 21 nt, Shigella flexneri 2a str. 2457T
cagguugaucccaccgggcaa

SEQ ID NO: 1926556 - RNA, 14 nt, Shigella flexneri 2a str. 2457T
cagguucguaagcg

SEQ ID NO: 1926557 - RNA, 19 nt, Shigella flexneri 2a str. 2457T
cagguugcucauaaaauga

SEQ ID NO: 1926558 - RNA, 23 nt, Shigella flexneri 2a str. 2457T
cagguuuaaacagagauuacuuu

SEQ ID NO: 1926559 - RNA, 14 nt, Shigella flexneri 2a str. 2457T
cagguuuugaccag

SEQ ID NO: 1926560 - RNA, 21 nt, Shigella flexneri 2a str. 2457T
aaacaacggaacgaaaaaaau

SEQ ID NO: 1926561 - RNA, 14 nt, Shigella flexneri 2a str. 2457T
aaacaaauccgcuu

SEQ ID NO: 1926562 - RNA, 14 nt, Shigella flexneri 2a str. 2457T
aaacaacaugcuau

SEQ ID NO: 1926563 - RNA, 22 nt, Shigella flexneri 2a str. 2457T
caggucgucuuuuacagcgcca

SEQ ID NO: 1926564 - RNA, 18 nt, Shigella flexneri 2a str. 2457T
cagguauuuugucagccc

SEQ ID NO: 1926565 - RNA, 18 nt, Shigella flexneri 2a str. 2457T
caggucaaaaaaugaaac

SEQ ID NO: 1926566 - RNA, 20 nt, Shigella flexneri 2a str. 2457T
caggucaaaagauugaauua

SEQ ID NO: 1926567 - RNA, 18 nt, Shigella flexneri 2a str. 2457T
caggucagcaggagcagc

SEQ ID NO: 1926568 - RNA, 14 nt, Shigella flexneri 2a str. 2457T
caggucaucauugc

SEQ ID NO: 1926569 - RNA, 15 nt, Shigella flexneri 2a str. 2457T
cagguccccgcuucg

SEQ ID NO: 1926570 - RNA, 14 nt, Shigella flexneri 2a str. 2457T
cagguguccagcca

SEQ ID NO: 1926571 - RNA, 22 nt, Shigella flexneri 2a str. 2457T
cagguuauuaaauaaccagcgc

SEQ ID NO: 1926572 - RNA, 21 nt, Shigella flexneri 2a str. 2457T
cagguuaaugacccaccccag

SEQ ID NO: 1926573 - RNA, 23 nt, Shigella flexneri 2a str. 2457T
cagguuaacucccccuuucugag

SEQ ID NO: 1926574 - RNA, 17 nt, Shigella flexneri 2a str. 2457T
caggugacgcgggcagc

SEQ ID NO: 1926575 - RNA, 19 nt, Shigella flexneri 2a str. 2457T
caggugacgcgggcagcag

SEQ ID NO: 1926576 - RNA, 21 nt, Shigella flexneri 2a str. 2457T
caggugcagcccguaagcaaa

SEQ ID NO: 1926577 - RNA, 16 nt, Shigella flexneri 2a str. 2457T
caguagacucaagcag

SEQ ID NO: 1926578 - RNA, 15 nt, Shigella flexneri 2a str. 2457T
caguagacagcaaag

SEQ ID NO: 1926579 - RNA, 23 nt, Shigella flexneri 2a str. 2457T
caguagacagcaaagugccccca

SEQ ID NO: 1926580 - RNA, 21 nt, Shigella flexneri 2a str. 2457T
caguacggucgugcgguuuca

SEQ ID NO: 1926581 - RNA, 20 nt, Shigella flexneri 2a str. 2457T
caguacgguaaagccgugcu

SEQ ID NO: 1926582 - RNA, 23 nt, Shigella flexneri 2a str. 2457T
caguacggcuucgaucaggaacu

SEQ ID NO: 1926583 - RNA, 12 nt, Shigella flexneri 2a str. 2457T
caguacggcagc

SEQ ID NO: 1926584 - RNA, 21 nt, Shigella flexneri 2a str. 2457T
caguacggcagcaaucgacca

SEQ ID NO: 1926585 - RNA, 23 nt, Shigella flexneri 2a str. 2457T
caguacggcagcaaucgaccagg

SEQ ID NO: 1926586 - RNA, 19 nt, Shigella flexneri 2a str. 2457T
caguaccgccaccaccaga

SEQ ID NO: 1926587 - RNA, 22 nt, Shigella flexneri 2a str. 2457T
caguaccgccgccauaaacagc

SEQ ID NO: 1926588 - RNA, 21 nt, Shigella flexneri 2a str. 2457T
caguaccuccuucacaguggc

SEQ ID NO: 1926589 - RNA, 20 nt, Shigella flexneri 2a str. 2457T
caguacgcccacgccagccu

SEQ ID NO: 1926590 - RNA, 22 nt, Shigella flexneri 2a str. 2457T
caguacgcccacgccagccugc

SEQ ID NO: 1926591 - RNA, 17 nt, Shigella flexneri 2a str. 2457T
caguacgcgcccgccgc

SEQ ID NO: 1926592 - RNA, 13 nt, Shigella flexneri 2a str. 2457T
caguacgccgccg

SEQ ID NO: 1926593 - RNA, 20 nt, Shigella flexneri 2a str. 2457T
caguagcgcaaucaccacca

SEQ ID NO: 1926594 - RNA, 15 nt, Shigella flexneri 2a str. 2457T
caguagccuuuaucu

SEQ ID NO: 1926595 - RNA, 19 nt, Shigella flexneri 2a str. 2457T
caguagcgcaaucaccacc

SEQ ID NO: 1926596 - RNA, 18 nt, Shigella flexneri 2a str. 2457T
caguagccaugcauaaug

SEQ ID NO: 1926597 - RNA, 14 nt, Shigella flexneri 2a str. 2457T
caguagugguaacg

SEQ ID NO: 1926598 - RNA, 21 nt, Shigella flexneri 2a str. 2457T
caguagugguaacgcacacau

SEQ ID NO: 1926599 - RNA, 19 nt, Shigella flexneri 2a str. 2457T
caguaguucgagaaucgca

SEQ ID NO: 1926600 - RNA, 14 nt, Shigella flexneri 2a str. 2457T
caguauacgccaca

SEQ ID NO: 1926601 - RNA, 15 nt, Shigella flexneri 2a str. 2457T
caguauacgccacau

SEQ ID NO: 1926602 - RNA, 20 nt, Shigella flexneri 2a str. 2457T
caguaucgagaaguuacagg

SEQ ID NO: 1926603 - RNA, 14 nt, Shigella flexneri 2a str. 2457T
caguccccacgcca

SEQ ID NO: 1926604 - RNA, 14 nt, Shigella flexneri 2a str. 2457T
cagucccaguucau

SEQ ID NO: 1926605 - RNA, 12 nt, Shigella flexneri 2a str. 2457T
caguccaucggc

SEQ ID NO: 1926606 - RNA, 18 nt, Shigella flexneri 2a str. 2457T
caguccauuaccgauaga

SEQ ID NO: 1926607 - RNA, 16 nt, Shigella flexneri 2a str. 2457T
caguccacgguugguu

SEQ ID NO: 1926608 - RNA, 15 nt, Shigella flexneri 2a str. 2457T
caguccagcgccuga

SEQ ID NO: 1926609 - RNA, 13 nt, Shigella flexneri 2a str. 2457T
caguccagcgccu

SEQ ID NO: 1926610 - RNA, 16 nt, Shigella flexneri 2a str. 2457T
caguccaccugaccug

SEQ ID NO: 1926611 - RNA, 12 nt, Shigella flexneri 2a str. 2457T
cagucaggcugu

SEQ ID NO: 1926612 - RNA, 17 nt, Shigella flexneri 2a str. 2457T
cagucaguuaagcaacu

SEQ ID NO: 1926613 - RNA, 12 nt, Shigella flexneri 2a str. 2457T
cagucagucuca

SEQ ID NO: 1926614 - RNA, 23 nt, Shigella flexneri 2a str. 2457T
cagucaggcgauuguuuagaucc

SEQ ID NO: 1926615 - RNA, 16 nt, Shigella flexneri 2a str. 2457T
cagucacuuuuuuccg

SEQ ID NO: 1926616 - RNA, 17 nt, Shigella flexneri 2a str. 2457T
cagucagcgaacaccag

SEQ ID NO: 1926617 - RNA, 17 nt, Shigella flexneri 2a str. 2457T
cagucauaaccagucca

SEQ ID NO: 1926618 - RNA, 15 nt, Shigella flexneri 2a str. 2457T
caguaugaucuugcc

SEQ ID NO: 1926619 - RNA, 15 nt, Shigella flexneri 2a str. 2457T
caguauugccaugca

SEQ ID NO: 1926620 - RNA, 19 nt, Shigella flexneri 2a str. 2457T
caguauuaucugggcugcc

SEQ ID NO: 1926621 - RNA, 17 nt, Shigella flexneri 2a str. 2457T
cagucaccugcccuccg

SEQ ID NO: 1926622 - RNA, 20 nt, Shigella flexneri 2a str. 2457T
cagucacaccgcgcgucccu

SEQ ID NO: 1926623 - RNA, 12 nt, Shigella flexneri 2a str. 2457T
cagucgcccccg

SEQ ID NO: 1926624 - RNA, 23 nt, Shigella flexneri 2a str. 2457T
cagucgcguagguaaucauauug

SEQ ID NO: 1926625 - RNA, 17 nt, Shigella flexneri 2a str. 2457T
cagucgcgcaauugcca

SEQ ID NO: 1926626 - RNA, 13 nt, Shigella flexneri 2a str. 2457T
cagucggcuuucu

SEQ ID NO: 1926627 - RNA, 21 nt, Shigella flexneri 2a str. 2457T
cagucggcuuucucauuuuuu

SEQ ID NO: 1926628 - RNA, 18 nt, Shigella flexneri 2a str. 2457T
cagucgcugaaguuucuu

SEQ ID NO: 1926629 - RNA, 13 nt, Shigella flexneri 2a str. 2457T
cagucgcugacac

SEQ ID NO: 1926630 - RNA, 15 nt, Shigella flexneri 2a str. 2457T
cagucgucaucccag

SEQ ID NO: 1926631 - RNA, 19 nt, Shigella flexneri 2a str. 2457T
cagucguucaaccacuuca

SEQ ID NO: 1926632 - RNA, 22 nt, Shigella flexneri 2a str. 2457T
cagucgugcgguaguuucuccc

SEQ ID NO: 1926633 - RNA, 19 nt, Shigella flexneri 2a str. 2457T
caguccccucgccccuccg

SEQ ID NO: 1926634 - RNA, 17 nt, Shigella flexneri 2a str. 2457T
cagucgcaaaccuggca

SEQ ID NO: 1926635 - RNA, 15 nt, Shigella flexneri 2a str. 2457T
cagucgcacgccugg

SEQ ID NO: 1926636 - RNA, 16 nt, Shigella flexneri 2a str. 2457T
cagucgcacgccuggc

SEQ ID NO: 1926637 - RNA, 20 nt, Shigella flexneri 2a str. 2457T
cagugaucgugugccaccag

SEQ ID NO: 1926638 - RNA, 14 nt, Shigella flexneri 2a str. 2457T
cagugauauauuuu

SEQ ID NO: 1926639 - RNA, 20 nt, Shigella flexneri 2a str. 2457T
cagugauauauuuuuaaaua

SEQ ID NO: 1926640 - RNA, 22 nt, Shigella flexneri 2a str. 2457T
cagugauauauuuuuaaauaua

SEQ ID NO: 1926641 - RNA, 20 nt, Shigella flexneri 2a str. 2457T
cagugaccgaaccuguuuuc

SEQ ID NO: 1926642 - RNA, 17 nt, Shigella flexneri 2a str. 2457T
cagugacuuccguaccg

SEQ ID NO: 1926643 - RNA, 17 nt, Shigella flexneri 2a str. 2457T
cagugauuuuugcugaa

SEQ ID NO: 1926644 - RNA, 15 nt, Shigella flexneri 2a str. 2457T
cagugcaaaugccag

SEQ ID NO: 1926645 - RNA, 16 nt, Shigella flexneri 2a str. 2457T
cagugcaccggacacu

SEQ ID NO: 1926646 - RNA, 22 nt, Shigella flexneri 2a str. 2457T
cagugcacgaaccagagacaga

SEQ ID NO: 1926647 - RNA, 18 nt, Shigella flexneri 2a str. 2457T
cagugcaauaccauggcu

SEQ ID NO: 1926648 - RNA, 18 nt, Shigella flexneri 2a str. 2457T
cagugcagcgccuuuugu

SEQ ID NO: 1926649 - RNA, 22 nt, Shigella flexneri 2a str. 2457T
cagucuggacaaagagcuuuca

SEQ ID NO: 1926650 - RNA, 23 nt, Shigella flexneri 2a str. 2457T
cagucuggacaaagagcuuucau

SEQ ID NO: 1926651 - RNA, 12 nt, Shigella flexneri 2a str. 2457T
cagucuggagca

SEQ ID NO: 1926652 - RNA, 21 nt, Shigella flexneri 2a str. 2457T
cagucugcgcccugggcuuca

SEQ ID NO: 1926653 - RNA, 17 nt, Shigella flexneri 2a str. 2457T
cagucuggcuucgcugu

SEQ ID NO: 1926654 - RNA, 14 nt, Shigella flexneri 2a str. 2457T
cagucuggagcaaa

SEQ ID NO: 1926655 - RNA, 22 nt, Shigella flexneri 2a str. 2457T
cagucuuaaaggggugaaaaaa

SEQ ID NO: 1926656 - RNA, 22 nt, Shigella flexneri 2a str. 2457T
cagucuuugccguuggcggcgu

SEQ ID NO: 1926657 - RNA, 16 nt, Shigella flexneri 2a str. 2457T
cagucuucccagcccc

SEQ ID NO: 1926658 - RNA, 13 nt, Shigella flexneri 2a str. 2457T
cagucuuccugcg

SEQ ID NO: 1926659 - RNA, 15 nt, Shigella flexneri 2a str. 2457T
cagucuuccugcggc

SEQ ID NO: 1926660 - RNA, 14 nt, Shigella flexneri 2a str. 2457T
cagucuucccagcc

SEQ ID NO: 1926661 - RNA, 19 nt, Shigella flexneri 2a str. 2457T
cagucuucaucauccucuu

SEQ ID NO: 1926662 - RNA, 22 nt, Shigella flexneri 2a str. 2457T
cagugacagguugcucauaaaa

SEQ ID NO: 1926663 - RNA, 23 nt, Shigella flexneri 2a str. 2457T
cagugaaaccgaaggcaccauua

SEQ ID NO: 1926664 - RNA, 22 nt, Shigella flexneri 2a str. 2457T
caggccugauaagacgcgcagc

SEQ ID NO: 1926665 - RNA, 23 nt, Shigella flexneri 2a str. 2457T
caggcgaucucguuuuugucucu

SEQ ID NO: 1926666 - RNA, 15 nt, Shigella flexneri 2a str. 2457T
caggcgaucuucccg

SEQ ID NO: 1926667 - RNA, 16 nt, Shigella flexneri 2a str. 2457T
caggccaucagcagcg

SEQ ID NO: 1926668 - RNA, 12 nt, Shigella flexneri 2a str. 2457T
caggccagcagc

SEQ ID NO: 1926669 - RNA, 16 nt, Shigella flexneri 2a str. 2457T
caggccagcagcagag

SEQ ID NO: 1926670 - RNA, 17 nt, Shigella flexneri 2a str. 2457T
caggaucugguauuaaa

SEQ ID NO: 1926671 - RNA, 17 nt, Shigella flexneri 2a str. 2457T
caggaucugguguuaaa

SEQ ID NO: 1926672 - RNA, 16 nt, Shigella flexneri 2a str. 2457T
caggaucugcgcggca

SEQ ID NO: 1926673 - RNA, 16 nt, Shigella flexneri 2a str. 2457T
caggauauagucgaac

SEQ ID NO: 1926674 - RNA, 18 nt, Shigella flexneri 2a str. 2457T
caggauauauuucaucaa

SEQ ID NO: 1926675 - RNA, 22 nt, Shigella flexneri 2a str. 2457T
caggauaucguggcacguacca

SEQ ID NO: 1926676 - RNA, 17 nt, Shigella flexneri 2a str. 2457T
caggauauuuauauuuu

SEQ ID NO: 1926677 - RNA, 22 nt, Shigella flexneri 2a str. 2457T
caggcauuaaauccugaaacca

SEQ ID NO: 1926678 - RNA, 18 nt, Shigella flexneri 2a str. 2457T
caggcaucacgucggcgu

SEQ ID NO: 1926679 - RNA, 14 nt, Shigella flexneri 2a str. 2457T
caggcaucacuuua

SEQ ID NO: 1926680 - RNA, 12 nt, Shigella flexneri 2a str. 2457T
cagggcggcagg

SEQ ID NO: 1926681 - RNA, 14 nt, Shigella flexneri 2a str. 2457T
cagggcgucaccgg

SEQ ID NO: 1926682 - RNA, 16 nt, Shigella flexneri 2a str. 2457T
cagggccuccugcagc

SEQ ID NO: 1926683 - RNA, 21 nt, Shigella flexneri 2a str. 2457T
cagggccgcgaaucuccagau

SEQ ID NO: 1926684 - RNA, 14 nt, Shigella flexneri 2a str. 2457T
cagggcaugacaca

SEQ ID NO: 1926685 - RNA, 17 nt, Shigella flexneri 2a str. 2457T
cagggcaugacacagaa

SEQ ID NO: 1926686 - RNA, 23 nt, Shigella flexneri 2a str. 2457T
cagggcacuuuuauccugucagu

SEQ ID NO: 1926687 - RNA, 22 nt, Shigella flexneri 2a str. 2457T
cagggcaaugcgggugcaauca

SEQ ID NO: 1926688 - RNA, 23 nt, Shigella flexneri 2a str. 2457T
caggcucagaagacgcuccagug

SEQ ID NO: 1926689 - RNA, 22 nt, Shigella flexneri 2a str. 2457T
caggcucauaccuuccacuuuc

SEQ ID NO: 1926690 - RNA, 15 nt, Shigella flexneri 2a str. 2457T
caggcuccuguagcu

SEQ ID NO: 1926691 - RNA, 12 nt, Shigella flexneri 2a str. 2457T
caggcugguggu

SEQ ID NO: 1926692 - RNA, 17 nt, Shigella flexneri 2a str. 2457T
caggcugcgaguccugu

SEQ ID NO: 1926693 - RNA, 14 nt, Shigella flexneri 2a str. 2457T
caggcuuaccagca

SEQ ID NO: 1926694 - RNA, 19 nt, Shigella flexneri 2a str. 2457T
caggcuuauggcucgccau

SEQ ID NO: 1926695 - RNA, 12 nt, Shigella flexneri 2a str. 2457T
caggcuguguuu

SEQ ID NO: 1926696 - RNA, 15 nt, Shigella flexneri 2a str. 2457T
caggaauacgcccgu

SEQ ID NO: 1926697 - RNA, 21 nt, Shigella flexneri 2a str. 2457T
caggaauagcggcaagcccag

SEQ ID NO: 1926698 - RNA, 12 nt, Shigella flexneri 2a str. 2457T
caggaauauacc

SEQ ID NO: 1926699 - RNA, 19 nt, Shigella flexneri 2a str. 2457T
aaaauuuuaguuuaaacau

SEQ ID NO: 1926700 - RNA, 13 nt, Shigella flexneri 2a str. 2457T
caggaacagccac

SEQ ID NO: 1926701 - RNA, 21 nt, Shigella flexneri 2a str. 2457T
caggaaccugugacagcagcg

SEQ ID NO: 1926702 - RNA, 17 nt, Shigella flexneri 2a str. 2457T
caggaaggccagcaggu

SEQ ID NO: 1926703 - RNA, 15 nt, Shigella flexneri 2a str. 2457T
caggaaguccgagga

SEQ ID NO: 1926704 - RNA, 22 nt, Shigella flexneri 2a str. 2457T
caggagacgcgcaaaucagauu

SEQ ID NO: 1926705 - RNA, 15 nt, Shigella flexneri 2a str. 2457T
caggagaagcaaauu

SEQ ID NO: 1926706 - RNA, 14 nt, Shigella flexneri 2a str. 2457T
aaaauuuucauugc

SEQ ID NO: 1926707 - RNA, 12 nt, Shigella flexneri 2a str. 2457T
caggauacgcau

SEQ ID NO: 1926708 - RNA, 22 nt, Shigella flexneri 2a str. 2457T
caggagcgauuaugaaacaaga

SEQ ID NO: 1926709 - RNA, 17 nt, Shigella flexneri 2a str. 2457T
caggauaaccuucaacu

SEQ ID NO: 1926710 - RNA, 13 nt, Shigella flexneri 2a str. 2457T
cagcuuuuacagc

SEQ ID NO: 1926711 - RNA, 23 nt, Shigella flexneri 2a str. 2457T
cagcuuuucgauaacccggcggc

SEQ ID NO: 1926712 - RNA, 21 nt, Shigella flexneri 2a str. 2457T
cagcuuuuccauaucaagcau

SEQ ID NO: 1926713 - RNA, 20 nt, Shigella flexneri 2a str. 2457T
cagcuuugcccgaucaucaa

SEQ ID NO: 1926714 - RNA, 13 nt, Shigella flexneri 2a str. 2457T
cagcuuuuuccug

SEQ ID NO: 1926715 - RNA, 15 nt, Shigella flexneri 2a str. 2457T
cagcuuuuuccugcg

SEQ ID NO: 1926716 - RNA, 18 nt, Shigella flexneri 2a str. 2457T
caggaacaccgcacgcag

SEQ ID NO: 1926717 - RNA, 14 nt, Shigella flexneri 2a str. 2457T
caggaacaccagca

SEQ ID NO: 1926718 - RNA, 22 nt, Shigella flexneri 2a str. 2457T
caggaaauuauggaucaccauc

SEQ ID NO: 1926719 - RNA, 16 nt, Shigella flexneri 2a str. 2457T
cagcuucccaaagauc

SEQ ID NO: 1926720 - RNA, 22 nt, Shigella flexneri 2a str. 2457T
cagcuuccaggcaaucagcaau

SEQ ID NO: 1926721 - RNA, 15 nt, Shigella flexneri 2a str. 2457T
cagcuugcuuuccag

SEQ ID NO: 1926722 - RNA, 13 nt, Shigella flexneri 2a str. 2457T
cagcuuucgcuua

SEQ ID NO: 1926723 - RNA, 19 nt, Shigella flexneri 2a str. 2457T
cagcugguugaugcgcccu

SEQ ID NO: 1926724 - RNA, 15 nt, Shigella flexneri 2a str. 2457T
cagcucuugcuccac

SEQ ID NO: 1926725 - RNA, 21 nt, Shigella flexneri 2a str. 2457T
cagcucuuccuucagcucccg

SEQ ID NO: 1926726 - RNA, 19 nt, Shigella flexneri 2a str. 2457T
cagcucucagccagcuggc

SEQ ID NO: 1926727 - RNA, 20 nt, Shigella flexneri 2a str. 2457T
cagcucucagccagcuggca

SEQ ID NO: 1926728 - RNA, 22 nt, Shigella flexneri 2a str. 2457T
cagcucugcugucaccgaagcg

SEQ ID NO: 1926729 - RNA, 20 nt, Shigella flexneri 2a str. 2457T
cagcucugggcuaacacccg

SEQ ID NO: 1926730 - RNA, 22 nt, Shigella flexneri 2a str. 2457T
cagcuucauaaggaaaauaauc

SEQ ID NO: 1926731 - RNA, 15 nt, Shigella flexneri 2a str. 2457T
cagcuucaccuucca

SEQ ID NO: 1926732 - RNA, 16 nt, Shigella flexneri 2a str. 2457T
cagcuucaccuuccag

SEQ ID NO: 1926733 - RNA, 16 nt, Shigella flexneri 2a str. 2457T
cagcuucagcgcgucg

SEQ ID NO: 1926734 - RNA, 13 nt, Shigella flexneri 2a str. 2457T
cagcuguuucugc

SEQ ID NO: 1926735 - RNA, 19 nt, Shigella flexneri 2a str. 2457T
cagcuuacgagugcgcucu

SEQ ID NO: 1926736 - RNA, 15 nt, Shigella flexneri 2a str. 2457T
cagcuuaucuuuuuc

SEQ ID NO: 1926737 - RNA, 22 nt, Shigella flexneri 2a str. 2457T
cagcuuauuagggaucaucuua

SEQ ID NO: 1926738 - RNA, 13 nt, Shigella flexneri 2a str. 2457T
cagcuuacgcuga

SEQ ID NO: 1926739 - RNA, 16 nt, Shigella flexneri 2a str. 2457T
cagcuuagaaaucgac

SEQ ID NO: 1926740 - RNA, 15 nt, Shigella flexneri 2a str. 2457T
cagcuuaaucaccag

SEQ ID NO: 1926741 - RNA, 23 nt, Shigella flexneri 2a str. 2457T
cagcgcugcgaaaguaccauuaa

SEQ ID NO: 1926742 - RNA, 17 nt, Shigella flexneri 2a str. 2457T
cagcgcgggcuggcgua

SEQ ID NO: 1926743 - RNA, 18 nt, Shigella flexneri 2a str. 2457T
cagcgcggugacgcacag

SEQ ID NO: 1926744 - RNA, 20 nt, Shigella flexneri 2a str. 2457T
cagcgcggugauaaccguuu

SEQ ID NO: 1926745 - RNA, 22 nt, Shigella flexneri 2a str. 2457T
cagcgcugaguaauccuucccc

SEQ ID NO: 1926746 - RNA, 19 nt, Shigella flexneri 2a str. 2457T
cagcuauucuuauaaagaa

SEQ ID NO: 1926747 - RNA, 21 nt, Shigella flexneri 2a str. 2457T
aaaauuguguaaauucaauaa

SEQ ID NO: 1926748 - RNA, 14 nt, Shigella flexneri 2a str. 2457T
cagcucgaccgcug

SEQ ID NO: 1926749 - RNA, 18 nt, Shigella flexneri 2a str. 2457T
cagcuccucuuucaucuc

SEQ ID NO: 1926750 - RNA, 19 nt, Shigella flexneri 2a str. 2457T
cagcuccgguauacguccc

SEQ ID NO: 1926751 - RNA, 17 nt, Shigella flexneri 2a str. 2457T
cagcuccguccagccac

SEQ ID NO: 1926752 - RNA, 18 nt, Shigella flexneri 2a str. 2457T
cagcucucgcguuacuac

SEQ ID NO: 1926753 - RNA, 11 nt, Shigella flexneri 2a str. 2457T
cagcuccagcc

SEQ ID NO: 1926754 - RNA, 22 nt, Shigella flexneri 2a str. 2457T
cagcucccccaaaguuaaggug

SEQ ID NO: 1926755 - RNA, 13 nt, Shigella flexneri 2a str. 2457T
cagcuccggcacc

SEQ ID NO: 1926756 - RNA, 19 nt, Shigella flexneri 2a str. 2457T
cagcuccaccgauuuugag

SEQ ID NO: 1926757 - RNA, 16 nt, Shigella flexneri 2a str. 2457T
cagcuccagcagaccc

SEQ ID NO: 1926758 - RNA, 12 nt, Shigella flexneri 2a str. 2457T
aaaauuuacagu

SEQ ID NO: 1926759 - RNA, 17 nt, Shigella flexneri 2a str. 2457T
cagcucauucagccggg

SEQ ID NO: 1926760 - RNA, 17 nt, Shigella flexneri 2a str. 2457T
cagcucauauuccugca

SEQ ID NO: 1926761 - RNA, 22 nt, Shigella flexneri 2a str. 2457T
cagcucaucaagcuguucuucc

SEQ ID NO: 1926762 - RNA, 18 nt, Shigella flexneri 2a str. 2457T
cacgucuuaauguaaugc

SEQ ID NO: 1926763 - RNA, 22 nt, Shigella flexneri 2a str. 2457T
cacgucuuccauugccgcuuuc

SEQ ID NO: 1926764 - RNA, 18 nt, Shigella flexneri 2a str. 2457T
cacgucuuugccgcgcuc

SEQ ID NO: 1926765 - RNA, 13 nt, Shigella flexneri 2a str. 2457T
cacuuucaaaagc

SEQ ID NO: 1926766 - RNA, 14 nt, Shigella flexneri 2a str. 2457T
cacuuucaaaagcc

SEQ ID NO: 1926767 - RNA, 20 nt, Shigella flexneri 2a str. 2457T
cacuuucaaauccggccagc

SEQ ID NO: 1926768 - RNA, 11 nt, Shigella flexneri 2a str. 2457T
cacgucugaag

SEQ ID NO: 1926769 - RNA, 14 nt, Shigella flexneri 2a str. 2457T
cacgucguucgggc

SEQ ID NO: 1926770 - RNA, 12 nt, Shigella flexneri 2a str. 2457T
cacuuucgcggc

SEQ ID NO: 1926771 - RNA, 14 nt, Shigella flexneri 2a str. 2457T
cacuuuccccggca

SEQ ID NO: 1926772 - RNA, 12 nt, Shigella flexneri 2a str. 2457T
cacuuucaguuu

SEQ ID NO: 1926773 - RNA, 17 nt, Shigella flexneri 2a str. 2457T
cacuuucacgcccauaa

SEQ ID NO: 1926774 - RNA, 12 nt, Shigella flexneri 2a str. 2457T
cacuuucugcgc

SEQ ID NO: 1926775 - RNA, 13 nt, Shigella flexneri 2a str. 2457T
cagaaaucagcuu

SEQ ID NO: 1926776 - RNA, 17 nt, Shigella flexneri 2a str. 2457T
cagaaauagaaagugac

SEQ ID NO: 1926777 - RNA, 18 nt, Shigella flexneri 2a str. 2457T
cagaaauagaaagugacu

SEQ ID NO: 1926778 - RNA, 23 nt, Shigella flexneri 2a str. 2457T
cagaaauagaaagugacugcugg

SEQ ID NO: 1926779 - RNA, 16 nt, Shigella flexneri 2a str. 2457T
cagaaaugaaaaaaua

SEQ ID NO: 1926780 - RNA, 19 nt, Shigella flexneri 2a str. 2457T
cagaaacggauaaucaugc

SEQ ID NO: 1926781 - RNA, 19 nt, Shigella flexneri 2a str. 2457T
cagaaacgccaucucuuua

SEQ ID NO: 1926782 - RNA, 18 nt, Shigella flexneri 2a str. 2457T
cagaaacgccauccagcc

SEQ ID NO: 1926783 - RNA, 23 nt, Shigella flexneri 2a str. 2457T
cagaaaccugauuacgcaccggg

SEQ ID NO: 1926784 - RNA, 20 nt, Shigella flexneri 2a str. 2457T
cagaaaaaaaguagggcuga

SEQ ID NO: 1926785 - RNA, 15 nt, Shigella flexneri 2a str. 2457T
cagaaacaaacgcaa

SEQ ID NO: 1926786 - RNA, 17 nt, Shigella flexneri 2a str. 2457T
cagaaacacacuuucca

SEQ ID NO: 1926787 - RNA, 13 nt, Shigella flexneri 2a str. 2457T
cagaaaaagagca

SEQ ID NO: 1926788 - RNA, 16 nt, Shigella flexneri 2a str. 2457T
cagaaacaguuguaaa

SEQ ID NO: 1926789 - RNA, 21 nt, Shigella flexneri 2a str. 2457T
cagaaugguguuaaccgguac

SEQ ID NO: 1926790 - RNA, 15 nt, Shigella flexneri 2a str. 2457T
cagaauuaacgcuga

SEQ ID NO: 1926791 - RNA, 17 nt, Shigella flexneri 2a str. 2457T
cagaagcguaauaucca

SEQ ID NO: 1926792 - RNA, 18 nt, Shigella flexneri 2a str. 2457T
cagaagcaaucaucccag

SEQ ID NO: 1926793 - RNA, 22 nt, Shigella flexneri 2a str. 2457T
cagaagcauuuuacauccugau

SEQ ID NO: 1926794 - RNA, 23 nt, Shigella flexneri 2a str. 2457T
cagaagcauuuuacauccugaua

SEQ ID NO: 1926795 - RNA, 15 nt, Shigella flexneri 2a str. 2457T
cagaagacgcuccag

SEQ ID NO: 1926796 - RNA, 22 nt, Shigella flexneri 2a str. 2457T
cagaacacuguuaccgcugcug
